United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 72

SEQ ID NO: 137442 - DNA, 1413 bp, Artificial Sequence
  Description of Artificial Sequence: Synthetic coding sequence
atgacacgcgggggcggcggtggagttctgtctgttaccggactcacggagaccgtgaacgaggtgtctaaattgagcaataagattggaatgaattgtgattactacatggaggaaaaggtgctgccaccctcatctttggaaggcaaggtgaaagaaaccgtacataatgccttctgggatcatttaaaggagcagctgtctgccacaccccccgattttagctgcgccctggaactcctgaaggaaattaaggaaatactgctgagcctccttctccctcggcagaatcgcctgaggatagagattgaagaggctttggacatggatttattaaagcaggaggctgaacatggagctctaaaggtactgtacttgagcaaatatgtgctcaacatgatggccctcctgtgcgcacctgtgagggatgaagctgtgcaaaaactggaaaacatcactgatcccgtgtggctcttaagaggtatcttccaggtactcggtcgtatgaagatggacatggtgaactatactattcagtcactgcagccacacctgcaagagcatagtatccagtatgaaagggcaaaatttcaggagctcctgaataaacagccttccctcttgaatcacaccacgaagtggctgacacaggccgccggcgatcttacaatgtccccacccacatgcccagatacctcagatagtagctccgtggctggcccctcgccaaacgaggcggctaataacccggaacctctgagcccaacaatggtgctctgccagggattcctcaatttgctgctctgggaccttgagaacgaagagttcccggaaacactcctcatggaccggaccagattgcaggaactgaagagccaacttcaccagttaaccgtcatggcttccgtgctgctagtcgcctctagtttttcaggatcagtgctgttcggctcaccccagtttgtggacaagttgaaacgtatcactaaatctctgttggaagacttccattcgcggccagaggaggcgatcttgaccgtgagcgagcaagtctcccaagaaatccatcaatcattgaagaatatgggcctcgtggctctcagttccgataacacagcgagcttgatgggccagttgcaaaacatcgctaagaaggaaaactgcgtgtgtagcgtcatcgaccaacggattcacttattcctaaaatgttgccttgttctaggtgtgcaaagatcactgctggacctccccggcggtctcacactgattgaggctgaacttgcggagctggggcagaaatttgtgaatctcactcatcacaatcaacaggtgttcggaccgtactacactgagatcctgaagaccttgatctcgcctgcacaggctctggagacaaaggtggagtctgtctag

SEQ ID NO: 137443 - DNA, 1398 bp, Artificial Sequence
  Description of Artificial Sequence: Synthetic coding sequence
atgactcgcggaggaggaggaggcggactaaccgagaccgtgaacgaagtgtccaagttgagtaataagattgggatgaattgtgattattacatggaggaaaaggtcctgcctccttccagcttggagggcaaagtcaaggaaaccgtccacaatgccttttgggatcatctaaaggaacagcttagcgcgacacctcccgacttctcatgcgcgcttgaactactgaaggagattaaagagattctgttgtcacttctcctccctaggcagaatagactccggattgagatcgaagaggccctggacatggatttgctcaagcaggaagccgaacacggagcacttaaggtgctttatctcagcaagtacgtgctgaatatgatggctctgctttgtgcgcctgtacgcgacgaggctgtccagaagttggagaatatcaccgaccctgtatggctcctccgaggtattttccaggtactaggacgaatgaaaatggatatggtgaactacacaatccagtcactgcagccccaccttcaagaacattcaattcagtacgagagagcaaaattccaagagctccttaataagcagccgtcgctcctgaatcacactaccaaatggttgacccaggcagcaggcgatctgactatgtcccctcccacctgtcccgatacttccgattcttcctctgtggccggtccctctccgaatgaggccgccaataatccggagcctctatcacccacaatggtcctatgccaggggtttctgaacctgttactgtgggatttagagaacgaggagttcccggagactctgctgatggacaggactcggctgcaggaactcaagtctcaactgcaccagttgaccgtgatggcttcggtacttttggtcgccagctcattttcggggtctgtcctgtttggttctcctcaattcgtcgacaagctgaagcgcatcacaaagtccctcctggaggacttccacagcagacccgaggaagccattttgaccgtgtctgaacaagtaagtcaggagattcatcagtccctaaaaaatatgggccttgtggcactaagttctgataacaccgcgtccctcatgggccaactgcaaaacatagcgaagaaagagaactgcgtctgctccgtgatcgatcaacgcatccatctcttcctcaagtgctgtctggtcctgggggtgcagaggtccttgctagacctccctggcggcctcactctgatcgaagcggagttggcagaactaggacagaaattcgtcaacctgacccaccacaatcagcaggtgttcggcccgtactatacggaaattctcaaaacactgattagtcccgctcaggcattagaaacaaaagttgaatccgtttag

SEQ ID NO: 137444 - DNA, 165 bp, Artificial Sequence
  Description of Artificial Sequence: Synthetic coding sequence
atgacgaggggcgggggcggaggggacaccatttcaaaaatgcccgatgtcaaagaaagcgtccctcctaagtatccaggggattccgaagggcgatcttgcaagccggagacgtccggaccacctcaagaggacaagtcaggctccgaggatcctcccccctag

SEQ ID NO: 137445 - DNA, 165 bp, Artificial Sequence
  Description of Artificial Sequence: Synthetic coding sequence
atgaccagaggaggcggcggtggcgatactatatccaaaatgcccgatgtcaaggaatccgtacctcctaaataccctggtgactcagaaggcagatcttgcaagcccgagactagcggaccgccccaagaggataagagcggatcagaagaccctccaccctag

SEQ ID NO: 137446 - DNA, 597 bp, Artificial Sequence
  Description of Artificial Sequence: Synthetic coding sequence
atgttttttgaacgccatctcgagaatctgctcaaacatttcatccctggaaccacagaccccgccgtcattctggatttgctgcctctgtgccggaactacgtgcggagagtgcatgttgaccagttcctaccccccgtccagctgccggctcaattacggcctggagaccagtcagacagtggcagcgagggggagatggaggagccaactgtggatcactaccaactcggcgacctggtggctgggcttagtcacttagaggagttagatttggtttatgacgtgaaggattgcggaatgaacttcgagtggaatttgttcctcttcacgtaccgggattgtctcagtcttgccgccgctatcaaagcgtgtcatacgctgaaagacggagggaaacagctgctcgagggcatgtcagataataagaccctgcttgagtttgatctgagactcagtgatgtggctcaggagtcagaatacttgatcgggcaggctctgtacgcaaatcgtgaggccgctcggcagcgcgccctgaacccctctcacttcatgtccaccatcactgctaatggcccggaaaactcagtcgggtag

SEQ ID NO: 137447 - DNA, 597 bp, Artificial Sequence
  Description of Artificial Sequence: Synthetic coding sequence
atgttcttcgagcggcatcttgaaaacttgctgaagcacttcatccctggaaccactgaccctgccgttatcttggacttattacccctgtgccgcaattacgtcaggcgcgttcacgtcgatcaattcctcccgccagtccagctccccgcgcagctgagaccgggcgatcagtcagacagcggttcagagggcgagatggaggaaccaaccgtggaccactatcagttaggcgacctggtggcaggcctatctcatttagaagaacttgacctcgtttatgatgtgaaagactgcggcatgaattttgaatggaacctattcctgtttacttatcgagattgcctgtcactggctgccgcaataaaggcttgccatactctgaaagatggaggcaaacagttgctcgaaggaatgagtgataacaaaacacttcttgaattcgatctcaggctgtcggatgtagctcaggaatctgagtacttgatcggccaagctctctatgccaatagggaagctgctcgccagagggctcttaaccccagtcacttcatgtcaaccatcactgcaaacggccctgaaaatagcgtgggctag

SEQ ID NO: 137448 - DNA, 1506 bp, Artificial Sequence
  Description of Artificial Sequence: Synthetic coding sequence
atgcaggacaccgttactacctctgcgctgctggatcccagccatagcagtgtgtctacacaggataattcctctacaggcggccacacttcgagtactagcccacagctctccaagcctagcattacacctgtgcctgccaaatctagaaatcctcaccctagggctaacatccgacgaatgcgtcgcatcatagccgaggatcctgaatggtctcttgcgattgttccgctgttgaccgagctttgcattcaacatattattcggaactttcagaagaacccgatcctgaaacagatgctgcccgaacaccagcagaaagtgctcaaccacctgagcccagatttgcctcttgctgttaccgccaacctaattgacagcgagaactattggctgcgctgctgcatgcacagatggcctgtgtgtcacgtggcacaccacgggggttcgtggaagagaatgttctttgaaagacacctggagaaccttctgaagcactttatccctgggacaacagaccctgctgtaattttggatctactccccctgtgtcggaattacgtgcgacgcgtacatgtagaccaatttttgccgcctgtgcaattaccagcccagctgcgccccggtgaccagtccgattcaggatccgagggcgagatggaggaacccactgtggaccactaccagctgggtgatcttgtagcaggcttgtcgcacctggaagagcttgacctggtgtatgatgtcaaggattgtggtatgaactttgagtggaacctgtttctgttcacctacagagattgcctctcgctcgcagccgcaatcaaagcatgccacacgctcaagatattcaagttgactagatccaaggtcgacgatgacaaggccaggatcattatcaggagcttactggaccacccggtgcttgaggagctcgatttgtcccaaaatcttattggggatcgaggcgccagaggggctgccaagctcctatcacatagtcgtctccgcgtactgaacttagcaaacaaccaagtgagagccccgggggctcaatctcttgcacacgctctcgcccacaatactaaccttattagcttgaacttgcgactaaattgtatcgaagatgagggaggacaggcactggcacatgccctgcagacaaataagtgcctgacaacgctgcatctgggggggaatgagctctctgagccaacagccaccttactctcacaggtcctggctattaacacaacactcactagcatcaacttgagttgcaaccacatcggcctggatggcggcaaacagctcctggaaggaatgtctgataataagaccttgctggaattcgatcttcgactctcagatgttgctcaggagagtgaatacctgattgggcaggccctctatgccaaccgggaggccgcccgccagcgggctctgaacccttcacactttatgtccacaattacggctaatggaccagagaattcagtcgggtag

SEQ ID NO: 137449 - DNA, 597 bp, Artificial Sequence
  Description of Artificial Sequence: Synthetic coding sequence
atggagaaaagggggcgaggcgtgaaaagctcaccgatccaaactccgaaccagacacctcaacaggcacctgtgactccaaggaaagagcgccgcccttccatgttcgagaaggaggcatacactcaaatcctccgagagcgcctaagagagtccatacacaacgtgcaatatgtcgaacctcctttcgacgacagcattgctgatatcggaaaggagtggaagagtgcactggctaagttgaagttcgccaactcctaccgaatggaaccactgaaaaaattccaggctcattcagtggaaaccaaggtgcagcagatactaacagagtctctcaaagacgtaaagtacgatgataaggtcttttcacacttgtccctggaactggcggataggatcctcctggccgttaaagaattcggatatcacaggtataagtttatcataaaagtgctgtttatccaaaaaaccggccaggctatcaacatcgcatccagatggatatgggatatagcctgggacagttgggtcgccgcaaagcacgaggcagagagttacgttgccctcgtgttggtgtttgctctgtattacgaatag

SEQ ID NO: 137450 - DNA, 666 bp, Artificial Sequence
  Description of Artificial Sequence: Synthetic coding sequence
atggcctctcggccactgcctcccggcagacaggaggaggagaatgcgaaggactccgggcgtaagccatctcccgtcagaccacggggctgcttgccctccatcgacgaggcccgccctgccggacccggtcctgcgcccgccagtagaaggggcagcatgctgggactggccgcctcattcagcaggcgtaactctctcgttggccctggcgccggcccaggaggtcaacgcccaagtctggggccagtgcccccactcggctctagggttagcttctccgggttgccattggctcccgcgcgttgggtagccccctcttatcggaccgagccagtacctggcgagcgttgggaggccgccagagcccagcgcgccttggaggctgccttggctgcgggattgcacgatgcctgctacagctccgatgaggccgcacgtctggtgagggagctctgcgaacaagtgcacgtacgactcagagaactatcccctcccaggtacaagcttgtctgttcagtggttctggggccgagggcaggacaaggcgttcacgtggtgtcccgggcgctgtgggacgttgcccgcgatggactcgcctctgtttcttacaccaatacttccctcttcgccgttgctacagtgcatggcctctattgcgagtag

SEQ ID NO: 137451 - DNA, 666 bp, Artificial Sequence
  Description of Artificial Sequence: Synthetic coding sequence
atggcttctcgaccactccctccaggacgccaggaggaagagaatgccaaggactctggacggaagccaagtccagttagaccaagaggctgtctcccatccatcgatgaggcacgcccggccggacccgggcccgctccggccagccgccgcggatctatgctggggcttgccgcctcctttagcaggcggaatagcttggtggggcctggagctgggccaggaggtcagcgccccagtctgggacccgttcctcctctcgggagccgagtttcctttagtggcctcccactggccccagctcgttgggtcgcaccaagttataggaccgagcctgtccccggcgagaggtgggaagccgcacgcgcgcagcgcgccctggaggctgctttagccgccgggttgcatgacgcatgctacagtagcgacgaagccgcccgcctcgtacgggaactgtgtgagcaggtgcacgtcagactccgggaactcagtccaccgcgctataagctcgtgtgtagtgtggttctgggccctcgcgccggtcaaggggtgcatgtggtctctagagctctttgggatgtagcacgtgatggactcgcctcagtaagttatacaaacacttcattatttgccgtggctacagtgcacggcctttattgcgaatag

SEQ ID NO: 137452 - DNA, 1074 bp, Artificial Sequence
  Description of Artificial Sequence: Synthetic coding sequence
atggagaggatgtccgactccgccgacaaacccattgacaacgacgccgagggtgtgtggtcaccagatatcgaacagagtttccaggaggccttagccatttatcctccttgtggaagacgcaaaattatcctgtctgatgagggtaaaatgtacggaagaaatgaattaattgcccggtacatcaagctgcggaccgggaaaactcgtacgaggaagcaggtcagcagccatatccaggtccttgcccggcggaaaagcagagattttcacagcaagctgaaagttacatccatggatcagactgcgaaggacaaggcactgcagcacatggcggccatgtcaagtgcacaaatagtcagtgccacagccatccataataagctgggcctacccgggatacccagacccaccttccccggagcgccagggttctggcccggaatgatacagaccggccagccaggatcatctcaggacgttaagccattcgtccagcaagcctaccctatccaacccgctgtgactgcaccaatcccaggatttgagccagcctctgcacctgcccccagcgtacccgcctggcaggggaggagcatcggcacaacaaagctgcggttagtggagtttagcgcatttttggagcagcagagagaccccgatagcgctgacctgaattgcaacatccaggatgatgctggcgcattctatggcgttaccagccaatacgaatccagtgagaacatgacagtcacttgcagtaccaaggtgtgttcgttcggcaaacaggttgtcgaaaaagtggagactgagtacgcgcggttcgaaaatggtagatttgtgtaccgcatcaatagaagcccaatgtgcgagtacatgattaatttcatccacaagctgaaacatctccctgagaagtacatgatgaactctgtgcttgagaactttacaatattgctcgtggttaccaatagagatacccaggaaacactgctctgcatggcttgcgtcttcgaggtcagtaattccgagcatggtgcccagcatcacatttaccgcttggttaaggactag

SEQ ID NO: 137453 - DNA, 1236 bp, Artificial Sequence
  Description of Artificial Sequence: Synthetic coding sequence
atggagaggatgtctgacagcgcggacaagccaatcgacaatgatgccgaaggcgtgtggtccccggatatcgaacaatccttccaggaggctctggccatctaccccccctgtggccgacggaagattattctctctgatgagggcaagatgtacgggcggaacgagctcatagcccgatacatcaagctccgtacaggcaagactaggaccaggaagcaggtgtctagccatatccaggtgttagccaggaggaagtcacgtgatttccacagtaaactgaaggatcagaccgctaaggataaagccctgcagcatatggctgcaatgtctagcgctcaaatcgtatctgctacagcaatacacaataagcttggcctccctggtattccacgaccaacctttccaggcgcccctggtttctggcccggaatgatccaaacagggcagcccggttccagccaggacgttaaacctttcgtgcagcaagcctatccgatccagccagcagtgaccgcaccaattcctgggttcgagcctgcttccgctcccgcgccatccgtgccagcttggcaaggaaggagcattgggaccactaaattgaggctcgtggagtttagtgcctttttagagcagcagcgggacccggatagctacaataagcacctgttcgtccacattggccacgcgaatcattcttactccgatcctcttctcgaaagcgtcgacattcgacaaatttacgacaagttcccggaaaagaagggagggttgaaggagctttttggcaaggggcctcaaaacgcgtttttcctagttaagttttgggcagatctcaactgcaacattcaagatgatgcaggagcattctatggggttacatcacagtatgaatcttctgagaacatgaccgtcacatgtagcaccaaagtgtgttcctttggaaagcaggtcgtggaaaaggtggaaaccgagtatgctagattcgagaacggcaggttcgtatatcggattaatcgcagtcccatgtgtgaatacatgatcaactttatacataaactgaagcatttacccgaaaaatacatgatgaattcagtactggagaatttcaccattctactggtcgtaaccaacagagacacgcaggagactctgctgtgcatggcatgtgtgttcgaggtttcaaacagcgaacatggagcgcaacaccacatttatcggctggtgaaagactag

SEQ ID NO: 137454 - DNA, 1281 bp, Artificial Sequence
  Description of Artificial Sequence: Synthetic coding sequence
atcgaacctagctcctggtccggctctgagagtcctgctgagaacatggagcgtatgagcgattcggctgacaagccgattgacaatgatgcagaaggtgtctggtcccctgacatagaacagagttttcaggaagcgctagctatctatccaccctgtggccgtcggaagatcattctgtctgatgagggcaagatgtacggacgtaacgagttaattgctcgttacattaagctgagaacgggaaagactcggaccaggaaacaggtatcatctcacattcaggtgctggcacgaagaaagtcccgagacttccattccaaacttaaggaccagaccgctaaggacaaggccctccagcatatggctgcgatgtcctccgcccagatagtctctgccactgcaatccacaacaaattaggactgccagggatccctaggcctactttccccggggcccccggcttctggcccgggatgatacaaaccggccagcccggatcctctcaggatgtaaagccatttgtgcagcaggcatatcctattcaaccagccgtgacggcgcctatccccggattcgagcccgccagtgcaccagcgccatccgtgccggcctggcaaggaagatccatcggcaccacaaagttgcgtttagtcgaattcagtgcgttcctggaacaacagcgagatccagactcttacaataaacatttgttcgtccacattggacacgccaatcacagctactcagatccccttctggagagcgttgacatcaggcagatctacgacaagttcccagagaagaagggtgggctaaaggaactgtttggcaaaggcccacaaaatgccttctttttggtgaagttttgggctgacttaaactgtaatatacaggatgacgctggggccttctacggggtaactagccagtatgaatcctccgaaaacatgaccgttacctgttcgaccaaggtctgcagcttcggtaagcaggttgtcgaaaaggtggaaaccgaatatgcgagatttgagaacggaagattcgtgtacagaatcaacagatctccgatgtgcgagtacatgattaattttatacataaactcaaacacctgcctgagaagtatatgatgaatagcgtgctggaaaattttacgatcctgctggttgtgaccaaccgggacacgcaggaaaccttgctgtgtatggcatgcgtcttcgaggtgtccaactcagaacacggagcccagcatcatatctatcggttggtcaaagactag

SEQ ID NO: 137455 - DNA, 993 bp, Artificial Sequence
  Description of Artificial Sequence: Synthetic coding sequence
atgcgctatgtgctgtcctggtgcgtgacagtaacttttaaggatcagactgcgaaggacaaagccttacagcacatggctgcaatgtcgtctgcccagatcgtttcagcaactgccatccacaataagctgggcttgcccggcatccctaggcccacttttccgggcgcaccaggcttttggccagggatgattcagactggacagccaggttctagccaggacgtcaagcccttcgtccagcaggcctatcccattcagccagccgtgacggcccccattcccgggtttgagcccgcctccgcccccgccccctctgtcccggcgtggcagggtcggtccatcggaacgaccaagctcaggctggtcgagttcagtgcgttcttagaacaacaacgagatcctgactcctacaacaagcaccttttcgtgcatattggacacgcaaatcattcttactccgacccactcctcgaaagtgtcgatattcggcagatttatgataagttccctgagaagaagggaggcctgaaggagctgttcgggaaaggccctcaaaacgcttttttcctcgtgaagttttgggcagatctgaattgtaatatccaggatgacgccggcgcattttacggagtgacatcacagtacgagtcttctgagaacatgaccgtaacctgctcgactaaggtgtgttcctttggcaaacaagttgttgagaaggtcgaaacagaatatgctaggttcgagaacgggcgcttcgtttacagaatcaatcgctctcccatgtgtgaatacatgatcaattttattcacaagttgaagcaccttccagagaagtacatgatgaactcagtactggagaattttaccatcttgctcgtggtcaccaatagggatacccaggaaacactactttgtatggcctgcgttttcgaagtcagtaacagcgagcacggtgcccagcatcatatctaccgcctggttaaggactag

SEQ ID NO: 137456 - DNA, 207 bp, Artificial Sequence
  Description of Artificial Sequence: Synthetic coding sequence
attgagcccagtagctggtctggttccgaatcaccagccgaaaacatggaacgcatgtccgattctgctgataagcccattgataatgatgcggaaggagtatggtctcctgatattgaacagagtttccaagaggccctcgctatatatcccccttgtggacggcgaaaaatcatccttagcgacgaaggcaagatgtacgggtag

SEQ ID NO: 137457 - DNA, 1281 bp, Artificial Sequence
  Description of Artificial Sequence: Synthetic coding sequence
attgaaccgagttcatggagtgggtctgagtcacctgccgagaatatggagagaatgtcagacagcgccgataaaccaatcgacaatgatgccgaaggcgtatggtctccggatattgagcaatcatttcaagaggcccttgccatatatccaccctgcggccgcaggaaaatcattctctccgacgaaggcaaaatgtatggccgcaatgaacttatagcccggtacataaaactacggaccggcaagacacgcacccgaaagcaggtgtcttcacacatccaggttctcgcacgcaggaaaagcagggactttcattctaagttgaaggatcagaccgcgaaggataaggccctgcagcatatggccgcgatgtcttccgcccagattgtcagtgcgaccgccatccacaataaactcgggctcccagggatacctaggccaacttttccaggcgctcccgggttttggcccgggatgatccagacaggacagcccggcagctcccaggacgtaaaaccttttgtgcaacaggcttaccctatccagccagcagtaaccgctcctattcctggtttcgaacccgcttccgctcccgctccttctgtgcccgcatggcaggggcgctccatcggtaccacaaagttaaggctggttgagttttcggcttttctggagcagcagagggaccctgatagctacaataaacacttgttcgtgcatatcggtcacgcaaaccattcatacagtgacccgcttctggagagtgtggatattaggcaaatctatgacaaattcccagagaagaaggggggtttaaaggagctattcgggaagggaccccaaaatgccttcttccttgtcaagttctgggccgatctgaattgcaacattcaagatgacgcaggagccttctacggagtcacatcgcaatacgagagctccgaaaatatgaccgtcacctgtagcactaaagtctgctcctttggcaaacaggttgtggaaaaggtggagactgagtatgctcgcttcgaaaatgggaggtttgtgtaccgcattaacaggtctcctatgtgtgagtatatgatcaacttcatccataaactgaagcacttacccgagaagtatatgatgaactctgtgttagagaactttaccattttactcgtagtgacaaatcgagatactcaggaaactctcctctgtatggcatgtgtattcgaagtctccaatagtgagcatggtgcccagcaccacatctaccggcttgttaaggactag

SEQ ID NO: 137458 - DNA, 1344 bp, Artificial Sequence
  Description of Artificial Sequence: Synthetic coding sequence
atgggtgagcccagagccggagcagctctggacgacggaagtggttggaccggtagtgaggaagggtcagaagaaggaacagggggatccgaaggggcaggtggcgatggcgggcccgatgctgaaggggtgtggtcccccgacatcgagcagagctttcaagaggctctagcgatatacccaccatgtggccgaaggaaaatcatcctaagcgacgaggggaagatgtacggaagaaatgagctgatagccagatacataaaacttaggaccggaaagacaaggacccggaaacaggtctcatcccatatacaggtgctggcacgccgaaaatctagggagatccagtctaagttgaaagatcaagtctctaaagataaagcctttcaaacgatggccaccatgtcctcagctcagctcatcagtgccccatcattgcaggccaaactggggcccaccggcccccaagcttccgaactattccagttttggagtggcggatccgggccaccttggaacgtacctgatgtcaaaccgttttcccaaaccccttttacattgtctctgacacctccttccactgatcttcccgggtacgagcctccgcaagccctctcacctttacctccgcccactccaagtcctcctgcttggcaggcccgaggcctagggaccgcaaggttacaacttgttgagttttccgcattcgttgaacctcctgatgctgtcgactcgtaccagaggcatctgtttgttcatatatcccagcattgtcctagtccaggtgccccgccattagagtcagttgacgttcggcaaatctatgataagtttcccgagaagaagggaggccttcgggagctatatgaccgcgggcccccccacgcttttttcctcgtgaagttttgggccgatttaaattggggaccctccggtgaggaggccggagctggggggagtatctcatctggaggcttctacggggtctccagtcagtatgagtcacttgagcacatgactctcacctgcagcagcaaggtgtgcagctttggaaagcaggttgtggaaaaagtagagacggaaagggctcaattagaggacggtaggttcgtctatagactcctacgctcccctatgtgcgaatacctcgttaacttcctgcacaaactgcgccagctgcctgagcggtatatgatgaactctgtactggagaactttaccatcttacaggtggttacgaaccgcgacacacaagagcttcttttgtgcactgcttacgtgtttgaggtgtcaacctcagaacggggcgcccagcaccacatctacagactggtgcgcgactag

SEQ ID NO: 137459 - DNA, 1353 bp, Artificial Sequence
  Description of Artificial Sequence: Synthetic coding sequence
atgggagagccaagagcgggcgcagctctggatgacgggtccgggtggacgggctccgaggaaggtagtgaggagggtaccggcggatcagaaggtgctgggggggacggcggcccggatgcagagggggtttggagtccagacatcgagcagtctttccaggaagctttggctatctacccaccctgtggccgaagaaaaataatcttgagcgacgagggcaaaatgtacgggaggaatgagttaatcgcgcggtatatcaagttgcggacaggcaaaacccggacccgtaaacaggtctcgtcacacatccaagtgctagctcggcggaaaagcagagagatccagagtaaactgaaagatcaggtttcaaaggataaggctttccagactatggctaccatgtccagcgcccagctaattagcgccccctctctccaggcaaaactcggcccaacgggaccccaagtggtgcaggccagtgagctcttccagttctggagtggcggctcgggccccccttggaatgtaccagacgtgaagccgttctcgcagactccctttaccctgtctttgacccccccctccacagacttgccagggtatgagcccccccaagctctctccccccttccacctccaaccccctctccaccggcgtggcaggcacggggcctagggaccgcccgattgcagctggttgagttttccgctttcgtggaaccgcccgacgccgtggatagctaccagcggcacctcttcgtccacatttcacagcattgccccagccccggagcaccccccctggagagcgtggacgtccgtcagatttacgataagttccctgagaagaaaggcgggctccgcgaactgtatgatagaggacctcctcatgctttcttcctggttaaattctgggcagatttgaattggggcccgtccggggaagaagctggcgccggaggttctatctcttccggtgggttctacggtgttagctctcagtatgagtcactggaacacatgaccctgacctgcagcagcaaggtatgtagcttcgggaagcaagtggtggaaaaagtcgagacggagagggcccagttggaggacgggaggttcgtctaccgtttgttgcggtccccgatgtgtgaatacctcgtcaactttttgcataaactgaggcagctccccgaaagatacatgatgaatagcgtactcgaaaactttactatcctgcaagtggtgacaaatcgggacacgcaggagctgctcctttgcactgcttacgtctttgaagtgagcactagcgaaaggggcgcacagcatcacatttatcgcctggtgagggattag

SEQ ID NO: 137460 - DNA, 960 bp, Artificial Sequence
  Description of Artificial Sequence: Synthetic coding sequence
atggctacaatgtccagtgcccagcttatctctgcaccatctctgcaggctaagctggggcccactgggccccaagtggtgcaggcaagtgaactgtttcagttttggagcggggggtccggccctccctggaatgttcctgatgtgaaaccgttcagtcagaccccctttactttgtctctgacgccaccctctactgacctgccgggatatgaacccccacaggcgctgtctccactgccacctcctacaccatccccccctgcatggcaagccaggggtctcggcaccgccaggctgcagcttgtagaatttagtgctttcgtggagccccccgatgctgtggatagctaccaacggcatctgtttgtacacatctcccagcattgcccaagccctggggcgccccctctggagagcgtagatgtgaggcaaatctatgataaattccctgagaaaaaaggcggattgagggaattatacgataggggaccacctcacgctttttttctggtcaagttttgggccgacttgaactggggaccgtcaggggaagaggcaggagctggcggctcgataagtagcggaggcttttacggcgtgagctcacagtatgaatcactggagcatatgacacttacatgctcttcaaaggtctgctcattcgggaagcaggtggtggaaaaggttgaaacagagagagctcagctagaggacggacggttcgtgtataggctgctcaggtcacccatgtgtgagtacctggtaaacttcctgcacaagctgcggcaactacccgagcgatacatgatgaatagtgtcctggaaaacttcaccattctccaggtggttaccaaccgcgatactcaggagctgctcctctgcaccgcttatgtgtttgaggtgagcaccagcgaacgtggagcacagcatcatatctacaggctggtccgggattag

SEQ ID NO: 137461 - DNA, 1356 bp, Artificial Sequence
  Description of Artificial Sequence: Synthetic coding sequence
atgggcgagccacgggcgggagccgccctggatgatgggtctgggtggaccggtagcgaagaggggtcggaggaaggaacgggcggatctgaaggcgctggcggagatggaggcccggatgcagagggtgtgtggtctcccgatattgagcagtcctttcaagaggcactagccatttaccccccatgtggtcgccgtaaaattattttgagcgacgaggggaagatgtatgggcggaacgaactgattgctcgttacattaagctgaggacgggcaaaacaaggacaagaaagcaggtaagtagtcacatccaggttcttgcgcgccgcaagtctcgggagattcagtcgaagctgaaggccctcaatgtggaccaagtcagcaaagacaaggcctttcagaccatggcaactatgtcatcagcccagctgatttccgcaccttctctccaggccaaactcggcccgactggacctcaggcttccgaactgttccagttttggtctggaggctcgggcccaccttggaacgtcccagatgttaaacccttctcccagacccctttcaccctctctcttacaccaccctcaacggatttaccaggttacgagccaccccaggccctctccccattgccacccccaaccccaagtccccctgcttggcaggctcgggggctaggaacagctcgcctccagctggtcgaattctccgcctttgttgagcctccagacgcagtcgactcataccaacgccacctgttcgttcatatcagccagcactgcccatcccctggagctcctccactggagtccgttgacgttcgacagatctacgacaagttcccagaaaaaaaaggagggctccgggagctgtacgatagaggacctccccacgctttcttcctggtaaagttttgggccgacctgaattggggccccagcggggaggaagctggtgctggaggctccatttcgtccggcggcttttacggagtgagcagtcaatatgagtctcttgaacacatgacactcacctgctcaagtaaggtgtgcagcttcggcaaacaggtggtcgagaaggtggaaactgaaagggcccagctagaggatgggagatttgtgtacagactactgcgcagcccaatgtgtgagtaccttgtgaatttcctgcacaaactgcggcagctccccgagcggtatatgatgaacagtgtcctggaaaattttacgatcctgcaggtggtgactaaccgtgacactcaggaattgctgctctgtacggcttacgtgttcgaagtgtctacttcagaaagaggggcgcagcaccacatctaccgtctggtaagagactag

SEQ ID NO: 137462 - DNA, 1356 bp, Artificial Sequence
  Description of Artificial Sequence: Synthetic coding sequence
atgggagagccccgagctggagccgctctggatgacggctcgggctggaccggaagcgaagaggggagtgaagaagggaccggagggtccgagggggccggcggagacggcggtccagacgcagaaggcgtgtggtcacccgatatcgaacagagctttcaggaagccctggcaatttatcctccatgtggtagacgtaagattatactttctgatgagggaaaaatgtacggcaggaacgagctgatcgcacgttatattaaactgcggactgggaagacgaggacgaggaaacaggtgtcctcccacatccaggtgttggctcgtagaaaaagccgggaaattcaaagtaagctgaaggctctgaatgtagaccaggtgagtaaggacaaagccttccaaaccatggccacaatgagctccgcacagttaatttccgcccccagccttcaagctaagctcggtcctacagggccccaagcgtctgagcttttccagttctggagcggaggctcgggccctccatggaacgtccctgacgttaagccgttttcccagacccccttcacgcttagcctgactccaccttctaccgacttgccaggttatgaacctccacaagccctcagccctttaccccctccgacgcccagtccgcctgcctggcaggcccgtggactcggtaccgcacgattacagcttgttgaattctccgcttttgtagaacctcccgacgccgtggactcttatcaacgccatctgttcgttcatatctcccagcattgtcctagccccggcgcacccccactagaatctgtcgacgtccgtcagatctacgataagtttcccgagaagaagggcggactgagggagttgtacgacagaggtcccccacacgcattttttctagtgaagttttgggctgatctgaattgggggcccagcggcgaagaggcaggggcgggaggatccatcagcagtggcgggttctatggcgtctcttcccaatacgagtcactcgaacatatgactttaacctgttcatccaaggtttgctcattcggcaagcaagtggtggaaaaggtggagacagagcgcgcacagctggaggacggaaggtttgtctatagactgctgcggtcgcctatgtgtgagtacctggtgaactttctacacaaactcaggcagctccccgaaagatatatgatgaacagtgtgcttgaaaacttcactatccttcaggtggtgacaaaccgggacacccaggagcttttactttgcacagcttatgtgttcgaagtgagcacctccgagaggggagcccagcatcatatttatagacttgttcgagactag

SEQ ID NO: 137463 - DNA, 1353 bp, Artificial Sequence
  Description of Artificial Sequence: Synthetic coding sequence
atgggggagcctcgagcaggcgctgccttggatgacggttcaggatggacgggaagtgaagaaggatctgaggagggaacaggaggatcagagggggctgggggggacggaggacccgacgccgagggtgtgtggtcccccgacatcgaacagagcttccaagaggctttagctatttaccccccctgcggccgcagaaaaatcattttgtccgacgaaggtaaaatgtacggacgcaacgagctgattgcccggtatataaaattgcggactggtaaaacacgtacaagaaagcaggtgtcttctcacatacaggtgttggccagacgaaagtctcgggagatacagagcaaacttaaggatcaagtgagcaaagacaaggccttccagaccatggccaccatgtcttcagcacagctgatcagcgccccttctctccaggcgaagctggggcctaccggaccccaagttgtccaagcgtccgagctcttccagttctggtccggaggctctgggcccccgtggaatgtacccgacgtgaagcccttcagtcaaactccctttaccctttcactcactcccccaagcaccgacctacctggctatgagccccctcaggccctatcacctctcccaccacccaccccaagtcctcccgcttggcaggcccggggattaggcaccgcgcgactgcaactcgtcgaattttctgcgtttgtggagcccccagatgctgtcgactcctaccagcggcacctcttcgtccacatttctcagcactgtcccagcccaggcgcccccccactcgagtcagtcgatgtcagacaaatatatgacaaatttcccgaaaaaaagggcgggctaagggaactctatgatcgagggccgccccacgcattcttcctcgttaaattttgggccgacctcaattggggtccctccggcgaagaagccggggccggtggatctatttcctcgggcggcttttatggagttagctcacagtacgagtctttggaacacatgaccctgacttgtagctccaaggtctgctcctttgggaaacaagtagtggagaaggtcgaaaccgagcgggctcaactcgaagacggccgatttgtctatcgcctgctgaggtctcccatgtgcgagtatctggtaaacttcctccataaacttcgtcagttgcccgaacgttatatgatgaactctgtcctggaaaactttactatcctgcaggtggtcacgaatagggacacacaggaactccttttgtgcacagcttatgtgttcgaagtcagcacctcagagcggggcgctcaacaccatatctacagacttgtccgggattag

SEQ ID NO: 137464 - DNA, 1308 bp, Artificial Sequence
  Description of Artificial Sequence: Synthetic coding sequence
atagcgagcaactcttggaacgcatcctcatcgccaggtgaagctagggaggatgggcccgaagggctggacaaaggactagataacgatgcagagggcgtctggagtcctgacattgagcagagctttcaagaggctctggccatttaccccccctgtggacgcagaaaaatcatactttccgacgaggggaagatgtatggcaggaacgagttaatcgctcggtacattaaactgaggacggggaaaacccgtacgcggaagcaggtgagctctcacatccaagtgttggctcgaaaaaaggtgcgcgagtatcaggtcggcattaaagccatgaacctggatcaagtaagtaaggataaggccctgcaatcgatggcctctatgagctcagcacagatcgtgtcagcatcagtactccagaacaagttctctcccccctcgccccttccacaggccgtgttttctacctccagccgcttctggagcagccccccactcctgggccagcagcctggcccctcgcaggatattaagccatttgctcagccggcctatccgattcagcctcccctgcctcctacactttcatcctatgaaccccttgccccactgccctccgccgcagcttcagtccctgtatggcaggacaggaccatcgcctcctcccggctgcggttgcttgagtacagtgcttttatggaagtccagagagatcccgatacgtattctaagcatctgtttgttcacatcggtcaaacgaaccccgccttctccgaccccccactggaagccgtggacgttcgacagatctatgacaagttcccagagaaaaaggggggcctaaaagagttgtacgaaaaggggccccccaacgcgttctttttggtgaagttctgggccgacttgaatagtactatccaagaaggtcccggcgccttctatggcgtgtcctctcagtattcctcagctgacagtatgacaataagcgtgagcacgaaggtttgctcctttggaaagcaggttgtcgagaaggttgaaaccgagtacgcgaggttagaaaatgggagattcgtataccggattcataggagcccgatgtgtgaatatatgatcaacttcattcacaaactgaagcatctgcccgagaaatacatgatgaactccgtcttggaaaacttcactatcttgcaggttgtgacgagccgagactcacaggaaacactgctcgtaattgccttcgtgttcgaagtgtcaacgagcgagcacggggcacagcaccatgtctacaaactggttaaagactag

SEQ ID NO: 137465 - DNA, 1356 bp, Artificial Sequence
  Description of Artificial Sequence: Synthetic coding sequence
ttatctaggcccgtcggctctggtcccgagcccagagccaccagtaccatcgcgagtaatagttggaatgcatccagcagccctggcgaggccagggaggatggacctgaaggcttggataaggggctagacaacgacgcggagggcgtgtggtcccctgatatagagcagtcattccaggaggctctggctatttaccctccctgcggtaggagaaaaataattctctccgatgagggtaagatgtatggacgcaatgagctcatcgcaagatacatcaaactgagaaccgggaagacacgaactcggaagcaggtgagcagtcacctgcaggtgctggcaagaaggaagagccgagaaattcagagtaagctgaaatccagtccccaggaccaggtatccaaagacaaggccttgcagtcgatggccagtatgtcaagcgctcagatcgtgagtgcgtccgtgctccagaataaatttagcccccccagtccactcccacaagccgtgttctcaacctcttctcgcttttggtccagccccccactattaggacagcagccagggccttctcaggacattaagccctttgcacagcccgcttaccctattcagccccccctgcctcctactctcagtagttacgaacctcttgctccactgcccagcgccgcagcatctgtgcccgtgtggcaagacaggactatcgcctcctctcgactgcgcctgctggagtatagtgctttcatggaagtccagagagacccagatacttactccaagcatctcttcgttcacattggccagaccaacccagctttttcagatccgccattagaagccgtcgatgtgcgacagatatacgataagttccccgagaagaagggtggcctgaaagagctgtacgaaaaagggccaccaaacgcattttttttagtcaagttttgggcggatcttaattctactatccaggaaggtcctggggccttctatggcgtatctagccagtactcctctgctgattctatgactatatcagtgagcacgaaagtatgcagcttcggcaagcaggtggtcgaaaaggtagaaaccgaatatgctagattagagaacggtcgattcgtctaccgaattcacaggagcccaatgtgtgaatacatgatcaattttatccataagctcaagcacctccctgaaaagtatatgatgaatagtgttctagagaacttcactattctgcaggtcgtgacatcgcgcgacagtcaggagaccctcctggttatcgcctttgtctttgaggtgagtacgtccgagcacggcgcccaacatcacgtgtataagcttgtgaaggattag

SEQ ID NO: 137466 - DNA, 1176 bp, Artificial Sequence
  Description of Artificial Sequence: Synthetic coding sequence
cttgagggcaccgcagggacaatcacatctaatgaatggtcatccccaacaagtcccgaaggctccaccgccagcgggggcagtcaggcattagacaaacccatcgataacgacgcggaaggtgtgtggtcccccgacatcgaacagagctttcaagaagcattggccatctaccccccgtgtggccggagaaagatcattctatccgatgaggggaagatgtatggcagaaatgaactgattgcccggtacatcaagctgcggaccgggaagacaagaacgaggaaacaggttagttctcacattcaagtgctggcccggagaaaggctcgtgaaatccaggctaaacttaagttctggcagggcgccctgcccgggcaagccgggacttctcacgacgttaagccattttcccaacagacctacgcggtacaacccccactacctcttcccggattcgaaagtcctgctgggcccgcgccttcacctagtgctcccccggcccctccgtggcaaggcagaagcgttgcatcgagcaagctgtggatgctggagttctcggccttcctcgaacagcaacaggatcccgacacttataataagcatctctttgttcatatcgggcagagcagtccctcctacagcgatccatatttggaggcggttgacattcggcagatttatgataagtttcctgagaaaaagggtggcttaaaggacctctttgagagagggccaagcaatgccttctttctagtgaaattttgggctgacctcaatacaaatattgaggacgagggctcttcattctatggggtaagctctcaatatgaaagtccagagaatatgataatcacctgttccaccaaagtttgttcttttgggaagcaagtcgtggagaaggtggagactgaatacgctcgttatgagaatggtcattattcttatcggattcatcgttctcctctctgcgagtacatgataaactttatacataaactgaaacacctccctgagaaatacatgatgaattcggtgctggagaactttactatactgcaggtggtgaccaatcgcgatactcaggagaccctgctttgtattgcatacgtgttcgaggtgtctgcgtctgagcatggggcacagcaccatatttatcgtctggtcaaggagtag

SEQ ID NO: 137467 - DNA, 1305 bp, Artificial Sequence
  Description of Artificial Sequence: Synthetic coding sequence
ctagagggcaccgctggaactatcacatcaaacgaatggtcctcacccacctcccccgaggggtccacggctagcggtggtagccaggctctcgataagcccatcgataatgacgcggaaggggtatggtcccctgatatcgaacaatcattccaggaggctctggcgatttaccccccctgcggtcggcgtaaaattattctaagtgacgaagggaagatgtacggcaggaatgagctgatagcgcgatacattaaactgcgcactggcaaaacccgaactaggaaacaggtatctagtcacattcaagtacttgctcgacgcaaagccagggagattcaggctaagctgaaagaccaagccgccaaggataaagcccttcaatcaatggcggctatgagttctgcccagatcatctctgcgaccgcttttcatagttccatggcccttgcacggggtcctggacgtcctgctgtgagcggtttttggcagggcgcattgcccggccaggctgggactagccatgacgtcaaacccttttcccagcagacttacgctgtccagccccccctgccactcccaggcttcgagagcccagcaggccctgctcctagcccatctgcgccgcctgctcccccttggcaaggccgtagtgttgcttccagtaaactgtggatgttggagtttagcgcctttcttgaacagcagcaagatccggatacttacaataaacacttgtttgtgcacatcggtcagtcaagcccatcctactccgacccttacctcgaggccgtggacattagacagatttatgataagtttcccgaaaagaagggcggactgaaagacctttttgagcggggccccagtaacgctttctttttggtgaaattttgggcagacctcaacaccaatatcgaagatgaggggagtagtttttatggcgtttcatcccagtatgagtcacctgagaacatgattattacctgttcaaccaaagtctgctcattcggaaagcaggtggtggaaaaggtagagactgagtatgcgcgttacgagaacggccactactcctatcggatccacagaagtccactttgcgaatacatgatcaacttcatacacaagttgaaacatctgcctgagaaatacatgatgaatagcgtgctggagaatttcacaatactccaagtggtgactaatcgggatacacaagaaacccttctgtgcattgcgtacgtgtttgaggtttccgcatcggagcacggagcacagcatcacatttataggctggtcaaagagtag

SEQ ID NO: 137468 - DNA, 918 bp, Artificial Sequence
  Description of Artificial Sequence: Synthetic coding sequence
atggcagctatgagctcggcgcagataatcagcgcgacagccttccatagctcaatggccctggcacgggggcctgggaggcctgctgtgtccggcttttggcagggcgccctccctggccaagctggtaccagccatgacgtgaagccattcagccagcagacctacgcagttcaacccccgcttccactacctgggttcgagtcacccgctgggccagcaccatccccaagcgcccccccagcccccccctggcagggccgatccgtggcttctagcaaactctggatgcttgagttttccgctttcttggagcagcaacaggatcctgacacttataacaagcacctcttcgttcacattggtcagtcaagtccctcatacagcgatccctacctggaagcagtcgatatccggcagatatatgataaattccccgagaagaagggtggcctgaaggacttatttgagcgcgggccctcaaatgcattctttctcgtgaaattctgggcggatctcaatactaacattgaagatgagggcagtagcttttatggggtgagcagccagtatgagtctcctgaaaatatgatcattacctgctcaaccaaggtttgctcttttggtaagcaggtggtggaaaaagtcgaaactgaatacgctcgatatgaaaatggtcactatagctatcgcattcatagatcaccgctgtgcgagtacatgattaactttattcacaagctgaaacatctgcccgaaaaatacatgatgaatagcgtgctagaaaatttcactatcctgcaggtggtgaccaacagagatacacaggagaccctcctgtgcatcgcatacgtgttcgaggtaagcgcctccgagcatggcgcccaacatcatatctaccggctcgtcaaagaatag

SEQ ID NO: 137469 - DNA, 219 bp, Artificial Sequence
  Description of Artificial Sequence: Synthetic coding sequence
cttgagggaactgcaggcaccattaccagcaacgagtggagcagcccaactagtccagaaggatctacagcttccggcggcagtcaggcactggacaagcctatcgataacgatgcggagggagtatggagcccggacatagagcagtcttttcaggaagccctcgctatctacccaccttgtggtagacgaaagattatcttgtctgacgaagggtag

SEQ ID NO: 137470 - DNA, 69 bp, Artificial Sequence
  Description of Artificial Sequence: Synthetic coding sequence
ctggagggaaccgccggcacaataacatcgaacgaatggtcatccccaacctctcccgagggttcttag

SEQ ID NO: 137471 - DNA, 528 bp, Artificial Sequence
  Description of Artificial Sequence: Synthetic coding sequence
ctggagggtactgccgggactattacctcaaacgaatggagttctccaacctcaccagaggggagtacagctagtgggggctctcaggctttggacaaaccaatagataacgatgcagaaggagtttggagcccggacatcgagcagagttttcaggaagctctggccatctaccccccgtgcggcagacggaagatcatcctcagcgacgagggcaagatgtatgggcgcaatgagctgatagctcgctatatcaagttacggacaggcaagactcggactagaaagcaagtttcctctcatatacaggtgctcgccaggcgtaaggcccgcgagatccaggccaagctgaaggaccaggccgcaaaggacaaggctctgcagtcaatggcggccatgagcagcgcccagataatcagtgcaactgctttccattcgagtatggccttggcccgcgggcccggaagaccagccgtctctggcttctggcagggggctctccccggccaggccggcacatcccattag

SEQ ID NO: 137472 - DNA, 3099 bp, Artificial Sequence
  Description of Artificial Sequence: Synthetic coding sequence
atgtgtaacgaggagaccgagatcaaagaagctcagtcttaccaaaacagtccagtgtcctctgctacgaaccaggacgccggatacgggtccccgttttccgagtcctctgatcagctggcgcatttcaagggctcctcaagtcgggaagagaaggaagatcctcagtgtccagactcagtgagctacccgcaagactccctagctcagattaaggccgtgtatgccaacctcttctccgagagttgctggtccagccttgcattagatctgaagaagtctggctccacaacgagcacaaacgatgcaagtcagaaggagagctctgccccaacacccaccccccccacctgccctgtgagcacaaccggacctaccacctccacccccagtacttcatgctctagcagcacttcccactcatccaccacttctactagttcttcatccgggtacgattggcaccaggcagctctcgcaaaaacactgcagcagactagtagttacgggttactgcccgagccttcactcttttccactgtccaactttaccgccagaacaataagctgtatggaagtgtcttcactggtgctagtaaattcaggtgcaaggactgttctgcagcatacgacacgctagtcgagctgacagttcacatgaacgaaacaggccattaccgggatgacaatcgcgataaggactcagaaaagaccaagcgatggtcaaaaccgcgtaaaagatctctgatggaaatggagggaaaggaggatgcccagaaagtactgaagtgcatgtactgtggtcattccttcgagtccctgcaggacctctcggtgcacatgatcaagaccaagcactatcagaaagtgcccctgaaggaaccggttccagcgattactaaacttgtcccatccaccaaaaaacgcgccctccaagacctagcgcccccgtgtagcccagagcccgccggcatggcagctgaagtagccctgtccgaatcagctaaggatcagaaggccgccaacccctacgtcactcctaataatcgctatgggtaccagaacggagcttcatatacatggcagttcgaggcccgcaaggctcaaattctcaagtgcatggagtgtgggagtagccacgatacactgcagcagttgaccgcccacatgatggtgacaggccattttttgaaggtaaccacttccgcatctaaaaagggcaagcaattggtcctcgatcccgtggtcgaggagaagatacagagcattccacttccccctaccacacacaccaggctgcccgccagcagcataaagaagcaaccagatagccccgccggctctacaacgagtgaggagaaaaaggagcctgaaaaggagaagccccctgtcgcaggggacgcggaaaaaattaaggaggagagcgaagatagcctcgagaaatttgaaccatcaactctttatccatatctgcgcgaagaggacctggatgacagccccaaaggcggtctggatatcctgaagtccctggaaaataccgttagtaccgccatctccaaagcacaaaatggagccccctcatgggggggctacccgagcatacacgcggcttaccagctgcctggaacggtgaaacctttgcccgcagctgttcagtcagtgcaggtgcagccgagctacgccgggggcgtgaaatccctctcttccgcagagcataatgcacttctgcactcccctgggtcactcactccacctccacataaatcgaacgtgtccgcaatggaggaattagtggagaaggtgacagggaaagtgaacatcaaaaaagaggagagacctccggaaaaggagaagagtagtctggccaaagccgcatcgcctattgctaaagaaaacaaagacttcccaaagaccgaagaggtttcagggaagccgcaaaaaaaaggcccagaagccgaaacggggaaagccaagaaggaagggccgctcgacgtccataccccaaacggcaccgagcccttaaaagccaaagttacaaacggatgtaataatctgggaataattatggatcacagcccagagccctcctttattaaccccctcagcgcactacagagtatcatgaatactcatcttggaaaagtaagcaaacccgtaagtccgtctctggatcccctcgccatgctttacaaaatctccaactcgatgctagacaagcccgtctatcctgctacacctgtgaagcaggcagacgctattgacaggtattactatgaaaactcagaccagccaatcgatctgaccaagtccaagaataaacctctcgtgtccagcgtggcagattcagtcgcctcgccattgagggaatccgccctcatggacatcagcgacatggtaaagaacctgaccggacgcctgaccccgaaaagcagcaccccctctacggtttcggaaaagtcagacgccgatggatctagcttcgaggaagctctggacgaactgtctccagtgcacaaacgtaaagggcggcaaagcaactggaaccctcagcaccttctcattctgcaggctcagttcgcatccagccttagggagaccacagagggcaagtatattatgagcgacttaggaccacaagagcgggtccacatttcaaagttcaccggactgtctatgacaactatctctcattggcttgctaacgtgaagtatcagttacgtagaaccggcggaaccaagtttctgaagaatttggacactggccacccagtcttcttctgtaacgactgtgcgtcccagttccgtaccgcgagcacatacatcagccaccttgaaacacatctcggcttctcgttaaaggatctgagtaagcttcccctgaaccaaatccaggagcagcagaacgtctccaaggtgctgacaaacaaaactctcggccccctgggggccacagaggaagaccttggatcaacctttcaatgtaagctgtgtaaccggactttcgcatccaaacatgctgtgaaactgcacctgtccaaaactcacggaaaaagcccggaggatcacttaatttatgtaactgagctggaaaagcagtag

SEQ ID NO: 137473 - DNA, 237 bp, Artificial Sequence
  Description of Artificial Sequence: Synthetic coding sequence
atgtgcaacgaagagaccgaaatcaaggaggctcaatcgtaccagaattccccagtttcctctgcaacaaaccaagatgcaggatacggttctccattttcagaaagctctgatcaactagcacactttaagggatcctccagtagggaagaaaaagaagaccctcagtgtcctgactccgtgtcctacccccaagatagtttagcccagataaaagctgtgtatgccaacctgtag

SEQ ID NO: 137474 - DNA, 321 bp, Artificial Sequence
  Description of Artificial Sequence: Synthetic coding sequence
atgtgtaacgaagagaccgagattaaggaggcccagtcttaccagaatagccctgtatcttcagctaccaaccaggatgcaggatatggttctccattctcagagagttctgatcagctggcgcacttcaaagggagcagctcgagggaggaaaaagaggatccacagtgtccagacagtgtatcttacccccaggattctctcgctcagattaaagcagtgtacgcgaatttattctccgagtcatgttggagtagcctggccctggacctgaaaaagtccgggagtacaaccagcaccaatgacgcctcgcagaagtag

SEQ ID NO: 137475 - DNA, 3096 bp, Artificial Sequence
  Description of Artificial Sequence: Synthetic coding sequence
atgatggcggctgccctgctgcactataccggctatgcccaggaggaacagctgaaagaggaagaggagataaaggaggaggaggaagaggaggactcaggaagtgtcgctcaactgcaagggggtaacgacactggaacggacgaggagctggagacaggccccgagcagaaaggatgcttctcttatcaaaattcccctggttcgcacctgagtaaccaagatgctgaaaatgagagcttgttatccgacgcctccgatcaagtgtctgatattaaaagcgtctgtgggcgtgacgccagcgacaaaaaagcacatactcacgtgagactccccaacgaggcacacaattgcatggacaagatgactgccgtctatgcgaacatcctctcggatagctactggtcaggattaggcctgggattcaagctctctaattccgagcgacgtaattgcgacacccggaatggatccaacaagtcagacttcgattggcatcaggatgccctatctaagtctctgcaacagaacctaccttctcggtctgtatccaaaccctctttgttttcatcagtccagttatacaggcagtcaagtaaaatgtgcggcacggtctttactggtgcctctagatttagatgtaggcagtgttcggccgcttacgacacactagtggaattgaccgtccacatgaacgagactgggcactaccaagatgacaataggaaaaaggacaagctgcgccccacctcctactcaaaacccaggaaaagggccttccaggacatggataaagaagatgcccagaaagttctcaagtgtatgttttgtggggattcattcgacagccttcaggacctgagcgtgcacatgatcaagacaaaacattatcaaaaggtcccccttaaggaacccgtgccaactattagttccaaaatggtgacgcctgccaagaagcgcgtcttcgacgtgaatcggccatgctcgcccgactccaccacaggatcatttgctgactcgttctcttcccagaaaaacgccaacctgcagctatcctctaataataggtacggctaccagaacggagcctcatatacgtggcagttcgaagcttgtaaatcacaaatacttaagtgtatggagtgtgggtcttctcacgatacgttgcagcagctgaccacacatatgatggttactggccattttttgaaggtcacgtcctctgcctctaagaaaggtaagcaactggtcctggatcccctggccgtcgagaagatgcaatctctgagtgaagcccccaattccgattctcttgcccccaagccatcctccaacagtgcaagcgattgtactgctagcactacagagcttaagaaggagtccaagaaggaaagacctgaagaaactagcaaggacgaaaaggtggtcaaatccgaggattacgaagatcccctgcagaaaccgctcgatcccactatcaagtaccaatacttaagagaagaggacttggaggatggcagtaagggcggaggggatattctcaaaagtctcgagaacactgtcacaacagctatcaacaaagctcagaacggggctccctcctggtccgcctacccttcaattcacgcagcctaccaactaagcgagggaacaaagccaccactgcctatgggtagtcaggtgcttcagataagaccaaaccttactaataaactgcgcccgatagctcccaaatggaaggtaatgccactagtctcaatgccgacccacctcgctccatacactcaggtgaaaaaggagtccgaagacaaagacgaggcggtgaaagaatgtggtaaagagtcaccccacgaagaagcctcatccttttctcacagcgaaggggactcattcagaaagagtgaaacgccgccggaggcaaaaaagacagagttggggccacttaaggaggaagaaaagctgatgaaggagggctcagagaaagagaagccccagccactggagcccacatccgcgctgagcaatggctgcgctctggccaaccacgccccagctcttccctgcatcaaccctttgtctgcgctgcagagcgtgctgaataaccatttggggaaagcaaccgaaccccttagaagtccgtcctgtagcagtcccagctcatcaacgatctcgatgtttcacaaaagtaacctgaatgtgatggacaaacctgttctaagtccggctagcacaaggtccgcgtccgttagtcggcggtatctgtttgagaactctgatcaacccatcgatctaacgaagagtaagagtaagaaagccgagagtagccaggctcagagttgcatgtctccccctcaaaagcacgccctgagtgacatcgcagacatggttaaggttttacctaaagccactactcctaaacccgccagttcctccagagtgccacctatgaaactggagatggatgtgagacgtttcgaggatgtcagtagcgaggtgtcgacgctccacaaacggaagggacgccaatcgaattggaatcctcagcacctgctcattctccaggcccagtttgcctcctcattgttccagacgtcggaaggcaagtatctgctcagcgatttgggcccccaggagcgaatgcagatcagcaagttcacgggattaagcatgactacaatttcgcactggctggccaatgtgaagtatcaattgcggaaaacagggggaacaaaattcctgaagaacatggataaggggcatccaatcttttattgttccgactgcgcttctcaattcagaacaccttccacttacatctcccacctggaatctcacctggggttccaaatgaaggatatgacccgcctgtcggttgatcagcaaagcaaagtcgaacaagagatctctcgggtgtcatcagctcagaggtcccctgagacaattgctgctgaagaagataccgacagtaaatttaagtgtaagctgtgttgtcggaccttcgtgagtaagcatgcagtcaaactgcatctgtctaagacccattccaaatcccccgaacaccacagccaatttgtcacagacgtggacgaggaatag

SEQ ID NO: 137476 - DNA, 3105 bp, Artificial Sequence
  Description of Artificial Sequence: Synthetic coding sequence
atgccccgaagaaaacagcaagctcccaagagggcagccggttacgctcaggaggagcagctgaaggaggaggaagagatcaaagaggaggaagaggaggaggactccggctccgtggcgcagctgcaagggggaaacgatactggtactgacgaagaactcgagacaggacccgaacagaaaggatgcttttcgtatcaaaattctcccggatctcacctgtccaaccaagacgccgaaaacgagtctctcctcagtgacgccagtgatcaagtatctgatataaagagcgtgtgtggtcgcgacgctagcgataaaaaagctcatacacacgtgagactaccaaacgaggcccacaactgtatggacaagatgaccgctgtttatgctaacattctctctgattcatactggtctggtctgggcttggggtttaagctgtctaactccgaacgcaggaactgtgacacacggaatggcagcaacaaatccgattttgactggcaccaagacgcattatctaaatcacttcagcagaacctgccctcaaggtccgtgagcaaaccgagcttattctcctctgtgcagctgtatcgacagagcagtaaaatgtgtggaaccgtgttcaccggcgcctccaggttcaggtgtagacagtgtagcgctgcctacgacacactggttgaactcacagtgcatatgaacgaaactggtcactatcaggacgacaacaggaagaaggacaagcttaggcctacctcgtactccaagcctcgcaagcgagcctttcaagacatggataaagaagatgcccagaaggtgcttaaatgcatgttttgtggagattcctttgattccctccaagacctctctgtccacatgattaaaacaaagcattatcagaaagtgccgcttaaagaacctgtgcccacaatctctagcaagatggttacgccagccaagaagagggtgtttgatgtgaatcgtccatgctcaccagattcaacaaccgggtctttcgccgattctttttcctctcagaaaaatgccaacctgcagctcagcagtaacaaccgatacgggtatcaaaacggcgcaagctatacatggcagttcgaagcttgtaagtcgcagattttgaagtgtatggagtgcggcagcagtcacgacaccctacagcaactgacaacccatatgatggtgaccgggcatttccttaaggtgacatcttctgcctctaaaaaggggaaacagttggtgcttgacccattagccgtcgagaagatgcagagtctgtcagaagccccaaattctgactccctcgcacctaagccttcctccaactcggcatccgactgtactgcaagcaccacagaacttaagaaggaaagcaaaaaggagcgcccagaagaaacatctaaggacgagaaagtggtgaaaagtgaagattacgaggaccccctgcagaagccactcgatcctaccatcaagtatcaatatctgcgtgaagaagacctcgaggatgggagcaaaggtggtggcgacatcttgaagagtttggagaacaccgttactactgccatcaataaggctcagaacggagccccgagctggtccgcttatccatctattcacgccgcatatcagctgagtgaggggactaagcctcctctgcctatgggcagccaagtattacaaatacggcctaacctcactaataagctgcggcctatcgctccgaagtggaaggtgatgcccctggtgtctatgccaacacacctggccccgtacacccaggttaaaaaggaaagtgaggacaaggatgaagcggtgaaggaatgcggtaaggaaagccctcacgaggaggcttcctcgttctctcacagtgagggcgactcttttcggaagagtgaaaccccacccgaagcgaagaagactgagctcggcccgttgaaggaggaagagaaacttatgaaggaaggttccgagaaggagaagccgcaacccctggaacccacctctgccctgtccaacgggtgcgccctggccaaccatgcgcctgccttgccttgcatcaacccactttcagctttgcagtcagtgcttaataaccacctggggaaggctaccgagccattgcggtcaccgtcatgttcttcaccttcatcctcaactatatccatgtttcacaaatctaacttgaacgtcatggataaacccgtgttgtctcccgcctctacacggagcgcaagcgtctcacgccgctacctgtttgaaaattctgaccaacccatagatctcacaaaatccaaatccaaaaaggcagaaagctcccaggcccagtcttgcatgtcaccccctcagaagcatgctctgtccgatattgctgacatggttaaggttctccccaaggctaccacccccaaaccagcttcttccagtagagtgccacctatgaaactcgagatggatgtgaggagatttgaagacgtcagtagcgaagtgagtactttacacaaacgaaaaggcagacagtctaattggaatccccagcacctcctgatcctccaagcacaatttgcttcctcgttgttccaaacatcagagggtaaatacctgctgagtgatctgggtcctcaggaacggatgcagatcagcaagtttaccggtctgagtatgactacaataagtcactggctcgccaacgtcaagtaccaactcagaaagactggaggcactaagttcctaaagaacatggacaaagggcatccaatattctactgcagtgactgtgcttcgcaatttcgaaccccttccacttatatctctcatctggagtcccacctgggattccaaatgaaggatatgacacggctatctgtggaccagcagagtaaggtagagcaggaaattagcagagtgtcgtcggcccagcggagcccggaaacgatcgctgccgaagaagacacagactctaaatttaagtgtaaactgtgctgccggacatttgtgtcaaaacacgcagtcaaactgcacctgtctaagacacacagcaagagccctgagcatcactctcagttcgtgaccgatgtggatgaggaatag

SEQ ID NO: 137477 - DNA, 3246 bp, Artificial Sequence
  Description of Artificial Sequence: Synthetic coding sequence
atgccccgcagaaaacaacaggcaccacggcgtgcagccgcctacgtcagcgaggagctgaaagccgcggctctggtcgacgagggactggacccagaagaacacaccgcagacggcgagccgtccgcgaagtatatgtgtccagagaaggagctggccagagcatgtccaagttaccagaacagccctgcagcagagtttagctgccatgagatggattccgaaagccacataagcgagacgtcagaccggatggcagacttcgaatcaggatcgattaaaaacgaggaggaaactaaggaggtgactgtccccctggaagataccacagtttccgatagcctcgagcaaatgaaagcagtttacaacaattttctgagtaattcctactggtcgaatttaaatttgaacctgcatcaaccatctagcgaaaaaaataatggcagctccagcagcagctcatcctcatcaagttcctgcggtagcggcagcttcgactggcatcaaagcgccatggctaaaacactgcagcaagtgagccagtcccgaatgctgccagaaccatctctgttctctactgtccagctttacaggcagagttccaaactgtacgggtctattttcacaggtgcaagcaaatttagatgcaaagactgctcagccgcctacgataccctggtggagctgaccgtgcatatgaacgagactggacactacagggacgacaatcatgagaccgataataataatcctaagagatggagcaaacctagaaaaaggagtctgctcgagatggagggcaaggaggatgcacaaaaggtgttaaaatgcatgtactgtggacatagcttcgagagtttacaggatttgtctgttcacatgatcaaaactaagcactatcagaaggtccccctgaaagagcccgttacacccgtggccgccaagattatacctgcaacacgcaaaaaagctagccttgaactggaactgcctagcagccctgactcaaccggagggaccccgaaggcaaccatatctgacactaacgacgccctgcaaaagaattcaaacccctatattacccctaataaccgatacggccatcagaatggggccagttatgcttggcatttcgaagcccgtaagtctcagatccttaaatgcatggaatgcgggtctagccacgacacattgcaagagctaacagcccacatgatggtaacgggccactttatcaaggtcaccaacagcgcaatgaagaagggcaagcccatcgtcgagactcctgtgacacctactatcaccacattgctggatgagaaagtccagtcagttccccttgcagctaccacattcacatccccatcaaacacaccggccagcatttcgcctaagctgaatgttgaggtgaagaaagaggtcgataaggagaaagcagttactgatgaaaaacccaaacaaaaggacaagccgggagaggaagaggagaagtgtgatatttccagtaaatatcactacctgacagaaaatgatttggaagagtctccgaagggcggtctcgatattctgaagtcgctggaaaataccgtcacatccgcaatcaataaggcccaaaacggaacaccttcttggggaggctacccatccatacatgccgcctaccaacttcctaatatgatgaagttgtcccttggtagttccggaaaatccactccactgaagccaatgttcggaaattcagaaatagtgtctccaaccaagaaccagaccctcgtgagtcctccatcctctcagactagtcctatgccaaaaacaaacttccacgcaatggaggagctggtcaaaaaggtgacggagaaggttgcgaaagttgaagagaaaatgaaggaacctgatggaaagttgagcccccccaagcgggccacaccaagtccctgttcttcagaagtgggagaacccatcaagatggaagcctcatctgatgggggatttagaagccaagagaacagcccgtctccacccagagacggctgtaaagatggtagccccctggccgagcccgtggagaacgggaaagaactggtaaaacctctggcgagtagcttgtctgggagcactgccattattacggaccatcccccagaacagccctttgttaatcctctctccgcacttcagtccgttatgaacattcacctgggaaaggccgccaaaccatctctgcccgccttggatcccatgtccatgctgtttaagatgtcgaactcactggccgagaaggccgctgttgccacgccaccaccactgcagtctaaaaaggccgatcatctcgacagatatttttaccacgtcaataatgatcagcctattgatcttaccaagggtaaatctgataagggctgtagcctcggtagcgtgctactttccccaacctctacggcccccgctacttcctcatctaccgttacaactgccaagactagtgccgtcgtgtcatttatgtccaactctcctctcagagagaacgccctttcagacatatctgacatgctgaagaacctgaccgaaagccataccagcaaaagcagcacaccaagtagcatcagtgagaaaagtgacatcgacggcgcaacattagaggaggccgaggagagtactccagcgcagaaaaggaagggcagacagagcaactggaatccgcagcatttgctcatccttcaagcacagtttgctgcctccctccgccagaccagcgaaggcaagtatatcatgtctgacctgagcccacaagaaagaatgcacatcagtaggttcacaggcctgtctatgaccacaatttctcattggctcgcaaatgtgaaataccagctcagaagaactggcggcaccaagtttttgaaaaatcttgatactggacaccccgtgtttttttgtaacgattgcgcttcccaaatccgcacccctagcacatacatttctcacctggaaagccacctgggtttcagattgcgagacctgtcaaaactgagcactgagcagatcaatagccagatcgctcagactaaatcgccaagtgaaaagatggtcacatcctctccagaggaggacctcggtacatcctaccagtgtaagctctgtaacagaaccttcgcttccaagcatgctgtgaagttacacctgtccaagacgcatggtaagagccctgaggaccacctgctgtatgtgtctgaacttgaaaagcagtag

SEQ ID NO: 137478 - DNA, 1896 bp, Artificial Sequence
  Description of Artificial Sequence: Synthetic coding sequence
atgaatttcaacaccattttggaggagatcctgattaagaggagccagcagaagaaaaagacatctcccctgaattataaagaaaggctgttcgtgctgacaaagtctatgttgacctattatgagggacgggcagaaaagaagtaccgcaagggcttcattgatgtgagtaagataaaatgcgtggagatagttaagaacgatgacggcgtgataccatgtcagaacaaatacccctttcaggtggtgcacgatgccaataccctgtacatattcgctccatccccccagagtcgggacctgtgggttaaaaagcttaaggaagagatcaaaaacaataacaacatcatgataaagtatcatcctaagttttggacagacggttcttaccagtgttgccggcagaccgagaaactagcacccgggtgtgaaaagtacaatctgttcgaatcctccatccgcaaagctttgcctccggcccccgaaacaaagaagcggcgcccccctccaccaatcccactggaggaggaggacaatagcgaggaaatcgtagttgcaatgtacgattttcaggctgccgagggacacgatctccggttggaaagaggtcaggaatatctgatactggagaaaaacgacgtgcactggtggagggcgagggacaagtacggcaacgaaggctacatcccttccaactatgtgactgggaagaagagtaataatctggaccagtacgaatggtactgccggaatatgaacagaagcaaagcagaacaattactacgcagtgaggacaaggagggcggcttcatggttagggacagttcgcagcctgggctgtacacggtgagcctatataccaagttcggaggtgaggggtccagtggattccggcactaccacattaaagagaccacaacatctccaaagaagtattacctagctgaaaaacatgcctttggaagcatccccgaaattattgaataccacaaacacaatgccgccggcctggttactaggctgcggtaccccgtttcagtcaagggcaagaacgctcccactaccgctggttttagctatgaaaagtgggaaatcaaccccagcgagctgacattcatgcgagaactgggctccggtctctttggcgtggttcggctgggcaagtggcgcgctcagtacaaagtggccattaaggccatacgggagggagctatgtgtgaggaggactttattgaggaggccaaggtgatgatgaagcttacgcatcccaagctggtgcagctctacggagtctgtacacagcaaaagcccatatatatcgttactgaatttatggagaggggctgccttttaaattttctgcgccagcggcagggccacttctcaagagatgtactgctgtcaatgtgccaggatgtgtgcgagggaatggagtacttggaacgcaactctttcatccaccgtgacttagccgcaaggaactgcctggtgtccgaggctggagtggtgaaggtgtctgatttcggcatggccagatacgtcctcgacgaccagtacacctcaagctcaggggccaaatttcccgtcaaatggtgtccacccgaggttttcaattacagccggttttcgtcaaagtctgatgtctggagctttggtgtcctgatgtgggaggtgtttactgaaggcaggatgccttttgaaaagtacacaaattatgaagtcgtgaccatggtcactagaggacatagactctaccagccgaagctcgcctcaaattacgtttatgaagtgatgttgaggtgctggcaggagaagcccgagggacggccatccttcgaggacctgctgcgaaccatagatgagctggtggagtgtgaggagacattcggccggtag

SEQ ID NO: 137479 - DNA, 2094 bp, Artificial Sequence
  Description of Artificial Sequence: Synthetic coding sequence
atggggtttcagccgccggctgcactgttgttgaggttgttcctgctgcaaggaattctgcgactcctctggggtgacctcgcctttatcccaccatttatccgtatgtcgggacccgcagtgagcgctagtctggtaggtgataccgaaggcgtgactgtctcgcttgccgttctgcaagacgaggccggcattcttcccattcctacttgcggagtcttgaacaatgagactgaggattggagtgtcaccgttatccctggggcgaaagtacttgaggtgacagtccggtggaagcgaggcctcgactggtgttcttcaaacgagaccgacagcttttccgaatcgccctgtattctgcagacactgttggtttccgcgagccataacagcagctgctccgcacaccttctgatccaggtcgagatctacgccaactcatcactcacacataatgccagcgaaaacgttacagtcatccctaatcaagtttaccagccactgggcccctgtccctgtaaccttactgcaggagcatgcgatgtaagatgttgctgtgaccaggagtgttcctccaacctgacaaccctttttcggcgaagctgtttcaccggcgtctttgggggagatgtgaatccacctttcgatcagctgtgctcagcagggactaccaccaggggagtcccagattggtttccgttcctttgcgtgcagagtcctctagcaaacacaccctttctcggatatttctaccatggcgcggtttctcctaagcaggattcctccttcgaagtgtatgtggacacagacgcgaaggacttcgctgacttcgggtacaagcagggggacccgattatgacagttaaaaaggcgtacttcactattccgcaggtgtctctcgcaggacagtgcatgcagaacgctcccgtggcctttttgcacaatttcgatgtcaaatgtgtaactaacctggagctgtaccaggaacgcgatggcatcattaacgcaaagattaagaatgtggcacttggggggattgtgacccccaaagttatttacgaggaggcaaccgacctcgacaagttcattacgaataccgagaccccactgaacaacgggagcacccctcgtatcgtcaacgtcgaggaacactacatcttcaagtggaataacaacacgatctcggaaattaacgtgaaaattttcagagccgagatcaacgctcatcagaaagggatcatgacacagcgatttgtggtgaaattcctgagctacaacagtgggaatgaagaggagttatctggtaaccctgggtatcagcttggcaagcctgtgagggcgttgaatattaacaggatgaataacgtcaccacccttcacttgtggcaatctgcgggacggggcctctgcacatccgccacgtttaagcccatcttatttggggagaacgttctgagtggatgcctcctggaggtgggcatcaacgagaattgtacccagctaagggagaacgccgtggagagattggactcattgatccaagctacacatgttgcgatgcggggaaacagcgactacgccgatctgtctgatggctggttagaaatcattcgggtggacgctcccgaccctggagcggacccactagcctcctcagtgaatggaatgtgtttggacataccggcgcacctgtccatccgtatcttaatatcagatgccggggctgttgaagggatcacccagcaggaaatccttggagtagagacgcgtttttcaagcgtgaattggcagtatcagtgcggccttacttgtgaacacaaggccgaccttcttcccattagcgccagcgtgcagttcatcaaaattcccgcccagctgcctcaccctctcactcgattccagatcaattatacagagtacgactgtaacaggaacgaagtctgttggccacagttattgtacccatggacccagtattaccagggggagttgcactcgcaatgcgtggcaaaagggctgcttctgctgctattcctcactctggctctcttccttagcaacccatggacacgaatatgcaaggcctatagctag

SEQ ID NO: 137480 - DNA, 2091 bp, Artificial Sequence
  Description of Artificial Sequence: Synthetic coding sequence
atgggttttcagcccccagctgccttgctgctaaggctcttccttctgcaaggtatcttgcggttgctctggggagacctcgcatttatccctccttttatacgcatgtccgggccagccgtgtccgcgagcctggttggggacacagaaggagtgaccgtgagtttggcagtactccaagacgaggcgggtattctcccgatccctacctgtggcgtgctgaacaacgagacggaggactggtctgtcactgtgattccgggggctgtcctggaagtgacggtgaggtggaaaagaggcctggattggtgttcttccaacgaaactgactcatttagtgagagcccgtgcatcctacaaactctcctggtgtctgcatctcacaactcatcctgtagcgcacacctcttgattcaggtggagatctatgcgaactcttctctgactcataatgcctccgagaatgtgactgtgatccccaaccaagtgtatcagccattgggcccatgtccgtgcaacctaaccgccggggcatgcgacgtcagatgctgctgtgaccaggaatgttcctctaacctaacaacactgtttagaaggtcatgttttacgggcgtattcggaggcgatgttaatccaccattcgaccagctctgctcggcgggcaccacaacccgtggagtgcctgattggtttccgttcctgtgtgttcagtcgccgctggcgaacaccccttttctgggctacttttatcacggtgccgtgtcccccaagcaggatagctccttcgaagtatatgtagatacagacgcgaaagacttcgctgatttcggatacaaacagggagacccgataatgactgtaaagaaggcgtactttaccattcctcaggtgagcctggcagggcaatgcatgcagaatgcgcccgtagcattcctgcacaatttcgacgtgaagtgtgtgacgaacctggaactctatcaggaaagggacggaattatcaacgccaagatcaaaaacgtcgcacttggtggtatagtaacccctaaggtgatctatgaagaagctaccgacctggacaaatttatcactaataccgagacccctcttaacaatggctcgactccccggatcgtgaacgtagaagagcactacatcttcaaatggaacaacaacacaatctcggagattaatgtcaagatttttagggcggaaattaacgcgcaccaaaaaggtattatgacccaaaggtttgtagtaaagttcctgtcatacaatagcgggaacgaagaagagctgtccggaaacccgggctatcaactgggaaaacccgttagagctctcaatattaatagaatgaataatgttaccactctgcacctgtggcagtcggccggacgcggactgtgtacatccgcgacctttaagccgatactgtttggtgaaaacgtcctgtccggttgtctcctagaggtggggatcaatgagaattgcactcagctcagggaaaacgctgttgagcggttggacagcttgattcaggctacacatgtcgccatgcgaggtaattcagattacgcggatctgtctgatggatggctggagatcatcagggtggacgcacccgatcccggagcggaccccctggcctcatccgttaatggcatgtgcctcgacattccggctcacttgagtatcagaatccttatctctgacgcgggagcagtggagggaatcacacagcaggaaattttgggagttgaaaccaggttctcatccgtaaactggcaataccagtgcggcctgacctgtgagcacaaggccgatttactacctatcagcgcatccgtgcagttcattaagattcccgcacagctgccgcatccactgacgagatttcagatcaattacacagagtatgattgcaaccgaaatgaagtgtgctggcctcaactcctatacccctggacgcaatattatcagggtgagttacattcccagtgtgtagccaagggcttgctgctactgttgttcctcaccctggccctgtttctgagcaatccatggacaaggatttgtaaggcttactcatag

SEQ ID NO: 137481 - DNA, 1824 bp, Artificial Sequence
  Description of Artificial Sequence: Synthetic coding sequence
atgaggacaccgcagctggcgctgctgcaggtcttcttcctggtctttcctgacggagtgcgaccccagccctctagttccccttccggggccgtgccgacatcccttgagttgcagagaggcactgatggtggaacactgcagtctcctagcgaagcaaccgctacccggccagccgtgcccgggctgcctaccgtggtgcccacactcgtgacgcccagcgcaccaggtaatcggactgtggatctattcccagtgctacccatctgcgtttgtgacctgacccctggcgcttgcgatataaactgctgttgcgatcgcgactgttatcttctgcatccaaggaccgttttctctttttgcctgccaggcagcgtgcggtcctcttcttgggtatgtgtggataattctgtcattttccgaagtaattcaccattccctagccgcgttttcatggacagtaatgggatacgtcaattttgtgtacacgtgaacaattcaaatctgaactacttccagaagctgcagaaggtaaatgccacaaacttccaggcactggcagcagaattcggaggcgaatcatttactagtacattccagacccagagcccaccaagcttttaccgtgccggtgatccaatcctcacatactttccaaagtggtccgtgatttcactcctccggcaaccagctggcgtaggagcaggcgggctttgcgctgagtctaaccctgccggcttcttggagtctaagtccacaacctgcactcgctttttcaaaaatttggcgtcaagttgcaccctggacagcgctctgaacgctgcgtcttattacaacttcacagtgctaaaggttccccgttccatgaccgatccacagaatatggaattccaggtgcccgtgattctcactagtcaggcaaatgcccccctcctggctggcaacacgtgccagaacgtcgtctcccaggtaacatacgaaattgaaaccaacggtactttcggaattcagaaggtttcagttagtcttggccagactaatctgaccgtggagccaggggcctccctccagcagcatttcatcttacgctttcgcgcgtttcagcaaagtacggctgcgtccctaacctctccgcgctctggtaaccctggctacatagtgggcaagcccctgctggcgttgaccgacgacatctcttactcaatgacactattgcagtcccaaggcaacggtagctgtagcgtgaaaaggcacgaagtgcagttcggcgtcaacgccattagcggatgcaagcttcggctcaaaaaggccgattgtagccatctccagcaggaaatctaccagacactgcatggacgccccagaccagagtatgtggctatctttggaaacgcggacccagcacagaagggcggatggacgcgcatcctgaaccgacattgctcaatttccgcgattaactgtacctcctgctgcctcatcccggtgagtcttgagatacaagtactctgggcctacgtgggcctcctgtcaaacccgcaggcgcacgtgtcaggcgtcaggtttctgtaccagtgccagtccattcaagactctcaacaggtaactgaggtttcactcacaacattagtgaattttgtggacatcacccagaagcctcagccacctagaggacagcccaagatggactggaaatggcctttcgatttctttccttttaaggtcgccttcagtcgcggcgtgtttagtcagaagtgcagcgtgagtccaattctcatactgtgtcttcttctcctcggcgttctgaatctggaaaccatgtag

SEQ ID NO: 137482 - DNA, 1290 bp, Artificial Sequence
  Description of Artificial Sequence: Synthetic coding sequence
atggattctaacggtattcggcagttttgcgttcacgtgaataactccaacttgaactactttcaaaagctgcagaaggtgaacgcgacaaactttcaggctctcgctgccgaatttgggggtgaatccttcacaagtacgttccagacccagtcacccccttcattctaccgcgccggcgatcccattctaacatacttccccaagtggtcagttataagtctgctgaggcagcctgcgggcgtcggcgcgggaggactgtgcgcagaatccaacccagccggatttctggagtcaaagtctaccacttgcactcgctttttcaagaacttggcgtcctcctgcaccctcgactccgccctcaatgcggccagctactacaattttaccgtgctgaaggtcccaaggagcatgaccgatccccaaaatatggaggtgacctatgaaatcgaaacaaatggcacattcgggatacagaaggttagcgtatcattgggtcaaactaatctaactgtggagccaggggcctcgcttcagcaacacttcatcctgcggttcagggcattccagcagagtacagcagcatctctcacatccccccgtagtggtaaccctgggtatatcgtgggcaaacctcttttagccttaacagatgatatttcatactcgatgacgctgctgcagtctcagggaaacggcagttgctctgtcaaacgccatgaggtgcagtttggagtcaacgccattagtgggtgcaaattaagactcaaaaaagccgattgcagccatcttcagcaggaaatatatcaaacactgcacggcagacctcgccccgagtacgtggccatattcgggaacgccgatcccgcacagaagggaggctggacccggatccttaaccgccactgcagcattagtgctatcaactgtacatcgtgttgcctgatcccagtatctctggagattcaagtgctgtgggcgtatgtgggattactgtcaaacccccaggcccatgtgtctggtgtgagatttctctaccagtgccagtctatccaagacagtcaacaggtcacagaggtgagcctgactactctcgttaattttgtcgatatcacacagaaaccccagccgccacgcggtcagccgaagatggactggaaatggccattcgatttcttcccattcaaggtcgcctttagtcgcggagtcttctcgcaaaagtgttctgtgtctcctatcttaatcttgtgtctcttgctcctgggagtcctcaaccttgagacaatgtag

SEQ ID NO: 137483 - DNA, 1332 bp, Artificial Sequence
  Description of Artificial Sequence: Synthetic coding sequence
atgcgtactcctcaactcgcattgctacaggtcttttttctggtgtttcccgatggggtgcgtccacagcccagctctagtccttccggagctgtgccaacctccttggagctgcagcgagggaccgatggtggcaccctgcagtctccttctgaagctactgctacaaggccagccgtcccaggactccccaccgtggtgccaacgcttgttacgccctccgctcccggcaatagaaccgtggacctttttcctgtactcccgatttgcgtgtgcgaccttacccctggggcgtgtgacatcaattgctgctgcgatcgggactgttatcttctgcatcctcggaccgtattcagcttctgtttaccaggctctgtgaggagcagctcctgggtctgcgtagataattccgttattttccgatccaatagcccatttccctcgcgcgtctttatggacagcaacggcattcgccagttctgcgttcacgtcaacaacagtaatcttaactatttccaaaagctacagaaggtgaatgcaaccaactttcaggccttggccgccgaattcgggggagaaagttttacaagcacattccaaactcagtctcccccctcgttctatcgggccggggaccctatattaacctatttccctaagtggtccgtgattagcctcttaaggcagcctgcaggggtgggcgccggaggactttgtgctgagtccaatcccgcaggatttctggaatcgaagagtaccacctgtactaggttttttaaaaatctcgcgagctcctgtacactagattccgcactgaatgctgcatcgtattacaatttcaccgtactcaaagttccacgatccatgaccgacccccagaacatggagtttcaagtccctgtaatcctgacaagtcaggcaaatgcaccactgctcgcgggcaacacatgccagaatgtagtgtcacaggtgacttatgagattgagacaaatggaacttttggcatacagaaggtgtccgtctcgttaggacagaccaatttgaccgttgagcctggcgcgtccttgcagcagcactttattctgaggttccgcgcattccagcagtccacagctgcctccttaacttcccctcggagcggtaaccctggctacatcgtaggtaagcccctcttagcgctgacagacgacataagttacagcgtcagtttcctggaacttgggggtctgcttcagccaaacgagaaaagctgcaaagggtttcaaacttacgtgaggttagcaaaaggtgaggagtttttcgtccattacaatgaggtgttaatctattag

SEQ ID NO: 137484 - DNA, 1878 bp, Artificial Sequence
  Description of Artificial Sequence: Synthetic coding sequence
atgagactcgagaccgccgaggcctatgtcgggcccggtggtcctgaatgcccgatgagaacaccccagctggctcttctgcaggttttttttctggttttcccagatggcgtacggccgcagcccagtagctcgccctcaggggcggtacctaccagcctggagctccagcgcggcactgatggtggcaccctccagtctccttctgaagcaacagccacacggccagccgtacctggcctacccactgtggtgcccaccctggtgacaccaagcgcaccaggtaaccggaccgtcgacctgttcccggttctccctatctgcgtctgcgacctgacgcccggtgcatgcgatatcaactgctgctgcgacagggattgctatctcctgcaccctcggacggtgttctctttttgcttgcccggctccgttcggagcagctcgtgggtatgcgtcgataactctgtgattttccgcagcaattctccctttccaagccgagtgttcatggactccaatggcatcagacagttctgtgtccacgtcaataacagcaacctgaactattttcagaagctacagaaggtgaacgctacaaatttccaggccctcgctgccgagttcggcggagagtcttttacatcgacattccagacccaatcccccccatccttctatagagcaggcgacccaatcctgacctattttccaaagtggagcgtcatttcgttactgaggcagcccgccggagtgggggcaggaggtttatgtgcagagtccaaccctgcaggcttcctcgagtccaaatcaacaacttgtactcggttcttcaaaaatctggcatcttcctgcactttagactctgccctgaacgctgccagctattacaacttcaccgtgttgaaagttccccgctctatgactgatccacaaaacatggagtttcaagtgcctgtgatcctcacatctcaggccaacgcccctctgctggcaggaaacacgtgtcagaacgtggtgtctcaggttacctacgagattgagaccaacggaacattcggtatacagaaagtatccgtttcgctaggacagacaaacctcacagtcgaaccaggtgccagcctgcagcagcactttatcttgaggttcagagcctttcaacagagtacggctgctagcctaacctcccccagatccggcaatcccgggtacattgtgggcaagcccctacttgccttgacagatgacatctcatatagcatgacattactccaatcccaggggaacgggtcctgctcggtcaaaagacatgaagttcagtttggggtcaatgcaatctcaggatgcaaactgaggctaaagaaggccgactgctctcaccttcagcaggagatttaccaaacgttgcatggccgtccccggcccgaatatgttgcgatctttggtaacgcagaccccgcacagaaagggggatggacgcgcatcctaaaccgccattgttcaatatccgcaatcaattgcacatcttgttgcctcatccctgtgtcactcgaaatccaggtcctgtgggcctatgtcggcttactgtcgaatccacaggcgcacgtctccggtgtgcggttcctataccaatgccagagtattcaggactcccaacaggtcactgaagtaagtctcaccacactggttaactttgtggacatcacccagaagccccagccgcctcggggtcagcccaaaatggactggaagtggccattcgacttttttcctttcaaagtggctttttccagaggcgtattctcacagaaatgcagcgtgtcacctattctcattctctgcctgctcctcctcggagtgctgaatctcgaaactatgtag

SEQ ID NO: 137485 - DNA, 1380 bp, Artificial Sequence
  Description of Artificial Sequence: Synthetic coding sequence
atgagaaccccacagctggccctcttgcaggtattctttctggtgttccccgacggagtgcgcccgcaaccatctagttcaccatccggggccgtcccaactagcctagagttgcagagaggcaccgacggcgggaccttgcagtcacccagcgaggccacagctactcggcccgctgtgcccggcctgcccaccgtggtgccaactctagttacaccatcggctcccggcaatagaacagtagacctcttcccagtcctgcctatctgcgtttgcgatctcactcctggcgcatgcgacataaactgttgttgcgatcgcgactgttatctcctgcacccacgcactgtgttttcattctgcttaccaggctcggttagaagctcatcttgggtttgcgtggacaactcagtcatcttccgatcaaattctcccttcccgtctcgggtgtttatggattcaaacggcattcgccagttctgtgtacacgtgaataactgttttctcgagagtaagtccaccacgtgcactcgattcttcaagaacctggcttcatcttgcacactagattcagccctgaacgccgccagctattacaactttactgtacttaaggtgcctaggagtatgaccgacccccagaatatggaggctttccaacaatccactgcggcatcccttacaagcccaaggagtggaaatcccgggtacattgtaggtaaacccctgctagcactgaccgatgacatcagctacagtatgacccttcttcagagtcagggaaatggaagttgtagcgtcaagcgccacgaggttcagtttggagtgaatgcaattagtggctgtaaacttcggttgaagaaagcagattgtagccatctgcaacaggagatatatcagaccctgcatggccgtcctcggccagaatacgtagccattttcggaaatgccgaccccgctcagaaaggtgggtggacaaggatcctcaatcgccactgctcgatttctgcaattaactgcacgtcttgttgtctaatccctgttagtctggagatacaggtcctgtgggcttatgtgggacttctctccaacccgcaggcacatgtttcaggtgtccggttcttgtatcagtgccagagcatccaggacagtcagcaagtgactgaggtatccctgacaacactagtaaattttgtcgatattacccaaaagcctcagccccctcgagggcaacccaaaatggattggaaatggccttttgacttcttcccattcaaagtagccttctctcggggagttttctcccagaagtgctccgtgtccccaatactgattctgtgtcttctgctgttgggggtgcttaaccttgagactatgtag

SEQ ID NO: 137486 - DNA, 6468 bp, Artificial Sequence
  Description of Artificial Sequence: Synthetic coding sequence
atgaattactctagtttcctccgaatatgggtgtcttttatcttcgcattagtccagcaccaggcccagccacgggagctgatgtatcccttttggcaaaacgacaccaagactcccaaagtggatgatggcagtagcagcgagattaagttagccatccccgtgtttttttttggagtgccatacagaacagtttatgttaacaacaacggggtcgtatccttcaacgttctggtgtcgcagttcacacctgaaagtttcccactcactgatggccgtgctttcgtggctcctttctgggcagacgtgcataacggaatccgaggcgaaatttattacagagagacgatggagccagcgatcctcaagagggcgacgaaggacatacgaaagtattttaaagatatggccacgttctcagccacatgggttttcatcgtaacatgggaggaggtgacgttctacggcggcagctctaccacacctgttaacacctttcaggcggtcctcgttagtgacgggagttacacttttacactgttcaattactatgaaataaactggactaccgggacggccagcggaggagatcccctcacagggctggggggcgtaatggctcaagctggcttcaacggggggaacctgactaacttcttcagtctacccggatccagaacgcctgagattgtgaatatacaggagactactaatgtgaatgtccccggcagatgggcgttcaaagtcgatggcaaagagattgacccagctaacggctgtactagcagaggccagttcctgcgccgcggggaagtcttctgggacgacttaaattgtaccgtcaaatgcagatgtctcgactttaataatgaaatttattgtcaggaggcatcgtgcagcccttacgaggtgtgcgaacctaaaggcaagttcttttactgtagcgctgtagaaactagtacatgtgtggttttcggggaaccccactatcacactttcgatggctttttgttccatttccagggtagttgcgcatatctgctggcaagacagtgcctccagacttcttccttgcctttcttttccgtcgaggcgaaaaacgagcatcgtagaggatcggccgtgtcatgggtgaaggaactatcagttgaggtaaacggctacaagatactgattccaaaaggctcctacggaagggtcaaggtgaatgatctggtgacctccttgccggtgacactcgatctcggcacagtgaaaatttatcagtcaggaatcagtacagctgtggagacagattttggattgctggtgacctttgacggtcagcactacgcctcaataagcgtgcctgggagttacatcaattctacatgcgggctctgcggtaactataataagaatcctctcgatgattttctccgtcccgacggtagaccggccatgagtgtcttggatctcggtgagtcctggcgcgtgtaccacgctgactggaaatgcgattctggctgtgtggataattgcactcagtgcgacgccgctaccgaggccctatatttcggctcggattattgcgggttcctcaataagactgatgggcccctgtgggagtgtggaaccgtggtcgaccctacagcattcgttcacagctgtgtttatgacttgtgttcagtgcgggacaatggcacgctgctctgtcaagccatacaggcctatgctttagtctgtcaggctctggggattccgatcggagattggcggactcaaactggatgtgtgagcaccgtccagtgcccttccttctcccactacagcgtttgcacgtcttcttgtcccgacacctgcagcgatctgacagctagcagaaactgcgcgaccccttgcactgagggatgcgaatgcaaccagggctttgtactctccactagccagtgtgtccccttacacaagtgtggatgcgacttcgatggccattactacactatgggcgagttcttctgggccactgccaactgcacagtgcagtgcctctgtgaggaaggtggtgacgtttactgcttcaacaagacctgcgggtctggggaagtctgcgccgtcgaagatggttaccagggctgcttccctaaacgagagacagtatgcttgctgagtcaaaatcaggtccttcacactttcgacggggcatcgtacgctttcccatcagagtttagttacaccctcctgaagacatgccccgagagaccagaatatctcgagatcgatattaacaaaaaaaagcctgatgctggccctgcctggctcaggggactcagaatacttgtcgcagaccaagaagttaagatcggtggcatcggagctagcgaagtcaaacttaacgggcaagaagtcgagcttccctttttccaccccagcgggaagttggaaatttatcggaataagaattctaccaccgtggaatcaaaaggcgtggttaccgtgcagtacagcgacatcggcctgctctatatccggctgtctaccacgtacttcaattgtaccgggggactctgcggattttataatgcaaatgcaagtgatgagttttgtctgcccaatgggaagtgtacagataacttggctgtctttttagaaagctggacaaccttcgaagagatttgcaatggcgagtgcggagaccttctgaaggcatgtaataacgacagcgaactacttaaattttaccgttccaggtccaggtgtggaatcattaacgacccctccaactcttcattcctggagtgtcacggggtggttaatgtgaccgcttactacaggacttgtctgtttcggctctgtcaaagcggggggaacgagtcagagctgtgtgactcagttgctcgctatgcctccgcttgtaaaaatgccgatgtggaggtcggaccttggaggacttatgatttctgcccccttgaatgccccgagaattcccattttgaggagtgcattacatgcacagaaacttgcgagactttgacactgggcccgatatgcgtcgattcatgctcggaaggctgtcaatgcgacgagggatatgcactgcttggttctcagtgtgttacccggagtgagtgcggctgcaatttcgagggtcaccagctcgcaacgaacgagaccttctgggtagatctggactgccagatattctgctactgctctggtactgataaccgcgtccactgtgaaactattccatgtaaagacgatgaatactgtatggaggagggaggactgtactattgccaggcccgaactgacgcttcatgtatagtgtccggatatggccactacctgacctttgacgggtttccattcgactttcagacctcatgcccactaattctgtgtaccacaggatcaaggccctcctccgacagtttcccaaagtttgttgtcaccgccaaaaacgaggatcgagaccctagtctggcactgtgggtcaagcaggtcgacgtgactgtatttggatactcaattgtgattcaccgcgcttataagcacaccgtgcttgttaatagcgagaggctatacctgccgcttaaactggggcaggggaagattaatatcttttcttttgggttccacgtggtggtggagactgattttggtctaaaggttgtgtacgactggaaaacattcctgtccattacagtgccacgttccatgcagaactccacgtatggactctgcgggagatacaatggcaatcctgacgacgatctggaaatgcccatgggtctgttagcttcttccgtcaatgagtttggacaaagctgggtgaagagagacaccttctgtcaggtcggatgtggagacaggtgtccctcatgcgccaaggtagagggcttctctaaagtccaacagttgtgctctctaatcccaaaccagaacgctgctttttctaagtgtcatagcaaggtgaacccaaccttcttctacaaaaactgtctgtttgatagttgtatcgacggcggggcagtgcagaccgcctgttcctggcttcagaattacgccagcacttgtcaaacccaaggcattaccgtcactgggtggcgcaattacacatcatgtaccgtgacatgtccccccaacagccactacgagagctgtgtgtccgtctgccagccaagatgcgcggcaataaggcttaagtctgactgttctcactactgtgtagaaggctgccattgcgatgcgggttacgtgctcaatggtaaatcatgtatcttaccacattcgtgcggctgttactctgatggaaaatattatgaaccaaagcaactgttctggaatagtgattgtacgagacgttgccggtgcttccgacgcaatgtcattcagtgtgaccctaggcagtgcaagagtgatgaagaatgtgccttacggaacggggtgcgggggtgctttagtactaagaccagttattgcctagcggcaggcggcggggtgtttcgaacctttgacggcgcctttctaagatttcccgctaattgcgcatttgtgctgagcacaatttgccagaaactccccgacattagttttcagcttattatcaattttgataagtggagcgccccaaatttaactattatttctcctgtgtacttctacatcaacgaagaacagattctcattaacgacaggaatactgtcaaagtgaatggcacccaagttaacgttccatttattacagggctcgcaaccaagatatactcttcagaagggttcttggtaatcgacacctctccagacattcaaatttactacaatgggtttaatgtcattaaaattagtattagcgaaagactgcagaataaagtttgcgggctgtgtggcaacttcaatggcgatctgacagacgattatgtaacattgaggggaaaaccggtcgtttcctccgtcgtccttgcgcagtcctggaaaaccaatggaatgcagaaacgccctcttgcccccagctgtaacgaacttcagttttcccagtacgcggctatgtgcgacaacgtgcacatccaaaagatgcagggcgatggatactgtctgaaactcactgacatgaagggctttttccagccctgttacggtttattggacccactgcctttttacgagagctgctatctggacggttgctactcacacaagaaattccagctgtgtggctctttggcagcttacggggaagcctgccggtcattcggtatactgagcaccgagtggatcgaaaaggagaactgtagcggagtggtggaagatccatgcgtgggcgctgactgtcccaaccgcacatgcgaactgggcaatggtcgagagttatgcggctgtatcgaacctcctccctacggtaataactctcacgacataatcgacgccgaggtgacttgcaaagccgctcagatggaggtgagtatctctaagtgcaagctgtttcaactgggcttcgagcgcgagggggtacgtatcaacgatcgacagtgtacagggatcgaaggggaggatttcatctcctttcagatcaataatacaaaaggcaattgcggcaacatagtgcagagcaatggaacccacatcatgtacaaaaatacactttggatagagtctgccaacaacaccggaaacattatcactagagatcgcacaataaacgtggagttcagttgcgcctatgaactcgacatcaagatctccctggattccgtagtgaagcccatgctgtccgtaattaacttgacggtccccacacaggaggggagttttatcaccaagatggcactctataagaacgcctcatataaacacccctacagacagggtgaagttgtccttacgactcgtgacgtgctgtacgtgggggtattcgtagtgggcgcggacgctactcacctcattctcaccctgaataagtgttatgccacgccaactcgcgactccaacgacaaactcaggtacttcattattgaaggtgggtgtcaaaatctcaaagataatactatcgggattgaggagaatgctgtgtctttaacgtgcagatttcatgtgaccgtattcaagtttatcggcgactacgacgaagttcacctgcactgcgccgtttccctgtgcgacagcgaaaagtacagctgtaagattacctgtccccataatagccggatagccaccgattatacaaaagagccaaaagaacaaatcatatctgtcggaccaatcaggaggaagcgtctggactggtgcgaggacaacggcgggtgcgagcaaatctgtacaagtagagtcgatgggccactgtgcagctgcgtgacaggcaccttgcaggaggacgggaagtcatgcagagcatccaattccagcatggagctccaggtttggaccctgcttctcatcatgatccagatcagcttgtggcactttgtctacaagtcggggaccacctcatag

SEQ ID NO: 137487 - DNA, 6468 bp, Artificial Sequence
  Description of Artificial Sequence: Synthetic coding sequence
atgaattatagttccttcctccgcatttgggtgagctttattttcgcactggtgcagcaccaagctcagccccgggagctcatgtatcctttctggcagaatgacactaaaacacctaaagtggacgacggctcaagcagtgagatcaaactcgctattccagtgttctttttcggggttccgtaccgcacagtgtacgtgaacaacaatggcgtcgttagctttaacgtgctggtgtcacagttcacaccagaaagcttccctttaactgatggtcgtgcctttgtggcaccattctgggccgacgtgcataatggaattcggggtgagatctattaccgcgagaccatggagcccgcaattcttaaacgcgcaacaaaggatattcggaaatacttcaaagatatggcgacattttcggcgacctgggtatttatcgttacgtgggaagaagtcacgttctacggaggttcatctaccacccctgttaataccttccaggccgttcttgtgtcggatgggtcctatacgtttaccctgttcaattactatgagatcaattggactacgggaaccgctagcggcggcgacccgcttaccggcctaggaggcgtcatggctcaggcgggcttcaacggcggaaaccttaccaactttttttccttacccggatcccggacaccagagattgttaatattcaggagaccaccaacgtcaacgtccctgggagatgggccttcaaagttgatggtaaggagattgatcccgcaaacggctgtacctcaagggggcagtttttacggcgtggagaggtgttctgggatgacctcaactgtaccgtgaagtgtaggtgcttggacttcaacaacgagatctactgccaggaggcctcttgtagcccatatgaagtgtgcgagcccaagggaaagttcttctactgttctgctgtagaaacgagcacatgcgtggtttttggggagcctcattaccacacctttgacggcttcttgttccattttcagggaagttgcgcttacttacttgcaaggcagtgtctacagactagcagccttccgttcttctcagttgaagctaaaaatgagcacagacgcggctcagcagtctcctgggtgaaggagttgagcgtcgaggttaacggctataagatcctaattcctaaaggctcttacgggcgcgtgaaggtcaacgacctcgtgacctctttgcccgtgacgctggacttaggcactgtgaagatctatcagtctgggatctccaccgccgtcgagactgacttcggattgctggtgaccttcgatggccaacattacgccagcatttctgtcccaggctcctacattaactcaacctgtggtctctgcgggaactacaacaaaaaccctttggacgactttttgcggcctgatggcagaccagccatgagtgtcctggatttgggcgaaagttggcgagtttaccacgccgactggaaatgcgactcagggtgcgtagacaactgcacccagtgcgacgcagcaacagaggccctgtatttcggatcagactattgcggctttcttaacaaaaccgacggcccattatgggagtgcggcaccgtagtcgatcccacagctttcgtccattcttgcgtgtatgatctgtgctccgtacgtgacaatgggactctgctgtgccaagctattcaggcttatgctcttgtgtgccaagccctgggtattcccattggcgactggcgtacccaaactggctgcgtgagcactgtgcaatgtccaagtttctctcactactcggtttgtacgtcctcctgcccagatacatgctcagacctgacagctagtcggaattgtgcaacaccatgcaccgagggttgcgagtgtaaccagggttttgtgctctccactagtcagtgcgtgcctttacacaagtgcgggtgcgatttcgatggccactattacacaatgggcgaatttttctgggccacagcgaactgcacagtccaatgcctgtgcgaggagggcggagatgtgtattgcttcaataaaacttgcggctcaggggaggtgtgcgcagtagaagatggctatcaaggatgtttcccaaagcgcgaaacagtttgtctgctgtcccagaaccaagtcctgcatacattcgatggcgcgtcttatgctttccctagtgaattttcttacaccttactgaagacctgccccgagcgtcccgaatatcttgaaatcgatataaataaaaaaaaacccgacgccggtccagcctggttaaggggactgcgaatcctggtagcagatcaagaggtcaagataggcggcattggggcaagcgaggtgaaactgaacgggcaggaggtcgagttgccctttttccatccttccggtaagctggaaatctatcgcaataagaattcaacaaccgtagagagcaagggtgtcgttaccgtgcagtactccgatatcggcctcctgtacatccggctgagcacaacttactttaattgtacaggagggctgtgcggcttttacaacgccaatgcttctgatgagttttgtttgccaaacggcaaatgcaccgataatctcgctgtgttcctggaaagctggaccactttcgaggaaatatgtaatggagaatgcggcgatcttctaaaagcgtgcaacaacgactctgagctgctcaaattttaccgatccaggtccaggtgcgggattattaacgatccaagtaactcctctttcctcgagtgccacggggtggtaaacgtcactgcctattatcggacatgcctctttaggctttgccagagtgggggcaacgagagcgaactgtgtgattccgtggcaaggtatgcctcggcctgcaagaatgcagatgtggaagtagggccttggagaacctatgatttctgtcccttggaatgtcctgagaactcccatttcgaggagtgtattacctgtaccgaaacatgtgagacactaacattagggccgatctgcgtggacagctgttcagaagggtgtcagtgcgacgagggctacgccttgctgggctcccaatgcgtcacccgttcagagtgcggctgcaattttgaaggtcaccaactcgccaccaacgagacgttctgggttgacctggattgtcaaatcttttgctattgttcagggaccgacaatagagtacattgcgagaccattccttgtaaggacgatgagtattgcatggaggaaggtgggctatactattgccaggccagaaccgatgccagctgtattgtctctggctacggtcactatcttacattcgacgggttcccgtttgatttccaaactagttgtccactgattctctgcaccaccggttcccgaccttcaagtgattcttttcctaagttcgtggtcacagccaaaaatgaggacagagaccctagccttgcgctgtgggtgaaacaagtagatgtaacagtgtttggctatagcatcgttattcacagggcctacaaacacactgtgttggtaaactccgaaagactgtacctacccctgaagcttggtcagggaaagatcaacattttttctttcgggttccatgttgttgtcgagacagattttgggctcaaggtggtgtatgattggaaaactttcctgagtatcaccgtgccaaggtctatgcagaactcgacatatgggctgtgcggtcgatacaatggtaatcccgacgatgatcttgaaatgccaatgggcctgctcgcttcaagcgtgaatgagtttggccagtcatgggttaagagagacactttttgccaggtgggatgcggcgaccgatgcccgagctgcgccaaggtcgaaggcttctctaaggtacagcagctgtgttccttgatcccgaaccagaatgcggccttcagtaaatgccactcaaaagtgaatccaactttcttctacaagaattgcttgtttgattcctgcatcgacggcggcgccgttcagaccgcgtgctcatggttgcagaactacgcctctacatgccagactcagggcattaccgtaacgggctggagaaactatacgtcctgcaccgttacctgtccgccgaacagccactacgagtcatgcgtgtctgtttgccagccccggtgtgccgctatccgtctgaagtccgattgtagtcactactgtgtggaagggtgtcactgcgacgcagggtacgtgttaaatggcaaatcttgcattttaccccattcttgtggctgctatagcgacggaaagtattatgaacctaagcagctcttctggaatagcgactgcaccagacgatgtcgttgcttccggcgcaacgtgatccagtgcgaccctcggcagtgcaaatcagacgaagaatgcgcactccgcaatggtgttcggggctgcttttcaaccaaaacaagctattgtctggctgccggcggcggagtttttcgcacatttgatggggccttcctcagattcccagcaaattgcgcattcgtgttgtcaactatctgtcaaaagcttcccgatattagcttccagctcatcatcaattttgacaagtggtcggcccccaatctaacaataatctctccagtgtatttttatatcaatgaagagcagattctcatcaatgaccgcaatacagtaaaggtgaatggcacacaggttaacgtccctttcataaccggactagccacaaagatatattcatcagagggcttcctggtcattgacacaagccctgacatccagatctattataatggctttaacgtcattaaaatttccatttccgaacgactccaaaataaggtgtgcggtttatgtgggaatttcaacggcgatttgaccgacgattacgtaacgttaaggggcaagcctgtcgtctcgtcggtcgtcctagctcagtcttggaagactaacgggatgcaaaagagaccactggccccatcctgcaatgagctacagtttagtcagtacgctgcaatgtgcgataatgtgcatattcagaaaatgcaaggtgatggctactgtctgaagcttaccgacatgaaaggcttcttccagccctgctatggcctattagatcccttgcctttctacgagagttgctatttagatggctgctacagccataagaagttccagctgtgtgggtcacttgcagcctatggtgaagcgtgtaggagcttcggcattctgagcacagagtggatcgagaaagagaattgctcaggcgtggtcgaggatccatgcgtaggagctgattgtcctaatagaacttgcgagttgggaaatggaagagagctgtgcgggtgtatcgagccacctccctatggcaataattcgcatgacatcatcgacgcagaagtgacctgtaaggccgcgcaaatggaggtgagcatctccaagtgcaaactgttccagctgggtttcgagagagagggtgtaaggattaacgatcgacagtgcacgggcatagagggagaagatttcatttcttttcaaatcaataatacaaaaggcaattgtggtaatatcgtgcagagcaatgggacacacatcatgtataaaaacacactgtggatcgagtctgcaaataatacagggaatattataaccagagacagaacaatcaatgtggaatttagttgtgcttatgagctggatattaagattagtttagacagcgtcgtcaagcctatgctgagtgtcatcaatctgaccgtacctacacaggaagggtcatttatcaccaaaatggctctgtacaaaaatgcctcctacaaacacccttacagacagggagaagtcgttctgaccacaagagacgtcctgtacgttggagtgttcgtggtaggagccgacgcgactcatctgattctgaccctcaataaatgctacgctacaccaacgcgagattccaacgacaagctgagatactttatcatagagggggggtgccagaatctgaaggataacactatcggcattgaggaaaacgcagtgtcgctgacttgtaggtttcatgtgacggtgttcaagtttattggggattacgacgaggttcacctacattgcgccgtctcgctttgtgactctgagaagtacagttgtaagattacatgtccgcataattctaggatcgccacggactataccaaggagccgaaggaacagataatcagtgtcggccctatacgcagaaagaggttggattggtgcgaagataacggaggatgtgaacagatttgcaccagtcgggttgatgggcccctgtgctcctgtgtgaccggcacattgcaggaggacgggaagtcctgtcgggcttccaattcgtccatggagttacaggtctggaccctgctcctgataatgatccagatctctctctggcattttgtgtacaaaagtggcaccacatcatag

SEQ ID NO: 137488 - DNA, 1257 bp, Artificial Sequence
  Description of Artificial Sequence: Synthetic coding sequence
atggcgaaactccttcagccccccccaaaatttcttccttcagagtggcacatcgcaaacaaaaatcaataccatcgcgccgatgcccagcgctctcgctccgaacggctcgtggccgaatcacagcggctggtggacgaaatcgaaaagaccactaggaagtcccagtctgatgtgaataagaagcttgaacagcggctcgaggaggtgcagttctggaaaaaagaactggacgataaactggaacaactggtgaatgtgactgatgatttgttaatatataaaataaggctagagaaagctctagaaacactaaaagaacccctgcatatcaccgaaacctgcttggcatatcgagagaaacggatcggcattgatcttgtgcacgacaccgtcgaacatgagctcattaaagaggccgagattattcagggtatcatggcattgcttacgcggaccctggaggaggcatccgagcagatccggatgaatcgcagtgctaagtataacctggaaaaggatcttaaagacaagttcgtggcccttaccattgatgatatatgtttcagcctcaacaacaattccccaaatattagatactctgaaaatgcggtccgtatagagcccaatagtgttagtttggaagactggttggacttttcttcaacaaatgtagagaaggccgacaaacagaggaataattcccttatgctcaaagcactggtggacaggatcctgtcacagacggcaaacgatctgaggaaacaatgtgacgtggtcgataccgcgtttaagaacggcttgaaggacacgaaggatgctcgcgataagttagctgaccacttggcaaaggtcatggaggagattgccagtcaagagaagaatataactgctctcgagaaggcaattctggaccaggaaggaccagctaaagtcgcccacaccaggttggaaacacgcacacatcgccctaatgttgaactctgtcgggatgtggctcagtacaggctgatgaaggaagtccaggagatcacacacaacgtcgcacgcctcaaagagaccctcgcgcaggctcaggcagaactgaaggggctccacagaagacaactagccttacaagaggaaattcaggtgaaagaaaatacaatttacattgacgaagtgctctgtatgcagatgagaaagtcaatccccctgagagacggggaggatcatggagtgtgggctggcggactgaggcccgacgccgtgtgttag

SEQ ID NO: 137489 - DNA, 819 bp, Artificial Sequence
  Description of Artificial Sequence: Synthetic coding sequence
atggccctgctcacacggactcttgaggaggcgagcgaacagatccgtatgaacagatctgccaaatacaatctggaaaaggacctgaaggacaaattcgtggccttgaccattgacgacatctgtttttcattgaataacaactctccaaatatccgctattccgagaacgctgtgcgaattgagcctaacagcgtgtcactcgaagactggctggattttagctccacaaatgtggaaaaggccgataaacagaggaacaatagtctgatgctgaaggccttagtggatcgaatactttcccaaaccgcaaatgatttaagaaagcagtgtgacgtcgttgatacggccttcaaaaatggcttgaaggataccaaagatgcacgcgacaagttagccgaccaccttgctaaagtaatggaggagatcgcgtcccaggagaagaatattactgccctggagaaggctatattggaccaagagggccccgctaaggtagcacacaccagactcgagacacgaactcatagaccgaacgtggaactgtgcagagatgttgcacagtaccgactcatgaaagaggtacaggagataacccacaacgtggcccgcttgaaagagaccctcgctcaggcacaagccgaattgaaaggattgcatagaaggcagttggccctgcaggaggagattcaagttaaggaaaacaccatttatatagatgaggtcctgtgcatgcagatgcggaaatctatacctcttcgggacggcgaggatcacggggtttgggcaggtgggttgagacctgacgctgtatgctag

SEQ ID NO: 137490 - DNA, 1473 bp, Artificial Sequence
  Description of Artificial Sequence: Synthetic coding sequence
atggaacgggtggggtgtacacttactactacatatgcacacccgaggcccacgccgacaaacttcctgcctgccattagcaccatggcttcgagttatcgggacaggtttccccactctaacttgacacattctctgtccctgccctggcggcctagcacctactataaagtcgcttctaacagcccctctgtcgccccctattgcactaggagccagcgagtgagcgaaaacacgatgctgccatttgtgtcaaacagaaccacatttttcacgcggtacacgcctgatgactggtatcgttccaacctgacaaattatcaggagtccaacacaagcaggcataatagtgaaaaactgagagttgatacctccaggctcatccaagacaaataccagcaaacaagaaagacgcaggcagacacgactcagaatcttggagagcgtgtgaatgatattggcttctggaagtccgaaattatccacgaactggacgagatgatcggtgaaacgaatgccctgactgacgtgaagaaacggctggaacgcgccctgatggaaacagaggcgcctctccaagttgctagagagtgtctgttccaccgggagaagagaatgggtattgacctagtgcatgacgaggtcgaagcgcagcttctgacagaagtggacacaatcctatgctgtcaggagagaatgaagttacatctggacaaggccatcgcccagctcgctgcaaaccgcgcatcgcaacatgaactggaaaaagacctgagcgacaagcagaccgcctacaggatcgatgacaagtgtcatcatctgaggaatacttccgacggggtgggctattttcgcggagtggagagggtggacgcaacagtaagtgtgcctgaaagctgggctaaatttactgatgacaatatcctccgctcacagagcgaaagggctgcctcagctaagttaagggacgacattgagaatctgttggtcgtgaccgccaacgaaatgtggaatcagtttaacaaggtgaatctgtcctttaccaataggatcgcagagaccgccgacgccaagaacaaaatccaaactcacctggctaagactctccaggagattttccagacagagatgaccattgagagcattaagaaggctattaaggataaaacagcctttctgaaggtggcccaaacccggttggacgagagaacacggcgcccgaatattgagctttgccgggacatggctcagctgagactcgtgaacgaggtccatgaagttgatgacacaatccaaacactgcaacagaggctgagggatgccgaggacacattacaaagtctggtccacattaaggccaccttagaatacgacctcgcagttaaagctaacagcctgtatatcgaccaagagaaatgcatgtctatgcggaagagttatcccaataccctgaggttagttggtttctgttag

SEQ ID NO: 137491 - DNA, 1473 bp, Artificial Sequence
  Description of Artificial Sequence: Synthetic coding sequence
atggaacgagtagggtgcaccctgactactacttacgcacatccacggccaacacccaccaattttctgccagctatatccaccatggcttccagttacagagataggttcccccattcaaaccttacccactccctgtcattaccatggcggccatctacctactataaggtggcttcaaactctcctagcgtcgctccatactgtactcgcagccagcgggtgtcagaaaacacaatgttaccttttgtctctaatcggactacgttcttcacacgctatactcctgatgattggtatagaagtaacttaacaaactaccaggaaagtaatacgagtaggcataatagtgagaaactaagagtggatacctcaagattaattcaggataagtatcaacagactcgaaaaacccaggccgatacaactcagaacctgggtgagagggtcaacgatattggtttttggaagagcgagatcatccatgagctcgatgaaatgataggggaaacaaacgctctaaccgatgtcaagaaacgcctcgagagagcccttatggagactgaggccccacttcaggttgccagggagtgcctctttcatcgggagaagagaatgggtatcgatctcgtccatgatgaagtagaggcccagctgctgactgaagtggacaccattctgtgctgtcaggaaaggatgaagttgcatctagacaaagccatcgcacagctggctgccaatcgcgcatcccagcatgagctagaaaaggacttgtcggataagcagacggcgtaccgaatagatgataaatgccaccatctccggaacacctccgatggggtgggttatttccgcggtgtagagagggtggatgctaccgtctcggtgcccgaaagttgggcgaaattcacggacgacaacattctccggagccaaagcgagagagccgcatctgccaagctgcgggatgatattgaaaatttgctcgtcgtaaccgctaatgaaatgtggaatcaatttaacaaagttaacctaagcttcaccaatcggatagccgaaaccgccgatgcaaaaaacaagatacaaacgcacctcgcaaagaccctgcaggagattttccagaccgagatgacgatagagtctataaagaaagctatcaaggacaaaacagcctttttaaaagtcgcgcaaacaagattagacgaaaggaccaggcggcccaatattgaattgtgtagggatatggctcagttaaggcttgtcaatgaggtgcacgaggtggacgacacgatccagaccctgcaacaaagacttcgcgatgctgaagacacattgcaatcgctggtacacattaaagctacacttgagtacgacctggccgtgaaggctaactcactgtacatagaccaagagaagtgcatgagcatgcgaaaaagctatcctaacactttacgcctcgttggtttctgctag

SEQ ID NO: 137492 - DNA, 444 bp, Artificial Sequence
  Description of Artificial Sequence: Synthetic coding sequence
atggaaagggttgggtgcacacttaccactacctacgcacatccacgacctacacccaccaatttcctgcccgctatctcaactatggcctcatcctaccgggacaggttcccacatagtaacctgacgcattctctgtctctgccctggagaccttctacttactataaggtcgcatcaaattctccaagtgtcgcaccctattgcactcgaagtcagagagtcagcgagaacactatgctgccttttgtatctaatcggactacattcttcacacggtacacacccgacgattggtaccgaagcaacctaactaattatcaagaaagtaatacatcccgccacaatagcgagaaactgagggttgacacgtcgcggctgattcaagacaagtatcagcagacacggaaaacccaggccgatacgacacagaacttaggctag

SEQ ID NO: 137493 - DNA, 423 bp, Artificial Sequence
  Description of Artificial Sequence: Synthetic coding sequence
atggagagagtcgggtgcactttaactaccacttacgcacatcctcgcccaacacccactaacttcctgccagccatttccactatggctagctcataccgtgatcgctttccgcattcaaacctgactcactcattgtcgcttccttggagaccgagcacctactataaggtggcctcaaacagtcctagtgtggctccctattgtactagatcccagcgcgtctccgagaacacaatgttgccctttgtgagcaatcgaactaccttcttcacgcgttacacacctgatgattggtaccggtccaatctcaccaactatcaggaatccaataccagccgccataacagcgaaaagctgagagtggacacttctcgccttattcaggacaagtatcagcagactcggaaaacccaggcatag

SEQ ID NO: 137494 - DNA, 249 bp, Artificial Sequence
  Description of Artificial Sequence: Synthetic coding sequence
atggaacgggtcggatgtacgttaactaccacatacgctcaccccaggcccacacctacaaatttcttgcccgcaatctccacaatggcatcttcatatagggacaggttcccacattccaacctaacgcactcactgtccctgccatggagaccctctacttactacaaagtggccagcaactcaccatccgtagcaccttactgtaccagatcacagcgggtcagtgagaacaccatgcttccttag

SEQ ID NO: 137495 - DNA, 2514 bp, Artificial Sequence
  Description of Artificial Sequence: Synthetic coding sequence
atggagcctgcaccctctgaagtaaggcttgccgtgagagaagccattcacgccctctcctcgtcggaagatgggggtcatattttctgtacacttgagagcctcaaacgttacctaggtgagatggagccacctgcgcttcctcgcgaaaaggaggagttcgcatccgctcacttctctcctgtgctaagatgcctcgcctcgcgcctgagtcccgcttggctagaactgcttccccatggccgcctggaagagctgtgggccagctttttcctagagggacctgcggatcaggcttttctggtgctcatggagaccatcgagggcgccgccgggccttcttttagactcatgaaaatggcccgcctgctggcgagatttctaagggaaggccgactggcagtgcttatggaagcgcaatgcagacagcagacccagcccggttttattctgctgcgggagacactgctgggaaaggtggtcgcgttacccgaccacctcggcaataggctgcagcaggaaaatctggcagaattcttcccacaaaactattttaggctactgggcgaggaagtagttagggtgctccaagccgtggtggatagtctccaagggggtctagacagctccgtcagttttgtttcccaggtcctaggcaaagcctgcgtgcatggaaggcagcaagaaatactgggcgtcctggtcccgaggctggctgcgctgacgcaggggtcttatctgcatcaaagagtttgctggcgccttgtagaacaggtgcctgaccgggctatggaggcggtactcacggggctcgtggaagccgcacttggcccagaagtgctgtcgcgtctgttgggcaacctggtggtgaaaaataagaaagcccagtttgttatgacacagaagctgctcttccttcagtcccgcttgactactcccatgctgcagagtttgctgggacatctggccatggactcccaacggagaccccttctgctgcaggttcttaaggaacttctcgagacgtggggctcatcgagtgctatcaggcacacccccttgccccagcagagacacgttagcaaggccgttctcatttgcctcgcacagcttggtgaacccgagctgcgggactctcgggacgagttattggcatccatgatggcgggggtcaagtgccgccttgacagcagcctgccgcctgtgcggcggttgggcatgatagttgccgaggttgtctcagcccggatccaccctgaaggcccccccttgaagttccagtatgaagaagacgagctgtccctggagcttctcgcactggcctcacctcagcccgccggggatggcgcttccgaagcgggtaccagcctcgtgcccgccaccgctgaaccccctgctgagacacccgccgaaattgtggatggcggcgtgccgcaggcacaattggctgggagtgactcagatcttgactctgacgatgaatttgtgccttacgatatgtctggcgaccgggagctgaaaagctccaaggcacctgcttacgttagagactgcgtggaggctctcacaacttctgaggacatagaaagatgggaggccgctctgcgagcgctggaaggtctggtttatcggagccccaccgccacccgcgaagtctccgttgagcttgctaaggtgctgctacatttagaggagaagacatgtgtggtcggttttgctggcctccgtcagagggccttggtggctgtaacggtgaccgaccccgcaccagtcgctgactatctcactagccagttctacgccttgaactattctctacgccagagaatggacattctggacgtgctgacccttgccgcacaagagcttagtcgtcccggctgtttgggccgcaccccccagcccggaagcccatcccccaatacgccttgcctacctgaagctgccgtgtcacagcccggcagcgccgtcgcatccgattggcgcgtggtggttgaggaaagaattaggagcaagacacagagactgtccaagggcggccctcgacagggaccggcaggatctccgagccgttttaactctgttgccggccactttttttttccactgttgcagagattcgatcggccactggttacgtttgatctactcggcgaggaccagcttgtactgggccgactggctcatacgctgggtgccttaatgtgcctggcggtaaatacaactgtagcggtcgctatggggaaggcacttcttgaattcgtatgggccttgagatttcatattgacgcatatgtaaggcagggcttactttccgccgtctcatcagttttgcttagtcttccagctgctcggctgctcgaagatctgatggatgagttgctagaggcaaggagttggcttgctgacgtcgccgaaaaggacccagacgaggattgtcgcacattggctcttagggccctcttgttattacagcggctcaaaaatcgactactgccaccagccagcccatag

SEQ ID NO: 137496 - DNA, 1083 bp, Artificial Sequence
  Description of Artificial Sequence: Synthetic coding sequence
atgatggcaggtgtgaagtgcaggctggacagcagcctgcccccagtcaggcgtttgggaatgatcgtggcagaagtggtctccgctcggatacaccctgagggcccacccttgaagtttcagtacgaagaggatgaactgagtctggagcttctggccctagcttcccctcagcctgccggggatggggcctcggaggccggtactagcttagtcccagctaccgccgaacctcccgctgagacccctgcggagattgttgatggcggtgtgcctcaagctcagctcgccggaagtgattccgaccttgatagtgatgacgagtttgtgccctacgacatgtccggagacagggaactaaaatcatccaaggctcctgcatatgtgcgcgattgcgtcgaggttttagatgtcctcaccttggctgcacaggagctgagccggccgggttgtctgggacgtacaccacaacccggttctccctctcccaataccccgtgcctgccagaagcggcagtgagccaacccggatcagcagttgcatctgactggcgggtggtcgtggaagagcgaattcggtcgaagacacagaggctttctaaaggcggaccccgtcagggccctgcaggcagtccttcccgattcaacagcgtcgccggccacttcttctttccactgctgcagagatttgaccgccccctcgtcacctttgacctgttaggtgaggaccagttggtgctaggccgactggcccatactctgggtgcgctcatgtgcctcgccgttaacaccacggttgcagtggctatgggtaaagcactgctggaatttgtgtgggcattgcggttccacattgatgcttatgtgaggcagggtctcctcagtgcagtgtcaagcgtgttgctgagcttgcccgctgctcggctgctcgaagaccttatggatgagctcttggaggccaggtcctggctcgctgacgtggccgagaaagaccctgacgaggactgcaggactctggccctgcgggcactgctcctgctgcaacgcctgaagaatcggctcctgcctccagcctctccatag

SEQ ID NO: 137497 - DNA, 3270 bp, Artificial Sequence
  Description of Artificial Sequence: Synthetic coding sequence
atggccgtgttcgatacacccgaagaggctttcggcgttctgcgcccagtctgtgtgcaactgacaaagacccaaactgtggagaacgtggaacatctccagacaagactgcaagccgtgtctgatagtgctttgcaggaactgcagcagtacattctgtttccacttcggttcaccctgaaaacacccgggcccaagagagagagactgatccaatcagtggtggagtgcctgacatttgtgctgtcgagcacatgtgtgaaagaacaggagcttttacaagaactcttttcggaacttagcgcctgtttgtacagcccttcgagccagaaacccgccgccgtttcagaggaacttaaactggcagtgatacagggcctctctacactgatgcattctgcatatggagatattatcctcacgttctacgagccgagcattcttcccaggctcggattcgctgttagcctactcttggggctggccgagcaagagaaaagcaaacagatcaagatcgccgccctcaagtgcctccaagtgctgctcctccagtgcgattgccaagaccaccccagatctctggacgaactggaacagaaacagctaggagacctgttcgcatccttcctgccaggcatctcgactgctctcaccagattgatcaccggagactttaagcagggtcacagtatagtggtgtcatctctgaaaattttctataaaaccgtcagcttcatcatggccgacgagcagctgaaaagaatttccaaggttcaggctaagcctgctgtcgaacaccgcgtcgccgaactgatggtctaccgcgaagccgactgggtaaagaagacgggcgataaactgaccattctaatcaaaaagattatcgaatgtgtatccgtccacccgcactggaaagtgcggctggagctggtggaactggtagaagatctccttctcaagtgtagccaatccctggttgaatgtgcgggcccactgctgaaggcgctagtcgggctggtgaacgacgaatcccctgaaattcaagcacagtgcaacaaggtgctccgccacttcgcggatcagaaagtcgtggtgggaaacaaagctctcgcggatatcctatctgaatcactccactcgcttgctacttctctgccccgattgatgaacagtcaggacgaccagggaaaattcagtacactctctctgctgttgggatatcttaagttactggggcccaaaatcaactttgtcctgaattcagtggcccacctgcagaggctcagcaaggcccttatccaggtcctagagctggacgtcgcggatattaaaatcgtagaagagcggaggtggaactcagacgatcttaacgcttctcctaagacaagcgccacgcagccttggaacaggatccagaggcggtactttagattcttcactgacgagaggatcttcatgctcctgcgacaagtgtgccagctgctaggctactatggaaatctgtatttgctggtggatcatttcatggaactctatcaccagagcgtggtgtacaggaaacaggcagctatgattttgaacgagcttgtgactggagccgcaggactcgaagtggaggacctgcacgaaaaacacattaagacaaacccagaagagttacgtgagattgttacgagtattctggaagagtatacgtcccaggaaaactggtatctggtgacgtgccttgagacagaagagatgggtgaagaactcatgatggagcaccctggacttcaggcaattacctccggggaacatacctgtcaagtgacctccttccttgcctttagcaagccaagtccaaccatttgcagtatgaactcaaacatatggcaaatatgcatccagctcgaaggaattggtcaatttgcttatgccctcgggaaagacttttgcctcttactgatgtcagctctttaccctgtactcgaaaaggctggagaccagacattactgatctcacaggtcgcaacctctactatgatggacgtttgtcgggcatgcgggtatgactcccttcagcacctgataaaccagaatagcgactatctggttaacgggattagccttaacctaagacacttagccctacatccacacacacctaaggtactggaggtcatgctcaggaactcggatgccaaccttttaccactggttgctgatgtcgtgcaagacgtgttggccacactcgatcaattttatgacaaaagagcggcctccttcgtttccgtgttgcacgccttaatggctgccctcgcccagtggtttccagacacaggtaacctgggccacctgcaggaacaatcccttggcgaagaaggctcacatttaaaccagcggcccgccgccctggagaagagtacaaccacagcggaggacatcgagcagtttctgctgaactatctgaaagaaaaggatgtggcagacggtaatgttagcgattttgacaatgaggaggaagaacagtcagtgccacccaaagtggacgaaaacgacacgcgacctgatgtcgaaccacctttgccactccagatccagatagctatggatgtaatggagagatgcatacacctgttgtctgataaaaaccttcaaatacgccttaaagttctcgatgtactggacctgtgtgtggtggtcctgcaatcgcacaagaatcagctcttacccctggcacaccaggcgtggccaagcctagtccacagattgacacgtgatgcccctttggccgtactacgggcatttaaagtcctccgaacactgggctcgaaatgtggggacttcctccgcagcaggttttgtaaggatgtgttacctaagttggctgggagtctcgtgacgcaggctccaatttctgcaagggcgggcccggtctactcacacacactcgcctttaagctccagctcgctgtgctccagggcctaggacctctttgtgaacgactggatttaggcgaaggcgatttgaataaagtggccgacgcttgcttgatttatttatctgttaagcagccggtcaaactccaggaggcagcccggagcgtttttctgcatctgatgaaggtagaccctgatagtacttggtttctgctgaacgagctgtattgtcccgtgcagttcaccccgccacacccatcactccaccccgtgcagctccatggtgcctccgggcagcagaacccgtataccaccaatgtgctccagcttttaaaagagctgcagtag

SEQ ID NO: 137498 - DNA, 3270 bp, Artificial Sequence
  Description of Artificial Sequence: Synthetic coding sequence
atggctgttttcgacacaccagaggaggctttcggcgtgctcaggcctgtgtgcgttcagctgaccaagacccagaccgtggagaatgtggaacacttgcaaacccggctccaggctgtgagcgacagcgctctgcaggagttgcagcagtatatcctctttccactcaggtttacattgaaaaccccaggccctaagagggaaagacttatacagtcagtagtagaatgtctgacttttgtcctcagtagcacttgtgtcaaggagcaggagttgctgcaggaactgttcagtgaactcagcgcctgtctgtattcgccgtcatcacaaaaacccgccgccgtgagcgaggaacttaaactggcagtgatacagggcctgtccacgctgatgcactccgcatatggtgacattattctcactttctacgagcccagtatactcccaagattgggcttcgctgtgtcacttctgctgggactggccgagcaagaaaaatctaagcagattaagattgccgcactcaagtgtctacaggtgttattactgcagtgcgactgtcaggatcacccacggagcctagatgagctggagcagaaacagctgggggaccttttcgcatcattccttccaggcattagcacagccctcaccaggttaatcaccggcgatttcaagcaagggcacagtatcgtggttagcagcttgaagatcttctacaaaactgtctcgttcataatggccgacgagcaactgaagagaatctccaaagtgcaggccaagcctgcagtagagcaccgcgtggccgagctaatggtctatcgcgaagcggattgggtgaagaaaactggagataagctcaccatactgattaagaaaattattgagtgtgtgagcgttcatccacattggaaagttcgattggaacttgttgaactggttgaagacctcctgcttaaatgtagtcaaagtctggtggagtgtgcaggtcccttactgaaggccttagttggactggtgaatgacgagagcccggagatccaagctcagtgtaacaaagtcctgcggcattttgccgaccagaaagttgttgtcgggaacaaggcattggcagatatcttgagcgaaagtctccattccttagctacctcgctgcctcggctgatgaattcacaagatgatcagggtaagttcagtactctcagtttattgttaggatacctgaagttattgggcccaaagatcaacttcgtcttgaattctgtagcccatctccagaggctgtctaaggcactgatacaggtactggaactggatgtagccgacatcaagatcgtggaggaacgtaggtggaattcagatgacctaaacgccagccctaaaaccagcgctacccaaccctggaataggattcagagaagatatttcaggtttttcaccgatgagagaatatttatgctgcttaggcaagtctgccagttgctaggctattatgggaacctgtatctactcgttgatcattttatggagctgtaccaccagagcgtcgtgtacagaaagcaggccgcgatgatcctgaatgaactcgtgacaggggcagcaggactggaggtggaagatctgcacgaaaaacatattaagaccaaccctgaagaactcagagagattgttactagcatcctggaggagtacacctcccaggagaactggtatctagtgacttgtctggaaaccgaggagatgggagaagaattgatgatggaacacccaggcctgcaggcaatcacatctggtgaacatacgtgtcaggtgacaagcttcttggcattttccaagccctctcctacaatctgctccatgaattcaaatatctggcaaatatgtatccagctggagggtatcggccagtttgcatacgccctgggaaaggacttctgcctgctgctgatgagcgctctctaccctgtgcttgaaaaggctggggaccagacactgttaatttcccaggtcgctacctctacaatgatggatgtgtgccgggcgtgtggctatgatagcctgcagcacctgataaaccaaaacagtgattacttagtgaacggcatcagcctgaatctccgccatcttgctctacatccccacacgcccaaggtgctagaggttatgctgcggaatagtgatgccaatctcctcccattggtcgccgacgtcgttcaggatgtactggccacactcgatcagttttacgataagagggcagcaagttttgtctccgttttgcatgccctgatggccgccctcgctcagtggttcccggacacagggaacctgggccatctgcaggagcagagcctgggtgaggaaggatctcacctgaatcagagacccgccgccctggagaaatcgactaccaccgcggaagatatagaacagttcttactgaactacctaaaggaaaaagacgtcgcggacggcaacgtaagtgacttcgacaacgaggaggaggagcaaagcgtaccgcctaaagtggacgaaaatgacacacgaccagatgttgaaccaccactccccctccagatccagattgcaatggatgtcatggaacggtgtatacacctgctgtccgacaagaaccttcaaatacgtctgaaagtgttagacgtcctcgatctatgtgtggtggtgctccagagtcataagaatcagctcctccctctggcccaccaggcttggccctcactcgtgcacagactaacacgggatgctcctctcgccgtgttgagggcattcaaagtgcttagaaccctcgggtctaaatgtggggatttcttgaggtccaggttttgtaaggacgtcctgccaaaactcgccggctcactggtgacgcaggccccaatttccgcgcgtgccggaccagtttatagccatacactggcctttaagctacagcttgccgtcttacaggggctggggccactgtgcgagagactagacttaggggagggggatctgaacaaagttgcggatgcttgcctaatctacttgtccgtcaagcagcctgtaaaactgcaagaggcagcgagaagtgtgtttctgcatttaatgaaggtcgatcctgacagcacatggtttctgctgaacgagctgtattgtcctgtgcagtttaccccaccccacccatcattgcaccccgtacagctccacggcgccagtggtcaacagaatccatataccacgaacgtgctgcagctgctgaaggagttacagtag

SEQ ID NO: 137499 - DNA, 3270 bp, Artificial Sequence
  Description of Artificial Sequence: Synthetic coding sequence
atggccgtgtttgacacgccagaggaagcttttggagtattaagacctgtgtgcgtgcagttaacgaagacccaaactgtggagaacgtggagcacctgcaaacaagactgcaggcagttagcgattccgcgctgcaggagctgcagcagtacatcctgtttcccctgagattcacactcaagacgcccggaccgaaaagggagaggctgattcaatccgtcgtggaatgcctcacattcgtactcagtagcacctgcgtcaaggagcaggaactgctccaggaactgttttccgaactgtctgcctgtttgtacagcccttcttcccagaaaccagctgcagttagtgaagagcttaagcttgctgtcatacagggtctgtcaaccctgatgcacagcgcctatggcgacatcattttgacattctacgaaccatctattctgccaaggctgggctttgccgtgagtctcctcttaggtctcgcagagcaagaaaagtctaagcagataaagattgccgcactgaagtgcttgcaggtccttttgctccagtgcgattgccaggaccaccctcggtctctcgacgagctcgagcagaaacagctgggtgacctgtttgcctcctttctccctggaatctccactgccttaacgcggctgatcacaggtgattttaagcaaggacacagtatcgtggtaagcagcctgaaaatcttctacaaaactgttagtttcataatggcagacgagcagcttaagcggattagtaaggtgcaagctaagcctgcagtggagcaccgagtcgctgagttaatggtataccgtgaggctgactgggtgaagaagacaggggataaactcacaatcttgatcaagaagataatcgaatgcgtgagcgtccatcctcattggaaagtccgccttgaactcgtggagttggtagaagatctcctcctgaaatgttctcagtcactggtcgagtgtgctggtcccctcctgaaagccctggtcggactcgtcaatgatgagagtcccgagattcaggctcaatgtaataaggtcctacgtcactttgctgaccagaaagtagtcgtgggaaacaaggcactcgccgacattttatctgagtctctgcattccttagccacctccttgcctcgactcatgaattctcaggacgaccaggggaagttttcaaccctatccctgctcctgggatacctcaaattacttgggcctaaaattaattttgtactcaatagtgtggcgcacttacagaggctctcaaaagccctgattcaggtacttgagctcgatgtggccgatattaagatagtggaggagagacgatggaactctgatgatcttaacgctagcccgaagacttcggctacacagccatggaatagaatccagcggcgctactttagattcttcacagacgagagaatctttatgctgcttagacaagtctgtcagctgcttggctactatgggaacctgtatctgctcgtggatcattttatggagctgtatcaccagtccgtggtatacagaaagcaggctgctatgattctcaacgagctagtgacgggagcggctggattggaggttgaagacctacatgaaaaacatatcaagacaaatccggaggagttgcgagagatcgttacctctattttagaagaatacacttcccaggaaaactggtatctagtgacttgtctggaaactgaggagatgggcgaagagctgatgatggaacatcccggattgcaggccataaccagtggcgagcatacatgccaggtgacaagttttctcgcattttccaagcccagccccaccatctgctccatgaactcaaatatctggcagatttgtatccagctagaaggtataggacagttcgcctacgcccttggcaaggacttctgtcttctgttaatgtctgccctatatccagtgctcgaaaaggccggcgaccagactttgcttatttcacaggtggccacaagcaccatgatggacgtctgccgcgcgtgcggatacgattcactacaacacctgataaatcagaattcagattatttggtaaatggtataagtttgaatctccgccacctagctttacacccccatacccccaaagttctggaggtcatgcttaggaattctgatgccaacctgctgcccctagttgctgacgtggttcaggatgtgttagctacccttgaccagttctatgataaaagagctgcaagttttgtgtcggtattacacgcactcatggcggcattagcacagtggttcccggataccggaaatttgggacacctacaggaacagtctctgggagaggagggttcacatttgaaccagcgcccagccgccctcgaaaagagtactaccacagccgaggacatcgagcagtttctgcttaattacttgaaggagaaggacgttgctgacggcaacgtgtccgattttgataacgaggaagaagagcagtcagtgccgcctaaggtggatgagaacgatactcggcccgacgtcgagccaccattgcctctgcagatccagattgctatggacgtgatggagcgatgcattcatctccttagcgacaaaaatctccagatcagactcaaagtcctcgacgtgctagacctctgtgttgtcgtgttacagagccacaagaatcagctgctccccctcgcccaccaagcctggcccagcctggtacatcggctcacgagggatgccccactggccgttctgagggctttcaaggtgctgcggacgttgggatccaagtgcggagacttcctccggagccgcttctgtaaggacgtgttgcctaaacttgcagggtcactggtcactcaggcaccgatttctgctcgcgctgggccggtgtacagccataccttggcgtttaagctacagctcgcggtgttgcaaggactcggtcctctgtgtgagcggctggacttaggtgagggggacctgaataaggtggctgacgcttgccttatttacctttccgtgaaacagcctgttaagctgcaggaggcggctaggagtgtgtttctgcacttgatgaaagtggatcccgattccacatggttcctgctgaatgagttgtattgtcccgtgcagtttacgcctccccacccttctctgcaccctgtccaacttcacggcgcatcaggacagcagaatccttacacaactaacgtgctgcagctactcaaggaacttcagtag

SEQ ID NO: 137500 - DNA, 1527 bp, Artificial Sequence
  Description of Artificial Sequence: Synthetic coding sequence
atggaactcgacagcgctctggaagccccatctcaggaggacagtaacctgagtgaggaactgagtcactccgcttttggccaggccttcagcaaaattctgcactgccttgcaaggcctgaggccagacgtggaaatgtgaaagatgccgtactcaaggacttaggggatctgatcgaggcgactgagttcgatcggttattcgaagggaccggtgcaaggctgcgcggaatgccagaaacactgggtcaggttgccaaagcccttgaaaagtacgccgcgccttctaaagaggaggagggaggtggtgacggtcactccgaggcggctgagaaagccgcgcaggttggactgctgttccttaagcttctgggcaaggtggagacagccaaaaattctctcgtgggccctgcttggcaaaccgggctgcaccaccttgccggcccggtctatatatttgcaatcacccattcactcgagcagccttggacgaccccacggagtcgtgaagtggcccgcgaagtgttaacatctctgttgcaggtcacagagtgcggaagtgtcgcaggatttctgcatggggagaacgaagacgagaagggccggctctctgtcatactcgggctcttgaagcctgacttatataaagagtcttggaagaataatcccgcaatcaaacacgtgttttcctggacgctgcaacaagttacacgaccatggctatcccagcaccttgagagggtgctgcctgcgtctttggtcatatctgatgattatcaaactgaaaacaaaatactcggggtgcactgtctacaccacattgttctgaacgtccccgctgccgacctgctgcagtataatcgggcacaggtgttataccatgccatctcaaatcatctctacactcctgaacaccatctcatacaagccgttctcctgtgtctcttggacctttttccaatactagaaaagaccctccattggaagggggacggcgcacgcccaacaacccactgcgatgaggtactgagactgatcctcacgcacatggagccagagcatcggctgctgcttcgcagaacatacgcccggaatctcccggccttcgtaaatagactgggcattctgaccgtgaggcacttaaaacgcctggagcgcgtgattatcggctatctcgaagtatatgatggcccggaagaggaagccaggctgaagatcctcgagactcttaagctcttaatgcagcatacctggccacgggtatcctgtaggctggtggttctcttaaaggctctactgaaactgatctgtgatgttgctcgcgaccccaacctgaccccggaatctgtcaaaagcgctctgctacaggaggccacagattgcctcattctgctggaccggtgtagtcaggggcgcgttaagggcctgctggctaaaatcccacagtcctgcgaggacagaaaggtggttaactacatccggaaggtacagcaggtctctgaaggcgctccctataacgggacctag

SEQ ID NO: 137501 - DNA, 1527 bp, Artificial Sequence
  Description of Artificial Sequence: Synthetic coding sequence
atggagctcgactctgctctggaagctccatcccaggaggatagtaacctctcggaggaactgtcacatagcgcttttgggcaagcttttagcaaaatcctccactgcctggccagacccgaggccaggcgcgggaacgtgaaggacgcagtgctgaaggatcttggcgatctcatcgaggcaactgagtttgatcggctctttgaggggacaggcgcaaggctgagggggatgcctgagacgctgggccaggtggccaaggcacttgaaaaatatgcagctcccagcaaggaggaagaaggaggaggcgacggccactctgaggcagccgaaaaagctgcccaggtgggactgcttttcctgaagctgctgggcaaggtggagacagcaaaaaatagcctcgtgggcccggcatggcagactgggctgcaccatctcgctggcccagtgtacatattcgctattacccattcccttgaacagccttggacaacgccacggagccgagaagtggcaagagaggtccttactagccttctgcaggttacagaatgtgggtccgtggctgggttcctacacggcgagaacgaagacgagaagggacggttatcggtaatcttgggactgttgaagccagacttgtataaggagtcttggaaaaataaccccgctatcaagcacgtgttctcatggacccttcagcaggtcactagaccctggctgtctcagcatctggagagagtgctaccagccagtctagtcatttccgatgactaccagactgagaataagattctcggcgtccattgcctgcaccacatcgtcctgaatgttccggccgccgacctgctgcagtataatcgggcccaggtgctataccacgcaattagcaatcacttatacactcctgagcatcatctgattcaggcagtcttgctttgccttctcgatctgtttccaatcctggaaaaaaccctgcactggaagggcgacggagcccgccccaccactcactgcgacgaggttctccggctgatcctgacccatatggaacccgagcaccgcctgctactccgtagaacgtatgctagaaacttgccggcattcgttaataggttaggaatcttgaccgtacgtcatctaaagagactcgaacgcgtgattatcgggtatttagaggtgtacgatggtcccgaggaagaagcacgactaaagatcctcgagactcttaagttactgatgcagcacacatggcccagagtgtcctgtcgcctggtggtattacttaaggccctcctcaaactgatttgtgatgtcgcacgcgatcctaatcttacccccgagtccgttaagtctgcactcctccaagaagccacagactgcctcatccttctggatcgttgtagtcagggccgggtgaaaggattattggcgaaaattcctcagtcctgcgaagatagaaaggttgtgaactacattcgaaaggtgcagcaagttagcgagggtgcaccctataacggcacctag

SEQ ID NO: 137502 - DNA, 1494 bp, Artificial Sequence
  Description of Artificial Sequence: Synthetic coding sequence
atggaactcgatagtgccctggaagcaccatctcaggaggattctaatctgtcagaggagctctcccactccgcttttggacaggcgttcagcaaaatcctccactgtctggcccggcctgaagcaagacgtggtaatgtcaaggacgctgtgttaaaagacctgggggacctcattgaggccacggaattcgacagactgtttgagggcactggagcccggctccgagggatgcccgagaccctgggacaggttgcgaaagctcttgagaagtatgctgcccctagcaaagaagaggaaggcgggggcgacggacactctgaagctgcagagaaggcagcccaggtgggcctactctttctgaaactgctggggaaagtcgagactgcgaagaactcactcgtcggtcccgcatggcagacgggcctgcaccaccttgccggacccgtctacatctttgccattacccactctctggagcagccctggacaacacctcggtcccgggaggtggcccgcgaagttctgacgtctttactgcaggtcaccgagtgtggttcagtggccgggtttcttcacggagaaaatgaggatgagaaaggccgtttaagtgtaatactggggttgctcaaacctgacctctataaggagagttggaagaacaatcccgccatcaagcacgtgtttagctggacgttgcagcaagtgacacgaccgtggctctctcagcacttggagagggtgcttcccgcatctctggtgatctccgacgattaccagacggaaaataagatccttggtgtgcattgtctccaccacatcgtgcttaacgtccccgctgcagacctgttacagtacaaccgcgcccaggtcttatatcacgcgatcagtaaccacctgtacactccagagcatcacttaatccaggccgtactgttgtgtctcctggacctctttccaatcctggaaaaaacactccattggaagggggacggcgcccgacccacaacccactgtgatgaggtgctcagactgattttgacacacatggaaccagaacaccggctgttgcttcggaggacctatgctagaaatctcccagcctttgtcaacagactcgaaagagtgatcattggttatttagaagtgtacgacgggcctgaagaagaggcacgcctgaaaattctagaaacactgaagctacttatgcaacacacctggccacgcgtgtcttgccgactcgttgtactgctcaaggctctgcttaagcttatctgcgatgttgctcgggatcccaacctgaccccggaaagtgtcaagagtgccctgttgcaggaggcaaccgattgcttgatcctgctggatagatgttctcagggccgagtgaaggggctcctcgcgaagataccgcagtcctgtgaggatcggaaggtggttaactacataaggaaggttcagcaggtgagtgaaggcgctccttacaatggcacttag

SEQ ID NO: 137503 - DNA, 306 bp, Artificial Sequence
  Description of Artificial Sequence: Synthetic coding sequence
atggaactggattctgccctggaggccccaagccaggaggacagcaacttgagcgaggagctctctcatagcgccttcggacaggccttttctaaaatcttgcattgtcttgcccgacctgaggcacgcagaggcaacgtgaaagatgcagtgcttaaagacttaggtgatctgatcgaggccaccgagtttgaccgcttattcgagggaacaggggcacggttgagaggaatgcctgagactctggggcaggtggcaaaagccttggaaaagtacgcggcaccctctaaggaggaggaggggtag

SEQ ID NO: 137504 - DNA, 2424 bp, Artificial Sequence
  Description of Artificial Sequence: Synthetic coding sequence
atgcctcgcgcgccaagatgccgcgcggtgaggagtctccttcgcagccactatagagaagtcctgccactggccacatttgtacggcgactcggcccacaaggatggagactcgtccagagaggcgatcccgcagcctttcgcgccctggtagctcagtgtttagtttgcgtaccctgggatgcccggcctcccccggcggcccccagctttagacaagtgtcatgcctaaaggagttggttgcacgcgtgcttcagcggctttgcgagcgaggagccaagaacgtcttggcttttggtttcgccttactggacggcgctcgcggtgggccgcccgaggctttcaccacgagcgttcggtcttacctgcccaatactgtgactgatgctctgagagggagcggcgcctgggggcttctgctgaggagagtgggcgatgatgtgctggttcacctgttagcaagatgtgcactatttgttctcgtcgccccatcatgtgcttatcaggtgtgtggtccacccctgtaccagctcggcgcagctactcaagcccgaccaccaccacacgcctccgggccgcggaggaggctgggctgtgaaagagcatggaaccattctgtcagagaggcaggggtgcctctaggcctgcctgcccccggcgctaggaggcgaggtggatctgcgtcccggagcctgcctcttccaaaacggccacgaagaggtgccgctccagagcccgagcgtacacctgtcggtcagggcagctgggcccacccaggtagaacccgcgggccttcagatcgcggtttctgtgtagtgagccctgcacgacccgccgaagaggcaacctctctggagggagctctgagcggcacccggcattcacatccctctgtgggtcgccagcaccacgcgggaccaccatctacgtctcggccccctcgcccatgggataccccttgtcctccagtttatgcggaaaccaaacactttctctactcttcaggagataaagaacaacttcgcccttcgtttcttctgagcagtctccgcccatcactcacaggcgctagaagactggtggaaacgatcttcctgggttccagaccgtggatgcctgggacccccaggcgtttacctcggttgcctcagcgttattggcaaatgagacccctgttcctcgagctgcttgggaaccacgcacagtgcccgtatggggttctgttaaagacgcactgccctctgcgggccgcagtcacccccgctgccggggtgtgtgcaagggaaaaacctcaaggtagtgtcgctgctcctgaggaagaggacaccgatcccaggcgcctggtgcaactgctccgtcagcatagctccccgtggcaggtttacgggtttgtgagggcttgtctgcggaggctggttccgcctggactttgggggtcaaggcacaatgagcgcagattcttaagaaatacaaagaaatttatttcattgggcaagcacgccaagctgtccctgcaggagttaacctggaagatgagcgtacgtgattgtgcctggctccgtcggtcccccggcgtgggatgtgtccccgccgctgaacaccgacttcgcgaagagattctagccaagtttctccactggctgatgagcgtatatgtggtcgaactgttgagatccttcttctacgtgacggagactacattccagaaaaaccgactgttcttctatagaaaatctgtctggtccaaactccagtctatcggaatccggcagcatctgaagcgggtgcaattgcgggagctctcggaggccgaggtgagacaacatcgggaagctcgacctgcattattgactagtcgcctgcgattcataccgaaacccgacggactgcggcccatcgtcaatatggattatgtggtgggtgcccggaccttccggcgagaaaagcgcgcagaaaggctcacctcacgcgtgaaggctctattctcagtcctgaactacgaaagggctaggagacccggactcctgggcgcaagcgtgttgggcctcgatgacatccaccgcgcctggaggacatttgtcctgcgagtacgagcccaggatccaccgccggaactgtacttcgttaaagtggatgtcactggtgcttatgacaccattccccaggacaggttgacagaggtcattgcatccatcatcaaaccacaaaatacatattgtgttcggaggtatgcagttgtgcaaaaggcagcgcacggacatgtgagaaaagcctttaagtcgcatgtgctgagaccagtgcctggggatcctgccggattacatccgctgcatgctgctcttcagcctgttctgagacgccacggggagcaggctgtgtgtggggactccgccgggagagccgcacctgcatttggtggatag

SEQ ID NO: 137505 - DNA, 3399 bp, Artificial Sequence
  Description of Artificial Sequence: Synthetic coding sequence
atgcctcgcgcgcccaggtgtcgggcggtccgatccctcctgagatctcactatcgggaagtgctccctctagctacctttgtccgcagactgggtccgcagggatggcgccttgtacagaggggagatcctgctgcttttcgtgcacttgtcgcccagtgccttgtctgtgttccctgggatgcccgcccccctcctgccgccccatcctttcgacaggtttcttgtctgaaagaattggtcgccagggtcttacaacgcttgtgcgaaagaggcgccaaaaatgtcttagcttttggatttgctctgttggacggggcaaggggcggtccccccgaggctttcaccaccagcgtgaggtcataccttcccaacaccgtcaccgatgccctgcgggggtcgggcgcctggggcctgcttctgagacgggtgggtgacgacgtcctggtgcaccttctggcacgatgtgcactcttcgttttggtggctccatcctgtgcctaccaagtctgcggaccacccctgtaccagctgggcgctgctacacaagcccgcccaccccctcatgcatccggaccacgacgacggctaggatgtgagagagcctggaatcattccgtcagagaggctggcgttccactagggttacccgccccaggtgctagaagacgaggcggcagcgcctctcgctctctccctttgccaaagcgccctcgcaggggagctgccccagaaccggaaaggacccccgtcggccagggctcttgggcccatcccgggagaacacgagggcctagtgataggggcttctgtgtggtttcaccagcacggcccgctgaagaagccacatcacttgagggggctcttagcggcacccggcactcccatccttccgttggcaggcagcaccatgcagggcctccttctacctctcgcccccccagaccttgggatacaccttgcccccctgtgtatgctgaaacgaagcactttctttattcctcaggggacaaagagcagctgaggccgtcattcctattgagctctctcagaccttcattgacaggagctcgacgtctggttgaaactatcttccttgggagtaggccttggatgccaggaacgccacgccgcttgccgcggctccctcagaggtattggcagatgcgacctctgtttctggagctgcttggcaaccacgcgcaatgtccttatggtgttctactgaaaacccattgtcctctgcgggccgccgtgacacctgcggccggagtgtgcgcacgcgaaaagccccaaggaagcgttgcagctccggaagaggaagataccgatccacgaagattagtgcaattgctgagacagcactcctctccatggcaagtgtacggctttgtccgggcctgtctacgcagacttgtgccaccaggcctttggggctcccgccataacgaacggcgctttttaagaaataccaagaagttcatatctctgggcaagcacgccaagctctccctgcaggaacttacctggaagatgtcggttagggattgtgcctggcttagacgatcccctggtgttgggtgcgtccccgctgctgaacaccggctgcgagaagagattctggccaaattcctccattggctaatgagcgtctacgtggtggaacttctgcggtcttttttttacgtcaccgaaaccaccttccagaaaaacagactcttcttttacagaaaaagcgtatggtctaagctgcagtctatcggcattcggcagcatttaaagcgcgtgcagttgcgagaactgtctgaggcggaagtgcgacagcatcgagaggctcggcccgcactcctcaccagtaggttgcgattcatcccgaagcccgacggtctgcggccaatagtgaacatggactacgtggtgggggccaggacttttagaagggagaagagggctgaacgacttacctcgagagtgaaagccttattctcagtgctgaactacgagagagctagaaggcctggcctgttgggcgcctccgtactgggacttgatgatatccatcgggcttggcgaacttttgtgcttagagtcagagcccaggatcctccgccagagctgtacttcgtcaaggtcgacgtcaccggcgcctacgacacaatcccccaggaccgccttacagaggtgattgcctctatcataaagccgcagaatacttactgtgttcggagatatgccgtcgtgcagaaagccgcccacggacatgtgcgcaaagccttcaagtcccacgtgtccacacttacagatctgcaaccctacatgaggcagttcgtggcacatctccaggagactagcccattacgcgatgccgtcgtaatagaacagagctcgagtctgaatgaggcctccagcggactgtttgatgtgttcctgcgcttcatgtgccatcatgctgtgcggatccggggtaaatcatatgttcagtgccaaggaatccctcagggctcaatcctgtctactctgttgtgctccctgtgttatggcgacatggagaataagctctttgctggtattcgtagagacggtcttctgttaagactcgtggacgattttctgctggttacccctcatctcacgcatgctaagactttccttagaaccttggtccgcggggtgcccgagtacggatgcgtggtgaacctgcgaaagacagtggtaaatttccctgtcgaggacgaggctctagggggcacagcgtttgtgcagatgcccgctcatgggctattcccctggtgcgggttactccttgataccaggaccttagaagttcagtccgattacagctcatatgctaggacttccattagggcgtctctgacttttaatcgtggcttcaaagcaggaaggaacatgcgcaggaagctgttcggtgttttgcgactgaaatgtcactctttatttctcgacctgcaagttaatagcctccagaccgtgtgtaccaatatctataaaatcctgctactgcaggcttatagatttcatgcctgcgtgctgcaactgccttttcaccaacaagtctggaaaaatccaaccttcttcctccgcgtcatatctgataccgcgtccctgtgttattcaatcttgaaggctaaaaatgccgggatgagcctcggggccaagggggccgcaggtcccctcccgtcagaggctgtgcagtggttgtgtcaccaagcgtttcttctgaaattgacccggcacagagtcacctatgtccccctgttgggttcactgcgcaccgcccagacacagttatctcggaagctgcctgggaccaccctaaccgcgctggaagcagccgctaaccccgctttgccgtccgacttcaaaactatactggattag

SEQ ID NO: 137506 - DNA, 3210 bp, Artificial Sequence
  Description of Artificial Sequence: Synthetic coding sequence
atgcctcgggccccacgatgtcgggccgtgcgtagcctgctgcgctcacactatcgtgaggtgttgccactggctaccttcgtacggagactggggcctcaggggtggaggctggtgcagcgcggagacccagcagctttccgggctcttgtagcacagtgtctcgtgtgtgtcccctgggatgccagacctccgcctgccgctccctccttccgacaggtgagctgcctcaaagagctcgttgcgagggttctgcaacggctctgcgagcgaggagcgaagaatgtattggcattcgggttcgctctcttggatggagctagggggggtcccccagaagcctttacaacgagcgtcagatcctatttacctaataccgtgaccgatgccctgaggggatcaggggcctggggtctcttactgcggcgggtcggggacgacgtcctggtccacctgctggcccggtgcgctttgtttgtcttggtcgctcctagctgtgcttatcaggtctgcggccccccactatatcagctgggtgcagcaacccaagcaaggcctcccccacatgccagcggcccacgtagaagactgggttgcgagcgggcttggaatcatagtgtgcgggaagcaggggtgccactggggcttcccgcccccggcgctaggaggcgcggcggctccgccagtcggtctttgcccctgccaaaaagaccacggaggggtgcagctccagaacccgagcggacacccgttggtcagggatcttgggcccatccgggccgcacacgcgggccttccgatcgcggcttttgtgtggtgtcaccagcgcggccagccgaggaggcgacttccctggaaggtgcactttcaggaacccggcactcccacccctcggtgggtagacagcaccacgctggacctccgtctacttcaagaccacccaggccatgggacacaccatgccctccggtctatgcagagaccaaacatttcctgtatagttcgggggacaaggagcagctgagaccttcgttcctgctgagttcattacggccctctcttactggcgccaggcggctcgtagaaactatatttctaggtagcagaccctggatgcctgggactcctaggcgcctgccaagactgcctcaaaggtactggcagatgcggccactttttttagaactgctggggaaccatgcacagtgcccttatggggtgctgcttaagactcactgtcccttaagggccgctgtgacacccgctgccggagtgtgtgctagggagaagccacagggatcggttgctgccccagaggaagaagacactgatccccgccgattagtccagctgctccggcaacattcttctccgtggcaggtgtacggctttgtcagagcgtgcctgagacgcttggtgccgccggggctttggggctcccgacataacgaacggcgatttctgcggaacactaagaagttcatttctctcggtaaacatgccaaacttagtctccaggaactcacttggaaaatgtccgtaagagactgcgcctggctccgacggagccccggggtgggctgcgtgcctgcagcagagcatcgcctgagggaggaaattctggcgaagttccttcactggttgatgtccgtgtatgttgtcgaactgctgagatcattcttctatgtgaccgagaccacctttcaaaaaaatcgcttattcttttacaggaaaagcgtttggtcaaaacttcagtcaattggcattcggcaacatctaaagcgcgtgcagttaagggaactttccgaggctgaagttcgacaacatcgggaggcacggcctgccctgctaactagccgcctgagatttatccctaaacctgatgggctccgccccattgttaatatggattacgtggtcggagcacgtaccttccgccgggagaagagggctgagcgtttaaccagtcgggtcaaggcacttttctccgtgcttaattacgagcgggctagaagaccagggcttcttggtgccagcgttctggggctggacgacatccatcgtgcctggaggacattcgtcctgcgcgtaagggcccaggaccccccacctgagctctatttcgtgaaagtagatgtcaccggggcttatgacactatcccccaggaccggcttaccgaagtgattgccagcatcattaagccacaaaacacatattgcgtccgccggtacgcagtcgtccagaaagctgcccacgggcatgttagaaaggcatttaagtctcacgtatccacgctcacagatctgcagccttacatgcggcaatttgttgcgcatcttcaggagacatcccctctgagggatgcagtcgtgattgaacagtcaagttccctcaacgaggcctcatccggactctttgatgtcttccttcgcttcatgtgccatcacgccgtgcgcatcaggggaaagtcttatgtccaatgccaggggatcccccagggatctatcctgagcactctactatgctcattgtgctacggagatatggaaaataagctgtttgcaggcattaggagagatggactgctactgcgcctcgtcgatgattttctgcttgtgaccccccacttaacccacgctaagactttcctcagttacgccaggacttcaattagggcgagcctgactttcaataggggttttaaggccggccgtaacatgcgacgtaagctgtttggcgtgctgaggttgaagtgccactctttatttttagatttgcaggtgaactctctgcaaaccgtctgcaccaacatttataagattctgctgctccaggcttacagatttcatgcatgcgtgctccagctgccttttcaccagcaggtttggaagaatccaaccttctttctccgggtgatctccgatacagcatctctttgttactccatccttaaagctaagaatgctggtatgtccctaggggccaagggagccgccggacccttgccctccgaagcagtgcaatggctgtgtcatcaggccttcctgctgaaactcacccgacatcgcgttacttatgtgccccttttggggtctctgagaactgcacagacccagctaagcaggaaattaccaggaactactctcaccgccctcgaggctgccgccaatcccgccctcccttccgacttcaagacaatccttgattag

SEQ ID NO: 137507 - DNA, 2424 bp, Artificial Sequence
  Description of Artificial Sequence: Synthetic coding sequence
atgccgcgggccccccgatgccgcgccgtccgttctctgctcaggagccattaccgggaagtccttcctctggccactttcgtcaggaggctggggcctcaaggctggcggctagtgcagcgcggcgatcctgccgctttcagggccttggtggcgcaatgtctcgtgtgcgtcccttgggatgcacgccccccccccgctgccccttccttcagacaggtgtcctgtctgaaagaactggtggccagggtcctacagagactgtgcgagcgcggagccaagaacgtactcgccttcggttttgccctcctagacggtgcccgcggcgggccacccgaagccttcacaacctccgtgcgctcttacctccccaacactgtgactgatgcgctgcggggctccggagcctggggcctgttgctgcgccgggtcggcgatgacgttctcgttcaccttcttgctaggtgcgccctgttcgtgctggtggcgccgtcgtgcgcataccaggtatgcgggccgccgctgtatcagctgggggccgccacccaggcaaggccacctccgcatgcctcaggcccacgccggaggctgggttgcgaacgtgcatggaatcattccgttagggaggctggggtcccattgggactacccgctccaggagcaaggaggcggggaggctcagcttcacggtccctcccgttgcctaagcgccccagacggggcgctgcacctgagcctgagaggacacctgtcggccagggaagctgggcccaccctggcaggactcggggcccttcagatcgtggattttgtgtggtttcccccgctagacctgccgaagaagctactagcctagagggcgctttgtctggaacccgccacagtcatccctctgtcggacgacagcaccacgcaggacccccaagcaccagccgccctccgcggccatgggatactccgtgtcctcctgtttatgccgaaaccaaacattttctctactcttcaggtgataaagagcaactgaggccatcatttctcctgagcagcctgagaccgagtttgactggggcacggcggctcgtggagactatctttctgggttcaagaccatggatgcccgggacacctcgcaggctgccacgactcccccagagatattggcaaatgcggccgctatttctggaactcctggggaaccatgcgcagtgtccatacggtgttctgctcaaaacccactgccctttacgggcagcagtaacccctgctgccggtgtatgcgccagggaaaaaccgcagggctctgttgccgccccagaggaggaggatactgacccccggcgcctcgtccagctgctgagacagcatagctccccctggcaggtttatggttttgtcagagcttgtttgcggaggctcgttccgcctggactctgggggtctcggcataacgaaagaaggttcttgcgaaacaccaagaaatttatctcactgggcaaacatgctaaactatccctgcaggagctgacatggaaaatgtcggttagagattgcgcctggttgagaaggtcccctggcgtaggctgcgtccctgcggcggagcatagactgagagaagagatcttggcgaaatttctccactggttgatgtccgtttatgtggtcgagcttctgcgctcgttcttttatgtgacagaaacaacctttcaaaagaatcgactctttttttaccggaagtcagtgtggagtaagttgcaatctatcggaatcaggcagcacctgaagcgagtccagctgcgcgagcttagcgaagccgaagtacggcagcaccgcgaggcgcggcctgcactcctgacttcaaggctgaggtttatccccaagcccgacgggctccggcccattgtgaatatggactacgtggttggagcccgcacgtttaggcgggagaagagagccgaaaggctgacatccagagtgaaggcactattctctgtactgaactacgagagggctaggcgtccagggcttctgggtgcatccgtgctagggctggacgacatacaccgtgcctggcgcaccttcgtgctgcgtgtcagagcgcaggaccctcccccggagctgtatttcgtgaaagttgacgttaccggcgcttacgacacaatcccccaggacagattgactgaggttatcgcatcgataatcaagcctcagaacacatattgtgtgcggcgctatgccgttgtgcagaaggccgctcatggccatgtccgaaaagctttcaaaagtcatgtgctgcgccccgtacccggtgacccagccggattacatccactgcacgccgctctgcagcctgttcttcgtcggcacggagagcaggcagtgtgcggagactctgctggacgcgcagcccctgccttcggcggctag

SEQ ID NO: 137508 - DNA, 372 bp, Artificial Sequence
  Description of Artificial Sequence: Synthetic coding sequence
atgatgttaccaaagccgggaacatattatcttccatgggaagtttccgcaggtcaggtacccgacgggagtactctgcggacatttggccgcctgtgcctgtacgacatgatccagtcacgagtgactctaatggcacagcatggcagtgatcaacatcaagtgttggtgtgtaccaagctagtggagccgtttcacgcccaggtggggtccctatacattgtcctgggagagctgcagcatcaacaggatcgcggcagcgttgttaaggcacgtgtgctcacatgcgtggaggggatgaatctgcctctgctggaacaggccatacgcgagcaaaggctgtataagcaggaacgaggtgggagtcagtag

SEQ ID NO: 137509 - DNA, 369 bp, Artificial Sequence
  Description of Artificial Sequence: Synthetic coding sequence
atgctgcccaagccaggcacatattatctgccttgggaggttagcgcgggacaggtacctgacgggtccacgcttcgcacctttggccgtctatgtctctacgacatgattcagtcccgagtcactctgatggcccagcacggcagtgaccagcatcaggtgctagtttgtactaagttagttgagccatttcacgcccaggtgggctccctctatatcgtcctcggtgagcttcagcatcagcaggatcgtggcagtgtggtgaaagctagagtcctgacctgtgtcgagggcatgaacctccccctcctcgagcaggccattagggaacagcgactgtataagcaagaacggggcggttctcagtag

SEQ ID NO: 137510 - DNA, 5514 bp, Artificial Sequence
  Description of Artificial Sequence: Synthetic coding sequence
atgggtgctatgacccagctgctcgctggcgtgtttttggcatttctggccttggccactgaggggggcgtcttaaaaaaggtgattcggcacaaaagacaaagcggggtgaatgctacactgcccgaggaaaaccagcctgtggtttttaaccacgtctataacataaagctgcctgtgggttctcaatgctccgttgacttggagtccgcttctggcgaaaaagatctagctccacctagtgaaccgtccgagtccttccaggagcatacagtggatggagaaaaccagatagtgtttacacatcgcatcaacatacctagaagagcttgcggatgcgctgctgcaccggacgtgaaggagctgttaagccggctagaggagctagagaatctggtgagctctctgcgggagcagtgcactgcaggggcgggatgctgtctgcaacccgccacagggcgtctggacacccgccccttttgctccgggcgtgggaatttctcaactgaagggtgtggatgtgtgtgcgaacctgggtggaaagggccaaattgctcggaacctgagtgcccgggaaattgccacttgcgcgggaggtgcatagacggacagtgtatttgcgacgacggatttaccggcgaggactgcagtcagctcgcatgtccaagcgactgcaacgatcagggaaagtgcgtgaacggagtgtgtatctgttttgaaggatacgcgggggctgattgttcacgagagatctgtcccgtgccgtgctcagaggaacacggcacttgtgtggatggactgtgcgtgtgtcatgatggctttgccggagacgattgcaacaagcctttatgtctgaacaactgctacaatcgcgggaggtgcgtcgagaatgaatgcgtttgcgacgaaggcttcacaggagaagactgctccgagctcatttgtccgaacgactgtttcgaccgaggccggtgcattaatgggacttgctactgtgaagagggatttaccggagaggactgcggtaagcctacatgcccccatgcttgtcacacacagggccgatgtgaagaaggacaatgtgtttgtgacgagggcttcgcaggtgtggactgtagcgagaaaagatgtcctgcagattgtcacaatcgtgggcgatgtgtcgacggaagatgcgagtgcgacgatggttttaccggtgctgactgcggggagctcaagtgccctaacggctgcagcggccatgggaggtgcgttaacggccagtgtgtgtgcgatgagggctatactggtgaagattgttctcagctgagatgtccaaacgactgccattcgaggggccgatgtgtcgaggggaagtgtgtgtgtgagcaggggtttaaaggctacgattgtagtgatatgagctgcccgaacgattgccaccagcacggaaggtgtgtgaacggcatgtgtgtatgcgacgacggatatactggagaagactgccgtgatcgacagtgtccccgcgattgttcaaaccgtggtctttgcgtagacggtcagtgtgtgtgtgaggatggctttaccggacctgactgcgctgagttgtcttgccctaatgactgtcacggacaggggcgttgtgttaacgggcagtgtgtgtgccacgaggggtttatgggtaaagactgcaaggaacaaagatgcccgtccgattgccacggtcagggccgctgcgttgacggtcagtgtatctgccacgaaggatttacgggcctggactgtgggcaacattcatgtcccagcgattgtaacaacctcggtcagtgtgtgtcaggtcgatgcatctgtaatgaggggtacagtggcgaagattgcagtgaggtatcccctccaaaggatcttgtagtaaccgaggttacagaggagacggtgaatctcgcttgggacaacgagatgcgcgttacggaatacctggtcgtgtacacgccaacgcatgagggggggttggagatgcagtttcgagtgcccggtgatcagacctcgaccattatacaggaacttgaacccggtgtggaatattttattcgggtctttgccatcctggaaaacaaaaaatctatcccagtcagcgctcgcgtcgccacgtacctccctgccccagagggactgaaatttaaatctatcaaggaaacctctgttgaggtggagtgggatcccctcgatatcgccttcgaaacatgggagataatattccgtaacatgaacaaagaggatgaaggggaaatcactaagagtcttagacgacccgaaacatcctatcggcaaaccggcttggcacctggccaggaatacgaaatttctctgcatatcgtgaaaaataacacccgaggcccgggactaaagagggtaacaacaacaagattagatgctccatcacaaatcgaggttaaagatgtcacagacactacagcgctgatcacatggttcaagcctttggcagagatagatggaatagaactaacttacggtattaaagacgtccctggggaccggactactatcgatcttaccgaggatgaaaatcagtactcaatagggaaccttaagccagatacagaatatgaggtatcactgattagtcggcggggtgatatgagttctaacccggcaaaggagaccttcaccacgggcctggatgccccacgcaacctgagacgggtctctcagactgataacagtatcacactggaatggaggaatggaaaagctgccatcgattcataccgcattaagtacgctcccatctcaggcggagaccacgctgaagttgatgtacccaaaagccaacaggcaaccaccaagaccaccctcactggtctaagacctgggaccgaatatggcataggggtgagcgcagtgaaagaggataaagagtctaacccagcaaccatcaacgctgctacagaactcgacacccccaaagacttgcaggtgagtgaaacagcagaaacatcactgaccctactctggaaaaccccactcgcaaagtttgacagatatcgccttaactattcgctccccacaggacaatgggtaggcgtccaactgccgcgtaatacgacatcctacgtgctcagaggactggaacctggacaagaatacaacgttttactcacagccgagaaggggaggcacaaaagtaagccggccagggttaaggcctccacggcgaaggagccggagattgggaatctcaatgtatccgacattactccagaatctttcaatctgagctggatggcgactgacggtatttttgagacattcaccatcgagatcattgactccaatcggctgctggaaaccgtggaatacaatatatcgggcgccgagcgcacggctcacatttccgggctgccaccaagtacagactttatcgtctatctttccggtctagccccaagcattagaaccaaaactattagtgctaccgctacaaccgaggccctgcccctgcttgaaaacctcactatcagcgatataaatccttacggctttacagtgtcatggatggcctctgagaacgcttttgactcctttctggtgacggtagtggactcaggcaagctcctggacccacaagaattcactttatccggaacacagagaaagctcgaactccgcggcctgatcacagggatcggctatgaggtcatggtgagcggtttcacccagggacaccaaacaaaacctctacgagccgagatagtgaccgaggcagagcctgaggtcgataacctgctcgttagcgacgcaactcccgacggctttcggctgtcctggacggctgatgaaggagtctttgataattttgtcctcaaaattagagataccaagaagcaaagcgagcctctggaaatcacacttctggcaccagagcgcacccgtgatatcacaggtctccgggaggccacagaatatgagatcgagttatatgggattagtaaaggcaggagaagccagacagtgagcgcaattgcaactacggccatgggctcacccaaagaagtcatcttttcagacatcaccgagaactccgctactgtgagctggagggccccaaccgctcaggtcgaatctttcaggattacatatgtgccgataactggaggtaccccctctatggtgactgtggacgggacgaagactcagacacgacttgtgaaactgatcccgggggtggaataccttgtttccattattgctatgaagggctttgaggaaagcgagcccgtgtccggttccttcactaccgctctcgacgggccttcaggcttggtgacggccaacataaccgacagcgaagccttggctcgctggcagccggctatcgccacagtcgattcatatgtgatttcatatacgggcgaaaaggtgcccgaaatcacaaggacggtgtccgggaacacggtagagtacgccctcactgacttggagcccgcaactgaatatacgttgcggatcttcgctgagaaggggccccaaaagagttccacaattacggctaagttcactaccgatcttgactccccgagagacctgactgcaacagaggttcagtctgagaccgcactcctgacttggagaccgcctcgcgctagtgtgaccggatatttgcttgtctacgagtctgttgatggcacagtaaaagaggtgattgtcggccccgatactacgtcttacagcctcgcagatttgtctcccagtacccattacacggctaagatccaggcactcaacggccctctccggtctaacatgatccaaaccatcttcactaccattggtttactgtatcccttccccaaagactgtagccaggcgatgttgaatggagacaccaccagtggcctgtacactatctacttgaatggcgacaaagccgaggccctggaggtgttctgtgatatgacatccgatggtggcggatggattgtcttcctgaggagaaaaaacggacgggagaacttttaccagaattggaaggcatatgcggcaggcttcggcgatcgccgtgaggagttttggcttggactggataatctcaataagatcaccgcgcagggccaatatgagttaagggtggacttgcgagatcatggcgaaacagcctttgcagtttacgataagtttagtgtaggagatgctaagacaaggtacaaactgaaggtggaaggctattcaggcaccgccggcgacagcatggcttaccacaatggccgtagtttctcaacttttgacaaagacactgatagtgccatcactaactgcgcactgagttataagggagccttttggtacaggaattgtcatagagtaaacctgatgggcaggtatggagacaacaatcattctcaaggcgtcaactggttccactggaagggacatgagcatagtatacagttcgctgagatgaaactacgcccctccaatttcaggaacctagaaggcaggagaaaacgggcctag

SEQ ID NO: 137511 - DNA, 4695 bp, Artificial Sequence
  Description of Artificial Sequence: Synthetic coding sequence
atgggcgcgatgactcagcttttggctggcgtttttctggcatttcttgccctggcgactgagggcggagtcctcaaaaaagtgatccggcataagaggcagtccggggtaaacgccactctccccgaggagaaccaaccagtggtgtttaatcacgtatataacatcaagctccctgttgggagccagtgcagcgttgatttagagtccgctagtggcgaaaaggatctggctccacccagtgaaccatcagagtccttccaagaacatactgtcgacggcgaaaaccaaattgtgttcacccacaggattaatattccccggcgagcctgtggatgcgctgccgctcctgatgtgaaggagctgttgagccggctggaggagttggagaacctcgtgagttcgttaagagaacaatgtaccgccggcgcaggatgctgcctccagccggctaccggccgattggatacgcgacccttctgctctggccgtggaaacttttctactgaaggctgcggctgtgtttgcgagccaggatggaagggccctaactgcagcgagcctgagtgccctggcaactgccacttacgaggacgctgtattgacgggcagtgtatctgcgatgatggtttcacaggagaggattgtagccagttagcgtgtcccagcgattgtaacgatcaaggcaaatgcgtgaatggagtgtgcatctgtttcgagggatatgccggcgccgactgctctcgcgagatctgtcccgtgccctgcagcgaggaacacggcacctgcgtagatggactgtgcgtctgtcatgacggttttgccggtgatgactgtaacaaacctttgtgtctcaataattgctacaataggggcagatgtgtcgagaacgaatgcgtgtgtgacgagggttttaccggcgaagactgtagcgagctcatttgtccaaatgactgcttcgaccgggggaggtgcattaatggcacgtgctactgtgaagaaggcttcacaggcgaggactgcggtaagcccacctgcccgcatgcctgccacactcagggacggtgtgaagaggggcagtgcgtttgcgacgagggctttgcgggagtcgactgcagcgaaaaaaggtgcccagccgactgtcataatcgtgggcgctgcgtcgatggacgatgcgaatgtgatgatgggttcacgggagcagactgtggggagctgaaatgcccgaacggctgtagcggtcatggacggtgcgtgaacggacaatgcgtatgtgatgaaggatacaccggagaggattgttcccaacttagatgtcccaacgattgtcactctcgcggacggtgcgtcgaaggtaagtgcgtgtgcgagcaagggttcaaaggttacgactgctcggacatgagttgtccgaacgattgtcatcaacacggccgttgtgtaaatggaatgtgcgtgtgtgacgatggctacacgggagaggattgtagggaccggcagtgcccaagagattgcagcaaccgaggattatgtgtggacggccagtgcgtatgtgaagatgggtttacaggtcctgattgtgctgaactgtcgtgtcctaacgattgtcatggacaggggcgctgcgtcaacggacaatgcgtttgccatgagggctttatgggtaaggattgcaaggaacagcggtgtccaagcgattgccacggtcagggcaggtgtgtggacgggcaatgcatctgccatgaaggatttacaggactggactgtggacaacacagttgtccatctgattgtaataacctgggccagtgtgtgtcggggcgttgcatctgtaatgagggatactctggcgaggattgcagcgaagtaagccctcccaaggacttagtggtgacagaagttaccgaggaaactgtcaacttggcctgggataatgaaatgagggtaactgaatatttagtggtatacactcccacacacgaggggggcctagagatgcagttccgagttcccggcgatcaaacatctacaattatacaggaactcgagccaggggtcgagtatttcattcgagtcttcgctatcctggagaataaaaagtcaatcccggtctccgcgcgggtggccacatatctacccgcgcccgaagggctcaagttcaaaagcatcaaagagacatcagtggaagtggagtgggaccctctcgatattgctttcgaaacctgggaaatcattttccgtaatatgaataaggaagatgagggcgaaatcacaaaaagcctgagacgtcccgagacctcctaccgccagactggcctggcaccgggtcaggaatatgagattagccttcacatcgtcaaaaataatacaaggggtccaggtctaaagagggtaactaccacccgactcgacgctccctcccagatcgaagtgaaggatgtcaccgatacgacggcattaatcacttggttcaagcccttggcagaaattgacggcattgaactcacgtacggtatcaaagacgtaccaggagataggacaactattgatttgactgaagacgagaaccagtattcaatcggaaacctgaagccagacactgaatacgaagtgtctctcataagtaggagaggcgacatgtcatccaatcctgccaaagaaacttttaccaccggtttagatgcccccagaaacctgaggcgagtctcccagactgataactcaatcacattggaatggagaaacgggaaagcggctatcgactcttatagaatcaaatacgcccctatttccggaggagatcacgcggaggtggatgtcccaaagagtcaacaggctacaactaaaaccaccctgaccgggctgcgtcctggtaccgaatacggaatcggtgttagcgccgtgaaggaagacaaggagtccaatcccgcgactattaacgcagcaactgaactcgatactcccaaggatttgcaggtgagcgagaccgccgagacaagccttaccctcctctggaagaccccattggccaagttcgataggtatagactaaattatagcctgccgacgggtcagtgggtgggagtgcagttgccaaggaacactacatcctacgtgctgcgcggtctcgagccgggtcaggagtataatgtcctcctgactgcagagaagggccgccacaagtccaaacccgcccgtgtgaaggcatccaccgccatggggagccctaaggaggtcattttctctgacatcactgagaattcggccaccgtctcttggagagcacctaccgcacaagttgagtcctttcggataacttacgtgcccattaccggtggtacaccttctatggtaaccgtggatggaactaagacacaaaccaggttggttaagctgatccccggagtcgagtatttggtctccattatagctatgaaggggttcgaagagtccgagcctgtgtccgggtccttcacaacagctctggacggccccagcggcttggtgacagctaacattactgatagtgaggcccttgcgaggtggcagccagctattgccactgtagattcatacgttatatcctacaccggcgaaaaggtgcctgagatcacacggacagtgtcaggtaacaccgtggaatatgccctgactgacctagaaccggctacagagtacactctgcggattttcgccgagaaggggccccaaaagagttccaccatcaccgcaaaattcaccacagacctggattcccctcgggacctcaccgccactgaagttcagagtgaaacagctctgttgacttggcggcctccccgagccagcgtgaccggctacttgctagtgtacgagagcgtagacggtaccgtgaaggaggtcatcgtgggcccagacacgactagctattccctggcagacctgagccccagtacgcactatacagccaagattcaagcactgaacggccctctgcggtcaaacatgattcagacgattttcaccaccatcggcctcctctatccttttcctaaagattgttctcaggccatgttgaatggtgataccacttccggcttatatacgatttacttgaatggcgataaagcggaggccctcgaagtcttttgtgacatgacaagcgatggcggcggatggatagtgtttttgagaagaaaaaatgggagggagaatttctatcagaattggaaagcctatgccgcgggcttcggcgataggcgcgaggaattctggttggggctggacaatctgaataaaatcacggcacagggccagtatgagctgcgggttgatctgagggatcacggggaaactgctttcgctgtgtatgataagttcagtgtgggcgatgcaaaaactcgatacaagctcaaggtcgaggggtacagtggcaccgctggggatagcatggcctatcacaacgggcgcagcttttcaacatttgataaggacactgattcggcaattactaattgtgctctatcctacaaaggcgccttttggtacagaaattgtcatagagtgaatctgatggggcgctacggagacaataatcactcgcagggagttaattggttccactggaagggccacgaacatagcatccagttcgccgagatgaagttgcgtccctccaacttcagaaaccttgagggcaggcggaagcgagcctag

SEQ ID NO: 137512 - DNA, 4968 bp, Artificial Sequence
  Description of Artificial Sequence: Synthetic coding sequence
atgggggctatgacccagctgctggccggggttttcttggctttccttgccctagccaccgagggcggcgtactgaaaaaggttattaggcacaagaggcagtctggcgtcaatgctactttaccagaggaaaaccagcccgtggtgttcaaccacgtctataatatcaaactccctgtgggaagccagtgttctgtggatttggagagcgcatcaggagagaaggatctggcccctccatcggagccatctgagtcatttcaggagcacaccgttgacggcgagaatcagattgtgttcacacatcggattaacatccccaggcgcgcatgcggttgtgccgcagcccccgatgtgaaagagctgctgagtcgtcttgaagaactggagaacttagtcagttccctgagggagcagtgcacggcgggcgctggatgttgtctccaaccggcaacaggtcggcttgacaccagaccgttctgctctggtcgcgggaatttttccactgaagggtgtgggtgtgtatgtgaacctgggtggaaaggcccaaactgctcagagcccgaatgcccaggaaactgccacctcagaggccgatgtattgacggccagtgcatctgcgatgatggattcactggagaagattgctcacaactggcctgtccaagcgactgcaatgatcagggcaagtgcgtaaacggagtctgcatttgctttgaaggttatgccggcgcagactgctctcgcgagatttgcccagtgccatgctcagaagagcacggcacatgcgttgacggtctttgtgtttgccacgacggattcgctggagacgattgcaacaaacccttatgcttgaataattgttacaaccgcggccgatgcgttgaaaatgaatgtgtttgcgatgaaggcttcaccggcgaagattgcagcgaactgatttgccctaatgactgttttgaccgcgggcgttgcattaatgggacctgttactgtgaagaaggttttaccggagaagactgtggcaagcctacctgtccccacgcatgtcatacacaaggccggtgcgaggaaggtcagtgtgtgtgcgacgaggggttcgccggcgtggattgtagtgagaagagatgtcccgccgattgtcacaatcggggaaggtgcgttgacggccggtgcgagtgcgatgacggttttacaggcgcggactgcggagagctgaaatgtcccaacggctgtagcggtcacgggcgctgcgtgaacggccaatgtgtgtgtgatgaaggatatacaggagaggactgttctcaactcaggtgtcccaatgactgccattccaggggcaggtgcgtggaggggaagtgtgtctgcgaacagggcttcaagggttacgactgttctgatatgagttgccccaacgattgccaccaacacgggcggtgcgtaaacggcatgtgtgtgtgcgacgatggctatactggcgaggattgtagagacaggcagtgtcccagggattgttctaaccgaggactgtgtgtcgacggccagtgcgtctgcgaagacggttttaccggacccgactgtgccgagctgtcgtgccctaatgactgtcacggccaaggacggtgtgttaacggacagtgtgtttgtcatgagggctttatggggaaggattgcaaggagcaaaggtgtccctctgattgtcatggccaaggccgatgtgtcgacggccagtgcatttgccacgaaggttttaccgggttggactgcggacagcacagctgtccatctgactgcaataacctgggacaatgtgtgagtggcagatgtatttgcaacgaaggttactcaggggaggactgttccgaggtgagcccacctaaagatttggtggtgaccgaggttaccgaagagaccgtgaaccttgcatgggacaatgaaatgcgcgtcactgaatatctggttgtatacaccccgacgcatgaggggggcctggagatgcagttccgcgtgccgggtgaccagacatctactatcatccaagaattggagccaggagttgagtacttcataagggtctttgccattctggaaaacaaaaagtcaatcccggtatctgcacgcgtggctacatatctgccagcccccgaaggtctgaaattcaagagtattaaagaaacctctgtggaggtggagtgggaccctctggatattgcatttgaaacctgggagatcatttttcgaaatatgaacaaagaagatgaaggcgagattacaaaaagcctacgcaggcctgagacgagttatcgccagaccgggctggcaccaggtcaagagtacgagattagcttgcacatcgtgaaaaataacacacgaggaccaggacttaagcgcgtcacgacaaccagacttgacgctcctagccagatcgaggttaaggatgtgaccgatacaaccgcgctcataacctggtttaaaccattagccgagatagacgggattgaattgacttacgggataaaggatgtgcccggtgatcggaccactatagatctgacagaggatgagaatcaatatagcatcggtaatttaaagcctgacaccgagtacgaggtgagtctgattagtcggcgaggcgacatgtcctctaatcctgcaaaggagacatttacaacaggcctcgacgctcctcggaacttgcgccgggtgtcacagaccgataacagcatcactctcgagtggagaaatgggaaggctgccattgacagctatagaattaagtatgctcctattagcgggggcgaccacgccgaggtggacgtgccgaaatcccagcaagccaccacaaaaacaaccttgaccgggctgcgtcccggaaccgaatatggaatcggcgtcagcgctgtcaaggaagacaaagagtccaaccctgctacaattaacgctgcaaccgagctggacacacctaaggacttgcaggtgtctgagacagcggagacctctctgacattgctctggaaaacacccctggcaaagtttgatagatacagactgaactattctttaccaactggccagtgggttggcgtgcagctgcctagaaacacaacttcgtacgttcttcgggggctggaacctggacaggaatacaacgtgttactgaccgcagaaaagggacggcacaaatcaaaacctgctagagtgaaggcatcaaccgaggccgaacccgaagtggataatctgttagtcagcgacgctacccctgacggcttccgcttgtcctggacagcagacgaaggggtcttcgacaattttgtgctcaagattagagacactaaaaaacaaagtgagccacttgagatcactttacttgccccggaaaggaccagagacattactggtctgagagaagcgacagaatatgagatagagctctatggaatctccaagggccgtcgctcacagactgtgagcgcaatcgctacgacagctatgggctctccgaaagaggtgatattctcagacattaccgagaattccgcaacagtatcatggcgagctcccacagcacaagtcgaaagtttcaggatcacgtatgttcctatcacaggtggtacaccaagtatggtcacagtggacgggactaagacacagacacgcctggttaaactcataccaggcgtggagtacctggtttcgataatcgcgatgaaagggtttgaagagagcgaaccagtgtccggctcatttactactgcactcgacggacctagtggtctggtgacggccaatattaccgactcggaggctctggctcgctggcagcctgccatcgctaccgtggactcctacgtgattagttataccggggagaaagttcccgaaatcacccgcacggttagcggcaacacagtggagtatgccctgaccgacctggaacctgctactgagtacactctgcggatcttcgccgagaaggggccacagaagtcctcgacgattactgccaagtttactaccgacctcgactccccccgcgatcttacagctactgaggttcagagcgagacggcactgctgacatggaggcctccgcgtgccagtgtaacagggtatctcctggtgtacgaaagtgtggatggcacggttaaggaggttatcgtgggcccagacactacaagctactcattggccgatctcagcccaagcacacactacactgcaaagatacaggcactgaatggacctcttcggagtaacatgatccagaccatttttacaactattggtctgctgtaccccttccctaaggactgttcccaggctatgctcaatggagataccaccagcggactgtacactatttatctaaacggcgacaaagccgaggctctggaagtcttttgtgatatgacttccgacggcggggggtggattgtctttctacgacggaagaacggtcgcgaaaacttctatcagaactggaaagcatatgctgctggcttcggggataggcgagaggaattctggctgggcctagacaatttgaataaaataaccgcacaggggcagtatgagctgcgagtggatctgcgagaccacggagagacggcatttgccgtatatgataagttcagcgtcggtgacgcaaagacccgctataagcttaaggttgaaggatatagcggcaccgccggtgattcaatggcatatcacaatgggaggagttttagtacttttgataaggatacagattcagccatcactaattgcgccctgtcttacaagggtgccttttggtacagaaactgtcatcgggttaatctgatgggccggtacggggacaataatcattcgcagggggtcaactggtttcactggaaaggccacgagcattccatccagtttgcagaaatgaaactgaggccctcaaacttccggaacctggaggggaggcgaaagcgggcttag

SEQ ID NO: 137513 - DNA, 6606 bp, Artificial Sequence
  Description of Artificial Sequence: Synthetic coding sequence
atgggagctatgacacagctgctcgcaggtgtgttcctggccttcctggcccttgccaccgagggaggcgtgttgaaaaaggtgatcaggcacaagcgtcagagcggtgttaatgcaacattgcctgaagaaaaccagcctgtcgtctttaatcacgtgtacaacatcaaattgccagtgggttcccaatgcagcgtcgaccttgaaagcgcatccggtgaaaaggatctcgctccccctagcgaaccttcagagtcattccaggagcatactgtcgatggcgaaaaccagattgtgttcacgcatcgcattaatattccccgtcgggcatgcggatgcgctgcagcacccgacgttaaggagctactgtcacgcctagaggagctcgagaacctggtgtcttctttgagggagcagtgcacagccggggctggctgttgcctccaacccgccacaggacgcctcgacacgcgcccattttgcagtgggcggggcaacttctcgaccgaaggatgcggttgtgtctgcgagcccggttggaagggccccaattgctccgagcccgagtgtcccggtaactgccacctaagagggcggtgcatcgatggacaatgtatctgcgacgacggctttaccggagaagactgctctcagctggcatgtcctagcgactgcaatgaccagggaaagtgtgtcaatggagtatgtatctgcttcgagggttatgcaggcgcagattgttcccgggaaatttgtcctgtaccgtgttccgaggaacacggaacttgcgtcgatggcctgtgcgtgtgtcacgacggttttgctggcgacgactgtaacaagcccttatgcctgaacaattgttacaatagggggcgttgtgtggaaaatgaatgcgtttgtgatgagggttttacaggtgaggactgcagcgagctgatctgccccaatgactgtttcgatagaggtcggtgcataaatggaacctgttactgtgaggagggctttacaggggaggattgcggcaagcctacctgtcctcatgcatgccacacccaaggacgttgtgaggagggacaatgcgtttgcgatgagggttttgccggcgttgattgttcagagaagcgctgccccgccgattgccacaatagagggcgctgtgtagacgggcgatgtgagtgcgatgacggatttactggcgcagactgtggggagctgaagtgtcctaacgggtgttctggccatggaagatgtgtgaacggacagtgtgtgtgcgatgaggggtacacaggtgaggactgctcccagctgcggtgtccaaacgattgtcactctcgggggagatgcgtggagggcaaatgtgtgtgtgaacagggattcaaggggtatgattgcagcgatatgagttgcccgaacgactgccatcagcatgggcggtgcgttaatggaatgtgtgtgtgcgatgacggatacaccggtgaggattgtagggataggcagtgtcccagagactgtagtaacagagggctgtgcgtcgatggtcagtgcgtgtgtgaggatggcttcaccggaccagactgcgctgagctctcctgccctaacgactgccatggtcagggtcggtgcgtgaatggtcagtgtgtgtgtcacgagggtttcatgggcaaggattgcaaggaacagaggtgcccttctgattgccacgggcagggcaggtgcgtggatggccagtgtatttgccacgagggatttaccgggctggactgcggacagcacagttgccctagtgattgtaacaacctgggccagtgcgtaagtggaagatgtatttgcaatgagggttactctggagaggattgctctgaagtcagtcctcctaaggacctggtcgtcacagaggtgactgaagaaaccgtgaacctggcttgggataacgaaatgagggtgactgagtacctggtcgtgtatacaccaactcatgagggcggcctcgagatgcaatttagagtgcctggcgaccagacaagtacaattatccaggagctggaaccgggagtcgagtactttattcgggtgtttgcgatactggagaacaaaaagtcaattcccgtgagcgcccgcgtagccacttacctgccggcccctgagggactgaaattcaaatccattaaggaaacgtctgtggaggttgagtgggatcctctggacattgcttttgaaacatgggagatcatatttagaaatatgaataaagaagacgagggcgaaataacaaaatccctgaggaggcccgagactagctaccggcaaacaggtctggcaccggggcaagaatacgagatttcgttgcacattgtgaagaataacacacgggggcctggcctgaaaagagttacaacaacacgtttggacgctccctcacagatagaagtgaaggacgttacagatactaccgcactgattacttggttcaaacccctggctgaaattgatggcattgaattgacttacgggatcaaggacgtgccaggcgatcgtactacgatcgatctgaccgaagatgagaaccagtacagcattggtaatttgaagccggatacggagtacgaggtttctctgataagtcgtaggggggatatgagctctaatcccgccaaggagacttttaccacagggctggatgcgcctcgcaatctccggagagtatcgcaaaccgataattcaatcacattagagtggagaaacggtaaggccgcaatcgattcatatcggataaagtacgctcccatttctggaggggaccacgcagaggtagacgtgccaaaatcccaacaggccaccacaaagacaacactgacaggactgagacccggaacagagtacgggattggcgtctcagcggttaaggaggacaaagagtctaacccagccactattaatgctgcaacagagctggacaccccgaaggacctgcaggtttccgagactgccgaaacctcactaacgttgttgtggaaaacccctctggccaaattcgatcggtatagactcaattactccctcccgaccggccaatgggtaggtgtgcagctcccgaggaacaccacatcctatgttctgaggggcttggaacctggacaggaatacaatgttctgctgaccgccgaaaaagggaggcacaaaagcaagccagcacgagtaaaagcatccacggagcaggcccctgaattggaaaatttaaccgtgactgaggtaggctgggacggactgaggctgaactggacggcagcggaccaggcttacgaacactttatcatacaggtacaagaggctaataaggtagaagccgcaaggaatctgactgtaccaggttcgctacgggccgttgacatcccaggccttaaagccgccacaccatataccgtctcaatctacggtgttattcagggatataggaccccggtgctgtccgccgaagcctcaaccggcgagactcctaacctgggcgaagttgtggtagccgaagttgggtgggatgccctgaagctcaattggacagcccctgagggagcttacgaatatttctttatccaggtgcaagaagcagatacagttgaagccgcccagaacctgactgtgcctggaggactgcggtccacagacttgcccggcttaaaggccgccacacattatacaattactatccggggagtcacgcaggatttctccactacccccctcagcgtggaagtcctaacagaagaggtgccagatatgggtaacttgactgttacggaggtctcatgggacgctctgcggttgaattggacaaccccagatggaacttatgatcagtttaccatccaagttcaggaggccgatcaggtggaagaagcccataacctaactgtccccggatccctgagatcaatggagattcccggactgagggcagggactccttatacggtgaccctgcacggtgaggtgcggggacattctaccagacctctggctgttgaagtcgttactgaggaccttcctcagctgggagatctggcggtttccgaggtggggtgggatgggttacgtctcaattggaccgcagccgataatgcttacgagcactttgtgatacaggtccaggaggtcaataaagttgaggcagcacagaatctcacgctacccgggtcgctcagggcagtagatatccctgggctggaggcagccaccccttaccgggtttcgatctatggagtcataagaggatatagaactcccgtcttgtcagccgaagcatctactgcaaaagagccagaaatcggaaacctgaatgtttccgacatcactcctgagagtttcaacctgtcctggatggccaccgatggtatttttgagacctttactatcgaaatcatagattccaaccggcttcttgagactgtcgagtacaacatctccggcgccgaacgaacagctcatataagcggtctccccccatcaacagatttcattgtctatttatcaggcctggccccctcaattagaactaagacgatttctgctactgccaccacagaggccttgccgctgttggaaaacttgacaatcagcgacataaatccgtacggctttacggtttcttggatggcttccgagaatgccttcgatagttttctggtgactgtcgtggattccgggaagctgctggaccctcaggaatttactctgtctggcacgcagcggaagctagaactgcgcggactaatcacaggtattgggtacgaggtaatggtgagtggcttcacacaagggcaccagactaaacccttgcgcgcagaaatcgtcactgaagctgaacccgaagtggacaacctacttgtgagcgatgcgactcccgacggcttcagactctcttggaccgcggacgagggcgtattcgacaacttcgtgctgaagatacgcgacactaaaaagcagagcgagccactggaaataacgctgttggcgccggaacgtacccgggatattacagggctgcgcgaggccactgaatatgaaatcgagctttatggcatttccaaaggtcgtaggagccagaccgtatctgctatcgccactacagctatggggtctccaaaagaggtgatctttagcgatatcaccgaaaatagcgcaaccgtgtcttggcgcgctcctacagcgcaggttgaatcctttcgcattacctatgttcctattaccggaggaaccccatccatggtgactgtggacggcacaaagacgcagaccaggctggtgaaacttattcccggcgtggagtaccttgtgtctatcattgccatgaaaggcttcgaagagtccgagccggtttcaggctccttcactacagctctggatgggccctctggcctggtcaccgctaatattaccgactcagaggccttggccaggtggcaaccagccatcgcaactgtagacagctatgtgatctcttacacgggagagaaagtgcctgaaataacaagaaccgtttctgggaataccgtagaatacgccttgaccgacctcgaacctgcaaccgagtataccttgcgaatcttcgccgagaagggtccacaaaaatcatcaactattaccgctaagttcaccactgatcttgattcccctagagatctaacagctacagaagtgcagtctgaaactgctctactaacctggcgtcctccccgggcctcagtgaccggctacctgttagtttacgaatccgtggacggcaccgtaaaggaggtgatcgtcggcccggacactaccagctactccttggcggatctctccccctccacccactatacagccaagattcaggccctcaatggccctctgaggtccaacatgattcagacaatctttacaactattgggctgctttacccttttccaaaagattgtagccaggccatgctgaacggagatacaacttcaggcctgtacactatctatctcaacggggacaaggcggaagccctcgaggtgttttgtgacatgaccagcgacggaggcgggtggattgtgttcctgcggagaaagaacggccgggaaaacttctaccaaaattggaaggcatacgcagcaggctttggagatcgacgcgaagagttttggctgggactggataacctgaataaaataacagcacaagggcaatacgaactccgcgttgacttaagggatcatggagagacagcctttgctgtctacgacaagttctccgtaggcgacgctaagacgcggtataagctcaaggtggagggatacagcgggactgccggggattctatggcctatcataacggcagaagtttcagtactttcgacaaagacactgatagcgccatcaccaactgtgccttgtcctacaaaggggccttctggtatcgaaattgccacagagtgaatctgatgggcagatacggcgacaacaaccattctcagggagtgaactggttccactggaaaggccacgaacactctatccagtttgcagagatgaagctgaggccatccaactttcgaaacctggaaggacggagaaagcgagcatag

SEQ ID NO: 137514 - DNA, 3240 bp, Artificial Sequence
  Description of Artificial Sequence: Synthetic coding sequence
atgggggccatgacccagctacttgcgggtgtgttcttggctttcctggcactagctacggaagggggcgtgttgaagaaggtaatcaggcacaagcgccagagcggggtcaatgccacattgcccgaggagaatcagccagttgtattcaaccacgtgtataatatcaagctgcccgtcgggagccaatgcagcgtcgatctggaaagtgcttcaggtgagaaagacctggcccctccttctgaaccaagcgagagcttccaggaacataccgttgacggcgaaaaccagatagtattcactcataggatcaatattcccagacgggcctgcggctgcgctgctgcaccagatgtgaaagaactcttatccaggttggaggaactcgagaacctggtttccagcctgagagagcagtgcactgccggggccggttgctgcctgcagcctgcgaccggacggctggacacacggccattctgtagcgggaggggcaatttctcgaccgagggctgcggttgcgtatgcgagccaggctggaagggtcccaattgcagtgaaccagagtgcccggggaattgccacttgcggggacggtgcattgacggccagtgtatctgcgatgacgggtttaccggggaagattgttctcagcttgcttgcccctctgactgcaatgatcaaggcaaatgcgttaatggtgtgtgcatctgttttgagggatatgctggtgcagattgcagccgtgagatctgccctgtgccatgttccgaggagcacgggacttgcgtagacggactttgtgtgtgccacgatggcttcgcgggggatgactgtaacaagcctctttgtctcaacaattgctacaatcggggcagatgtgtggaaaacgagtgcgtctgcgacgagggatttaccggcgaagattgttcggaactgatctgtccgaacgattgtttcgatcgcggcagatgcatcaatggaacttgttattgcgaagagggtttcacgggagaggactgtggaaaaccaacatgcccgcacgcttgccacacccagggccgctgtgaagagggccaatgcgtttgcgacgaagggttcgctggtgtcgactgctctgaaaagaggtgccctgctgattgtcacaaccggggccggtgcgttgatggccgttgtgaatgtgatgatggtttcaccggagcagattgcggagaactgaaatgccccaatggctgttccggccatggtagatgcgttaacggtcagtgtgtttgtgacgaaggctacactggagaggattgtagccagctgcgatgccctaacgactgtcatagccgtggtcgctgtgttgaggggaaatgtgtgtgtgagcaaggcttcaagggatacgattgtagtgacatgtcatgtcccaatgactgccaccagcacggccggtgcgttaacgggatgtgcgtctgcgatgacggctacacaggagaggactgtagagatcggcagtgcccacgggactgtagtaatcgggggctgtgcgtagacgggcagtgcgtctgtgaggacggctttacaggccccgactgcgctgagctgagctgccctaacgactgccatgggcaaggaaggtgtgttaacggccagtgcgtgtgtcacgagggatttatgggcaaggattgtaaggagcagcggtgtccctctgactgtcacggtcaaggccgatgcgtagatggacaatgtatctgccatgaaggctttacgggtctggactgcggacagcattcttgtcccagtgactgcaataacctgggccagtgtgtaagcggtagatgcatctgtaatgaaggctatagcggggaagactgttctgaggtctccccacccaaagatctcgttgtcactgaagttacagaggagacagtaaacctggcctgggataacgaaatgcgcgtgaccgagtatctggttgtctacacgccgacccacgagggcgggctggaaatgcagtttagagtccctggggaccagacttcaacaatcatccaggagctcgaacccggagtggagtatttcatcagagtcttcgcgatactggagaacaaaaagagcatccctgtttctgcacgggtggccacttatctacccgcccctgaggggctgaaattcaagagtatcaaagaaactagcgtagaggtagaatgggatcccctagatatagcttttgagacctgggagattatttttagaaacatgaacaaagaggacgaaggggagattacaaaaagtcttcgcaggccggagacctcgtatcgccagaccggactggcccctggccaggagtacgagatatccctgcacatagtcaaaaataacacccggggcccaggtctgaaacgcgtcacaaccacccggttggacgccccttcccaaatcgaggtaaaggacgtgaccgacaccaccgctctcattacctggtttaaacctctagccgagatcgacgggatcgaactcacctacggaattaaggacgtacccggcgacaggaccaccatagacctcaccgaggatgaaaaccagtactcgatcggaaatcttaaacctgataccgagtatgaagtgagcctgataagccgccgcggagatatgtcgagcaaccccgctaaggagactttcaccacaggactcgatgcaccaagaaacttgcgcagagtgagccagacggacaacagtatcacactggaatggcggaatgggaaagccgctattgattcttatcgcatcaaatatgcacccatctctggcggggatcacgcagaagtggatgttccaaaatcccagcaagcgaccacaaaaaccatcacagcaaagtttactacagacctcgatagtccgcgggacctcactgccacagaggtgcagtccgagacagcactcctcacttggcgcccaccccgtgcgagtgtgacaggctacctgctggtgtatgaaagcgttgatggtactgtgaaggaagtaatcgttggcccagacacaacctcatattcgttggcagacctctcccccccatccttatttctccactttattcagcagaagccggaaaagcagtactgcttccatttcaaggatatgataaatattatcaatattataatgatgatgatgatgatgaaaacaaaagacttcagcagagacttgagtttccagaacatctcgggccagtacctaatcgtattcttcttctag

SEQ ID NO: 137515 - DNA, 279 bp, Artificial Sequence
  Description of Artificial Sequence: Synthetic coding sequence
atgggagccatgacccagcttcttgccggggtcttcctggcctttctggccctggccaccgagggtggcgtgctgaaaaaggtcatccgacacaaacggcaatctggcgtgaatgcaacactgccagaggagaaccagcccgttgtattcaatcatgtgtataacataaagctgcccgtgggctcccaatgcagtgtcgatcttgagtccgccagcggcgaaaaggacttagcacctccatcagagccatccgagagtttccaggagcacacggtctag

SEQ ID NO: 137516 - DNA, 5241 bp, Artificial Sequence
  Description of Artificial Sequence: Synthetic coding sequence
atgggcgcaatgacccagttgctggccggtgtgttcctggccttcttggcactggctaccgaggggggagtgttgaagaaggttattagacataagcgacagtctggagtcaacgccactctgcctgaggagaaccagcctgtagtttttaatcacgtgtataatattaagctccctgttgggagtcaatgcagcgtggacctggagtctgctagcggagagaaggacctggcaccacccagtgaaccgtctgagagctttcaggagcatactgtcgacggcgagaatcagattgtttttacccaccggattaacatcccgagacgcgcttgtggatgcgccgctgccccggacgtaaaggaactcctatcaagactggaagagctggagaatttggtgtcctcgctgagggagcagtgtactgccggggctggctgttgtctacaacccgctaccggtagactggatacacgcccattctgttccggtcgtggcaacttttcaacagagggatgcggctgcgtctgtgagccgggttggaagggtccgaactgttcggaacctgaatgcccgggcaattgccacctgcgcggacgatgcatcgatggccagtgcatttgcgacgacggcttcactggagaggattgcagccagctcgcctgtccttccgattgtaacgaccaaggaaagtgtgtgaatggcgtgtgtatttgctttgaagggtatgcgggtgcagactgctcccgggagatctgcccagttccctgcagcgaggagcacggtacatgtgtagatggcctgtgtgtgtgtcatgatggctttgccggtgatgattgcaataaacccctgtgcctgaataactgttacaaccgtggcagatgtgtcgaaaatgaatgtgtttgtgatgagggcttcacaggagaggattgctccgagcttatttgtcccaacgactgcttcgacaggggccgctgtattaacgggacatgttactgtgaagaaggctttacaggcgaggactgtggtaagccaacctgtccgcatgcttgccatacccagggcagatgtgaggagggacagtgcgtctgtgatgagggatttgcgggagtggattgctccgaaaaaaggtgtccagccgattgccacaatcggggtcggtgtgttgacggccgatgcgaatgtgatgatggttttacaggcgcggattgcggagaactgaagtgtcccaatgggtgcagcggacacgggcggtgcgtcaacggtcagtgcgtgtgtgatgagggttacaccggagaagattgcagccagcttcgttgtcctaacgactgccactcccgcgggcgctgcgtcgagggaaaatgcgtgtgcgagcagggcttcaaagggtatgactgcagcgacatgagctgcccgaacgactgccatcagcatgggaggtgcgtgaacggaatgtgcgtttgcgacgacggttataccggagaagattgccgcgataggcagtgtcctcgtgactgcagtaaccggggcctgtgtgtggacgggcagtgtgtctgtgaggatggcttcacaggccccgactgtgctgaactgtcgtgcccaaacgattgtcacggtcaaggtcgttgtgtaaatggacagtgcgtctgtcatgagggatttatgggtaaagattgtaaagaacagagatgccctagcgattgtcatggtcagggtaggtgtgtggacggccaatgcatatgccacgaaggcttcactggcttagactgcggacaacactcttgcccctctgactgtaataacttaggacagtgcgtgtctgggaggtgcatatgcaacgagggctactcaggtgaggactgctctgaggtatccccgcctaaggatctcgtggtgacagaagttacagaggaaactgtgaatttagcatgggacaatgaaatgagagtgacggagtatctggttgtgtacaccccaactcatgaagggggactggagatgcagtttagagtccccggagatcagactagcaccattattcaggagctcgagccaggggtagagtacttcatcagagtgttcgccatcttagaaaataaaaaaagcattcccgtgtctgcacgcgtagccacctatctgcccgcccccgagggactaaagttcaaaagtataaaggagacttcagttgaagtggagtgggatcctctggatatcgcttttgagacctgggagattatatttcgtaatatgaacaaagaggacgagggtgagatcacaaagagcctaaggcgaccagaaactagctacaggcaaactggactggcaccaggccaggagtatgagattagtctacacatcgtgaaaaacaacacgcggggacccggactgaagcgtgtcaccactacccggctcgatgccccctcacaaatcgaggttaaggacgttacagatacaactgccctgatcacatggttcaaaccactcgccgaaatcgacggcattgagcttacatatggaataaaagatgtgcccggagaccggacaaccattgatcttaccgaagacgagaatcagtacagtattggcaacctcaagcctgataccgagtatgaagtgagcctgatcagtagaagaggcgacatgagctccaatcccgctaaagagaccttcaccacggggcttgatgcacctcgcaacctgagacgcgtgagccagactgacaattctatcacccttgagtggagaaacggaaaggccgccatagactcataccggataaaatacgcaccaatttctggaggggatcacgcagaggtggatgtcccaaagtctcagcaggccactaccaaaaccacattgacaggactgaggcccggaaccgagtacggtattggcgtatccgccgtaaaggaggataaggagtctaaccccgccacaataaacgccgctactgaactggacacccctaaggaccttcaggtcagcgaaacagctgaaacttcgctgacattactttggaagacccctctggctaagttcgacagataccggcttaattactccttgccaacagggcaatgggtgggcgtgcagctgcctaggaatactactagttacgtgttaagggggttggagccaggccaggaatataacgttttgctcactgccgaaaaggggcgccataaatccaagccagcacgggtgaaagcctccacagccaaggagccagaaattggcaatctcaatgtgtccgatataactccagagtccttcaatctgagttggatggcgaccgacggcatctttgaaaccttcaccattgagattatcgacagcaaccgcctcctcgaaaccgtggagtacaacatctctggggccgaaaggacggcacatatctcaggcttgcctcctagtactgattttatcgtctacctgagcgggctcgcaccaagcatccggacaaaaaccatttccgccactgctactacggaggccgagccggaagtggacaatcttttggtctctgatgccacacccgacggcttccggctaagctggactgctgatgagggggtctttgacaactttgttttgaagattagggataccaagaaacaatcagagcctttagaaataacacttctggcccctgaacgaactcgcgacatcactggactcagagaagccactgagtacgagatcgagctgtacggaatttctaagggcaggagatctcaaaccgtgtctgccattgctacgaccgccatgggtagcccgaaggaagtgatattttctgatattaccgaaaattctgcgacagtgagttggagagccccgaccgcccaggtagagtcctttcgtatcacgtacgtgcctatcacggggggcactcctagtatggtcactgtggatggcacaaaaacacagacccgactcgtgaaactgatacctggggtggagtatctagtatcaatcatcgccatgaaaggatttgaagagagtgagcccgtgagcggaagttttaccacagctctggacggcccaagcggactggttactgcaaacatcaccgattccgaggcactcgcccgctggcagcccgcaatagctacagtggatagttatgtgatcagctacaccggagaaaaggtacccgagatcacgcgaactgtgagcggaaataccgttgagtacgctcttacggaccttgagcctgctactgagtacaccttgcggattttcgcagagaaggggccccaaaaatccagcactatcacagccaaatttacaactgatctcgacagcccccgggacctgactgccacagaagtccagagcgaaactgccctattaacatggaggcccccgagggcttccgtgaccgggtatctccttgtctatgagtccgttgatgggacggtcaaggaggttatcgtgggacctgatactacgtcctactctttagctgacctatctccctccacacattatactgctaagatacaggcattaaatggacccctgcgtagtaatatgattcaaactatctttaccacaatcggcctactgtatcctttcccgaaggattgcagccaagccatgttaaacggcgacaccacttccggcctttataccatctatctcaacggtgacaaggcagaggccctggaggtcttctgtgatatgacttccgacggaggcgggtggattgtgtttctgcggcgcaaaaatggacgggaaaacttttatcaaaattggaaggcctacgcagcagggtttggcgaccgacgagaggagttctggctgggactggacaacctgaacaaaattaccgcccagggacagtacgagcttcgggtggacttgagggatcatggcgagaccgccttcgccgtgtacgacaagtttagcgttggggacgcaaagacgcggtataagctgaaggtcgagggctattctggaactgcaggtgactccatggcataccacaatggacgatcatttagcactttcgacaaggacactgactcggccatcactaactgtgcgctgtcctacaaaggagccttctggtaccgcaactgtcacagggtgaacttgatgggcagatacggtgataataaccatagccaaggtgtgaattggtttcattggaagggtcatgagcacagtatccagttcgcagagatgaaacttcgccccagcaattttaggaatctggaagggagacgaaagcgcgcttag

SEQ ID NO: 137517 - DNA, 5517 bp, Artificial Sequence
  Description of Artificial Sequence: Synthetic coding sequence
atgggggctatgacacagttgctggccggcgtgtttctggcctttctcgcactggcgacggaggggggtgttctgaagaaggtcatccgtcacaagcggcagtctggggtgaatgccaccctccccgaggagaatcagcctgtcgtctttaaccacgtgtacaatattaagctgcctgtgggatcacagtgctccgtggacttggaatctgcatccggagagaaggatctagctcctcccagcgagccctctgagagtttccaagaacacactgtcgacggcgaaaatcaaattgtcttcacccacagaattaacatcccacgccgcgcgtgcggctgcgccgctgcccccgacgtcaaggagctgttgtcccgtttagaggaactggagaacttagtcagttccttaagagagcagtgtaccgccggcgcggggtgttgtctccagccagctactggccgtctggacacaagaccgttttgttccggtcggggaaatttttcaacagaaggctgtggctgtgtctgtgagcccgggtggaagggccctaactgctcagaacccgaatgtccagggaattgccacttgaggggaagatgtattgacggacaatgtatctgcgatgacgggttcactggcgaagactgttcgcaactcgcctgtccgagcgattgcaacgatcaaggcaagtgcgtcaatggggtgtgcatttgtttcgagggctacgcgggtgccgattgtagccgagaaatctgcccagtcccttgcagtgaggagcatggaacttgtgtcgacggattgtgtgtgtgtcacgatggattcgccggtgacgactgtaacaaacctctgtgcctcaacaactgctacaacagagggcgatgtgtggagaatgaatgcgtgtgtgatgaaggctttaccggtgaggattgctcagagcttatctgtccgaacgattgtttcgatcggggccgctgtatcaatgggacctgttattgcgaggagggctttaccggagaggactgcggcaaacctacctgtcctcatgcctgccacacccaggggcggtgtgaggagggacagtgcgtgtgcgatgaggggtttgctggggtggactgctcagagaagcggtgtcctgctgattgtcataaccgaggtcggtgcgtcgacggccggtgcgaatgtgacgatggattcactggggccgattgcggtgaactcaagtgccctaatggctgttcaggacatggtaggtgtgtaaatggccagtgtgtatgtgatgaaggctacacgggcgaggactgcagccagctgcggtgtccaaacgactgtcatagcaggggaagatgcgtggaaggaaagtgtgtgtgcgagcagggattcaaaggctatgattgcagcgacatgtcttgtcctaatgactgccaccagcacggacgctgcgttaacgggatgtgcgtctgtgacgatggctataccggggaggactgcagagaccgccagtgtcccagggactgttctaacagaggcctgtgcgtcgacgggcagtgcgtgtgcgaggacggtttcacaggtcccgattgtgcagaattgagttgcccaaatgattgtcacggacagggacgctgtgtcaatgggcagtgtgtgtgccacgagggatttatgggcaaagactgcaaagagcagaggtgtccaagtgattgccacggtcaaggccgctgtgtggatgggcaatgtatttgtcacgagggttttaccggactcgactgtggacagcattcctgtcccagtgattgtaataacttaggccagtgcgtcagcggtagatgcatttgtaacgaagggtacagcggcgaggactgcagtgaagtgtcacctccaaaagatcttgtcgtgactgaggtgaccgaggaaacggtcaatctggcctgggacaacgagatgcgggtgaccgagtacctggttgtctataccccaactcacgaggggggcctcgagatgcaatttcgggtgccaggagaccagacatccaccattattcaggagctggagcccggagtcgagtacttcatcagggttttcgccatattagagaataaaaaatcgattcctgtcagtgcaagagtcgccacctacctacccgcacccgaggggcttaagttcaaatccattaaggagactagcgtggaagtcgaatgggatcctctagacattgcattcgaaacctgggagatcatattcaggaatatgaataaagaggacgaaggagagataacaaaaagcctcagacggcctgaaacgagctaccgacagaccgggctggccccaggccaggaatacgaaattagtctccacatagtaaagaacaatacaagaggacctggactgaaaagggtcaccacaacccgcctagatgcgcccagccaaattgaagttaaggacgtcaccgacaccacggcccttataacttggttcaaacccctggccgagattgatggtatcgagctgacctacggcatcaaagacgtgcccggcgatcgtacaaccatcgacctgacagaggatgagaaccagtatagtatcgggaaccttaagccagataccgagtacgaagtcagcttgatttccaggcggggggatatgtctagtaatccagctaaggagacgttcacgacagggctcgacgcgccgcgaaatcttagaagagtgagccagacagacaatagtatcacattggagtggcgtaacggtaaggccgccatcgattcttataggatcaaatacgcccccatctctggaggtgatcacgccgaggttgacgtgccaaagagtcagcaggcaaccactaagaccacactcacggggttgagaccagggaccgaatatgggattggggtgagcgccgtcaaggaagacaaggagagcaacccggccacgattaacgcggccaccgagcttgacacaccaaaagatttgcaggtaagtgagacagccgagactagcctgacactgctttggaagacccctctggctaagttcgacaggtaccgcttaaattactcactccctacagggcagtgggtgggggtccagctgccccgaaacacgacttcctacgttctccgcggactggagcccggccaggagtacaatgtgctgctgactgcagagaaaggcagacacaaatccaagcctgcccgcgtcaaggcatccaccgccaaggaaccggagatcgggaacttgaatgtgtctgatatcactcctgaatccttcaatttatcctggatggccacagacgggattttcgaaactttcaccatcgagatcatcgattctaaccgtcttctcgaaaccgtcgaatataacatctcgggggccgagaggacagctcacatatccggactcccgcccagcacagacttcattgtgtacctcagcgggttggctccatccatcagaaccaagacaatttctgcaacggccaccacagaaccaaaaccgcagttggggactctgattttctccaatattaccccgaaatcgtttaatatgtcgtggactacccaagctggcctgttcgccaagatcgtgatcaatgtcagtgatgctcatagcctccatgagtcgcagcaattcactgtgtcaggtgatgccaagcaagcccacatcacaggactggtggagaacactgggtacgatgtctctgtcgcgggcactaccctggcaggtgacccaacgcgacctctcactgctttcgtaattacagaggctgaacctgaggtggataatctgctggtcagcgacgccactccagatggctttaggttgtcatggactgcagacgaaggcgtattcgataactttgtactgaagattagagacaccaaaaaacagtcggagcccctggaaatcaccttactggcccccgaacggacccgcgacataactggcctcagagaagcaacagagtatgagatcgaactctacggaatttccaaagggcgccgctcgcaaactgtttcagcgatagcaaccacagctatgggatccccaaaggaagtgattttctctgacattaccgaaaatagcgccaccgtgtcttggcgcgcgccaactgctcaggttgagagcttcagaattacgtacgtccccattaccggcggcacgcccagtatggttaccgttgatggaaccaagacacagaccagactggtgaagctcattcccggggtagaatacctggtgagcatcattgccatgaaaggatttgaggagtcggaaccagtgagtggcagctttacaaccgccctggacggcccctccggacttgtgactgcgaacattaccgacagcgaagcgttggcgaggtggcagccagctatcgctacagttgattcttatgtcatctcttacaccggggagaaggtccctgagattaccagaaccgttagcggaaatactgtggagtacgcccttacagaccttgaacctgctacggaatataccctgcgcatcttcgccgagaaaggccctcaaaaaagcagcaccatcactgctaagtttacaactgatctggactctcctcgagacctaactgctaccgaagtgcagtccgaaaccgcactgctgacatggcgacctccgcgagcctccgtgactggctatctgctggtctacgagagcgtggatgggactgtcaaggaggtgattgtagggcctgatacaacctcatattctctcgccgatctgtccccgtctacccactataccgccaaaattcaggccctgaacgggcctctgcgctcaaacatgattcaaactatcttcacgaccataggactactctatccgtttccaaaagactgctcacaggccatgctgaatggagatactacttccggcctgtacacaatatatttgaacggagataaggctgaggccctggaggttttctgcgatatgaccagcgacggaggcgggtggatcgtctttctgcggaggaaaaacggacgggagaacttttaccagaactggaaggcttacgcggcggggttcggggatcgcagagaggagttctggctgggattggacaatctcaacaaaatcaccgcgcaaggccagtacgaacttcgggtggatctccgggatcatggtgagactgccttcgcagtctatgacaagttcagcgtgggggacgctaaaactaggtataagctaaaagtcgagggctacagtggcactgccggcgactctatggcgtatcacaatggcagaagtttcagcacattcgataaggacacagatagcgccatcaccaattgcgccttatcctacaagggagcattttggtaccgtaattgccacagagtcaatcttatgggccgatatggcgacaacaaccactcgcagggggtcaactggtttcactggaagggccacgaacacagtatacagtttgcggagatgaaactgcgtccttctaattttcgtaatcttgagggcagacggaagcgcgcttag

SEQ ID NO: 137518 - DNA, 4077 bp, Artificial Sequence
  Description of Artificial Sequence: Synthetic coding sequence
atgggcgcggacggagagaccgtcgtgctgaagaacatgctgatcggaataaatcttatcctcttgggcagcatgataaagccatccgagtgccagcttgaggtgaccaccgagcgtgtgcagagacagtctgtggaggaggaggggggcatcgcaaactataataccagcagcaaggaacaaccggtcgtcttcaaccatgtgtacaacatcaacgtgccactcgacaatctctgtagctcgggcctggaagctagcgcagagcaggaggtgagtgcggaggatgaaactctggctgaatacatggggcagacatcagatcatgagtcacaggtcacttttacacaccgtattaatttcccaaagaaggcttgcccttgcgccagcagcgcccaagttctgcaggagcttttgagccgtatcgagatgcttgagcgcgaggtatcagtactgagggaccaatgcaatgccaactgttgccaggagagcgccgctacaggacagttggattacattccccattgtagtggtcacggtaacttcagttttgaatcctgcggctgcatatgcaatgaaggatggttcggaaagaattgctcagagccctactgccctttggggtgcagttctaggggcgtttgcgtcgatggtcagtgtatctgcgattctgagtactcaggagatgactgttcagagttgagatgccctacggactgctcctcacgcggcctctgtgttgatggcgaatgcgtctgcgaagagccatacaccggcgaggattgtcgggaattgcgctgtccgggcgactgttcaggcaagggcaggtgcgccaacggaacttgcttgtgtgaggagggttacgtgggggaggattgcggtcagcgccaatgtctgaatgcgtgttcaggccgtgggcagtgcgaggaggggttatgcgtgtgtgaggaagggtaccaaggccccgattgtagtgcagttgccccccccgaagacctgagagtcgcaggcattagcgacaggagcatcgagctggagtgggatggccctatggcagtgacggaatacgtgatctcttatcagccaacggcgctgggggggcttcaacttcaacagagggtgcctggcgattggtctggtgtgaccatcaccgaactggagccggggctgacctataacatttccgtttatgcagtgataagtaacatattgtccctaccaattaccgccaaagtggccactcacctgtctactccacaggggcttcagtttaagaccattactgaaactacggtggaggtccaatgggagccttttagcttctccttcgacggctgggaaataagtttcatcccaaaaaacaatgaagggggtgtgatcgcgcaggtgccttcagatgtcaccagcttcaaccaaacaggactgaagccaggcgaggagtacatcgtaaatgttgtggcattgaaggagcaggccaggagccctccgactagcgccagcgtgagcactgtaatagatggtccgacgcagatactggtgagagatgtgtcagacaccgtggcattcgtagaatggattcctcctcgtgcaaaggtggatttcatactgctgaagtatgggctggtggggggggaagggggcagaaccaccttccgcctccagcctccactctcccagtattccgtacaggctctgcgtccaggtagcaggtatgaggtctcagtgagcgcagtgcggggcacaaacgagtccgactcggcaactacccagttcacgacggagatcgacgctccaaagaatctgcgagtggggtctcggacggcgacatcgctagacctcgaatgggataactcagaagctgaggtccaggaatacaaggttgtttatagcacattagccggagagcagtatcatgaggtgcttgtgcctcgcggaatcggaccgacaactagggccactttgaccgacttggtgccgggtacggaatacggtgtgggcatttccgctgtgatgaactctcagcagtctgtaccagctacgatgaacgctcgaactgagctcgactcccctcgcgatttaatggtcactgcaagctccgagacctccatctcgcttatttggaccaaggcttcaggccctatcgaccactacaggatcacctttaccccctcaagcggaatcgccagtgaggtaaccgtccccaaagaccgcacttcatataccttgactgatctggagccaggggccgaatatataatctctgtcactgccgaaagagggcggcaacagagtctggagtccaccgtcgacgccttcaccggcttccgccccataagccatctgcacttctctcacgtgactagctccagtgtgaacatcacctggtcagatccttcccctcctgccgatcgcctcattctcaactacagccctagagacgaagaggaggagatgatggaggtcagcctagacgcaacaaagcggcatgctgtcttaatgggtttgcagcccgcaaccgagtatattgtgaacctcgtcgcggtgcacggaaccgtgacatctgagccgatcgtgggctcaatcacaacaggaatagatccccctaaggacatcaccatctcaaacgttacaaaagactccgttatggtctcctggtccccccccgtagcaagctttgattactaccgagtttcttatcggcctacccaggttgggaggctcgactctagcgtcgttccaaataccgtgaccgagttcacaattactcggctaaatcctgccactgagtatgagatctcactgaacagcgtgaggggaagggaggagagcgagcggatatgtactctggtgcataccgcaatggacaaccccgtggacctcatcgccacaaacattacccctacagaagctctgctccagtggaaagctccagttggggaagtcgagaattatgttatcgtgttgacccatttcgctgtcgccggcgaaacaatcttggttgacggagtttcagaggagttccgcttagtggatctcctgccatcgacgcactataccgctacaatgtatgctacaaatggcccactgacaagcgggaccatctccacaaacttttcgacactcctcgacccacctgccaatctgaccgcttccgaggtgaccagacagtcagctctgatctcatggcaaccgccacgcgcagagatagagaactatgtgctgacttacaagtccacagatgggtcacgaaaagaactgatcgtcgacgcagaggacacctggattcgtctcgaagggctactggaaaacaccgattacactgtactgctccaggctgcacaggacaccacgtggtctagtattaccagcacagcctttacaaccgggggtcgcgtgtttcctcatcctcaggactgcgcgcaacatttgatgaatggagacacactctcgggggtatatcccatcttccttaatggggagctctcacagaaacttcaggtctattgcgatatgactacagacggtggtggatggattgtgtttcaaaggagacaaaatgggcagacagacttcttcaggaaatgggctgattatagggtcgggttcgggaacgtcgaggatgaattctggcttggcttggataacatccatcgtatcacgagtcaaggtcgctatgagttgcgagtggatatgcgagacgggcaagaggcagcttttgctagctatgaccgattcagcgtcgaggatagtagaaacctctacaagctgcgcatcgggagctacaatggaaccgccggcgattctcttagttaccaccaagggcgacctttttcaactgaagatcgagacaacgatgtggcagtgaccaactgcgccatgagttacaagggcgcctggtggtataaaaactgccataggaccaacctgaacggaaaatatggagaatccagacacagtcagggcatcaactggtaccactggaaaggtcatgaattctcgatcccctttgtcgaaatgaaaatgaggccttacaaccaccggctgatggccggccggaaacggcagagccttcaattctag

SEQ ID NO: 137519 - DNA, 3807 bp, Artificial Sequence
  Description of Artificial Sequence: Synthetic coding sequence
atgggagccgacggcgagacagttgtcctgaaaaacatgctgatcggtatcaacctgattctcctgggttccatgatcaagccttctgaatgccagctagaagtgaccaccgaaagagttcagaggcagagcgttgaggaagagggtggtattgcaaattacaacactagttctaaagagcagcccgtggtgttcaatcacgtctataatatcaacgtccccctggacaacctatgcagcagcggcctcgaagcaagcgctgagcaggaagtctctgctgaggacgagactctggctgaatatatgggccagacctctgaccatgagtctcaggtgacattcacccacaggattaactttcccaaaaaagcgtgtccctgtgcgtcgtctgcccaggtactccaggaattactctctcgaattgaaatgctggagagggaagtcagcgtactgcgcgatcagtgtaatgctaattgctgtcaggaatccgccgccacaggccaactggattatattccccactgcagcggacacgggaactttagcttcgagtcgtgcgggtgtatctgtaacgaaggatggttcggcaagaactgttctgaaccttattgtcctcttggatgcagctccagaggggtgtgtgtggatggacagtgtatttgtgactccgaatactccggtgatgattgcagtgaactgcggtgtcctacggactgctccagtcgcggcctctgtgtggacggagagtgtgtgtgcgaggagccgtatacgggcgaggattgccgggaactgaggtgtcccggggactgcagtgggaagggtcgctgcgccaatggaacatgcctatgcgaggaaggatatgtgggtgaggattgcggccaacgccaatgtcttaacgcctgctctggccgaggacagtgcgaagagggattatgtgtatgcgaggagggataccagggtcctgattgttccgctgtggccccgccggaagatctaagagtcgcaggcattagcgatcgcagcatcgagctggagtgggatgggccaatggctgtgactgaatacgtgatctcataccagcctactgcgctgggagggcttcaactgcaacagagggtaccgggtgactggagtggggtgactattactgaattggaacccggtctcacgtacaatatttccgtctacgccgtaatctctaatatcttgtcattaccgatcacagctaaagtggccactcacctgagtacgccccagggtctgcagtttaagacaattaccgagaccacagtggaggtccaatgggaacccttctccttcagtttcgacgggtgggagattagttttataccaaagaataacgaggggggggtgatcgcccaggtccctagtgacgtcacttccttcaaccagaccgggctcaaacccggagaggagtatatcgtgaacgtggtggctttgaaagagcaagcacgctcccctcccacatccgccagcgtgtctactgttatagatggacctacgcaaatcttagtgcgggatgtgtcagacactgtggcattcgtggagtggatcccaccacgagccaaagtcgatttcatccttctcaagtatggactcgtcggcggggagggcggtcgcaccacctttcgcttgcagcctccccttagccagtattctgtgcaggctctacggcctggcagtcgctacgaggtaagtgtgagtgctgtgcgcgggacgaacgagtccgacagcgccacaacccaatttacaactgaaatcgacgcaccgaaaaatctgcgcgtggggagtagaaccgccacgtccctcgaccttgagtgggacaactcagaagcagaggtccaggagtataaggtggtctattcgaccttagcgggcgagcagtaccacgaggtactcgtcccccgggggattggccccactactcgagctacactgactgaccttgtccccggcacagaatatggggtcggaatttcggccgtgatgaatagtcagcagtcggtaccagccacaatgaatgctcgaacagagctggatagtccaagggatttgatggtgaccgcttcatcggagacttctatttcactgatctggactaaagcgagcggcccgatcgaccattaccgtatcacatttactcctagcagcggcatcgcgtccgaggtgactgttcccaaggaccgcaccagctacactttgacagacctcgaacccggcgccgagtatataatcagcgtcaccgcagagcgtggccgacagcagtctcttgagtccaccgttgacgccttcacaggcattgaccctcccaaggacattaccattagcaacgttaccaaagattctgtaatggtgagttggtcgccccctgtggcctcttttgactactatcgagtctcttaccggcccacccaggtcggacggctcgacagctccgtggtgccaaatacagtgaccgagttcacaattactcgcctgaacccagctactgaatacgaaataagcctcaattcagttagaggtagggaggaatccgagagaatctgtaccctcgtacataccgctatggataacccagtggatctcattgccaccaatattacaccaactgaagccctcctgcagtggaaggccccagtgggtgaggtggagaattatgtaatcgtgttaactcactttgctgtcgccggagaaacaatcctggtggacggggtttctgaggagtttcgactggtcgatcttctaccctcaactcattataccgctaccatgtatgcaactaatgggccccttaccagcgggacaatctctacgaacttctcaacacttctggacccccctgcaaacttaactgccagtgaagtgacgcggcagtctgcactgattagttggcagccaccccgagccgaaattgagaactacgtgctcacctataagtctaccgacgggtcgcgtaaggagctgatcgtagacgcggaggacacatggatcaggctggaaggtctgctggagaacaccgattataccgttctcctccaggccgcacaggatactacctggtcctccatcaccagcactgccttcacaactggcggccgcgttttcccccatccccaggactgtgcccagcatcttatgaacggcgacacactttctggcgtgtacccgatattcctcaatggcgaattatcccaaaagctgcaggtgtattgtgacatgactaccgatggcgggggttggattgttttccagcgaaggcagaacgggcagactgatttcttccgaaaatgggccgattatcgtgtgggcttcggtaacgtggaggacgagttttggttgggccttgacaatatacaccgcattacctcccaaggtcggtatgaactgcgcgtggatatgcgcgacggacaggaggctgcttttgctagttacgaccggtttagcgtggaggacagcaggaacctgtacaagctacggattggatcttacaacggtactgcaggggactccctgtcctatcatcagggaaggccattttccaccgaagatagagataatgatgttgcagtcacaaattgtgccatgtcctataaaggggcttggtggtataaaaactgccacagaacaaatcttaacgggaagtacggcgagtctcggcacagccagggcatcaattggtaccattggaaaggtcacgagtttagcattccattcgtggaaatgaaaatgcgcccatataatcaccgtctgatggccggcagaaaacggcagagtctacaattttag

SEQ ID NO: 137520 - DNA, 4077 bp, Artificial Sequence
  Description of Artificial Sequence: Synthetic coding sequence
atgggcgccgacggagaaaccgtagtgcttaaaaatatgctgatcggcatcaatcttatcttgctgggatcaatgattaaaccatcagagtgtcaactggaggtgaccaccgagcgtgttcagcgccaatccgtcgaggaggaggggggcatcgccaactataacacctccagtaaagagcagcctgtcgtgtttaatcatgtatacaacattaatgtaccacttgataatctctgttcgtcgggcctggaggcatcagccgaacaggaagtgtcagcagaggacgagacacttgcagagtacatggggcagaccagtgatcacgagtctcaggtcaccttcacacaccggatcaactttcccaagaaagcatgtccctgtgcatccagtgcccaggtgctccaagaactgctttctcgcatagagatgttggagcgagaagtcagtgtccttcgcgaccaatgtaatgctaattgttgtcaggaaagtgccgccactgggcagctggattatatcccccattgttctggacatggtaacttttcattcgagagttgtggctgcatctgcaatgagggatggttcggcaaaaattgctcggagccatattgccctctcgggtgcagttcccggggtgtgtgtgtggacgggcagtgcatctgcgactctgagtacagcggcgatgattgttctgagctgaggtgcccaactgactgttcatcccgaggcctctgtgtagatggggagtgcgtttgcgaggaaccctacactggcgaagattgcagagaactgcggtgccctggggattgctccggtaaaggcaggtgtgctaatggtacatgtctatgtgaggaagggtacgtgggcgaagactgcggccagagacagtgcttaaacgcatgctctggacggggccaatgtgaagaaggactgtgtgtatgtgaagaaggctatcagggcccagactgttccgccgtagcgcccccagaagacctgcgggtggccggcattagtgatcgcagcatcgagttggagtgggacggccccatggccgtcactgaatatgtgatttcgtaccagcctacagccctggggggtctacagttgcagcagagggtacctggagactggtcaggagtgacaattacagaactggaaccagggttgacttacaacatttcagtctatgcggttatatcgaatatcctttctcttcccatcacggctaaggtggctacacacctatcgacacctcaagggctgcagttcaaaacaataacagaaactaccgtggaggtccaatgggagcctttctcatttagttttgacggatgggagatttcattcatacccaaaaacaatgagggaggcgttatcgcccaggtgccctcagacgtcacatcttttaatcagaccgggctcaagccaggggaggaatatatagtgaatgtggtggctttgaaggagcaggcacgatctcccccaacatcagcctccgtttccacagtcatagacgggccgactcagattctggtgcgtgacgtgagcgacactgtagcattcgtggaatggatcccaccacgagctaaagtagatttcatcctcctgaagtacgggttagtgggtggggagggcggaaggactaccttcagactgcaaccacctctctcacagtactctgtacaggctctaaggccaggctctcggtacgaggtgagcgtgtctgccgtaagaggcactaatgagtctgattctgcaactacgcaatttacaactgagatcgatgctcctaagaaccttagggtcgggtcccgcacggccaccagtctagatctcgaatgggataactccgaggcagaagtgcaggagtacaaggttgtctactccacgctggcgggggaacagtaccacgaggtcctcgtacctagaggcatcggccctacaactcgagctaccctgactgacctggtgccagggaccgagtatggagtcggcatatcagctgtgatgaactctcagcaatctgtgcccgcgactatgaatgctaggactgagctggacagcccgagggatctcatggtaactgcctcctccgaaacctccatttctcttatctggaccaaggctagtggccctatcgaccattaccgaataacatttaccccctcatcaggaattgctagcgaagttactgttccgaaagataggacatcctacactctcacagatcttgaaccaggagctgagtacatcatctcagtgacggctgaaagaggccgtcaacagtccttggagtccaccgtagacgccttcacaggattccgtccaatcagccacctgcattttagtcatgtcacctcctcttcagttaacatcacatggtctgatccttcaccccccgcagatagactaatcttgaactattcgcccagggacgaggaggaggagatgatggaagttagcctcgacgcaactaagcggcacgccgtgctgatgggactccaacctgctacagagtacattgtgaatctggtcgcagtccatggtacggtcacaagcgagcccatcgtggggagcatcactacaggcatcgaccctcccaaagatatcaccatcagcaacgttaccaaggactccgtgatggtctcatggagcccacccgtggcctcattcgattactatcgagtgtcttaccgaccaactcaagtggggaggctcgatagctctgtggtgcccaatactgtgacggaattcaccatcactcggcttaatcccgccaccgagtatgaaatttcccttaattcggttagaggacgcgaggagtccgaaagaatctgtaccttagttcacaccgccatggacaatcctgtagatctcatcgctactaacattaccccaaccgaggccctgctccagtggaaagcccccgttggagaagttgaaaactacgtcatcgtgctgacacatttcgcagtggccggtgaaacaatcttggtagacggcgtatccgaggaatttagactcgtggatctactgccatccacacactacacagccactatgtacgccacaaacggccctctgactagcggaaccatttctaccaatttcagcaccctcctcgatccacctgccaatctgacagctagcgaagtgacccgtcagtccgccttgattagctggcagcccccccgggctgaaatagagaattacgttctcacctacaagtcaactgatggttcccgcaaggaactgattgttgatgcagaagatacttggataagactggaggggctgttagagaacactgactacaccgtcctgctccaggcagcccaggacacgacttggagctctataacctctaccgcctttacaaccggcggcagagttttcccacatccacaggattgcgcccaacacttgatgaatggagacacactgagtggagtttatcccattttcctcaacggggaactctcgcaaaagctccaggtctactgcgacatgaccaccgacgggggcggctggatcgtgttccaacgcagacagaacggacagaccgatttttttaggaaatgggccgattaccgcgtcggattcggcaacgtagaagacgagttttggctgggccttgacaatattcatcgcattacctcgcagggccgttatgagctgcgcgtggatatgcgagatggtcaggaagctgcgtttgcctcatacgaccgcttctctgtggaagatagtagaaacctgtacaaactcaggattggatcctacaatgggaccgcaggagacagcctctcctatcatcaagggaggcccttcagtaccgaggatcgggataacgacgtcgccgtcacaaattgcgccatgagttataagggcgcctggtggtataagaattgtcaccgcaccaatctgaatggaaaatacggcgaaagcagacattcacagggaatcaattggtatcactggaagggacacgaattttctatccctttcgtggaaatgaaaatgcgaccgtataaccaccgtctaatggctggtagaaaaagacagtctttacagttctag

SEQ ID NO: 137521 - DNA, 534 bp, Artificial Sequence
  Description of Artificial Sequence: Synthetic coding sequence
tagatcaacttccctaagaaagcttgcccttgcgccagttctgcacaggtgctccaagagttgttatcaagaatcgagatgttggagcgagaagtctctgttctgcgggatcagtgcaacgctaactgctgccaggagtctgccgccacggtggctccccctgaggatcttcgggttgcgggcatctcagatcgctcgattgaactggagtgggatggtccaatggccgtcaccgagtacgtgatctcctaccagcccacggctctgggggggctgcaactgcagcaacgggtaccgggcgactggagcggagtcactatcactgagctcgagcccggactgacctataacatctccgtttacgcagtgatctcgaacattctctcccttcccatcaccgccaaggtggcaactcacctgagcactcctcaggggctccagttcaagaccattactgaaaccacagtagaagtgcagtgggaacccttctccttctcctttgacggctgggaaattagctttataccgaaatag

SEQ ID NO: 137522 - DNA, 12669 bp, Artificial Sequence
  Description of Artificial Sequence: Synthetic coding sequence
atgatgccagcacagtacgctttaacctcctctctggttctgctcgtcctattgagcacggctagggctggccctttttctagcaggtctaacgtgacactaccagcccctaggccccccccccaaccaggtggccatacagtcggagccggagtgggctctccgtccagccaattatatgagcacaccgtggaaggaggcgaaaaacaagttgtcttcacacatcgcatcaacctcccaccctccaccggatgtggctgcccacctgggacggaacccccagtgctggcttcggaggttcaggcactgcgggtccgactcgagatcctggaggaactggtgaaggggttgaaagagcaatgtacggggggctgctgtccagcaagtgcacaggctggaacagggcagaccgacgttaggaccctgtgctccctacacggagtattcgatcttagcagatgcacttgtagctgtgagccaggctggggagggcctacatgtagcgaccctacagatgccgaaataccaccttcatcacctccaagtgcaagtggaagctgccccgatgactgcaacgatcagggacgctgcgtgcgcggacgctgcgtctgctttccaggctacaccggccctagctgcggatggcctagctgtcccggtgactgtcagggtagggggagatgtgtacagggagtgtgtgtgtgtcgtgccggcttctccgggccagattgtagccaacggagctgccccagggggtgctcccagcgaggtcggtgtgaaggcggcaggtgcgtgtgcgatcctgggtacacaggagacgattgcggtatgcgctcctgtccgaggggatgctctcaacggggccgatgcgaaaatggtcgctgcgtgtgtaatccagggtatgcaggcgaggattgcggtgtcagaagctgcccccgcggctgctctcagcgaggccgctgtaaagacgggcggtgcgtgtgtgaccccggctacaccggcgaggattgtggaactcgttcatgcccctgggactgtggagaagggggccgctgtgtggatggtcggtgcgtttgttggcccggctacaccggggaggactgttctacccgtacctgtccaagggattgtagagggcgcggcagatgtgaggacggcgaatgcatttgcgataccggctattccggcgacgattgtggggtacggtcgtgcccgggcgactgtaatcagagaggtcgttgcgaggacggacgatgtgtctgctggcccgggtatactggcacggattgtggcagccgagcatgtcctagagactgtcgtgggagggggaggtgtgaaaatggggtttgcgtttgtaacgctgggtattccggcgaagattgtggagtgagatcttgccccggtgattgcagaggccgggggaggtgcgagtctggacgatgcatgtgctggcctggatacactgggcgggactgtggtacccgggcctgcccaggtgattgtcgggggcggggccgctgcgtggatgggcggtgcgtgtgcaaccccggcttcaccggagaggactgcggctcccgaagatgccctggtgactgccgaggccacggtctgtgcgaagatggtgtctgcgtgtgtgacgcaggctactccggcgaggactgctcaacacgttcctgccctgggggatgcaggggacgaggacagtgtctcgacgggcgatgtgtctgcgaagacggctacagcggcgaagactgcggcgtccgtcaatgccctaacgattgcagccagcacggagtttgccaggatggagtgtgcatttgttgggagggatatgtgtctgaggactgtagcatcaggacctgcccctccaactgccatggtagggggaggtgcgaggaggggagatgcctgtgtgacccaggctacacaggacctacatgcgcaacaagaatgtgcccagctgattgcagaggcaggggcaggtgtgtccagggtgtctgcctctgccatgtgggctacggtggggaggactgtggccaggaagaaccgcccgcctccgcttgccccggtggctgcggtccgagagaactgtgccgcgcgggacaatgcgtgtgtgtggaaggcttccgcgggccagattgcgccattcagacctgtcctggcgattgccgcggcagaggagagtgccacgacggctcatgtgtatgtaaagatggttatgccggagaagattgcggcgaggaggtccccactatcgaaggcatgcgcatgcacctgctcgaggagaccactgtgagaaccgagtggacaccggctccagggccagtggatgcttatgaaatccagtttatacctacgacagaaggggcctcccccccatttacagccagggtaccgagtagtgccagcgcgtacgatcagcgcggacttgccccggggcaggaataccaggttaccgtgagagcgctgagggggactagctggggcctccccgccagcaagaccatcaccacaatgatagatggcccccaagatttgcgggtggtggctgttaccccaaccacccttgaactgggatggcttagacctcaggcagaggtagatcgctttgttgtgtcctatgtgagtgccggaaaccagagagtgcgactagaagttcctcctgaggcagatggaacactgctcacagaccttatgcctggagttgagtacgtggtgaccgtcactgccgagagaggtcgggccgtcagctatccagctagcgtccgcgctaacacaggaagctccccactcggactacttgggaccaccgatgagccccctcccagcggaccgagtactacccagggagcccaggctcctctgttacagcagcgtccacaagaactcggagaacttcgtgtgcttggaagggacgaaaccggtcgccttcgcgtggtatggacagcacaaccagataccttcgcctacttccagttgagaatgagggtgccagagggaccgggggcccacgaagaagtcctgccaggtgacgttcgccaggcattggtgcctccccccccaccaggcaccccctacgaattgtctctgcacggagtccctccgggaggaaaacctagcgaccccatcatctaccaggggatcatggataaggatgaggagaaacctgggaagtcctctggaccaccacgcctgggtgagttgacagttaccgatcgtacatccgactctctcctattgcgttggactgtgcccgaaggtgagttcgacagctttgtcattcagtacaaggacagggacggccaaccacaagtagtccccgtcgagggcccgcagcgtagtgcagtcattacatcactcgatcccggacggaagtacaagttcgtgctgtacggattcgtaggcaaaaaacggcacggtccactagtggcagaggccaaaattctcccccagagcgacccatcccccggcacccctccacacctgggaaatctgtgggtgactgaccctaccccggattccctgcacttgtcatggactgtgccagagggtcagtttgataccttcatggttcaataccgcgacagagacggccgtcctcaagtcgtgcctgtcgagggtccggagcgctctttcgtcgtttcctcacttgatcctgaccacaagtataggttcaccctgttcggcatcgccaataaaaaaaggtacggaccgctgaccgccgatggcacaaccgcccccgaacgaaaagaagagcctcctcgtcccgaattcttggaacagcccctgctgggcgaattaacggtaacaggggtgaccccagactccctgagactcagctggacagtagcgcagggcccgttcgactccttcatggtccagtataaagacgcccagggacaaccccaggctgtgccagtggcaggagacgagaacgaagtgacggtccctggtctggacccggatcgaaagtacaagatgaatctgtatggacttcgcggcagacagcgtgtggggcctgagtccgtggttgctaaaacagccccacaggaggacgtagacgagactccctcccccaccgagctagggacggaagctccagagagcccagaagagcccctcctgggagagctgaccgtgacggggtccagccccgactcattgagcttgttttggaccgtgcctcaagggtcttttgacagctttacagtgcagtacaaagaccgcgacggtcggccacgtgccgtgcgggttgggggtaaagagtcggaagttactgtggggggcctcgagccaggacacaaatacaagatgcacctctacggactccacgaaggtcagagagttggaccggtcagcgctgtgggcgtcactgctccacagcaggaagaaaccccacctgccaccgagtcacctctcgaacccagactgggggaacttaccgtcacagatgtcacccccaacagcgtggggctctcttggactgtcccagaggggcaatttgattccttcatcgtgcagtataaagataaagacggacagccccaggtggttccagtcgccgcagatcagcgtgaggttaccgtttataacctggaacctgaacgcaagtataaaatgaacatgtacggcctccacgatggacagcggatgggaccactctcagtcgtaatagtgactgccccgctgccgccagcccccgctacagaggcatccaaacctccactggaaccccggctaggtgagctgacggtcacagacatcactccagattcagtgggattgagttggacagttcccgagggagaatttgactctttcgtggttcaatataaggatcgggacggccaaccacaggtggtgcctgttgcggccgaccagagagaggtgacgattccagatctggagccgagccggaagtataaatttctcttgttcggaatccaggacggaaaaaggagatcaccggtgtccgtggaagcaaagaccgtagcacgtggcgacgcttctccaggcgcacctccacgcctcggcgaactatgggtcactgaccccaccccagactctctgcgattgtcctggaccgtccctgaggggcagtttgatagcttcgtcgtgcaattcaaggacaaagatggcccacaggtggtgccagtagaggggcacgagcggagcgtcaccgtgacccccctagatgctggtagaaagtatcggttcttgctatacggactgctgggaaagaagcgccacggcccactgactgcggacggaaccacagaagcaaggagcgcgatggacgatacagggactaaaagaccacccaagccccgactaggggaggaactgcaagtaacgactgtcacccagaatagcgtagggttgtcatggaccgtgcccgaggggcagttcgactcatttgtcgtgcagtataaggaccgcgatggtcagccccaagttgtccccgttgagggcagcctgcgtgaagtctctgtccctggcttagaccctgcccaccgctataagctgttgctctatggcttgcatcacggcaagagagtgggccctatcagcgccgttgccatcactgccggccgggaggaaactgagactgaaaccactgcacctacccctccggcaccagagccccacctgggtgagctcactgttgaggaggcaaccagtcacacccttcacttaagttggatggttacggaaggtgagtttgatagtttcgaaatccaatataccgaccgagacggacagctgcagatggtgcgaatcggcggcgatcgcaatgatatcacactttcaggtctcgagagcgaccacagatacctggtcacactttacggattcagcgacggtaagcacgtgggtcctgttcatgtggaggccttgacagttcctgaagaagaaaagccaagtgaaccaccaacggctactccggaacctccaatcaagccgcgactgggtgagctcacagtgaccgacgccacaccagattcattgtctctaagctggaccgtgcctgagggacagttcgaccatttcctggtgcagtaccgcaatggagatgggcagccaaaagctgtgcgcgtgccaggacacgaggagggagtcaccatttctggactggagcctgaccataagtacaaaatgaacctgtatggtttccacggggggcagcgcatggggcccgtgtccgtggtgggcgtgaccgccgccgaagaggaaactccctcccctaccgaacccagtatggaggcacccgaacccgctgaggaaccactgctgggggagctgactgtcaccgggtccagtcccgacagcctgagcttgagttggaccgtgccacagggacgcttcgactccttcacggtccagtataaagaccgggacggaagaccccaggtggtaagggtggggggcgaggaaagtgaggtgacagttggcggattagaaccagggcggaagtacaagatgcacctgtacgggttgcacgaggggcgccgcgtgggacctgtatcagccgtgggggttaccgcgccagaggaggaatcccctgacgcccctcttgccaagttgaggctcggacagatgaccgtgcgcgatatcacctcagactctttatccctcagctggacagtgccagaaggacagtttgaccactttctcgttcagttcaagaacggagatgggcaacccaaggccgttcgggtcccgggccacgaggacggagtgaccatatcgggtttggagcctgaccataagtacaagatgaatctgtatggatttcacggagggcagcgcgtgggtcctgtctctgccgtcggtctgaccgctcccgggaaagatgaagagatggctccagcatccaccgaaccacccacacccgagcccccaattaagccaaggttggaggagctgactgtgaccgacgcgacgcccgattcactttcactgtcctggaccgtgcctgaaggccaattcgatcatttccttgtgcagtataaaaacggcgacggacagccaaaagcgaccagagttcctggacatgaggatcgggtgactatctctgggctggagcccgacaataaatacaagatgaatttatatggcttccacggaggccagagagtcggcccagttagtgccataggtgtcacagccgctgaagaagagactccatcccccactgagccgtctatggaggcacctgagccccctgaagagcctcttctgggcgaacttaccgtcacggggtcaagccctgactcactttcattatcttggaccgtgccccagggcaggtttgacagtttcactgttcagtacaaagacagggacggcagaccccaggttgtgagagtcgggggggaagagagtgaggtcactgtcggggggctggagccgggccgcaaatacaaaatgcacctgtatggactccatgaggggagacgagtgggacccgtgtccacagtgggtgtgaccgcgccacaggaggacgtggacgagacacccagtccgacggagcccgggaccgaagccccagaaccgcccgaagaaccactgttgggcgagttaactgtcaccgggagttcgcccgactccttgtctttgtcttggacggtaccacagggtagattcgattcctttaccgtgcagtacaaggaccgggacggccggccgcaggccgtgcgggtgggaggccaggagtccaaggtgacggtgaggggccttgagccagggaggaaatataaaatgcacttatatgggctgcacgagggccgccgcctcgggcctgtcagtgctgtcggcgtaaccgaggacgaggcggagaccacacaggccgtaccaacaatgacacctgagcccccaataaagccaagacttggagaattaacaatgacagatgcaacgcccgactctcttagcctgtcctggacggtgcccgaaggccaattcgatcacttcctggtgcagtaccggaacggggacggtcagcctaaagccgtgagggttccaggacacgaggatggagttaccattagcgggctcgaaccagatcacaagtataagatgaatctgtatggctttcatgggggccagagggtgggtccgatctcagttatcggggtcaccgccgcagaggaggagaccccatcaccaacagagctgagcaccgaagcacctgaaccaccagaggagcctctgctgggagaactgaccgtcactggttctagccctgatagcttgtccctatcatggacgattcctcagggacatttcgacagcttcacggtgcagtataaagatcgggacgggcgcccccaggtgatgcgggtgcgcggcgaggagtccgaagtgactgtcgggggacttgaacccggacgcaagtacaaaatgcacttatacggcctgcatgaaggtagacgcgttggacctgtcagtaccgtgggcgtgactgtcccaaccactacccctgaacctcctaataagcccaggctgggagaactaactgtcaccgatgctactcccgacagcctttccctctcctggatggtgcccgaaggccagtttgatcattttctggttcagtataggaatggcgacggacagcccaaggtagtgagggtaccaggacacgaagatggagtgacaatatcaggtctggagcccgatcacaaatacaaaatgaacctctacgggtttcatgggggccagcgcgtgggccctatctccgtaatcggggtaactgcggccgaggaagagacgcctgctcctacggagcctagcaccgaggccccagagcctcctgaagaacccctgctgggcgagttaactgtcactggaagcagccccgacagtttgtccctgagctggacgataccccagggcagattcgattcatttactgttcaatataaagacagagatggcagaccccaggtggttcgagtgcgaggcgaggaaagcgaagtgactgtcggaggattggaacctggttgtaagtataaaatgcatctgtacggcctccatgagggccaacgggtggggcccgtgtcagcagtcggggtgaccgtacccaccatgactccagagccccccatcaagccgcgcctcggagagttaacagtcacggatgccaccccagattctctgtcattatcatggatggttcctgaagggcaatttgaccattttttggttcagtatagaaatggcgatgggcagcctaaagctgttagagtaccaggacatgaagatggcgtgaccataagtgggctggagcccgatcataagtataaaatgaatctgtatggcttccacggaggccaaagagtgggtcccgttagtgcaattggggtaactgaggaggagacaccaagtccaacggaaccctccacagaggccccggaggctccagaagagcccctccttggtgaactgacagttactggtagttcacctgattcactgagcctgtcctggacagttccccagggcaggttcgactcttttactgtgcaatacaaggatcgcgatgggcaaccacaggtagtgagggtgcgaggggaagagagtgaggtgaccgtgggcgggctggaacccggacggaaatacaaaatgcacctctacggcctgcatgagggccagcgtgttggtccagtgtcgaccgtgggaatcactgcacctctaccaactccgctccccgtggagcctagactcggcgagttggcagtggctgccgttaccagtgattccgttggactttcatggacagtagcccaggggccgttcgattcgtttctggtgcagtaccgggatgctcaagggcagcctcaggcagtgcctgtttcaggagacctgagggcggtagctgtgagcggtttagacccagctagaaagtacaagtttttactatttggtttgcagaacgggaagagacacggtcccgtccctgttgaagcccggacagccccagacacaaaacccagtcctagattgggggaactaaccgtgacggatgctactccagacagtgtcggattgtcttggacagtgccagagggagaatttgacagttttgtggtgcagtacaaagacaaagatgggagactgcaggtcgtccctgtagccgctaatcagagggaggtaactgttcaaggcctcgaaccctcgaggaaatatagattccttctgtacgggctttctggtagaaagcgtttggggcctatctctgcagattccaccacggctcccctggagaaggaactgcctcctcacctcggggagctcactgtggccgaggagactagctcatctctccggttaagctggactgtggcccaagggccctttgattccttcgtagtccaatacagggacaccgacgggcagccccgggctgtgcctgtggctgccgatcagaggactgtcactgtggaggatctggagcctggaaagaagtataagttcttattatacggtcttcttggaggcaaaaggttgggcccagtctcggctctgggcatgaccgccccggaggaggacactccagcccccgaacttgcgcccgaagcccctgaaccgccagaagaacctcggcttggcgtgctgacagtgacagacacaacacccgatagtatgagactgagctggagtgtggctcaagggccattcgacagttttgtagtgcaatatgaagacacaaacggacaaccccaggccctgctggtcgatggagatcagtcaaagattttaatttccggccttgagccttcaaccccctaccggttcctgctgtacggactccacgaaggaaaacgcttaggccccctttcagcagaaggaaccactggtctggcacccgccgggcaaacaagtgaggaatctagaccaaggctctctcagctgagcgtgacagacgtgaccacctcaagtttgagattgaattgggaggcccccccaggtgccttcgacagctttctgctgaggttcggcgtgccatctccttcgaccctcgagccgcatcccaggcccctgctgcagagagagctgatggtgcccggtacgcgtcacagtgcagtgttgcgggacctcaggtctggcactctttatagcctgacattatatggactgagaggacctcataaggcagattccatccagggaacagcccgaactctgagtcctgttctggaatctcctcgggaccttcagttctccgagattcgcgagacatctgcaaaagtgaattggatgcctccacccagtcgtgctgacagcttcaaagtgagctaccagctggctgatgggggcgaaccgcagtcagtgcaggttgacggccaggcgcgcacccagaaactgcaaggacttattccaggcgctagatacgaggtcactgtggtgtcagtcaggggattcgaggaaagtgaacccctgaccggcttcttaacaacagtgcccgatggccccactcaattgcgggctctgaacctaaccgagggttttgctgtgctgcactggaaacctcctcagaaccccgtcgacacttatgacgttcaagtaaccgcacctggggccccgcccttacaagccgagacacctgggtctgctgtcgactaccctctccatgatctggtcctgcacacgaactataccgctactgttcgtgggctccggggacctaacctgacaagccccgcatccatcacgtttactaccggcctcgaagctccacgtgacctggaggctaaggaggttacccctaggaccgccctgctgacctggaccgaaccacctgtgagaccagccgggtatctcttaagtttccacacacccggcggccagaaccaggagattctcttacccggcggcattacatcccaccagctattgggtctgttcccatccacgtcttataatgcacgcctgcaggctatgtggggtcagtcgctgcttcctcccgtatcaacttcatttacgaccggcgggctcaggatccccttccctcgcgactgtggggaagagatgcagaatggcgctggagcgtcacgcacctcaacaatctttctaaacggtaatagggagcgccctctaaatgtgttttgcgacatggaaacagacggagggggttggttggttttccagagacggatggatggacagacagatttctggagggattgggaagattatgcccacggttttggcaatatctccggcgaattttggctcgggaatgaagcactgcattcactgactcaggcaggagactactctatgcgcgtagatctgagagcaggcgatgaagcagtgttcgcccagtacgattcttttcacgtggactctgcggcagaatactacaggttgcaccttgaggggtaccatggcaccgctggggacagcatgtcatatcattcgggcagtgtgtttagcgcgagggaccgggaccccaactcattgctgatttcatgtgctgtcagctatcgtggagcttggtggtatagaaattgtcactatgccaatttgaacggcctttatgggtccactgtcgatcaccagggtgtcagttggtaccactggaagggctttgagtttagcgtgccattcaccgaaatgaagctgcgtccccggaattttcgttccccagctggagggggctag

SEQ ID NO: 137523 - DNA, 6450 bp, Artificial Sequence
  Description of Artificial Sequence: Synthetic coding sequence
taggctgaagaagaaacaccctcaccaacagagcccagcatggaggccccagaaccggccgaggagcctctcctgggagaattgaccgtcacaggatcctctcctgactccctgtctctgtcgtggacggttccccaggggcggttcgatagcttcacagttcaatacaaggaccgggacggtagaccccaagtggtgagggtcggaggggaggagagtgaagtgaccgtgggaggcttagagccaggaagaaagtacaaaatgcatttatatgggttacatgagggcaggcgcgtgggtccggtcagcgctgtaggtgtgacggcacctgaggaggagtctccagacgcccctctggccaagctcaggctagggcaaatgaccgtgcgggacataactagtgattcgctgtctctgagttggaccgtgcccgaggggcagtttgatcattttctggtgcagttcaaaaatggcgacgggcagcccaaggctgtgcgggtccctggtcacgaggacggcgtaacaatctcaggccttgaacccgatcataagtataaaatgaacttgtatgggtttcacggcgggcaacgtgttggccctgtgagcgcagtcggcttgacggcacctggcaaggatgaggaaatggccccggcgagtacagagccacccactcccgagccgcctattaagccacgtttggaagaattaactgtgactgacgctacaccggattcactgagcctctcctggactgtgcctgagggacagttcgaccatttcctggtgcagtataagaatggggacggacaacccaaagccacccgggtccccggccatgaagacagggtgacaattagtggtctggaacctgacaacaagtacaaaatgaacctgtacggctttcacggcgggcagagggttggtcctgtgtccgccataggcgtgaccgcagctgaggaggagactcctagccccacggagccaagcatggaagcccctgaacctcccgaggaaccactcttaggcgagttaacagtgaccggaagcagccccgactcattatcactttcttggaccgttccccagggacgttttgacagtttcacagttcagtacaaggatagggacgggagacctcaggtggttcgtgtggggggggaggagagcgaggtcacagtgggcggcctcgaacctggccgcaagtacaagatgcacctctacggacttcatgagggtcgaagagtcggaccagtgtccacagtgggcgtcactgctccccaggaggatgttgacgaaacaccaagccctactgagcctggtactgaagctcctgaacctcccgaggaaccacttctgggagagttgactgtgaccggatctagtcccgacagccttagcctcagctggaccgtgccccaagggagattcgattctttcaccgtccagtataaggatagagatggcaggccccaggcggttcgagtcgggggtcaggagtcaaaagttacagtcagagggctggaaccgggaaggaaatataagatgcacctctacggactgcacgagggacggagactgggccctgtgagtgctgttggcgtcacagaggatgaagcagaaactactcaagctgtgcccactatgacccctgagccaccgattaagcccagactcggggagttgaccatgaccgacgcgacccccgactccctctcactgtcttggactgttccagaaggacaattcgaccacttcctggtacagtacaggaacggagacggccagccgaaggcggttcgggtgccgggacacgaagacggtgtgaccatctctggactggaacctgaccacaaatataagatgaatctctacggcttccatggtggtcagcgtgtgggcccaatctctgtcacaggcgtgacggctgccgaggaggagactccctccccaacagaactgtccacagaagcaccagagccaccggaagaaccactgctgggagagctgacagtgaccgggtcctccccggattctctctccctttcttggacgataccacagggccactttgatagttttacagtgcaatacaaagatagggatggacgcccccaggtgatgagggtacgaggtgaggaatcagaggtaacagtggggggactcgagcccggacggaaatacaagatgcacctgtatgggttgcacgaaggccgtcgcgtgggtcctgtgagtaccgtgggggtgacagtccctaccacgacacccgagccacctaacaagcctcggcttggggaactcaccgtcacggacgctacaccagactccttgtcgctgtcatggatggtgcccgagggccagttcgatcattttttggtccaatacagaaatggagacggccaaccaaaggtagtgcgagtacccgggcatgaggatggtgtcactatatctggactggagccagaccataagtacaagatgaacttatacggtttccatggcggccagagggttgggccgataagcgtgatcggggtgactgcagccgaagaagagacccctgcccctacagaaccatctaccgaggctcctgaaccgcccgaagaacctttgctgggtgagttaacagtgaccggaagtagcccggatagcctgtctttgagctggactataccacaaggaaggttcgatagcttcaccgtccagtacaaagaccgtgatgggagaccacaggtggtacgtgtccgcggtgaggagtctgaggtgactgtaggtggcttagaacccgggtgcaagtataagatgcatctgtacgggctgcacgaggggcagcgggtcggcccggtgagcgccgtgggtgtgactgtgcctacaatgacaccagaaccccccattaaaccccgtcttggcgaactgaccgtgacggacgcgactcccgattcactcagtctatcgtggatggtaccagagggacagtttgatcacttcctcgtgcaatacaggaacggagacggacagcccaaggccgtcagggtgcccgggcatgaggatggagtgacaataagtgggttggaacctgatcacaagtacaagatgaacctgtatggatttcacggtggacagcgcgttggacctgtctctgccatcggggtcaccgaggaagagacgccatcacctaccgagccaagtacagaggcccccgaggcacccgaagaaccccttttaggtgaactgactgtaacaggctcctcccccgatagcttgtcactgagttggacagtcccccaggggcgcttcgattcgttcactgtgcagtacaaagaccgagacgggcaaccccaagtggttcgcgtgagaggtgaagagagcgaagtgaccgtggggggtctggagcccggaaggaagtacaagatgcacctgtacgggctgcatgaaggccaacgggtgggtcccgtgtcaaccgttggcattacagcccccctgcccacacccctgcctgtggaacctaggctgggtgaactcgccgtggcagcagtgacctccgattcagtcggcttgtcttggactgtcgcccagggaccctttgactcctttctggtccaatatcgggacgcccagggacaaccgcaagctgtgccggtgtcaggtgacctgagggcagtggcagtgtcagggctcgaccctgcaagaaagtataaatttctgctctttggtctgcagaatggaaaacgacatggccccgttcccgtcgaggccaggacggcacccgacacaaagcctagcccgcggctgggcgagctcacggtcactgacgccacaccagactcagtcggcctctcttggacagttcctgaaggggagttcgacagctttgttgtacagtataaagataaggacggtagactgcaggtggtccctgtcgcggccaaccagagggaagtcacagttcaaggcctcgaaccctctcggaagtatcgtttcttgctgtatgggttgtcggggcggaagcgactcggacctatctctgccgactccacaacagccccactcgaaaaggaactcccaccccacctcggcgaactgactgtcgcagaggagacctcatccagcttacgcctcagttggacagttgcacaaggaccttttgatagctttgtggtgcaataccgggataccgatgggcagccccgtgctgtccccgtcgcagccgaccagcggactgtcactgtcgaggatctcgagcccggtaagaaatacaagtttctgctctacggcttgctaggtgggaagcggcttggacctgtctccgctctggggatgaccgccccagaggaagatacccccgcaccggagctcgctccagaagcgcccgagcctccagaagagccacgcctcggcgtcctcacggttacagacactacccccgactcaatgaggttatcttggtctgtcgcccaggggcccttcgattcttttgtggtccaatacgaagataccaacggacagccccaagcactacttgttgatggagaccaatcaaagatcctgatttcaggcctcgaaccgtccacaccctatcgctttttgctgtacggcctgcacgagggaaagcgcctcggccctctgagtgcggaggggactactggcctcgcaccagccggacagacttccgaggaatcacggccccgcctcagccaactctcagtcacggatgtcacaacatccagtctacggttgaattgggaggccccccctggagcattcgatagctttctgcttcgatttggagtgccctctcccagtactctggaacctcacccgaggcccttactgcagcgagagttgatggtgccgggcacgcgccattcagctgtgctgcgggacctgcgttccggtacactgtacagcctaacactttatggattaagaggacctcataaagcagattccattcagggcacggcgcgtacattgtcacccgtgttggagtctccgagagacctgcagttcagcgaaattcgtgaaacgagtgcaaaagtgaactggatgccaccaccttcacgagcagattcctttaaagtgtcgtatcaactggcagatggcggagaaccacagtctgtacaggtcgacggccaagcaagaacgcagaaactgcaagggcttattccaggtgctaggtatgaggttaccgtggtgtcagtacgaggtttcgaggaatcggagcctttgaccgggttcctgactacagtgccggatggtcctacacagttaagggccctgaatttgacggaaggattcgccgtacttcattggaagcccccccagaacccggtcgacacatacgacatccaggtgaccgcccctggtgccccacccctgcaggcagaaacccctggctcagccgttgattatcccctacacgacctggttcttcacacaaattatacagcaactgtccgagggcttcggggtcctaacctcacttccccagcatccatcacatttaccaccgggctcgaggcccccagggatttggaggccaaagaggtcacaccaagaaccgccctcctgacatggactgagcctccagtgaggcccgctggctatctgctgagctttcacactccaggtggccagacccaagagatcttgctccctggagggattacatctcatcagcttctggggctgtttccatctacatcctataatgccagacttcaggcaatgtggggccagtctctgctccctcccgtctctacctcatttacaacaggtggccttagaatcccattcccgcgcgattgcggggaagagatgcagaacggtgcaggagcatcaaggactagcaccatctttttgaacgggaaccgtgagaggccactgatcgtgttttgtgacatggagacagatgggggcgggtggttggtctttcagcgtcgcatggatgggcagacggatttctggagagactgggaggactacgctcatggtttcggaaacatcagcggggagttctggctcggcaatgaggccctacattcactgactcaggcgggcgactactccatgcgcgtcgacttgcgtgctggtgatgaggcggttttcgcccagtacgacagtttccacgtggatagtgccgccgagtattatcgtttgcacctggaagggtaccacggaaccgccggtgactccatgtcttaccatagcggctctgtctttagcgcccgggaccgggatcccaacagcttactcataagttgcgctgtcagctatcgaggagcttggtggtataggaattgtcattatgctaaccttaacggcctgtatgggagcaccgttgaccatcaaggagtatcctggtaccattggaaaggctttgagttttccgtaccattcacagagatgaagttgagacccaggaatttccgttcgcctgccggcggcggttag

SEQ ID NO: 137524 - DNA, 27 bp, Artificial Sequence
  Description of Artificial Sequence: Synthetic coding sequence
atgatgcccgctcagtatgccctgtag

SEQ ID NO: 137525 - DNA, 27 bp, Artificial Sequence
  Description of Artificial Sequence: Synthetic coding sequence
atgatgcctgcccagtacgccctttag

SEQ ID NO: 137526 - DNA, 9891 bp, Artificial Sequence
  Description of Artificial Sequence: Synthetic coding sequence
tgatcttcaccactgggattactggggactacggacgaaccacctccatccggcccgagtaccacccaaggtgcccaggccccactgctccagcagaggccacaggaactcggggagctgagggtactcggaagagacgaaacgggcaggctgagagtggtgtggaccgcgcagccagatacgttcgcctatttccagttacgcatgagggtgccagaaggacctggcgcccatgaggaggtcctacctggcgacgttaggcaggcactagtaccgccgcctcctccggggacaccctacgagctatcattgcacggggtgcctcccgggggtaagccaagtgaccccatcatatatcaggggatcatggacaaagacgaagagaaacccggaaagtccagcgggcctccccgtctaggggaactcactgtcacagatcggacatccgactctctcttgctccgctggactgtgcccgagggagaatttgattctttcgtcatccagtataaagaccgcgatgggcagccccaagtggtgcctgtagaggggccacagcggtcagctgtgatcaccagtctcgaccccggcaggaagtataagtttgtgctttacggcttcgttggcaaaaaacgtcacggacctctggtagctgaggctaaaatcctgccacagagtgacccatcacctgggacccctccccatctgggcaacttgtgggttactgacccaactcccgactcattacacttgtcctggaccgtgcccgaagggcagtttgataccttcatggttcagtaccgcgatagggacggcaggcctcaggtggtcccagtagagggtccagagagatctttcgtggtgtctagtctcgacccagatcacaagtataggtttactctttttggaatcgctaacaagaaacgctatgggcccctgaccgcagacggcactacggcacctgagcgcaaagaggagcctcctagacctgagtttctggaacaaccccttctcggggagcttactgttacaggcgttactcccgattccctgcgtctaagttggaccgtagctcagggtccctttgattcttttatggtccagtacaaggatgcacagggccagccccaggctgtacctgtcgccggcgatgaaaatgaagtcaccgttcctggactcgacccagacagaaagtataagatgaacctctatggactgcgggggcgacagagagtggggcccgaatcagtggtggcaaaaacagcccctcaggaggatgtggacgaaaccccgtcacctactgagctgggtaccgaggccccggaatcgccagaagaacctcttcttggagagttgactgttaccgggagtagccccgatagtctgagccttttctggaccgttccacagggttcattcgatagttttaccgtgcagtacaaggatcgggacgggcgtccccaggctgtgcgcgtgggcgggaaggaatctgaggtgacagtggggggattggaacctggacataagtataagatgcacctctatggtctccacgagggacagcgggtgggcccagtctccgcggtgggtgtcacggctccacagcaggaggaaacacccccagccactgaaagccccttagagccgcggcttggcgagcttacagttaccgatgtcacgcctaactccgttggcttaagttggacagtccctgaaggccaattcgatagtttcattgtgcaatacaaagacaaagacggccagccccaagtggttccggtggccgctgatcaacgtgaggtgaccgtttataatcttgagcctgaacgaaagtacaagatgaacatgtacggcctccacgacggacagagaatgggtcctcttagcgtggtgattgtgacagctcccttgcccccggcacctgcaaccgaggccagtaagcctccactggaaccccgcctgggcgaactgacagtgactgacattacacccgattctgttggccttagttggaccgtgccagaaggcgaatttgacagttttgtggtacagtacaaagatcgagatggacagcctcaggtggtcccagtggctgctgaccaacgggaagttactattccggacttggagccaagccgtaaatataagtttcttctgttcgggatccaggacgggaaacgccggtcccctgtgagtgtcgaagcgaagaccgtggcccggggcgacgccagcccaggcgcaccgcctcgcctcggtgagctctgggtgaccgatccgactccggattcactcagactttcctggaccgtccccgaagggcaattcgacagctttgtagtacagtttaaagacaaagatgggccccaggtggtcccggtggaggggcacgaaaggtccgtgaccgtcacacctctcgatgctggcaggaaatacagattcctgttgtatggtttattgggaaaaaagaggcatggaccattgaccgccgacggcacaaccgaggcccggtccgccatggacgataccggtacaaaaaggcccccaaaaccacggcttggtgaggagcttcaggtgacaacagtgacccagaattccgtgggcttgagctggaccgtgcctgaagggcaatttgattccttcgtcgttcagtacaaggatcgagacggacaaccgcaggtggtgcctgtcgagggctccttgcgagaggtatccgtgccaggcttggatccagctcataggtacaagttgctcctctacggtttgcatcacggtaaaagggtgggacccatcagcgcagttgctataactgctggcagagaggagactgagaccgaaacaacagcaccaacacccccagctccagaaccccaccttggcgaattgactgtcgaggaggcaacgagccacacactgcatctctcttggatggtcacagaaggagaatttgactctttcgaaatccagtataccgacagagacggacagctacagatggtgaggattggaggcgatagaaacgacattacattgagcggccttgaaagcgaccacagatacctcgtgacgctgtatggcttttccgacggaaaacacgttggccccgtgcacgtcgaggccctcactgtccccgaggaagaaaagccctccgagcccccaaccgccactcctgaacctcccatcaagcccagattaggggagctgacagtgaccgatgccacccctgactcactgagtctgagctggacagtgccagaagggcagttcgatcactttcttgttcagtaccggaacggggatggccagcccaaagctgtcagggtcccaggccatgaggagggggtaactatttcaggcctggagcccgaccacaagtataagatgaatctgtatggatttcatggagggcagcggatgggcccagtgtcagtggtgggcgtgacagcagcagaggaagagactccaagtcccaccgagcctagtatggaggcacctgagccagccgaagagcctctgttaggagagctgactgtgactggaagcagccccgattctctgagtctctcttggacagtgccccagggccgctttgatagcttcactgtgcaatacaaggacagagacggtcgaccacaagtcgtcagagtaggtggtgaagaatccgaagttacggtcggtggactggagccaggtaggaaatacaaaatgcacctgtatgggttacacgagggaaggcgggtgggcccggtttctgcagttggcgtcacggctcctgaggaagaaagccccgacgcgcctttggcaaagcttcgactcggacagatgacagttcgagacataacaagcgattccctaagtctgagctggacagtgcctgagggacagtttgaccacttccttgtccagttcaaaaacggagatggtcagcccaaggccgtgagagtgccaggtcatgaggacggcgtgactatatccggtctcgagcctgaccacaaatataagatgaatttgtacggattccacggcggccaacgggtgggccccgtatccgccgtcggcctgactgcgccggggaaggacgaggagatggctccagcatcaacagagcccccgacacccgaaccccctatcaagccacgcctcgaggaattaactgtgaccgacgcgacccctgatagcctgtctctgtcatggactgtaccagaaggccaattcgaccacttccttgtgcaatacaaaaacggcgatggacagcccaaagcaactagagtgcccggacacgaagatagggtgactatctctggactcgaacccgataataaatataaaatgaacctctacggatttcatggagggcagcgggtgggtcctgtaagcgccatcggtgtgactgccgctgaagaagagactccctctccaacagaaccatcaatggaggcgcccgaaccccctgaagagccactgttgggagagttaacggtgactggttcctctcccgactccctttccttaagctggaccgtgccccaggggcggttcgattcctttactgtacagtataaggaccgtgatggcagacctcaagtggttagagtgggaggtgaagagagcgaagtgaccgtcggtggacttgaaccaggcaggaagtataaaatgcatctttacggcttgcatgagggaagaagagtcgggcccgttagtacagttggagtgacagctccccaggaagacgttgacgagacgcctagcccaaccgaaccaggaaccgaggcccctgggccccctgaggagccactcctcggggagctaacagtgactggcagctcacccgacagcctgagtctatcatggactgtacctcaaggtagatttgacagctttacagtgcagtacaaagaccgcgatggtcgcccccaagccgtacgggtgggtgggcaggagtctaaagtaactgtacgtggtctggagccgggcaggaaatataagatgcatctgtacgggctccacgaaggacggcgccttggccccgtgtctgcagttggagtcaccgaagacgaggccgaaaccacgcaggcagtcccgactatgactcctgagccccccattaaaccgcgactgggagaactcaccatgacagacgctacacccgacagcctctccttgagttggactgtgcccgagggacaattcgaccatttcctggtgcaatacagaaatggagacggccaacccaaggcagtacgcgttccgggacacgaggatggcgtgacgatctccgggttagaacctgatcacaagtacaaaatgaacctctatggatttcatggtgggcaaagagttggaccaatctccgtaataggagtaaccgctgcagaggaggagacacccagtccaactgaactgtctactgaggcccccgagccgccggaggagcccctgctaggggagctcaccgtcacaggctctagccccgactcgctaagcctctcttggacaatcccccaaggtcactttgactccttcacagtgcaatacaaagacagagatgggagacctcaagtgatgcgggtgcgaggagaggagtccgaggttactgtggggggactggaaccaggccgcaaatataagatgcacttatacggcttacacgaaggccgacgcgttgggccagtgtctaccgtgggagtgacagtacccactaccacccccgaaccccctaacaagcccaggctgggggagttaacggtcaccgatgccacccccgacagcctgtccttgtcctggatggtaccagagggccagttcgatcacttcctagtgcagtatagaaacggcgatggccagccgaaggtggtgagagtgcctggtcatgaggatggagttaccatttccgggcttgaacctgatcataagtataagatgaatttgtacggcttccacggcgggcagcgagtcggtccaatctcagtcatcggcgtgaccgctgcggaagaagagactccggctccaactgaaccctccaccgaggcgcccgaaccccctgaagaaccactcctgggagagttaactgttaccggatccagtcccgactccctcagcctctcttggactatcccgcaaggaaggttcgactcttttaccgtgcagtataaggatcgcgacgggcggcctcaagtcgtgcgggtgaggggtgaggagtccgaagtgaccgtgggggggctcgaaccagggtgtaaatataagatgcacctatacggtctccacgagggccagagagtcggtcctgtaagcgctgtaggtgtgacagttcccacaatgactccagagcccccgatcaaacccagactcggcgaactaaccgtcacagatgcaacgcccgactccttgagcttgtcttggatggtcccagaagggcagtttgatcattttctggtccagtatcggaatggggatgggcagcctaaagccgtgcgcgtacccggtcacgaagacggagtgaccatctcaggcttggaaccagaccacaagtacaagatgaatctgtatgggtttcacggtggacagagagttggacctgtgtccgccattggcgtgaccgaggaggaaactccttcccctaccgagcctagtacagaggcacctgaagcccccgaggagccccttttaggggagctcactgtaactggatcatcgcccgatagcttgtccctgtcctggaccgttcctcagggcagattcgactcttttactgtacagtacaaggatagagatggtcagccccaggttgtgagagtgcgcgttgaagagtctgaggtgaccgtggggggtttggagcctggacggaagtataaaatgcatctgtacggactccatgaaggtcagcgcgtcggacccgtgtctaccgtcgggattacagctcctctgccaacgcccctccccgttgagccccggttgggagagctggctgtggccgcagttaccagcgattctgtggggttgagctggacagtcgcacaagggccattcgactcatttttagtgcagtaccgtgatgcccagggccagccccaggccgtccctgtgtccggggacttgagagccgtggccgtgtcagggttggatccagcccgcaagtataaattcctcctgttcgggttacagaacggtaaacgtcacggccctgttcctgtggaggcccggaccgctcccgatacgaagccctccccccgcttaggagagctcaccgttactgacgcaactcccgattcagtggggctgagctggaccgtcccagaaggagagtttgactcattcgtggtacagtataaagacaaagatgggcgcttgcaagtcgtgccagtcgccgctaatcagagggaagtgacggtgcagggactcgagcctagtcggaagtaccgctttctgctgtatggccttagcggcaggaagagactcgggcccatcagcgcagattccaccactgcccccctggagaaagagctcccaccccacttgggagaactgacggtagccgaggaaacttccagctcccttagattgagctggactgttgctcagggccccttcgacagcttcgtggtacagtaccgcgatacagatggccagcctcgcgctgtacctgtcgctgccgaccagcgcaccgtcacagtggaagacctggagcccggtaagaagtacaagtttttgctgtacggattgctggggggcaaacgactcggtcctgtctctgctctcggaatgaccgcaccggaggaggacacccccgcccctgagttggctccagaggcgccagagcctcctgaagagccaagactcggagtactgacggtgacagacaccacccccgattccatgcggttaagttggtctgttgcacagggaccttttgacagtttcgttgtgcagtatgaagatacaaacggccagccgcaagccttactggtggacggtgaccagtcaaaaattctcatatcaggtctcgagccatccacaccatatcggtttctactttacgggctgcatgagggcaagcgcctgggtcctctctccgccgaggggaccacaggcctggcccccgccggacagacatccgaggagagtcgccctagactgagtcagttgtccgtcactgatgtcacgacatcgtcactcaggttaaactgggaggctcctcctggtgcctttgacagctttctgctgcggttcggggtgccatctccttccactttagagccacaccccaggcccctcctgcagcgagagctcatggttcctggaactagacattcagctgtcctgcgcgacttgagatcagggacactgtacagcttgactttgtatggactgaggggaccccacaaggcggactcaatccagggcaccgccagaaccctgtctccagtactcgaatccccgcgtgacctgcagttttcagagattcgagagaccagtgcaaaggtcaattggatgccacctcctagtagggcagattcatttaaagtcagttaccagttggccgacggcggcgagcctcagtccgtgcaagtggacggtcaggcaagaactcagaaattgcagggacttatacctggagcacggtacgaagtcactgtggtgtccgtgcggggctttgaggaatctgaacctctcaccgggttcctaactaccgtccctgacgggccaacacagctgcgcgccttaaatctgactgagggattcgccgtcctgcattggaaacctccccagaaccccgtcgatacctacgacgtgcaggtaactgcccccggagccccccctctgcaggctgagacacctgggtctgcagtggattatcccctgcacgacttggtgttgcacaccaactacaccgctactgtgagaggcttacgtgggcctaatctgactagccccgccagcataacctttactaccggcctggaggcgcccagggatctggaggccaaggaggtgactcctcggactgcgctgttgacctggaccgagccgcctgttagacctgcgggttaccttctgagttttcataccccaggaggtcagaatcaggagatcttgctgccaggaggtatcacttcccaccaactcctgggcctgtttccatccacctcttacaacgcacggcttcaggctatgtggggtcaatctctgctcccccccgtgtccacctcctttaccaccgggggccttaggataccatttcctagagactgcggcgaagagatgcagaatggcgccggtgccagtaggacatctaccatcttcctcaacggcaatcgtgaacgtcccctgaatgtgttttgcgatatggaaacagatgggggcggatggcttgtctttcagaggcggatggacggtcagactgacttttggagggactgggaggattacgcacatgggttcgggaacatatcaggagagttttggcttggcaatgaggctctgcactccctcacccaggcaggcgactactccatgagagttgatctgagggctggagacgaagctgtattcgcccagtacgatagcttccacgttgactcagccgcagaatattatcgactccacttagaaggataccacgggactgccggcgacagtatgtcataccacagcggttctgtattttctgcaagagaccgggatcccaattcattgttaatatcctgcgcagtcagctacagaggggcctggtggtaccgcaactgccactatgcgaatctgaacgggctgtacgggtctaccgtggaccaccaaggcgtgtcctggtatcactggaagggctttgagttttcagtgccctttaccgagatgaagctgaggccccgtaacttccggagtcccgccggaggggggtag

SEQ ID NO: 137527 - DNA, 12669 bp, Artificial Sequence
  Description of Artificial Sequence: Synthetic coding sequence
atgatgcctgcccagtacgccctcaccagcagtctcgtgctgctagtcttgctgtccacggcccgagccgggcccttttcttctcggtccaacgtaacacttcctgccccccggccaccaccacagcctggcggccacacagtgggggccggggtggggtccccctcatcacagctttatgagcatacggtcgagggcggcgagaagcaggtggtgtttacgcataggataaaccttcccccctccaccgggtgtgggtgcccgcccggaaccgagcctccagtgctagcctcagaagtgcaggcgctgcgcgtgcgcctggagatattggaagagctggtgaaagggctgaaagaacagtgtactggcggctgttgcccggccagcgcgcaggctggaaccgggcaaacagatgtcagaaccctctgttctctgcacggggtgtttgacctttcacgttgtacctgctcctgtgagcctggatggggagggcctacctgttcagatcccaccgacgcggagataccgccctcttcccccccgagtgcgagcggtagctgtccagacgactgcaatgatcagggtcgatgcgtgcgcgggaggtgtgtatgctttccaggatatactgggccctcctgcgggtggcctagctgtcccggggattgccagggcagaggcagatgcgtacagggagtgtgcgtgtgccgggcaggtttttccggccctgactgctcacagcgctcctgtcctagagggtgcagccagcgcggtagatgcgaaggagggagatgtgtatgtgatcctgggtacactggcgacgactgcgggatgagatcatgcccaagagggtgcagccagagaggcaggtgtgaaaacgggcggtgcgtctgtaatcccggttacacaggcgaggactgcggcgtgaggtcatgtccacgaggttgctcccagagaggcaggtgtaaggatggcagatgtgtgtgcgatccaggctacacaggtgaggactgtggaactagaagttgtccctgggattgcggggaaggcggtcggtgcgtcgacggtcggtgtgtttgttggcccggctacacaggggaagattgtagcacaaggacatgccccagggattgtaggggtaggggccgctgtgaggacggggagtgtatatgcgataccgggtattctggagatgattgtggagtaagatcctgtcccggggattgcaaccagcgtggcagatgcgaggatgggagatgcgtttgctggcctggctacactggcaccgactgtggctcccgggcgtgtcctcgcgactgcaggggaagaggccggtgtgaaaacggcgtgtgcgtgtgcaatgctgggtactctggagaggattgtggtgtgcgcagctgtcccggcgattgtcggggacgagggcgatgtgagtcgggaagatgtatgtgttggcccgggtacacgggacgggattgcggaacacgcgcttgtccgggggattgtagaggccggggcaggtgtgtggacgggagatgtgtgtgcaaccctggctttacaggggaggattgtggatcacgaagatgcccgggcgattgcaggggtcacgggttgtgcgaggacggcgtgtgcgtgtgcgatgcaggatacagcggggaggattgcagcacccgatcctgcccgggtgggtgtcgcggcagagggcagtgcctggacggccggtgtgtttgtgaggacggctatagcggggaagactgtggcgtcagacagtgccctaacgactgtagccagcacggggtttgccaagacggcgtctgcatttgctgggagggctatgtgtctgaagactgttcaatccgcacctgcccaagcaattgtcacggaagggggcgatgcgaggagggccggtgcctgtgcgaccccggctatacagggcctacttgtgccaccaggatgtgccctgcagattgtcggggccggggtcggtgcgtccagggtgtctgtctttgccacgtggggtatggtggcgaggactgcggccaggaggaaccgccagctagtgcctgcccgggcggctgcggcccacgggaattgtgcagagcaggacagtgtgtatgcgtcgagggtttcagagggcccgactgtgctattcaaacatgtcccggggattgccgaggtaggggggagtgccacgatgggagctgtgtgtgtaaagatggctatgctggagaggattgcggcgaagaggtgcctactattgaagggatgagaatgcatcttcttgaagagacgacggtgcggaccgaatggaccccagcacccggacctgttgacgcctatgagattcagtttattcccactacagaaggcgccagtcctccgttcaccgctcgcgtgccatcaagtgctagtgcctacgatcagaggggcctcgcacccgggcaagagtaccaggttaccgttcgcgcactgaggggcacctcctggggcttgcctgcctcgaaaacgattactaccatgattgatggtccccaagatctgcgtgtggtggctgttacacctacgaccctggagctcggatggctgaggccccaggccgaagtggacagattcgtggtatcctatgtctcagccggtaatcagcgcgtgcggcttgaagtcccccctgaggccgacggaaccctgctaacagacctgatgccaggagttgagtatgtggtcactgttaccgcagagcgtgggcgagccgtgagttaccccgcatctgtgcgcgctaataccgggtcaagtcctctgggtctgctgggtactacagacgaaccgccacccagcgggccctcaacgacccagggtgcccaagccccactgcttcagcagcgacctcaggagttaggcgagctaagagttctcggccgtgacgagactggaaggctgagggtcgtctggacagcccagcccgataccttcgcctattttcagcttcggatgcgggtgccagaggggcccggcgctcatgaggaggtgctgccaggcgacgtgaggcaggccctcgtcccccccccccctcctgggaccccctatgaactcagtttgcatggggttccgcctggaggaaaaccctccgaccctattatctatcaaggtataatggacaaagatgaagagaaacccggaaaatcaagtggcccaccccgcttaggagagctaaccgtgaccgacagaaccagcgacagcctgttgcttaggtggacagtgcccgaaggcgagtttgactcatttgtaatccaatataaggacagggatggacagccacaagtcgtgcccgtcgagggccctcaacgttctgcagtgataactagccttgacccaggcagaaagtacaagtttgtcctgtatggtttcgttggcaagaagcgtcacggacccctggttgccgaggcgaagatccttccacagagtgatccaagcccaggaacaccacctagacttggaaacctatgggttacggaccccacacccgacagtctgcacctctcttggacagtcccagaaggccagtttgacacattcatggtccagtatcgggaccgggatggaaggccacaagtagtccccgtggagggccctgagagatcttttgttgttagcagcctggatcccgaccacaagtatcggtttaccctatttggtatcgcaaacaagaaaagatacggaccattaacagctgatggaactacagccccggagcgcaaggaagagccacctaggccggagttcctagagcaacccttgctcggtgagctcactgtaaccggcgtgaccccagatagcttgcggctgagctggacggtcgctcagggccctttcgattcattcatggtccaatacaaagacgcccagggccagccacaggcagtccccgttgctggagatgagaatgaagttacagtgccgggactggatcctgatcgaaagtataaaatgaacctgtatggattacgaggccggcagcgcgtggggcccgagtccgtggtggcgaagacagcaccccaagaggatgttgatgaaaccccgtcacctacggaactggggacagaggctccagaaagccccgaagaacccttactgggtgagctgacggtgacaggatcttcgccagacagtctgtcacttttctggactgttccacaaggtagtttcgatagtttcacggtccagtataaggatcgcgacggacggcccagagccgtcagagtgggagggaaagaatctgaagtgaccgtcggaggtctggagccgggacataagtacaagatgcatctctatggactccatgagggtcaacgtgtcggacctgtgagtgccgtcggagtgaccgccccccagcaggaggagacgcctccagcaactgagagtccactcgagcctcggctcggcgaattgaccgtaaccgacgttaccccaaacagcgtcggcctgtcttggaccgtacctgagggtcaattcgatagctttatcgtgcagtacaaagacaaagacggccagcctcaagtggtgccagtggccgccgaccagagagaagtaaccgtctacaacctcgagcccgagcgaaagtacaaaatgaatatgtacgggctccatgatggacagcgcatgggtcctctttccgtggtgattgtgacggcgcccctccctccagcgcctgctaccgaggccagcaaaccccccctagaacctcggctgggcgaactcactgtgacagatatcacccccgactcagtaggactgtcctggacagtacctgaaggggagttcgactctttcgttgtgcagtataaggatcgcgatggccagcctcaagtagtacctgttgccgccgatcagcgagaggtgactatccctgacctggaaccatctcggaagtataagtttctgctcttcggcattcaagacggtaagcgtaggtcccctgttagtgtggaggccaagacagtggcccggggcgatgcctcacccggagcacctccaaggctcggagaactgtgggttaccgatccaacgcctgactcactgaggctttcttggaccgtgcctgagggccagttcgacagctttgtggtccagtttaaggataaagacggacctcaagtagtgccggtggagggtcacgaaaggtccgttacagtcacaccgttagatgccggcagaaaatacagatttttactgtatggtttacttggcaaaaagagacacggccctctcaccgccgacggcacaaccgaggctaggagtgcaatggatgatacaggaacaaaacggccacccaagccacgtttaggagaagagctgcaagtaacaactgtaacgcagaatagcgtgggcctcagctggaccgtgcctgaaggccagtttgactccttcgtcgtccagtacaaagacagggatgggcagccccaggtggtccccgtggaagggtcgctgcgtgaagtgtccgtcccgggcctggacccggcccaccgctacaaactgcttctgtatggactacaccatgggaaacgggtgggacctatcagtgccgtggcaatcaccgccgggagggaagagaccgagactgagactaccgcgccgactccgcccgctcccgagcctcacttgggtgagctgactgttgaagaagctactagccataccctacacctttcctggatggttacagaaggcgagtttgacagttttgagattcagtacaccgaccgagacgggcaactgcaaatggtacggatcggcggagaccgcaacgatataactttatccggactggaatccgatcatcgctacttggtaaccctctacgggttttccgacggtaagcatgtcggtcccgttcacgtagaagccttaactgttccggaggaggagaaaccttccgaacctccaaccgccacaccagagccacctatcaagccccggctgggagagttgacggtcaccgatgctacccctgattctctgagcctgtcgtggaccgtgcctgagggacagttcgatcattttctcgtccagtacaggaacggcgatgggcaacctaaagctgtgagagtgcccgggcatgaagaaggcgtcaccatcagtggcctggaaccagaccacaagtacaaaatgaatctttatggtttccacgggggccagagaatggggcctgtgtctgtcgtaggagttacggccgcagaggaagaaaccccctcaccaacagaaccctccatggaagccccagaaccagcagaggagcccctccttggagagctcacggtaaccgggtccagtcctgacagcctgtccctctcatggacggttccccagggccgattcgactcattcactgttcagtataaggacagggatggtaggccacaggtggtacgtgttggaggcgaagaatctgaggtcaccgtcggaggactggagcctgggcggaagtacaagatgcatctgtatggactccatgaaggtaggcgtgtgggacccgtatcagcagtaggagtcaccgccccagaggaggagtctcctgacgcacccttggccaagctccgcttaggccagatgaccgtgcgagacatcacttctgacagcctttccctttcatggaccgtgcctgaaggtcagtttgaccacttcctggttcagtttaaaaatggcgatgggcaacctaaggctgtgagagtgcccgggcacgaagacggtgtcaccatcagtggacttgagccagatcataaatacaaaatgaacttgtacggcttccacgggggccagcgtgtaggccctgtgtctgccgtgggcctcacagcccccgggaaagatgaggaaatggcacctgcaagtacagagccccccacccccgagcctcctattaaaccaagactcgaggaactgacagttacagacgcaaccccggatagcctgtcgctgagttggacagtccccgagggacagttcgatcatttcttagttcaatacaagaacggcgacggtcagcccaaggcaaccagggtgccgggccatgaggatcgggtgacgatcagcggcctcgaacccgataataaatacaaaatgaacttgtatggcttccatggaggtcaaagggtgggacctgtaagtgccattggggttactgcagcagaagaggaaacaccaagcccaaccgagcctagtatggaggcacctgagccccccgaggagcccctcctgggcgagctcacggtgacaggatccagcccagacagcctgtcattgtcttggaccgtgcctcagggtaggttcgattcatttaccgtccagtataaggaccgggacggaaggccccaggtggtgcgggtgggaggggaagaatccgaggtgacagtgggcggcctagaacccggccgcaaatacaaaatgcacctgtatggcctccatgagggacggcgggtcggtcctgtttctacagtgggagtgaccgcaccccaggaggatgtggacgagactccaagccccacggaacctggaacagaggcccctgaacctcccgaggagccactcctgggcgagctgacagtaacgggcagcagcccagattcgctcagtctgtcttggacagtgcctcaaggtcgcttcgattcctttacggtccagtataaggatagggatggacgcccccaagcagtccgcgtcggtggccaagaatccaaagtaacggtgaggggccttgaacccggtcgcaagtacaagatgcatttgtacggtttgcatgagggcaggaggctcgggcctgtgtcagcggtgggcgtgacagaggacgaagcagagacaacccaggcggtgccgaccatgactcctgaacccccaatcaaaccacgactgggagagctgaccatgacagacgctaccccagattctctgtcccttagttggacagtcccagagggccagtttgaccattttctggtgcagtaccggaacggtgacggacaacctaaggccgtgagggtgcccgggcacgaagatggagtgactatttctgggctagaaccggatcataaatacaaaatgaatctgtatggattccacggtgggcaacgtgttgggccgatctcagtgataggcgtgactgctgccgaagaagaaactccgtctcccaccgaactgtcaactgaggcacccgagcccccagaagagcctttactgggggagctgaccgtgacaggctccagcccagacagccttagcttgtcatggacaatcccgcagggacatttcgacagttttacagtgcagtacaaagatcgggacggtcgtccgcaggttatgagggtccgcggtgaagagagtgaggtgacagttggcggtctagagccaggacgaaaatataaaatgcacctgtacgggctgcatgaaggtcgcagagtgggtcctgtgtccaccgtcggagtgactgttccaacaactacacctgaacctccaaacaagcccaggctgggggagttaacagtgacagacgccacacccgatagtctatcattgagctggatggtgcctgagggtcagttcgatcactttttggtccagtatcgcaatggcgacggccagccgaaagtggttcgggtgccagggcatgaggatggagtgactatctccggtctagagcccgaccacaagtataagatgaatctgtacggctttcacggtggtcagcgcgttggtccaatctcagtaataggcgtcactgcagcggaggaggagaccccagccccaacagagccatcaacagaggcgccagagccaccggaagagcccttgctcggagaacttaccgttaccggctcatctcctgactcgctgtctctgtcgtggactatcccccagggcaggtttgattcatttaccgtccagtacaaggatagagacggccggccccaagtcgtacgcgtgcgtggggaagaatctgaggtcaccgtaggggggctcgaacccggatgcaagtacaaaatgcacctgtatgggcttcacgagggccaacgggttggtccagtgtcggcagtgggtgtgactgtccctaccatgacccctgagccccccatcaagcccaggctgggcgagctcacggtgacagatgcaacacctgactcactcagcttgtcttggatggtaccagaaggccagttcgaccactttctagttcagtatcgcaatggggacgggcagccaaaggctgttagagtccccggacacgaagacggcgtgaccatttctggactcgagccggatcacaagtacaaaatgaacctgtatggattccacggtggccaaagagttggccctgtgtctgctatcggcgtaaccgaggaggagaccccttctcccacggagccgtccactgaagcgcccgaagctccagaagagcctctgctcggcgaacttactgttacgggttcttcccccgattccctgtctctcagctggaccgtaccccaagggcgtttcgacagctttaccgtgcagtacaaggacagggatggtcaaccccaggtggttcgagtccgcggagaggagtccgaggtaaccgttgggggtctcgagcctgggaggaagtacaagatgcacctatacgggctccatgaagggcagagggtgggtccggtctctacagtgggaattaccgcccctctgcctaccccgctgcccgtggagcccagactcggagaactcgccgtcgcggccgtgacttcagactctgtggggctgtcttggacggtagcccaaggcccgtttgactcttttctggtgcagtatcgtgacgcgcaagggcagccgcaagctgtgcccgtttcaggtgacctgcgtgctgtcgccgtatccggtctcgatcccgcaaggaaatacaaattcctgttatttggactgcaaaatggcaagagacacggtcccgtaccagtcgaggccaggactgccccagataccaaaccctcgcccagattgggtgagttgaccgtcacagacgccacaccagactctgtgggtctgtcatggactgtgcctgaaggtgagttcgactccttcgtggtgcagtacaaggataaggacggccggctccaggtggtaccagtggcagccaatcaacgcgaagtcaccgtccagggcctggagcccagccggaaataccggttcctcctgtacggacttagtggtcgtaagcggctcgggcctatctcagccgattcaaccaccgctcctctggagaaggagctccctccccacttgggggaactgacagtagctgaggaaacctcttcctctcttagactgagttggaccgttgcacagggaccgttcgacagctttgtggtacagtatcgcgacaccgatggtcagcctcgtgcggtgcccgttgctgcagatcagcgcacagtgactgtggaggatctcgagccgggcaaaaagtataaatttttactctacgggttgctgggcggaaagcggctcggcccagtgagtgcactgggcatgaccgcccccgaagaagacacccctgctccagagctggctcccgaggcacctgagcccccagaagagcccaggctcggtgttctcactgttactgataccacacccgacagcatgcgcctttcatggagcgtggcacaagggccattcgacagtttcgttgtgcagtatgaagatacgaacgggcagccccaggccctgctggtagacggcgaccagtctaagatcctgatttcagggttggaaccctctacaccataccgcttcctcctgtacgggcttcatgagggaaagaggctggggccgctgtccgccgagggaaccacaggacttgctccggccggacagacaagtgaggaaagcaggccccgcctctcacagctttcggtgacagatgtgacgacttccagcttgaggctgaattgggaagctcctccaggcgcatttgattcctttctgttgcgctttggcgtgccctcaccatccactttggagcctcaccccaggcctctgctgcaacgcgagctgatggtacctggcacccggcactctgctgtcctgcgggatttgagatcaggaacactgtattcacttactctctatgggctgcgcggaccacataaagctgattccatccaaggcacggccagaacattaagcccggtcctggaatcccccagagatttgcagttttccgaaataagggaaacttctgctaaggtaaactggatgccaccgccctctcgtgccgattcattcaaggtgtcctatcaacttgctgacggaggagaacctcagtccgtccaggttgatggccaggctcgaacgcagaaactccaggggctgattccaggagccaggtacgaggtgactgttgtctccgttcgtggatttgaagagtccgaaccgctcactggattcttgactactgtccccgatggccccacccaactcagggctctgaacctgactgaggggttcgcagttcttcactggaagccccctcagaatccagtcgatacctacgacattcaggtcacagcgccaggcgcacctccactgcaggccgagacccctgggtcagccgtggattatcctttacacgatctggttctgcacactaactatactgctacagtccgcggcttgaggggccctaatttgacaagccctgccagtatcaccttcaccacaggactggaggccccccgagatcttgaagccaaagaagtgactccaaggacggccctcttgacctggaccgaaccaccggtgcgccccgcaggttatctgcttagctttcacacaccaggaggacaaacccaggagatcctgctcccaggggggatcacttcacatcagctcctgggtctctttccttcaacatcttacaatgctaggttgcaggcgatgtggggacagtcactgctcccgccagtgtccacttcctttactacagggggcctaaggattccttttccccgggattgcggcgaagaaatgcagaacggggccggcgcatcccgcaccagcaccattttcttgaatggcaacagagagcgcccacttatagtgttctgcgatatggagacggacggcggcggatggctcgtcttccagaggaggatggacggccagacagacttttggcgtgactgggaagattatgcccacggatttggcaacatctccggcgagttctggctgggtaacgaggccctccactcccttactcaggccggagactacagcatgcgggttgaccttcgagctggcgacgaggccgttttcgctcagtatgatagctttcacgtcgattccgcagcggaatattataggctgcatctggaggggtatcacggaactgctggcgattcaatgagctatcacagtgggtccgtctttagcgcgcgcgatcgcgacccaaactcccttttaatcagttgcgcagtcagttataggggcgcctggtggtatagaaactgccattacgctaacctgaacggcctgtacggtagtacagtggatcaccaaggggtttcatggtatcactggaaaggttttgagttttctgtgcctttcaccgagatgaaactgagacccagaaatttccggagtccagctgggggcggctag

SEQ ID NO: 137528 - DNA, 27 bp, Artificial Sequence
  Description of Artificial Sequence: Synthetic coding sequence
atgatgcctgcccaatatgctttgtag

SEQ ID NO: 137529 - DNA, 1905 bp, Artificial Sequence
  Description of Artificial Sequence: Synthetic coding sequence
taatcgtcccctctcggtctcctaggcactacggatgaacctcctcctagcggtccctccacaacacagggcgcgcaggcaccacttctccagcagagaccccaagagctaggcgagctgagggtcctgggccgagatgagacggggaggctacgcgtggtgtggactgcgcagcccgacacattcgcctactttcagctgagaatgagagtgccagaagggccaggtgcccatgaggaggttcttcccggcgacgttcgccaggctctggtgcctccacctccacctgggacaccatatgaactatccttgcatggcgtccctcctggggggaaaccctcagatcctattatctatcagggcatcatggacaaggacgaagagaaacccgggaaaagctcaggaccccctaggctgggggagctgactgttacagatcggacatccgacagtctattactccgttggacagtacccgaaggggagtttgacagcttcgtgattcaatacaaggaccgggatggacagccccaagtggttcctgtggaggggccgcagcggtctgctgtgattaccagcttagatcccgggagaaagtacaaattcgttttgtatggatttgtcggcaagaaacgtcatgggcctcttgtcgcagaagctaaaatattaccccagagtgatccttctccaggaaccccccctcgattaggtaatctttgggtcactgatcctactccagattccctgcacctgagttggaccgtgcctgagggccagttcgatacattcatggtgcaatatagggacagagatggacgcccccaggttgtccccgtggaaggacctgagcggtctttcgtggtgagttcattagatccagaccataagtacagattcacgctatttggcattgctaacaagaaacgctacggccctctaactgcggacggcacaaccgccccagagagaaaagaggaacctccaaggccagagttcctggagcagcccctcctcggagagttgaccgtgacaggcgttacacctgatagcctgagactgtcttggactgtagcccaaggcccctttgactccttcatggtgcagtataaagacgcacaggggcagcctcaggctgtgcctgtggccggcgatgagaacgaggtgacagttcctggactggatcccgatagaaagtacaaaatgaacctgtatggcttgcgcggccgacagagagtcggacccgagtcagttgttgccaaaaccgccccacaggaggatgttgatgagaccccaagccccacggaactcgggaccgaagctccagagtctcctgaagaaccacttctgggggagctgacagtgactggtagcagtcccgactctcttagcctgttctggactgtcccccagggtagctttgattccttcaccgtgcagtacaaggatagagatggccgcccccgtgccgttcgggttggtgggaaggagagcgaggtgactgtgggcggtctggagcccggtcataagtataagatgcacctatatggactccatgagggacagcgagtgggtcctgtctctgccgtgggcgtcaccgccccacagcaggaagaaacccccccagctaccgaatctcctttggaacctagactgggggagctcacggtaactgacgtcacacccaatagcgtgggattgtcttggacagtgccggagggccagtttgatagcttcattgtccaatacaaagacaaagatggacagcctcaggttgtgccagtggcagccgaccagcgcgaggtgaccgtgtataaccttgaacccgaacgcaaatacaagatgaatatgtacggactccacgatgggcaacggatggggccactgtctgtggtcattgtcacctag

SEQ ID NO: 137530 - DNA, 27 bp, Artificial Sequence
  Description of Artificial Sequence: Synthetic coding sequence
atgatgcctgcccagtacgccttgtag

SEQ ID NO: 137531 - DNA, 12669 bp, Artificial Sequence
  Description of Artificial Sequence: Synthetic coding sequence
atgatgccagcccagtacgccctgaccagctctctggtgcttctggtactcctttcgaccgctcgcgcagggcctttctcaagtcgctccaatgtcacccttccggcccctcgcccacccccccagcccggcggacacacagtaggtgccggggtcgggtcaccatctagccaactatatgaacacacagtggaagggggagagaagcaggtcgtattcacccaccggataaatctgccgccttcaactggctgcggatgcccacctggcaccgagccacccgttttggccagcgaagtccaggctctgcgggttagactggagatcttggaagaactcgtcaaaggactgaaagagcagtgtacagggggctgctgtcctgcctctgcacaagctggcacaggccagactgacgttcgtactctgtgctcactgcacggcgttttcgatctgtcacgatgtacatgtagctgtgagcctgggtggggcggaccaacctgctctgatccaacagatgcggaaatccctccctcctccccaccttccgcctcagggagctgcccagacgactgtaacgatcaaggccggtgcgtgcgaggccgatgtgtgtgcttccctggctacactggaccatcatgcggttggcccagttgtccaggcgattgtcaggggcgtggaaggtgtgtccaaggcgtatgtgtttgtcgggccggcttcagcgggcctgactgttcgcagcgatcttgcccccgcgggtgtagccagaggggaaggtgtgaaggcggcagatgcgtatgtgatcctggttacaccggtgacgactgcggaatgcggtcttgtcctcgcggctgtagtcaacgtggccggtgcgagaacggacgatgcgtgtgtaatcccggttacacaggagaggactgtggggttaggtcttgcccacgggggtgcagtcagcggggacggtgcaaggacggtcggtgtgtgtgcgaccctggctatactggcgaagactgcggcacccgttcctgtccctgggattgtggcgaaggggggaggtgcgtggatggacggtgcgtctgttggcccggctataccggcgaagattgctccacgcgaacttgtccacgtgattgtagggggaggggccgctgcgaggacggcgagtgcatttgtgatacaggatactccggcgacgattgtggagtgcgcagctgtcctggagactgcaaccaacgaggtagatgcgaggatggccgatgtgtctgttggcctggatacacagggacggattgtggatcccgggcctgtcccagagactgtcgggggcgtggtagatgtgaaaacggcgtatgtgtgtgcaacgcaggttacagcggcgaagactgcggcgtcaggtcctgtccgggtgattgccgggggcgaggccggtgtgaatcaggcagatgcatgtgttggcccgggtatacaggccgagattgtggaacccgcgcttgccccggagattgccgtgggaggggtcgctgcgtggacggacggtgcgtttgcaaccccggcttcactggcgaagattgcggttcaaggcgttgtcccggcgactgccgggggcacggactgtgcgaggatggagtctgtgtgtgtgatgctggctacagtggcgaagattgcagtactcgaagttgccctggcggttgtcgtggacgagggcagtgcctcgacggccggtgtgtttgcgaggatggctattccggggaggattgtggtgtgagacaatgtcccaatgactgctctcaacatggagtgtgccaggacggggtttgtatctgctgggaaggctatgtctcggaggattgttcaatccggacttgcccatctaattgtcatggtagggggcgctgcgaagagggtcggtgtttgtgtgacccagggtacactggccctacctgcgccacccgcatgtgccccgccgactgccggggacggggtcggtgtgtacagggtgtgtgtctttgtcacgtaggttatggcggtgaggattgtggacaagaggagccccccgcctctgcttgtcccggaggatgcgggccccgggagctgtgtcgggccggtcagtgcgtgtgcgtagagggtttccggggtccagactgtgcgatacagacctgtcctggcgattgccgcgggcgaggagaatgccacgatgggtcatgtgtatgcaaagacggttacgcaggcgaggactgtggcgaagaagtccccaccatagaagggatgcgcatgcatctgcttgaggagaccactgttcgaactgagtggacacctgctcccggtccagttgacgcgtatgaaatccagtttatccctacaaccgaaggcgcctcaccgccattcacagcccgcgttccctcctccgcctcagcctacgatcaaagagggctggcccctggccaagaatatcaggtcactgtccgggctttgagaggaacctcatgggggctccctgcttcaaagacaatcaccaccatgattgacggccctcaggatctccgcgtagtggccgtgaccccaactacgctggagctcggatggttgcgcccacaagccgaggtggataggttcgtcgtgtcatacgtgagcgctgggaaccagcgggtgaggttggaagttcctccagaggctgacggcaccctcctcactgatctcatgccaggggtcgaatatgtggtgactgtgacagccgaacgcggccgcgccgtgagttatcctgcttcagtccgagccaacactggctcgtcccctctcggtcttctgggcaccacagacgaaccccccccttctgggccaagtaccactcagggagctcaggcccctctcctgcagcaacgaccgcaggagctgggggagctcagagtgcttggaagggacgaaactggccgtttgcgagtggtctggactgcccaacccgacacctttgcctacttccagctccgcatgcgggtgccggagggcccaggtgctcatgaggaggtgttgccaggtgatgtgcgccaggcactggtccctcctccaccaccaggaaccccatatgagctgagtctgcatggcgtgccccctggcggcaaacctagtgacccgataatctaccagggtataatggacaaggatgaagaaaaacctggaaagtcatctggccctcccaggctaggcgagcttactgttaccgataggacgagcgacagtctgctgcttagatggacagttcccgagggcgaattcgactctttcgttatccaatacaaagaccgagatggacaaccccaagtggttcctgttgagggaccccagcggagcgccgtgatcaccagcctcgatccgggccggaaatacaaatttgtactgtacgggttcgtgggtaaaaagcgacatggccccttagttgccgaggcaaaaattctgccccagtctgacccatctcctggtactcctcccagacttggtaacctatgggttactgatcccacgcctgatagtctgcacctatcatggactgtgcctgagggtcagtttgataccttcatggtacagtatcgcgatcgagacggccgcccgcaggtggtgccagtggagggccccgagcgcagcttcgtcgttagtagtcttgatcctgatcataaataccgctttacactttttggtattgctaataaaaaacgatacgggccactgacggccgacggaaccacggcccccgaacgtaaggaagaaccccctcatcctgaatttctggaacagcctctcctcggagagttaacagttaccggggtgacgcccgattccctgcgcctgtcatggacagtagctcaagggccattcgactcattcatggtgcagtataaagatgctcaaggacagccgcaggctgtgccagtcgccggggacgagaacgaggtaaccgtgccaggactcgaccccgaccggaaatataaaatgaatctgtacggcctaaggggccgccagagggtggggccagagtctgttgtggctaaaacagcccctcaggaggacgtggatgaaactcctagccccaccgagctgggcactgaagcgcccgaatcacccgaagagcctctcctcggagaactaacggtcacaggttcgagccctgacagtctgtccttattctggaccgtgccccaggggagtttcgatagtttcactgtacagtacaaggaccgtgatggccggccacgggccgtgagagtgggaggaaaagagtcggaagtgaccgtgggcggccttgagccgggccacaagtataagatgcatctgtatgggcttcatgagggccagcgcgttggccccgtgtctgcagtgggcgttaccgctcctcagcaggaggagacgccccctgcgaccgaatctcccctcgagccccgcttgggagagttgacagtgaccgacgtcactcctaatagcgtcgggctctcctggacagttcctgaaggacagtttgatagtttcattgtgcaatacaaggacaaggatgggcagccccaagttgtacccgtagctgctgatcaaagagaggttacagtttataatctggagccagagcggaagtacaaaatgaacatgtacgggctccacgacggccagcgaatgggccccttgagcgtggtgatcgtgacggccccactgcctcccgcacccgcaaccgaagcaagtaagccaccgctcgaaccaagactgggcgagctgacggtgaccgatatcacgcctgactccgtcggattgtcatggaccgtcccagagggggagttcgactcctttgtagtccagtacaaggacagggacggccagcctcaggtggtgccagtggcagcagatcagcgcgaggtcactatccctgatctggagccatcccggaagtacaaattcctgctgtttggcattcaagatggaaagagacgctcacccgtgtctgtcgaggcaaaaacagtagcaaggggtgacgcgtcgcctggtgcgcctcctaggctgggagagctgtgggtgaccgatccaacccctgattccctgcggctctcctggactgtacctgaggggcaattcgactctttcgtggtccagtttaaagacaaagatggcccacaagtcgttcctgtggaaggtcatgaaaggagcgtgactgtgacaccactagacgcagggagaaagtatcgcttcctgctctatggacttcttggaaagaagcggcacggcccactgactgcggacgggactaccgaagccagatcagctatggatgacacggggaccaagcgcccacctaagcccagactcggagaagaactgcaggttacaacagtaacacagaactctgttggacttagctggacggttcctgaaggccagtttgatagtttcgtggttcaatataaggaccgagacggacagccacaggtggtcccagtggaaggatccctccgagaagtatccgtcccgggccttgatccagcacatcgatataaattgttgctctatggcttacaccatggcaagagagtgggccccatcagcgccgtggctattaccgcaggcagggaagagaccgagaccgagacaacggcacctaccccccctgcaccggaacctcatctgggcgagctgactgtggaggaggccaccagtcacacgctccacttatcttggatggtaacagagggcgagttcgactcctttgaaatacagtacaccgatcgcgacgggcagctccaaatggtgagaattggaggggataggaacgacattactttaagcgggctcgaatctgatcataggtaccttgtgactctctatggattttccgatggcaagcacgtggggccggtgcacgtggaggctcttactgtgccagaagaggaaaagcctagcgagccccccacagccactcccgaacctcctatcaaacctcggctaggagagctaacagtgacagacgccactcccgattctctgtccctcagctggactgtcccggaggggcagtttgaccacttcctggtccagtacaggaacggcgatgggcagccgaaggctgttcgggtccccggccatgaagagggggttaccatttcggggctggagcctgatcacaagtacaagatgaacttatatggcttccacgggggtcagcgcatgggccctgtgtcagttgtcggagtcacggctgccgaggaggaaactccaagcccaacagagccatccatggaggcccccgagcccgccgaagagccgttgctcggcgagctgacagtgaccggcagcagccccgactccctctccttgagctggacagttccccagggtaggtttgatagctttaccgttcaatataaggaccgagatgggaggccccaagttgtaagggttggaggtgaagagtcagaagttaccgtcggcggtctggagccagggcgcaaatacaagatgcatctgtacggtcttcatgagggacgcagggtggggccagtgagtgccgtgggggtgaccgcccccgaggaggaatcccctgatgcacccctcgcaaaacttagactgggccagatgaccgtcagagatattactagcgactcgttgagtctttcgtggacggtcccagaggggcagttcgatcacttcctcgtgcagttcaagaatggcgacggacagcctaaagccgtgcgtgttcctggccatgaggacggagttacaatttccgggctggagcctgaccataaatacaaaatgaatttgtatggctttcatgggggacagcgggtggggccggtcagcgcggtcggtcttacagccccaggaaaggacgaggagatggcccctgcctccacagaaccccccacacccgagcccccgattaagccaaggctggaagaacttaccgtgacagatgcaacgcccgattcgctcagcctttcatggaccgtgcccgaagggcagtttgaccatttcctggtgcagtacaagaacggagacggccagccaaaagcaacacgagtgcctggacatgaggatagagtgacgattagtggactagagccggacaacaaatacaagatgaacctgtacggatttcacggcggccaacgggtgggtcccgtgagcgcaattggagttactgcggccgaagaagagacaccaagtcctaccgaaccttcaatggaggccccagaaccccccgaagagccacttctgggggagctgacagtcaccggatcttctccagacagtctgagcctgagttggaccgtcccacaagggcggttcgacagttttacagtgcagtataaggatagagatggccgcccccaggtggtgagagtcggtggtgaggagagtgaagttacggtggggggacttgagcctggccggaagtacaaaatgcacctatacgggctccacgagggtcgaagggttggtcctgttagcacggtgggtgtgactgctcctcaggaggacgtagatgaaactccctctcctactgagcctggaactgaagctccagagcccccagaagaacctctcttaggggaactgacagtaacaggaagctctccggacagtctgtcactgagctggaccgtcccccaaggtcgtttcgattctttcacagtgcaatataaagatagagatggtcgcccacaagcagtccgggtgggcgggcaagaaagtaaggtgaccgtgagaggtttagagccaggtaggaagtacaaaatgcacctttacggtctccatgaggggaggaggttggggccggtgtcggctgtaggagtgacagaagacgaggccgaaaccacccaggctgtgcccaccatgacacccgaacccccaatcaagcccagattgggcgaattgactatgactgatgctactcccgacagcctgtcgttatcatggaccgtacccgagggacagttcgatcattttctcgtccagtaccgcaacggtgatggacaacctaaggcggtcagggtgcctggccatgaggatggtgtgaccatttcagggttagaaccagaccataaatataaaatgaatctgtacggctttcacggcggtcagcgcgtgggccccatttctgtcatcggcgtgacggcagctgaggaagaaaccccttctccaacagaattatccactgaagcaccagaaccgcctgaagagcctctcttgggagaacttaccgtgacaggcagtagcccggattcattgagtctttcatggaccattcctcaaggccactttgactccttcactgttcagtacaaagacagggacggccggcctcaggtcatgagggtgcgcggagaggaatcggaagttaccgttgggggcctggagccgggacgaaagtacaaaatgcatctatacggcctgcacgaagggaggcgggtggggccagtctcgaccgttggggtgaccgttcccactactacccccgaaccacctaacaagcccagactcggggagctgaccgtgacagatgccacacccgattctttaagcctctcgtggatggtcccggaggggcagtttgaccattttcttgtgcaatacagaaacggggatggccaaccaaaggtggtgcgtgtgcccggccacgaagatggagtcaccatttccggcctcgagccggaccataagtacaagatgaatctgtacgggtttcacggaggacagagagtggggccgattagtgtgatcggggtgaccgctgccgaagaggagacacccgcccccaccgagcccagcacagaagcacccgagccccccgaagagcccctgctcggcgagttgacagttacagggtcgtcccctgattctctgtccctttcgtggaccatccctcagggaagatttgatagctttaccgtgcagtacaaagatagagatggtaggccgcaggtcgtccgcgtgcggggtgaagagtcagaggtgactgtgggcgggctggagcccggctgcaagtataagatgcacctgtacggtctgcacgaggggcagcgggtcggaccagtttctgctgtcggggtcaccgtaccgaccatgacccctgagccccctattaaaccccgcctgggagaattgactgtgactgatgcaactccggacagcctgagtctgagctggatggtccccgaaggacaattcgatcatttcttagtccagtatcgcaacggcgatggacagcctaaggctgttagagtgcccgggcacgaggacggcgtcaccataagcggcctcgaacccgatcataagtataagatgaacctgtacggttttcatggaggacagagggttggacccgtcagcgcgatcggcgtcacagaggaggagacaccctctcctacggagccaagtactgaggccccggaagccccagaggaacccctgttgggcgagctcacagttaccggaagttccccagatagtctatctctgtcttggaccattccccagggccgctttgacagtttcacagtgcagtacaaggatagggacggccagccccaggttgtaagagttagaggtgaggaatccgaagtaacagtagggggccttgagcccggcagaaagtataagatgcatctctatggcctgcatgaaggacaaagggtgggcccggtttccacagtgggaattactgctccgctgccaaccccactcccagtggagcccagactgggcgagctggctgtggcggctgtgacctccgacagtgtggggctctcctggaccgttgcccagggcccttttgactcatttctggtacagtatcgggacgcccaagggcaaccacaggccgtgcctgtttctggagacctgagggcggtcgccgttagtgggttggaccccgcaaggaaatataaattcttgctgttcgggctgcagaatggaaagagacacggacctgttcccgtggaggctcggaccgcccccgataccaagcctagtccacggctgggggagctcacagtaactgatgccacgcctgacagcgtggggctgtcctggactgttccagaaggagaatttgattcgtttgttgtacagtataaagataaggacgggagactacaggtagtgcccgttgctgctaatcagagagaagtgacagtgcagggtctggaacctagccgcaagtaccgctttttgttgtacggattaagtggtcggaaacgcctcgggccgatctctgcggactccactactgcccccttggaaaaagagctcccacctcacctcggtgagctgactgtggcagaggagacatcctcctccctgcggctatcttggaccgtggctcaagggcccttcgattcttttgtcgttcaatacagagatacggatggccaacctcgggctgtgccagtggccgccgaccagcggacggtcacagtcgaagacctagagcccggtaagaagtacaaatttcttctgtatggactgctggggggaaaacgtcttggacctgttagtgcactaggcatgaccgcccccgaggaagatacccccgctcccgaacttgcaccggaggcccccgagcctccagaggagcccaggttaggagtgctaactgtgactgatactactcccgactcgatgcgcctctcatggtcagtcgcgcaagggccctttgattctttcgtggttcagtacgaggacacgaatggacagcctcaggcgctgcttgttgatggggaccagtccaagatcttaataagtggtttggagccttccactccttacagatttctgctatacggacttcacgaaggaaagagactgggccctcttagtgccgaggggaccaccggactggcccctgccgggcagacgtcagaagaatctaggccaaggttgtcccagctttctgtgacagacgtcacaacgtccagtctccggctaaattgggaggctcccccgggagcgtttgacagctttctcttgaggttcggcgttccttcaccttctactcttgagcctcatcctcgccccttgcttcagagagaactgatggttccagggactcggcacagtgccgtactgcgggatctcaggtctgggacgctatactcgctgacgctgtacggccttagaggtcctcacaaggccgattccattcaaggcaccgctcgcaccctgagccccgttctggagagccctagggatctgcagttcagtgaaattagggaaactagcgcaaaggtgaattggatgcctccaccatccagggcagattcatttaaagtgtcctaccaactggccgatggcggagagccccaatccgtgcaagtcgacggccaggcccggacacagaaattacaaggacttatcccaggcgcacgatatgaagtaacagttgtgtccgtgcgggggtttgaagagtctgaaccccttaccgggttcctgactacggtcccagacggccccacacagctgcgggccctgaatctgaccgaggggttcgccgtgttacattggaaaccccctcagaatcctgttgatacctatgacatccaggtcactgctcccggagccccaccactgcaggcggaaactcccgggagtgccgtggactacccgctgcatgacctggtgctacatacaaactatacggccacagtgcgaggactgagggggccaaatttaacctcaccagctagtatcacattcactactggtctggaggcgccccgtgatctggaagcaaaagaagtcaccccaagaacggccctgcttacctggactgaaccccccgtgcgaccggccggctacctgcttagcttccatacgccggggggccaaacacaagagatactgctcccaggcgggatcacgtcccatcaactactgggtctttttccttccacctcatataatgctagactgcaggcaacatggggccaaagcttgctcccccctgtcagtacctcttttacgactggaggtctgcgtatccctttccctcgagactgtggcgaagaaatgcagaacggcgccggcgctagccggacaagcactatatttttaaacgggaaccgggagcgcccattgaacgtgttctgtgatatggaaactgacggaggcggatggctggtatttcaacgacgtatggacggacagacagatttttggcgcgactgggaagactatgcccacggctttggcaacatcagtggagagttttggctcggaaacgaagctctacactcactgacgcaggccggtgactattcgatgcgtgtcgaccttcgcgcaggcgatgaggctgtattcgcgcagtacgattcgtttcatgtggactccgcagctgagtactaccgcctccatcttgagggatatcatgggaccgcgggcgatagtatgagttaccatagtggatctgttttcagcgcaagggaccgggacccaaattccctcctgatcagctgtgccgtgagctataggggcgcatggtggtaccggaactgtcactacgctaacctgaatggactttacggaagtacagtggatcaccagggcgtgtcatggtaccactggaaggggttcgaattctctgtgccattcacagaaatgaaactgcgtccgcgcaacttccggtcccccgccggggggggttag

SEQ ID NO: 137532 - DNA, 27 bp, Artificial Sequence
  Description of Artificial Sequence: Synthetic coding sequence
atgatgccagctcagtacgccttatag

SEQ ID NO: 137533 - DNA, 6843 bp, Artificial Sequence
  Description of Artificial Sequence: Synthetic coding sequence
atgatgccagcccagtacgctctcacaagcagcctagtactgctggtcctcctgagtacggcccgggccggaccttttagtagtaggagcaacgttactctgccagctccacgccctcctcctcaacccggcggccacacggtgggagccggagtcggatctccctctagtcagctgtatgagcacaccgttgagggaggtgagaagcaagtcgtcttcactcaccgaatcaatctccccccaagtaccggttgcgggtgccctccaggcacagagccgcccgtgctagcttctgaagttcaggcactgcgggtccgcctagagattttggaagaattggtgaaagggctgaaagaacaatgcactgggggctgttgccccgcttcagcacaagccggtactggtcagacagacgtaaggaccctttgcagtttacatggagtgtttgatttgtccagatgcacgtgcagctgcgagcctgggtggggcggcccaacatgcagcgacccaaccgatgctgaaatccccccatcttccccacccagtgcgagcggcagctgtcctgatgattgtaacgaccaagggcggtgcgttagagggagatgtgtgtgttttccaggatataccggaccatcctgcggctggccctcctgcccaggcgattgtcaggggcgagggagatgcgtgcagggcgtgtgtgtctgccgcgcaggcttctccggtccagactgcagccagaggtcctgtccaagaggctgttcccagagaggacgatgtgagggagggagatgcgtgtgtgaccctggttacaccggtgatgattgtggaatgagatcatgtcctcgaggctgtagccagaggggccgttgtgagaacggcagatgcgtgtgcaacccgggctacacaggagaggattgcggggtacggtcctgcccaagaggatgcagtcaaagaggacggtgtaaggacggcagatgtgtctgtgatcctggatatacaggtgaagattgcggtacacgcagctgcccttgggactgtggagaaggcggtcgctgtgtggatggtaggtgcgtatgctggccaggctacaccggtgaagactgctctaccaggacatgcccacgggattgccgagggcgggggcggtgcgaagatggagagtgcatctgcgacaccggatatagcggagacgactgtggagttaggagctgccctggggattgtaatcaacgtgggcgttgcgaggacgggaggtgtgtgtgttggcccgggtacaccggtacagactgcgggtcccgtgcttgtccgagggattgccggggccggggcaggtgtgagaatggggtgtgtgtctgtaacgctggctactctggggaggattgcggcgtccgctcttgccccggcgattgccgcggacgcgggcgatgtgagagtggaagatgtatgtgttggcccggctacacaggaagggactgtggcaccagagcatgccccggagactgtcgcgggcgtgggcgctgcgtggatggtcgctgcgtttgtaatccagggtttacaggtgaagattgcgggtcgcggaggtgccctggcgactgccgcggccacggactctgtgaggatggcgtgtgtgtgtgtgacgcagggtacagcggcgaagactgttccacccgctcctgtccggggggctgccgggggagaggacagtgtctggacgggcggtgtgtttgtgaggacggctactctggtgaggattgtggagtccggcaatgtcctaacgactgctctcagcacggcgtgtgtcaagacggcgtttgtatctgctgggagggttatgtgtcagaagactgttccatccggacctgcccaagtaattgccacggccgcggtagatgtgaggaaggccgatgcttgtgtgatccaggctataccggtcctacgtgcgccacacgtatgtgccccgcagactgcagaggaagaggccgctgtgtgcagggcgtttgtctgtgccacgtcgggtatgggggggaagattgtggccaggaggagccccccgcgagtgcctgcccaggtgggtgcgggccgcgcgaactatgccgcgcaggacagtgcgtctgcgtggaaggtttcaggggaccagactgtgccatacagacctgtcccggtgactgccgagggcgaggtgagtgccacgatggatcttgtgtatgtaaggacggctacgcaggggaggattgtggcgaggaggtgcctactatcgaaggaatgaggatgcaccttctcgaagagactactgtccggactgagtggacccccgcaccgggccctgttgacgcctacgaaatccagttcatccctaccacagaaggcgcctctcccccatttaccgccagggttccatcatcagcctccgcatacgatcagcggggtctggctcctggacaggagtaccaagtaactgtgagagccttgcgggggacctcatgggggctgccggcaagtaaaacaatcaccacaatgatagatggccctcaggatcttcgagttgtggctgtcacccctacgaccctggagctgggctggttaagaccacaggctgaggttgacagattcgtggtgtcatacgtgagcgcgggtaatcagcgagtgcgtctggaagttcccccagaagccgacggcacactgctgaccgatctgatgccaggcgtggagtatgtagtgacggtcaccgcggaacgcggacgggcggtcagttatccggccagcgtgagggccaacacaggcagcagtcctctgggcctgctcggaaccaccgacgaaccccctccctctggcccttctacaacacaaggcgcccaggcccccctgctgcagcagcggccgcaggagcttggggaactgagagtactagggcgcgacgagaccggccgtctgagagtggtatggaccgcccagcccgataccttcgcctattttcagctgagaatgcgtgtgccagaagggccaggggctcatgaggaagtgctccctggagacgtgaggcaggccctcgtgccaccccccccacccggcaccccctacgaattgtccctccatggcgtccctccagggggcaagccttcggatcccatcatatatcagggcattatggataaagatgaagaaaaacctggaaagagctctggccctccacgcctgggggagctgaccgtgaccgatcggacctcagactcattgctgcttcgctggacggtgcccgaaggagaattcgatagctttgtcatacagtataaagacagagatggacagcctcaggtcgtgcccgtcgaaggtccccaacgaagtgcagtcattacaagcctggacccaggccggaaatataagtttgtgctgtatgggttcgtgggcaagaagcgtcatggacccttggtcgccgaggcgaagatcctgcctcagtccgatccgtctcctgggacaccaccacatctcgggaatctgtgggtgaccgatcctacaccagacagcttacatctgagttggacagtacctgaggggcaatttgacacattcatggttcaatacagagatagagatggcaggccccaggtggtgccagtggaaggcccagaacgctcctttgtggtttcctcactggacccagatcataaatataggttcacgctgttcggcatcgctaacaaaaagaggtatggccccctgaccgccgacggaactacagcacctgagcgaaaggaagagccccctcgccctgaatttctcgagcagcctctgcttggtgagctgactgtcacaggcgtgactccagactccctcagactgagttggactgttgcacaaggacccttcgactcctttatggtacagtacaaggatgctcagggccagcctcaggcagtgccggttgcgggggacgaaaacgaagtaaccgttccagggctcgaccccgaccgaaagtataaaatgaatctctacggtttacgaggcaggcagagggtcggacccgagtccgtggtagccaaaaccgctcctcaagaagacgtggatgagactccctctcccaccgaattgggaacggaggcacccgagtccccagaagagcctctcctgggtgaactgactgtgaccggatcctcccctgattccctgtctcttttctggaccgtgccgcaggggtcgttcgattctttcaccgtccagtacaaggaccgggacggtaggccacgtgcagttcgggttggcggcaaggaatccgaggtgaccgttggaggacttgaaccaggccacaaatataaaatgcatctctacggactgcacgaaggccagcgggttggacctgtcagtgcagtcggcgtgacggcccctcagcaggaagagactccacctgctacggaaagccccctggagcctcgcctcggtgagctaactgtaacagacgtaacccccaatagtgtcggattatcgtggactgtccccgaaggccagttcgatagctttattgttcagtacaaggataaggacggccaaccacaggttgtgccagtcgccgccgaccagagggaagtcactgtctataatttagagcccgagcggaagtacaaaatgaatatgtacgggctgcatgatggacagcgcatgggtccgctgtccgtagtgattgtgacagcccctctcccccctgccccggcgacagaagctagcaaaccaccgctggaacctaggctgggagaactgaccgtcacggatataacccccgacagcgttggattaagttggaccgttcctgaaggggagttcgacagctttgttgtccaatataaggaccgggacggtcaaccccaggtagttcctgttgctgccgatcagcgtgaagtaaccatcccagacttagagccctcccgaaagtacaaattcctgctgtttggaatccaagacggcaagcgccgttcgcctgtgtcagtagaggcgaaaacagtggcgaggggagatgcctctcccggagctcctcctagacttggtgagctgtgggtgacggaccctaccccagacagcctgaggctgagctggactgttcccgagggacagttcgactcattcgtggtgcagtttaaggacaaggacggtccccaggtggtccccgtagaggggcacgagcggtctgttacggttacacctcttgacgcaggtcgcaaatacagatttctactgtatggtctactcggaaagaaacgccacggaccgctgacagccgatgggacgacagaggctcgatcagctatggatgatactgggactaagcgccccccaaagcctaggctcggagaagaactccaagttacaaccgtcacccaaaattctgtgggcttgtcctggaccgtacctgaggggcagttcgactcattcgtggttcagtacaaggatcgcgatggccagccacaggtcgtccctgtggagggaagtctccgggaagtgtccgtgccagggttggaccccgctcatagatataagttgttgctgtacggactccaccacggaaagagggtggggccaatcagtgcagtggcaatcacagctggtagagaagaaacagagacagagaccaccgcccctacgcctccagcaccggagccacatctcggtgagttgacagtggaagaggctaccagtcataccctccatctgtcttggatggttactgaaggcgagttcgattcattcgaaattcagtacacggaccgggacggccaactgcagatggtcaggattggcggggaccgcaacgacattaccctgagcggcttagaatcggaccatagatacttggtgactctgtacggattctcagacggcaaacacgtgggccccgtgcacgtcgaggccctcacagtaccggaggaagagaagccctccgaacctcctactgctaccccagaaccgcctataaagccaaggctcggagaactgactgttacagacgccacgcctgattcactgtctctgtcttggactgtgccagagggccagttcgatcacttcctagtgcagtaccggaatggcgacgggcagccgaaggctgttcgggtgcctgggcacgaagagggagtaacaatttcagggctggaaccagatcacaagtacaagatgaatctctacggttttcacggaggtcagagaatgggtccagtgtcggtcgtgggcgttaccgcagctgaagaggagacaccaagccctacggagccaagtatggaggccccggaacctgccgaggagccacttctaggcgagctgacagtcactggctccagtccggactccctcagcctgagctggacagttcctcagggacgttttgattccttcacagtacagtacaaggatagggacgggagacctcaggtcgtccgcgttggaggcgaggagagcgaagttaccgtggggggcctcgagccgggtcgcaagtataagatgcacctgtacggcctgcacgaggggcggcgcgttggacctgtaagtgctgtgggtgtgaccgcacccgaagaggaatctcccgacgcccccttggcgaaacttaggctcggtcaaatgacggtgcgagacatcacatctgattcattgagcctgagttggactgtgcctgagggccaattcgatcactttttagtccagttcaagaatggcgatggacaacccaaagcggtgagggtgcccggacacgaggatggagtcaccattagcgggttggaacctgatcataaatacaagatgaatctttatggcttccatggcggtcagagagttggacctgtttcagcagtaggtttaacgtag

SEQ ID NO: 137534 - DNA, 2022 bp, Artificial Sequence
  Description of Artificial Sequence: Synthetic coding sequence
atgaggttgagttggtctgtcgctcagggaccttttgactcctttgtggtgcagtacgaagatacgaatggacaacctcaggcattgctggtggacggtgaccagtctaaaattttgatatccggactggaaccgagcacgccctataggttcttattgtacgggctgcacgaagggaaacgcctaggaccactgtccgccgagggcaccacaggactggctcccgccggccagaccagcgaagagagtaggcctcggctgagccagctctccgtgaccgacgtgacaaccagcagcctgcgattaaactgggaggctcctcccggggctttcgattcattcttgcttcgtttcggagtgccaagtccttcaaccctcgaaccacacccccggcctctgctgcagagggaactgatggtgccaggcactaggcatagcgcagtcttgcgagatctccgcagtgggaccttgtacagcctgaccctctatggccttagaggtccccacaaggctgacagtattcagggtacagccaggactctctcccctgtgcttgaaagccccagggatctgcagttctctgaaatcagagagacatcagctaaagtaaactggatgcctcccccctctagggccgattccttcaaagtttcataccagctcgccgacgggggcgagcctcagagcgttcaggtggacgggcaagcacgtacacagaagctacagggcctcatacctggcgcacgctacgaggtcaccgtggttagcgtgcgtggcttcgaggaaagcgaacccctgacaggattcctcacaaccgttcccgatggacccacgcagctaagagccctcaatctcaccgagggatttgcagttttgcactggaaacctccacagaacccagtcgacacatacgatatccaggtgacagcccccggagcccctccccttcaagcagaaaccccaggatcagctgtagattatccattgcacgatcttgtgctccacaccaattatactgcaactgtgaggggcctaaggggtcccaacctgacctccccggcttcaataacatttacgacgggtctggaagcccctagagacctcgaggctaaggaggttaccccacgcaccgccctgctgacttggacagaaccaccggtgcggccagctggctacctgttgtcattccacacgcccggcggtcagacccaggagatcctgctcccaggcggcatcactagtcatcagctccttggactctttccttctacgagctataatgcgaggttgcaggccatgtggggccagagtctgttacctcccgtgtccacttccttcaccaccggcggactgagaattccatttccccgggactgtggggaggagatgcagaacggagcgggcgcctctcgaaccagcacaatattcttgaatgggaacagagagcggccgctcatcgtgttctgcgacatggaaaccgacggcggcgggtggcttgtctttcagagacggatggacggccagacagacttctggcgggactgggaggattacgctcatgggtttggcaacatcagcggcgaattctggctcgggaacgaggcgctccatagcctgactcaggccggggattatagcatgagggtggatcttcgcgccggtgacgaggccgtgtttgcccaatacgacagcttccatgtggattccgctgctgaatactacagactacatcttgaagggtaccacggtaccgccggcgattccatgagttaccatagcggaagtgtcttttcagcccgggatcgggatcccaattcactccttatctcctgcgcagtttcttacaggggggcttggtggtacagaaactgccactacgctaacctcaacggactttacggctccaccgtggatcaccagggagtatcttggtaccattggaaaggcttcgagtttagcgtcccttttaccgagatgaagctacggccgaggaacttccgcagccctgctggggggggctag

SEQ ID NO: 137535 - DNA, 654 bp, Artificial Sequence
  Description of Artificial Sequence: Synthetic coding sequence
gcccccggaaaggacgaagaaatggcacccgccagcacagagccccctacccctgagccacccattaaaccaaggctagaggagctgactgtgaccgacgccacaccggacagtctatccctatcatggacggtcccagaagggcagtttgaccatttcttagttcaatacaagaacggagacggccagccaaaggctacgcgggtccccgggcacgaagacagagtcacaatttccggactcgagccagacaataagtacaagatgaacctctacggtttccacggaggccagcgagtcgggccagtatcagctattggcgttacggctgcagaggaagaaaccccctcccctactgaaccaagtatggaagccccagaaccacctgaagagccgttgctgggggagttaactgtcaccggatccagccctgactctctgtctctctcttggactgtaccccagggccggttcgactcattcactgtccaatacaaagaccgtgacggccgacctcaggttgtccgagtcggcggcgaagaatccgaggtcaccgttggcggcttggaacctggtcggaaatacaaaatgcatctctacggactgcatgagggccgccgcgtgggccccgtcagcaccgtgggagtgacatag

SEQ ID NO: 137536 - DNA, 12729 bp, Artificial Sequence
  Description of Artificial Sequence: Synthetic coding sequence
atgatgcccgcgcaatatgcccttacatcctccctggtattgctggttctcctgagcactgcacgggccggccccttctcaagtcgcagtaatgttactttgcccgctcctagacctcccccccagccaggcggccataccgtgggagccggcgtaggatcacctagtagccaactctacgagcacaccgtggagggaggtgagaaacaggtggtctttacccatcgaattaacttgcctccatccaccgggtgcggatgtccacctggtacggaacctccagtgttagcaagtgaagtgcaagcactcagagtgcggctggaaatactggaagaactggtgaagggactgaaagagcagtgcacaggaggatgctgtcccgcgagcgcgcaggctggcaccggacagaccgatgttcgaactctctgcagcttgcatggagtttttgacctgagccggtgcacatgctcctgtgagcccggctggggcgggcctacatgctccgaccctaccgacgctgagattccgccttctagccctccaagtgcctcaggctcctgtcccgacgattgtaacgaccagggcagatgcgttagaggacgctgcgtgtgcttccctggctatactggaccctcttgcggctggccatcctgtcccggagattgccaggggcgtggacgctgcgtgcagggcgtctgtgtctgccgcgctggtttctccggtcctgactgttcacagcggtcctgtccccgaggctgctctcagagaggaaggtgtgagggtgggagatgcgtatgtgatccaggatacacaggagacgactgtggcatgcggtcatgtccaagaggttgttcccagcgaggtcggtgtgaaaatggccggtgtgtttgcaaccccggctacactggggaagactgtggtgtgcggtcgtgcccccggggctgcagccagaggggtagatgcaaagacgggcggtgtgtttgcgacccgggttatactggcgaggattgcggcacgcgtagttgtccatgggactgtggcgaaggcggaagatgcgtggacggcagatgtgtatgctggccagggtataccggcgaagactgttccactcgcacctgccccagagattgcaggggccggggccgctgtgaagatggcgaatgtatttgtgacaccgggtactccggagacgattgcggcgtgcgctcctgcccgggagattgcaaccagcgaggcagatgtgaagatggtcggtgtgtttgttggcccggatacactggcacagattgtggatccagggcatgtcctcgagactgtcgcgggcgggggcgctgcgaaaacggtgtgtgcgtctgcaatgccggatacagtggtgaggactgcggagtgcggtcttgcccaggagactgtagggggagaggtcgctgtgaatcaggacggtgtatgtgttggcccggctatacaggtcgtgactgtggcaccagagcctgtcccggtgactgccgcgggagagggaggtgtgtcgatggaaggtgtgtctgcaatcccggcttcaccggcgaggactgtggctcccgaaggtgccccggtgactgtcgcggtcacggcctctgtgaggatggggtctgtgtgtgtgacgcaggatattccggggaagattgttcgacaagatcctgtccgggggggtgtcggggccgaggtcagtgtctggacggtcgctgcgtgtgcgaggatggctattcaggcgaagattgcggtgtgcgacagtgtcccaacgattgttctcaacacggtgtgtgtcaggatggcgtctgcatctgttgggaaggatatgtgagcgaggactgctccatcagaacttgcccatctaattgccatggaagaggaagatgtgaggagggaaggtgtctatgtgatcctggctataccggccctacctgtgcaactcgtatgtgtccagcggattgcagaggtcgtggacgctgtgtccaaggagtgtgcctatgtcacgtgggctatgggggtgaggactgcggtcaggaggagcccccagccagcgcatgtcccggagggtgcggcccccgagagttatgtcgggccggccagtgcgtgtgtgtggaaggctttcgcgggcccgactgcgccatccagacctgccctggcgattgtcggggccggggtgagtgtcatgacggtagttgcgtctgcaaagatggatatgcgggtgaagattgtggcgaggaggtgccaacaatagagggcatgcggatgcacctgctggaggagacaaccgtccgtactgaatggactccggctccaggaccagtcgatgcttacgagatccaattcattcccacaactgagggcgcaagtccacctttcaccgctcgagtgccttctagcgccagcgcttacgaccagcgagggttagccccagggcaggaatatcaggtaacggtgcgcgcattgcggggaacatcctggggattacctgcctctaaaactattacaacaatgatcgatggtccccaggatctgcgcgtggtggccgttacgcctacaactctcgagcttggttggttaaggccccaggctgaagtcgaccgcttcgtagtctcatacgttagcgcgggtaaccaacgtgttagactggaggttcctcccgaagctgacggcacactgctaaccgatttgatgcccggagtcgagtatgtcgtaactgtgacggcggagcggggtagggccgtctcgtacccagcatctgtgcgcgcgaacaccggctcgtcccctttgggcctgcttgggacgaccgacgaaccacctccttctggaccatctactactcaaggcgctcaggctccccttctgcagcaacggccacaagagctgggcgagctccgggtgctgggtcgggatgaaacagggagactgagagtggtctggacagctcagccagatacattcgcatactttcaactcagaatgcgcgtgccagaaggcccaggagctcacgaagaggtactccctggtgacgtgcgacaggccctcgtgcccccccctcctcctggtactccttatgaactctccttgcacggggtcccacccggcggcaaaccctccgatccgatcatctaccagggcattatggacaaagacgaggagaagccaggtaagagctcgggacccccgagactcggggaactgactgtgactgaccgtaccagtgattcacttctgctgaggtggacggtccccgagggcgagttcgactctttcgtgattcaatacaaggaccgagacggacaacctcaggtggtgccggtcgaaggcccgcagaggtctgctgtgatcaccagtctggacccaggcaggaaatataaattcgtgctctacggctttgtggggaagaagcgccatgggccactggtagccgaagcgaaaatcctcccgcagtccgacccatcacctggcacccccccgcgcctgggtaacctctgggtaacggatcccactccggacagtctgcatttgagctggactgtgcccgaaggccagttcgacactttcatggtccagtaccgagaccgggacgggcgaccccaggtcgttcctgtagagggcccggagcggtcatttgttgtctcttctctggaccctgaccacaagtaccgcttcaccctgttcgggatagctaataagaagcggtatgggccattgaccgcagacgggaccacagctccggaacggaaagaggaacctcccagacccgaattccttgagcagcctctgctgggggaactgactgtgaccggcgtgacaccagattccctaagattgtcatggaccgttgcccaaggcccgttcgattcctttatggtccagtataaggatgcccaaggacagcctcaagccgtgcccgtagcaggtgacgagaacgaagtgacagttcctggattagatcccgacaggaaatataagatgaatctgtatgggctgagaggccggcagcgggtgggaccagagtccgtggtagcaaagactgcaccccaagaggacgtggacgagacaccttcacccaccgagctcggcaccgaggcccctgaatcgccagaggagcctctactcggggagttgactgtcactgggagctcccccgatagtctgtcgctgttttggacagttcctcaaggatcgttcgatagcttcaccgtgcagtacaaggatagagacgggcggcctcgtgcagtacgtgtcggagggaaagaatctgaagtaaccgttggtggactagagcccggacataagtacaagatgcatctctatggcctgcacgagggtcagcgtgtggggcccgtgtcagcggtgggggtgacagctccgcagcaagaagagacaccacctgcaacggaatccccgttagagcctagattaggagagctgacagtgaccgacgtgaccccaaatagcgttggactgtcatggaccgtgccggaggggcagtttgactcatttattgtccagtacaaagacaaggatggacagccccaggttgtcccagtcgccgctgatcagcgagaggtaaccgtctataacttagaacctgaacgcaaatacaagatgaacatgtatggtttgcacgatgggcagaggatgggtcctctctcggtcgtgatcgtcacagcccccttacctccagccccggccactgaagcgtcaaaacctcccctggagcctcggctgggagagctaacggtgaccgacattaccccggattcagtgggcctgtcatggaccgtgccagaaggagaatttgattcctttgtggtgcagtacaaagatcgcgatggtcaaccccaggtcgtgcccgtggcagcagaccagcgggaggtgactattcccgatctggaaccgagccgcaagtataagttcctcctgttcgggatccaggatggcaaaagacggagtccagtgtccgttgaggcgaaaaccgtggctaggggagacgcttctcctggagcaccacccagactgggcgagctctgggtgactgaccccacgcccgattctttacgtctatcatggacagtgcccgagggtcagttcgactccttcgttgtacaatttaaggataaggatggcccacaggtagtcccagtggaaggccacgagcgcagcgtcacagtaaccccactggacgcagggcgcaaatatcgttttttgttgtatgggctgctggggaaaaaacgacacggcccacttacggccgacggtacgactgaggccaggtctgcgatggatgatactggcaccaagagaccccccaaaccgagactgggagaggagctgcaggttacaaccgttacccagaattctgtaggcttatcttggaccgtgccagagggtcagttcgatagcttcgtggtgcagtataaggacagggatgggcagccacaggtggtccctgtcgagggtagcctaagagaagttagcgtgcccgggctggaccccgctcatcgttataagctgttgctgtacgggcttcatcatgggaagcgagtaggcccgatctctgctgttgcgattacagccgggagggaggagacggagactgagaccaccgctcctacaccaccggcaccagaaccacaccttggtgaactgactgtggaagaggccacaagccatacacttcatctgtcttggatggtgacagagggcgaattcgattcatttgagatccagtatacagatagagacggccagttgcagatggtgcgcattggcggtgacaggaacgatatcacactgtctggcctggagagcgatcatcgatacctggtgacactgtatggatttagtgacggtaaacatgtaggaccagtgcatgtagaggctctgaccgtcccagaggaagagaagccaagcgaaccaccaaccgctacgcccgaacctcctatcaaacctaggctcggcgagctaacagtgactgacgccacacctgactcgctttccctatcttggacagtcccagaaggccaatttgaccattttttggtacaatatcgcaatggcgacggccagcccaaagctgttcgggtgcctggccatgaggaaggcgtgacaattagcggactggagccagaccacaagtacaaaatgaatctgtatggtttccacggaggacagcgcatgggtcctgttagcgtggtgggggtcacagcagctgaggaggaaactccttctcctacagagccgtctatggaggcccctgaaccagcagaggagcctttgcttggcgagctcacagtgaccggctcctctcctgacagtctttctctgtcgtggacagttccccagggtcgcttcgactcatttaccgtgcagtacaaggatcgggatgggcgtccgcaggttgtgagagtcggtggggaagagtccgaggttaccgtcggaggtttagaaccaggccggaagtacaagatgcacctgtatgggctgcacgagggacgtcgcgttggacccgtgtcagccgttggggtgaccgcacctgaggaggagtcaccagatgcacctctcgcaaagctgcggttgggtcaaatgactgtgcgcgacataacctccgactctctgagcttgtcatggactgtgccagagggacagtttgaccattttttagtgcagttcaaaaacggagatgggcagcccaaagccgtgcgagtccccggccatgaggatggagtgactatcagcggtcttgagccagatcataaatacaaaatgaacctgtacggattccatggtggccagcgggtgggacctgtgagtgctgtgggactgactgctcctggaaaggatgaggagatggccccggcatcaacagaaccacctacccctgaaccccccatcaagcctcggctcgaggagctcactgtgacagatgcaacccctgatagtctaagccttagctggactgtgccagaaggtcagttcgaccactttctggtgcagtataaaaacggggacggccagccgaaggccactcgggtacccggacacgaggacagagtgaccatctccggtctcgaacctgacaacaaatacaagatgaatttgtatggatttcatgggggccagcgggtcggaccagtttccgcgatcggcgtgaccgctgcagaagaggagaccccttcacccacagagccaagcatggaggccccagagcctccagaggaacccctgctgggagagctgaccgtgactggctccagccccgattccctttccctcagttggacagtgcctcagggtagatttgatagtttcaccgtccaatacaaggaccgagatggccgcccacaggtggtgagggttgggggagaggagtctgaagtcactgttggcggccttgagccgggccgcaaatataagatgcacctgtacggactgcacgagggtaggcgggtgggtcctgtgtccacagtgggggtcaccgcaccccaggaagacgtagatgaaaccccttctcccaccgaaccaggaactgaggccccggagccacctgaagaacccctgttgggggagctcactgttaccggaagctctcccgactctctttccttatcctggactgtgccgcagggccggtttgatagcttcactgtgcaatacaaggatagagacggacgaccgcaggctgtccgtgttggggggcaagagtctaaagtaaccgttcggggtttggagccagggaggaaatacaagatgcacttatacggcctgcacgagggccggcggttaggcccagttagtgcagtaggggtgaccgaggacgaggccgaaacgacacaagccgtgcctactatgacacctgaacctcccattaagccaaggctgggagaactcaccatgacggacgccacgcctgattccctgtccttgtcttggaccgtgcccgagggacagttcgatcacttcctagtgcagtacagaaacggcgatggacagcccaaagccgtcagagtccctggacacgaggacggagttaccatctccgggctcgagcctgatcacaagtataagatgaacctgtatggcttccatggcgggcagcgtgtaggccccataagtgtgatcggggtcaccgccgccgaggaggagactccttctcctacagagctaagcacggaggcccctgaacccccagaggaacctttgctcggcgagctaacagttaccgggagctcacctgacagcctttcgctgtcatggacaatccctcaaggacactttgactccttcacggtgcagtacaaggacagagatggaaggccccaggtgatgagggtcagaggagaagaaagtgaagtgaccgtcggggggctggagccaggccgaaagtacaagatgcacttgtacggactgcatgaaggtaggcgcgttggccctgttagtaccgtcggtgtgactgaagacgaggccgagaccactcaggctgtaccaactaccacgcctgaaccccctaacaagcctcggctgggcgagctcacagtgaccgacgctacaccagattcattaagcctgagctggatggtgcctgagggacagttcgatcacttcctggttcagtatcgtaatggagatggccagcctaaggtcgtccgagtgcccggccacgaggatggagttacgatttctggactggaacccgatcacaagtacaaaatgaatctgtacggctttcatggcgggcaaagagtcgggcctatttccgtgatcggagtaactgctgcagaggaggaaacgcctgccccgaccgagcccagtaccgaagctccagaaccaccagaggagccactgctaggcgaactgacggtgacggggtcttcgccagacagcctgtccttgtcatggacaatccctcagggcagatttgattcgtttaccgtccaatacaaggacagagatggcagacctcaggtggtgagagttcgcggcgaagaatcagaggtcacagtgggcggactggaacccggctgcaaatataaaatgcacctctacgggttacacgagggacaacgggttggacccgtttcagccgttggggtgactgcccctaaagatgaggcagagactacccaggccgtgcccaccatgacacctgaaccacccattaaaccacgattgggagagctcactgtaactgacgccacccctgatagtctgtctctcagctggatggtcccggaaggtcagttcgatcactttctggttcagtatcgtaatggagatggccagcccaaggccgtgcgtgtccccggacacgaagatggggtgaccatctctggactggagccagatcataaatacaaaatgaatctttatgggtttcacggaggccagagagtaggtcctgtctcagcaattggcgtgaccgaggaggagacgcccagcccaaccgaaccctctaccgaagcacccgaggccccagaggagcccctgctgggagaactgactgttactgggtcttcccccgattccctttctttgagttggactgttcctcagggcaggttcgattcctttaccgtccaatacaaagaccgcgatgggcagccacaggtggtgagagtgagaggtgaggaaagcgaggtgacagtcggcggactagagcctggcaggaaatacaaaatgcacctgtacggcctgcatgaggggcagcgggtaggacctgtgtctacagtggggataacggctcccctgccgacacccctgcccgtcgagccccggctgggcgagctcgctgtggccgctgtcacatccgactccgtgggcctcagttggacagtagctcaaggaccattcgactctttcctagtccagtaccgcgatgcccaggggcagccacaggccgtgcccgtaagcggggacctcagagccgtcgcggtgtctggcctggatcctgcccgaaaatataaatttttgttgttcgggctccagaacggtaagcgtcatggtccagtgcccgtggaggcacgaactgcacccgatacaaaaccaagtccacgccttggagagctcacagtgacagatgccactccagatagtgtagggctgagttggacagtgcccgaaggagaattcgactcattcgtggtgcaatataaggacaaggatggtcgactacaggttgtgccagtggccgctaaccaaagggaagtgactgttcaaggccttgaaccctccaggaaatataggtttctgttatacggattgagcggccgtaagagattgggccccatatctgcagatagcacgactgccccattggagaaggagctgccaccccacctcggagaattaacagtagctgaagagactagtagcagtctgcggctgagctggacagtggcccaagggccctttgatagttttgtggtccagtatcgcgacaccgatggacaaccccgcgctgtgcccgtcgccgcagatcagaggaccgtgacagtcgaagatttggaacccgggaagaaatataagtttctgttgtatggcctgctaggcgggaaaagattggggcccgtatcagctctgggaatgaccgcccccgaggaggatacccccgcacccgaattagcacccgaggctcctgagccaccggaggaacctcggttgggcgttctgactgtgaccgataccacgccagattctatgcgcctctcctggtcggtggcccagggcccgttcgactctttcgtggtgcaatacgaggacaccaatggccagccacaggctttgctggtggacggagaccagtctaaaatcctaatctccggcttagagccttcgacgccttacagatttctcctgtacggacttcacgaaggcaaaaggctggggcccctaagcgccgaggggacaaccggacttgccccagcagggcagactagcgaagagtcccgaccgagactaagccaactttcagtcactgatgtcaccacctcatcccttaggctaaattgggaagccccacctggcgcatttgattcatttcttctgcgatttggagtccctagcccaagcacgctagaacctcatccgaggcctctcctgcagagggaactcatggtgcctggcactagacattcagcagtcttacgagacctgaggtctgggacactctactcattgaccctgtatggcctgagagggcctcataaggccgactctatccagggaacagcacgcaccctgagccccgttctggaaagcccccgcgacctccaattcagcgagatccgggagactagcgcaaaagtcaactggatgccaccaccctccagagcggacagttttaaagtgagctaccagctagccgatggaggggagccacagtccgtgcaggtggatggacaggccagaactcagaagctacaaggcctgatcccgggggctcggtacgaggtgactgtggtgtccgtccgcggctttgaggagagcgaaccactcactggtttcctgacaactgtgccagatgggcccacgcagctgagagctctcaacctcacagaaggatttgcagttctgcattggaagcctccccaaaaccccgtggatacttatgatattcaagtcacagcccccggtgcacctccactccaggcggaaacaccaggaagcgcagtcgactatcctcttcacgacctggtcctgcatacaaattacactgccacagtacgcggacttcggggtccaaacctgacaagtcccgcatctatcaccttcactactggtctcgaggccccaagagatttggaagcgaaagaggtcacaccacgcacggctctgcttacctggaccgagcctcccgtgaggcccgccgggtatctgcttagctttcacacccctgggggacaaactcaggagatactgttgccaggtggcattacatctcaccaactcctgggcttatttccttccacctcctacaatgcccggctgcaggctatgtggggccagagcctactgccgccagtttccacctcctttacaactggcggcctgcgaatcccatttccccgagactgtggagaagagatgcagaatggagccggtgcgtctcgcaccagcacaatctttctcaacgggaacagggaacgccccctgattgttttctgtgacatggagacagatggcggtggctggcttgtcttccagaggcggatggacggtcagaccgacttttggagagactgggaggactacgctcacggtttcgggaacatttctggcgagttctggctcggaaacgaggccctgcattctttgacccaagccggagactatagcatgcgtgtggatctgcgggctggagatgaagccgtgttcgcacaatacgactccttccacgttgattcagccgctgagtattaccgtctgcatttggagggctaccacggcacagcaggagacagcatgagctatcactccggctcggtgttctccgcacgggatcgcgaccctaacagcctgctgatctcctgcgccgtctcttatcgaggcgcatggtggtaccggaattgtcactatgccaatctgaacggcttgtatggctctacagtagatcaccagggtgtctcttggtatcactggaaggggttcgaattctccgtgcccttcacagaaatgaagctgcgtccgcgcaactttcgcagccccgccggcgggggatag

SEQ ID NO: 137537 - DNA, 12729 bp, Artificial Sequence
  Description of Artificial Sequence: Synthetic coding sequence
atgatgcctgcccaatatgcgctaacctcttctctggtcttattagtgctgctgtcaacggctcgagctggtccctttagtagtcgaagcaatgtaacacttcctgcccctcggccacccccccaaccagggggacataccgtcggggcaggcgtcggcagtccatcatcacagctctacgagcatacagttgagggaggtgagaagcaagtcgtcttcacccatcgcatcaatcttcctcccagcaccggttgtggctgcccccccggtaccgagcctcccgttctagcttcagaagtgcaggccctcagagtccgtctggagattctcgaggaactggtgaaaggtctaaaagaacagtgcactgggggctgctgtcctgcgagcgcccaggcaggcactggtcagacggatgtgcggacattatgcagtttgcacggggtattcgatctctctcggtgtacttgcagctgtgagcctggctggggcggacccacgtgttctgaccctacagacgcggagatccccccatcatcccctccatcggcgagtggaagttgtcccgacgattgtaacgaccagggcaggtgcgtacgcggccgatgtgtctgctttccaggatacactggccctagttgcggctggccatcttgcccgggagattgtcagggacgagggagatgtgtgcagggcgtgtgcgtgtgcagagccggtttttccggccccgactgctctcagagaagctgccccagaggctgttctcaacgaggtaggtgtgaaggcggccgatgcgtgtgtgacccaggctatacaggagacgactgcgggatgcggagctgtccaagggggtgctctcagcgcgggagatgtgaaaatggacggtgcgtgtgcaacccaggctacgctggagaagattgtggtgtgaggtcatgtccgagagggtgctcacaacgggggcgctgtaaggacggcagatgtgtctgtgaccctggctatacaggagaggattgcggtacacgttcctgcccatgggattgcggggaaggcggtcggtgtgtggacggacggtgtgtatgctggcccggatacaccggtgaggattgcagtaccaggacttgccctcgagactgtaggggaaggggccgctgcgaagacggtgaatgtatttgtgacactggctatagcggcgatgactgcggggtacgttcatgtcccggcgattgcaaccagaggggacggtgtgaggatggacggtgtgtctgttggcccggatacaccggaacagattgcggctctcgggcatgcccccgggactgcagaggaagaggcagatgcgaaaacggtgtgtgcgtatgtaacgccgggtactctggagaggactgcggagtgaggtcctgtcccggcgactgtcgggggaggggacgttgtgaatctggaagatgtatgtgctggcctggatataccggaagagactgtggaacacgtgcctgcccgggcgattgcaggggacgcggaaggtgcgtggacggtagatgtgtgtgcaaccctggcttcacaggagaggactgcggcagcaggcgatgcccaggggactgccgcggccacggcctgtgtgaggatggagtttgcgtctgtgatgctggatatagtggcgaggattgttctacgagatcctgtccaggcgggtgcaggggcagaggccagtgcctagacgggaggtgcgtgtgtgaggatggctactccggcgaggactgtggcgtgcgccaatgtcccaacgactgctctcaacacggcgtgtgccaagatggtgtctgtatctgttgggaaggctacgtgtccgaggattgcagcattaggacatgcccatccaattgccacggacgaggaaggtgtgaggagggtcgatgcctgtgcgatcccggatacaccggccccacctgcgccacacgaatgtgtcctgccgattgccgcgggcgagggcgctgtgtacaaggagtctgcctttgtcatgttgggtacgggggcgaagattgtgggcaggaggaaccaccggcctctgcctgtccaggaggttgcggacctcgggagctctgtcgggccggtcagtgcgtgtgcgttgagggtttccgtgggcccgattgtgcgattcagacctgtccaggggattgcagagggagaggggaatgtcacgatggatcatgcgtgtgtaaagatggatatgcaggagaagattgtggagaggaggtgcccacgattgaaggcatgagaatgcacctgctagaagaaaccactgtgcggacggaatggactccagcccctggacctgttgacgcctatgagattcaattcatcccaacgaccgagggcgcatcccctccttttaccgcgcgcgtgccctcatccgcctctgcctacgatcaacgtggcttagcaccgggacaggagtaccaggtcactgtcagggcgctccgcggcacaagctggggactacctgcctccaaaactattacaactatgatagacgggccacaggacctccgggtagtcgcggtgacccctaccacactggaattgggctggcttcggccccaagctgaggtggaccgattcgtggtgtcgtacgtgagcgcggggaaccagcgggttcgcctcgaagtccctccagaagccgacggaaccctgctgaccgacctcatgcccggcgtggagtacgtggtcactgtaacggcagagagagggcgtgctgtttcttatccagcttccgtccgtgcgaacacagggtcttccccactgggcctgcttggcaccacagacgaaccccccccgtccggcccaagtacaacacaaggagctcaggcccctttactccaacagcgcccacaggaacttggagagttgagggtgcttggccgggatgaaactggcagactgcgggtggtgtggacagcgcaacctgacacattcgcctactttcagctccgtatgcgcgtgcccgagggtccaggagcccacgaggaggttctaccaggggacgtccggcaggccctcgtccctccaccccctcccggtaccccctacgagctctctctccacggcgttcccccagggggcaagccgagcgaccccatcatctaccagggcataatggataaggatgaagaaaaacccggaaagagctcaggtcccccaagactcggggagctgaccgtgaccgatcggacatccgactctctcctgttaaggtggaccgtccctgagggcgagttcgactctttcgtgatccagtacaaagacagagacgggcagccccaggttgtccccgtcgagggacctcaacgcagcgctgtcattacctcccttgatccaggtagaaaatacaagtttgtgctgtatgggttcgttggtaagaagcgccatggcccactcgtggccgaagcgaaaatattgcctcagtccgatccttctccgggcactccgccacatctgggtaacttatgggtgacagaccccacgccagatagtctgcatttgtcatggaccgtgccggagggccagttcgacacttttatggttcagtatcgtgacagagatgggcgcccgcaggtggtcccagtcgaagggccagagagaagctttgtggtgagcagcctcgacccagatcataagtacaggtttaccctatttggcatcgcaaataaaaagcgatacggcccgctcaccgctgacggcacaaccgccccagagagaaaagaggagccccctaggcccgagtttctagagcagcccttgctcggggagctaacggtaaccggagtgacccctgattccctcagactgtcctggaccgtggctcaggggccattcgattcctttatggtgcaatataaggatgcccagggacagccgcaggccgtccctgtagccggcgatgaaaatgaagtcacagttcccggtctagatccggatcgtaaatacaagatgaacctgtacggactgagaggaaggcagcgggtcggcccagagtcagtagtggctaagaccgccccccaggaagatgtagatgagaccccttctccgaccgagcttggcactgaggccccagagagcccagaagagcccctcctcggcgaattgaccgtcaccggcagctcccccgacagcttgagcctattctggacggtacctcaaggctctttcgattcctttaccgtccagtacaaggatcgcgatggacgccctagggcagtccgggttggagggaaggaatcagaagtgaccgtgggtggcctagagccagggcataaatacaagatgcacctgtatggtctgcatgagggacagcgtgtgggaccggtatctgccgtgggggtaaccgccccacaacaggaggaaacacctcctgctactgaaagtcctttggagccaaggctgggcgagctgacggtaacagatgtcaccccaaattcagtgggcctgtcatggacagtccctgagggccagttcgacagctttattgtacagtacaaggataaggacggccagcctcaggttgtgcccgtcgccgctgaccaacgagaagtcaccgtctacaaccttgagcccgagaggaagtacaaaatgaacatgtacggtcttcacgacggtcagaggatgggccccctatccgtggtgattgtgacagcaccgctcccacctgcccccgcaactgaggccagcaagccaccactggagcctcggctaggtgagctcaccgtcacggacatcacccccgactccgtgggactgagctggactgttcctgagggcgagtttgatagtttcgtggttcagtacaaagaccgggacggacagcctcaggtagtgcccgtggccgctgaccagagagaagtgactatcccagatttggaaccctcccgcaaatataaattcctcttgttcggcattcaggatggtaaaaggaggtcacctgtgagcgttgaggcaaagaccgtcgcccgtggtgacgcgtcgcccggcgccccaccccgccttggagaattatgggtgactgatcccacacccgattctctcagattgtcatggactgtccccgaggggcaatttgactccttcgtcgtgcagttcaaggacaaggatgggcctcaagtagtccctgtcgagggacatgagcgcagtgtaaccgttacacccttggatgctggacgtaagtaccgattcctgttgtatggcctgcttggtaaaaagagacacgggcccctcacggcagacggcactacagaggcaagatccgccatggatgataccggtaccaagcgaccacccaagcctaggctgggagaagagctgcaggtgactacagtcacccaaaactccgttgggttgtcttggacagtgcctgagggccagtttgactcctttgtggtccagtataaggaccgggacgggcagccacaggtcgttccggtggagggctctctccgagaggtgagcgttcccggattggacccagctcataggtataaactcctgctgtacggccttcatcatggcaagcgagtaggccccatttcagcggtggctatcacggctggtcgggaggaaaccgagaccgagaccactgccccaacacccccggcccctgagccccacctcggagaactaactgtcgaagaggccacgagccataccctccacctgtcttggatggtgacagagggagaattcgattccttcgagatccaatatactgatcgcgatggtcagcttcagatggtgcggattggtggagatcgcaacgatatcacgctctctggcttagagtctgaccacagatacctggttacactgtacgggttttcagatggtaagcacgtgggtccagtgcatgttgaggccttaaccgtgcctgaagaggagaagccaagtgaacctcccaccgctacccccgaaccacctatcaaaccccggttgggggagcttaccgtgactgacgccacccctgactcactcagtctttcatggacggtgcctgaagggcaattcgatcactttctggtgcagtatcggaacggggacggccagcccaaggcagtgcgggttccgggacacgaagagggcgtgaccatcagcgggttggaacccgatcacaagtataaaatgaatctctacggtttccatggaggacaacgtatgggaccagtcagcgttgtcggtgttaccgccgccgaagaggaaactccgtctcccacagaaccctctatggaggccccagagccggccgaggaacctctgctcggcgaactcacagtcacgggatccagccccgacagtctctcacttagctggacggtacctcagggccgctttgatagctttactgtgcagtacaaggatagagatggccggccccaggtagtccgagtgggcggggaagagagcgaggtgacagtagggggtctggagcccggaagaaagtacaaaatgcacctgtacggtctgcacgagggtagaagagtaggtcccgtcagcgccgtcggggtgactgcgcccgaggaggagtctccagacgcacccctggccaaattgcgccttggtcagatgactgttcgggacatcacctcagacagtctatcgctgtcctggaccgtcccggaaggccaatttgatcactttcttgttcagtttaagaatggggatggccaacccaaggcggtgcgagtccctggccacgaagatggtgtaactatcagcggactggagccggaccataagtataaaatgaacctgtatggctttcatggcggccagcgagtcggtcctgtgagtgcggtaggtttaactgctcccgggaaggatgaggaaatggctccagcatctacagagccacctactcctgagccgcccattaagcctagactcgaagagttgacggtcacagatgcaacgcccgacagtctgagtttgtcatggactgttccggagggccaatttgaccattttctagtgcagtataaaaacggggatgggcagcccaaagccacccgggttcccggccacgaagacagagtgactatttctggtctcgaacctgacaataaatacaaaatgaacctgtacggtttccacggggggcaacgggtggggcctgtgtcagcgatcggcgtgactgcagcggaggaggaaacacccagtcccaccgaaccttctatggaagcccccgagccacccgaggagccactgctaggcgaattgacggttacagggagtagtccagactccctttccctgtcttggactgtacctcaaggccgctttgactctttcaccgtgcagtataaggatcgtgatggccggcctcaggtggtgagagtaggcggcgaagagtcggaggtcactgtcggcgggctagagcccgggcgtaagtataagatgcacctatacggcctgcatgaaggccgacgcgtggggccagtaagcacagtgggagtcacagcccctcaagaagatgttgatgaaaccccttcacctacagagccgggcacagaggcccccgaaccgccggaagaacctcttcttggcgagttgaccgtcacaggttcgagtcccgatagcctgagcttgagctggaccgtcccgcagggccgattcgacagctttacggtgcaatacaaggatcgggacggccggccgcaagctgtcagagtgggcggccaggagtccaaagtgacggtgaggggcttagaacccgggcgaaagtacaaaatgcacctgtacggactgcacgaggggcgccggctgggacctgtgtccgccgtaggagtgacagaggatgaggccgagaccactcaggccgtgcccactatgacgcccgaaccgcctatcaaaccaagattgggagagctgaccatgaccgacgcaacacccgactcactgagtctgtcctggaccgttccggagggacaattcgatcattttctggttcagtaccgaaacggtgacggtcaacccaaggcagtccgggtgccaggtcatgaggacggcgtcaccataagcgggctggaacctgaccacaagtacaaaatgaatctgtacgggtttcatggggggcagagagtaggccctatcagcgttattggtgtcacagcagcggaggaagagacaccaagccccaccgaactgtctaccgaagcacctgaaccacctgaggaacctctgttgggggagctgaccgttactggctctagccccgactcgctgagtctgtcatggaccatcccgcagggccacttcgactcttttactgtccagtataaggatcgagatggcagaccccaagttatgagagtgaggggcgaggaaagcgaggtgacagtcgggggcctggagcctggaagaaagtataagatgcacctctacggattgcatgagggaagacgtgtgggccccgtatcaactgtaggggtgacagaggatgaggccgaaaccacacaggcggtcccaacaaccacgccagaacccccaaataagccccggcttggtgaacttactgtcacagacgccaccccagactctttatcactgtcctggatggtaccggagggacagttcgatcatttcctagtgcagtatcgcaacggggacggacaacctaaggtagtcagagtgcccggccatgaggacggggtgaccatatccggtctggaacccgaccataaatataagatgaacttatatggctttcatgggggtcagagagtaggtccaatttctgtgattggggtaactgctgccgaggaggagaccccggcacctacagagcccagcactgaagcaccagagcctcctgaagagccccttctcggcgaattgactgtcaccgggtcatctcctgattcactttcactatcttggacgatcccacaaggccggtttgattcatttacagtccagtacaaggacagggacggccggccacaggtagtccgagtgcggggggaagaatcggaggtcacggttggagggttggagcctggctgcaagtacaaaatgcatctatacgggctccacgaaggccagagggttggccctgtgtccgctgtgggcgtgaccgcgcccaaagacgaagccgagactacccaggcagtgccaacaatgactcccgaaccacccattaaaccccgactgggggaattgactgttaccgacgcaaccccagattctttgtctctgtcctggatggtacctgagggccaatttgatcatttccttgtccagtatcggaatggagacggtcagcccaaagctgtgagagtccccgggcacgaggatggtgtgacaataagtggtctcgagccagaccacaaatataaaatgaacctctacggcttccatggtggccaacgggtagggcccgtaagtgctatcggcgtgaccgaggaggagacaccttcccctaccgaaccgagcacagaggcccctgaagcccctgaggagccccttctcggagagctcaccgttaccgggagttcgcccgacagtttgtcattgagctggactgtccctcagggccgtttcgactctttcaccgtgcagtataaagacagagacggccagccacaggttgtgagggtgagaggtgaagaaagtgaggtcacagtggggggactcgagcccgggcgtaagtacaaaatgcatttgtacggcctccacgaaggccaaagagtgggcccagtctccacagttggcattaccgcccctttgcctaccccacttcccgttgagcctaggctcggcgagcttgccgtagcagctgtaacatccgacagcgttggactgtcctggacggtggcacagggtcctttcgactcattcctcgtgcagtaccgggacgctcagggacagccacaagcggttccagttagtggcgatctcagggctgtggccgtgagtggcctagaccccgcacggaaatacaagtttctgctgttcggccttcagaatggaaaacgccacggtccagtcccagtggaggcccgaacagccccagacactaaaccgagtccgagacttggggaactgacagtgactgacgccactcctgatagtgtgggtctctcctggacagtgccagagggcgaattcgacagtttcgtggtgcagtacaaggacaaggatgggaggcttcaggtcgtgcccgtggctgcaaaccagagggaagtgactgtgcagggccttgagccttcccgcaagtatagattcctactgtatgggctgtctgggaggaagcgcctggggcccatttcagccgattcaacgacagcaccactagagaaggagctgccaccacatctgggggaactcacagtagcagaagagacctcttctagtttaagactgtcctggaccgtggcgcagggaccctttgactcctttgtcgtgcagtatcgcgacacggatggacaacctcgagccgttcccgtagccgctgatcagagaacagtaacggttgaagacctggaacccggcaagaagtataaatttctgctgtatggtctcttaggcggtaaaaggctggggcccgttagtgccctggggatgaccgccccagaagaggacacccccgcccccgaattggctcctgaggctcccgaacccccggaagagccacgcctgggagtccttaccgtgaccgatacaactcccgactcaatgagactgtcatggtccgtggcacaaggccccttcgactccttcgtcgtgcagtatgaggacacaaatgggcagcctcaggctctgctggtggatggtgatcagtccaaaatcctgatttccggactggagcccagtacgccatatcgttttctgctgtatgggctgcatgaaggtaagaggctgggaccactgagcgcagaaggaaccacaggattggcccctgctggacagacgagtgaggaatccagacctagactctctcagctgtccgtgactgatgtaaccacaagttccctgcgcctaaactgggaggcaccacccggtgctttcgacagcttcctcctgcgtttcggggtcccatctcctagtacacttgaaccacatcccaggcccctgttgcaacgggagctgatggtgccaggaacccggcatagcgccgtgctgagggatttgcggtccgggaccctctattcactgacgctctacggccttagggggccgcacaaagccgactcaatccagggtaccgctcgtacactgtccccggtattagagtctccccgcgatttacagttcagtgaaattagagagactagcgccaaggtgaattggatgccccctccatcacgcgctgactcttttaaggtcagctatcagcttgcagatgggggcgagccccagtctgtgcaagtggacgggcaggcacgcacacagaaactgcagggcctgatccccggcgctcgttacgaagtaacggtggtgtccgtaaggggatttgaggagagtgagccccttaccggttttctgactaccgttccggatgggcctacgcagcttagggcattgaatctgacagagggctttgcagtgcttcattggaagccaccacagaacccagtggatacttacgacgtgcaggtcaccgccccaggtgcccccccactgcaggccgagactcctggaagcgctgtggactaccctctgcatgatttggttctacataccaactacactgccaccgtacggggtttacgtggtcctaacctgacctcacccgcttccatcactttcactaccggactggaggccccaagagacctggaagcgaaggaagtgactcccagaacggctctgctgacatggactgagccccctgtcagaccagctgggtaccttcttagtttccatacgccaggtggacagaaccaggaaatcctcctgcctgggggtatcactagccaccaactgctcggtctgtttccatctacctcctataacgcacggctacaggcaatgtggggtcaatctttgctcccgcccgtttctacttcttttacaacaggagggttaaggatccctttccctcgagactgcggcgaagaaatgcagaacggcgcgggagcaagcaggacctcgacaattttcttaaacggcaacagagaacgccctttgaacgtgttctgcgacatggaaacggacggcgggggctggctggtgttccaacggcgcatggacgggcagaccgatttttggagagattgggaagattacgctcacgggtttgggaatatcagcggcgaattctggctaggcaatgaggctctacactcactgacccaggccggagactacagtatgcgtgtcgatctgagagcgggcgatgaagctgtgttcgcccaatatgatagcttccacgtggacagtgccgctgagtactatcgcctccacctggaagggtaccatggtactgccggagactccatgtcctatcacagcggctctgtgttctcggctcgcgacagagatcccaattctcttctgatttcgtgcgcagtttcttataggggagcatggtggtataggaattgtcactacgctaatttgaacgggctgtatggatctaccgtggatcaccaaggggtctcttggtatcattggaagggcttcgagttttctgttccctttacggaaatgaaacttcgaccccgcaacttccgctccccagctggtggcggctag

SEQ ID NO: 137538 - DNA, 843 bp, Artificial Sequence
  Description of Artificial Sequence: Synthetic coding sequence
atggtaaccgagggcgagttcgatagttttgagatccagtacactgaccgagatgggcaactgcagatggtaagaataggtggtgatcgcaatgatatcacactgagcgggctggaaagtgaccacaggtacctggtgacactctatggcttctcagatgggaagcacgttggaccagttcacgtcgaagcgttgacagtgcccgaggaggaaaagccttcagagccccctaccgccacgcctgaaccccctatcaaaccgcgactgggtgaactgacagtcactgacgctacccccgactccctctccctctcgtggactgtcccagagggccagtttgatcattttttagtgcaatatcgaaacggcgatggtcagcctaaggccgtccgggtgcctggacacgaagagggcgtcaccatatccgggctggagcctgaccacaagtataaaatgaacctatatgggtttcatgggggacagaggatggggccagtgtccgtcgtgggggtgaccgccgctgaagaagaaacaccctcgcccaccgaaccctctatggaagctcctgagcctgccgaggagcccttattaggtgaactgaccgttactggttctagccctgattcactaagcctcagctggacagtgcctcagggccgcttcgactcctttactgtgcagtacaaagatagggacggtagaccccaggtcgtccgcgtaggtggggaagagtccgaggtcaccgtgggcgggctcgaacccgggaggaaatataaaatgcacttgtatggacttcacgagggaagaagagtgggtccagtttccgcagtgggcgtgacatag

SEQ ID NO: 137539 - DNA, 12729 bp, Artificial Sequence
  Description of Artificial Sequence: Synthetic coding sequence
atgatgcccgcccagtatgcgttaaccagtagtctggtcctactcgtcctcttgagtacagcaagagcaggcccgttctcctcgcggagcaacgtcacactccccgcgcctcgtcctcctccccaacccggtgggcacacagtgggcgccggggtgggctcccccagctctcagctctacgagcatacagtggagggcggagagaagcaagtggtttttacccataggatcaaccttcctccatccaccggatgcggttgtccacccggcaccgagccacccgtcctggcttctgaggtacaggcgttgagagtgagactcgagattcttgaggaattagtgaaaggtctaaaagagcaatgcaccggcggctgctgccccgcaagcgcccaggccggcacaggacagacagatgtaagaacactctgcagtctccacggcgtcttcgacctgtcgcgctgcacctgcagctgcgagccaggatggggtggccccacatgttccgaccctacggacgcagagatcccccccagctcccctccatccgcctcgggttcctgtcccgacgactgcaatgaccagggaaggtgcgtgaggggccggtgtgtgtgtttccccggatatacgggtcccagttgcggctggcccagctgcccaggcgactgtcaaggccgtggccggtgcgttcagggagtgtgtgtgtgtagggcaggtttcagcggaccggattgttcccagcgcagttgcccacgcgggtgttctcagcgtgggcgctgtgagggcggacggtgtgtgtgcgaccccggatacactggcgatgactgtggcatgcgctcttgcccccgtgggtgtagtcagcggggccgctgtgagaacgggcgctgtgtttgtaatccaggctacactggcgaggactgcggcgtccggtcctgtcctcggggttgcagtcaaagagggcggtgcaaagacggcaggtgtgtgtgcgacccgggctatactggggaggactgtggaacgcgtagctgtccttgggattgcggggaaggcggccggtgtgtggatggaagatgtgtctgctggcccggttacactggagaggattgctctacgagaacatgcccaagggattgccgagggcgcggcaggtgcgaggatggcgagtgtatctgtgacaccgggtacagtggcgatgattgtggcgttcgctcttgccctggggattgtaaccagcggggtaggtgcgaggatggccgctgcgtctgttggccagggtatacagggactgattgtggctctcgggcttgccctcgcgactgtaggggcagaggcagatgtgagaatggggtttgtgtgtgtaacgctggctactctggagaggattgtggtgtgcggagctgtcctggcgactgccgcggcagaggtagatgcgaatccgggcgctgcatgtgttggccagggtacaccggccgtgattgtggaacaagggcgtgtcccggtgactgtcgcggccggggaaggtgcgtggatggcagatgcgtctgtaacccaggcttcaccggagaggattgcggaagcaggagatgtccaggcgattgtaggggacacgggttatgtgaagacggagtctgtgtgtgtgatgcagggtactcgggcgaagattgcagcacaaggagctgtcctggggggtgcagaggaagagggcagtgtctggacggccgctgcgtatgtgaggatggttattcaggagaagattgtggggttagacagtgtcccaatgactgcagccagcacggcgtttgtcaggatggggtgtgtatctgctgggagggttatgtgtccgaagactgtagcatcaggacctgccctagcaactgccacggacgagggagatgcgaagagggcaggtgtctatgcgatccaggatacactgggcctacgtgcgccacaagaatgtgtccagctgactgccgcggcagagggaggtgtgtacagggtgtatgtttgtgccatgtcgggtacggcggcgaggactgtggtcaagaggagcctcccgctagtgcatgtcccggcggttgtggaccaagggaactgtgccgcgccggtcagtgtgtctgtgtcgaaggatttcgcggacccgactgtgccatccagacgtgccctggcgattgccgcggtaggggcgaatgccacgatggctcctgtgtgtgtaaagatggctacgccggcgaagattgtggggaggaggtgcctactatcgagggcatgagaatgcatctgttggaggaaactacagtgcgcaccgaatggacccctgctccggggccagtcgatgcatatgaaatccagttcatcccaactaccgaaggtgcctcgccacccttcacagcaagagtgccgagctctgcctccgcatacgaccagcggggattagcccctggacaagagtaccaagtgactgtgcgcgctcttcggggcacctcatgggggctgcctgcctccaagacaattactaccatgattgatggcccacaagacttgagagtggtggcagtgacccccacaaccctggagctgggctggttacgcccccaagccgaggtggatcgtttcgttgtgagttacgtgtcagctggaaatcagagagttcgccttgaggtgcctcccgaagctgacggcacccttctaaccgacctgatgcccggggttgaatacgtggtcactgtaaccgccgagcgcgggagggccgtgtcctaccccgcaagcgtgcgagcaaacaccggctccagtccgctcggcctactgggaacaacagatgaaccacctccctccggtccaagtactactcagggcgcccaggcgcctttactgcaacaacggccacaggagctcggagaactgagagtactgggtcgggacgaaaccggccggctgagagttgtgtggaccgcacaaccagatacctttgcctatttccagctcagaatgagggtcccagagggtcctggggcccacgaggaggtcctccctggagacgtgaggcaggctctcgtgcctccgccaccccccggaacgccgtacgaactcagtctgcatggtgtgcctcccggagggaagcctagcgacccaattatctatcaaggtatcatggacaaggacgaggaaaagcccggcaagtcttctggtccgccacggctgggcgagctcaccgttaccgatcgaaccagcgactccctgctgctgcgctggaccgtgcctgagggcgagtttgactcttttgttatccagtataaagatcgcgatgggcagccacaggtcgtacccgtagaaggtccccagcggagtgcagttatcaccagtttggaccctgggcggaaatacaaattcgtcctctatgggttcgtgggtaaaaagcggcatggccctttggtggctgaagccaagatcttgccacaatctgacccatctcccggtactccaccacgcctaggcaatttgtgggtaaccgaccctacgccagactctctgcatctgagttggacagtgcccgaaggtcaatttgacacatttatggtgcagtatcgggatcgggacggtcggccacaggtggtcccagtcgaaggacctgagcggtccttcgtcgtttcctcactcgatccagaccataaataccggttcaccctcttcggcatcgccaataagaagcgctatggcccactgacagctgacgggactacagcacccgagcgcaaagaagaacctccacaccccgagttcttggaacagccactgctcggcgaactgactgtgacaggcgtcacccccgattcgttgcgcctgtcttggacagtagctcagggcccctttgatagctttatggtccaatacaaggacgcccaaggccaaccccaggctgtgccagtggccggcgacgaaaatgaagtcacggtcccaggcctggatccggaccgtaagtacaaaatgaatttgtatgggcttaggggcagacagagggtgggccctgagagcgtcgtggcgaagacagcacctcaggaagacgtggatgagactccctcccctaccgagttggggacggaagccccggagtcacccgaggaacctctattgggcgaattaaccgttaccggctcctcaccagattcattatcactcttttggactgtgccacagggatccttcgatagttttactgtccagtataaggaccgggatgggagaccaagagcggtccgggtcggaggaaaagaatccgaggtgactgtgggcggtttagagcctgggcataaatacaagatgcatctgtacgggctccacgagggccagagagtgggacctgtgagtgctgttggcgtcacagccccacaacaggaggagaccccgcctgcgacagaaagtccactggagccaagattgggagagctgaccgtgacggacgtgacgccaaactctgttggactgtcatggactgttcctgaaggacagttcgactcctttatcgtacagtacaaggacaaggacggccaaccacaggtagtgccagttgccgccgatcaaagggaagtcaccgtctataatcttgagccagaacggaaatacaagatgaacatgtatggcctgcatgatggacagaggatgggtccactgagcgtcgtcatcgtaacagcacccctgccccctgctccggctaccgaggcatctaagccgccgctggagccgagactcggggagctgaccgtcactgatattacacccgactcggttggattatcctggactgtgccagagggagagttcgattcctttgtcgtgcaatacaaagatcgggatggccaaccacaggttgtccccgtagctgccgaccagagagaggtcactataccggacctggagcctagtcgtaagtacaaattcctgttgttcgggatccaggacgggaagagacggagtcccgtttccgtggaggcgaagaccgtggcaagaggtgacgccagccctggcgcccctcctcgtctgggggaactgtgggtcactgaccctacacccgactcactcaggttaagctggaccgtccctgaaggacaattcgattcctttgtcgtgcagtttaaggataaagatgggccccaggtagtacctgtggaaggacatgaacgctctgttaccgtgactcctctcgacgcgggccggaagtatcgcttcctgctgtacggcttattgggcaaaaaaaggcatgggcctttgactgcagacggaacaaccgaggccaggtccgccatggatgacacgggcaccaaaagaccgcccaagcctcggctcggtgaagaactgcaggtaaccactgtgacgcaaaattcagtgggcctgtcatggacagtgcctgagggacagttcgacagcttcgtagtgcagtacaaagatcgggacgggcagccacaggtggtcccagtagaaggctcactgcgtgaagtctctgtcccaggactcgaccccgcacatcgctacaagcttctgctgtatggtctccaccacggcaaacgggtgggccccatctctgccgtggcgatcacagctggaagggaggagacggaaaccgaaaccaccgcgccaactccacctgcgccagagccacacctgggggaactgactgttgaggaagccaccagtcacacattacatctaagctggatggtgacagaaggcgagttcgattcttttgaaatccagtacactgatagagacggccaattgcaaatggtgagaatcgggggcgatcggaatgacatcacacttagcggtttggagtcggaccatcgctaccttgttaccttatatggattttcagatggtaagcatgtaggccctgtccatgtcgaggcgctgacagtaccagaggaggaaaagcccagcgagcctccgacggctacccccgaaccccctataaaaccacggctgggagagctcaccgttacggacgcaacccctgatagtctaagtttgtcttggaccgtgcccgaaggacaatttgaccattttctcgtgcagtaccggaacggggatgggcagccaaaggctgtgagggtccccggccacgaagagggtgtaacgatctctgggctcgaaccagatcataaatacaagatgaacctctatggtttccatggaggccagcgcatgggtcccgtctcagtggtcggcgtgaccgctgcagaagaggagaccccctctcctactgaaccatctatggaggcaccagaacccgcagaagagccacttctgggcgaactgactgtgacagggagtagccccgacagtctgagcttgagctggacagttcctcagggacgttttgactcatttaccgtacaatacaaagaccgcgacggacggccacaggtggttcgggtaggcggtgaagaaagcgaggtgacggtgggaggcctggagcccggccggaagtataaaatgcacctatacggcctacacgagggaagacgcgtcgggcccgtgtccgcggtcggcgtgacggctcccgaggaggaaagtccagacgcccccttagcaaaacttaggctcgggcaaatgaccgtcagggatattacctcagatagcctctcactctcttggaccgtgccagaagggcaattcgaccactttctcgtccaattcaagaatggggacggtcaaccaaaagccgtgcgtgtgccaggccacgaggatggggtgacaataagcgggttagaacctgatcacaagtataagatgaacctctacgggtttcacgggggccagcgcgtaggacccgtgtctgccgttgggctgactgcacccggtaaagacgaggagatggctcctgccagtaccgagcccccgacgcccgagcctccaataaaaccccgactggaggagctgacggtcactgatgctacaccggactctctttctctgagttggaccgtcccggagggacagttcgaccactttctggtgcagtacaagaatggcgatgggcaacccaaggccacacgggtcccagggcatgaagacagagtaacaattagtgggctggagcctgataacaaatacaagatgaatctgtacggcttccacggcggtcagcgtgtcggcccagttagcgctatcggggtcacggctgcagaggaagagacccccagccctacagaaccttcaatggaagctccggaaccccccgaggagcctctgcttggagagctgacagtcacgggctcctcacctgattctctgtcactctcgtggaccgtgccacagggcagattcgactcattcaccgttcagtataaggatagggatggtaggccgcaggtcgtgcgagtgggaggagaggagtctgaggtcaccgttggcggcctggagcctggtaggaagtacaagatgcacctttacgggctccacgaagggagaagagttggccccgtctctactgttggagttacagcacctcaagaggacgtcgacgaaacgccttccccaacagagccgggaactgaagcaccagagccacctgaagagccactcctaggcgagctgacagtgactggtagcagccccgatagcctatctctgtcttggacggttccccaggggcgcttcgactcgttcactgtacagtacaaagacagagacgggcgtcctcaagcggtgcgggtgggtggtcaggagagtaaggttactgttagaggtctcgagccaggaagaaagtataagatgcacttgtatggcttgcatgaaggacggcgtttgggacccgtttccgcagtgggcgtaacggaggacgaggccgagacaacccaggccgtcccgactatgacacctgaacccccaatcaagccacggctcggggagctcaccatgacagatgcgacgcctgactccctgtctttgtcctggaccgtccccgaggggcagtttgaccactttctggtgcagtatagaaatggcgacgggcaacccaaagctgtcagagtccctggacacgaggatggggttaccatcagcggactggaacccgaccacaagtataaaatgaatctctacgggttccacggcggacagcgggtcggtccgataagcgtgatcggggtgaccgcagccgaagaagagactccatccccaacagaattgtccaccgaggctccagaaccacctgaagagccactcctaggagagctgacggtgaccggcagcagcccagattctctcagtctgtcatggacaatcccccagggacacttcgattcattcactgtccagtataaagacagggacggacgcccccaggttatgcgagtcaggggcgaggaaagtgaggtgaccgtgggcggccttgagccagggaggaaatacaaaatgcatctgtacggactgcatgagggccgtagggtgggcccagtttcaacggttggagtgaccgaggatgaggctgaaacgactcaggcagtaccgacaaccacgcctgaaccgccaaacaagccgcggctgggagagctcacagtgaccgatgccacaccggatagcctgtctctcagctggatggtccctgaaggacagtttgatcacttcctggtccagtaccggaacggagatggacagcccaaagtggtgagagtgccagggcacgaagacggagtgactattagtgggttggaacccgatcacaagtataagatgaacttgtatgggtttcacggggggcagcgagtcggaccgatctccgttatcggggtgaccgccgcagaggaggaaacacccgcccccaccgagccatccaccgaggcccccgagccacctgaagagcctctcctgggagagctaactgtgacgggttcatctcctgactcactcagcctctcctggaccattccccagggccgcttcgattcatttaccgtgcagtacaaagatagagacgggcgccctcaggtggtgcgcgtaaggggagaggaatccgaggtaaccgtagggggattagaaccgggctgtaagtacaagatgcatctgtatggcttgcatgagggacagcgggtgggacccgtttccgccgtcggtgtgacagctcccaaagatgaagccgagactacacaagccgttcctactatgacccccgaacctcccatcaaacctagactaggggaactgacggtcactgatgcgacccctgactcactttccttaagctggatggtgcccgagggccagttcgatcatttcctggtccaataccgcaatggagacggccagccaaaagccgtgagggtgccaggacatgaggacggggtcacaatctcggggctcgaaccagaccataagtacaagatgaacctgtacgggttccacggcggacagagggtgggcccggtgtccgctattggcgtgaccgaggaagaaacaccctctcccacggaaccgtctacggaagcacccgaagctcctgaggaacccctcctgggagagctaacagtcactgggtccagccctgatagcctgtctctgagttggacaattccgcaggggcgcttcgatagtttcactgtccagtacaaagaccgagacggccagccacaggtcgtccgtgtaaggggagaggaaagcgaggtaacagtgggtggcctggaacccggcaggaaatacaagatgcatctctatggactacatgagggccagagagtgggacctgtgagcaccgttggcatcacggccccgttgcctactcctctgcccgtggaaccccggctcggggagcttgctgtggcagccgtaaccagcgatagtgtcggcctctcctggacagtagctcaagggccatttgattccttcctcgtgcagtatagggatgcccaagggcagccacaagccgttccagtttctggagacctaagagccgtggctgtaagtggcctggatccagctagaaagtacaagttcttactttttggtcttcagaacggcaagcgccacggacctgttcctgtcgaagccagaactgcaccggacaccaaacccagcccgcgccttggcgagcttaccgtcaccgacgcgaccccagactctgttgggctatcatggacagtgcccgagggtgaattcgactcattcgtggtgcaatataaagacaaggacggtcgtctgcaggtagttcccgtggccgctaaccagcgcgaggttactgtccagggtctggagccttcacggaaatatcgatttctcctctatggtctgagcggcaggaaaagactgggcccaatctccgctgattctaccacggccccacttgagaaggagctcccacctcatctcggcgaattaaccgtggccgaggagacttccagtagcctgaggctgtcctggacagttgcgcagggaccatttgacagctttgtggtgcagtatcgagatacagacggtcagccacgggccgtgcctgtggcagcggatcaacggacagttaccgtagaggaccttgaacctggcaagaaatacaagttcctgctttatggcctcctggggggcaaacgccttggacccgtttccgcactgggcatgactgcccctgaggaagacacacctgcgccggagttagctccagaggccccagagccccctgaggaacctcggcttggcgttcttacggtgacagatacaacgccagacagcatgagattgtcatggagtgtggcccaggggccctttgactcattcgttgtacaatacgaagacactaatggacagcctcaggctctgctcgtcgatggagaccaaagtaagattctgatatctggactggaacccagcacgccatacagatttctgttgtacgggttgcatgagggcaagcggctgggaccactgtcagccgagggcaccaccggactggcccctgcgggccaaacctctgaagagtcccgtccacgtctttcccaactctccgttactgacgtgaccacatcttcactacggctgaactgggaagcaccacctggcgcttttgactccttcctcctgcgttttggcgtcccatctccttccaccctggagcctcacccaagaccactgctgcaaagagagctcatggttcccggcacacgacactcggcagtcctgcgtgaccttcgcagcggtacgctatatagtctgactttgtacggtttgaggggaccacacaaagccgattctatacagggcactgcccgcacactctctcctgtcctagaatcccctagggacctccagttttccgagattagggaaacaagcgcaaaagtgaattggatgccccctccaagcagggccgattcattcaaagtgagctatcagctggcagacgggggagagccccagtcagtacaggtagatggccaagcccgaacgcagaagttacagggcctcatccccggagcaaggtacgaggtgaccgtggtgtccgtcagaggattcgaagagagtgagcctctgacaggcttcctgactaccgtgcccgacgggcccacccagctgcgcgccttaaacctcaccgagggattcgccgttctgcattggaagcccccgcagaatcctgtggatacctacgacatccaagttacagctcctggagcgcctccactccaggccgagacccctgggagcgctgtggattaccctttacacgacctcgtccttcataccaattatacggccacggtcagaggtctgcgcgggcccaacctgaccagccccgcgtctattacattcaccacagggcttgaagccccgcgcgacctggaagcaaaagaggtcacacccagaaccgcattgctgacctggacagaaccaccagtcagacccgccggctacctgctgtcattccataccccaggcgggcagactcaagagatcttgctgcctgggggcattacgtcacaccagcttcttggcttatttccatctacctcatataacgccaggctgcaggccacttgggggcagtctcttcttccaccagtgagtacttcctttaccaccggggggctcagaatccccttcccacgcgactgcggcgaggaaatgcagaacggggccggtgcctccaggacttccaccattttcctgaatggcaatcgagaaaggcctttaaacgtgttttgcgatatggaaacagatggggggggttggctcgtttttcagaggaggatggatggccagacagatttctggcgagactgggaggactatgctcatgggttcggcaatatctccggcgaattctggctcggcaatgaggctctgcatagtttgacccaggcaggcgattattccatgcgggtcgatctgcgggcgggcgacgaggccgtttttgcacagtatgattcttttcacgttgatagcgctgccgaatattacagactgcatctggagggctaccacggaacagccggagacagcatgtcctatcactcgggaagcgttttctccgcaagggacagagacccaaatagtctccttatctcctgcgctgtaagttatcgcggagcttggtggtacaggaactgccattatgccaatctgaacggcttatatggtagcacggtagaccaccagggagtcagctggtatcactggaaagggttcgagttttcagtaccttttacagagatgaagttgcggccgaggaacttcagatctcctgcgggaggcggatag

SEQ ID NO: 137540 - DNA, 2022 bp, Artificial Sequence
  Description of Artificial Sequence: Synthetic coding sequence
atgagactgagttggtctgtggcacagggaccattcgattccttcgtagttcagtatgaagatactaacggtcagcctcaggccctgctcgtggatggcgatcagtctaaaattctcatttccggcctggaacccagtacaccgtacaggttcctcttgtatggcctgcatgaggggaaacgtctggggcccctatccgccgaaggaactacaggcctcgcaccagcgggacaaacgtcagaagaatccaggccaagactgtcgcagctgtctgtgaccgacgtgacaacctcatccctgagactgaattgggaggcgccacctggggcgtttgactcatttttattgcgtttcggggtgccatctccgtcaacccttgagccccaccctagacccctgcttcagagagagttaatggtgcccggtacccgacacagcgctgttcttcgcgacctccggagtggcacactttacagcctgactctctacggactgcgtggaccacacaaagccgatagcatccagggtaccgcacggacgctctcaccggtgctggaaagcccgagggaccttcagttctctgagattcgggaaacgagcgccaaagtaaactggatgccgcccccatctcgggccgattctttcaaagtgagctaccagcttgcggacggcggggaacctcagtccgtgcaagtcgacggccaggccagaacccagaaactccagggactcatccccggagctcgttatgaggtcacagtggtgtcagtccgcggatttgaggagagtgaacctctcaccgggttcctaacaacagtacctgatggcccgacccagctgcgcgcgttgaatctaacagaggggttcgctgtgctccattggaaaccccctcaaaatcccgtggatacctacgacgtgcaagtgaccgctcccggggccccccccttgcaagccgaaactccaggctctgctgtagactatccactgcacgaccttgtgttgcatacgaactacaccgcaacggtgcggggcttacggggcccaaacttaactagtcccgcttctattaccttcacaacgggcctcgaagccccgagagaccttgaagccaaagaagttacgccccggacagccctgctaacctggactgagccaccagtccgccccgccggctacttgctcagttttcacactcccgggggccagaaccaagaaattttacttccggggggcatcacaagccaccagttgttgggcctcttcccatccacatcatataacgcacggctgcaggccatgtgggggcagtcactgctgccgcccgtgagtacctcgtttacaacgggaggcctcaggattccttttcctcgggactgcggggaggagatgcagaacggcgccggggcctcccggactagcacaattttcctgaacggtaatcgggaaagacccctgaacgtattctgtgacatggagacggacggtggtggttggctggtattccagcggcgaatggacggacagaccgatttctggcgagattgggaggattatgcccacggcttcggaaacatctctggagaattctggctcggtaatgaagctctccacagcttaacgcaagccggagattattctatgcgcgtagacctgcgtgcaggagacgaggctgtgttcgcacagtatgacagcttccacgtagacagcgcagccgagtactaccgcctgcaccttgagggttatcacggcactgccggcgactccatgagctatcattcgggctcagtgtttagtgcgcgcgacagagacccgaacagcctgttgatttcctgcgcagtgagctacagaggtgcttggtggtatagaaactgtcattatgcaaatctgaacgggctgtatggctccacagtagatcatcaaggagttagctggtatcattggaaaggcttcgaatttagtgtgcccttcactgaaatgaagctgcggcctcgcaatttccggtctccggccgggggcggttag

SEQ ID NO: 137541 - DNA, 654 bp, Artificial Sequence
  Description of Artificial Sequence: Synthetic coding sequence
gccccaggaaaggatgaggagatggctcccgcctcaaccgagccccccacaccagaacctccaattaaaccgcgcctggaggaactcacagttactgacgccacgccggattctctctcgctgagctggacagtgcccgagggtcagttcgaccactttctggtgcagtataaaaatggagacggccagccgaaggctacacgggtccccggccacgaagatcgggtgacgatcagcgggctcgagcctgacaacaagtataagatgaacctctatggattccatggcggacagcgcgtgggaccagtcagtgctatcggcgttaccgccgccgaagaggaaaccccgagccccacagagcccagtatggaagctcctgagccacctgaagaacccctgttgggcgaactgactgtgactggtagtagtccagatagcctaagcctctcttggacggtgcctcaagggcggtttgattcttttacggttcagtacaaggacagggacggtcgcccccaggtggtacgcgtcggaggagaagagagcgaagtgaccgtcgggggactcgagccaggccgcaaatacaagatgcacctgtacggactgcacgaaggaaggagagtgggccccgttagcaccgtgggcgtcacctag

SEQ ID NO: 137542 - DNA, 942 bp, Artificial Sequence
  Description of Artificial Sequence: Synthetic coding sequence
actgagccaggtacagaggctcccggaccgccagaggagccgcttctgggcgagctaacagtcacaggatcttcccctgactcactgtcattaagctggacagtgccgcagggacgtttcgactcattcactgtgcagtacaaagatcgcgatggaagaccacaggccgttcgcgtgggtggtcaagaaagcaaggtgacagttcgggggctggagcccggcaggaagtacaagatgcacctgtatggcctgcatgagggccggcggctgggtccggtttcggcggtgggcgtgactgaagacgaagcagagactactcaagccgtgcctacaatgacacccgaaccaccaatcaaaccccggctaggggagctcaccatgacagacgcgaccccagacagcctttctctctcgtggacagtgcccgaaggacagtttgatcatttccttgtgcagtaccggaacggtgatggtcagcccaaagcagtcagggtgcctggtcatgaggacggcgttaccatctcaggcttggagcctgatcacaagtataaaatgaacctctacgggtttcacggcgggcagcgagttggtccgatatccgtgatcggagtcacagctgcggaggaggagacgcccagtcccaccgaattgtctactgaggctcctgagcctcccgaggaaccgctgcttggtgaattgaccgttaccggaagcagccccgacagcttatctttaagctggacgataccccagggacatttcgacagcttcacggtccaatataaggatcgagatggcaggccccaggtgatgcgagtgaggggcgaggaaagtgaggtgacggtgggggggctcgagcctggtagaaaatataaaatgcatttgtacggactgcacgaagggcggagggtgggccctgtgtctaccgtgggggtgacatag

SEQ ID NO: 137543 - DNA, 942 bp, Artificial Sequence
  Description of Artificial Sequence: Synthetic coding sequence
atgacacctgagcctccaattaagccccggctgggcgagttaaccatgacggacgccacccctgacagcctgtctttaagctggactgtgccagaaggccagttcgaccatttcctcgtgcagtaccgaaatggagacgggcagccaaaggcagtccgggtcccaggtcacgaggacggtgttacaatctcgggactcgagcctgatcacaaatacaagatgaacttgtatggctttcatggcggtcaacgcgtcggccctatttctgtaacgggcgtgaccgcagcagaggaggaaaccccctcccccactgaactgtcaaccgaagccccagagccccctgaagagcccctcctaggagagctgaccgttaccggatcttcccccgactctctctcactcagctggacaattcctcagggccacttcgatagcttcaccgtccagtataaagacagagacggtagaccgcaggtcatgcgggttagaggagaggagagcgaagtaaccgtgggcggcttggagccgggtagaaagtacaaaatgcatctttatggattacacgagggtagaagagtgggaccggttagcaccgtgggagtcactgcccccgaagacgaagaggaagagacccccgccccaaccgagcccagcacagaggccccggagccacccgaagaaccccttctgggcgagctgacagtgactgggtcgtcacctgacagcttgagtctgtcatggaccattccacagggtcggtttgactcttttactgtgcagtacaaggacagagatggccgaccccaagttgtacgcgtgcgaggggaagaatcagaggtaacagtgggcgggctcgagcctggttgcaaatacaagatgcacctgtatggcctgcatgagggacaacgggtgggacctgtgagtgccgtgggtgtcacatag

SEQ ID NO: 137544 - DNA, 1281 bp, Artificial Sequence
  Description of Artificial Sequence: Synthetic coding sequence
gctggcgaggattgtggagaagaggttcctacaattgaagggatgcgaatgcatctgttggaagagacaacagttcgaaccgagtggactccagcgccaggcccggtcgatgcctatgagattcaatttatccctacgactgagggcgcctccccccccttcactgcgcgggtgccgagtagtgcatctgcttacgaccagagaggattagccccaggtcaggaataccaggtcaccgtgcgcgcgctccgaggaactagttgggggctccccgctagtaagacaataactactatgatagatggaccacaggaccttcgagtggtggccgtgacgcctaccacactggaactcggttggctgcgtcctcaggctgaagtggacagatttgtggtaagttacgtgagcgctggcaatcaaagagttcgacttgaggtccctcccgaggcagacggaaccctcctcaccgacttgatgcctggcgtggagtacgtagtcacagtgactgctgagaggggacgggcagtcagttaccctgccagcgtgcgcgctaataccgggtcatcacctttgggtcttctgggtaccaccgacgagcctcctccgtcaggtcctagcactacccagggtgcacaggcaccactactccagcaacgcccacaagagcttggtgaactgcgcgttttgggcagagatgagacaggcaggctacgggttgtttggaccgcccagcccgacacttttgcatatttccaactccgaatgcgagtaccggaaggcccaggagcccatgaggaagtcttacctggggatgtgaggcaggccctggtgcccccacctccccctggcacaccctacgagctgtccctccatggcgtaccaccgggcggcaagccctccgacccaataatctaccagggaatcatggataaagatgaggagaaacctggcaaatccagcgggcccccacggcttggagagctgaccgttacagaccgaacctcggatagcctgctgttgcgatggactgttcctgaaggagagtttgattcatttgtaatacagtacaaggatcgtgacgggcaacctcaggtggtccctgtcgagggcccacagcgctccgccgttataacatccttagatccgggccgcaaatacaaatttgtgctgtatggtttcgttggcaaaaagagacatggcccactggtcgctgaagccaagattctacctcagagcgaccccagcccaggcactccgcctcaccttggcaatctgtggtag

SEQ ID NO: 137545 - DNA, 2598 bp, Artificial Sequence
  Description of Artificial Sequence: Synthetic coding sequence
ctgtatgggttgagaggtaggcagcgcgtcggcccagagagcgtggttgcaaagaccgccccacaggaggacgtggatgaaactccgtcacctacggagcttggtacagaggctccagaaagtcccgaggagcccctgttgggagaattaacggttacaggctccagcccagactcactcagcttgttctggacagttcctcagggctcgttcgacagttttacggtgcagtacaaagatagagacggcagacccagagccgtgcgggtcggcggaaaagagtccgaggttactgtcgggggactggagcctggccacaaatacaagatgcacttgtatggcctccacgagggccagcgtgtgggacccgttagcgctgtgggcgtgaccgctccacagcaggaggagactcctcccgcaacagagtctcccctcgagccgcgtctgggagaactcacagtcaccgacgtcacccccaattccgttgggctctcctggactgttcctgagggtcagtttgactcatttattgtgcaatacaaagataaggacggtcaacctcaggttgtgcctgtggcagccgaccagagggaggttaccgtgtacaacctcgaacccgaacggaaatataagatgaacatgtacggcctgcacgacgggcagaggatgggaccccttagcgtggttatagtgacagcacccttaccgcccgctcccgcaacggaggccagcaaacccccattggaacccagattaggtgagctgactgtgactgatataacacctgactctgttggactgtcatggaccgtgccggagggggaattcgacagctttgtggtacagtataaagaccgagatggccagcctcaagtggtgccagtagctgccgatcagagagaagtcactatcccagatctggaaccgtctcgaaaatataagtttctcctgtttgggattcaggatggcaagcggcggtctcccgtgtccgtggaagccaaaacagtggctagaggggacgcgtctccaggcgcccctccgaggctgggcgagctctgggtgaccgacccaactcccgactcgctcagactgtcttggaccgtgcctgagggccagttcgatagctttgtagtgcagttcaaggacaaggatggcccccaagtcgtgccggtggaaggacacgaaagatccgttaccgttacgccactggacgcagggcggaagtatcgctttttgctgtatggactcctgggaaaaaaacgacatggtcccctgaccgcggatgggaccaccgaggccagatccgctatggacgacaccggcacgaagcggcctcccaaaccaaggctgggtgaagaactgcaggtcaccacggttacgcaaaactctgtggggctgagttggacagtccctgagggccagttcgacagttttgtggttcagtacaaagatagggacggacagccacaggtggttccagtggagggatccttgcgtgaagtgtcggtacccggcctggatccagcccaccgttataagttacttctgtacggtctgcaccacggaaagagagttggacccatcagtgcagtcgctattaccgccggccgtgaggaaacagaaactgaaacaaccgcccctacaccccccgcccctgagcctcacttgggagagctgacagtggaagaagctaccagtcatacgctgcacctttcatggatggtcacagagggagaattcgattcttttgagatccagtacaccgaccgggacggccagctgcagatggtgcgcataggcggagatcggaacgatattacgcttagtggtttagaatctgaccacaggtacctggtgaccttgtacggctttagcgatggaaaacacgtaggtccagtacatgtagaggccctgactgtgcctgaggaagaaaagccatcggagccacccacggccactccagagccacctattaaaccacggctgggggaattgaccgtgaccgacgcaacacccgacagccttagcctgtcttggacggtgcctgaaggccagtttgatcacttcctggtgcagtaccggaatggagatggacagccgaaggctgtgagagtccccggacacgaagaaggggtgaccatatcaggtctcgaaccagaccacaaatacaagatgaacctttatggattccatggcgggcagcgcatggggcctgtctcagtggtgggcgtgacagcagcggaagaggagacgccatccccgaccgagcccagtatggaggctcctgaaccagctgaagagcctttgctcggcgagctcactgtgactggcagttctcctgattctctgtcattgagttggactgtgccacaaggaagattcgactccttcaccgtgcaatacaaggaccgtgacggacgcccgcaggtagtaagagttggcggagaagagagcgaagtcacagtggggggcctggagccaggtcgaaagtacaaaatgcatctctatggacttcacgagggcaggcgagtcggccctgtctctgcagttggcgttaccgcgccagaggaggagagtcccgatgcccccttggcatag

SEQ ID NO: 137546 - DNA, 5208 bp, Artificial Sequence
  Description of Artificial Sequence: Synthetic coding sequence
atgagcgtaagtcgcactatggaggacagttgcgagttagacctagtgtatgtgactgagcggattattgccgtgtcgtttccgtccaccgccaacgaggagaatttccgcagcaacctgagggaggtggctcagatgctgaagagtaagcacggcggcaactatcttctcttcaacctatccgaaaggaggcctgacattacgaagctgcatgctaaagttctcgaatttgggtggccagacctgcatacccccgcacttgaaaagatttgttccatttgcaaggctatggatacatggttgaacgccgatccccacaacgttgtcgtcctgcacaacaagggaaaccgaggcagaatcggtgtggtcattgctgcttacatgcactattctaacatatccgcctccgctgatcaggccctggacagattcgccatgaaaaggttttatgaggacaaaattgttcctatcggtcagccttctcagcgacgctacgtgcattatttttctggcctgctgagtggcagcatcaagatgaataataaacctctatttttacatcacgtgatcatgcatgggatccctaattttgagtcgaagggcggctgccggccctttctccgcatctatcaggccatgcagccagtatacacttccggcatctacaatatccccggcgactcccagacttctgtatgtataacgattgagccgggcctcttgctcaagggtgacatcctcctgaagtgctaccacaagaagttccgcagccccgctagggatgtgattttccgggtgcagtttcatacttgtgccattcacgatctgggtgttgtctttggaaaggaagacttggacgatgctttcaaagatgataggtttccagagtacgggaaggttgagttcgtgttctcttatgggcccgaaaagatccagggaatggaacatctggagaacggaccttccgtctccgtggactataacacatcagatcctctcatccggtgggatagttatgataatttctccgggcatcgtgacgatggcatggaggaggtggtgggtcacacccagggtccactcgacggcagcctatacgcaaaagtgaaaaaaaaggattcattgcatggaagtaccggagccgttaacgccacgcgccctactctgagcgccacacccaaccacgttgagcacaccctgagcgtatcttctgacagtgggaactcaacggcaagcactaagacagacaagactgacgagcccgtgcctggagcctctagcgcgaccgctgcactgtctcctcaggagaagcgtgagcttgatcggctgttaagtggcttcggactcgagagggaaaagcagggagccatgtatcatactcagcacctgagaagcaggcccgccggtggcagtgcggttccctcaagtggacgccacgtagtacccgcacaggtccatgtaaacggaggcgccctggcatcggaacgggaaaccgatatcctcgatgatgagctcccaaatcaagacggacatagtgcaggcagtatgggaacactgtcttccctggacggcgtcacaaatacctccgaggggggctaccccgaagccctatcgcctctcaccaacggattggataaaagttaccccatggagccaatggtgaacggtggcggatacccctatgagtctgcatcacgcgcagggccagctcacgcgggacataccgccccgatgcgcccttcctactcagcccaggaagggttagccggctaccagcgcgagggcccacaccccgcatggccccaacctgtcacaacgtcccactatgctcacgacccatcaggtatgttccggtcgcagtccttctctgaggccgagccacagctgcctccggctccagtccgcggcggctcttcacgagaggcggtgcagcggggactgaactcatggcaacagcagcagcaacaacagcaacaacctcgaccgcctccacgacagcaggaaagagcccaccttgagtctttggttgcatctcggccttctcctcagccgctggcagaaacgcccattcctagcctcccagagtttcctcgggccgcctctcaacaggaaattgagcagagcatagaaacactgaatatgctcatgctggatcttgaacctgcgagcgcagcagcccctctccataagagccagagcgtgccaggtgcctggcctggggcatctccgctgagttctcaaccactgtcaggcagttccagacagtcccatccgctgacacagtctagatcaggttatattccatccgggcactctcttgggacgcctgagccggccccgcgcgccagtctcgagtcagtgcctccgggaagatcctactctccctacgattaccaaccctgcctggccggccctaaccaggacttccatagtaaatcccctgcctccagtagtctacccgctttcttgcctactacccacagtcctccaggccctcaacagcctcccgcttccctgcctggtctaaccgcccagcctttgcttagtccaaaggaagcaaccagcgatccttctcgcactcctgaggaggagccccttaatctggaggggctcgtggcccaccgtgtggcgggggtccaagcccgggagaaacagccagccgagccccccgcccctctaaggagacgagctgcctctgacggccaatacgagaatcagtcgcctgaggccacatccccccggagccctggggtccgcagcccagttcagtgcgtgagccctgagctcgcccttactattgcactgaatccaggcgggagacctaaggagccccaccttcacagttataaggaggcttttgaggagatggaagggacttccccttcctcccctcctccctcaggtgtccgcagtcctcctggattggctaagaccccactcagcgcactgggactgaaacctcacaatccagccgacattcttcttcaccccacaggggtaacacgccgacgcattcagcccgaggaagatgagggaaaggtagttgtgagattgtcagaggagccaagatcctacgtggaatcagtggcccgcacggccgtggctggcccccgggctcaggacagtgagcccaagtcctttagtgctcctgcgacgcaggcctatgggcatgaaatccccctgcggaacggcactctgggcgggtctttcgtctcgccctcccccctgtccaccagcagcccgatcctgtctgccgactcgacctccgtggggagcttcccttccggagagtctagtgatcagggtccacgcactccaacccaacctctcctggaatccggatttcgttcagggtcgctcgggcagccatccccatctgctcagcggaactaccagtcatccagcccgctgccaactgtgggtagtagttattcctcacccgactacagcttacagcattttagttccagcccagagagtcaggccagagcccagttttcagtggcaggcgtgcacacagttccaggctcgccacaagcccgtcaccgtaccgtgggaactaatacacccccatcacctggattcggatggcgcgccatcaatccaagtatggccgcccccagctcccccagtctgagccaccaccagatgatgggccccccaggaacagggtttcatggctctactgtatcaagcccacagagcagtgcggccaccaccccaggttcccccagtctgtgccggcaccccgccggcgtgtaccaagtcagcggcctgcataataaggtggccacaacaccaggctcgccgagcctgggaaggcatccgggtgctcaccagggcaacctggcgagcggtctacattccaatgccattgcgagccccggttcccccagcctgggtcggcacctgggcggcagcggtagtgtcgtgcctggctcgccatgcttggatcggcatgttgcttatggcggttatagcaccccagaagacaggagacccactctcagtcgccagtcttctgcttccggatatcaggcaccttccacaccatctttcccggtttcacctgcctactatcccggcctgagctctccagccacgtctcccagcccagatagtgccgccttccgacaggggtcccctacccccgccctgcccgagaagcgccgcatgagtgtgggcgacagagccggcagtctcccaaactacgccaccattaacggtaaggtgtcaagccctgtggcaagcgggatgtcatccccttccggagggtcgactgtgagctttagtcatactctgcccgacttctctaagtatagtatgcccgataactctccagagacaagggctaaggtgaaatttgttcaagatactagcaagtattggtacaagcctgagattagcagagaacaggccattgcgctcttgaaggatcaggagcccggcgcctttatcattcgtgactcacacagcttcaggggagcttacgggttagccatgaaggtcagctctcctcccccgacgatcatgcaacagaacaagaagggggacatgacccacgagctggtacggcatttcctgatcgagaccggacccagaggcgtcaaactgaagggctgccccaacgaaccaaactttgggtctttgtctgcacttgtgtatcagcatagcattattccccttgcattgccttgtaagttggtgatcccaaatcgcgatcctactgacgagagcaaggacagctcgggtccagccaactcaaccgccgatctgctcaagcaaggtgctgcctgcaatgtactgttcgtaaattctgttgatatggaatccctgaccgggccacaagccatctccaaagcaacctcagagaccctggctgctgatccaacgccggcagccacaattgtgcacttcaaggtcagcgcacaaggcattacgctcaccgataatcagcgaaaacttttctttaggcgccattacccgcttaatacagtaactttttgtgacctcgacccacaggagcggaaatggatgaagacggagggaggggctccggccaagctgttcggatttgtggcgcggaaacaggggtctaccaccgacaatgcctgtcatcttttcgcagagctcgatccaaaccagcccgcatccgccatcgtaaatttcgtcagcaaggtaatgctcaacgctggtcagaagcgctag

SEQ ID NO: 137547 - DNA, 1251 bp, Artificial Sequence
  Description of Artificial Sequence: Synthetic coding sequence
atggtgccattccagcagagaaaggactgtgtcctggaaggctcgactagggtgacaccttccgtgcagccacacctgcagcccatccgcaatatgagcgtgagtcggactatggaagattcttgtgaactcgatctggtgtatgtaaccgagagaattatcgcagtcagcttcccttctacagcgaatgaggagaactttaggtcaaacctgcgggaggtggcccagatgctgaaaagcaagcacgggggcaactacctcctgtttaacctatcggagcgcaggccggacatcacgaagctgcatgctaaggtgcttgaatttgggtggcccgatctccacacaccagctctggaaaagatctgctcaatctgcaaggcgatggacacatggctgaacgccgacccccataatgtcgttgtcctgcacaataagggcaacaggggcaggatcggtgtggtgatcgccgcctatatgcactactctaacatatcagcctcagctgaccaggcactggatcgattcgccatgaagagattctatgaagacaaaattgtgcctatcggacaaccatcccagagacgctatgttcattacttctccggcctcttgtccgggtccatcaaaatgaacaataaacctctgttcctgcaccacgtgatcatgcatggtattccgaactttgagagcaagggggggtgtcgcccgtttcttaggatttatcaagccatgcagcctgtctatacctctgggatatataacattcctggcgattcccagaccagcgtgtgcatcactattgaacccggattactgcttaaaggtgatattctgcttaagtgctaccataagaaattcagaagcccagctcgagatgtgatctttagggtacaatttcatacctgcgcgatccatgacctcggagtagtcttcggtaaagaggatctggatgatgctttcaaagatgatcgcttccccgagtatggcaaagtggagttcgtcttctcatatggcccagagaagatccaaggcatggaacacctggagaacggccccagcgtgtccgttgattacaacactagcgacccactcattagatgggacagttatgacaatttttctggacatagggacgacggaatggaagatggaaacaaacaaaacacaaattcccagtccatcggtagtattagtggcggcctcgaggatcagtatacctggccagatacacattggccttctcaatcctag

SEQ ID NO: 137548 - DNA, 312 bp, Artificial Sequence
  Description of Artificial Sequence: Synthetic coding sequence
atgtctgtcagtagaactatggaagactcctgtgagctggacttggtttatgtcaccgagcgcatcattgccgtgagctttccaagcaccgcaaacgaggaaaatttccggagtaatttaagggaggtggcccagatgcttaagtcaaagcacgggggcaattacctcctgtttaacctgtcagagcgaaggcccgatatcacaaaactgcacgctaaggtcctggagtttggatggccagacctccacacaccagcccttgaaaaaatttgcagcatatgcaaagcaatggacacatggctgaatgcttag

SEQ ID NO: 137549 - DNA, 5145 bp, Artificial Sequence
  Description of Artificial Sequence: Synthetic coding sequence
atgagcgtgtcaagaaccatggaagattcctgtgagctcgatctggtctatgtgactgaaaggattatcgcggtctctttcccgtcaactgccaatgaagaaaatttccggtctaatctccgggaagtggcccagatgctcaaatcaaagcacggcggtaactacttgcttttcaatctcagcgagagaaggccagacattaccaagttgcatgcgaaagtccttgagtttggatggcctgaccttcatactcctgcattggagaaaatatgctctatatgtaaggctatggatacctggctgaacgccgacccccataacgtcgtcgtcctgcacaacaagggcaaccggggcagaatcggcgtggtaatcgccgcctatatgcattattcaaacatatctgcaagtgcggaccaagccctggataggttcgctatgaagcgtttctacgaggataagattgttccgattggacagcccagccagaggaggtacgtgcattacttctctggcctgttgtcaggatctatcaagatgaacaacaagcccctgttcctgcatcacgttatcatgcacggaatacctaattttgaatccaagggagggtgtaggccattcctgcgcatctaccaagccatgcagcctgtgtacacgtcggggatatataacatcccgggcgattcacagacgtccgtttgcattaccattgagcccggattactgctcaagggggacatactcctaaagtgctatcataaaaaattccgaagcccagcccgggatgtgatcttcagagtccagtttcacacgtgtgccatccacgatctcggagtcgtgttcggaaaagaggatctcgacgatgccttcaaggatgatagattccccgagtacgggaaggtggaattcgtgttcagttacggcccagaaaaaattcagggtatggagcatctggagaatggcccatctgtgtccgtcgattacaacacctcagaccccctgatcaggtgggattcctatgataatttctcgggacacagagacgacggcatggaggaggtcgtcggtcacacccagggccccctggacggaagtctgtacgccaaagttaagaagaaggactccctccacgggagcacaggagctgtgaatgccaccaggcccaccctaagcgcaacgcctaaccatgtggaacataccttgagtgtgagttctgacagcggtaattccacggcctccacaaaaacagataaaacggatgagccagtacccggggcaagtagcgctaccgccgcactctccccacaagagaagcgtgaactggatagactgctgtccggtttcggcctggagcgggagaaacagggggcaatgtaccacacacagcacctgagatcccggcctgccggcggctctgccgtacccagtagtgggagacacgtagtgcccgctcaggtgcacgtcaacggcggggcactggcctctgaacgagagacagatattttggacgatgagttaccgaaccaggacggccattctgctgggagtatgggcactctgagctcactggacggagtcaccaataccagcgagggcggatatcccgaggctctcagccctcttacaaatggtctagacaaatcctaccctatggagccaatggtgaacgggggtggttatccctacgagagtgcttccagagcaggccctgctcatgcgggacatacagcccctatgcgcccatcctattcagcgcaggaaggattggccgggtatcaacgtgaaggcccccaccccgcatggccacagcctgtgacgaccagccattatgcccatgatccatccggcatgttcaggtctcagagcttcagcgaagccgaaccccagttgccacccgccccggtgagaggaggatctagcagagaagcagtccaacggggtctgaacagctggcagcagcagcagcagcaacagcagcagccacgcccacctccccgtcagcaggagagggcacacctggagtcgttggttgcatcacgcccaagcccccaacctctggcagaaacacctattcctagcctccctgaatttccccgggccgcaagccagcaagagatcgagcaaagtattgagactttaaatatgctcatgcttgatctagagcctgccagtgctgctgcccccctccacaaatcccaaagtgtgccaggagcatggcctggggcctcacctctgtctagtcagcctttgagcggttcttcgcgccagtcccaccctctcacccagagtcgctccgggtatatcccaagcggccattctcttgggacccctgagccagccccaagggcttccctggaatcggtgccaccaggccggtcctacagcccgtatgactatcagccctgcctggctggccccaaccaagatttccatagtaagtccccggcatcaagctcgctgccggcctttcttccaactactcattcaccccccggcccgcaacagcctccagcttcgctgccaggcttgacggcacagccactcctctccccaaaggaagcaacctccgatccgagccgcacccccgaggaagagccgcttaacctggaagggctcgttgctcaccgcgtggcaggcgttcaagcccgcgagaaacagcctgcagaaccccccgctccactacggcggcgcgctgcgtctgacggtcagtatgaaaaccagtccccagaagccacaagtccaaggtcacctggtgtgcggtcccctgtgcagtgtgtctccccggagctggcattaacaattgcgctgaatcccggaggacgacccaaggaaccccatttgcactcatacaaggaagccttcgaggagatggaggggaccagcccctctagccctcccccaagcggtgtgcggagcccacccggactggccaaaacacctctctccgcactcggactgaagccgcacaacccagccgacatcctgctgcaccccaccggcgaacctaggagctacgtcgaatctgtggctcgaacagctgtggcagggcctcgagcacaagatagtgagccaaagtcattttccgccccagcaacccaggcctatggccatgagatcccactgaggaatggaacactcggaggttcattcgtgtccccaagtcctctctcaacatcctcaccaatcctttctgctgatagcacatcagtgggaagttttcccagtggtgaatcttccgaccagggcccaaggacacccacacagcctctgctcgagagtgggtttaggagcgggagcttggggcaaccttcgccctccgcccagagaaactaccagtctagctcaccactgcccactgttggctcgagctattcctctccggattacagcctgcagcacttctctagctctcccgagagtcaagctagagcccagttctcagtggccggggtgcacaccgtccccggaagccctcaggctcgccatagaactgtcgggacaaacacccccccaagccctggctttggatggcgagccatcaatcctagtatggccgcccccagcagcccttcactcagccatcaccagatgatggggccccccggcaccggatttcacggaagcacagtgtccagtcctcagtcatccgccgcaaccaccccagggtcgccatctctgtgccgtcatcctgccggcgtttatcaggtctcaggccttcataataaggtagcaacgacaccaggctctccatccctaggtagacaccctggagcacatcaagggaatctggcgtcgggactgcactctaacgccattgccagtccaggctccccctccttagggcgccacctcggaggatccggatcagttgtgccaggatcaccatgtctggaccgccatgtggcctacggaggatactctaccccggaagaccgaaggcccacactctccaggcagagctccgcgtccgggtatcaggcaccatctacgccatccttccctgtctccccagcttattatcctggactgtcctcccctgcaacgagcccctctcccgactctgccgcattccgtcagggctctccgactccagccctgcctgaaaagagacggatgtccgtgggagaccgcgccgggagcttaccaaactatgccactataaacgggaaggttagtagccccgtcgctagtggcatgtcctccccatctggaggctccactgtatcatttagtcataccttaccagattttagcaaatactctatgcccgacaactcaccagaaacacgcgccaaggttaagttcgtgcaggacacctctaagtattggtacaagcccgagatatctcgtgaacaggcaattgccctacttaaagatcaggagcctggagcattcatcatccgggactctcatagcttcagaggagcttatggcctggccatgaaggtaagttccccccctccgaccatcatgcagcagaacaaaaaaggggacatgacccacgaactcgtccgtcactttctgatcgaaacaggtccaaggggcgtgaaactgaaaggatgcccgaacgaacctaactttggcagcctgtccgccctggtgtatcaacactctatcataccgctggcgctgccctgtaaactcgtgattccaaatagggaccccaccgacgaatccaaagattcatccggcccagccaattccactgccgatctgttaaaacagggagccgcctgtaatgtgctttttgtcaactccgtggacatggaatccctgaccggccctcaagccatatctaaagcaacttctgaaactctggcggccgacccaacccctgccgccacgatcgtgcattttaaggtatcagctcagggcattacgctcaccgacaaccagaggaagctctttttcagacgacattatcctctgaacaccgtcactttttgcgatttagacccacaggaacggaagtggatgaagaccgaaggtggggctcctgctaagttgtttggcttcgttgcaagaaaacaaggatctacgacagacaatgcttgtcatctcttcgccgagctggaccctaatcagcccgcaagcgccatcgtgaattttgtatctaaggtcatgttaaacgcaggccagaagaggtag

SEQ ID NO: 137550 - DNA, 186 bp, Artificial Sequence
  Description of Artificial Sequence: Synthetic coding sequence
atgagcgtttctaggactatggaagatagctgcgagctggatctagtgtacgtaacagaacgcatcattgccgtgtcttttccaagtaccgccaacgaagaaaatttcaggtccaatttgcgagaagtcgcccagatgctcaaaagcaaacacggtgggaattatctgctttttaacttgtcatag

SEQ ID NO: 137551 - DNA, 75 bp, Artificial Sequence
  Description of Artificial Sequence: Synthetic coding sequence
atgagtgtatctagaaccatggaggactcgtgtgaactcgatctcgtgtacgtgaccgagcgcatcatagcgtag

SEQ ID NO: 137552 - DNA, 4338 bp, Artificial Sequence
  Description of Artificial Sequence: Synthetic coding sequence
atggaggaaggccatgggttggatctgacctacattactgagagaatcatcgccgtgtcattcccagccggctgctcagaggagtcttatctccacaatctacaggaagtgacccggatgctgaagagtaaacacggtgataactatttggtgctcaatctcagcgaaaagaggtacgacctgacaaaactcaacccaaagataatggacgttggatggcctgagctccatgcacctcccttggataaaatgtgcactatttgtaaggcccaggagtcctggctcaactcaaatctacagcatgtggtggtcatccattgtcgcgggggcaagggccggatcggagtggtgatctcttcctacatgcacttcactaatgtgtccgctagcgccgaccaggcgctggaccgatttgctatgaagaagttttacgatgataaagtctccgcattgatgcagccttcccaaaagcggtatgtccagttcctgtcgggattgctatctggctccgttaagatgaacgcgtccccattgttcctgcatttcgtgatactgcacggaacaccaaactttgacactggtggtgtgtgtaggcccttcctgaagctttatcaggcaatgcaaccggtgtatacttctggtatttataatgtgggacctgaaaacccatctaggatctgtattgtgatcgagcccgcgcaactgttgaaaggggacgtgatggtcaagtgttaccataaaaagtatagatccgcaacaagggatgtgatcttccgtttgcagtttcatacaggtgccgtgcaagggtacggtctggtttttgggaaggaagatctcgataacgcatcaaaagatgacaggttcccggactacgggaaggtagagttagtcttttcagctacccccgagaagatccagggtagtgagcatctgtacaatgatcacggagttatcgttgactataacactactgacccactgattagatgggacagctatgagaacctgagtgcggacggtgaagtcctacacactcagggacccgtggatggctcactctacgccaaggtgaggaagaaatcaagttcagaccccggcatccctggcggtccccaagcgatcccagccactaattccccagaccattcagaccatacacttagtgtaagctccgacagtggacactcaactgcgtccgcacgcaccgacaagaccgaggaaagactggctccaggcacaagaagaggtctgtcagcacaggagaaagcggagctggaccagcttctttcaggatttggcctcgaggatcctggaagctccttaaaggagatgacagacgcccgttctaagtattctggaactcggcacgttgtgcccgctcaggtgcacgtgaatggtgacgccgctctcaaagaccgagaaactgatatactagatgatgagatgccccaccacgatctgcactcggtcgactccctggggaccctttcaagttcagagggtccccagtcagcacaccttggacccttcacatgtcataaatcctcccagaactctctgttgtctgacgggttcggtagcaacgtgggcgaggacccacaggggacattagtgcccgaccttgggctgggtatggatggaccgtatgagagagaacgaacctttggttctcgcgagcctaagcagcctcagccactgctcaggaagcccagcgtgagtgcccagatgcaggcctatggtcagagcagttacagtactcagacgtgggtcaggcaacaacaaatggtggttgcacaccagtactctttcgcccctgacggcgaagccagattagtcagtcggtgccctgctgataatccaggactggtgcaggcccaaccacgcgttcccctgacacccacacgtggcacatccagccgggtggcagtgcagagaggagtagggtctggcccacacccgcctgacactcagcagccatcaccttccaaagctttcaagcctcgattccctggcgatcaggtcgtcaatggggccgggcctgagctgagtacaggaccttcgccgggctctcctaccttagatatcgatcagtcgattgaacagctgaatagacttattctagaactcgacccaaccttcgagcccatacccactcatatgaacgccctggggtcccaagcaaacggaagcgtatcaccggattccgtgggagggggcctccgtgcaagttcacggctgcctgataccggagaaggacccagccgcgcaacagggaggcagggcagttcagccgagcaacccctgggcggccggctgcgtaaattgtctctgggccagtacgataacgacgctggaggccagcttcctttctctaagtgcgcatggggaaaggccggtgttgactacgccccaaatctgcccccctttcctagccctgccgacgttaaggaaaccatgacaccaggatatccccaggatctcgacatcatcgatggccggatcttaagttcaaaagagagcatgtgctccacacctgcttttccagtgtccccagaaaccccatacgtcaagacagctttgcgacacccacccttttcacctccggaaccgcccctgtcaagtccagcctcacagcataagggtgggcgggagccaaggtcatgtcccgagactctgacacacgcagtaggaatgtccgagtcccctattggacccaaatctacaatgctccgggccgacgcttcgtcgacccccagtttccaacaggctttcgcctctagctgcactatcagcagcaacgggccagggcagcgccgagagagctcgagcagtgccgagcgtcagtgggtcgaatcatccccaaagcctatggtcagcctgctagggtccggcagacccaccggcagcccactgtctgcagagttctcaggtactcgtaaagattctccggtgctgtcctgctttcctccctccgaactgcaggctcccttccattctcacgagctctctttagcagagccccccgactcgcttgccccaccttcgtcccaagcctttcttggcttcgggactgcacctgtgggctcaggactgccgcctgaggaggatcttggtgccctcctggctaactcgcacggggccagcccgaccccatcaattccactgactgccaccggggctgcagacaacgggtttcttagccataacttcctaaccgtcgcccctggtcattcctcccatcattcaccaggcctacaagggcagggggtgaccttgcccggccaacctccgttgcctgaaaaaaagagggccagtgaaggggacaggagcctaggatctgtttcgccgtcctcatctggtttctctagcccgcatagcggatcgaccatcagtataccgttcccgaatgtgctccccgacttcagcaaggcgtcagaagccgccagtcctttgcctgacagtcctggggataagctcgttatagtgaagtttgtccaagatacctcgaaattttggtataaagctgacatatctcgagagcaagcaatcgcgatgctcaaggacaaagagccagggagctttatcgtgagagactcccactcattccggggggcctatggactggctatgaaagttgccacgcctcccccgtctgtgctacagctgaacaaaaaggccggagatctcgccaatgaactagtgcggcatttcctcatagagtgtaccccgaaaggggttcgcctgaagggctgttctaatgaaccctatttcggcagtctcaccgcactagtatgccagcattcaataacacctttggctctgccatgtaaactcctcattcctgagcgagatcctctcgaggagattgctgagtcttctccccaaactgcagcaaactctgcagcggagctcctaaagcagggcgccgcttgcaatgtgtggtatctgaattccgttgaaatggaatcccttacgggacaccaggctatccagaaagctttatcaatcaccctggtacaggagccaccacccgtcagtactgttgtccacttcaaggtgagcgcccaggggataacccttacagataaccagcgtaagctgttttttaggcggcactatcccgtgaacagtgtgattttctgcgctttagatccccaggatcgcaaatggatcaaggacggcccgagctccaaggtgttcggcttcgtcgcaagaaagcagggttccgctaccgataacgtgtgccaccttttcgctgaacacgatcccgagcagcccgccagcgccatcgttaacttcgtgagcaaagtcatgatcgggtcccctaaaaaggtgtag

SEQ ID NO: 137553 - DNA, 3618 bp, Artificial Sequence
  Description of Artificial Sequence: Synthetic coding sequence
atggaagaaggccacggcctggatctaacttatattaccgaacggatcattgccgtgtccttccccgcaggatgctcagaggagtcttacctacataatctacaagaggtaactagaatgctgaagtcaaagcatggagataactacctggttttgaacctctctgagaagcgctacgatttgaccaaacttaacccaaaaatcatggacgtcggctggccggagctccatgccccgccgctggacaagatgtgtaccatttgtaaggcacaggagagttggctgaattctaatctgcagcacgtggtggtaattcactgtcgcggggggaaagggcgtattggcgtagtcatttcctcttacatgcacttcaccaacgtgtctgcctccgcagaccaagcactggacagatttgctatgaagaaattttacgatgacaaggtgagcgccctgatgcagccgagtcagaagaggtacgtgcaatttttatcaggcctactgagcgggtctgtgaaaatgaatgcgagtcccctgtttttgcattttgtgatcctccatggtactcccaattttgacacaggtggcgtgtgcagaccttttctcaagttgtatcaagctatgcagccagtctacacatctggaatatataacgttggtccagagaacccctcacggatctgtattgtgatcgagcctgctcaactcctgaaaggagacgtgatgatgccccaccacgacctgcattctgtggatagcctcggcacactgtcttcgagcgaggggcctcagagcgctcatctgggcccattcacttgtcacaagagtagccaaaattccctgttgagcgacgggttcggctcaaatgtcggggaggatccccaggggaccctggttcctgatttaggcctcggcatggatgggccgtacgagcgcgaaagaactttcggtagcagagagccaaagcaaccccagcctctgctccgaaagccttctgtatcagcccagatgcaagcgtacggccaaagcagctattctacccagacatgggtcaggcagcagcagatggtggtggcgcatcagtacagctttgccccggacggagaagctcggttggtgagccgatgtcctgctgacaatccgggcctggttcaggcacagccacgagtcccactgactccaacgcgaggaaccagctctcgggtggctgtccagcggggagtcggctcaggaccacaccctcccgacacacagcaacccagcccgtctaaagcctttaagcctaggttccctggtgaccaggtcgttaatggggccggccccgagctcagtactggtccatcccccggatccccaactctggacatagaccagtctattgagcagctgaatagactgattctggaactggaccccactttcgaacctatcccgacccatatgaatgctttaggcagccaagccaacggatctgtcagtccagactctgtgggcggcgggctgcgcgcttctagtcgcttgccggatacaggcgagggccctagcagagctactggaagacaaggaagctcagccgagcagcccctgggcgggaggctgcgcaagttgagcttagggcagtatgataatgacgctggcggccagctcccattctcgaaatgcgcgtggggaaaggctggcgtggattacgctcctaacctgcccccattccctagccccgccgatgtgaaggaaaccatgacccccggatacccacaggacttggacattattgacggacggattctgtcctccaaagaatccatgtgttcaactccagcctttccagtaagtcctgaaacaccctacgtgaaaacagcattaaggcaccccccgttctcccccccggagcccccactgagcagtcctgcatcacagcacaagggggggagggagcctaggtcctgcccggaaactctgacacacgctgttgggatgtccgaatccccaatcgggccgaaaagcaccatgcttagagccgacgccagctctacgccatccttccagcaggccttcgcctcttcctgtacgataagctcgaacggccctggccagagaagagagtcctcttcaagcgctgagaggcagtgggtggaaagttcgccgaagccgatggtgagcctgctgggctcaggtcgaccgacaggctctccactgtccgcggagtttagcggtacgcgaaaagattctcctgtcctctcttgttttccccccagcgagctgcaagccccttttcacagtcacgagctgagtctggccgagcctccagactcgcttgccccacccagctcacaagcatttcttggcttcgggactgccccagtgggaagtggcctgccccctgaggaggatttgggtgccctcttggcaaactcgcatggcgccagcccgaccccttcaatacctttaactgctacaggcgcggcggataacggttttctaagtcacaattttttaacagttgcaccaggacacagcagccaccacagtccaggcctccagggccagggcgtgaccttgcctggtcaaccgcctctccccgagaagaaaagggcgagcgaaggagatcgcagcttaggatccgtctcccccagttcctccggtttttctagtccacactctggctccaccatcagcattcccttccccaatgtgctacccgatttttccaaggcctccgaagcagcgagcccactgcctgatagccccggggataagcttgtgatcgtaaagttcgtgcaggacacctccaaattctggtacaaagccgacatctccagagagcaggcaattgcaatgctgaaggataaggagcccggaagtttcattgtgcgtgattcacactcgtttagaggcgcctatggcctggcaatgaaggtggccactcctcctccgtctgtcctccagttgaacaaaaaagctggcgacctggcaaacgagctcgtacgacacttcctaattgagtgcactccaaaaggcgtgaggctgaagggatgctcaaatgaaccgtatttcgggagtttgacggcgctggtctgccagcattctattactccattagccctgccctgcaaacttctcattccagagcgggaccctctggaggaaatagcggaaagttccccacaaactgctgcgaactcggccgccgagctgcttaagcaaggagccgcatgcaacgtgtggtatctgaacagcgttgaaatggagtctttaacaggccatcaggcaatccagaaagcactctctataaccctggttcaggagcctccgcctgtgtctacagtggtccacttcaaggtcagtgctcagggcattactctcactgacaaccagcgcaaactgtttttccggcgccactaccccgtaaactcagtgatcttctgtgcattagatcctcaggatcgaaagtggatcaaggacggcccatcttccaaagtattcggcttcgtagctcggaaacaaggtagtgccaccgacaatgtgtgccatctgtttgccgaacacgatcctgagcagccagccagcgctatagtgaacttcgtatctaaagtgatgattggatccccaaaaaaggtgtag

SEQ ID NO: 137554 - DNA, 4338 bp, Artificial Sequence
  Description of Artificial Sequence: Synthetic coding sequence
atggaggagggccacggactggacctgacttatattaccgagagaattattgcagtgagcttccccgcaggatgctccgaagagtcctacttgcacaacctccaagaggtgaccaggatgttgaagagcaagcatggggacaattatctggtacttaatctcagcgaaaagcgttatgatctgacaaaacttaaccccaaaatcatggacgtggggtggcctgagctgcacgcccctcccctggacaagatgtgtacgatctgcaaagcccaggagtcatggttgaatagcaacctccaacacgtggttgtgattcattgtcgcggcggtaaagggaggatcggcgtcgtgatctcttcgtatatgcattttaccaatgtgagcgcctcagcagaccaggcgctggatcgattcgcaatgaagaaattctacgatgataaggtctcagccttgatgcagccatcccagaagcgctacgtacagtttctttcagggctactgagcggctcggtaaagatgaacgcctcccccctgtttctgcacttcgtaatcctgcatggcaccccaaacttcgatacgggcggcgtatgccgtccgtttttgaagctgtaccaggccatgcagccggtatacacatctggcatctacaatgtcggtcccgagaatccctcaaggatttgtatcgttattgagccagctcagctgctcaagggagatgtgatggtcaagtgctaccacaaaaagtacaggtctgccacaagggatgtgatttttagactgcaattccacacaggtgccgtgcaggggtatggactggtgtttggaaaagaggatttggacaacgccagcaaggatgaccggtttcccgattacgggaaagtggagctggtgttcagcgccaccccggagaagatccagggatctgaacatctgtataatgatcacggggtgatcgttgactacaatacaaccgatccactcatccggtgggattcttatgagaatctgtcggcagacggtgaagtccttcatacccaaggccccgttgacggcagcctttacgcaaaagtgcgtaaaaaaagcagctccgatcccgggattcccgggggacctcaggccatccctgcaaccaattctccagatcacagtgaccacaccctgtcagtcagctctgactcgggacactccacggctagcgcgaggacagataaaaccgaagagcgactggctccgggcactcgacggggactttccgctcaggagaaagccgagcttgaccagctgttaagcggttttggtctcgaggatcccggctcttctttgaaggagatgacagacgctcgctccaaatatagcggcaccaggcacgttgttccagcccaagtgcacgttaatggggatgccgcgctgaaggacagagagactgacattcttgatgacgagatgccacatcacgatctgcacagcgttgactctttgggaactctaagttcgtccgaagggccccagagcgcacacctgggccctttcacctgccataagtcctcacagaattccctgctgtccgacggctttgggagtaacgtgggggaggacccacaaggaactctggttcccgatttgggcttgggcatggacggcccttatgagcgtgagagaacgtttggatcgagagagcccaaacaaccgcaaccattgctgaggaaaccttctgtatcagcccagatgcaggcatatggacagtcatcttactccacccaaacatgggtcaggcagcagcagatggtggtcgcacaccaatactcatttgcgccagacggcgaggcccgcttggtctcccgctgccccgccgacaacccaggcctggttcaggcccagccccgggttcccttgaccccaacgagaggtacaagctcacgggtggctgtgcagcggggcgtggggtcgggtcctcaccctcccgatacgcagcagccgagcccgtctaaagcctttaagcctcgctttccgggagatcaggttgtgaacggtgctggacccgaacttagtacgggccccagccccggtagtccaacgctggatatcgaccagagtatcgagcagttgaaccgtctgattctcgaactggatcccacttttgaaccaattcctacccacatgaatgctctgggctctcaggcgaatggctccgttagccccgattcagtcggtggcggtttgcgggcatcatctaggctgcccgacacaggtgaagggccgagcagggcaacagggcggcagggaagctccgcagagcaaccactcggcggaaggttgcggaaactgagtctggggcagtacgacaatgatgccggcgggcagctgccatttagcaaatgtgcctgggggaaggcgggcgttgattatgcgccgaacctcccaccctttccaagccccgcagatgtcaaggagacgatgacgcctgggtacccccaggacctggacatcatagatggcaggatcctttcatctaaagaatccatgtgtagcactcccgccttcccggtttccccagagaccccgtacgtgaaaacagctcttaggcatccacctttcagcccccccgagccgccgctttccagcccagcctctcagcacaagggaggaagggagccacgcagttgtcctgaaacgttaacccacgctgttggcatgtccgaatctccaataggaccaaaatctacaatgctgcgggcagacgccagctccacaccctcatttcagcaggcttttgcaagttcttgcaccatttcctcaaatggaccaggacaacgacgggagagttccagcagcgccgaaaggcagtgggtcgaatctagcccaaaaccgatggtgtctttattaggatctgggaggccaactggttcaccgttgtcagctgaattctctggaactcggaaggactcccctgtacttagttgtttcccaccctccgaactgcaggcacccttccatagccacgagctttcactggccgaaccccctgactctctcgccccaccctctagtcaggcatttcttggtttcggaaccgctccagttggttcgggtctccctccagaagaagatctcggagcattgctcgctaacagtcatggggccagtcctactccaagcataccccttacggcgactggggcagcagataatgggtttctttctcataactttctgaccgtggcccccggccatagctcacaccactcaccaggcctccagggccaaggagttacactcccaggccagccgccactgcctgagaaaaaaagagccagtgagggagatcgctccctgggttccgtgtccccatcctccagtggctttagcagccctcactcaggaagcactatctcaatacccttcccgaatgtcctgcccgatttctcaaaggcttcagaggcagcatcccctttgccggactctcccggagataagttggtgatcgtgaagtttgtgcaggatacttctaaattctggtacaaggcggacatctctagggaacaagcgattgcaatgctcaaggacaaggagccaggttcttttatcgtgagggacagccacagcttcaggggtgcttatggattagcgatgaaggtcgccacccccccgccttctgtcctccaactgaacaagaaagccggcgacctcgccaacgagttagtccgtcattttctgatagagtgtacacctaaaggcgtgagactgaagggatgtagcaatgagccgtacttcggaagcctgaccgctctggtgtgtcagcattccatcacccccctcgctctgccatgcaagctcttgattcctgaacgggaccctctggaggagatcgccgaaagcagcccccaaacggctgcgaactcagccgccgagctgctgaagcagggcgccgcctgcaacgtgtggtacctcaacagcgtggaaatggaatcgttaacagggcaccaggccatccagaaagcgttgagtataactctggtgcaggaaccacctcctgtgtccaccgtggtacactttaaggtatcagcccaggggataacactcacagacaatcagagaaaactcttcttccggagacattaccctgttaacagcgtcatattctgtgccctggatcctcaggacagaaaatggattaaagacgggccctcctcgaaagtgtttggatttgtcgctcggaagcaagggagtgctacagacaacgtgtgtcacctgttcgccgagcacgatcccgaacagccggccagcgcgattgtgaatttcgtgtctaaggtaatgattggcagtccaaagaaagtatag

SEQ ID NO: 137555 - DNA, 327 bp, Artificial Sequence
  Description of Artificial Sequence: Synthetic coding sequence
atggaagaagggcatggactcgatctgacctacattactgaaaggattatcgctgttagttttcccgcagggtgctccgaggagtcctacctccataatctgcaggaagtgaccaggatgctcaaatccaagcatggtgacaattacctcgtgttgaaccttagcgagaaacgctatgacctgacaaagttaaatcccaagattatggatgtgggatggcccgaattacatgcaccaccgctggacaagatgtgtactatatgtaaggctcaggaatcctggcttaacagcaacctgcagcatgtagtggtgattcattgcagatag

SEQ ID NO: 137556 - DNA, 417 bp, Artificial Sequence
  Description of Artificial Sequence: Synthetic coding sequence
atggaggagggccacggcctggacctgacctacatcactgaaaggatcatcgccgtctcattccccgccggatgttctgaggaatcctacttgcataatttgcaggaggtgaccaggatgctgaagtctaagcacggcgacaattatctggttttaaacctgtcagaaaagcggtatgacctgaccaagctgaatcccaagattatggatgtcggctggcccgagctgcacgccccaccattagacaagatgtgtacaatctgcaaggcccaggaaagctggttgaactcaaacctgcaacacgttgtggtaatccattgcaggggggggaaaggccggataggcgtggtgatttcttcgtacatgcattttacaaacgtttctgcatctgctgatcaagctctcgataggttttag

SEQ ID NO: 137557 - DNA, 753 bp, Artificial Sequence
  Description of Artificial Sequence: Synthetic coding sequence
atggaggaaggccacggcctcgacttgacgtacatcaccgagcgaatcattgccgttagctttcctgcaggctgtagcgaagagagctacctgcacaacttacaggaggtaaccagaatgctcaaatcaaaacacggcgataactaccttgttctaaatctgtccgagaaaaggtatgacctaactaagctgaacccaaaaattatggacgttgggtggccagagctgcacgcaccccccctagataagatgtgcactatttgtaaagcccaggagtcctggctgaactcgaacctccagcacgtagtggtgatccactgtaggggtgggaagggccggatcggagtggtgatttcttcctacatgcactttactaacgttagtgcaagtgccgaccaggccctggatcgcttcgccatgaagaaattttacgatgataaggtgagcgcacttatgcagccaagccagaagcgctacgtccaatttctaagtggtctgctttcagggtcagtgaagatgaatgcctcccccctgtttttacactttgtcatcttgcatggcaccccgaatttcgacaccgggggcgtgtgccggcccttcttaaaactgtatcaggcaatgcagcctgtatacactagcgggatatacaatgtgggcccagagaatccctcacgtatctgcatcgttattgaacctgcacaactcctcaagggggacgtgatggtgatgaactacaacatcgctaacatttag

SEQ ID NO: 137558 - DNA, 753 bp, Artificial Sequence
  Description of Artificial Sequence: Synthetic coding sequence
atggaagagggacatgggttagacttgacttatattactgaacgaataatcgccgtgagctttccagcaggatgctctgaggaatcatacctccataacctccaagaggtgactaggatgttaaaaagcaaacacggcgataattatctggtgttgaacctcagtgagaaaagatacgacctgaccaagctcaatcctaaaattatggacgtgggctggccagaattgcacgccccacccctggacaaaatgtgcaccatttgtaaagcacaggagagctggcttaactcgaacctgcagcatgtagtggtaattcactgccggggcggcaagggcagaatcggagttgttatttctagctatatgcatttcacgaacgtttcagcttcagcagatcaggctctcgaccggttcgccatgaagaagttttatgacgataaagtaagtgcattaatgcagccctcacagaaacgttacgtccagttcctctcaggcttgttgagcggatccgttaagatgaatgcctctcctctgtttctgcattttgtgattctacacggaactcctaactttgacacagggggagtgtgccgtcctttcctgaagctgtaccaggctatgcaaccagtctacaccagcgggatttacaatgttggcccagagaacccgtctcgaatatgtatagtgatagagcctgcacaactcctaaagggggatgtcatggtgatgaactataacattgccaacatctag

SEQ ID NO: 137559 - DNA, 3816 bp, Artificial Sequence
  Description of Artificial Sequence: Synthetic coding sequence
agccaggcgctgaacgagcgtatgaattggctgtgcagaaatcaggatcctaacccgccaccccagcctgaggagctcacttcctccctgcatgcatttaaaaataaagctttcaagaaatctaaagtctgcggtgtttgcaagcagatcattgatggccaggggatttcatgcagggcgtgcaagtactcctgtcacaaaaagtgcgaggctaaggtggtgatcccctgtggagttcaggtgcgcctggagcaggcccccgggagtagcacactctctagttcattgtgcagggacaaacctctcaggcctgtgatcctgtccccgaccatggaggaaggacacggtctcgacctcacttacattacggaacgaattatagccgtcagctttcccgccggctgcagtgaggagagctatctgcataacctgcaagaggtcactcgtatgcttaagtccaagcacggtgacaattatctggtgttgaacctttccgagaagcggtacgacctgactaaactgaatcccaagatcatggacgtgggctggcccgaactgcacgcaccaccgcttgacaaaatgtgtacgatttgcaaggcgcaggaatcttggcttaactctaatcttcaacacgtcgttgttattcactgtaggggaggtaagggcaggattggggttgttatcagctcttatatgcactttactaacgtgagtgccagcgccgatcaggcacttgacaggtttgccatgaaaaaattctacgacgataaagtttctgctttgatgcaaccgtctcagaaaaggtacgtacaatttctttcaggtcttctttctggctccgtgaagatgaacgcatcccctcttttcctccactttgtcattctacatggcacccccaactttgacactggaggggtctgccgacccttcttgaaattgtaccaggccatgcagcccgtgtacacttccgggatctacaacgtggggccagaaaacccctcccggatctgtattgtgatcgagcccgcccagctgctgaagggtgacgttatggtgaagtgctaccacaaaaagtaccggagcgccactcgagatgtcatcttcagactgcagtttcacaccggggccgtgcaaggttacggactggtgttcggaaaggaggacctcgataatgcttctaaggacgaccgctttccggattacggtaaggtagagctggtgtttagtgctacccctgagaaaatccaggggtccgaacatctatataatgaccatggcgtgatcgtggactataataccaccgatcccctgattagatgggattcttacgagaatctttccgcagacggcgaggtgctgcatacccagggcccggttgacgggtccctatacgccaaggtgcggaagaagtcgtctagcgaccctggcatacccggagggccccaggctatcccagccaccaattccccggaccacagtgatcacacactctctgtcagcagcgactcaggacactctacagccagtgccagaacagacaagactgaagagcgtctagcccccggcacccgtagaggcctgagtgcccaggagaaggccgagctcgaccagctgttaagcggctttggactggaggatcctggcagctcattaaaggagatgactgacgcaagatctaagtatagcgggactcgacatgtggttccagctcaggtccacgtgaatggagatgctgctctcaaggatagggaaaccgacattctagacgacgaaatgccccaccatgatctgcattctgttgacagtttaggaacattatcatcatcggagggcccccagtccgcccatctcggacccttcacttgtcacaaatcttcacagaactctctgctttcagatgggtttggttctaatgtcggcgaagacccacagggcaccctcgtgcccgacctgggacttgggatggatggtccctatgagagggaacggacctttgggtcccgggagcctaaacagccccaacccctgctgcgtaagccatcagttagcgcccagatgcaggcatacggccagtcttcttactcaacgcagacctgggttcggcaacaacaaatggtagtggcccaccagtactcctttgcccccgacggcgaggctcggctggtgtcaaggtgtcccgcggacaaccccggactggttcaggcccaaccccgtgtaccacttacaccaacccggggaacgtccagccgagtggcggtgcagcggggggtgggttccggaccacacccacccgacacgcagcaacctagtccctccaaagccttcaagccacgattcccaggcgaccaggtggtgaacggcgccgggccggaactctctacgggccctagtcctggatcacccactctcgatatcgatcagtcgatcgaacagctcaaccgcctcatcttggaactcgatcctacttttgagcctatcccaacgcatatgaatgcattgggctcgcaagctaatgggagcgtcagcccggacagcgtggggggggggttaagagcaagttcgcggttgccggacactggagaaggaccttcacgcgctaccggtcggcagggctcctccgctgaacagccactaggaggtcgccttcgcaagctttcactgggacagtacgataacgacgcaggagggcagctgcctttctcaaagtgtgcttgggggaaagccggggtggattacgctccgaatcttcccccgttcccctcaccagcagatgtgaaggaaacgatgacccctggctaccctcaggatctggacattattgatggtcggattcttagctccaaggagagtatgtgttccacacccgccttccctgtgtctcccgaaaccccatacgtcaagactgccctgcgccatcccccttttagcccccccgagcccccactttcctccccagcttcccagcataagggcggccgagaaccacgttcttgtccggagacccttacccacgccgtggggatgtctgaaagtcctattggaccaaagagtacaatgctgcgggctgatgccagctcgaccccgagctttcagcaagcattcgcaagctcttgcactattagcagtaatggcccaggccagcggcgcgaatcatcgagctccgctgagagacagtgggttgaaagcagtcccaagccaatggtcagcttgctgggaagtggcagacccactggtagcccactgtcagccgaattctcaggcactcggaaggactcaccagttcttagttgctttccaccctcagaactccaggcgccgttccattcacacgaattatcgttggctgaacctccggattctctcgcccccccctcaagccaggcttttttgggattcggcacagcacccgtcgggagcggacttcctccggaagaggatcttggcgccctcctggctaattctcatggcgcctccccgacaccatctattcctttgactgcgacaggcgccgccgacaatggatttctgagtcacaatttcctgacagtcgcgccaggacattcatcccaccattcacccggccttcagggacaaggcgtgaccttacctggtcaaccacccttgcctgaaaagaaacgggcttccgaaggagataggtccctgggttctgtgtccccatctagttcaggcttttcgtcaccacactctggctctactatttctatcccattcccgaacgtgttgcctgacttttccaaggcctctgaagcgcccaccttctaccagacctccaagccagatatccccgggccgtag

SEQ ID NO: 137560 - DNA, 2760 bp, Artificial Sequence
  Description of Artificial Sequence: Synthetic coding sequence
atggatggaccttacgaaagagaacgcaccttcggaagtagggagcccaagcagccccagccactgctcaggaagccttccgtcagtgcccagatgcaggcctatggtcagtcgagctacagcacgcagacatgggtgagacaacagcagatggtggtggctcaccagtattcttttgcccccgacggagaagcacggctcgtcagccgatgccctgcggacaaccctggcttagtgcaggcccaacctagagtgcccttgaccccaactaggggcactagcagccgggtagctgtccagcgaggggtgggcagcgggccccacccaccggatactcaacagccgtctcccagtaaagcttttaagcctcgattcccgggagatcaagtggtgaacggcgctgggcctgaattgtcaacaggcccaagccccggatctcctactcttgacatcgatcagtctatcgagcagcttaatagactcatcctcgagttagacccaacattcgagcccattccaactcacatgaacgccttgggatcacaggccaatggcagtgtcagtcccgactctgtgggaggtgggctgcgtgcttcttcccgcctcccagacactggcgagggtcccagcagagccacaggccgacagggctcatccgccgagcagcctctgggtggccggctgcgaaaactgagtctgggacaatacgataacgatgctggcggccagttacccttttctaaatgtgcctggggcaaggcaggggtcgactatgctcctaacctaccaccgttcccctctcctgccgatgtgaaggagactatgacacccggatatccccaggacctggatatcatcgacggtcggatcctgagttccaaggagagcatgtgtagcaccccagctttccccgtcagccctgagactccttatgtgaaaaccgctctgcgccacccacctttctccccacctgagccccctctatcctcccccgcatcccagcataaaggagggagagagcctcgcagctgtcctgagaccttgactcatgccgtcggcatgagtgagtccccaatcggccccaagtctaccatgctccgggcagacgcatcgtcaacacccagttttcaacaggccttcgccagctcgtgcacgatttcttctaatggaccgggacagcgtcgcgagtcctcctcctccgcagagagacagtgggttgaaagctccccaaaacccatggtaagcttgctggggtccggacgtcccaccggctcaccactcagcgccgagttcagcggcaccaggaaggacagtcctgtgttatcatgctttccgccttctgaactgcaggcccccttccactcccatgaacttagcttagccgagcccccagattctctcgctccaccgtcatcccaggctttcctgggcttcggaaccgcccctgttgggtctggcttacctccagaggaggatctgggcgctcttttggcaaacagccacggcgcaagccccacaccaagcatccccctcacagccaccggagccgccgataatggattcctttcccataattttttaaccgtggccccggggcattccagccatcattcacctggcctgcagggccagggcgtaactctgccggggcagcctcctctgcccgagaagaagcgggcctctgagggtgatagaagtcttgggtctgtctccccaagctcatctgggttttcatctccacatagtgggtccactataagcattccgttccccaatgtgctccccgacttctctaaagccagcgaagctgcgagccctctgcctgacagccccggggataagttggtgatcgtgaagttcgtgcaggacaccagcaaattttggtacaaggcggatatcagccgagagcaagccattgctatgctgaaagacaaagaacctgggagcttcattgtgcgagattcccactcatttaggggcgcctacggtctggctatgaaggtcgctacccctcctcctagtgtgctgcagctgaataagaaggccggggatctggccaacgaactggttcggcactttctcatcgagtgtacaccaaagggcgtccgtctaaagggatgttccaatgaaccttattttggctcattgacagctctcgtttgtcaacactcaataacaccgctggccttaccttgcaagctcctgatccccgagcgggacccactcgaggaaattgctgagagctcccctcagactgccgcaaacagcgctgcagagctcttgaagcagggcgccgcatgtaacgtgtggtacctaaactctgtggaaatggaatcgttaaccgggcatcaggccatccaaaaagcactgtctatcacactggtgcaggaaccccctcctgtgtctacagtggtgcattttaaagtgtccgctcaaggaatcactcttactgacaatcagcgaaaactgttctttagacgccattaccctgtaaatagcgtgatcttctgcgccctggacccacaggataggaaatggatcaaggacggccccagctccaaggtgtttgggtttgtggctcgcaaacaggggtcagcgaccgataacgtgtgtcacctatttgctgagcacgatccagaacagcctgcaagagaaagccagagacacagaggtgctcgggacggtccacacgaagcaatgcccagacgccacagtggatcacccgccaacgttctgtttgagcttatcggacaggtgtag

SEQ ID NO: 137561 - DNA, 2148 bp, Artificial Sequence
  Description of Artificial Sequence: Synthetic coding sequence
atgtctcaggttatgagctcccccctcctggctggagggcatgctgtgtccctggcaccctgcgacgaacctagaaggaccctgcatccagcacctagtccgagcctcccgcctcagtgcagctactatacaacagagggttggggcgcccaggctctgatggctcctgttccctgcatggggccacccggtcgtctgcagcaggcgcctcaagtggaagctaaggcgacgtgcttcttgccctccccaggtgagaaagcactcgggacgcctgaggatctcgacagttatattgacttcagtttagagtcattaaaccagatgatccttgaactggatcccacattccaattgttgcctcccggaactggaggaagtcaggcagagttagcacaatctacaatgagtatgcgtaagaaggaggagtctgaggcactggatatcaaatacatcgaagtgacatccgcgcggtcacgttgtcacgacggccctcagcactgctctagtccctctgtgactccgccctttggaagtctgaggagcggtggactgctcttgagcagggatgtgcctcgcgagacgcgatcttcaagcgagtccttgattttttcgggaaaccagggtcgtggacatcagcgcccactccccccctccgaagggttatcgccccggccccctaactcaccaagcatatcaattccttgcatgggctctaaggcatcctctccacatggtctcggaagtcctctggttgcatccccccgcctggagaaaagactcggaggtctcgctcctcagcgaggtagtcgtattagtgtgctgagcgctagtcccgtgtccgacgtatcgtacatgtttggttcaagccagtcactgttgcattcgtcgaattcatcccatcaatccagctctaggagtctcgagtcgcctgctaacagtagttcatcactgcactccttaggctcagtctctctctgcactaggccaagtgattttcaagccccccgaaatcctacccttaccatgggtcaacctcgtaccccccatagtcctccgctggctaaggaacacgcctcttcatgcccgccttcaatcaccaatagcatggttgatattcccattgtacttattaacgggtgccctgagcctggttcatccccccctcagaggaccccaggccatcaaaactctgtgcagcctggagctgcatctccatccaacccttgccccgccacacggagcaacagccagaccctttccgacgctcccttcacaacttgcccagaaggaccagctagggatatgcaacctacgatgaaattcgttatggataccagcaaatactggttcaaaccaaatatcacccgtgaacaagccatcgaacttttgagaaaggaggaaccaggggcattcgttatacgcgactccagcagctacaggggcagttttggacttgccctgaaggtgcaagaggtgcccgcttcggcccagagtaggccaggagaagactcaaatgatttaattaggcactttctgattgagagtagtgcaaagggtgtccatctgaaaggtgctgacgaggaaccctacttcggttcactgtctgcttttgtttgccagcatagcataatggccctggcacttccgtgcaagctgactataccacaaagagaacttggtggggccgatggagcaagcgactccacagattcgccggcatcttgccagaagaagtcagctgggtgccacactctgtatcttagctcagtgtccgtggagactttaacgggcgcgctggcagtgcagaaagccatttctaccacattcgagcgagacatactgccgacgcccacagtcgtacacttcaaagtcacagaacagggcataacgctaactgatgtccaaaggaaagtcttctttcgacggcattacccactgacgacattgcggttttgcgggatggacccggagcagagaaaatggcagaaatactgcaaaccatcgtggattttcggtttcgttgcaaaaagtcagactgagccccaggagaatgtgtgccacctgtttgccgagtacgatatggttcagcctgcctctcaggttatagggctcgtaacggccctgttacaagacgcggagagaatgtag

SEQ ID NO: 137562 - DNA, 2148 bp, Artificial Sequence
  Description of Artificial Sequence: Synthetic coding sequence
atgagccaggtaatgtccagcccccttctggccgggggacacgccgtgtcattagctccatgcgatgaaccacgacgtaccttgcacccagccccgtccccttctctgccgccacaatgttcttactacacgaccgaagggtggggggcccaggcgttaatggctccagtcccttgtatgggaccaccaggccggctgcagcaggctccccaggtggaggcaaaagcaacatgcttcctcccaagcccgggcgagaaagcactggggacaccggaggatctcgactcctacatcgatttttccctggagagtcttaatcagatgatactggaactcgacccaacatttcagctgttgccgcccggtacaggggggtcccaagcagagctggcccagagtaccatgagcatgcgaaagaaggaagaaagcgaggccctcgacattaaatatatcgaggtgacctcagcacgcagtaggtgccatgatgggccacagcactgtagcagcccttctgtgactccgccattcggcagtcttcgatccggcgggctcctgctctctcgagatgtgccccgcgagactaggtcctcgagtgagtctttgattttctccggcaatcagggcagggggcaccagcgccccttacccccctctgaggggctgagtccgaggccccctaattccccgagcatcagtatcccatgcatggggtcaaaagcaagcagtccccatggactcggctcgcccctagtggcaagccctcggttagaaaaacggctggggggcctcgcccctcagcgaggctcccgaatctccgtgctgagcgccagcccagtgtctgatgttagctatatgttcgggtcatcccagagcctcctccactcttccaactcaagtcaccaatcaagctccaggtctctagagtctcccgctaacagcagtagcagcctccattcattagggagcgtttctctgtgcactagaccctctgacttccaagcccctagaaatcccactctgacgatgggccagccccggaccccccacagccctcccctggccaaagaacatgccagcagctgccccccaagcatcacaaactcaatggttgacataccgatcgtcctcataaatggctgccccgaacccggctctagccccccacaaagaacgccgggacatcagaattcggttcaaccaggggcggcatcacctagtaacccatgtcctgctactcggtctaacagccaaaccctttctgacgccccatttacgacatgccctgagggcccagctcgtgatatgcagcctaccatgaagttcgtgatggacacatcaaaatattggtttaagccaaacattacgcgcgaacaagccatagagcttctccgcaaggaagaacctggggcattcgttattagggactcttccagctaccgtggttcatttggactcgccctcaaagttcaagaggtgcctgcgtcagcccaatcccgcccaggagaggatagtaatgatcttatacgccatttcctgatagagagctccgcaaaaggggtgcatctaaaaggggcagatgaagagccatatttcggatcactttctgctttcgtctgtcaacattccatcatggcactggccttgccgtgcaagctgaccattccacagcgcgagcttggcggagcggatggcgctagcgatagtactgattctccggcttcatgccaaaaaaagagcgccggttgccatacactgtatcttagctctgttagcgtagagaccttaaccggagccttggctgttcagaaagctatttcaacaacattcgaacgcgacatcctgcctacacccaccgtggttcactttaaagtgactgagcagggaattactctgaccgatgttcagcgtaaggtctttttcagaaggcattaccctcttaccacactccggttctgtggtatggatccagaacagagaaagtggcaaaagtactgtaaacccagttggatattcggctttgtagccaaatcccaaaccgagccccaggaaaacgtgtgccacctatttgccgagtatgatatggttcaacccgcttcacaagtgatcgggctggtcacagcactcttgcaggatgcagagcgcatgtag

SEQ ID NO: 137563 - DNA, 387 bp, Artificial Sequence
  Description of Artificial Sequence: Synthetic coding sequence
atgaggccagtgcccgtgcggggcgtgcatagtctgcacccgcgaccttttggagggcctgtctcactgccctggcttcgcaccggcagatgccggtggggactggggctgtaccgacagcctagcctgttgcctgaagaaatctgtggcgtattcttcagacgccactatccattgaccacattgcgcttctgcggtatggacccggaacagagaaaatggcagaaatactgtaaaccctcttggatcttcggattcgtcgccaaatcccaaaccgagccacaagaaaatgtgtgccacctgtttgctgaatacgatatggtacaacctgcttcccaagttatcggtttggttactgccctattacaggatgcggagagaatgtag

SEQ ID NO: 137564 - DNA, 4230 bp, Artificial Sequence
  Description of Artificial Sequence: Synthetic coding sequence
atgaaatcctccgggcccgtagaaaggctcctgagggccttaggacgacgggactcaagtcgggccgctagccggccacggaaagcagagccacactcctttagagaaaaggtgtttagaaagaagccacccgtgtgtgctgtgtgcaaagtaaccatcgacggtactggggtgtcatgccgcgtgtgtaaagtggcaacgcatcgcaagtgtgaagccaaagttacttcggcatgccaggctctgccacctgtcgaactccgccggaacaccgcccctgtccggcgcatcgaacatctgggctccacgaaaagtctaaaccactccaagcagaggtctaccctgccgcgttccttctcattggacccattaatggagaggcgctgggaccttgacttgacctatgttaccgagagaattcttgctgccgcatttcctgctagacccgacgagcagaggcacagaggacacctccgggaactggcacatgtgctgcagagtaagcacagagacaagtatctgctctttaacctgtccgagaaacggcacgatctaacccggctgaatcctaaggtgcaggacttcgggtggcctgagttgcacgccccaccgctggacaagctgtgtagcatttgtaaggcgatggaaacttggctgtcggcagaccctcagcatgtggtggtgctgtattgcaaggggaataaaggcaaattgggggtcatcgtctctgcctacatgcattacagcaagatctctgccggcgctgaccaggccctggcgactcttactatgcggaagttttgtgaggacaaggtcgctaccgagctccagccgtctcagcggcgatacattagttattttagcgggctgctatcaggcagcatcagaatgaactcaagccccctctttctccattatgttttgatccctatgcttcctgctttcgagcccggcacaggttttcagccgtttctcaagatctaccagagtatgcaacttgtgtacacatctggcgtctatcacatagccgggccaggcccacagcagctatgcatatcactggaacctgcgctcctgctcaagggggatgtgatggttacatgttaccataaaggcggcaggggcacagaccggacccttgtctttcgggtccaattccacacttgcactattcacgggccacagttgacatttccaaaggatcagctcgacgaggcgtggaccgacgagagattcccatttcaggccagcgtggaattcgtgttttccagctcccccgaaaagataaaaggttccacaccccggaacgatccgagtgttagtgtggactacaacactacagaacccgccgttcgctgggactcttatgagaacttcaatcagcatcacgaggacagcgtcgatggctccttgacgcacacccgcgggccgttggacggctccccttatgctcaggtacaaagacctccacgccaaaccccccctgcaccctcacccgaacctccacctcccccaatgctttcagtgtcctctgattccgggcattcttcaactctgacgaccgaacctgccgcagagagtccaggacggcctccccccacggctgccgagcgccaggagctggataggttgctgggcggctgcggcgtggcctctggcggccgtggagcaggacgcgagactgctattttagatgacgaagagcagccaactgtgggcggaggtcctcacctgggggtgtacccgggccatcggcccggactgagtaggcactgttcatgcagacagggctatcgagagccttgcggggtgcccaatggtgggtactatcgcccagaaggcacactagagcgaaggagactggcctatgggggttatgaaggctccccgcagggctatgcagaagcctcaatggagaaaagaagactctgccgatcacttagcgaagggttatatccttatccacctgaaatgggaaagcccgccaccggagatttcggttatcgagcaccaggatatagggaggttgtgattttggaggatcccggactccccgcactgtacccttgcccagcatgcgaagagaaactggctctcccgactgcggccttgtacggactgcgtctcgagagggaagctggggaaggctgggcctcagaagcaggcaaaccattacttcatcctgtgcggcccggacatcccctcccgctcctgctccctgcctgtggacatcatcatgcccccatgcctgactattcttgcctgaaaccacccaaggccggcgaggagggccacgagggctgcagctacaccatgtgtccagagggccggtacgggcaccccggctacccggcactggtcacctattcttacggcggggcagtgccatcctactgtcctgcctacgggcgggttccacactcctgtgggtctccgggggaaggcagggggtacccttcaccgggcgcccatagcccccgagcagggagcatttcgccgggatcccccccgtatccccagtcccgaaagctgagctacgaaatccccaccgaagagggtggcgatagatatccccttccagggcacctggcgtctgcaggccccctggcctctgctgagtcactggagcctgtaagctggcgggaaggaccctccggtcattcaacacttccaagatcgccaagggacgctccctgcagcgcatcaagtgaattatctggaccgagtactcccctgcatacctcgtctcctgtgcaggggaaggagtctacaaggcgccaggacaccagatctccaactagtgcccccacacaaagactgagcccgggggaagccctccctcccgtatcacaggctggcaccggcaaagccccagaactgccaagtggcagtggaccagaacctctggcccccagcccagtctctcccaccttccccccctcatcccctagtgattggccgcaggaacggtcacccggaggtcattcagacggagccagcccccggagtcccgtaccaacgaccctaccaggccttagacatgccccttggcaaggccctagaggccctcctgactcaccggacggatcacccctcacgccagttccttcccagatgccctggttggtcgctagtcctgaaccgccccagagttcacccactccagcattcccgctcgccgccagctatgacactaacgggctgtctcagcccccactgcctgagaagaggcacctgccaggccctgggcaacaacccgggccatggggtccagagcaagcgtcttccccagcacgaggcatttctcatcatgtgaccttcgctccacttctctcagacaatgtgcctcagacaccagagccgccaacccaggaatcgcaatctaacgtgaagttcgttcaggatacgtcaaagttttggtataaaccccatctgtccagggatcaggctatcgctctgcttaaagataaagaccccggagccttcctcatcagggattctcactccttccaaggggcctatggtcttgccttaaaggtagccacccctcctcctagtgcgcagccatggaaaggagaccccgtagaacagctcgtgaggcattttttgattgagacagggcccaagggagttaaaattaagggatgtccttcagaaccttacttcgggagtctgtcagccctggtatcccagcacagcatttcccccattagcttaccctgttgcctgaggataccgtccaaagaccctctcgaggagactcccgaagcgcccgttcccacaaacatgagcacagcagccgacctgctgaggcagggagccgcctgcagcgtgctgtatctgacaagcgtcgaaacagagtctttgactgggcctcaggcagtcgccagagctagtagtgcagccctgtcttgcagtcccagacccacccctgctgtcgtgcattttaaggtgtctgcccagggtattacccttacagacaaccagcgaaagctgttctttcggcgacattacccagtcaactccatcacattttctagtacagatccacaggatcgtcgttggaccaacccagacggtacaacttcaaaaatctttggatttgtggcaaaaaaacctgggagcccttgggagaatgtatgccacctcttcgcagagctggaccctgatcagcctgctggtgctattgtgacgtttatcactaaggtgctcctcgggcagagaaagtag

SEQ ID NO: 137565 - DNA, 4260 bp, Artificial Sequence
  Description of Artificial Sequence: Synthetic coding sequence
atggatggaggcggcgtctgcgttgggcggggggatctgctgtcatcacctcaggctctagggcagttactgcggaaggaatccaggccacgacgggcgatgaagcccagaaaagcagagccccacagctttagggagaaagtgtttcgcaaaaagcctccagtatgcgctgtgtgtaaagtaaccatcgacgggaccggggtaagctgccgcgtctgcaaagtagccactcaccggaaatgcgaggccaaggtgacatcggcatgccaggcactgccacccgtggagctacgtaggaacacagcacccgttcgacggatagagcaccttggttcaactaagtccctaaaccacagcaagcaacggtcaactctccccaggtctttctccctagatccgctaatggagaggcgctgggatctggacctgacctacgttaccgagaggatcttagccgctgccttcccagccagaccagacgagcagcgccacaggggccatctgcgggagctggcacacgtgttacaatcgaagcaccgagataaatatctcttattcaatttatccgaaaaacggcacgatcttacccgcctgaatcccaaggtacaggattttgggtggcccgagttgcacgcccctcccctcgataaactatgcagcatctgtaaggccatggagacctggctgagcgctgatccacagcatgttgtggtcctgtactgtaaggggaacaagggcaagctgggagtgattgtctctgcgtatatgcactattcaaagattagcgccggtgcagaccaggcactggctacactaaccatgagaaagttctgcgaggataaagtggctacagaactccagccatctcaaagaagatatatcagctatttttctggcctgctgtccggatccatacgaatgaactcgagccctctgtttctgcattatgtgttgattcccatgctacctgcatttgaacccggcactggatttcagcccttcttgaagatatatcagagcatgcagctggtttataccagtggcgtctaccatattgctggtccaggtccccagcaactctgtatctccctcgagccagccttgcttctcaaaggagatgtgatggtgacctgctatcataaaggaggtcgggggaccgatcgcacgctggtgttcagggttcaattccacacatgcacaatccacggaccacagttaacattccctaaggatcagttagatgaggcctggacggacgaaaggtttcccttccaagcaagtgtggagtttgtcttttctagctcgcctgaaaagattaagggctccacaccgaggaacgacccttcagtttcagttgattacaacacgacggagcccgctgttcgatgggattcatatgagaatttcaatcaacatcacgaggactccgtggatggatcgctaacccacaccagaggtccactggacggctcgccctatgcacaagttcagaggcctcccaggcagacaccaccggccccgtctcctgaaccgccaccaccaccaatgctgtctgtgtcaagcgactccggacacagcagtactcttactacagagcccgccgcggagtcgccaggtagaccccccccgaccgctgccgagcggcaagagttggatcgtctattgggggggtgcggtgtggcaagcgggggacgaggcgccgggagggaaaccgccattcttgatgatgaggagcagccaactgtcgggggaggaccacatctcggcgtgtacccgggccatcgaccagggctcagccgccactgttcttgtcgtcagggctaccgcgagccctgtggggtgcccaatgggggatactacaggcctgagggtacacttgagcggagacggctggcctacggcggatacgaaggctccccgcagggctacgccgaagcctcgatggaaaaacggcggctctgcaggagccttagcgagggtctctatccctacccaccggaaatgggaaagccagctactggagatttcggctacagggccccagggtaccgcgaagttgtgattttagaagacccgggtctccccgctctgtacccctgccccgcgtgcgaggagaagctggccctcccgacagccgccttgtacggactgaggctggagcgtgaggccggggaggggtgggcaagtgaggcaggcaaaccattactccacccagtcaggccaggtcatcctctgcccctgctactgccggcctgtggtcatcaccacgctcccatgccggattatagttgcctgaagcctccgaaggctggagaggaaggccacgagggatgcagttacaccatgtgtcctgagggtagatacggtcaccctggttatccggctctagtaacttatagttacggcggcgccgtgccgtcatactgccctgcttatggccgtgtcccacacagctgcggatccccaggggagggacgtggctatccatcccctggtgctcactcacctcgtgccggatctatctctccgggatcacccccataccctcagagccgaaagctttcctacgaaatccctaccgaggaggggggcgaccggtaccctctcccaggacacctggcctccgcgggtccgctcgcatccgccgagtctctggaaccagtgagttggcgggaaggcccttccggccatagcacactacccagaagccctagagacgctccctgttctgcaagctccgagctgtcaggcccttccacccccctgcatacctcttctccagtccaaggaaaagaatctactcgaagacaagatactaggtctcctaccagtgcccctacccagcgattaagccctggcgaggccttgccccctgtgtcgcaggccggtactggtaaagctccggagttacctagcggttccgggcccgagcccttggcaccatctccagtaagtcccaccttccccccgtcctcaccgtccgattggcctcaggaacggtcacctggcggccatagtgacggtgcttcaccgaggtctccagtccccaccaccctgcctgggctgcggcacgccccctggcagggccctagagggccacctgactcacccgatggatccccactcactccagtgcccagccaaatgccttggctcgttgcatccccagagcccccgcagtccagtccaacccccgcctttcctctcgccgcttcttatgacaccaatgggttgtcacaaccacccctgccggaaaagcgacatctgcccggacccgggcagcagcccggcccctggggacctgagcaagccagcagcccagccagaggcattagtcaccacgttaccttcgctccactgctatcagacaacgtcccacagacacctgaaccaccaacacaagagtcccagagtaatgtcaaattcgtgcaggatacatccaagttctggtacaaaccacatttatctcgggaccaggctattgcactactcaaggataaagaccctggcgcgtttctgattcgagacagccactcctttcagggcgcctatgggcttgctttaaaggtggctacacctcccccatcggctcagccctggaaaggcgatcccgtggagcaactggtgcggcactttcttatcgaaaccggacccaagggtgtcaagatcaaggggtgcccctccgagccttatttcggaagtctctcggccttggtgtcacaacactctattagccccatttcactgccctgctgcctgcgaattccctccaaagacccactggaagagactcctgaggcacctgttcctaccaacatgagcaccgcggctgatctgctgcggcagggagcggcctgttccgtgctgtacctgacctccgtggaaacggagtcactcacaggaccacaggcagtggcgcgggcaagtagcgcagcactcagctgcagcccgcgtccaacacccgctgtcgtacatttcaaggtgtcagcacagggcattaccctcactgataatcagcggaaactgttttttagacgccattatcccgtgaatagcataacattttcatcaacggacccccaggaccgcaggtggacaaatccagacggaaccacatctaaaatttttgggtttgtggctaagaaaccaggttcgccttgggaaaacgtttgccacctgttcgctgagctggaccctgatcaacctgctggcgcaatcgtgacctttattaccaaggtcctgctcggccagaggaagtag

SEQ ID NO: 137566 - DNA, 3858 bp, Artificial Sequence
  Description of Artificial Sequence: Synthetic coding sequence
atggaacgtcgttgggacctggacctgacgtacgttacagagagaattttggccgccgccttccccgcaaggcctgatgagcaaagacatcgtggccatctgagggaactggcccatgtgctgcagagtaaacaccgggacaagtaccttctcttcaacttatccgaaaaaagacatgatctgacacgtttaaatccgaaggtccaagacttcggctggccggagttacacgctcctccattggacaagctgtgcagcatatgcaaggctatggaaacctggctgtcagcagacccccagcatgtggtcgtcttatactgcaaggggaataaggggaaactgggggtgattgtcagtgcgtacatgcactactccaagattagtgcaggcgctgatcaggccttagccacgctgaccatgagaaagttctgcgaggacaaagttgctacggaacttcaaccgtctcagcggaggtacatcagttatttctcaggcttgctgtcaggaagtataaggatgaacagctctcctctgttcttgcactatgtgctgattccaatgttgcccgcttttgagcccgggaccggctttcagccttttctaaaaatctaccaaagcatgcagctggtatacacctccggggtgtaccatatagcgggacctggtccacaacagctgtgtatctctctcgagcccgctctccttctcaagggtgacgttatggtaacgtgctatcacaaaggcggaaggggcactgatcgcactctggtctttagagtccaatttcatacttgtactatccacgggcctcagcttacctttcctaaagatcagctagatgaggcatggacagacgaacgcttcccgttccaggcctctgtagagttcgtgttcagcagcagccctgagaaaattaaaggaagtaccccaagaaatgatcccagcgtttccgtggattataacaccaccgagccggccgtacggtgggattcctatgaaaacttcaatcagcaccatgaagactccgtagacggcagtttaactcacacccgcggcccccttgatggctccccttatgcgcaggtgcagaggccccctagacagactccccctgctccctcgcctgagccccctcctccccctatgctgtcggttagctcagatagcggacactctagcaccttaaccacggaaccagccgccgagtcccccggcaggccaccacccacggccgccgagcggcaggagctggacaggttactgggaggctgtggggtggcgtcaggaggccggggagccggccgagagacagctattctcgatgatgaagagcagcccacggtggggggcggcccacatctgggggtctatcccggacacagaccaggcttgtctaggcactgtagctgccggcagggataccgcgaaccgtgcggggtgccaaacggcgggtattacagacctgaaggcaccctcgagcgccggcggttagcctacgggggctatgagggtagccctcaaggttacgccgaggcgagtatggagaaacgacgactgtgtaggtcactgtcggagggcctgtatccctatccgcccgaaatgggcaaaccagcaacaggcgacttcggttaccgggcgcctggctaccgcgaagtcgtgattttagaggaccctggattgccagctctttatccatgcccagcctgcgaggagaagctcgccctgcctactgcggcactctatggactccgtctcgagagagaagctggagaaggatgggccagcgaagccggtaagccccttttacatcccgtgaggcccgggcaccccctccctctgctcctgccagcctgtgggcatcaccacgcgcccatgccggactacagctgcctgaagccacctaaggcgggcgaggagggccacgaggggtgctcttatactatgtgccctgaaggaaggtacgggcaccccggctatccggcactagtgacctatagctatggaggggctgtcccttcatactgcccagcatatgggcgggtgccgcattcctgcggcagccctggggaagggcgaggctatccttcccccggcgctcactctccccgggccgggtccatctcccccggttcacccccctacccccaatcacgcaagctcagttatgagatcccaactgaggagggcggcgatcggtaccccttgccaggacacctcgcgtccgccgggccactcgcatccgctgagagtcttgaacccgtgagctggcgagagggcccctctgggcattccacactgccccgcagtccgcgggacgcgccttgtagcgccagttcagaactgtcagggccgagcacgcccctacatacttcttcacctgtgcaaggaaaggagtctacccggcggcaagacacaaggtctcctacaagcgccccaacccagcggctgtcccccggagaggccctgcctccggtctcccaggctggcacgggcaaggccccagagcttccaagcggaagtggcccagaaccactggctccctcccctgtctcccctacattcccaccatcctcgcctagcgactggccacaggagaggtcccccggagggcattcagacggggcatcccctagatcacccgtccctacaacactccccggattgcgccatgccccttggcagggcccacggggccctcccgattcacccgacggctccccactcaccccagtgccatctcagatgccatggctcgtggcgtcccctgaaccccctcagtcttctcccaccccagcattccctctggccgcctcctatgatacaaacgggctcagccaacctcccctgcctgagaagaggcatctacctggaccgggacagcaaccgggcccttggggccctgagcaggcctccagtccagctcgcgggatcagtcatcacgttacgttcgcacctttgctgtcagacaacgtcccccagactcctgagcccccgactcaagagtcccagtccaacgtgaagttcgttcaagacacctccaaattttggtacaagccccatttgtcacgggatcaagccattgccctgttgaaggacaaggatcccggcgcatttttaatccgggatagccacagcttccagggtgcttatggcctcgccctcaaagtggcaactccccctcccagcgctcagccctggaagggcgacccagtggagcagttagtgcgccactttctaatcgagaccggcccgaaaggcgtaaagataaaggggtgccccagtgaaccctactttggcagtttgagtgccctcgtgtcacaacactcgatttcccctatcagcctgccatgctgtctcagaattccctctaaggaccctcttgaggaaactccggaggctcctgtccctacaaacatgtcaaccgctgcggacctgctcagacagggggccgcctgctcggtgctctatctgacttccgtggagaccgagagtctcactgggccgcaggctgtggcacgagcctccagcgctgccctcagttgcagccccagaccaactcctgccgtcgttcacttcaaagtttcagcacaggggatcaccctaacagacaatcaaaggaaactgttcttccggcgccactacccggtcaactctataacattcagcagtactgatccacaggacagaagatggaccaatcctgacggcaccacctccaagatatttgggttcgtggcaaaaaagccaggtagcccttgggagaacgtctgtcacctgtttgccgagctggacccagaccagcccgctggagcgatcgtcactttcattactaaagtcctgcttggacagcggaagtag

SEQ ID NO: 137567 - DNA, 2346 bp, Artificial Sequence
  Description of Artificial Sequence: Synthetic coding sequence
atgaaatcgagcggacctgttgagcggctcttacgcgccttaggcagaagagattcctcacgagctgccagcaggccaagaaaggctgaacctcacagcttccgggaaaaagtttttcgtaagaagcccccagtgtgtgcagtgtgtaaagttactattgacggtactggcgtgtcctgtagggtctgtaaagtggcaacccataggaaatgtgaggccaaggtgacaagcgcatgccaggcactgccaccagtggaactcaggaggaacacagccccagtgcgacggatcgaacacctcgggtcaacgaagagcctcaaccattctaagcagcggtctacactcccgcgaagcttttctcttgacccgctgatggaaagacgctgggatttggaccttacatacgtcactgagcggatactagctgccgcctttcctgcccgacccgacgagcagcgccatcgggggcacttgagggaactggctcatgtgttgcagtccaaacatcgggataaatatctgctatttaacctatccgagaagcgccacgacctgacaaggctgaaccctaaagtgcaggacttcggctggcccgagctccatgctcctcccctggacaagctttgctcaatttgtaaggcgatggaaacttggctgtccgcggacccacagcatgtggtggtgctgtactgtaaggggaacaagggtaagttgggagtaatcgtctccgcatatatgcactatagcaaaattagtgcgggagcagatcaggctctggcaacattaaccatgagaaaattctgtgaagataaagtcgccaccgagctacagccttcccaacgaagatacatttcctacttctcgggcctgttgtccggttccattcgaatgaactcttcccctctgttcttacactatgtccttattcccatgctgccagcctttgagcctggcacagggttccagccctttctaaaaatttatcagagcatgcagctcgtgtatacttccggcgtttaccatatcgctggccctggaccacagcagctctgcatttccctggaacctgcactcctgctaaagggggatgttatggtgacctgttaccacaaaggcgggagaggaacagatcgtacgctcgtgttccgcgtccagttccacacctgtaccatccacggtccacaacttacttttccaaaggatcagctcgatgaggcatggacagacgaacgtttccccttccaggcaagtgtcgagtttgtgtttagcagttctcctgaaaagatcaaaggatccacacctagaaatgacccatctgtctcggtggactacaataccaccgagcctgccgtgcggtgggactcttacgaaaatttcaatcagcatcatgaagactctgtcgacggatctttaacacacacccgaggccctctcgatgggtcgccttatgctcaagtgcagcgcccacctcgacagacccctccagcaccctcacccgagcctccaccaccccccatgctgtcagtcagctcagattctggccatagtagcacccttaccaccgaacccgctgccgaatcgcccggtcgacccccgcccaccgcagccgaacggcaagagctcgaccgcctgttaggtggctgcggagtggcttccggaggcaggggagcagggcgcgagaccgcgattctagatgatgaggagcaacctacagtgggcgggggaccgcacctcggagtttatccgggtcacagaccgggcttgagtaggcattgttcctgccgccagggctatcgcgaaccttgcggagtgcccaatggaggatactaccggcctgaggggactttggaacgcaggagattggcttatggcgggtatgaaggttcgccacagggatacgcagaagctagcatggaaaaacgacggctttgcaggagcctgtcagagggcctttatccttacccccccgagatgggaaagccagctacaggagactttggctatcgggctagctcagctgcacttagctgctctcccaggcctacgccagcggtggttcacttcaaggtttctgcccaaggaatcactctcacagacaatcagcggaagctgttttttaggcgacactatccagtcaatagcattacattcagttccactgacccccaggaccgaaggtggacaaatcctgacggcaccacctccaagatctttggattcgtcgctaagaagccagggtccccctgggagaacgtgtgtcatctctttgccgagttggaccccgaccagcctgccggggccattgtcacgttcattaccaaggtattgttagggcaaaggaaatag

SEQ ID NO: 137568 - DNA, 4200 bp, Artificial Sequence
  Description of Artificial Sequence: Synthetic coding sequence
atgaagtcatctggacctgtcgaacgcctgctgagggcccttggccggcgggacagttcccgtgctgctagtagaccccgcaaggctgaaccacacagtttccgggaaaaagtgttcaggaagaaaccgcctgtgtgtgcagtctgtaaggtgaccattgacggcacaggcgtgagctgcagagtctgcaaagtcgccactcatcgaaagtgtgaggccaaagtcactagtgcttgtcaagcacttccaccggtggagctccggcgaaatacggctcccgtgagacgcatcgagcacctggggtcaactaagagcttgaatcactcgaagcagcgtagcacccttccgcgctcattctccctggatcccctcatggagaggcgatgggatcttgacctgacttatgtaaccgaaagaattctcgccgctgctttcccagcacgccctgacgagcagcgccaccgcggtcatctgcgggagctggcccatgttcttcagtccaaacaccgagacaaatacttgctgttcaacctgtccgaaaagagacacgatttaactcgtctgaatccaaaagttcaggattttgggtggccagaactgcacgcccctcccttggacaaactgtgcagcatttgcaaagccatggaaacttggttgtcagctgatccacagcatgtcgtagttctctattgcaaaggaaacaaagggaaactaggggtcattgtaagtgcttacatgcactattccaaaatctctgccggagccgaccaagccctcgccactttaacgatgagaaagttttgcgaggataaagtggccactgagttgcagccgtcccagaggcgctacatttcctatttttcaggtttattatctggaagcattcggatgaatagttcacccttatttctgcattacgtgcttatacccatgttaccggcctttgagccggggacgggatttcagccgttcctgaagatttaccagagtatgcagctggtctacacctccggagtgtaccacattgctggtccagggccacagcagctctgtatatcgctggagccagcgctgttactgaagggggatgtaatggtcacgtgttatcataaaggcggtcgcggtactgatcgaacgttggtgttccgcgtgcagttccacacatgtaccattcatggtccacagctgacgtttcctaaggaccagctcgatgaagcttggacagatgagcggtttccgttccaggctagcgtcgagttcgttttcagcagttcccccgaaaaaatcaagggctccaccccccgcaacgacccgtccgtgtcagttgattataatactacagaaccagccgtgcggtgggattcttatgaaaatttcaatcaacaccacgaggatagtgtcgacggatccctcacacatacaagaggcccgcttgacggaagcccttacgcgcaggtgcagcgacccccaagacagaccccccctgctccctctcctgagccaccccctccaccaatgttgagtgtatcctccgacagcggacatagctccacccttactactgaaccagccgccgaaagcccagggcgacctccacccactgctgcggaacggcaagagttggaccggcttctcgggggatgcggagtcgcgtccgggggtcgaggtgcaggccgggaaactgctattcttgatgatgaggagcagccaacagttggcgggggtccccacttgggcgtgtaccccggtcataggccagggctgtctcggcactgctcatgcaggcagggctatagggaaccttgcggcgtgcccaacggtggatactatcgtccagaaggaacattagaacgccggcggttagcctatggaggctacgaaggctctccgcaaggctacgcagaggcatcaatggaaaaaagacgcttgtgccgatccctgagcgagggtctatacccttatccaccggagatgggaaagcccgcaacgggagattttggctacagagcaccaggttatcgcgaggttgtgattttggaggacccagggctgccagccttgtacccttgcccagcgagcctttacggtctgcggctggagagggaagctggggaaggctgggctagcgaagctggaaagcccctgctgcacccagtgcgaccaggtcatcctcttcccctgctcctccctgcctgcggtcatcatcatgcccccatgcccgactacagctgtctcaaacctcctaaagctggtgaagaggggcacgagggatgctcctacactatgtgcccagagggccgctatgggcaccctggatatccagcgctggtgacctattcctatggcggcgccgttcccagctactgtccagcctacggacgtgtccctcactcttgcggcagtccaggggagggccgcggctaccctagcccgggggcacactcccccagagccggcagcatttcccccggcagccctccctatccccaatctaggaagctgagctacgaaatccctacagaagaaggcggtgatagatatccactgccaggccacctggcctctgcagggcctctcgcctccgctgaatctcttgagcctgtgagctggagagaaggtccttccggtcattccactctcccgagatccccgcgggatgcaccgtgctcagccagtagtgaactgagcgggccttcaacacccctccacacctcatctcctgttcaaggaaaggagtccaccagacgtcaggacaccagaagtccaacttctgcacccacgcaacgactctccccaggcgaggctttgccaccagtatcccaggctggaacaggcaaggcgccagagctgccgtccggtagcggcccagaacccctcgccccctctcccgtaagtcccacatttcctccatccagtccctcagattggccacaggagcgctcccccggtggtcactccgacggcgcgagcccacgctctccagttcccacgaccctacctgggctgcgacacgctccatggcagggtccaagaggcccaccagattcaccagatgggagccctctgacgccggtccctagccagatgccttggctggtggcttcgcctgagcccccacagtctagtcccaccccagcctttccccttgctgcaagttatgatactaatgggctctctcagcctcccctccccgaaaaacgacacttgcctgggcccggccagcaacccgggccatggggtccggagcaggcatcttcccctgcacgcggaatctcacatcatgttactttcgccccattgcttagtgataacgtaccgcaaaccccggaacctcctacacaggaatcacagagcaacgtcaagtttgtgcaagacacctcaaaattttggtataaaccacatttgagccgggatcaggccattgctctgctgaaagacaaagaccccggagcgtttctgattcgcgattcccacagttttcagggggcctatgggctggcactcaaggtggctaccccacctccttctgcccagccgtggaaaggcgacccggttgaacagttggttaggcattttctgatcgagaccggaccaaagggggtcaagatcaaaggctgtcccagcgagccttacttcgggtccctgtctgctctcgtatcccagcacagtatctccccgatttctctgccttgttgcctgaggatacccagcaaagacccacttgaagaaacccctgaggctcctgttcccaccaatatgagcactgctgccgatctgctgcggcagggagcggcctgttcggtcctttatctcacaagcgtcgaaacagaatctctgacagggccgcaggccgtggccagagcttcttcagcagcgctgagctgctcccctcgccccacccctgctgtggtccattttaaagtgtctgcccagggtattaccctaacagacaatcaacgaaaactgtttttccgacgtcactaccccgtcaacagcatcaccttttccagtaccgaccctcaggacaggcggtggaccaatcccgacggcaccaccagcaagatttttggcttcgttgccaaaaagcccggttctccctgggaaaacgtttgccacctgtttgccgaactcgatcccgaccaacctgccggtgccatcgttacattcattacaaaggtgttgctaggacaacgcaaatag

SEQ ID NO: 137569 - DNA, 567 bp, Artificial Sequence
  Description of Artificial Sequence: Synthetic coding sequence
atggattgccgtaaaatggctagatttagttattctgtcatctggatcatggcaatcagtaaggtgttcgagctgggtcttgtggccggactgggacaccaggaatttgcccgacctagcagggggtacctggcttttcgcgatgatagtatttggcctcaggaagaacccgctataaggcctaggtcatcacagcgggtgccgcctatgggaatacaacattcaaaagagttgaatagaacttgttgtctcaacggcggtacttgtatgcttgggagtttctgcgcctgcccgccctcgttttatgggagaaattgcgagcacgacgtgaggaaagagaattgcggcagtgttccgcatgacacgtggttgccaaaaaagtgttcgctgtgtaaatgttggcatggccagctgagatgctttccccaagcttttctcccggggtgtgacggcctcgtcatggatgaacacctggttgcctccaggacccctgagctccccccaagcgcacggaccaccactttcatgctggtgggtatttgtctctccattcagagttattactag

SEQ ID NO: 137570 - DNA, 519 bp, Artificial Sequence
  Description of Artificial Sequence: Synthetic coding sequence
atggccatctctaaggtattcgaacttggcctggtggccggactgggccatcaagagttcgccaggccatccagaggctatctggctttcagagacgacagcatctggccacaggaggagccagcgatccgtccacggagttcacaaagggtgcctcccatgggcatacagcacagtaaggaactcaatcgcacctgttgcctcaacggaggcacctgcatgttgggaagcttctgtgcatgtcccccatctttttatgggaggaattgcgagcacgatgttcggaaggaaaattgtggctcagttcctcacgatacgtggctgccaaagaagtgcagcctgtgcaagtgttggcacggtcagctgaggtgctttccccaggctttccttcctggttgcgacggcctggtgatggacgagcatctggtggccagccgcacacccgaactgccccctagtgctagaactactacgttcatgttagtaggaatctgcctgagcattcagtcttactattag

SEQ ID NO: 137571 - DNA, 645 bp, Artificial Sequence
  Description of Artificial Sequence: Synthetic coding sequence
atgggggctgcacattcagcatctgaggaagtgagagagttggaggggaaaaccgggttttccagcgatcagattgagcagctgcatagaaggtttaaacagttatctggagatcaacctacgatccgcaaagagaacttcaacaacgtgcctgacctggaactgaacccaatccggtcgaagatcgttcgggcattcttcgacaataggaaccttagaaaaggacccagcggcctggccgacgaaataaactttgaggatttccttacaataatgagttattttcgaccgatcgacactacaatggacgaggagcaggtcgaactctctcgcaaagaaaaactgcggtttttgtttcacatgtacgactctgactcagatggcaggatcaccttagaggagtaccgcaatgtggtggaggaacttctgagcggaaatcctcacatcgaaaaggagtcagcgaggagtattgcagacggtgccatgatggaggccgcgtctgtgtgcatggggcagatggagcctgatcaagtctacgaagggatcacctttgaggacttcctgaaaatatggcaaggtatcgacatcgagaccaagatgcacgtgagatttcttaatatggaaacgatggccctctgtcactag

SEQ ID NO: 137572 - DNA, 804 bp, Artificial Sequence
  Description of Artificial Sequence: Synthetic coding sequence
atgagacctaggagcggtcctacgagaaacccaagattgagagcttttgcaggcgtgccgactaggggacgcacacggggtcagtccagaagatgcgccgccgaagccagtgcaggccctgaaagagacgccaggcctggagctcccgccgcggggacgatgggcgccgcacacagcgcatccgaggaggtgagagaacttgaaggcaagacgggattctcctctgaccaaattgagcagctgcacaggaggtttaaacagctgagcggggatcagccgactatcagaaaagagaacttcaataatgtgcccgatctagagttaaatccgatcagatcaaaaattgtgcgtgcatttttcgataatcgaaatctgcggaagggtccctcaggcctggctgatgagattaattttgaggacttcctcactataatgtcttatttccgtcctatagacaccactatggacgaagagcaggtagaattgtctcgaaaggagaagctccggtttctattccatatgtacgactctgattccgacgggaggatcacccttgaggaatatcgaaacgtggtcgaggagctcctctccgggaatcctcatatcgagaaggagtccgccagaagcatcgccgacggcgccatgatggaagctgcgtcagtgtgcatgggccaaatggaaccagatcaggtgtacgaaggaatcacgtttgaggactttcttaaaatatggcagggaatcgatatcgaaaccaaaatgcatgtccgcttcctgaacatggaaactatggcattgtgccattag

SEQ ID NO: 137573 - DNA, 564 bp, Artificial Sequence
  Description of Artificial Sequence: Synthetic coding sequence
atgggcgctgcacattcggcctcagaggaggtccgagaactggaaggaaaaacaggattctcgagcgaccagattgaacagctccatcgtcgctttaaacagttgtccggggaccagcccactatcaggaatctccgtaaaggtccttctggactggccgatgagattaactttgaggattttctgactattatgtcctatttcaggcccatagatactactatggatgaggagcaggtggagctgtccagaaaggaaaagctgaggtttctgtttcatatgtacgatagcgattcggacggtcgcataacattggaggaatatagaaatgtcgtggaggaactcctgtcaggtaatccccatattgagaaggaatctgccagaagcatcgctgacggagccatgatggaagcggcatctgtatgtatggggcagatggagcctgaccaggtgtatgagggcattacatttgaagattttttgaagatctggcaaggcatagacattgagaccaaaatgcatgtgaggtttttgaatatggagacaatggctttgtgtcactag

SEQ ID NO: 137574 - DNA, 1266 bp, Artificial Sequence
  Description of Artificial Sequence: Synthetic coding sequence
ctgaacctagaggtgaaattcaagaaaatgggtctaggacacgagcagggtttcggtgccccgtgccttaaatgcaaggagaagtgcgagggctttgagttgcacttctggagaaaaatctgccgcaattgcaagtgtgggcaagaagagcacgatgtgctgctgagcaacgaagaggatagaaaggtggggaaactttttgaagataccaagtacactactctcattgccaagctgaaatcagacgggataccaatgtataagagaaatgttatgatcttgacaaatccagtggccgcgaagaaaaatgtgtccattaacactgtgacctatgagtgggcgcccccagtccagaatcaggcactagcacgtcagtatatgcaaatgctgccaaaggaaaaacagccagtagcaggaagcgagggagcccagtaccggaagaaacagttagcaaaacagctcccagcccacgaccaggatcccagcaaatgtcatgaactatcaccacgggaggtgaaggaaatggaacagtttgtgaagaagtacaagtctgaggctctcggcgtgggagacgtgaagctgccatgcgagatggatgcccagggaccaaaacagatgaatatacccggaggcgaccgaagtacccccgcagcagtcggggcaatggaagataaaagtgctgaacacaagcgaacacagtactcctgttactgttgtaaacttagtatgaaggagggagacccagccatctatgctgagcgcgctggatatgacaagctgtggcaccctgcctgcttcgtttgttccacctgtcatgaactgctggttgacatgatttacttctggaagaacgaaaagttgtattgtggccgccactattgtgattccgaaaaacctcgatgtgctgggtgtgacgagctgatttttagtaacgaatacacgcaggcggagaaccagaactggcaccttaaacacttctgctgcttcgactgtgattccatactggcaggagagatctacgtcatggtaaacgataaacctgtctgcaaaccctgctatgtaaagaatcacgccgtcgtttgtcaaggatgccacaatgctatcgacccggaggtgcaaagggtgacttacaacaatttctcctggcatgcttcgacggagtgtttcctctgttcctgttgtagcaaatgtctgataggacaaaagttcatgcctgtggagggcatggtgttctgctctgtagaatgcaaaaagaggatgtcctag

SEQ ID NO: 137575 - DNA, 1266 bp, Artificial Sequence
  Description of Artificial Sequence: Synthetic coding sequence
atggatcttgagaacaaagtgaaaaagatgggtctgggccatgaacagggattcggcgctccgtgcctgaaatgcaaagagaaatgtgagggctttgagctccacttttggaggaagatctgccgcaattgtaagtgtgggcaagaagagcacgatgtcctgctcagcaacgaagaggacaggaaggtggggaagcttttcgaggatacaaagtataccacgctcatcgcaaagctgaaaagtgacgggattcctatgtataagcgcaatgttatgattctcactaaccctgttgcagctaaaaagaacgtgtccatcaacaccgtcacatacgaatgggctccccccgtacagaatcaagcattagctcggcagtacatgcagatgctacccaaggagaagcagcctgtagcaggttctgaaggagcccagtaccgaaagaagcagctggcaaagcagctccctgctcacgatcaggatcccagcaaatgccacgaactgagtccgcgggaggtcaaggaaatggaacagttcgttaaaaaatacaagtcagaagcactcggcgtcggggacgtaaagctgccgtgcgagatggatgctcagggacccaagcagatgaatatccctggcggggaccgcagcacccccgctgctgtcggcgccatggaagataaaagtgcagaacataaaaggacacaatattcctgttattgctgcaagctatccatgaaggagggggatccagccatatacgcggagcgggctggctatgacaaactgtggcaccccgcttgcttcgtctgctcgacatgccacgagctgttggtggatatgatctacttttggaaaaacgagaaattgtattgtgggcgtcactactgtgacagcgagaagcccagatgcgctggctgcgatgaattgatctttagtaatgagtacacacaggcagagaatcagaactggcatcttaagcatttctgttgctttgactgtgacagtatcctggccggagagatctacgtaatggtcaatgacaagcccgtgtgtaaaccctgctacgtgaaaaaccacgcggtagtgtgtcaagggtgccataacgcaatagatcccgaggtccagcgcgttacctacaataatttttcttggcatgctagtacggaatgcttcttatgttcttgctgcagtaaatgcctgattgggcaaaagtttatgcctgtagagggaatggtgttttgtagtgtagagtgcaagaaaagaatgagttag

SEQ ID NO: 137576 - DNA, 1239 bp, Artificial Sequence
  Description of Artificial Sequence: Synthetic coding sequence
atggggcttggacatgaacagggctttggagccccctgtctaaagtgcaaggaaaagtgtgaagggtttgagctgcatttctggaggaagatttgccggaactgcaaatgtggtcaggaggagcacgatgtcctgctcagcaacgaggaggaccgaaaggtcggaaagctgttcgaggacaccaaatataccactctgatcgccaagctgaaaagtgacggcattccgatgtacaagaggaacgtgatgatcctcacgaaccccgtggcagcaaagaaaaatgtctcaatcaatacagtcacatacgaatgggcaccacccgtacaaaatcaggccctggccaggcaatatatgcagatgttacctaaggaaaaacagccagtcgctggctctgagggagcccaatacaggaagaagcagctggccaaacagctcccagcccacgaccaggatccatctaagtgccacgagctgtcacctcgggaggtgaaggagatggaacagttcgtcaagaaatacaagtctgaggccttaggggtgggtgatgtcaagcttccatgtgagatggatgcgcaggggcccaaacagatgaatatcccaggtggagacaggagcaccccagcagccgtgggggccatggaggataaatcagccgagcacaaacgaacacagtattcttgctattgctgcaaattaagcatgaaggagggagacccagctatctacgctgaacgggctgggtatgataaattgtggcaccccgcatgctttgtgtgtagcacctgccacgagttgctagttgacatgatctatttttggaaaaacgaaaaactctactgcggtagacactattgcgactccgaaaagccacgatgtgcaggatgcgacgagttaatcttctcaaatgagtacactcaagcggagaatcagaattggcatctgaaacacttctgttgtttcgactgcgattcaatactcgccggtgagatctatgtgatggttaacgacaaacctgtctgcaaaccttgttacgttaaaaatcacgcagtggtgtgtcaggggtgtcacaacgcgattgaccctgaggttcagcgcgttacctacaataatttctcttggcacgccagcaccgagtgttttctctgcagctgctgctcgaagtgcctgattggccagaagtttatgccagttgagggtatggtgttttgttctgtcgaatgcaagaaacgaatgagttag

SEQ ID NO: 137577 - DNA, 540 bp, Artificial Sequence
  Description of Artificial Sequence: Synthetic coding sequence
atgaaggaaggtgaccctgctatctacgcagagagggccgggtacgacaagctgtggcatcccgcttgttttgtttgcagcacgtgccacgaactgctcgtggacatgatctatttttggaagaatgagaagttgtactgcgggagacactactgcgactcagaaaaacctagatgcgccggttgtgacgaactcatcttcagcaatgagtatacacaggcagagaatcaaaattggcacctcaaacatttctgttgtttcgactgtgactctatacttgcaggcgaaatctacgtcatggtaaatgataagcccgtttgcaaaccctgttacgtaaagaatcatgctgttgtatgccaggggtgccataacgcaattgaccctgaagtccagagggtcacgtataacaatttctcatggcacgcatctacagagtgctttctgtgttcttgttgcagtaagtgcttaattggacaaaaattcatgcccgtcgagggaatggttttctgcagtgttgaatgtaagaaacggatgagttag

SEQ ID NO: 137578 - DNA, 804 bp, Artificial Sequence
  Description of Artificial Sequence: Synthetic coding sequence
atgggagctcgtcagattcagacttcttccagtcaaacatctcctgaagaagcgatgggcactcctcggatccaacacctgcttatcctgctcgtcctgggggcgagcctcctgacctctgggctcgaactgtattgtcagaagggcttatcaatgacagtggaggccgaccctgccaacatgttcaactggaccaccgaggaggtcgaaacctgtgataagggggccctctgtcaggaaactattctcattatcaaggcgggtacagagactgccatcctggctacaaaagggtgtattccagaaggcgaagaggcgattactatcgtgcagcactcatcaccgcctggactgattgtgacgtcctactccaactattgcgaagacagtttttgcaacgacaaagatagtctatcccaattctgggaattctcggaaacaaccgcgagcaccgttagcactacgttgcattgccctacttgtgtagccctgggaacctgcttcagcgctcccagtctaccttgcccgaacggcacgaccaggtgttatcagggtaaactggaaataaccggcggggggatagagtcatctgtggaagtcaagggttgcaccgcgatgatcgggtgccgcctgatgtctggaatactcgccgtgggtccaatgttcgttcgagaggcatgtcctcatcagctgctaacgcagcctaggaaaactgagaacggcgccacgtgtctgcctattccagtgtgggggctgcagctgcttctcccgttgctgctcccctcgtttatccatttttcttag

SEQ ID NO: 137579 - DNA, 789 bp, Artificial Sequence
  Description of Artificial Sequence: Synthetic coding sequence
atccagacttcttcaagccagactagccctgaggaggctatgggcacccccaggatccagcacctcttaatcctcctggtgctgggcgcctctctgttgacctcggggctcgagttatactgccagaagggcctctctatgacagtcgaggctgatcccgccaacatgttcaattggactaccgaggaggtggagacctgtgacaagggcgctctgtgccaggagacaattctaattattaaagcagggactgagacagcaatcttggccaccaagggctgtatccctgagggggaagaagctattacgattgtacaacatagtagtccacccgggttaatagtcacctcttatagcaattactgcgaggactcattttgcaacgacaaggatagcctctcccaattctgggagttctccgaaacaactgcgagtacagtgtcaaccaccctccattgtcctacctgtgtggccctgggaacctgcttctccgcccccagcctgccctgccccaacggtacaactcgttgctaccagggaaagcttgagatcacgggcggaggcattgaatcaagcgtggaggttaaaggatgcaccgccatgataggctgcaggctgatgtctggaattcttgcagtgggccccatgtttgtcagagaggcatgcccccaccagctacttacgcaaccccgaaagaccgaaaatggtgccacctgtctgccaatcccggtgtggggacttcagctgttactacctctgcttctgccgtcgtttatccatttctcatag

SEQ ID NO: 137580 - DNA, 750 bp, Artificial Sequence
  Description of Artificial Sequence: Synthetic coding sequence
atgggtacgccacgaatccaacacctgttgattctgttggttctgggggcctccctgttaaccagcggtctagagctgtattgtcaaaaaggcctgtccatgactgtggaggccgacccagcaaatatgttcaattggacaacagaagaagtcgagacttgtgacaaaggagctttatgccaggagacaatcctcattatcaaagccgggacggagaccgccatcctcgccaccaagggctgtatacccgagggggaagaggccattaccatcgttcagcactctagcccccctggactgatcgtcacctcatacagcaactattgtgaggacagcttttgtaatgacaaggattccctgtcccagttctgggagtttagtgagacaactgctagcaccgtttccacaacgttacactgtcccacttgcgtcgccctgggcacgtgctttagcgccccatctctcccttgtcccaatgggacaacacggtgctaccagggaaaactggagatcaccggtggagggattgagagctcagtggaggtgaaaggttgcacagcaatgattggatgtcggttaatgtcaggcatcctggcggtcggcccaatgtttgtgagagaagcttgccctcaccagttgctcacccaaccgcggaagacagagaatggtgcaacatgtctgcctatcccagtgtggggtcttcagcttctgctgccccttcttttgccttcgtttatccatttttcatag

SEQ ID NO: 137581 - DNA, 804 bp, Artificial Sequence
  Description of Artificial Sequence: Synthetic coding sequence
atgggggcaagacagatccaaacctctagctctcagactagcccggaggaggctatgggcaccccaagaatccaacacttgctaattctcctcgtgctgggagccagcctccttacttctggcctggagctctactgccagaagggcttaagcatgacggtcgaggctgaccctgccaatatgttcaattggacgacagaagaggtagagacttgcgacaagggggcactgtgccaggaaaccatccttatcatcaaggctgggacagaaactgccattctggcaactaaggggtgtatccccgaaggagaggaagctatcaccattgtccagcactcttctccaccaggcctcatcgtgactagctactctaactattgtgaagattctttttgcaacgacaaggattcactcagccagttctgggagttcagtgagactaccgcctcaacagtgtctactacattgcattgccctacttgtgtcgccttaggcacatgttttagcgccccctcgctgccatgcccaaatggcacgacccggtgctaccagggcaaactagagataactggaggggggatagaatcatctgtggaagtcaagggctgcactgccatgattgggtgcagattgatgtctggcatcctggctgtcgggcccatgtttgtgcgggaggcttgccctcaccagctactgacacagcctcggaagactgagaacggcgccacatgtctgcctattcccgtttggggcttgcaactgcttctccccctgctcctgccctcctttatccacttcagttag

SEQ ID NO: 137582 - DNA, 2823 bp, Artificial Sequence
  Description of Artificial Sequence: Synthetic coding sequence
atgatatctgcccactgtaatcttcggctgctctgtagctccgactcatccgcaagcgcaagtcaagtcgccggcactacggaggttgtcgagaatttggtcactaacgataattctccgaacatcccagaagccattgacagacttttctcagatatcgctaatattaatagggagtcaatggctgagatcacagatattcagatcgaagagatggctgttaacctgtggaactgggcgctcactataggtggaggctggctcgtcaacgaggagcagaagattcgccttcactatgtcgcttgcaagctgctgtccatgtgtgaggccagcttcgcctccgagcaatcaatccagcggttgattatgatgaacatgcgcattggaaaagagtggcttgatgccggaaacttcttaatagccgacgagtgctttcaggccgctgtcgctagccttgagcaactctacgttaagcttatccagagatccagtcctgaagcagacctcacaatggaaaagatcacagtagagtcggaccactttagagtgctttcatatcaggcagagtccgctgttgcccagggcgactttcagcgagctagtatgtgcgtgcttcaatgtaaagatatgctcatgcgactgccccagatgacctcaagcttgcatcatctatgctataacttcggagtggagacccagaaaaataataagtatgaagagtctagcttctggctctcacaatcctatgatatcggtaaaatggataagaaatctaccggccctgagatgctggcaaaggtgctcaggctcttagccacgaattatctcgactgggatgatacaaagtattatgacaaagccctgaatgcagtgaaccttgctaacaaggagcacttgtcctctcccggactgttcctgaagatgaagatcctgttgaagggagagacatccaacgaagagttgctggaagcagtcatggaaatccttcacctggatatgcccctggatttctgcttgaacatcgcaaaactcttgatggaccacgaacgagaaagcgtcggattccacttcctgaccataatccatgagaggttcaagtctagcgagaacattggaaaagtgcttatcctacacaccgacatgctcctgcagcgcaaagaagagctgctggcaaaggagaaaatcgaggaaatatttctggcccaccaaaccggcaggcagttaacagcagaaagcatgaactggctgcataacattctatggagacaggcagcctcctccttcgaggtgcaaaactatactgatgcgctgcagtggtactactactctctccgcttctattcaaccgatgaaatggacctggattttaccaagctgcaacgaaatatggcttgttgctacttgaacctccagcagttagataaggcaaaggaagcagtcgctgaggcggagcggcacgatccaaggaacgtgtttacacaattttacatcttcaagatcgcagtgatagaaggtaattccgaaagggccctgcaggctatcatcactttggaaaacattctcacggacgaggaatccgaagataacgatttggtcgccgagagaggatcacccacaatgcttctgtccctggccgcgcagtttgccttagaaaatgggcagcaaattgtcgccgaaaaagcactggaatacctcgcccaacactcagaagaccaagagcaggtgctgaccgcggtgaagtgtcttttgcgatttctcctacctaagatcgccgagatgcccgagtccgaagataagaagaaagaaatggatcgcttgctgacatgcctcaacagagcatttgttaagctcagccaaccatttggagaggaggccctgagtctggagtcgagagccaacgaagcccagtggttccgcaaaaccgcgtggaacctcgctgtgcaatgtgacaaggaccccgtgatgatgagagagttcttcattctttcatataaaatgtcccagttttgccctagcgaccaggtgatcctgatcgccagaaagacttgtctgctcatggcggttgctgtggacctagagcaggggaggaaggcctcaacggcttttgagcagacaatgttcctgagccgtgcccttgaggagattcagacttgcaatgacatccataactttctgaaacaaacaggtactttttctaatgacagttgtgaaaagctactactcctgtatgagtttgaagtgcgcgccaagctgaacgatcccctgttagaaagttttcttgagagcgtgtgggaactgccacatctagaaaccaaaacattcgagacaattgccataatcgccatggagaagccggcgcactatcccctcattgctctgaaggctttgaaaaaagctctcctgctgtacaagaaggaggaacctatcgacattagccagtactccaagtgcatgcacaatctcgtcaatctgagcgtccctgacggagcctccaatgtcgagctgtgtcctctggaggaggtgtgggggtattttgaagacgccctgtctcatatctcccgcaccaaagactaccccgagatggagatcctgtggctgatggtcaaatcttggaatacaggcgtgctgatgttcagccggagtaagtacgcaagcgccgaaaaatggtgtggcctggccctgcggttccttaaccacctcacgtcctttaaagagtcctacgagacccagatgaatatgctgtacagccagttggtggaggctctttcaaacaacaagggacccgtttttcatgaacatggctattggtctaagtcggattag

SEQ ID NO: 137583 - DNA, 1848 bp, Artificial Sequence
  Description of Artificial Sequence: Synthetic coding sequence
atggaaattctgcacctcgatatgccactggacttctgcttgaacattgccaaactcctcatggaccatgaaagagaatctgtggggttccattttctgaccatcatccatgagaggtttaaatcttccgaaaatatagggaaagtcttgattctgcacactgacatgctccttcagcggaaggaggaactgctggcaaaggagaagattgaggaaatcttcctggcgcaccagacagggagacaactgacggcagagtccatgaattggctgcataatattctttggcgccaagccgccagctcttttgaggtgcaaaactatacagacgctctgcagtggtactactatagtcttcgcttctacagtacggatgagatggacttagacttcacaaagttgcagcgtaacatggcttgttgttacttaaacctccagcagctggacaaagcaaaagaggccgtggcagaggccgagcggcacgacccccgcaatgtgttcacccagttctacatttttaagatcgcagtcattgagggcaattcagagcgcgctctccaggccattataaccttggagaacatattgacagatgaggaatctgaggataatgatctcgttgctgagcgggggagtccaacaatgttactctccctggcggctcagttcgcgctcgagaacggtcaacagatcgtggccgagaaagctctcgagtacctggcgcagcatagtgaggatcaagaacaggttttaactgcagtgaagtgcttgctccgctttctcctgcctaagatagccgagatgccagagtccgaagacaaaaagaaagaaatggatagactgctgacctgcctgaatcgtgcctttgtcaaactgagccagccatttggtgaggaagctctatcattagagtcccgcgcaaacgaagcccagtggtttaggaagacggcctggaatttggctgtgcagtgtgataaggatccggttatgatgcgagagttttttatcctttcctacaagatgtcacagttctgcccttccgaccaggttatcctcattgcgagaaagacatgcctgttgatggccgtcgccgtggacttagaacaagggagaaaggcctcaactgccttcgaacagacaatgttcctgagccgggcgctcgaggaaatccagacttgtaatgacattcacaatttcctgaaacaaaccgggaccttttcaaacgattcatgcgagaagctcctgttactgtatgagtttgaggttcgggccaaattaaatgacccgctgctggagagcttcttggagtccgtgtgggagttgcctcatctggagaccaaaactttcgaaaccatagccatcattgccatggagaagccggcccattacccgctcattgcgctaaaggcgctcaagaaggccttgctgctgtacaagaaggaggagcccatcgatattagccagtatagcaaatgcatgcacaatcttgtgaacctgagtgtgccagacggggcttccaatgtcgaactttgtcccttggaggaggtctggggctacttcgaagacgctctttcccacatcagccgcacaaaagattatcccgagatggagatcctgtggctgatggtcaagtcctggaacacaggcgttttgatgttcagccgctctaagtatgctagcgctgaaaagtggtgtggacttgcactgagatttctaaaccacctgacttcttttaaagagagttacgagacgcagatgaatatgctgtactcacagctggtggaggctctctccaataataagggccctgtgtttcacgaacacggatactggtctaagtccgactag

SEQ ID NO: 137584 - DNA, 2778 bp, Artificial Sequence
  Description of Artificial Sequence: Synthetic coding sequence
atggataacgatgacttcttcagcatggattttaaagaggtcgttgaaaatctggtgaccaacgataattccccaaacatccccgaagcaatcgatcgactgttctccgatatcgccaatatcaaccgcgagtccatggctgagatcaccgatattcagatagaggagatggccgtcaacctctggaactgggccttaaccattggtggggggtggttagtcaacgaagaacagaagataaggctccactacgtggcctgtaagcttctttccatgtgcgaggcctcgttcgcatctgaacagtccattcagagattgataatgatgaacatgagaattgggaaagagtggctcgacgctgggaactttctaattgcggacgagtgcttccaggcggccgtggcttcactggaacaactttacgttaaactcatacaaagatcctctcctgaagccgacctaaccatggaaaagatcacggtggagtccgatcactttcgggtgctgagctatcaggccgaatctgctgtggctcagggtgattttcagcgagcctccatgtgcgttctgcaatgcaaggacatgttgatgagactgccacaaatgactagttctctgcaccacttatgctacaatttcggtgtagagactcagaagaataacaagtacgaggagtcatccttttggctgtcccagagctacgatattggcaaaatggacaaaaaatctactggccccgaaatgctggccaaagtcctcaggctgctcgccaccaattacctagattgggacgacaccaagtattacgacaaggccctcaatgctgtgaacctggctaacaaagaacacctgagctctcccgggttattcctcaaaatgaaaattctgctgaaaggggaaacaagtaacgaagagctgctggaggccgtcatggagatcctccatctcgacatgcctctcgatttctgcctaaacatcgctaaactactcatggaccatgagcgagagagtgttggtttccattttctgaccattatccacgagcgcttcaagagctccgaaaatatcggtaaggtgctgatcttacatacagacatgttacttcaaaggaaggaggaactgctggccaaggaaaaaattgaggagattttcctcgcccaccagaccgggcgacagcttaccgcagagtccatgaattggctgcataacattctttggaggcaggctgcttcatcctttgaggtccaaaactacacagatgcacttcaatggtactactacagcctgcggttctactccacagatgaaatggatctcgactttaccaagttgcaaaggaatatggcttgctgctacctgaacctgcaacagctggataaagcaaaagaggctgtggccgaggccgaaaggcacgatccaagaaatgtgtttacacagttttacattttcaagattgcagtaatcgaaggtaactccgagcgcgccctccaggctatcatcacacttgaaaacatccttacagatgaggagtccgaggacaatgatctggtggcagagcgcgggtcgcctacaatgctacttagcttggctgctcagttcgctctcgaaaatggccagcagattgtggcagaaaaggcgctcgagtacctcgcgcagcactctgaagatcaggaacaggttttaactgctgtgaagtgcttactgcgtttcctcttgcctaagatcgcagagatgcccgagtctgaagacaagaaaaaagagatggaccgactactgacgtgtcttaatcgggcctttgttaagcttagccagccttttggtgaagaggcactgtctcttgagtcccgtgccaatgaggcccagtggttccgaaagactgcatggaatctcgccgtgcagtgtgataaggaccctgtaatgatgcgagaattcttcatcctgagctataagatgtctcaattttgtccatccgaccaggtgatattaatagccaggaaaacttgcctactcatggctgtggccgtggatcttgagcagggacgaaaagcatccaccgcttttgagcagacgatgttcctctcaagggcactcgaggagattcagacatgcaacgatattcacaattttttgaagcaaactgggaccttctccaatgatagctgcgaaaaactactcctcctctacgaatttgaagtgagagccaagttgaacgatcccctcctcgagagcttccttgaatcagtatgggaactgccccacctcgagactaagacatttgaaacaattgccattattgctatggagaagcccgcacactaccccttgatcgctttaaaagccctgaaaaaggcattactgctgtacaagaaagaggagcccatcgacattagtcagtacagtaaatgtatgcataacctggtcaacctgagcgtgcccgatggcgcaagtaacgtagaactgtgcccactagaagaagtctggggatacttcgaggatgccctgtcacacatctctcggaccaaggattatccagagatggagatcctgtggctcatggttaagtcatggaacaccggagtgctgatgttcagtcgttctaagtacgcatccgctgaaaaatggtgcggtttggccctccggtttctcaaccatctgacgtccttcaaagaatcttacgaaacccagatgaacatgttatacagtcaactggtggaagcgctctctaacaataaggggcctgtcttccatgagcatggatactggtccaagtctgactag

SEQ ID NO: 137585 - DNA, 2823 bp, Artificial Sequence
  Description of Artificial Sequence: Synthetic coding sequence
atgatatctgctcattgtaacctccggctgctgtgcagctcggattcttcagcatcagcctcccaggtagctgggaccaccgaggtggtcgaaaacttggttaccaacgataattctccgaatataccagaggctattgataggctgttctccgacatcgctaacattaatcgagaaagtatggccgaaattaccgacatccagattgaggagatggctgttaacttgtggaattgggccctcaccataggcggcggatggttggtcaatgaagagcaaaaaatcaggctccactatgtcgcatgtaagctgctttccatgtgtgaagcctcatttgctagcgagcagagcatccaaaggctgatcatgatgaacatgcggatcggaaaggaatggctagacgcaggaaatttcctcatcgctgacgagtgtttccaggcagcagtggcttctctggaacagctatacgtcaagctgatacagcgctcaagtcccgaggctgacctgactatggaaaaaatcacagtggagagtgaccacttcagggtgctgagctatcaggctgaaagtgcagtcgcccagggcgacttccaacgtgcttctatgtgtgtcctgcagtgtaaggatatgctaatgcgattaccacaaatgacttccagcttacatcatttatgctacaactttggcgtggaaactcagaaaaataataaatatgaagagagttctttctggttaagccagtcatacgatattggcaagatggacaaaaagtccaccggaccagagatgctggccaaggttttgagacttctcgccactaactatctagactgggatgacacaaagtattacgacaaagcccttaacgccgtgaatctggcgaacaaggagcacttgagcagtcccggcctgtttcttaagatgaaaatactacttaagggggagacttctaacgaggagctgctcgaagcagtgatggagattttacatctcgatatgcctctcgacttttgtcttaatattgctaaactgctcatggaccatgaaagagaatctgtggggtttcattttctgacaatcatccatgaaaggtttaagagtagcgagaacatcgggaaggtcttaatccttcacacagatatgctcttgcagcgaaaagaagaactcttggcaaaggagaagattgaagaaatattcctcgcacaccaaactggaagacagttaaccgccgaaagcatgaactggttgcataacatcctctggaggcaggctgccagcagtttcgaggtgcagaattataccgacgcactgcagtggtactattattcactgagattttatagcaccgatgaaatggacctggacttcactaaactgcaaaggaacatggcgtgttgttacctgaacctgcagcagttggacaaagccaaagaggccgttgcagaggccgaacgccatgacccgaggaatgtgttcacacagttctatatttttaagatcgcagtcattgagggcaattctgagcgagcacttcaggcgattatcacattagaaaacatattaacagacgaggaatcagaggacaatgacctagtggccgagaggggcagtcctacaatgttgctcagcttagccgcccaattcgcattggagaacggccagcagatcgtggcagagaaggctctagaatacctggcccagcatagcgaggatcaggaacaggtcctgacagcagtcaagtgtttactgcgattcttacttcctaagattgcggagatgcccgagtctgaggataagaaaaaggagatggaccggctgctgacctgcctgaacagagcctttgtcaagctgagccaaccttttggggaggaggctctatctctggaatctcgcgcgaacgaggcccagtggttccgcaaaaccgcttggaatctcgctgttcaatgcgacaaagatcccgtgatgatgcgcgagtttttcattctgagttataaaatgtcgcaattctgtccctctgaccaagtaatactcatcgcccgcaagacatgcttgttgatggccgtagccgtggacctggaacagggacggaaggcttccactgcctttgagcagacaatgttcttgagtagggctcttgaagagatccagacctgtaacgacatccataattttctgaagcagacaggaacctttagtaacgattcatgtgaaaaactccttctgctctatgaatttgaggtcagagctaagctgaacgatccactgctggaaagctttcttgagtctgtgtgggagctgccccacctagaaaccaaaaccttcgagacaattgcaataatcgccatggagaaacccgcccactacccactgatcgccctcaaggccctgaagaaggctctcctgttatacaaaaaggaggagcctatcgatattagtcagtatagcaagtgcatgcataacctggttaatctcagtgtaccagatggggcctccaacgtggaactctgccccctcgaggaggtgtggggatactttgaagatgccctttcccacataagtaggacaaaagactaccctgagatggaaatcctttggcttatggtcaagagttggaacaccggcgtgctgatgttctcaagatcaaaatatgcctctgcagagaaatggtgtggattagccttacggttccttaatcacctgaccagcttcaaggaatcgtatgagacccagatgaatatgttatatagccagctcgtggaggctctttccaataataagggtcccgtgttccacgagcacgggtattggtcgaaaagtgactag

SEQ ID NO: 137586 - DNA, 372 bp, Artificial Sequence
  Description of Artificial Sequence: Synthetic coding sequence
atgatggcaaatcacttagtcaagcccgacaatcgaaactgcaagcggccgcgcgagctggagagtcccgtgccagattctccacaactgtctagcctggggaagagcgacagctcattttccgaaatctccggcctgttttacaaggacgaggccttagaaaaagacttgaatgatgtctccaaggagattaatctgatgttgtcaacctatgctaagctactatcggagcgtgcggccgtggacgcctcatatatagacgaaatagacgagttgttcaaggaggccaacgctatcgaaaacttcctgatccagaagcgggagtttctgagacaaaggttcaccgtcatcgctaatacactgcatagatag

SEQ ID NO: 137587 - DNA, 372 bp, Artificial Sequence
  Description of Artificial Sequence: Synthetic coding sequence
atgatggctaaccacctcgtcaagcccgataaccgtaactgcaaaaggccgcgtgaactggaaagccctgtaccagacagccctcagctgtcctcacttggaaaatctgattccagcttctccgagatttcaggtcttttttacaaagacgaagcactagaaaaggatctcaacgacgtgtcgaaggaaattaacctgatgcttagcacatatgcaaaactcctgagcgaacgggcggcagtggacgcctcatatattgacgaaatcgatgagctctttaaagaggctaacgccatcgaaaattttttgatccaaaagagggagtttctaaggcagaggtttactgttatcgctaacaccctacaccgatag

SEQ ID NO: 137588 - DNA, 1059 bp, Artificial Sequence
  Description of Artificial Sequence: Synthetic coding sequence
atggccctgaggcctgaggatcccagcagcgggttccggcacagcaatgtggtggcctttatcaacgaaaaaatggcgagacacacaaaggggcctgaattctacctggagaacatctcactctcctgggaaaaagttgaggacaaactgagggcgatattggaggattccgaagtgccaagcgaggtcaaagaggcctgcacatgggggagcctggcgctcggggtaagatttgcccaccgacaggctcagttgcagagacacagggtgcggtggttacacggattcgccaagctccacaaaagtgccgcacaggccctcgcctcagatctgaaaaaactgcgggagcaacaggagaccgagcggaaagaagccgcttcccggctcagaatggcgcagacttctctcgtcgaggtgcagaaggagcgcgacaaggagcttgtcagcccccacgaatgggaacagggtgccggctggccaggcctggctaccgccgggggcgtttgtaccgagggggctgccgaagaggaggaagaagccgccgttgctgctgcaggggctgctggcggtaaaggcgccgaggaggaacagcgcgggtgttggcgtctgtggctgccactgtggagaccttggctaccactgtggcgtttaggcctgcccccctggcgcccatcgagccccacatggcgccccggcctgccgccgtggcggccccagagatcctggagggagtcctcttgctcatccctggagatgctgatcaggaaatctacgcccattggaggaagaagaagggaaatatcaggccgctccaaacagcctcatctcatcagcctggaaccacgaacccccggcccagagccccaccaaaatctatttctctcatctagccttccccacacacatactcatacacaagccctgtttcccccttcacaaacatacccgctctacccactacacaaacagcaaagccagcaccagtttaggctctcatgtctccccaccggacgaccccttattctggcctgcgggctaatggggggccccacagagtag

SEQ ID NO: 137589 - DNA, 1059 bp, Artificial Sequence
  Description of Artificial Sequence: Synthetic coding sequence
atggcacttcgacctgaggacccatcatccggcttcaggcactcgaacgtggtagccttcatcaacgaaaagatggccaggcacacaaaaggccccgagttttatttggaaaacattagcctgtcttgggaaaaggtagaggataaacttagagctatactggaagactcagaggtaccatccgaggtgaaggaggcctgtacatggggtagtctcgcgctcggcgtacgctttgcacaccgtcaggcccaactgcagcgccaccgagttcggtggctccacgggttcgctaaactgcacaagtctgcagcacaagcactcgcaagcgacctcaagaaactcagggagcagcaggagacagagaggaaggaggccgcctcccgcctgagaatggcccagacatcattagtcgaggtccagaaagaaagagataaggagcttgtgtcccctcacgagtgggaacagggagccgggtggccgggactggctaccgcgggcggtgtctgcacagagggcgctgccgaggaggaggaggaggcagccgtagctgccgctggggctgccggcggcaaaggggcagaggaggagcaacgaggatgttggcggttatggttacccctgtggcgaccttggctcccactgtggagattgggcctcccaccttggcggccctctagtcctacctggaggcccggactgcctccatggagacctcagcgtagctggcgggaaagctcctgctcttctctcgagatgctcattcggaaatcaacgccgattggcggccgaagacgcgaaatttccgggagatccaagcagccccatctcatttccctggaacccaggacccccgggccagagcctcatcaaaacttatttctatcgagcagtttgccacacactcacactcatacccaggcgctctttcctccgtcccaaacgtaccccctgtaccctcttcacaaacagcagagccaacaccagttcaggctgtcctgcctgcctacaggtcgcccccttatcttagcctgcggattaatgggggggccaacagaatag

SEQ ID NO: 137590 - DNA, 1230 bp, Artificial Sequence
  Description of Artificial Sequence: Synthetic coding sequence
atggcccttcgccccgaggatccgagttcaggcttcaggcacagcaacgtcgtcgctttcattaatgagaaaatggcacgacacacaaaaggacccgaattctacttggaaaatatctctctcagctgggaaaaagtggaagataagctgcgggccatcctggaagactcagaagtgcccagcgaggtgaaggaggcctgtacatgggggtctctcgcgttgggagtacgcttcgcccacagacaggcccaacttcagaggcacagagttaggtggttacacggcttcgctaagcttcacaagagtgcagctcaggcattagctagcgacctgaagaagttgagggaacagcaggagacagagagaaaagaggctgcctcccggctaagaatggctcagacttccttggttgaggtacaaaaggaacgcgacaaggagctcgtgagtccgcacgagtgggaacagggggctgggtggcccggacttgccaccgcaggcggcgtgtgtacagagggtgcggccgaggaagaagaggaggccgctgtggccgctgctggagctgccggtggtaagggcgcagaggaggagcagagagacgtggaagtggtggccgctcccgttgaggccatggcccctcctgttgaagccggcgcggcccctatggagacccaattccctcacgtggaggcgagggcagcaagtatggagaccacagaaaaacttgagcggatcctacttcagctgcttggtgacgccgatcaggagaagtacacgtactgggggcagaaagaaggggatttgaggtctgtggaaacggctaccagctatttttccgggactaccaatccctggagtcgtgcaagctctgagcccttacccgtccagcttccggctagctatagctacagctactcctcccctttttcatccttttctgatattcctactataagtcccccgcaggccacagtcaccgcacctgtgccgccgcagttgcctagcgattgggaggccttcgatacctctctgtggtcagacggtggcccacaccgcattgaccaccaggaacacccccgggatcgacgttattctgaacctcatcaacagagaccacctgtctatcgtaggcccggggactgggactgtccgtggtgtaatgcggttaatttttccaggagggatacttgcttcgactgcggtaagggaatctggctgcagaaaccacattag

SEQ ID NO: 137591 - DNA, 939 bp, Artificial Sequence
  Description of Artificial Sequence: Synthetic coding sequence
atggctctgagaccagaggacccctctagcggctttaggcacggaaacgtcgtcgccttcattattgagaaaatggccagacatacaaaaggccccgaattttacttcgaaaacataagtctgtcgtgggaggaggtggaggacaaactccgggccatcctggaggattctgaggtgccgtccgaggttaaggaggcatgcacctggggctcgctggccctgggagtgcgtttcgcgcataggcaggggcagctccaaaaccgacgcgtgcaatggctgcaaggattcgcgaaactccatcgtagtgctgcactcgtcctggcttctaacctgactgaacttaaagaacagcaggaaatggagtgtaacgaggccacctttcaactccagcttaccgagacatcgcttgctgaagtgcagcgagagcgtgacatgctacgttggaaattattccatgccgagctagctccacctcaggggcaaggtcaggccacagtgttccccggtctcgctaccgccggtggagattggaccgagggcgcaggcgagcaggagaaagaggcggtcgctgccgccggagctgcaggcgggaaaggcgaggaacgctatgctgaagcaggccccgccccggcagaggtcttgcagggtctagggggcgggtttagacagccccttggggcgatcgtggcaggaaagctacacttgtgtggtgccgaaggagagcgtagccaagtgtctacaaacagccacgtatgtctactgtgggcctgggtgcacagcctgacgggcgctagcagctgtccagccccatatcttatccatattctgatccctatgccttttgttagattgctgtcccacacacagtatacacctttcacctccaagggccaccgcaccggctccaattcagatgccttccaactaggcggactgtag

SEQ ID NO: 137592 - DNA, 4494 bp, Artificial Sequence
  Description of Artificial Sequence: Synthetic coding sequence
atgtcccgcgccgtccgtctgcctgtgccctgcccagttcagctagggacacttcgaaatgactccctcgaggcacaattacacgaatacgttaaacaggggaactacgttaaggtgaaaaagatcctcaagaagggtatttatgtggacgccgtgaacagcctaggtcagaccgctttgttcgtggccgctcttttgggactgcgaaaattcgtcgacgtcctggttgactacggctctgatcctaatcatagatgttttgacggaagcactcccgtgcatgccgctgctttcagcgggaaccagtggattctgtccaagctccttgacgccgggggtgatctcaggctccacgacgagagggggcagaacccaaagacctgggctcttaccgcaggcaaggaaaggtctacccagatcgtagaattcatgcaacgttgtgcttcccacatgcaggcaataatccaaggattttcttacgacctcctgaagaaaatcgacagcccgcaacgccttgtgtattccccaagctggtgtggcggcctggtgcaggggaatccaaatggctctcctaatcggctgctgaaagcaggggtgatctctgcacagaacatctattcatttgggtttggaaaagcgatgccttggtttcaattctatttgacaggggctacacaaatggcctacctgggatccttgcctgtaatcggggagaaggaagtgattcaagccgatgacgaacccaccttttcatttttcagtgggccctacatggtcatgacaaaccttgtgtggaatggctctagagtcaccgtgaaggagttgaatttgcccacccaccctcactgctctcgccttcgactggccgacctattgatagccgagcaggagcactcaagtaaactgcggcacccttacctgctgcagctaatggcagtgtgtctatctcaggacctggaaaaaacaaggctcgtatacgagcggatcaccatcggaactctcttcagcgtcttgcatgagaggcgaagccaattccctgtgctgcatatggaggtgatcgtccatttgctcttgcagataagtgatgctctccggtacctccacttccagggattcatacacagatcgttgtcctcttacgctgtacatatcatcagtcccggtgaggcccgcttgactaacttggagtatatgctcgagtctgaggacagaggggtccagcgcgatctcacacgcgtgcctctgcccacacagctttacaattgggcggctccagaagtgatcctgcagaaggccgctactgttaaaagcgacatctacagtttctccatgattatgcaggaaatcctgacagacgacattccctggaaggggctggacggctccgtggtgaaaaaggcagttgtgtcgggcaattaccttgaggcagatgtccgcttgcctaagccgtattatgacatcgttaaatctggcattcacgtgaaacaaaaagacagaaccatgaatctgcaggatataaggtacattctgaagaacgacctgaaggacttcacgggtgctcagcgcacgcagcctaccgagagcccacgggtccaaaggtatggccttcaccctgatgtgaacgtgtacctggggctcacctccgagcatccacgggaaactccagatatggagatcatcgaacttaaggagatgggcagtcagcctcattcaccaagggtgcacagcctcttcacggaaggaaccctggacccccaggcccctgacccatgtctcatggcacgcgagacccagaaccaagacgccccttgcccagccccattcatggctgaagaggccagctccccctcaacaggtcagccttccctctgtagctttgaaataaacgagatatactctggctgcctgatcctggaggacgacatcgaggagccaccaggtgctgcttcatccttggaagctgacggccccaatcaggttgatgagctgaagtccatggaggaggaactcgacaagatggaacgtgaggcttgttgttttggatctgaagacgagagcagttcaaaggcagagacagaatatagcttcgacgattgggactggcagaatggcagcttgtccagcctttctttgcccgagagcacacgtgaagctaagagcaatttgaataacatgtcaacaaccgaagagtatcttatcagcaaatgcgttctcgatcttaagatcatgcagacaatcatgcacgaaaatgatgataggctccggaatatcgaacagattttagacgaggtcgaaatgaagcagaaggagcaggaggagaggatgagcttatgggctacatccagggaattcacgaatgcctataaactaccactggcagtgggtccaccctcgctcaattatattcccccggtgttgcaactgagcggtggccagaaaccagacaccagcggtaactaccctactctgccccggttcccccgcatgctccctacgttgtgtgaccctggtaaacaaaacactgacgagcagttccagtgtacacagggagctaaggactccctcgagacaagcaggatacagaataccagttctcagggccggcccagggagtcaaccgcccaggccaaggcgacacagtttaatagcgctctcttcaccctcagttctcacagacagggcccttcagctagcccaagttgccactgggattccacccgaatgtcggtcgaaccagtgtccagcgaaatttacaatgccgaaagccggaacaaggacgatgggaaagtgcacctgaaatggaagatggaggtgaaagagatggccaaaaaggcggccactgggcaactgaccgtgcctccctggcatccccagtcgtccctgacactggagagcgaggccgagaacgagcctgatgctctgttgcagcctcccatcagatcgccagagaatacagattggcagcgggttatagaataccacagggagaacgatgaacccaggggaaacggtaagttcgataaaactggcaataacgactgcgacagcgatcagcatgggaggcagcctagactcggatcttttacttccattcggcacccgtctccgcggcaaaaggagcaacctgagcactcagaagcctttcaggcatcttcggacacgctggtcgccgtggagaagtcctatagccatcagagcatgcagtcaacgtgttcaccagagtcctcagaggacatcaccgatgagttcttaacaccagacggagagtacttctacagctctactgctcaggagaacctggctcttgagacatccagtcccatcgaggaagactttgaagggattcagggcgccttcgcacaaccacaagtgagcggagaagagaagttccaaatgcggaaaattttgggtaaaaacgctgagatcctgcctagaagccaatttcagccagtgcggtccacagaagatgagcaggaagaaacatccaaagagtccccaaaagaactgaaagagaaagatatctccctgactgacatccaagacttaagcagtattagttacgagcctgattcttcttttaaagaggcgagttgtaaaacgcccaagattaatcacgcacccacctctgtctccacccccctgtcgccaggcagcgtgtcaagcgcagccagccagtataaagactgtctggagtccataacatttcaagtgaaaactgaattcgcttcctgctggaattctcaggagttcatacagactctgtccgacgattttataagcgttcgagagagagccaaaaaactggacagcctgctaacttctagcgaaacccccccaagtaggttaaccggactcaaaaggctgtcgtctttcatcggtgccgggtcaccatcactggtgaaggcctgcgactcttcaccaccacacgctacacagcggaggagcctcccaaaggtggaggctttttcccagcaccacatcgatgaattgcctccaccttcacaggaactgctggacgacatcgaactgctcaaacagcagcaaggatcctccaccgtgctgcatgagaacactgcatctgatggcggcgggacagccaacgaccagaggcacctggaagaacaggagacagacagtaagaaggaagatagcagcatgctcctttctaaagagactgaggatctcggagaggacaccgagcgggcgcactccaccctggacgaggacctggaacgatggttacaaccccccgaagaaagcgtggagctgcaggacttgccaaagggctctgagcgggaaacgaacatcaaggatcagaaagtgggtgaggaaaaacgcaaaagagaagattctatcacgccggaacggcgcaaaagcgagggggtcttaggcaccagcgaggaggatgagcttaagtcttgcttctggaagcgtctcggttggagcgagagcagtcgtattattgttctggatcaatcagacctatccgactag

SEQ ID NO: 137593 - DNA, 4356 bp, Artificial Sequence
  Description of Artificial Sequence: Synthetic coding sequence
atgtcacgcgcagtccgcctgcctgttccctgcccagtgcagttaggtacactgcgcaacgattcattggaagcgcagttgcacgaatatgtgaaacagggtaattacgtgaaggtgaagaagattctaaaaaaagggatctatgtcgacgccgtcaactcactaggccagactgcgctgtttgtcgccgctcttctgggactgcgtaagttcgttgacgtgctggtggactatggttcagacccaaaccatcggtgttttgatgggagcactcctgtccacgccgctgctttttcaggtaatcaatggattcttagtaagctgctcgatgccggtggtgatcttaggttacatgatgaacggggtcagaaccctaagacttgggccctgactgcaggaaaagaaagatctacacagattgtggaattcatgcagagatgcgcaagtcatatgcaggccattatacaaggctttagttacgatctccttaagaaaattgattcccctcaacgtttggtctacagccccagctggtgcggagggctggtgcaggggaacccaaatgggtccccaaaccgactccttaaggccggagtcatttcagcccagaacatctactcatttggctttggcaagttttacctgactggagccacgcagatggcttacctgggctccttacctgtgatcggcgagaaggaggtgattcaggcagatgatgaacctacgttcagcttcttttccgggccgtatatggtcatgacaaacctagtgtggaacggctctagggttaccgtgaaagagctgaatttacctacccaccctcattgttcccggctcaggttggcagacttacttatagcggaacaggagcacagctcgaagcttagacatccctatctactccagctgatggctgtctgtctgtctcaggacctggagaaaacaagactagtctatgagaggattacaataggaaccttattcagcgtgctgcatgagcgaagaagtcaattcccagtcttgcatatggaggttatcgttcacctcctgctccagatcagtgacgctctcagatacctgcactttcaagggttcatacaccggtcgctgagctcttatgccgtgcacatcatttctcccggagaagctcgcctgacaaatcttgaatatatgttagagtctgaagatcgcggtgttcagcgggacctcactagagtaccgttacccactcagctttacaattgggcggcccccgaggtcatcctccagaaggccgctaccgtgaagtctgacatatactccttcagtatgatcatgcaggaaatccttactgatgacattccttggaaaggacttgatggctccgttgtcaaaaaggctgttgtttccggaaattatcttgaggccgacgtgagactgccaaagccttactatgatatagttaaatctggaatacatgtgaagcagaaagataggaccatgaacctacaagacattcgctacatactgaaaaacgatctcaaggactttacgggagcacagaggactcagccgaccgagagcccacgagtgcagcgatacggcctgcatcccgatgtcaacgtgtacctggggctgacaagcgagcaccccagggaaacacccgacatggagatcattgagttgaaggaaatgggttcacaaccacactctccgcgcgtgcattctttgtttaccgagggcacccttgacccgcaggctcccgacccatgcctcatggccagggaaactcaaaaccaggatgcaccatgtcccgcacctttcatggctgaggaggctagtagtccctctaccggtcaaccttctttgtgttcattcgagatcaatgagatctacagcggctgcctcattctcgaggacgacatcgaagagccgcccggggcagcgtcatcgttggaagcagatggtccaaaccaggttgacgaattgaaaagtatggaagaggagctcgataaaatggaaagggaagcatgctgttttgggagcgaggatgaatcttcgagtaaggccgagactgaatatagctttgatgattgggattggcagaatggaagcctatccagcttatctctgccagagagcaccagagaggccaagagcaacctgaacaacatgtccactacggaggagtatctgatttccaaatgtgtgcttgacctgaaaattatgcaaactatcatgcacgagaacgacgaccggctacgaaacattgaacaaattcttgatgaggttgagatgaagcagaaagagcaagaggaacgcatgagcctgtgggctacatctcgcgagttcaccaatgcgtataagcttccactagcagtgggtccaccgtcactgaattacattccaccagtgctgcagctgtcaggagggcagaaaccagatacgtcgggaaattatccgacccttccaaggttcccccgcatgctcccgacgctttgcgatccaggtaagcaaaacacagatgagcagttccagtgtacccagggggcgaaggacagcttagagaccagcaggatacaaaacacctcttctcagggccgaccacgagagtctaccgcgcaggcgaaagcaacccagttcaatagcgcccttttcactcttagttctcataggcaggggcccagcgcctcaccctcctgtcattgggacagtacccgcatgtctgtggaaccagtgtcctccgaaatctacaacgcggagtctcggaataaggatgatggaaaagtgcatctcaagtggaagatggaggtgaaagagatggcaaaaaaggcggcaactggccagcttacagtgcccccttggcacccccagtcttcactcacgctggaatccgaggcggagaacgagccggacgctctgttacaacccccgatcaggtcccccgagaacaccgattggcagagggtgatcgaataccatagagaaaacgacgagccgaggggaaatggaaagttcgacaagacggggaataatgattgcgactccgaccaacacggacgtcagccacgcctgggctccttcacaagtatacggcacccctcacctagacagaaggaacaacctgagcattctgaagccttccaggcatccagcgatacactcgtcgccgtcgagaaaagttattccacctcctcccctatcgaggaggatttcgaagggatccagggcgctttcgcccaaccgcaagttagtggagaagagaagttccagatgaggaagatccttggcaagaacgccgagattctacctcggtctcagtttcaacccgtgcggtccaccgaggatgagcaggaggaaacaagcaaagagtcgcccaaagagctaaaggaaaaggatatatcactcaccgacattcaagatctgagctcaatcagttacgaacccgactccagctttaaagaggcctcttgtaagaccccaaaaataaaccacgcaccaacctcagtgtccacacctctatcccccggcagtgtttcatcagccgcaagtcaatataaggactgcctggaaagcattacatttcaggtgaagacggagttcgcaagttgctggaatagccaggaattcatccagactctgtctgatgacttcattagcgtacgtgaaagggccaagaagctagacagtctcctcacaagtagcgaaacccccccttcgcggctgaccggcctaaagcgcttatcctccttcattggagccgggtctccttccttagtcaaggcctgtgactcatccccaccccacgccacccagcgacgctcattacccaaagttgaggcattttcacagcaccatattgatgaattgcccccaccgtcccaggaactgttggacgatatagaactgctgaagcagcagcaagggtcaagtactgtgctgcacgaaaacactgcctcagacggggggggcaccgccaatgaccagcggcatctggaggagcaagaaacagattcaaagaaagaagatagctcaatgctattgagtaaggagaccgaagacctgggagaagatacggaaagggcccactctactctagacgaggatcttgagcgctggctgcagccacctgaggagtctgtcgaacttcaagatctgcctaaaggctctgaaagggaaactaatatcaaagaccagaaagtgggggaagaaaaacgcaagcgcgaggactctatcactcccgagagacgcaaatccgaaggagtgctggggacaagcgaggaggatgagctgaagagctgtttctggaaaagactggggtggagcgagtcatccaggatcattgtccttgaccaatcagacctgagcgactag

SEQ ID NO: 137594 - DNA, 4476 bp, Artificial Sequence
  Description of Artificial Sequence: Synthetic coding sequence
atgtctcgcgctgttcgcctcccagtcccatgtccagtccagctgggcaccctcaggaatgacagtctagaggcccaactacatgagtacgtgaagcaaggcaactatgtgaaagtgaagaaaatcttaaagaagggcatctatgttgacgctgtgaactccctgggacagacggcccttttcgtggccgctttgctggggctgaggaaattcgtcgacgtgctagtggactatgggtctgatcctaaccaccgctgctttgacggttccactcctgtccatgcggcagctttctcaggaaaccagtggatactctctaaactgttggacgctgggggggacctcaggctgcacgatgagagaggccaaaatcccaagacatgggcgctgacagcaggcaaagagaggtctacgcaaattgtcgagttcatgcaaaggtgtgcatcccacatgcaggccatcattcagggattttcctatgatctgctgaagaagattgatagtcctcaacggcttgtgtactcaccttcatggtgcggtggactcgtccagggcaatccaaatggttccccgaatcgcctgcttaaggcaggtgtgattagcgcccagaacatttattctttcggattcggtaaattctatctgacaggcgcgactcagatggcctacctcggttccctgccagtgattggagagaaggaagttattcaggctgatgacgaacccaccttctcttttttttcaggaccctacatggtgatgactaatctggtgtggaacggcagccgggtgacggtgaaggagctcaacttaccaacccatccccactgctcaagactgcggttagcagaccttttgattgctgaacaagagcacagcagcaaattaagacacccatacctgttacaactgatggccgtctgtctgtctcaggacctcgaaaagacgcgcctggtttacgagaggattaccatcggtactctgttctctgtgttgcacgagcggagaagccagttccctgttctacatatggaggtcatagttcatctacttttgcaaatttcagacgcccttcgttatctccatttccagggctttatacaccgctccctcagttcatatgcagtgcacataatttcacctggcgaggcccgtttaacgaacctggaatatatgctggagtcagaagaccggggcgtccaaagggacctgaccagagtgccactgccgacacagctgtacaattgggccgccccagaagtgattctgcagaaagcggcgactgtgaaaagcgacatttacagcttctccatgattatgcaagagatactgaccgatgacatcccttggaaaggcctggacggatccgtggtcaagaaagccgttgtatctggcaactatctagaagccgacgtgcgcctgccaaagccttattatgacattgtcaagagtggaatccatgtgaaacagaaggatagaacaatgaacctccaggacatccggtacatactgaagaacgatttgaaggacttcactggagcccagaggacgcagccaacggaaagccctagagttcaacgatacggcttgcaccctgatgtgaatgtgtacctcgggctgaccagcgagcaccctcgcgaaacaccagacatggaaatcatcgagctgaaagagatgggcagtcagccccatagcccaagggtgcacagcctattcacagaggggactctcgacccacaagcacctgatccctgcctcatggcccgggagacacagaaccaggatgccccttgcccagcaccatttatggccgaagaagcttctagtccaagcaccgggcagccttcactttgctcattcgagataaacgagatttatagcggatgcctgattctcgaggacgacattgaagagcccccaggcgcagcaagttccctggaagccgatggacctaaccaggtggatgaacttaagagcatggaggaagagttggacaagatggagcgagaggcttgttgcttcggctccgaagatgaatcctcctccaaggccgagaccgagtatagctttgatgattgggactggcagaacgggagccttagctcccttagcctcccagaatcaactagggaggcaaaatctaatctgaacaacatgagcacaacagaggaatacctgatcagtaaatgcgttctggaccttaaaataatgcagaccatcatgcacgagaatgatgaccgactgaggaatatcgagcagatccttgacgaagtcgagatgaaacagaaggagcaggaagagagaatgtctctgtgggccacaagccgggagttcacaaatgcgtataagctgcccctggcagttggacccccatcccttaactacatcccacctgttctgcagctatcaggcgggcagaaaccggatacgtcggggaattacccaacattaccgcgtttcccacggatgttgccgactctgtgtgaccccggaaaacaaaacaccgatgagcagtttcagtgcacacagggagctaaggactcacttgagacgtccaggattcagaacacaagctcacaggggcggcccagggaatccaccgcccaagcaaaggccacccaatttaacagcgccctattcacactaagtagccaccggcagggcccctccgcctccccgagttgccattgggactcaactaggatgtcagttgaaccggtgagcagcgagatctataatgcggaatctagaaataaagatgatggaaaggtacatttgaaatggaagatggaggtgaaggaaatggctaagaaggcggccactggccagcttacagtgccgccttggcatcctcagtcctccctaacactcgagagcgaggccgagaacgagcccgacgccctgctgcagcctccgatcaggagccccgagaacactgattggcagagagtcattgagtatcacagggagaatgacgaacctaggggaaatggcaaattcgataaaactggcaataacgactgcgattctgaccagcacggcagacagcctaggctcggctctttcacttctataagacacccatccccaagacagaaggaacagcccgaacacagtgaagctttccaggctagcagtgataccttagtagccgttgaaaaatcatattcccatcagtctatgcagagcacatgtagccctgagtccagcgaagatattacagacgagtttcttacacctgatggggaatacttttattcaagcacggcccaggaaaatctcgctctagagaccagttccccaatcgaggaagactttgagggaatccagggagctttcgcacagcctcaggttagcggggaggaaaagttccagatgcgtaagattttaggtaagaatgcggaaatcctgcctcgttctcagtttcagcccgtgcgctccaccgaggacgaacaagaggagacaagcaaggagtcccccaaagaactgaaagagaaggacatttcactgacagacattcaggacctgagctctatttcctatgagcccgacagttcttttaaagaggcatcctgtaagactcccaaaatcaatcatgccccgacctctgtgtcaactccccttagcccgggtagtgtaagtagcgccgcgtcacaatataaggattgtctggaatctattacttttcaggtgaagacagagttcgctagttgctggaactcgcaagaattcatccagaccctgagcgatgatttcatcagtgtgcgggagagagcaaagaaactggactcgctgctcacctcctctgagacccctccttcaaggctgaccggtttaaagagactgtcctccttcatcggagccgggagtccatccctggtgaaggcttgtgatagctctccaccccacgccacccaaagaagaagtctgcctaaggtggaagccttctctcagcatcacattgatgagctgcccccaccctcccaagagttgcttgatgatattgagcttctaaagcaacagcagggaagctctaccgtgcttcacgaaaacactgcatcagacggcggaggtacagccaacgaccaacgtcacttggaggaacaggaaaccgacagcaaaaaagaagactcttccatgttgctctctaaggaaaccgaggacctcggggaagatacagagagggcacactcgacattagacgaggacttagagcgctggctgcagcctcccgaggagagcgtggaattgcaggatcttcccaaaggctcagagagggagacaaacatcaaggaccagaaagtaggcgaggagaaacggaaacgggaagattccatcacacccgagcgccggaagtccgagggagtgctcggcacaagcgaggaggacgagcttaaatcatgtttttggaaacgcttgggttggtccgagtccagcaggattatcgtgctggaccaaagtgatctctccgattag

SEQ ID NO: 137595 - DNA, 8370 bp, Artificial Sequence
  Description of Artificial Sequence: Synthetic coding sequence
atgccatccgacgccaaagattcagttaacggtgatctgctcctgaattggacaagtctgaagaatatcctctctgggctcaatgccagtttccctcttcacaacaacactggttccagtaccgtcactactagcaagtctatcaaagacccacggctgatgaggcgggaggagtccatgggggaacagagcagcaccgctggacttaatgaggttctgcagttcgagaaatccagcgacaatgttaactctgagattaaaagtacaccctctaattcagcctcttcctccgaggttgtgccgggagattgcgctgtgcttaccaacggtctggatactccttgtttcaagacatctgttaacgatagccaaagctgggcgcataatatgggctcagaagactatgactgtatacccccaaacaaggtcacaatggccggccagtgcaaagaccagggcaattttagttttcctatcagtgtgtcaaatgtggtttcagaggtggaaaatcagaaccacagcgaggaaaaagctcaaagggcacagcaagagtcagggaacgcatacaccaaggaatattcaagccacattttccaggattcgcaatcatcagacttgaagacgatctaccaaactggatgtcagacaagtacagtctttcctttgaagaagaaagtgtccatagacgagtacctgcagaatactggaaaaatgaagaactttgcagatctcgaggatagttccaagcacgaagaaaaacaaaccagttggaaagagatcgataatgactttactaatgaaactaaaatcagtcctatcgacaattatatcgttttgcaccaggaatacaaagagtccgagtcacataactcttttggaaaatcttgcgataagatcctaatcactcaagaactggaaatcaccaaaagttcaacttccaccattaaggataaggatgaacttgaccacctagccctggaatggcagatcaccccatccttcgagtctctctcccagaagcacccacaacactccgtggagtatgagggtaacattcatacctcattagccattgcccaaaagctcatggaactaaagctgggcaagatcaaccagaactacgcgtcaatcatcacagaagcatttccgaaacccaaggacataccacaggccaaggagatgttcattgacactgtgatttcatcttacaacatcgaaaccgcccacgatagtagtaactgctcgataactcgggagcacatttgcgtgcaccggaaaaacgaaaacgagcctgtgtcattggagaatatccaacgggattacaaggagacggcttacgtagaggatcggggccaggaccataatcttttttgcaactcccagctcagcaatgacatctggctgaacgtgaacttcaagaaacagaccgaccgggagaaccaaaacgaggccaaggaaaattctgccagctgcgttgaaaataacatcgagaacatttacggagataaaaagcaggatagtcataccaacgagaatttctctaacatcgacgaaaaagaggataaaaactaccacaatattgagattctgtcatccgaggaattcagcacaaagtttaatctgatctgccgtgaggacaacgctgtgtcagccgcaacagcgctgcttgagtctgaggaagacactatctcagctgtgaagcagaaagacaccgaaaacacaggccgaagcgttgagcatctcgctagcacgacatttccaaagactgcaagtagctctgtctgtgtagcctccaatgcggctatacagattgcaagcgctacgatgcccgcattatctcttaataacgacgaccatcagatataccaattcaaggagacatgttcgagcgagtctcccgactttggcctccttgtcaaacatcgcgtatcagactgtgaaattgataccgataaaaataaaagccaagaatcctttcaccagagtatcaacgagaacctcgtcctccagtccattgaactcgagtcagagatcgagattgaacttgaggattgtgatgacgccttcattttccagcaggatacccattcccatgagaatatgctctgcgaggaattcgtgaccagctataaggccctgaagtcccgaatttcctgggaaggtcttcttgctctggacaacggcgagatggaagttctagagtctactacagggagagaaaattcagaccagcattattcaaaagaatccaattacttctatagtagcacccagaacaacgagaccgaacttacttcaccgatcctgcttccagacctgcagatcaaaataaccaatatcttccgtcctgggttcagcccaaccgccgattccctcgccctgaaggattccttttgtacacatgtgacggaggcgacgaagccggagatcaataaggaagacggggagatactgggattcgatatttactcacagccctttggtgagaacgcggattacccctgcgaagataaggtggataacatccgccaggagtctgggccagtgagcaatagcgaaatctccctgagctttgatctgtccagaaataccgatgtcaaccacactagtgagaatcaaaattccgagagtctgttcacggaaccgtcgaacgtgaccaccatagacgacggttcgagatgctttttcaccaaatcaaagactgactacaacgatacgaagaataaaaaggaggttgagagcaggatatctaaaaggaagctccatatctccagtcgggaccagaatattccacacaaggacctcagaagacacaagatatacggcaggaaaagaaggctgacatctcaggacagcagtgagtgttttagcagtctgtctcagggtaggattaagacttttagccaaagcgagaaacacataaagagcgtgcttaatatcctgagcgatgaggccagcctgtgcaagtctaagtgcttgtccagaaagctggataaagctgtcgtgcatctcaagaaggcccaccgaagagtacataccagtctccagctgattacgaaagtgggtgaagaaagaaagggccccttacctaagtcatacgcaattatttgcaacaacttctgggaatcatgtgatctgcaggggtattcaagcgtctctcagcggaagtattactccactaagcatttctcttctaaacgcaaatacgacaaaaggcggaagaagcgcgcacccaaggccgatatcagtaagagtctgacacacgtgtcaaaacacaaatcgtacaagacttccggtgagaaaaaatgtctgagtcggaagtctatggctagcagtgtgagcaagagccacccaacgacctcgcacatgggggagttctgcaatcaagaacacccagaaagccagcttcccgtttcttcgacctctcagtctactagccaatcagtttattacaatagttccgtgagtaacccctccctatctgaagaacatcagccgttctcgggcaagacggcttaccttttttcccctgatcattctgacgagaaactgattgagaaagaaaaccagatcgacacagccttcctgtcatcgacgtccaagtatgagaaactcgaaaaacatagtgctaaccacaatgttaaggatgctactaaggagaactcgtgtgatgcaaatgaggtgattaatgagtccaattcagtgtccctctcttgtatcaaggaaaacatcaacagtagcacgggcaatgactgcgatgccacatgcatcgggcacacaaaagccaagaccgatgtactgatctctgtgcttgacagtaatgtcaaacattttctcaatgatttataccagcagggcaacctgatcttgtccgactgcaagcgcaatctggaggtgaaatggactgaccctatagaacgacccaagcaaaacattatcacgggcaattttcttatggggcccctgaacctcactttaatcgcatccaagaaatacagcatcccacaactgtccgctgcagctgtcacagattcagaaggggagagctcaaaaagctatttagataagcagagaattctgacagtggatagctttgcagccagctcaaccgtccctcactgtgagcagtcgtgtcgcgagaaggagctcctgaaaacggaacagtgtagcagcgggaattgcttgcatacggacggtaatgagacgaacgtaacagagaactacgagttggacgtggcttccggtacggaagaggataagtcctatggggaaaatatagtcgaattgtccagctccgactcatccctcctgctgaaagataacgtaaaggggtccagctcagaaacctgtatcgtaaagaaagatactgaagacagaattacttggaaagtcaaacaggctgaaaaggccaaggattccgtgtacaagaggtccatgactgaggggagcactgtgaatacagagtacaaaaatcagaagaaccagatcagtgaagaaagctgcttgaacgagaagattattaccacgaacctgatagattctcatctcagtacaaagaatacaaccaccgagtccgtgccactgaagaacaccgtctctaaccccctgaataagcgcgaaaagaagggggagatcaaagtgagcaaggattctcagagcgacctgacacttcattcagagattgcttacattagcaagccggggattctgggcgtgaatcatacccccatactgcctgcccactccgaaacctgtaaggttccaactctgctcaaaaagccagctagttacgtaagtgatttcaaggaaaaacactgcagcgccaaccacaccgccctgatcgctaacctgtctcagatccttcagcgagccgacgaggcctcttccctacagattctacaggaggagactaaggtgtgcctaaatatacttccactctttgtggaagctttcgagcgtaaacaggagtgtagcgtagagcagatcttgatttcacgcgaactgctcgtggaccagaatctttggaacaactgtaaacatactctgaagccttgcgcggtcgacaccttggtcgagctacagatgatgatggagacaatccaattcatagaaaataaaaagcggcatctcgaaggcgagcccaccttacgctcactgctgtggtacgacgagaccctatatgcagagctgctggggaaacctagggggttccagcaacaatcaaacttttaccccgggtttcagggtagactgaaatataatgcgttttgtgaactacaaacatatcacgatcagctggtcgaactgctggaggaaactaagcgggagaagaatagctactatgtgttccttaaatataaacggcaggtaaatgagtgcgaggccattatggagcactgctctgactgcttcgatttttccctgtctgtccccttcacttgcggggtgaactttggtgatagcctggaggatctggagattctgcggaaatctaccctcaagctgattaacgtctgtggcgactcacccaaggtccatagctaccctggcaaacaggatcatctgtggataatcattgagatgatttccagcaaggttaactttataaagaacaacgaggccgtgcgggtgaagatttctctctatggactggaacacatattcttcgatgccgccaagaacctcgtttggaaagaacggacgcaatcatttagtaaaaagtactcacagaaaaaggacgaagagcggcttctcagagtgaacaagtgtgctttctctaagcttcagaagatctacgataccctcagcaaagatctcaataatgaacccatttctcctattggactagaggaggacacgattatagcttctcggaagagcgaccacccaattaacgaagcaacaatcagcatagaaaactcgaaattcaatagcaacttgcttgcccatcctgacatatgttgtatctcagagatactcgaccaggcggagttcgctgatctgaaaaagctccaggacctgactttgagatgtaccgaccatctggagatactcaaaaaatactttcagatgctccaagataacaacatggataatatattcatcacggaggagaacgtgctcgacgttgtgattaaccactcccacgaggctattattctcaaacctgaagcaatcgagatgtacattgagatagtcatggtctccgaaaccattcatttcctgaaaaattcaattgcgaagaagctggataaacagaggttcaggggcatgctctggtttgatctctctctgcttcctgaactcgttcaatgtcaggagaagatggcatcctttagtttcctcaaagacaactcaacagacgtgtgtctgtggaaggttattgaaaccgccgtgtcagagctgaagaaagacttagacattatttgcaaatataacgaagctgtgaactgttcctacgctatccatctgctctccagggagttacaggaactgagcgagatcaagaaacttctcaagaagtctaagtactttatttcaacctacatagacttcgtcccatacatcgcttcaattaactatggctcaacggtcacagagctagagtacaactacaaccagttcagtactctgcttaaaaacgtcatgtctgctcctaggaaggatctcggcaagatggctcacatccggaaggttatgaaaacaatcgaacatatgaaaatgatctgcacaaagaatgccgaactaacaatctctttctttttgtgccagatgctatataataggagaaagatacttcagctgaagaggaaagaaaaaatgaatatccacatcgttaagccaggagagaacaataataagttttcaattagcactatgctaccacccgtgagtgagtgcatcaataagaatatctccaactcctccaagaagagaccatccacggttgacaagtgcgaggactcccaggagcagcaacaggatactacagtgtcctcctgtaaaaaacttaaagtggatatgaaggatgttacaaagataaatcgtgaaaaggccactttcaagcaccctagaacaaccggttcacatcccaagtccgaaaataagatcgtgcctagtagttgcgactcattaaagagaaatcacctaacccccaaaaaggtcgagatgcaacggtctctccccggctctctattgccacttgagaatccgaaggatacgtgcgcctccaagtcagagagcaaaattgacttgaccgtgtcaagcgaccacttctccggtcagcaggagaatttaaattccatgaagaaacgtaacgtgaatttctcggccgctgaaactaagtctgacaaaaaggattgtgcagcatttgccatctgtgatcagaagagcgtgcatggcaccttcagccccgaccacggcaccctgttacagaagtttcttaaaaactcccccgatcctacacaaaagtcatgcctctctgacataaaccccgaaaccgacgtttcactggttcctgatgcaagtgtgctgagtaaaccaatcttctgctttgttaaggacgtacatccagacctcgagatgaacgacacagtgttcgagcttcaggacaatgatatagttaattcctccattaagaactcgtcgtgtatgacatctccggagcccatttgcattcagaataaaatccctactctccagatcaataaactgcagccaacagaaacggagtctgaggacaagtacatgaaagatacactgaatcctaataccgttcacacgtttggcgcctccggacatataaccctcaatgttaaccagggcgctgagtactcgctgagcgaacagcaaaatgacaaaaactcaaaggtcctaatgcagaacgccgccacctattggaatgaattgccacagagtgcatgcaatccgacatataactcgagcgaacatttatttggaacctcctatccctattccgcttggtgcgtctatcagtacagcaattctaatggcaacgcaatcacccagacctaccagggcatcacgtcatacgaggtgcagccgagcccttctggactgctcaccacggtcgccagcactgcccagggcacccattctaacctgctctactcacagtatttcacttattttgccggcgagccccaggccaatggctttgtccctgtgaacggatactttcaaagccagattcctgccagtaatttcagacaaccaatcttttcacagtatgcgagtcatcagccattgccacaggcaacctatccctacctaccaaacaggttcgtgcctccggaggtcccttgggtctacgccccatggcatcaggagtcgtttcatcctggccactag

SEQ ID NO: 137596 - DNA, 1233 bp, Artificial Sequence
  Description of Artificial Sequence: Synthetic coding sequence
atggtgctcaaagctgaacatacacggtccccctccgccaccctgcctagcaatgttccctcatgccggtcactgagcagtagtgaagacggccccagtggcccaagtagcctcgccgacggcggtctcgcacataacctgcaggactctgtgagacatagaatcctgtacttgtctgagcaactgcgcgtggaaaaggctagtagagacggcaacaccgtgtcttatcttaaactagtgagtaaggccgatcgccatcaagtccctcatattcaacaagcttttgagaaggtcaaccagcgggctagtgctactatagcacagattgagcaccgcctgcatcaatgccaccagcagcttcaggagttagaggagggctgtcgtccagagggactgttgctgatggctgagagcgaccctgctaactgcgagccaccgtccgagaaagccctgctgagtgaaccccctgaaccaggaggggaagacggcccagtgaacctgcctcacgcctcgaggccttttatactggagtctcgatttcagtccctgcaacagggcacctgcctggagactgaagacgttgcacagcagcagaacctgttgctccagaaggtgaaggccgagctggaggaggcaaaacgctttcatatctctttgcaggagtcctaccactctttaaaggaaaggtcccttaccgatttgcagctattactggaaagcctgcaagaggagaaatgcaggcaagccttaatggaagaacaggtgaacgggcgcctccagggccagctgaacgagatttacaacctcaagcacaatctcgcctgcagcgaggagcgtatggcctatctgagctatgagcgagctaaggaaatttgggagattaccgaaacattcaagagccgcatctctaagttggagatgctccagcaagtgacgcagctggaggcggccgaacacttgcagagccggcctccgcagatgttgtttaaatttctttcaccaagattgtctctggcaacggtgttactggtgtttgtcagtacactttgcgcttgccccagttccttgataagcagtcggctttgcacttgtactatgctgatgctcattggcctgggcgttctcgcctggcagaggtggcgagccatcccagctacggattggcaagaatgggtgccatcccgatgccgattgtattctaaggactcgggcccacccgcggacgggccctag

SEQ ID NO: 137597 - DNA, 1233 bp, Artificial Sequence
  Description of Artificial Sequence: Synthetic coding sequence
atggtgttgaaggccgaacacacccggagtcctagtgcaaccttacccagcaacgtccctagctgtcggtcgttgtcctcctcagaggacgggccaagtgggccctcttccctggctgacggggggctggcacataatttgcaggactctgtgcggcataggatcctctatctctccgaacagctccgggtcgaaaaggcaagtcgggatggcaatacagtgtcttatctgaaactggtctctaaagcagatcggcatcaggttcctcacatccagcaggcctttgaaaaggtcaaccagcgcgccagtgcaactatcgcccaaatagagcaccggctccaccagtgtcaccaacaattgcaggaactggaagaaggctgccggcctgaaggcctgttgttgatggctgagagcgatcccgcgaattgcgagccccccagcgagaaggcattattgagtgaaccgcccgagccgggaggcgaggacgggccagtgaacctaccgcatgcctctagaccctttatcctggaatcccggttccaaagcttgcagcaaggaacctgcctcgaaactgaagatgtggcacagcagcagaatttgctgctccagaaagtgaaagcggaactcgaggaggctaagcggttccacatcagcctccaggagagctatcacagcctcaaggagaggagcctcacagacctgcagcttttgctggagagcctgcaagaggaaaagtgcagacaggcgctgatggaagagcaggtcaatggcaggctgcagggccagctgaacgagatctacaacctgaagcacaacttggcctgctcagaagagcgtatggcctacctgtcctatgaacgggctaaggagatctgggagatcactgaaacttttaagtctcgaatcagcaaactggagatgctccagcaggtaacgcagctggaggccgcagagcacctgcaatcacgcccgcctcagatgctgttcaagtttcttagcccgcgcttatctctggccaccgtactcttggtgttcgtttccacactctgcgcgtgtccctcctctctgatttcatcccgtctgtgtacgtgtaccatgctaatgcttattggcttgggagttctggcatggcagcgctggcgcgcaattccggcgaccgactggcaggagtgggtaccgtcccgatgtaggctgtacagcaaagattctgggccccccgctgatggtccctag

SEQ ID NO: 137598 - DNA, 945 bp, Artificial Sequence
  Description of Artificial Sequence: Synthetic coding sequence
atgcgtccggaagggtctctcacctatcgcgtgcctgagaggctgcgtcagggcttttgcggagtaggaagggcggcccaggcattggtttgtgcctccgcaaaggagggcactgcttttcggatggaggccgtccaggagggtgccgctggggtggaaagtgaacaggccgccctaggggaggaggccgttctgctcctcgatgatatcatggccgaggtcgaggtggtggcagaagtcgaagtggtggcagaggaagaaggtctggtagaacggcgggaggaagcacaacgggctcagcaggcagttcccgggcctgggcctatgactcctgagtcggccccagaagaactgcttgccgtgcaggtcgaactcgagcccgtgaatgcccaagcccggaaagctttttctaggcagcgcgagaagatggaacggcgacgtaagccccatttggacaggcggggagcggtgatacagagcgtcccaggattctgggctaatgtcatcgcaaaccatccgcagatgagcgcccttattaccgacgaggacgaggatatgctttcctatatggtgtcactggaggtgggagaagagaagcaccctgtgcacttgtgcaagatcatgctttttttcagatcgaacccttattttcagaacaaagtaattacaaaggaatacctggtgaacattactgagtatcgtgcaagtcattccacaccaatcgagtggtatcctgactatgaagtggaagcataccggcggagacatcataattccagtcttaatttctttaattggttcagtgaccataatttcgctggaagcaacaagattgccgaaatcctgtgcaaggacttgtggaggaacccgttgcaatactacaagcgcatgaaaccaccggaagagggaacagagacgtctggcgattcacagcttttatcatag

SEQ ID NO: 137599 - DNA, 927 bp, Artificial Sequence
  Description of Artificial Sequence: Synthetic coding sequence
atgcgcccggaggggtctctcacgtatcgggtgcctgagcgcctccggcagggcttctgcggagtgggacgtgccgcgcaagctttagtatgcgcctctgctaaagagggcacagccttccggatggaagccgtccaggaaggagccgctggcgtggaatccgaacaggcagcgttaggcgaggaggctgtcctcctgctggacgacattatggccgaggtggaagtagtagctgaagaggagggtcttgtcgaaagaagagaggaagcacagcgggcgcagcaagccgtgcccggcccgggccccatgacccccgagtcggctcccgaagagcttctggctgtgcaggttgagctggaacccgtaaatgctcaggctaggaaggcttttagccgtcaaagagagaagatggagcggcgccgaaaacctcatctcgatcgccggggggcagtgattcagagtgtcccgggcttttgggccaacgtcattgccaaccatccacagatgtcagctttaatcactgatgaggacgaggacatgctgtcttatatggtaagtctagaggtgggggaggaaaagcatcctgtacacttgtgcaagattatgctgttcttcagatcaaacccttatttccagaacaaggtgattacgaaagaatacctcgtaaatataactgagtatagagcttctcactcaacccctatagaatggtacccggactacgaagtggaagcctacagaagaagacaccataactcaagcctcaattttttcaattggttttcggatcacaacttcgccggctccaacaaaatcgctgaaattctgtgcaaggacttgtggcgcaacccccttcagtactacaaacgcatgaagcctcccgaggaaggaaccgaaacctcgggcgatagtcagctgctgtcttag

SEQ ID NO: 137600 - DNA, 2097 bp, Artificial Sequence
  Description of Artificial Sequence: Synthetic coding sequence
atgatgcgctctcgctccaaaagccctagacgcccatcgcctaccgcccggggtgccaactgtgacgtagagctcctcaaaacaactactcgcgacagggaagaactgaaatgcatgctcgaaaaatacgaacgccatcttgctgaaattcagggcaatgttaaggtgctgaagagtgagcgggacaagatctttttgctctatgagcaggcgcaggaagaaatcacgcgtctgaggcgtgaaatgatgaaaagctgcaagtctcccaaaagtactactgcccacgccatactccgccgcgtggagacagaaagggatgtggcttttacagacctgcgccggatgacaacagaacgagacagcctgcgggagcgcctgaaaattgcccaggaaaccgcctttaacgaaaaagctcacctcgagcagcgcatcgaggagctcgaatgtacagttcataacctcgacgacgagaggatggaacaaatgtctaatatgactctcatgaaggaaaccatatccacagttgagaaagagatgaagtcattagctcgaaaagccatggatactgagtccgaactggggcgacagaaggccgaaaataacagcctgaggcttctgtacgagaacacagagaaagacctgtcggacacccagaggcatctggctaagaagaagtatgagcttcagctgacccaggagaaaattatgtgccttgatgagaaaattgacaattttactcggcagaacatagcgcaacgcgaagagatctctatccttggggggacattgaatgacctcgccaaggagaaggaatgtcttcaggcctgcctcgacaagaagtctgaaaacattgccagtctgggcgagagtcttgctatgaaagaaaaaaccatttctggcatgaagaacatcattgccgagatggaacaggcttcacgacagtgtactgaagccctcatcgtgtgcgagcaggatgtgtctcgaatgcgccgacaactcgatgagacgaacgacgaactggcacagatagccagagagcgggatatcctggcacatgacaacgataacctccaggagcagtttgccaaggccaagcaggagaatcaggccctgagcaaaaagctgaacgatacacacaacgaattgaacgacattaagcagaaggttcaggataccaatctggaagtgaacaaactcaaaaatatcctgaagagcgaagagtcagagaacagacagatgatggagcagcttcggaaagccaacgaggatgccgaaaactgggaaaacaaagcacggcagtctgaagccgacaataacaccctcaaacttgagctgataactgccgaagctgaaggtaaccgcttaaaggagaaagtggacagcctcaatcgcgaagtcgaacagcatctgaatgctgagagatcatataaaagtcagatctcgacactgcacaaatccgtggtcaagatggaggaagagttgcagaaagtgcagtttgagaaggtgtctgcacttgcggatctgtcttcgacccgggagctctgtatcaagttggactctagcaaggagctgctgaataggcaactcgttgcaaaggaccaggagatcgagatgcgagaaaacgaactggattctgcccactccgaaattgaactactgagaagtcagatggctaacgagcgcatttctatgcagaacctggaggctctgttggtggctaaccgggataaagaatatcagtctcagattgccctgcaggagaaagagagtgaaatccagctgctgaaagagcatctgtgtttagcagagaataaaatggctatacagtccagagatgtggctcaatttaggaacgtagtgactcaactagaggcagatcttgacattacgaagaggcaactaggaacagagagatttgaaagggagcgtgccgtacaggagttgagacgccagaattattcttctaatgcttatcatatgagttcgaccatgaagcctaacacaaagtgccattcacccgagagagcacatcacagaagccccgatcgtgggctggatagatcccttgaggaaaacctctgctaccgggatttctag

SEQ ID NO: 137601 - DNA, 2073 bp, Artificial Sequence
  Description of Artificial Sequence: Synthetic coding sequence
atgatgcggagccgtagtaaatctcctcgcaggcctagtccaaccgctagaggtgctaactgtgacgtggaactgctcaagaccacaaccagagaccgtgaagagttaaaatgcatgctggagaagtacgagcgacacctggcggagattcagggaaatgtgaaagtactgaaatccgaacgagataaaatcttcctgctgtacgagcaggcccaggaagaaatcacccgtctgaggcgcgagatgatgaagagttgcaaatcacctaagtcaaccaccgcacatgctatactgcgcagagtggagacagagagagatgtagcctttacggaccttcggcgtatgacaaccgaacgggacagtctcagagagcgcttgaagatcgcacaggagacagcctttaatgaaaaggcccacctggaacagcggattgaggagctcgagtgtactgttcacaacctggacgatgagcgcatggaacagatgagtaacatgactcttatgaaggagaccatcagtactgtggaaaaggaaatgaagtcgttggcacgcaaagctatggataccgagtctgaactgggacgccagaaagccgaaaataactctttaaggttgctatatgagaacacggagaaggacctgtccgacactcagagacatctggcaaaaaagaagtacgagctccagctgactcaagagaaaatcatgtgcttggatgagaagattgataattttacaagacagaatatcgcacagagggaagaaatttccattctcggtggcaccctcaatgacctggctaaggagaaagagtgcttgcaggcttgcttggataagaaatcggaaaacatagccagtttgggggagtcattagctatgaaggagaagacaataagtggaatgaagaatattatcgctgagatggaacaagcatcccggcagtgtacagaggccctcattgtatgtgaacaggacgtgtctcggatgcgcaggcagctcgacgagacgaacgatgaactcgcccagatagctcgcgagcgggatatcctagcacatgataatgacaacttgcaggagcagtttgcaaaggctaagcaagaaaatcaggcactgagtaaaaaacttaatgacacccacaatgaacttaatgacatcaaacagaaggtccaggacaccaatcttgaagttaacaaactcaaaaacatccttaagtccgaagagagtgaaaaccgacagatgatggagcagctacgcaaggctaacgaagatgctgaaaattgggagaacaaagccagacagtcagaagctgataacaataccttgaagttagaactcatcacagccgaagccgagggtaatagactcaaggagaaggtcgattccctaaatcgagaagtcgagcagcatctgaatgcagagaggagctataagtcccagatttctaccttgcacaagtctgtggtgaagatggaagaagagctccagaaggtccagtttgaaaaagtttcagcactcgccgacctatctagtactcgggaactttgcattaagcttgattccagtaaagagctcctgaaccgacaactggtcgccaaagatcaggaaatcgaaatgcgagaaaacgaactggattctgcccacagcgagattgaattactgcgcagtcaaatggctaatgagcgaatctctatgcagaacctagaagcattactggtcgcaaaccgggacaaggagtaccagtcccagatcgctttgcaggagaaagagagcgagatccagctgctgaaagagcacttgtgtctggccgaaaacaaaatggccatccagtcgagggatgtggctcaatttcgtaacgttgtaacccagctcgaagccgatttagatatcaccaagcggcaactgggcaccgagcggtttgagcgcgagagagccgtgcaggagctgcggcgtcaaaactatagcagtaatgcatatcatatgtcctcgacaatgaagcccaacacaaagtgtcattcccccgagagagctcaccacagatcacctgatcgaggtcttgaccgttcacttgagtag

SEQ ID NO: 137602 - DNA, 2097 bp, Artificial Sequence
  Description of Artificial Sequence: Synthetic coding sequence
atgatgaggtcccgcagcaagagcccaagaaggccctctccaaccgcaagaggtgctaattgtgatgtggagctactcaaaacaaccacacgcgatagggaggaactgaagtgtatgctcgagaagtacgagcgacacctcgctgagatccagggtaatgttaaagttctaaaaagcgaacgtgataaaattttcctgctgtatgagcaagcccaggaggagattacgaggctccgcagggagatgatgaaatcttgtaagtccccgaagtccaccaccgcccatgctatcctgcgtcgggtagagaccgaacgcgatgtcgcatttacggaccttcgccggatgactacagaacgcgattcccttcgtgaaagacttaagattgcccaggaaactgcttttaacgagaaggctcacctcgagcagaggatcgaagaactggaatgcaccgtgcacaatctggatgatgagaggatggaacagatgtccaatatgacactcatgaaggaaacaatcagcacagtcgaaaaagaaatgaagtcactcgcacgcaaggctatggatacggaatctgaactaggcagacagaaggcagaaaacaactctctccggctcttgtacgagaatacagagaaggacctgtcagacacccagcggcacctggccaaaaagaagtacgaactgcagttaacccaggagaagattatgtgtttggatgagaagatcgacaattttacacgccagaatattgcccaaagggaagagatcagcatcctgggtggaactctgaacgatctggctaaagagaaagaatgtctccaggcttgcttggataagaagagtgaaaacatcgcatcactcggggagagcttagcaatgaaagaaaagactattagcgggatgaagaacatcattgccgaaatggaacaagcctcaaggcagtgcaccgaagctttgattgtgtgcgagcaggatgtgtcacggatgcgacggcagctggacgaaaccaatgatgaattagcgcagatagcacgggaaagagatatacttgctcacgataatgataacttgcaggagcaatttgctaaggctaagcaggagaatcaggccctgtctaaaaagctgaacgatacacacaacgagttaaatgacatcaagcaaaaggtgcaagacacaaacttggaagtcaacaaactgaagaacattctgaagtctgaggagtcagaaaaccgccaaatgatggaacagctgcgaaaagccaatgaagacgccgaaaactgggaaaacaaggcccgtcagtctgaagcagataataatacactgaagctggaactcatcacggccgaggccgagggtaatcggttgaaggagaaggtcgactccttaaacagggaggtggaacagcacctgaacgctgagcgatcttacaaaagccaaatatccaccctgcacaaaagtgtggtaaaaatggaagaggaactccagaaagtccaatttgaaaaggtgtcagccttagccgacctgtcatcaacacgggagctatgcattaagttggacagcagtaaggaattgctcaacagacaactagtggctaaagatcaggagatagagatgcgggaaaacgaattggacagcgcgcacagcgagattgagcttctgcggagccagatggcaaacgaacgcatttccatgcagaacctggaggctctcctggtagcaaacagagataaggagtatcaatcccagatagcccttcaggagaaggagagtgaaatccagctgctgaaggaacacctttgcctggccgaaaacaagatggccatccagtcgcgggacgtggctcaattccgcaacgttgttacccaactggaagctgatttggatataaccaagcggcagctaggaacagaaagatttgaaagagagagggccgtacaggagttgcggagacaaaactattcctccaacgcctaccacatgagcagtaccatgaaaccgaacactaagtgccactcccctgaaagagcacatcatagatcccccgatcgcggtctagacaggagcttggaagagaacctctgttacagggatttttag

SEQ ID NO: 137603 - DNA, 2097 bp, Artificial Sequence
  Description of Artificial Sequence: Synthetic coding sequence
atgatgaggagccggagcaaaagccctcggcgacccagccctaccgctcggggcgctaattgcgatgttgaactactgaagacaacaacaagagaccgggaggaactcaagtgcatgctggagaagtatgaacgccatctggccgagatacagggaaatgtgaaggtgcttaagtctgagcgggacaagatctttctcttgtacgagcaagctcaggaagagatcactcggcttaggcgggaaatgatgaaaagttgcaaatctccaaagagtacaacagctcacgctatcctccgcagggtcgaaactgagagggacgtagcctttacagacctgaggcgtatgacaactgagcgggattccctgcgggaaagacttaaaatcgcgcaagagactgcttttaacgagaaagcccacttggagcaacggattgaggagctggagtgtaccgttcacaatctcgacgacgagcgtatggagcaaatgtccaacatgaccttgatgaaagaaacaatctcaaccgtagaaaaagaaatgaagtccctggctcgcaaagccatggacacagaatcagagctcggtcgccaaaaggccgaaaacaactcgttacggttattatacgagaatactgaaaaggacctgtctgatacgcagcgtcatctggctaagaagaaatatgagttgcaactgacacaggaaaagatcatgtgcctcgacgagaagatagataatttcactcggcagaatatcgctcagagggaagagatcagtattcttggcggaactcttaatgatctcgctaaggagaaggaatgtctccaggcttgtttagacaaaaagagcgaaaatattgcatcgctgggtgagtcattggccatgaaagagaaaaccatctccgggatgaaaaacatcatcgccgagatggaacaggcatcaagacagtgtaccgaggccctcattgtgtgcgaacaggatgtgtcaagaatgagacggcagctggacgagacgaatgatgaactcgcacaaatcgcccgggagagagatatcctcgcccacgacaacgacaaccttcaggagcagtttgctaaggccaagcaagagaaccaagcgctgagcaagaagcttaacgacacgcataatgaactcaacgacatcaagcagaaggtgcaggatactaatttagaggtgaacaagctgaaaaacattttgaaaagtgaagagtccgagaacagacaaatgatggaacagctgaggaaagctaatgaggatgctgaaaactgggagaacaaggcccgtcagtctgaggctgataataatactctcaagctggagcttattaccgcagaggcagagggaaatcgtctcaaagagaaggttgactccctaaatcgtgaagtggaacagcacctaaatgccgaaaggtcctataaaagccagatttcgaccctgcacaaatctgtagtgaaaatggaggaggagcttcagaaggtacagttcgagaaggtgtctgccttggcagatttgtcctcaaccagggagctctgtattaaacttgactccagtaaggagctgttaaatagacagttagtggctaaggaccaggagatcgagatgagggagaacgagcttgattcagcacactcagaaattgagctgctcaggagccagatggccaatgaaagaataagcatgcaaaatctggaagcactcctggtcgctaacagagataaggagtaccagagccaaatcgcgcttcaagaaaaagagtccgagatccaactcttgaaggaacacctgtgcctggcagaaaataaaatggctatccaaagcagagatgtagctcagttcagaaatgtagtgacgcagctggaagccgacctcgacattaccaagaggcagctgggaacggagaggttcgaacgtgagcgagcggtgcaagagttgcgtcgacagaattactccagcaacgcataccacatgtcatctaccatgaaacctaacacgaagtgccacagtcccgaacgtgcacaccatcgaagcccggaccggggactcgatagaagcctcgaggagaacctttgctaccgggatttttag

SEQ ID NO: 137604 - DNA, 2097 bp, Artificial Sequence
  Description of Artificial Sequence: Synthetic coding sequence
atgatgcgctctaggagcaaatcacctagaaggccttcaccaacagcccgtggcgccaattgtgacgtcgaactgctgaagaccacaacccgtgaccgcgaagagctcaagtgtatgttggagaagtacgagaggcacctcgcagagatccagggcaacgtaaaagtactcaagtccgaaagggataaaatctttctactgtatgagcaggcccaggaggagatcacccgccttagacgggaaatgatgaagtcatgcaagtctcctaaatctacaactgctcacgccatactcagaagagttgaaaccgagagagacgtagcctttactgatcttcgtcggatgacaactgagagggactcattgagagagcgtctcaaaattgcccaggaaacggcatttaacgagaaggctcatctggagcaaagaattgaggaactcgagtgcaccgtgcacaatctcgatgatgagcggatggagcaaatgagcaatatgacattaatgaaagagacaatctccaccgtggagaaggagatgaagtctcttgctaggaaggccatggacacagagtctgagttagggcgccagaaggccgaaaacaattcgctccgcttactgtacgagaacacagaaaaggatctcagcgatactcagagacacctggccaaaaagaagtatgagttgcaactgacccaggaaaagattatgtgcttggatgaaaaaattgataatttcaccagacagaacatcgctcaacgggaagagatttcgatcctgggaggcacgttaaacgatctggctaaggaaaaagagtgtctccaggcatgcctggataagaagtccgagaacattgcctccttgggggagtctctggctatgaaagaaaaaaccattagcgggatgaaaaacatcattgcggagatggagcaggcttctagacagtgtaccgaggccctaatcgtgtgtgaacaggacgtatcgagaatgcggcgtcaactcgatgaaaccaacgacgagttagcccaaatcgcgcgagagcgtgatattttggcccacgacaacgacaacctgcaggaacaattcgccaaggccaagcaggaaaaccaagccttaagtaagaaattgaatgatacacacaacgaactgaatgatataaagcagaaggtgcaagacacgaaccttgaggtcaataagctgaaaaatatcctcaagtccgaagagtcagaaaaccgccaaatgatggaacagttgcggaaagcaaacgaagatgccgagaattgggagaacaaagccaggcagtcggaagccgataacaatacccttaaactggagctgattaccgccgaagctgaaggcaacagactcaaggagaaggtcgatagccttaatagagaagtagaacaacacttgaatgccgaacgatcttacaaatcccagattagtacgctgcataagagtgtcgtgaaaatggaggaggaactacaaaaggttcagttcgaaaaagtttccgccttggctgacctctcctctactagagaactgtgcatcaagttggactccagcaaagagcttctgaacaggcagctggtcgctaaagatcaggagatcgaaatgagggaaaacgagttagatagtgcccatagcgagattgaactgctacggagccagatggctaatgagcgcatctctatgcagaacctggaggccctccttgttgcaaatagggacaaagagtaccaaagccagattgctctacaggaaaaggaatctgagatccagttgctcaaggagcatctgtgccttgcagaaaataagatggccatacagtctagggatgtagcccagttcaggaatgtagtgacacagctggaggcggacctggacataactaagcgccagcttggaacagagagatttgagagagaacgcgctgtgcaggaattacggaggcagaactattcttctaatgcataccatatgtctagcaccatgaagccgaacaccaagtgccatagtccagagcgggcccatcatagatcccccgataggggactggatcgctcactcgaggaaaacctctgctatagggatttttag

SEQ ID NO: 137605 - DNA, 894 bp, Artificial Sequence
  Description of Artificial Sequence: Synthetic coding sequence
atgatgcggtcaaggtctaagtcaccccgcagacccagccccacggcaaggggagccaattgtgacgttgaacttctgaaaacaacaacacgcgaccgggaggaactgaagtgtatgctggagaagtacgagcgacacctggccgaaatccaggggaatgtgaaagtactgaaatcagagcgagacaagatcttcttgctgtacgagcaggcgcaagaggagattacccgcctgcggcgtgagatgatgaagtcttgtaaatctcctaaaagtaccacggctcacgcgattctgaggcgcgtggagaccgaacgcgatgtggcgttcacagatctccggaggatgaccaccgaacgggactctcttcgggagaggctcaaaattgcccaggaaaccgcctttaacgaaaaagcccatctggaacagcgtatcgaagagcttgagtgtactgtccataacctggacgacgaacgaatggaacagatgtctaacatgactctaatgaaggagacgatcagcaccgtagagaaggaaatgaaatcactcgctaggaaggcaatggatacggagagcgaactgggtcgtcaaaaagcagaaaacaatagtcttaggttgctctacgagaacacagagaaagacttatctgacacccaacgccacctggccaaaaagaaatacgagctgcagctgacgcaggaaaagattatgtgcctggacgaaaagattgacaacttcacacgccagaatattgcccaacgtgaggagatatctatccttggggggaccctcaatgatctggccaaagaaaaggagtgcttgcaggcctgcctggataaaaagtccgagaatattgcaagcctgggtgaatcgctggcgatgaaaacagtgtactag

SEQ ID NO: 137606 - DNA, 1881 bp, Artificial Sequence
  Description of Artificial Sequence: Synthetic coding sequence
atggccggcgagcgcccacccctcagagggccaggcccggggccgggggaagtgcctggagagggaccacccggacctggtggcactggcggcggcccgggccgaggtcgccctagcagctatcgggccctgcgctccgccgtgtccagccttgcccgagtggatgattttcactgcgccgaaaagatcggcgcgggatttttcagcgaggtttacaaagtcagacacaggcaatccggccaggtcatggttctgaagatgaacaaactcccaagcaaccgcggaaacacacttagggaagtgcagctgatgaataggctgcgccatcccaacatactccggtttatgggcgtgtgtgtgcatcagggacagcttcacgcgctgaccgagtatatgaacgggggaacactcgagcagctgctctcttccccagaacctctaagctggccggtgagattacacttggcactggacatagcgaggggcctgcgctatctgcactccaaaggcgttttccatcgtgacctaaccagcaaaaactgccttgtccgtcgggaggacaggggattcactgccgtagtcggagattttggcctggccgagaaaattccagtttacagagaaggggcaaggaaggagccgctggcagttgtggggagtccctattggatggccccagaagtactgcgaggggagctgtatgacgagaaagctgatgtgttcgcctttggaatcgtgctttgcgagcttatagcaagggtgccagcagatcctgactacttgcctcgcactgaagacttcggactggacgttcccgccttccgcacccttgtcggagatgattgcccattaccattcctactcctcgccattcattgttgcaatctcgagccctctacacgcgccccatttactgagattacccagcacctggaatggatactggagcaactccctgagcctgcccccttgacccggaccgcactgacacataatcaaggctccgttgctagggggggaccctctgcaacactccctaggcctgatccgcggctttcaagatcccgctccgatctgtttttgcccccctctcctgagagcccccccaattggggggacaacctcacaagggtgaacccgtttagtctgcgcgaagacctgcgcggcggcaagattaaattactcgacaccccgtccaagcccgtgctccccctggttccaccctccccctttccctctactcaacttccattggtcaccactcctgaaacactggtgcagcctggcactcccgccaggagatgccgctccctgccctcaagcccggaactgcctcggcggatggaaaccgcgttaccaggcccgggtccgccagccgttggtcccagcgcagaggaaaaaatggaatgtgaggggtcgtctcccgaacctgagccccctggaccagctcctcagttgcctctcgcagtggctaccgacaattttatcagcacctgtagcagtgcttcacagccctggtcccccaggagcggccccgtgctcaataacaaccctccagccgtagtggttaacagcccccagggatgggctggagagccttggaaccgggcccagcactcactcccacgagccgcagctctggagcggacagagcccagtccaccacccagcgccccccgcgaacccgacgaaggactaccgtgcccagggtgctgtttggggccatttagttttggtttcctgagtatgtgccctagaccaacccccgctgtcgccagatatcggaaccttaattgtgaagctgggtcactgctgtgccaccggggccatcatgcgaagcccccaacaccaagcttgcagcttcccggggccaggagttag

SEQ ID NO: 137607 - DNA, 474 bp, Artificial Sequence
  Description of Artificial Sequence: Synthetic coding sequence
tctgctcgagcggctgccctatcacggaacctgcagggacaacgcccactacctctggctgttgctacagacaactttatcagcacctgctcatccgcctctcagccttggagcccacgaagcgggcccgtactgaacaacaaccccccagctgttgtcgtgaattcaccgcagggctgggccggggagccctggaacagagcccagcactctctgccccgcgccgccgctctggagcgcaccgaaccctcaccccctccctccgctccgagagagccggacgaaggcttgccatgccctggatgttgtttgggtccattctccttcgggttcctgtccatgtgtccccggcctacacccgctgtcgctaggtaccgcaatcttaattgcgaagcgggctccctcctgtgccatagaggccaccatgctaaaccccctactcctagtctccagctgcctggtgcaagatcatag

SEQ ID NO: 137608 - DNA, 1077 bp, Artificial Sequence
  Description of Artificial Sequence: Synthetic coding sequence
atggacgacgcaaccgtgcttcgcaagaagggctatatcgtgggaattaatttgggaaagggatcatacgccaaagtcaaaagtgcgtactctgaacgcctgaagtttaacgtcgcagtgaagatcatcgaccgcaaaaagacaccaacagactttgtcgaacgtttccttcctagagaaatggatatcctggcaactgttaatcatggatctatcataaagacatacgagatcttcgagacaagcgacgggaggatttacattataatggaattgggggtgcagggcgatcttctggagtttatcaagtgtcagggggcactgcacgaagatgttgcccggaagatgtttaggcagctttcaagcgctgtgaaatactgccacgatttagacatcgtgcaccgcgatctgaagtgtgagaatctactactggacaaagacttcaacattaaacttagcgattttggtttcagcaaacgatgtctgcgtgacagcaacgggcgtattattctgtccaagactttctgcggcagtgccgcttacgctgcccccgaagttctccagtcaatcccctatcagcctaaagtttatgacatatggtctctgggtgttattctgtacattatggtctgtggctctatgccatatgatgactccgatattagaaagatgctgcgtatacagaaggagcacagggtagactttccgaggagtaaaaatctaacttgcgaatgcaaagatctgatttatcggatgctccaaccggatgtatcccagcgactccatatcgacgagatcctctcgcactcttggttgcaacctcccaaaccgaaagccacttcgtcggcaagcttcaagagggaaggcgagggaaagtatagggctgaatgtaaacttgacaccaagacaggtctcaggcccgatcaccgccccgaccacaaactcggcgctaaaactcagcacaggttgctcgtcgtgccggagaatgaaaaccggatggaagatagactcgccgaaacttcaagggctaaggaccaccacatctcgggcgctgaggttgggaaggcatcgacttag

SEQ ID NO: 137609 - DNA, 807 bp, Artificial Sequence
  Description of Artificial Sequence: Synthetic coding sequence
atggaggacttcctgttgtcaaacggttaccagctgggcaagaccattggtgaggggacctattccaaagtgaaagaagccttttctaaaaagcatcagcgaaaagtcgcgatcaaggttattgataaaatgggaggcccggaggaatttattcagagattcctgcctagagagcttcagatcgtgcggacgctggatcacaagaacataatacaagtgtatgaaatgcttgaatctgccgatggtaagatctgccttgtgatggagctcgcggaggggggagacgtgtttgattgtgttttgaacggaggtccactcccggaatcaagagcgaaagctctgtttcgccagatggttgaggcaatcaggtactgtcacgggtgcggtgtggcccatcgcgacttgaagtgcgaaaacgctcttctccaaggcttcaacctgaagctgaccgattttggtttcgcaaaagtgttgcccaagtctcatcgtgagcttagtcagacattttgcggctctactgcttatgcggcccctgaagttctacaaggcattcctcacgacagtaaaaagggcgacgtgtggtccatgggcgtggtgctgtacgttatgctgtgcgcgtctctgccgtttgacgacaccgatatacctaagatgctgtggcagcagcagaaaggcgtcagttttcccactcacctgtccatttccgcagactgtcaagatctgttgaagaggctgctcgaaccagacatgatcctgcgtccatctattgaggaggtgagttggcacccgtggctggcctccacctag

SEQ ID NO: 137610 - DNA, 987 bp, Artificial Sequence
  Description of Artificial Sequence: Synthetic coding sequence
atggggaaaggagacgtactggaagcagcgccaacaacgacagcataccactctctgatggatgaatatggctatgaagtggggaaggccattggtcatggatcttatgggtcagtttatgaggcattttacacaaaacagaaggtgatggttgctgttaagattatttccaagaaaaaagcgagcgatgactacctcaataagttcctcccccgtgaaatccaggttatgaaggtccttcgacataaatatttgatcaacttctatcgtgccatcgagtccacgtcacgggtgtatataattttagaactggcacaaggcggcgatgtcctcgaatggattcaacggtatggggcttgttcagagcccttggcggggaaatggttctcccagttgacgttaggtattgcgtacctgcatagcaaaagcatcgtacatcgcgatctgaagctagagaacttgttgctggacaagtgggagaacgttaagatttctgactttggattcgctaagatggtcccgtctaatcagcctgttggttgttctccctcttaccgtcaggttaactgcttttctcacctctcgcagacatattgtgggtcctttgcttatgcatgtccggaaatcctgcgcggacttccctataatccattcctatctgatacctggagcatgggagtcatcctctacacattggtggtcgcacacctaccattcgatgacacaaacctcaagaaactcttacgcgagacacagaaggaagttacatttccagctaaccataccattagccaagagtgcaagaatctgatattacagatgctaaggcaagccactaaaagagcaacgattctcgatattatcaaggatagctgggtgctgaaatttcaacctgagcagcctacccatgaaattcgtctcttggaggcaatgtgccagctacataacaccacaaaacagcaccagagccttcagatcacaacctag

SEQ ID NO: 137611 - DNA, 1017 bp, Artificial Sequence
  Description of Artificial Sequence: Synthetic coding sequence
atgggcaagggcgatgtgctggaggctgcccctaccactacagcttaccacagtcttatggatgaatatgggtacgaagttggcaaagctatcggtcatggcagctacgggtccgtttacgaagcgttttacactaagcagaaggttatggtcgcggttaaaatcattagcaagaagaaagccagcgacgactacctgaacaaatttctgccacgtgagatccaggtgatgaaagtccttagacataaataccttatcaacttctaccgcgcaattgagagtacctcaagagtgtatataattctggaattagcccaagggggagatgtattagagtggatccagcggtacggggcctgcagcgagccactggcaggaaagtggttttcacagctgactttaggtatcgcctacctccactccaagtcaatcgttcacagactaatgccttctctctcagcagccgggcgtgacctcaagctggagaaccttttactcgataaatgggagaatgtgaaaatcagcgacttcggatttgcaaagatggtgccatcaaaccaacctgttggatgctcaccctcttatcgccaggtcaattgcttttctcatttgtctcagacctactgtggctctttcgcttatgcttgcccagagatcctcaggggtttaccatacaacccctttttatctgatacctggtccatgggagtcatactctacacgctagtggtggcacacctgcctttcgatgacacaaacctcaagaagcttcttagagagacccaaaaagaagtaacattccccgcaaatcacaccatctcacaggaatgtaaaaacctgattctccagatgctccgacaggcaacaaagagagcgactatcttggatatcattaaggatagctgggttcttaagtttcaacctgagcaacctacccacgagatacgtttgctggaggcaatgtgtcagctgcataacacaaccaaacagcatcagtcactccaaattacaacttag

SEQ ID NO: 137612 - DNA, 759 bp, Artificial Sequence
  Description of Artificial Sequence: Synthetic coding sequence
atgaaggtgctcaggcacaaatatctgataaatttctatagagccatcgagtcaacaagcagagtgtacatcatattggagctagcccagggcggagacgtccttgagtggattcagagatacggagcctgcagcgagcccctggctggcaagtggttctctcagctgacccttgggattgcctatctacatagtaaatctattgtgcaccgagacctcaaactggaaaatctcctgctcgacaagtgggagaacgtgaagatctccgacttcggcttcgccaaaatggttcccagcaatcagcctgtgggttgcagcccatcttaccgccaggtgaattgcttcagccacctgtctcagacctactgtggatctttcgcgtacgcatgtcctgagattctgcgggggttgccatataatcctttcctgtctgatacttggtccatgggtgtaattctgtacacattggtcgtggcccaccttccatttgatgacaccaatctgaaaaaactcctgcgggagacgcagaaagaagtgacattccccgccaaccacacaatcagccaggaatgcaaaaatctgatccttcagatgctgcgccaggccaccaagcgggctactattctcgacatcataaaagactcgtgggttctgaagtttcagcccgaacagcccacccatgagattaggctgttggaagctatgtgtcagctccataatacaacaaaacaacatcagagcctccagatcacaacttag

SEQ ID NO: 137613 - DNA, 822 bp, Artificial Sequence
  Description of Artificial Sequence: Synthetic coding sequence
atgagcggcgacaaactcctgtcggaattagggtacaagctcggaaggacgatcggtgaagggtcatatagcaaggtcaaagtcgcgacctcaaagaagtataaagggaccgtcgctataaaagtggtagatcgccgcagggcaccccctgatttcgtgaataagttcttaccacgcgagttgagcatactgcgtggcgttcgtcacccccatattgtgcacgtgttcgagttcattgaagtctgtaacggaaagctgtacattgtgatggaagccgctgcaacagaccttttgcaagctgtgcagcgtaatgggcgtatacctggcgtccaggcccgggatttatttgctcaaatcgcgggggccgtcaggtatctccatgaccaccacctggtgcaccgtgatcttaaatgcgagaatgtcctgctgtctccggacgagcgaagggtgaagctaacagacttcggcttcggtcgccaggcccacggctatccggatttgtcgacgacctattgcggtagcgcggcatatgcctccccagaagttctcctcggaatcccctacgaccccaaaaagtacgacgtgtggtctatgggcgtggtcttgtatgtcatggttacggggtgtatgccttttgacgattccgacattgccggactgcctaggcgtcaaaagcgcggggtcttgtaccccgagggcctggaactaagcgagcgctgcaaggccttaatcgcagagctcctacagttttccccctcagctcggccaagcgctggacaggtagctaggaactgctggctccgtgccggagactccgggtag

SEQ ID NO: 137614 - DNA, 822 bp, Artificial Sequence
  Description of Artificial Sequence: Synthetic coding sequence
atgtccggggacaaactgctgagcgaactgggatacaagctgggcaggacgataggtgaggggtcatattccaaggtcaaggtagctacatccaagaagtataaaggaaccgtggccatcaaggtggtggaccgcaggcgtgcgcctcccgattttgtgaacaagttcctgccacgcgaactatcaattctgcgcggggtcaggcacccacacattgtacacgtgttcgagttcatcgaggtatgcaacggcaagctgtacatcgtgatggaggcagccgcaacagacctcctccaggcagtgcagcgcaacgggcggatcccaggggtgcaggcacgtgatctgttcgcacagattgcgggggcagtgcgctatttgcacgaccatcatctggtgcaccgggacctgaagtgcgagaacgtgttgctgagtcctgacgaaagacgagtgaagctaactgactttgggtttggaagacaggctcacggatatcctgacctgtctaccacctactgtgggagtgccgcctacgcctcgcccgaggtgttgctagggatcccctacgaccctaaaaaatatgacgtgtggtcaatgggagtggtcctgtacgtgatggttacaggttgtatgccattcgatgatagcgatatcgccggcctgccacgacggcaaaagcgcggagtgttgtacccagaagggctggaactgtctgaacggtgtaaagctctcatagccgaactgctgcaatttagtccctccgccagaccctccgcagggcaggtagccagaaattgttggctgcgggccggggactccgggtag

SEQ ID NO: 137615 - DNA, 6411 bp, Artificial Sequence
  Description of Artificial Sequence: Synthetic coding sequence
atgtctcgctcacgccacgcaaggccttcaaggctggtgaggaaggaggatgtgaacaaaaaaaagaaaaacagccaactgcgcaagaccacaaagggcgctaacaagaacgtggcgtctgtgaaaacactttctccaggaaaactcaagcaattgattcaggagagagacgtaaagaaaaagacggagcccaagccccccgtgcccgtgaggtctctcctgaccagagccggcgctgccagaatgaacctagatcggacagaggtcctcttccagaatcctgaatctcttacctgtaatggtttcaccatggccctcaggagtacctccctatctagacgactaagccagccaccgctggttgtcgcgaagtccaaaaaggttcccctgtccaaaggactggaaaagcaacacgactgcgactacaaaatcctgcccgctctcggcgtgaagcatagcgagaacgattctgtgcctatgcaggacactcaagtcctgcccgatatcgagacacttattggcgtacagaacccatccttgctcaagggaaaaagccaagaaacaacgcaattttggtcccaacgcgtggaggacagtaagataaacatcccaacacatagtgggccagcggctgaaatcctgcctgggcccctggaagggacccgatgtggcgagggactcttctccgaagagacactgaatgatacgtctggttccccaaagatgtttgcccaggatactgtgtgcgcacctttcccccagagggccacccccaaagtcacttcccaaggcaacccgagcattcagctggaggaactcggatcacgagtcgagtccttgaagctcagcgatagctatttggatcccattaagtccgagcacgactgctaccccacatcttctctaaataaagtcattcccgacctaaatctgagaaattgcctcgcgctcggtggctcaacctccccaacatcagtgattaaattcttgttagccggctcaaagcaggccaccctgggggcaaagcctgaccatcaggaagcttttgaagccaccgctaatcaacaggaagtcagcgacacaacatcctttctggggcaggcatttggagctatcccccaccagtgggagcttcccggagctgatcctgtgcacggagaggctctgggtgagacacccgatttgccagagatccctggagcaattcctgtgcagggcgaggtgttcggtacaatattggaccagcaggaaacactcggaatgtctggctccgtcgtgccagatctaccagttttcctcccggttcccccaaatcctatcgctaccttcaatgcaccgagcaaatggcccgagccccagagcactgtgtcctatggtctcgctgtccagggggccattcaaattcttcctctgggatcagggcacacccctcaatccagttccaatagcgagaaaaacagcctccccccggtgatggccatctcaaatgtggagaacgagaaacaagtacacattagtttcctccccgccaacactcagggctttcccctcgctccagagcgaggcctcttccacgcaagccttggcatcgcccagctgagtcaagccgggcccagtaaatccgatcgggggagcagccaggttagcgtgacctccacagtccacgtcgttaatactaccgtcgtgacgatgccggtccccatggtgtccaccagctcatccagttataccaccttgcttcccactctggaaaagaagaagcgcaagcgctgcggcgtatgtgaaccgtgtcagcaaaagaccaattgtggtgagtgtacctactgcaagaatcggaagaacagccatcaaatttgtaagaagagaaagtgtgaggaacttaagaaaaagccaagcgttgttgtccccctggaggtcatcaaagagaataaaaggccccaacgtgagaagaagcctaaggtcctcaaggcagacttcgacaataaacccgtcaatgggccgaagagtgaatcaatggactactcaagatgcgggcacggcgaggaacaaaagcttgagttaaacccacatacagtcgaaaatgtgacaaaaaacgaggacagtatgactggcattgaggtagaaaaatggacacagaataaaaaatcccagctgaccgaccatgttaagggtgattttagtgcgaacgttcctgaggcagaaaagtccaaaaattctgaagtggacaagaagagaacaaagtctcccaagctttttgtccagaccgtgaggaacgggatcaagcacgtccattgtctccctgccgagacgaacgtctcattcaaaaaattcaatatcgaggagttcggaaagacactcgagaacaactcatataagtttctgaaagacacagccaaccacaagaacgctatgtcttctgtagcgacagacatgagttgtgatcacctaaaaggtcggtcgaacgtcctggttttccagcagcctgggttcaattgttcatctataccccattcatcccacagtatcattaatcatcacgcctcaatccacaatgagggggatcagccaaagactccggaaaacataccctcaaaagagccaaaggacgggtcacctgtgcagccttccctactctcgctgatgaaggataggaggctcaccctggaacaggtggtcgcaatcgaagccctgacgcagctgtctgaagccccatccgaaaattcatctcctagcaaaagcgaaaaggatgaggaatccgagcagcgcactgcatccctgctgaactcttgcaaggccattctctatacagtcagaaaggatctccaggatcctaatctccagggtgaacctcccaaacttaatcattgtccatcccttgagaagcaatcttcgtgcaacacagtggtatttaacggccagactacgactctttccaactctcacatcaacagcgcgaccaatcaagcaagcactaagtctcacgagtatagcaaggtgactaactcactcagcctgttcattcctaagagcaacagtagcaagattgatacaaataagtctatagcccaaggcataatcaccctggataattgctcaaacgatctgcatcagctgcctcccagaaacaacgaggtagagtattgcaaccagctgcttgactcatcgaagaagcttgactccgatgatctgtcatgccaggatgctactcacacacaaatcgaggaggacgtcgcaacacagctcacgcagctcgcatcaataatcaaaataaactacatcaagccagaggataagaaggtagagagtactccaacgtccctggtgacctgtaacgtacagcagaaatataaccaggagaagggaaccattcagcagaagccgcccagctccgtgcacaacaaccatggctcttcccttactaaacagaagaatccaacccagaaaaaaactaagtcgaccccgtctagggacaggaggaaaaaaaagcctaccgtcgtttcatatcaagaaaacgaccggcagaaatgggagaagctgtcatacatgtacggaacaatttgtgacatatggatcgctagcaagtttcagaatttcggacagttctgccctcatgattttccaactgtgtttggcaagatctctagctccaccaaaatttggaaacctctcgcccagactcgcagcattatgcagccaaaaacagtcttcccacccctgacgcagattaagctccagcgctatccagaatctgccgaagaaaaggttaaggtggagccattagacagcctttcgttattccaccttaagaccgaatctaacggtaaagctttcactgataaggcctacaattctcaggtgcagctgacagtcaacgcaaaccagaaagctcacccactgactcaacctagttctccccctaatcaatgtgccaacgttatggcaggcgacgaccagatcagattccagcaagtggtgaaagagcagctgatgcaccaacggttaccaacattgcccggcatttctcatgagactcccctgccggaatctgccctgactttgagaaacgtcaacgtagtctgctcgggaggcattactgttgtgtcgacaaaatcggaagaggaagtgtgcagctcctcctttgggacctcagaattcagcaccgtagattccgctcaaaagaacttcaatgactatgctatgaactttttcaccaacccaaccaaaaatctcgtgtcaattaccaaagactctgagcttcctacttgcagctgcctggatagggtgatccagaaggataagggtccatattacacacatctgggggccggcccttccgtggcagcggtgcgtgagattatggaaaaccgatatggccagaaaggaaatgccatacggattgagattgtggtctatacaggcaaagagggaaagtcctcccatggctgtccgatcgcaaagtgggttctgaggagaagctccgatgaagaaaaggtgctgtgcctcgtgcgacagagaactggacatcactgtcccaccgctgtgatggtggtgttgatcatggtgtgggacggcatcccactccctatggctgatcggttatacaccgaacttaccgaaaacttgaaaagttataacggccatccaaccgacagaagatgtacactgaacgaaaaccggacctgcacatgtcagggaatagaccccgagacatgcggcgcttctttttcgtttgggtgttcttggagtatgtattttaacggttgcaaatttggtaggagtccatccccccggcggttccgcatagatccctcctcgccactgcatgagaaaaatcttgaagataatttgcagagtttggctacaaggctcgcgcccatatacaaacagtacgcccccgtggcatatcaaaatcaagttgaatacgaaaatgtcgctagggagtgcagactgggttcaaaggagggacggcctttctctggagtgaccgcctgtctcgacttctgtgcccacccccatcgcgacatccacaacatgaacaatggttccacagtagtgtgcacccttactcgtgaggacaataggtcgctaggcgtcatcccacaggatgagcaattacacgtgcttcctctctataaactttcggatacagacgagtttgggagtaaagaggggatggaggcaaagatcaaatccggagcaattgaggttctcgctccgagacggaagaagcgcacttgtttcacacagccagttcccagatcagggaagaagagggccgcaatgatgactgaggtcctggctcacaaaatccgagcagtggaaaagaaacctatcccaaggatcaagaggaagaataattcgacaacaacaaataattccaagccttcgtcgctgcccacccttggctcaaacaccgagacggttcagccagaggttaaaagcgagaccgaaccacacttcattctcaaatcgagcgacaatactaaaacatatagcctgatgccatccgctcctcatcccgttaaggaggctagtcccggcttcagctggagtcctaagacagcctccgccacacccgccccacttaaaaacgacgcgactgcctcatgcggcttttctgagcgcagctcaactccacattgtacaatgccgtcaggcaggttgagtggagccaatgctgccgctgccgatggccctgggatttctcagctcggcgaggttgctcccttgccaactctcagcgcacctgtgatggagccactgattaattccgagccgtcaactggggtgacagaacctctcacccctcaccagcccaaccaccagccatcattcctgacgtcaccccaggatctggcaagctcacctatggaagaggatgagcaacattccgaggcggatgaaccaccaagtgacgaacccctgtcggacgatccattatcgccagccgaggaaaagctgcctcacatcgatgagtactggtctgatagtgaacatatcttcctggacgcaaacatcggcggcgtggccattgcgccagcccacggctctgttttgatcgagtgtgcccgccgggagctccacgcgacaactccggtggaacatccaaatcgaaatcacccgacacgcctgtcgcttgtgttctaccagcacaagaacttgaacaagccccagcacggcttcgaacttaacaagatcaagttcgaagctaaagaggctaagaataagaagatgaaagcaagtgagcagaaggatcaggccgctaacgagggccctgaacagtcttctgaggtcaacgaactgaaccagattccatctcataaggcacttaccttgacccacgataatgtagtgactgtgtccccatacgcactgactcatgtggccgggccttataaccactgggtttag

SEQ ID NO: 137616 - DNA, 330 bp, Artificial Sequence
  Description of Artificial Sequence: Synthetic coding sequence
atggccgaccgattgtacactgaactcacagaaaatcttaagagctataatggtcaccccactgatagacgatgcacactgaatgagaatcgtacatgcacctgccaggggatcgatcccgagacatgcggcgccagcttttcatttggctgctcttggagtatgtattttaatggatgcaaattcggaaggtctccatctccccgccgctttaggatagatcctagtagcccactgcacacctactacgaacgcattactaagggccggaacccggaaaggagatatatgaagccagaacgcatttcacccggtcatgaggctatgtag

SEQ ID NO: 137617 - DNA, 726 bp, Artificial Sequence
  Description of Artificial Sequence: Synthetic coding sequence
atgcaatgcttcagctttatcaagaccatgatgattttgtttaaccttctgatctttttgtgcggcgccgcactactggccgttggcatctgggtgtctatcgacggggcaagctttctgaaaatatttggtcctctgagctcttctgcgatgcagttcgtgaatgtggggtactttctgattgcagccggggtggtggtgttcgccttgggttttctgggttgttacggagcaaagactgagagtaaatgtgcactggtaacatttttttttattctgttactcatcttcatcgccgaagtggccgccgcagttgtggctcttgtctacaccaccatggccgagcatttcttgacgctgctggtagtgccagccatcaaaaaggactatggtagccaggaggacttcacgcaggtatggaacactacgatgaagggactgaaatgctgtggattcacaaattacacagacttcgaagactccccttacttcaaagaaaatagcgcctttccgcccttttgctgtaatgataacgtgacaaatactgctaacgagacatgtacaaagcagaaggcccacgaccaaaaggtagaaggctgtttcaatcagcttttatatgacatccggacaaacgcagtgaccgtggggggagtggcggcggggattggcggactcgaactcgcggcaatgattgtttctatgtacctgtattgcaacctccagtag

SEQ ID NO: 137618 - DNA, 702 bp, Artificial Sequence
  Description of Artificial Sequence: Synthetic coding sequence
atgtcatcgtacttcgtcaacccaacttttccaggcagccttccttctggacaggatagttttctcgggcaactaccactttatcaagccggctatgatgcattgcgccctttccccgccagttacggcgcttcctccctcccagacaagacctatactagcccgtgtttttaccaacaatcgaacagcgtgctggcatgcaacagagcgtcatatgaatacggggcttcctgcttctactcagacaaagatctttctggtgcttcgccctcagggtcagggaaacagcgggggccaggagattatttgcacttcagtcctgaacagcaatataagccagatagctcttccggccaaggaaaagccctgcatgacgagggggccgaccggaagtatacttctcccgtgtacccgtggatgcagcgcatgaattcttgtgctggggctgtgtatgggtctcacggcaggcggggccggcagacatacacacgctatcagacactggagctcgagaaggagttccattttaaccgctatcttacacggcggagacgcatagagattgccaacgccctatgtttgacagagaggcaaatcaaaatctggttccagaacaggcggatgaagtggaaaaaggagaacaagctgatcaattctacccagccgagtggcgaagatagcgaagcaaaagcaggggaatag

SEQ ID NO: 137619 - DNA, 918 bp, Artificial Sequence
  Description of Artificial Sequence: Synthetic coding sequence
atggcgcgggaagactccgtaaaatgcctgcgctgtttgctgtacgccctgaatctcctgttctggctcatgtctatttctgttctcgccgtgtccgcttggatgagggactatcttaataacgtgctgacactcacagctgaaactcgggttgaggaggccgtgatactgacctactttccagtggtccatccagtgatgattgccgtctgctgttttctgattatcgttggaatgttgggatattgtggaaccgtcaaaagaaacctgctgttgctagcctggtactttggctccctgctggtgatcttctgcgtagagcttgcctgcggagtgtggacatacgagcaggagctgatggtgcccgtacaatggagcgatatggtgaccctgaaagcccgcatgaccaactatggcctgcctaggtaccgctggctgacacacgcatggaatttctttcaaagggagtttaaatgctgtggagtcgtttattttactgattggctggaaatgacagaaatggactggccccccgactcttgctgtgtaagggagttcccaggctgtagcaaacaggcccaccaggaggacctcagcgacctgtaccaagaaggttgcgggaagaagatgtattctttcctgcggggaacaaagcagcttcaggtattaaggtttctcggaatcagcatcggagtaacccagatattggccatgatcctcaccatcactttactctgggccctgtactatgacaggcgggagccagggacggatcaaatgatgtccctgaagaatgacaactcacaacacctctcctgcccctccgttgagctgctgaagccaagcctctccagaatatttgagcacacctcaatggcaaattcttttaatacccatttcgagatggaggagctctag

SEQ ID NO: 137620 - DNA, 339 bp, Artificial Sequence
  Description of Artificial Sequence: Synthetic coding sequence
atggctcgtgaggattccgtgaagtgtttaagatgcctgttgtatgctctcaacctcctcttctggttgatgtcaattagcgtactcgctgtcagcgcctggatgcgcgactatcttaacaatgtactcacccttactgcagaaacccgcgtggaagaggcggtgatcttgacatatttccccgtcgtgcatcccgtgatgatagctgtttgttgcttcctcattatcgtcgggatgctgggttattgcggcaccgttaagagaaacttgctcctgctagcttggtactttggctccttgcttgtcatcttctgtgtggaacttgcttgcggcgtgtag

SEQ ID NO: 137621 - DNA, 288 bp, Artificial Sequence
  Description of Artificial Sequence: Synthetic coding sequence
atggcccgcgaagacagcgtaaaatgcttgcgttgcctgttgtatgctcttaacctgttgttttggctaatgagtattagcgtgctggccgttagcgcctggatgagggactatttaaataacgtcttaaccctcaccgccgagacgcgggtagaagaggctgtcatactgacatatttccctgtggtacatcctgtgatgatcgcagtctgctgcttcctgatcattgtcggaatgctgggatattgcgggaccgtcaagcgcaacctgctgctgcttgcttggtag

SEQ ID NO: 137622 - DNA, 363 bp, Artificial Sequence
  Description of Artificial Sequence: Synthetic coding sequence
atggcgagagaggatagtgtaaagtgtctgcggtgcttactctacgccctgaatctgctgttttggctgatgtctatcagcgttctggccgtatccgcttggatgagagattacctgaataacgtacttaccttgaccgccgagactcgggtggaagaagccgtgatcctcacttatttcccagtggtgcacccagtgatgatagcggtttgctgttttctgattatcgttgggatgctggggtattgcggaacagtgaaacggaacctgctccttcttgcctggtatttcggtagtctactggtcattttttgtgtagagctcgcctgcggcgtgtggacgtatgaacaggagctcatgtag

SEQ ID NO: 137623 - DNA, 444 bp, Artificial Sequence
  Description of Artificial Sequence: Synthetic coding sequence
atggctagagaggactcagtcaagtgtctgcggtgcctcctgtatgcgttgaatctactgttctggcttatgtcaatctccgtcttagccgtgtcagcctggatgcgtgactacctaaataacgtgttgacattgactgcggagactcgggtggaagaggcagtaatccttacttacttccctgtcgtgcacccagtgatgattgctgtctgctgctttcttattatcgtggggatgcttggctattgcggtactgttaagcggaatctactgttgttagcctggtacttcggctcactgcttgtcattttttgtgtcgagctcgcatgcggagtttggacctatgagcaggaacttatggtgcctgtgcagtggagcgacatggtgacattaaaagctagaatgacgaactatggcctgcctagatacaggtggctgacttag

SEQ ID NO: 137624 - DNA, 885 bp, Artificial Sequence
  Description of Artificial Sequence: Synthetic coding sequence
atgcccaggggcgactctgaacaagttcgttattgcgccaggttcagctacctgtggctgaaattttctctgatcatttatagcacagtcttctggctcattggggccctcgtactgtctgttggcatctacgcggaagtcgaacgccagaagtataaaaccctcgagagtgcgtttctggccccagctatcatcctcatactgttgggagtggtcatgttcatggtgtcgttcatcggagtgctggccagcttgagggacaatctgtatctccttcaggcatttatgtatattctgggtatctgtcttataatggaactgatcggaggcgtggtggcgctaaccttcagaaaccaaacaatcgatttcctcaacgataacatccggcgtggtatcgaaaattactatgatgacctggatttcaagaatataatggattttgtgcagaagaagttcaaatgctgtgggggggaggactatagagattggtccaaaaaccagtaccatgattgtagcgcacccggcccactggcttgcggtgtgccttatacgtgttgcattcgcaataccaccgaggtggtgaatacaatgtgcggttataaaactatcgataaagaacgcttcagtgtgcaggacgtgatttatgtgagggggtgtaccaatgccgttatcatctggttcatggataactataccataatggctgggatcttgcttggaatcctgctgcctcaatttctcggggtcctcctgacacttctgtacattacaagagtggaagacattatcatggaacactctgtcactgacgggctgctgggcccaggcgctaagcccagtgtcgaggctgccggaactggatgctgtctttgctacccaaactag

SEQ ID NO: 137625 - DNA, 582 bp, Artificial Sequence
  Description of Artificial Sequence: Synthetic coding sequence
atgggccggttccggggcggactgaggtgtatcaagtatttactactgggttttaacctcctattttggctagctggttcagctgtgatcgcgtttggtctttggttccggttcggtggcgcaattaaagaacttagttccgaagacaagtctccggagtatttttacgttggactttatgtcctcgttggggctggagccctaatgatggcagtgggattcttcggctgttgcggagctatgcgggagtctcagtgcgtgctgggcagcttctttacatgcttactggtgatcttcgccgcagaggtaacgacgggcgtctttgcattcatcggaaaaggcgtggcaattagacatgtccagaccatgtacgaggaggcttacaacgactacctcaaagaccggggtaaaggcaacggaactctgattacatttcattcaaccttccagtgctgcggtaaagaaagcagtgagcaagtgcagcccacctgccctaaggaactgctaggccataaaatattcggaatgatattcagtatggtgctctgttgcgcaatccgcaacagccgcgacgtcatctag

SEQ ID NO: 137626 - DNA, 591 bp, Artificial Sequence
  Description of Artificial Sequence: Synthetic coding sequence
atggggcgctttcgaggcggcctgagatgtatcaaataccttttgctgggcttcaatctcctcttctggctggccggctctgctgtgatagcctttgggctgtggttccggttcggtggtgcgattaaagaactcagttcagaggacaagtccccagagtatttttacgtcggcttatacgtactggtgggggccggggcactgatgatggcagtaggatttttcggttgttgtggcgctatgcgtgaaagccagtgcgttttagggtcagccatacggcacgtgcagacaatgtatgaggaagcatacaacgattacctcaaggaccgtgggaagggcaacgggacactgattactttccacagcacgttccagtgctgcggcaaagaaagctccgagcaggtgcaacctacgtgtcctaaagaactgctgggccataaaaactgtatcgatgagattgaaacaatcatcagcgtgaaactgcagcttattggaattgttggcattggtatcgcgggcctgacaatatttgggatgatcttctctatggttctgtgctgtgccattcggaatagtagagatgtgatctag

SEQ ID NO: 137627 - DNA, 666 bp, Artificial Sequence
  Description of Artificial Sequence: Synthetic coding sequence
atgggtcggtttcgtgggggcttaagatgcatcaagtacttacttcttggattcaacctcctcttttggttggccggttctgcggtcatcgcgtttggactatggttccgttttggaggcgctatcaaagaactctcgtcggaggacaaaagccctgaatatttttacgttggcctctatgtgctcgttggagctggagctctgatgatggccgtgggctttttcggatgctgcggcgccatgcgtgaaagtcagtgcgttctgggtagtttcttcacctgcttactggttatctttgccgcagaagtgacaacaggggtattcgcgtttattggcaagggggtagcaataaggcatgtgcaaactatgtatgaggaggcatacaacgactatcttaaggatcgcggcaaaggtaatggtacacttattacgtttcactctacattccagtgctgcggaaaggaatcaagtgagcaagtgcagccgacttgccccaaggagctgttaggccacaaaaactgcattgacgaaattgagactataatctccgttaaactccaactcattggaatcgtggggatcggcattgccggacttactattttcggaatgatttttagcatggtcctctgctgcgcgatacgaaatagtagggacgtgatttag

SEQ ID NO: 137628 - DNA, 564 bp, Artificial Sequence
  Description of Artificial Sequence: Synthetic coding sequence
ggattgcgctgcatcaagtacctcctgttagggttcaacctgctcttctggttagctggatccgctgtcatcgcctttggattgtggttccgcttcggaggtgcaatcaaggagctgtcatccgaagacaaaagtcccgaatatttttacgtggggttgtacgtccttgtgggggccggcgcactcatgatggccgtcggattcttcggctgctgcggagctatgcgggagagccagtgcgtgctggggtcgttctttacctgcctccttgtgatttttgcggctgaggttacaacaggcgtgttcgccttcatcggtaaaggcgtggctatcaggcatgtgcaaaccatgtacgaagaggcctacaatgactaccttaaagacagaggcaaaggcaatggcaccctgatcacatttcattccacctttcaatgctgcgggaaagagagctcagagcaagtgcagcctacctgccctaaggaactgctggggcataagatcttcgggatgattttttcaatggtgctgtgctgcgcaatccgaaatagcagagatgtgatatag

SEQ ID NO: 137629 - DNA, 762 bp, Artificial Sequence
  Description of Artificial Sequence: Synthetic coding sequence
atgggccagtgcggtataacctccagcaagacagttctggtgttcctcaatctcatcttttggggtgccgcggggatcctttgttatgtaggcgcttatgtcttcattacctacgatgattacgaccatttctttgaggatgtgtacacgctgatcccagcggtcgttatcattgccgtcggggcccttttgtttatcataggcttgataggctgttgcgctaccatccgagaatcccggtgtggccttgctacctttgtgatcatcctcctgctcgtatttgtaaccgaggtagtggtggttgtgctggggtacgtttaccgcgcgaaggtggagaatgaggtggaccgctcgattcaaaaggtttacaaaacatataacggaacaaaccctgatgcggcctcaagggcgatcgactacgtgcagcgccagcttcactgctgtggaatccataattactctgactgggaaaacacagattggttcaaggagaccaagaaccagtccgtgcctctcagctgttgtagagagaccgccagtaactgtaatggctccctcgctcacccgagcgacctctatgctgagggctgtgaggccttggtggtgaaaaaactgcaagagatcatgatgcatgtgatttgggcagcgctcgcattcgccgccatccaacttcttgggatgctgtgcgcttgcattgtgctgtgcagaaggagccgggaccccgcatacgagctcctcataaccggcggcacctacgcctag

SEQ ID NO: 137630 - DNA, 687 bp, Artificial Sequence
  Description of Artificial Sequence: Synthetic coding sequence
atgggacaatgcggcataacctcctccaaaaccgtattggtgttcctgaacctcatcttttggggcgccgccggaatcctgtgttacgtcggggcttacgttttcatcacatacgatgattatgatcacttctttgaagatgtctacacactcatcccagctgttgtcatcatcgctgtgggtgctctgctcttcattatcggactgattggctgctgcgccacaattagggagtctagatgtggcctggcgacagtcgaaaacgaggtggacaggtccatacagaaggtgtacaagacatataacggaaccaacccggatgccgcatcgagagctatcgattatgtgcagagacaattgcattgctgtgggatccataactacagcgattgggagaacactgattggttcaaagaaactaagaatcagagtgtgcccctcagctgttgtcgtgagaccgccagtaattgcaacgggagccttgctcaccccagcgatttgtatgctgaaggctgtgaagcccttgttgtgaagaagctgcaggaaattatgatgcatgtgatatgggccgccttggccttcgccgcaattcagttactgggtatgctgtgcgcctgtatagtgttgtgccgaagatcacgcgatcctgcttacgaactcttaatcactggtggcacctatgcctag

SEQ ID NO: 137631 - DNA, 651 bp, Artificial Sequence
  Description of Artificial Sequence: Synthetic coding sequence
atgtgggaacccatgtcaagcagcctaatgatgacaatgacaaccagcctgaagatgtgtacgcggagcagtctcctctttatcattggtctcatagggtgctgcgcgacaatccgcgagtctcggtgcgggttggccaccttcgtgatcatcttactgcttgtcttcgttacggaggtcgtggttgtggtgctcgggtatgtctatcgggcaaaagtggaaaacgaggtagatcggtccatccagaaggtctacaaaacctataatgggaccaatccagacgccgcctcccgcgccattgattatgtccagagacagctgcattgctgcggaattcataattacagcgactgggagaacacagattggttcaaagagacgaagaaccagtccgtgcctctttcctgctgtcgagaaacagcctccaattgtaacggctccctggctcatcccagcgacttgtatgccgagggctgtgaagcccttgtcgtgaaaaagctgcaggagatcatgatgcacgtgatttgggccgctttggctttcgctgccatccagcagctcctggggatgctgtgcgcctgtatcgttctgtgtcgccgcagccgggaccctgcctatgagctgcttattacaggcgggacatacgcatag

SEQ ID NO: 137632 - DNA, 570 bp, Artificial Sequence
  Description of Artificial Sequence: Synthetic coding sequence
atgggtcagtgtggcatcacctcttccaaaaccgtgcttgtgttcttgaacctaatattctggtttgtgataatattactattggtgtttgtaaccgaggtcgtggtggttgtgctaggctacgtgtaccgcgccaaggtggaaaacgaggtcgaccgctcaatacagaaggtgtacaagacttacaatggtacaaatcccgacgcggcgtctagggcaatcgactacgtgcaacgacaactccactgctgcggcatccacaattatagcgactgggagaatacggactggttcaaggaaaccaagaaccaaagcgtgcctctgtcctgttgcagagagaccgcttcaaattgtaacggatctctcgcccatcctagcgacctctatgccgagggatgcgaagccctggtagtcaagaaactacaggagatcatgatgcacgttatctgggccgccctcgcattcgcagctatacagctgctgggaatgctgtgcgcttgcatagtcctgtgccggcgtagccgcgaccctgcatatgaactcttgataacaggcgggacttatgcctag

SEQ ID NO: 137633 - DNA, 633 bp, Artificial Sequence
  Description of Artificial Sequence: Synthetic coding sequence
atggtctgcggcggattcgcgtgctctaagaacgccctctgcgcactaaacgtggtgtacatgttagtctcgcttctcctcattggggtcgccgcttggggaaaagggctgggcctggtttcttccatacacattatcgggggggtgatcgcagtcggagtttttctgttactcattgctgtagcaggcctcgtaggagctgtaaaccaccatcaagttctgctctttttctacatgatcattctgggcctggtcttcattttccagttcgttatctcgtgctcctgtctggccatcaaccgaagcaagcagaccgatgtcatcaacgctagttggtgggtaatgtccaataagacacgagatgaactggagcgctcatttgactgttgcggtctctttaacctgacaacattgtaccagcaagactatgacttctgcaccgccatttgtaagtctcaaagcccaacgtgtcaaatgtgtggcgaaaaattcttgaagcactctgatgaggcactcaagattctcggaggcgttgggctgtttttcagcttcacggaaattttaggcgtgtggctagccatgaggttccggaaccagaaggatccacgagccaacccaagtgcgttcctttag

SEQ ID NO: 137634 - DNA, 963 bp, Artificial Sequence
  Description of Artificial Sequence: Synthetic coding sequence
atgggcccatggagcagagtacgagtagctaaatgtcagatgcttgtgacctgtttttttatattgcttctggggctgtcagtcgctacaatggtgacacttacctatttcggggcccactttgctgtgatcaggagagcctctctggagaaaaatccatatcaggccgtccaccagtgggcctttagtgctggtttatcccttgttggcctactcactttgggtgcagtgctttcagctgctgccaccgtgcgcgaggcacagggcctcatggcaggtgggttcctgtgcttctcactggccttttgcgcgcaggtgcaggtggtgttttggcgactacactctcccactcaagtagaagacgctatgctggacacgtatgacctcgtctacgaacaggccatgaaagggactagccacgttaggcgccaggagctagcagccatacaggacgtcttcctgtgctgtgggaaaaagagtccattcagtagactcgggagcacggaggccgatctgtgccagggggaagaggctgctagagaggactgtctccaaggaatccgttcctttctccggactcatcagcaggtggcaagctctctgacgagcattgggctagcgctcaccgtttccgccttgcttttctccagttttctctggttcgccatccgctgcggatgctcgctggaccgtaagggaaagtacacccttaccccacgcgcgtgtggcagacagccccaagagccgtcgttactccggtgctcccaaggaggacccacacactgcctccactctgaggcggtcgcaattggcccacgtggttgctctgggagtctgcggtggctacaggagtccgatgccgcccccttaccactatcctgccaccttgctgcccaccgagccctgcagggacggagccgtggaggcctcagcggatgtccagagcgtggcttgtcagattag

SEQ ID NO: 137635 - DNA, 762 bp, Artificial Sequence
  Description of Artificial Sequence: Synthetic coding sequence
atggggccttggagccgcgtccgggtcgccaagtgccagatgctggtgacctgtttttttattctgctactggggctgtccgtcgctaccatggtgacgctcacttacttcggggcacatttcgctgttatccgaagggcctctctggagaagaatccctaccaggctgtgcaccagtgggccttctccgcaggtctgtcactagttgggcttctcacactgggcgcagtgcttagtgccgcagccactgtcagggaagcccagggcctgatggcgggaggctttctctgcttctcccttgctttttgcgctcaagtgcaggtggttttttggcgcctccacagcccgacccaggtggaagatgcgatgttagacacttacgatctggtgtatgaacaggccatgaaaggaacaagtcacgtacggcgacaggaactggcggctattcaggacgtgtttctctgttgcggcaagaaatcacccttctcacggctgggatcgaccgaagctgatctctgccaaggggaggaagcggctcgggaggactgcttgcaggggattagaagcttcttaaggacgcaccagcaagttgcttccagtttaacctctataggcctcgctctgacagtgtcagctttgttattctcaagtttcctctggttcgccattaggtgtggctgctctttggaccgcaaaggaaaatacaccttgactcctcgaagccctggccagaagtccaggtgggcccaatgggtgccctag

SEQ ID NO: 137636 - DNA, 525 bp, Artificial Sequence
  Description of Artificial Sequence: Synthetic coding sequence
atggcaataggcttcgtgggctgtcttggggcaatcaaggagaataaatgtctgctgctcacctttttccttctgctgctgctggtttttctgctcgaagctactattgctattctcttcttcgcgtacacagacaaaatcgaccgctatgcccaacaggacctgaaaaaagggttacacctctatggtacacagggtaatgtcgggctgacaaatgcttggtctattatccagactgacttccggtgttgcggggtctcaaactacacagactggtttgaggtgtacaatgccacccgggtccccgatagctgttgccttgaatttagcgagagttgtgggttacacgcgccaggtacatggtggaaagcaccatgctacgagaccgtaaaagtgtggctgcaggaaaatcttctggctgtagggatctttgggttatgtaccgcgctcgttcagatattgggactcacgtttgcgatgacaatgtactgtcaggtcgtcaaggcagacacctactgtgcctag

SEQ ID NO: 137637 - DNA, 717 bp, Artificial Sequence
  Description of Artificial Sequence: Synthetic coding sequence
atggcaagggcctgcctgcaggcggtcaaatacctgatgtttgcttttaatctgctgttctggctgggtggctgcggcgttcttggcgtgggtatctggctggcagccacacagggctcttttgcgacactgtcatcctctttcccgtccctctccgccgccaatctgttgataattaccggcgctttcgttatggcaatcggcttcgtcggctgcctgggagctattaaggaaaacaagtgtctcctgctgaccttcttcctgctcctgctgttagtctttctcctcgaggccacaatcgccattctcttctttgcttacactgacaagattgacaggtacgcacaacaggacctcaagaagggccttcacctgtacgggacccagggaaacgttggactgactaacgcgtggtcgataatccagaccgattttaggtgctgcggagtatcgaattataccgattggtttgaggtgtacaacgctacaagagttcccgacagctgttgcctggaatttagtgaatcctgcggattgcatgctccaggcacttggtggaaagctccatgttatgagactgtaaaagtctggctccaggaaaatctgctggctgtgggcatctttggtctatgcacagccctcgtacagattttggggctcacatttgccatgactatgtattgtcaggttgtgaaggcagatacatattgtgcttag

SEQ ID NO: 137638 - DNA, 717 bp, Artificial Sequence
  Description of Artificial Sequence: Synthetic coding sequence
atggctagggcatgcctccaggccgtcaagtaccttatgtttgcttttaatctgctcttctggttagggggctgcggcgtgcttggagtcggcatctggctcgctgccacacaaggaagcttcgcaaccctctcctcatctttccctagcctctcagctgctaatttgcttattattaccggtgcctttgtgatggccattggatttgtgggctgtctgggggccatcaaggaaaacaaatgtctcctgctcactttcttcctattattgctgctcgtatttcttcttgaggccactatcgctatcctgtttttcgcatataccgataagatcgacaggtacgcgcagcaagatctgaagaaaggcctgcatctgtacgggacacaaggcaacgtgggcctgaccaacgcctggagcattattcagacagactttaggtgctgtggggtgtctaattatactgattggttcgaggtctacaatgccaccagagtgcccgacagctgctgccttgaatttagtgaaagctgcggcctgcacgcccctgggacttggtggaaggccccctgttatgaaaccgtgaaagtatggctacaggaaaaccttctcgccgtcgggatttttggtctgtgcaccgccctggttcagatcctgggccttactttcgcgatgacgatgtactgccaagtagtgaaagccgatacctattgcgcgtag

SEQ ID NO: 137639 - DNA, 717 bp, Artificial Sequence
  Description of Artificial Sequence: Synthetic coding sequence
atggcccgcgcctgcttacaggctgtcaagtacctgatgttcgcgtttaacctcctcttttggttggggggctgcggagtcctcggcgtggggatttggctcgcagccacccagggaagctttgccactcttagctcctctttcccctccctttccgcggcaaacttactcatcatcaccggagcatttgtgatggctattgggtttgtgggttgtttgggagcgattaaggaaaataaatgccttttgcttactttctttctcttactactactggtgttccttcttgaggctacgatagcaatcttgtttttcgcttacacagacaagatagatagatatgcacagcaggacctgaagaagggcctgcatttgtacggcactcagggcaatgtcggcttgacgaacgcctggagtattattcaaaccgattttcgctgctgtggggtttcaaactacactgattggttcgaggtgtacaatgccactagggtcccggacagctgctgcctcgagttttcggaaagctgcggcctccacgctcccggtacgtggtggaaggcaccatgttatgaaacggttaaggtgtggctgcaggagaacttgcttgctgtcgggattttcggactatgtactgcactggtacagattttgggcttaaccttcgccatgacaatgtactgccaagtcgtgaaggcagatacttattgtgcatag

SEQ ID NO: 137640 - DNA, 717 bp, Artificial Sequence
  Description of Artificial Sequence: Synthetic coding sequence
atggcaagagcgtgcctccaagctgtcaaatacttgatgtttgcctttaacctcctgttctggttgggaggctgcggggtgctgggggtgggcatctggcttgccgccacccagggaagttttgcaactctgagcagctcatttccctccctctcagccgccaatttacttattataacaggcgcctttgtaatggcaatcggcttcgtcggatgcttaggggctataaaggaaaacaaatgcctcttgctaacctttttcttactgctgctgctggtattcctcctcgaagcaacaattgccatcctattcttcgcttatacagataagatcgacagatacgctcagcaggatctgaaaaaaggacttcacctgtatggcacacaaggtaacgtcgggttgacaaatgcctggtcaataattcagaccgatttccggtgctgtggcgtgtctaattataccgactggttcgaagtgtacaatgcgacaagagtaccggactcctgttgtctggaattctcagagtcctgtggacttcacgcaccaggaacctggtggaaagcaccctgttatgagaccgtcaaggtgtggttgcaggaaaatttgctggctgtcggaatcttcggcctgtgtacagcactggtgcagattcttggcctgacctttgccatgaccatgtactgccaagtggtaaaagccgacacttattgcgcctag

SEQ ID NO: 137641 - DNA, 717 bp, Artificial Sequence
  Description of Artificial Sequence: Synthetic coding sequence
atggccagagcttgtctccaggctgtcaagtatctgatgtttgcttttaaccttctcttctggttgggagggtgcggcgtgttgggagtcggtatttggcttgcagccacacaggggtcatttgctacactgtcgagcagtttcccctcgctctcagccgcaaacctactcatcattaccggcgcgtttgtcatggccatcggattcgtcggctgcctcggggccatcaaggagaacaagtgtttgctgctgacattttttctgctccttttgcttgtattcctgctcgaagcaacaattgctattcttttttttgcctatacagataagattgaccggtacgcccagcaggaccttaaaaaaggacttcacctctatggcacacaggggaacgtcggactcactaacgcatggagcatcattcaaacagatttccgatgctgcggggttagcaattacacagactggtttgaagtttataacgctactcgcgtgcccgattcttgttgcttagaattctcagagtcctgcgggttgcacgcgccaggtacatggtggaaagccccctgctacgaaacggtaaaagtgtggctgcaggaaaatctgttggctgtgggaatctttgggctatgtacagcactagtccagatcctaggactcaccttcgcaatgaccatgtactgccaggtcgtcaaagcggatacgtattgtgcttag

SEQ ID NO: 137642 - DNA, 774 bp, Artificial Sequence
  Description of Artificial Sequence: Synthetic coding sequence
atgacaccaagatccgccgggaccagtgcacacggagctgagctgaagcgctgtgggatggcccgcgcatgcttgcaggccgtcaagtatctcatgttcgctttcaacctacttttttggctgggggggtgcggggtcttgggcgttggtatttggttagcagcgactcagggatcattcgcaaccctatcttcatcttttccttccctgtcagcagccaacctcttgatcattacgggcgcttttgttatggctatcgggttcgtgggatgcctgggcgccatcaaggagaataaatgcctattgctcactttcttcctgctgttgctcctcgttttcctgttggaagccacaattgccatcctgtttttcgcatatactgacaagatcgacagatacgcccagcaggatctgaaaaagggcctgcacctgtacggtacacagggaaatgtagggctcactaatgcttggagtataatacagaccgatttcaggtgctgcggggtatccaattacaccgactggttcgaggtctacaatgccacacgcgttcctgatagctgttgtctggaatttagcgagtcctgcgggctgcacgctcccggaacgtggtggaaagctccctgctatgagacagtcaaggtatggctacaggaaaatctgttggccgtggggatttttgggctgtgcacagctttggtgcagatcctgggactaaccttcgccatgactatgtattgccaggtagttaaagctgacacatactgcgcttag

SEQ ID NO: 137643 - DNA, 717 bp, Artificial Sequence
  Description of Artificial Sequence: Synthetic coding sequence
atggcacgggcgtgcctccaagccgtcaaatatctaatgttcgcctttaacttgctgttctggctgggtggctgcggggtgcttggcgtggggatttggctggcagccactcagggcagctttgcgacgctttcttctagcttcccctccctgagcgcggccaatctccttataattaccggtgccttcgtgatggctattggcttcgtggggtgtctcggtgctataaaagagaataagtgtttgctcctgaccttttttctgctgctgttgctggtgtttcttctcgaagccaccatcgctattctgtttttcgcttatactgataagatcgaccgctatgcgcagcaggacctgaagaaagggttgcacctgtacggtacccagggcaatgtcggcctcactaatgcatggtcaatcatccagacggacttcaggtgctgcggcgtttctaactataccgactggttcgaagtctataacgccactagggtacctgacagttgctgtctcgagtttagtgagagctgcggactccatgctccagggacatggtggaaggccccctgttacgaaactgtcaaggtctggctccaggagaacctactggctgtcggcatcttcggtctgtgcacagctctggtgcagatcctaggactgacttttgctatgactatgtattgtcaagtggtaaaagccgatacatattgtgcttag

SEQ ID NO: 137644 - DNA, 525 bp, Artificial Sequence
  Description of Artificial Sequence: Synthetic coding sequence
atggcaattggctttgtggggtgtctgggagccatcaaagaaaataaatgcttattgctgaccttcttcttgcttctgctactggtgtttctcttggaggcaaccatcgccatcctgttttttgcctacacggataaaattgatcgatatgcacagcaggacctgaaaaaggggttgcatctatatgggacacaggggaacgtcggattgaccaacgcctggtccatcattcagacagattttagatgctgtggcgtgagtaattacacagactggtttgaggtctacaacgcaacaagagtgcccgactcttgctgccttgaattctcggagtcctgcggactgcacgccccaggtacttggtggaaggctccttgttatgagacagtcaaagtttggttgcaggagaacttgctcgctgtagggattttcggactgtgcactgcactggttcagatcctgggtcttacatttgctatgactatgtactgccaagtcgtcaaggctgacacttattgtgcttag

SEQ ID NO: 137645 - DNA, 303 bp, Artificial Sequence
  Description of Artificial Sequence: Synthetic coding sequence
atggctatcggtttcgtcgggtgcctgggagccattaaggagaacaaatgtctgctgctgacctttttcctcctcctgctgttggtctttctgctggaagccacaatcgccattttgttcttcgcctacaccgataaaattgacagatatgctcaacaggacctgaaaaaggggttgcacctgtatggcacccagggcaatgtcggactaacaaatgcttggagtatcattcagaccgattttagatgctgcggtgtctctaactacacagattggttcgaagtgtacaatgccaccagatag

SEQ ID NO: 137646 - DNA, 480 bp, Artificial Sequence
  Description of Artificial Sequence: Synthetic coding sequence
atggctcgggcgtgtttacaagcggtcaagtacctgatgtttgcctttaatcttctattttggctcggtgggtgtggtgtcttgggggtgggcatctggcttgctgcaacgcagggaagtttcgctactttgagcagctcttttccatcactcagcgctgctaacctgttgattatcaccggcgcgttcgttatggcgatcggcttcgtgggttgtttgggggcgatcaaggaaaacaagtgtctcctactaacgttctttctgctgctcctattagtgttccttctggaagctaccattgctatcttgttcttcgcctacactgacaaaattgaccgttacgctcagcaagaccttaaaaagggacttcacctgtacgggacgcagggcaatgtcggactgaccaacgcttggtcaattatacagacggatttcaggtgctgcggcgtctcaaattatactgattggtttgaggtatag

SEQ ID NO: 137647 - DNA, 258 bp, Artificial Sequence
  Description of Artificial Sequence: Synthetic coding sequence
atggctcgggcttgcttacaagctgtgaaatatctcatgttcgcttttaacctcttgttttggcttggggggtgtggtgtgttgggtgtaggtatctggttggccgcaacccaaggcagtttcgctacactgtcttctagcttccctagtctgagcgcggctaaccttctgatcatcaccggagcctttgtcatggccatcgggtttgtaggctgcctgggcgcaataaaggagaacaagtgtctcttacttacctag

SEQ ID NO: 137648 - DNA, 807 bp, Artificial Sequence
  Description of Artificial Sequence: Synthetic coding sequence
atgtcagggaagcactataaaggacctgaagtgagttgctgtataaagtattttatcttcgggtttaacgtcattttctggttcctaggcatcacatttctgggcattggactgtgggcgtggaacgaaaaaggtgtcctgtctaatatctcgtccatcaccgacttagggggatttgacccagtgtggctgttcctggtggtcggaggagttatgttcatattgggatttgccgggtgcatcggagctctcagagagaacacattcctgttgaaattcttttctgtgttcttgggcattatcttctttctggagctcacagctggtgtcctggccttcgtgtttaaggattggatcaaggaccagctgtatttctttatcaataacaatattcgcgcctaccgagatgatatcgatttgcagaacttgattgatttcacgcaagagtactggcaatgttgcggcgccttcggagcagacgactggaacctgaacatttatttcaattgcacagattccaacgcctccagagaacggtgtggggtcccattcagctgctgcacaaaggaccctgcggaggacgtcattaacacacagtgcgggtacgatgcaagacagaagcccgaagtcgatcagcaaatcgtcatctatactaagggatgcgtgcctcagttcgagaaatggctccaggacaatttaacgatcgttgccggaatcttcatcggcatcgctctcctgcagattttcgggatatgccttgcacagaatctcgtcagtgacatcgaggctgtgagagccagttggtag

SEQ ID NO: 137649 - DNA, 594 bp, Artificial Sequence
  Description of Artificial Sequence: Synthetic coding sequence
atgttcatcttgggattcgcgggatgtataggcgctctaagagagaacacatttctgcttaagttcttctctgtatttctcggtattattttcttcctggagctgactgccggcgtcctggcattcgtgtttaaagattggatcaaagatcagctgtatttcttcatcaacaacaatatacgcgcataccgagatgacatcgacctgcagaaccttatagacttcacacaggagtactggcagtgctgtggcgctttcggggctgacgattggaatctgaatatttatttcaactgcaccgattctaacgcctccagggagcgctgcggtgtcccattctcatgttgcacaaaagatccagctgaggacgtgattaacacacagtgtggctacgacgcacgccagaagcccgaggtcgatcagcagatcgtaatatataccaaaggctgcgtgccacagtttgaaaagtggcttcaggacaacctgactatcgtcgccggcatctttatcggcatcgccttgttacagatcttcggcatctgtctcgcccaaaatctggttagcgatattgaggcagtgcgcgcgtcttggtag

SEQ ID NO: 137650 - DNA, 801 bp, Artificial Sequence
  Description of Artificial Sequence: Synthetic coding sequence
atggcctctcgtagaatggagacaaagcccgtcattacatgcctcaaaaccctactgattatctactcatttgttttttggaaagaaaaagctgccggattttgcggtagacaggatgtggccatggccctgatcaccggagtcatcctgcttgcagtaggggtatggggcaaactgacactgggaacttacattagtctgattgctgaaaattcgacaaatgccccctacgtgttgatcggaaccggcacaaccatcgtagtgtttgggttgttcgggtgcttcgccacctgtagaggaagcccctggatgctgaaactttatgcaatgtttctctcattggtatttctggcagagttagtggccggcatcagcggattcgtttttaggcacgaaattaaagacacattcctcagaacatacaccgatgcgatgcagacctataacgggaatgatgaacgatctcgggccgtggatcacgtccaacgctccttaagctgctgcggtgtccaaaattacacaaattggagcacgtctccatattttctggagcacggcatccctcccagttgctgtatgaacgagacagattgcaacccccaagatctgcacaacttgaccgtggctgcaacaaaggtcaaccagaaagggtgttacgatctggtgaccagctttatggaaacaaatatggggatcatcgctggagtcgcattcggtatagcattctcccagttgatcgggatgcttcttgcatgttgcctgagcaggttcattacagctaaccagtacgaaatggtgtag

SEQ ID NO: 137651 - DNA, 750 bp, Artificial Sequence
  Description of Artificial Sequence: Synthetic coding sequence
atggctagtcgaaggatggagaccaagccagttatcacttgcttaaagaccctactgatcatctactcctttgtgttttggattacgggggtcattttgttggccgtcggagtgtggggaaaactgacattaggaacatacatctcacttattgccgaaaactctaccaatgccccatacgttcttataggaactgggaccaccatagtggtgtttggcctgtttgggtgcttcgcaacttgccgaggcagtccctggatgctgaagttgtacgcaatgttcttatcactagtgttcctggccgagctggttgcgggtataagtggttttgtgtttagacacgaaatcaaggacacgttcctgagaacttacacggatgccatgcagacttacaatggcaatgatgaacgtagcagagccgtcgatcatgtccagaggagcctttcttgctgtggggtccaaaattatacgaattggtccacttccccatactttcttgagcacggtatcccaccgtcctgctgtatgaacgaaaccgactgcaatccccaggatctccataaccttaccgtggcagccactaaagtcaaccagaagggctgctacgatctcgtgacttcttttatggaaacaaacatgggtattatcgccggagtggcttttggcatagcattcagtcagctgatcggaatgctgctggcgtgttgcctcagtagattcatcaccgctaatcagtacgagatggtctag

SEQ ID NO: 137652 - DNA, 828 bp, Artificial Sequence
  Description of Artificial Sequence: Synthetic coding sequence
atggccaacagaaccgtgtgcaatggccagggccggagtcgggatctgcttcggatcaaaaacatcccaaatgctcccggtcattttctcatagctggagttgggggcagttcatctcagggccgtagcattgaggaggagggcaaaactcacctgggtatcactggcgtcatcttgctggccgtgggcgtttggggcaagctgacgctggggacatacatttcactgatcgcagagaattctactaatgccccctacgtccttataggaactggcactacaattgttgtgtttggactatttggttgttttgccacatgccggggctccccatggatgcttaagttgtatgccatgtttctgtctttggtgttcctggctgagctggttgcaggtatttcggggttcgtctttcggcacgagataaaggacacttttcttaggacttatactgatgccatgcagacctataacgggaatgatgagaggtcacgtgccgttgaccatgtgcaacgctctctgtcctgctgtggagtgcagaattacaccaattggtcaacctccccatatttcctggaacatgggataccgccttcctgctgcatgaacgagacagactgcaacccccaggacttgcataatctgactgttgccgcaaccaaggtcaaccaaaagggctgctacgacttggttacaagcttcatggaaacaaacatgggcatcattgctggagtcgcgtttgggattgcatttagtcaactaatcggaatgctccttgcatgttgcttgtcccgatttataacagccaaccaatacgagatggtatag

SEQ ID NO: 137653 - DNA, 672 bp, Artificial Sequence
  Description of Artificial Sequence: Synthetic coding sequence
atgatcactggggtgattctcctggccgtcggggtgtgggggaaactgactctggggacctatatctcacttatcgccgagaacagcaccaacgcaccttacgtacttataggcacaggcacaacgattgttgtgtttggcttgttcggttgcttcgccacatgcaggggaagcccctggatgctgaagttgtacgccatgtttttgtccctggttttcctggctgagcttgtcgcaggaatctctgggttcgtattccggcatgaaatcaaagacacttttcttcggacttacactgacgctatgcagacctataatggcaacgatgagagaagtcgcgcagttgaccacgttcagagatccctaagttgctgcggcgtacagaactacacaaattggtccacctccccttacttcctagagcacggcatccccccaagctgctgtatgaacgaaacagactgtaaccctcaggatctccataaccttacagtggccgccactaaggttaatcagaaagggtgctatgacctggttacgagcttcatggagaccaatatgggcatcatcgccggagttgcctttggcattgctttcagccagctgatcggcatgcttctggcttgctgcctgagtcgattcattactgcaaatcaatatgagatggtgtag

SEQ ID NO: 137654 - DNA, 714 bp, Artificial Sequence
  Description of Artificial Sequence: Synthetic coding sequence
atggccggagtctccgcgtgcatcaagtattcaatgttcacatttaactttctgttctggctttgtggtatcctcatattggctctggccatttgggtcagagtttctaatgacagccaagcaatcttcggcagcgaagatgttggcagcagcagctacgtcgccgttgacattttgattgcggtgggcgcaattataatgatcctcgggtttctgggttgttgcggtgccattaaggaatctagatgtatgctcctgcttttctttattgggctgctgctgatactgcttctgcaggtggccacagggatcttgggcgcagtctttaagagtaaaagtgaccgcatcgtaaacgagacgctgtatgaaaatacgaagcttctctctgcaaccggggagtccgagaagcagttccaggaggctatcattgtatttcaggaggaattcaaatgctgcggcctcgtgaatggggcggctgattgggggaataacttccagcactatccagagttatgtgcgtgtctggacaagcaaaggccttgtcaaagttacaatggaaagcaagtttacaaggaaacctgtatcagtttcattaaagatttcttagctaaaaacttaataatcgtcatcggaatttcattcggtctagccgtgatcgagatcttggggctggtgttttcaatggtactttactgccaaatcggaaacaagtag

SEQ ID NO: 137655 - DNA, 714 bp, Artificial Sequence
  Description of Artificial Sequence: Synthetic coding sequence
atggcgggagtcagcgcttgcataaaatactctatgtttacttttaactttcttttttggctttgtgggatcctcatcttggcactagctatctgggtacgtgtgagcaacgatagccaggctatcttcgggtcagaggacgttggcagtagctcatacgtcgcagtagatatactcattgctgttggggctattatcatgatcctgggctttctgggatgttgcggtgcgattaaggaatccaggtgcatgctgctcttattttttatcggcctcttactaatccttctcttgcaggtcgcgactggaattctaggcgcggtgttcaaatcaaagtcagaccgcatcgtcaatgagaccctctacgagaatacaaaactgctatctgcgacgggcgagagcgaaaaacagttccaggaggcgatcattgtttttcaagaggaattcaagtgttgtggactcgtaaacggggcggcagactggggaaacaacttccagcactatcctgagctgtgtgcatgcctcgacaagcaacggccttgccaatcatacaatggcaaacaggtgtacaaagagacctgcatttcctttatcaaggattttctcgccaagaatcttataatcgttatcgggattagctttggcctagccgttatcgagattctcggactagttttctccatggtgttgtactgtcagatcggcaataagtag

SEQ ID NO: 137656 - DNA, 714 bp, Artificial Sequence
  Description of Artificial Sequence: Synthetic coding sequence
atggccggcgtgagtgcatgtatcaaatatagcatgttcacgttcaattttctgttctggctctgtgggatcctcatactggcccttgcaatttgggtccgagtatctaacgatagtcaagctatatttggaagtgaggatgtgggtagctcttcttatgtggcagtcgatattttaatagccgtcggggccatcattatgattctcggtttcttgggctgctgtggagcgattaaggagtccagatgcatgctgttgttgttttttattggcctgcttctgattcttttgctgcaagtcgccaccgggatcctgggcgccgtattcaaaagcaaaagtgaccggattgtcaatgagacgctgtacgagaacactaagctcctgagtgccacgggagagagtgaaaagcagtttcaggaggctattatagtctttcaggaggagtttaagtgttgtggtctggtaaacggcgccgcggattggggaaacaacttccagcactacccggaactatgcgcgtgtctggataaacaaagaccctgtcagtcctacaacggcaaacaagtctataaggagacatgcatctcttttattaaggatttcctggctaagaacctgatcatcgtcatcggaatttcattcgggctggcggttatagagatcctagggcttgtgttctcaatggtgctctactgtcaaattggcaacaaatag

SEQ ID NO: 137657 - DNA, 720 bp, Artificial Sequence
  Description of Artificial Sequence: Synthetic coding sequence
atggcacggggttgtctttgttgtctaaagtacatgatgttcctgttcaacctaatcttctggctttgcggttgtgggcttctaggggttgggatttggctgtccgtgtctcaggggaactttgccaccttttccccctcatttccctccctgtccgctgccaacctggtcatagctatcggaactatcgtcatggtgactgggttcttgggctgcttaggcgccattaaagagaataaatgtctgctcctcagcttctttattgtgctgctggtcatcctgctggccgagctgatacttctgatcctgttttttgtttacatggataaagtcaatgagaacgccaaaaaggatctgaaggaagggttattgctctatcatactgaaaacaatgtcgggctaaagaacgcatggaacattattcaggcagagatgagatgttgtggcgtcaccgactacaccgactggtaccccgtgcttggcgagaacactgtgcctgatagatgttgtatggagaacagtcaaggctgcggccgcaacgccacaaccccactgtggcgcactggctgctacgaaaaagtgaagatgtggttcgatgacaacaagcacgtgcttggaacggtcggtatgtgcatcttgatcatgcagatattgggcatggcatttagtatgactctgtttcagcacatccaccggaccggcaagaagtacgatgcgtag

SEQ ID NO: 137658 - DNA, 720 bp, Artificial Sequence
  Description of Artificial Sequence: Synthetic coding sequence
atggctcgcggctgtttgtgctgtctcaagtacatgatgttcttgttcaacctaattttctggctgtgtggctgtggactcctcggggtcgggatctggctctcggtttctcaagggaactttgcaacgttttctccatcttttcctagcttgtctgccgctaacttggtgattgctatcgggaccatcgtgatggttacagggtttctgggctgtctgggggctattaaagaaaataaatgtctgctgttatccttctttatagtactgcttgtcatcctgctggccgaactcattctccttatcctgttctttgtctacatggataaggttaatgagaatgccaagaaagacctcaaggaaggtcttcttctgtatcacactgagaacaatgtgggcttaaaaaatgcctggaatatcatccaggctgagatgcggtgctgcggagtcaccgactacacggactggtaccccgtgctgggtgagaacactgtgccagacagatgttgtatggagaacagccagggctgcggcagaaacgcgacaacccctctttggcgcacgggctgctacgaaaaagtcaaaatgtggtttgacgataacaaacacgtgttaggaactgtagggatgtgcattctgatcatgcagatcttgggtatggctttcagtatgacactcttccagcacattcaccgcaccgggaaaaaatacgacgcctag

SEQ ID NO: 137659 - DNA, 1044 bp, Artificial Sequence
  Description of Artificial Sequence: Synthetic coding sequence
atggccctgatgctgagcctagtgttatcgttgttaaaactgggcagcgggcaatggcaggtcttcggacccgacaaacccgtgcaggcactggtgggtgaggatgctgccttttcatgctttcttagcccaaagaccaacgccgaggcgatggaggtccggttcttccggggtcagttcagtagcgtggtgcacttataccgggacgggaaggaccagccgtttatgcagatgccccagtatcagggcagaactaaactggtgaaagactcgatcgccgaaggtaggatcagtctcagactggagaacatcactgtcctcgatgcggggctatacgggtgccgtatatctagccagtcatattatcagaaggctatttgggagttgcaagtatccgctctcggttctgtgcctttgatttcgattactggatacgtggatagagatattcaattgttgtgtcagagttcgggttggttcccacgacccaccgctaaatggaaagggccacaggggcaggacttatctacagacagcagaacaaacagggatatgcatggcctctttgatgtcgaaatttctttgacggtacaggagaacgccggcagtattagctgttctatgcggcatgcccacctgtcaagagaagtggagtctagggtacagatcggtgataccttcttcgaaccgatcagctggcatctggctacaaaggtcctgggaatcctgtgctgcggcctgttcttcggtatcgttggtctgaaaatattcttctccaagttccaatgcaagcgggagcgcgaggcttgggcgggcgccctcttcatggtgccggcgggaacagggagtgagatgcttccacaccctgccgcatctctgcttctggtgctggcctctcgaggacccggtccaaaaaaagagaatccaggcggcacaggtcttgagaaaaaagcccgaaccggccgcattgaacggaggccagagactagatcagggggggatagcggaagccgggacggaagccctgaggccctgaggttttag

SEQ ID NO: 137660 - DNA, 879 bp, Artificial Sequence
  Description of Artificial Sequence: Synthetic coding sequence
atgggcgaaaagtcagagaattgtggagttcccgaggatctcctgaatggtctgaaggtaacagacacccaagaggctgagtgcgcagggccccctgtgcctgacccaaagaatcaacattctcagtcaaaactgctgagggatgatgaagcacacctacaggaagaccagggcgaagaggaatgttttcatgattgttctgccagctttgaggaggaacctggggccgacaaagtcgagaacaaaagcaatgaggacgtcaacagcagcgagctcgatgaggagtatttgatcgagctcgaaaaaaatatgtctgacgaggaaaagcaaaagaggcgtgaagagtccacacgactgaaagaggagggtaacgaacagttcaaaaaaggggattatattgaggcagagtctagctactcacgcgccctcgagatgtgcccttcatgtttccagaaggagcggtctattctgtttagcaatagggccgcggctaggatgaaacaggacaaaaaagaaatggcgatcaacgattgttctaaggctatccagcttaacccttcatatattcgcgccattctcagaagagctgagttgtacgagaaaaccgataaactggacgaggctctggaggattataagtccattttagagaaagatcccagcatccaccaggctcgggaagcttgcatgaggttgccaaagcaaatagaggagcgcaatgagagactgaaggaggaaatgttgggcaagttgaaagatctgggaaacctggtgctgcggccattcggactcagcactgagaatttccagataaagcaggattcctccaccggtagttacagcattaatttcgtacagaatcccaataataacaggtag

SEQ ID NO: 137661 - DNA, 2199 bp, Artificial Sequence
  Description of Artificial Sequence: Synthetic coding sequence
atggacgccgacaaagagaaggatctgcagaagtttctcaagaacgtcgacgaaatatccaacctgattcaggaaatgaattccgacgacccagtcgtgcaacagaaggcagtgttggagactgaaaagcggctgctgctgatggaagaggatcaagaggaagacgaatgccggactaccctcaacaagacaatgatctcacctcctcagaccgccatgaaatctgcagaggagataaactctgaagccttcctggcgagcgtggagaaagacgcaaaggaaagggccaagaggagacgagagaacaaggtgctggctgacgccctgaaagaaaaggggaacgaagcatttgctgagggtaattatgagacagccatactgcgttattcagaggggctggaaaagctgaaggacatgaaagtactgtataccaaccgtgcccaagcatatatgaagttagaagattacgaaaaagcgctagtggattgcgaatgggccctcaagtgcgacgagaagtgcacaaaggcttatttccatatgggaaaagcaaacctggccctgaagaattattccgtgtcgcgcgaatgctacaaaaaaatcctagagatcaaccccaagctgcagactcaagtcaagggatacctcaaccaagtggatctgcaggagaaggccgacctgcaggagaaggaggcccatgaactcctggatagtgggaaaaacaccgccgtgactacaaaaaatttgctggagaccctgagcaagccggaccagatacctctgttttatgccggagggatcgagatcctgaccgagatgattaacgagtgtacagaacagacactgtttcgtatgcataacggatttagtattataagtgacaatgaagtgattcgccgatgctttagcaccgccggcaatgacgcagtcgaggaaatggtctgcgtgagcgttctgaagctctggcaagcagtctgtagcagaaacgaagaaaatcagagagtcctggtcatccaccacgacagggcaaggctgctcgccgccctgctctcatctaaggtgcttgcgatacggcagcagagcttcgcactcctcttgcatctcgcacagaccgagtcgggtaggtccctgatcattaaccatctcgatctgacccggttattagaggcactagtgtccttcctcgacttctcagacaaagaagctaacactgctatgggcctgttcaccgacttagcactcgaagagcgattccaggtgtggtttcaagcaaatctgcccggggtgttgcctgcgctcacaggagtgctgaagacagacccaaaagtatctagctcatccgctctgtgccagtgcatcgccataatgggcaaccttagcgccgaacccacaacccgacgccatatggccgcgtgcgaggagtttggcgacgggtgcctgtccctgctggcacgttgcgaggaagacgtggacctgttccgcgaggttatctatactctcctgggactgatgatgaacttgtgtctgcaggctccatttgtaagcgaagtgtgggcggttgaagtgtcacggaggtgcctgtccttgttaaactcgcaggatggtggcatcctgacaagagccgctggtgtgctgagccgcacactgtcctcgtcactgaagattgttgaggaagccctccgggccggagttgtcaaaaaaatgatgaaatttttgaaaaccggcggcgagacagcctcccgatacgccattaagattctcgcaatctgtaccaattcttaccacgaagccagagaggaggtcatcagacttgacaaaaaactttccgtgatgatgaagctgctgtccagcgaggatgaggttctcgtggggaatgcagcgttgtgtctaggaaattgcatggaggtccccaacgtggcaagttccctcctgaaaaccgatttactccaggttttgctgaagctcgccggctcggacactcagaaaactgctgttcaggtgaatgcgggcatcgccctgggcaagctatgcaccgctgagccacgagtgccagccgagagctcgcacctgcagtttggtcgcgaatctgccgcacctgaagccctgagcccccgcaggtgggaggagatgtttcatatgctggtattttccctcagcagcgttgacccaccgcccccccctccgcaaacgtgttatccctag

SEQ ID NO: 137662 - DNA, 324 bp, Artificial Sequence
  Description of Artificial Sequence: Synthetic coding sequence
atggacgccgacaaggagaaggatctgcagaagtttttgaaaaacgtggacgaaatctctaatcttatccaggagatgaactctgatgaccctgtcgtccagcagaaggcagtgttggagaccgaaaaacggctactgctgatggaagaggaccaggaggaagacgagtgcaggaccaccctcaataaaactatgatctccccaccacagactgcaatgaagtcagcggaggagattaattctgaagcgttcttagccagcgtagagaaagacgctaaggaacgcgctaaaagacgaagagagaacaaggtcttggctgattag

SEQ ID NO: 137663 - DNA, 609 bp, Artificial Sequence
  Description of Artificial Sequence: Synthetic coding sequence
atggacgccgacaaggaaaaagatctgcagaagttcctcaagaatgtggatgagatctcaaatcttattcaagagatgaactctgacgaccctgtcgtgcaacagaaagccgtccttgaaacagagaaaagactcctgcttatggaggaggatcaggaagaagacgaatgtagaaccactttaaacaaaacaatgatttcacccccacagacagctatgaagagcgctgaggagattaatagcgaagcttttctggcctcagttgaaaaagacgcaaaggagcgagccaaaaggaggcgcgagaataaggttctcgctgatgctctgaaggagaagggcaatgaagccttcgcggaaggcaattacgagactgctattttaagatactcggagggactggagaaacttaaggacatgaaggttctctacaccaaccgggcccaggcatatatgaagctcgaggactacgaaaaggcacttgtggactgtgaatgggcactgaagtgcgatgagaagtgcactaaagcttattttcacatggggaaggctaaccttgcactgaagaactattccgtatcaagggaatgttacaaaaaaatcctggagtag

SEQ ID NO: 137664 - DNA, 504 bp, Artificial Sequence
  Description of Artificial Sequence: Synthetic coding sequence
atggatgccgacaaggagaaggacctccagaagtttctgaagaacgtcgacgaaattagtaatctgattcaggagatgaacagcgatgaccctgttgtccagcaaaaggctgtcttggagactgaaaaaagactcttgttgatggaggaagatcaggaggaagatgaatgtcggactactctcaataagacaatgattagtcccccacaaaccgctatgaagtcggccgaagagatcaatagtgaagcttttctggctagtgtggaaaaagacgctaaagaacgcgcgaaacgtcggagagaaaacaaggtgctggcagacgctcttaaggagaagggcaacgaggcgttcgccgagggcaattatgaaaccgccattcttagatactccgaggggctggagaaactcaaagacatgaaggtgctatacacgaatcgcgcccaggcttacatgaagctcgaggactacgaaaaagccctcgtggattgcgagtgggcactatag

SEQ ID NO: 137665 - DNA, 2118 bp, Artificial Sequence
  Description of Artificial Sequence: Synthetic coding sequence
atggatgccgacaaagagaaggatctgcagaagtttctaaaaaacgttgatgagatctccaacttgatccaggagatgaacagtgatgatcccgttgtccaacagaaggctgtgctagaaacagagaagcgattactattaatggaggaggaccaggaagaggatgagtgcaggacgactctaaataaaaccatgatcagtccgcctcagaccgcaatgaagagtgcagaagagattaactcagaggccttcctggcctccgtggaaaaggatgctaaggaacgagccaaacgccgcagagaaaataaggttttagcggatgcgctcaaagaaaagggaaacgaggccttcgctgaaggaaattacgaaactgccatcctcaggtatagcgaggggcttgaaaagttgaaggatatgaaagtgctttacactaaccgcgcccaggcttatatgaagctggaagactacgaaaaggccctagtggattgtgaatgggcccttaagtgtgacgaaaagtgcactaaggcctacttccacatgggaaaagctaacctggctcttaagaactactctgtctctcgagaatgctataagaaaatcttggagatcaaccccaaattgcagacgcaggttaaaggctatctcaatcaagttgacttgcaggagaaagctgacttgcaggagaaggaggcccacgagctgttagacagcggaaaaaacacagcagttacaactaagaacctgcttgaaacactgtctaaaccggatcagatcccactcttctacgccggcggtatcgaaattttgaccgagatgatcaatgaatgcacagagcaaaccctttttcggatgcacaacggcttttccatcatatctgacaacgaagtgattcggcggtgcttctctacggctggaaatgatgccgtagaagaaatggtgtgtgtgtcggtacttaagctctggcaggccgtctgttccagaaacgaagagaatcagcgggtgttggtgatccatcatgaccgagctaggctgctagcagccctcctgagctcaaaggtcctggccatccggcagcagagcttcgccctgctgctgcatctagctcagacggagagcgggcgctctctgatcataaatcatcttgacctgacgaggctgttggaagctctggtgtcatttctggacttctctgataaggaagctaacactgcaatgggccttttcacagatctggctctcgaggagcgcttccaggtttggtttcaggcgaatcttccaggagtacttccggctttgactggagtgttgaagaccgaccctaaggtttctagcagctccgctctatgtcagtgtatcgccatcatgggcaatttgtccgccgagcctactacgcgtcgacacatggccgcctgtgaggagtttggagatggctgcctcagcctcctggccaggtgtgaagaggatgtagacctcttccgcgaagtgatatacaccttactcggactgatgatgaacctgtgcctgcaagcgcctttcgtttcagaggtgtgggccgtggaggtcagtagaagatgcctgtcccttctgaacagtcaggatgggggtattctgacccgagcagccggggtactcagccgcacattaagctcaagcttaaaaatcgtggaagaagccctcagagctggcgtggtgaaaaaaatgatgaagttccttaaaacaggaggggaaaccgcttctcgttatgcaataaaaatcctggctatttgcacaaacagctaccacgaagctcgcgaagaggtgattaggctcgataagaaactaagcgttatgatgaagctcctgtcctctgaggatgaagtgcttgtcggcaacgcagcattgtgcctagggaactgcatggaggtcccaaacgtggccagcagcctcctaaaaacagacctgttgcaggttctcctaaagctggcaggttctgatacccaaaaaaccgccgttcaggtgaatgctggcatcgccctgggaaaactgtgcacagccgagcctaggtttgccgcccagctgcgcaagctccatggcctggaaattctgaatagcacaatgaagtacatctctgatagctag

SEQ ID NO: 137666 - DNA, 1143 bp, Artificial Sequence
  Description of Artificial Sequence: Synthetic coding sequence
atgttcaggttgcttagctggtctcttggccggggcttcctcagagccgccggccggcgatgcagaggatgttcggctagattgctgcctggactggcgggcgggcccggcccagaggtccaagttccaccttcccgggtggcacctcacggcagaggcccaggactgcttcccctcctcgcagctttggcctggttctcccggccggcagcggccgaagaggaagaacagcagggcgccgacggggcagcagcagaggacggcgcagacgaagcggaggccgaaattatacagctgctaaagagggctaagctatccatcatgaaagatgagccagaggaggctgagctgatattgcacgatgcactgcgacttgcctaccagacagacaataagaaggcaatcacctacacatatgatctcatggccaatttggcctttatccgaggtcagttggaaaacgccgagcaactcttcaaggctaccatgtcttatctgctgggcggtggcatgaagcaggaggataacgcgataattgaaataagtctaaagttagccagtatttacgccgcccagaatcggcaggagttcgccgttgctggttacgagttctgtatcagcacactcgaggagaagatcgagagggagaaagagctggcggaggacatcatgtccgtcgaagaaaaggccaatacccacctgctgctaggaatgtgcttggacgcctgtgcccgatatttactttttagtaagcagccctcacaagcacaacggatgtacgagaaggccctccaaatatcagaggaaatacaaggcgagaggcatccccagacaatcgtgctcatgagcgacctggcaaccacactggacgcgcaaggacgatttgacgaggcatatatatatatgcagagagccagtgacctggcccgccagatcaatcacccagaactccacatggtcctttcaaacctggctgccgtgttgatgcatagagaacgatacactcaggccaaggaaatttaccaggaggcgctgaaacaggcgaaactcaaaaaagatgaaatcagcgttcagcacataagggaggagctggccgagctatccaagaaatctcggcctcttaccaactccgtgaaactgtag

SEQ ID NO: 137667 - DNA, 1143 bp, Artificial Sequence
  Description of Artificial Sequence: Synthetic coding sequence
atgttcagactcctgagctggtcccttggacgcggattcctgagagccgccggacggcggtgccgcggttgctcagccaggcttctccctggacttgctggcggaccaggacctgaggtgcaggtgccaccctctcgggtcgccccacacggccgaggaccaggcctgctgcctctgctagctgctctggcttggttctcacgtcctgccgcggcagaagaagaagagcagcagggcgctgacggcgctgctgccgaggacggggccgacgaagctgaggcagagattatccagctgttgaaaagagccaagcttagcatcatgaaggatgaacccgaagaagcggagctgatcctgcatgatgctctgaggctggcctatcagacagataataaaaaggccattacttacacatatgacctgatggccaacctggcctttataaggggacagttagagaatgctgagcagctctttaaggctaccatgtcatacctgctcggcggcgggatgaaacaggaggacaatgcgataatagagatcagccttaagctggcatccatctacgctgcgcagaacagacaagagtttgctgtcgccgggtacgagttctgcatctcaaccctcgaggagaaaattgagagagaaaaagagctggccgaagacattatgtcagtggaggagaaagccaatacgcatctccttctggggatgtgcctggacgcttgcgctcgctatctcctgtttagcaaacagccctcacaggcacagcggatgtacgaaaaagctttacaaataagtgaagaaatccaaggcgagcgccatccccaaacaatcgtattgatgagcgacctagccaccacccttgacgcgcagggacggttcgatgaggcttacatttacatgcaaagagcttccgatctggcccgacagattaatcatccagagctacatatggtcctatcaaacctggcggcggtgttaatgcaccgcgagagatacacccaagctaaggaaatatatcaggaagccctgaaacaggctaagcttaagaaagatgagatctctgtacagcacatccgagaggagctggctgaactctcaaaaaagagtcgccctttgacgaattcagtgaaactctag

SEQ ID NO: 137668 - DNA, 1506 bp, Artificial Sequence
  Description of Artificial Sequence: Synthetic coding sequence
atggctcagccccatacgacctctgtgccatattttgcaaggtcaccagcacccccgcccccaagccggagcggcgccccccctcaaccccccgcaacactgcgcccgagcaggcgacgaactagacctcctagacccgctgacagacgtgacgctcctgctgattgtgcatacctctggcgcatactgacacctcggagggggagagctcgccgaagtgacgtgggagccaggcacagggcatgtggcagacgagacgtgctgctgtccaggcaggggcctgcgaaccccgaaggcgcccggcgcgtagtgggagggcaggagagagtgtggccagctgtgcgaagggggcgcggcggatcaatgttccggctgctgagctggtctctgggccgcggattcctgagggccgccggaagacggtgcaggggatgcagcgcccgtttattaccagggttggcaggcggaccagggcctgaggtgcaggtgcctcctagccgagtcgcccctcacggacgaggtccaggactgctgcccttactagccgcgcttgcttggttttcaaggcccgctgcagcagaagaagaggagcagcaaggggccgatggtgcagcagccgaagacggtgcagacgaggcagaggccgaaatcattcagctgctcaagagagccaaactaagtattatgaaggacgaaccagaagaggcggagttgattttacacgatgccctcagactcgcgtatcagaccgacaacaaaaaagctattacctacacctatgatttgatggccaacctcgcttttatcagaggacaattagaaaacgctgagcagttgttcaaagccactatgtcctacttactcggcggcgggatgaagcaggaggacaacgccataattgagatttccctgaagctggctagcatctatgcagctcagaaccgccaggaattcgccgtggccggttacgagttctgtatctccaccctcgaagaaaaaatagaacgcgagaaagagctcgccgaggatattatgagcgtggaagagaaggcaaatacgcatctacttttgggtatgtgtttagatgcctgcgcgaggtacctgttattttccaagcaaccatcccaagcccagcgtatgtacgaaaaggcgcttcagatctcggaggaaatacaaggcgagaggcatcctcaaactatcgtgctgatgtccgacctcgcaaccaccctggacgcccaagggagattcgacgaggcctatatttacatgcaacgtgctagcgatctcgcccggcagattaaccacccagagctgcatatggttctgtctaacctggctgctgtcctaatgcaccgggagaggtacacgcaagccaaagagatatatcaagaggctctgaagcaagcaaagctgaaaaaggatgaaatcagcgttcaacatatcagagaagagctagctgagttgtcgaaaaaatcccggccgttgacaaacagcgtgaaactgtag

SEQ ID NO: 137669 - DNA, 501 bp, Artificial Sequence
  Description of Artificial Sequence: Synthetic coding sequence
tgacaggagcgggtgtggcctgccgtgcggcgcggtagaggcgggtccatgtttcgtttactctcatggtctctcgggagaggcttcttaagggccgccgggcgaagatgtcggggctgttctgccagattactgcctggtcttgccggggggccggggcctgaagtccaagtccctccgtcacgggtcgctccgcatggtaggggccccgggctgttgcctctgttagcagccctcgcctggttcagtaggcctgctgctgctgaagaggaggagcagcagggggccgacggcgccgctgctgaggacggagctgatgaagcagaggccgagatcattcagctgcttaagcgtgccaaggtgcggcgtctgagagcactgcggcccgctgagcggggaagtctgtgcgaacgagggctgggagtggccgcgcattacagcctgaggttagcagaggagtggatggaggcaccgagagtgaaactgccccgcatgtcctag

SEQ ID NO: 137670 - DNA, 3951 bp, Artificial Sequence
  Description of Artificial Sequence: Synthetic coding sequence
atggactctcaggaattgaaaacactaattaattattactgccaggagcggtactttcaccacgtgctactggtcgctagtgaaggtattaagcggtatgggagcgatcccgtttttcgtttttaccatgcatatggaacactgatggaagggaaaactcaggaagctctacgggaattcgaagcaatcaagaacaagcaggacgtttccctttgtagtctgttggctctgatttacgcccacaagatgtcgcccaaccccgaccgagaagctatactcgagagcgatgcccgggtgaaggagcagcggaaaggggcaggagagaaggcattgtatcatgcaggtctgttcttgtggcacatcggtagacatgataaagcaagagagtatatcgacaggatgatcaagatttcagacgggtcaaaacaggggcatgtgttaaaggcatggcttgacatcacccgaggcaaagagccctatacaaaaaaagccctgaagtactttgaggaggggctccaggacgggaacgacacttttgcacttctgggtaaagcccagtgcttggaaatgaggcaaaactacagcggcgcactcgagaccgttaaccagatcatcgtaaacttcccaagctttcttcccgccttcgtgaaaaaaatgaagctgcagctggccctgcaggactgggatcagaccgtggagactgcgcagcgccttctgctccaagacagtcaaaacgtggaggccctgcgaatgcaggccctttactacgtatgtcgggaaggtgatatcgagaaagcctctacaaaactggaaaatctgggtaacactctcgatgccatggagccgcaaaatgcccagctgttttataacattactctggcattcagccgcacctgcgggcggtcccaattaatcctccagaaaattcagaccctgctggaaagagcttttagcctgaacccccagcagtccgagttcgctacggagctcggataccagatgatattgcagggccgggtgaaggaagccctgaagtggtacaaaaccgccatgacccttgacgagactagcgtgagtgccctagtgggctttatccagtgtcaactcatcgaaggacagctgcaggacgcagatcaacagctcgagtttctgaatgagattcagcagtcaatcgggaaaagcgcggagctaatttacctgcatgctgtcctggccatgaaaaagaacaaaaggcaggaagaggtgattaatcttcttaatgacgtactcgatacccatttctcccaactggaggggctgcccctgggcatccaatacttcgagaagctcaatccagattttctgctggagatagttatggagtatctgtctttctgtcctatgcagcccgcctctccgggccagccactctgccccctcctccgccgatgtatctcggtgctcgaaactgttgttagaacggtgcccgggctcctgcagacagttttcctgatagcaaaggtaaagtacctgtcaggggacattgaagcagctttcaacaatcttcaacactgtttagaacacaacccgtcctacgccgacgcgcacttacttctggcccaggtttacctgtctcaggagaaagtcaagttgtgctcacagagtctggagctttgcctaagctacgacttcaaagtccgggattaccccttataccaccttattaaggcacagtctcagaaaaaaatgggggagatcgctgacgcgattaagactctgcatatggcgatgtccttgccagggatgaagagaattggggcctcaacaaaatctaaggatcgaaagaccgaggtggatactagccacagactgagtatcttccttgaactcattgatgtccaccgattgaacggcgaacagcacgaggcgacaaaagtgctccaagatgccatccacgagtttagcggcacctccgaggaagtgcgcgtgaccattgccaacgcggacctggccctagctcagggcgatatcgagcgagctctgagcattcttcagaatgtgaccgcagaacaaccgtattttatcgaagcgagagagaaaatggcggacatttatctcaagcatagaaaagacaaaatgctgtacatcacctgtttcagggaaatcgcagagcgcatggctaacccacggtctttcctcttactcggcgatgcgtacatgaatatattggaacccgaggaagcaatcgttgcttatgagcaggctttaaaccaaaacccaaaagacggtacgttggcctccaaaatgggcaaagcgctcattaaaacccacaattattctatggcaattacgtattatgaggcggccctgaagacaggccagaaaaactacttgtgctatgacctcgctgagctgctattgaagctgaagtggtatgataaagctgaaaaagtgctccagcacgcccttgcccacgaacccgttaatgagctcagcgctcttatggaagacggacgatgccaggtgttgctcgctaaggtctactccaagatggagaagctgggcgatgctatcaccgcactgcaacaagcccgggagttgcaggccagagtgctgaaacgcgttcagatggagcagccggacgccgttccagcacagaaacacctggctgcagagatatgtgcagaaatcgctaagcactccgtggcccaaagagactatgaaaaggcaataaagttttacagggaagctttagtccactgtgagaccgacaataagatcatgttggaacttgccaggttgtacttagcacaggatgatccagattcttgtcttaggcagtgcgctctgctgctccagtctgaccaggacaacgaggctgctaccatgatgatggcagacttaatgttccgtaagcaggattatgaacaggctgtgttccaccttcagcaactcttggagagaaagccggacaattacatgactctgtctcggctcatagatcttctgcgacgatgtgggaagttggaggatgtgcccaggttttttagcatggccgaaaaaaggaacagccgggccaagctagagccgggtttccagtattgtaaagggttatatctctggtacacaggagagcctaacgacgccttgagacactttaataaggctaggaaggacagagattggggccagaatgctttgtataacatgatcgaaatctgcttaaaccctgataacgaaaccgtgggtggggaagtcttcgaaaatttggatggtgacctcggaaacagcaccgagaagcaggagagcgttcagctcgcagtcagaacagccgaaaaattactaaaagaactgaaaccccagaccgttcagggccacgttcagttgagaattatggagaactattgcctcatggcaaccaagcagaaatcaaacgtcgaacaggccctgaacacattcaccgagattgcagccagcgaaaaggaacatattcctgctcttctgggcatggccaccgcctacatgatcttgaagcaaaccccaagagctagaaaccaactcaagcgaattgccaagatgaactggaatgctattgatgccgaagaatttgaaaaaagctggctcctgctggctgatatctatatccaaagcgccaaatatgatatggcagaggacctgctgaaacggtgtctgcgccacaataggtcctgctgtaaggcctatgagtatatgggctatattatggaaaaagagcaggcctataccgacgccgctctcaactatgagatggcctggaagtatagcaatcgcactaatccagcagtaggctacaaactcgcgttcaattacctgaaggctaagaggtatgttgattcaatcgatatatgtcaccaggtgctggaggcacatcctacatacccaaaaattcgcaaggatatattagataaggctagagcatccctgcggccctag

SEQ ID NO: 137671 - DNA, 765 bp, Artificial Sequence
  Description of Artificial Sequence: Synthetic coding sequence
atgattgagatatgtctgaatcccgacaacgagacagtgggtggagaagtgttcgagaacttggatggcgatctggggaactcaaccgaaaaacaggagtctgtgcagcttgctgtcagaacagccgaaaagcttctcaaagaactgaagccccagacagtgcaggggcacgtgcagctcaggattatggaaaactattgcctaatggccactaagcagaagtccaacgtcgagcaggccctcaacactttcaccgagatcgccgcgagcgaaaaggagcacatcccggctttgctaggaatggccacagcttacatgatcttaaaacagacccccagggccagaaaccaactcaaaagaatcgctaaaatgaactggaatgccattgacgccgaggagttcgagaagtcttggttgctgctggccgatatctacatccagagcgctaagtatgatatggccgaggatcttttgaagaggtgcctccgtcataaccgaagttgctgcaaggcctacgaatacatgggttacatcatggaaaaggaacaagcatacaccgatgccgccctcaattatgagatggcctggaagtattccaaccgaactaatccagcagtgggctataaactagcattcaactacttgaaggcaaaacggtatgtcgacagcatcgatatctgccatcaggtcttagaggcgcatccaacctaccccaagatccgtaaggatattctcgataaggccagggcgagtctgagaccttag

SEQ ID NO: 137672 - DNA, 6078 bp, Artificial Sequence
  Description of Artificial Sequence: Synthetic coding sequence
atggataacttcgccgagggcgatttcaccgttgccgactacgctctgctcgaggactgcccccacgtggacgactgtgttttcgctgccgagtttatgagcaacgattatgtgagagttacccagctctattgcgatggggtaggagtgcagtacaaggactacatacagtccgaacggaacctggaatttgacatttgtagcatctggtgttcaaaacctatatccgttttgcaggattactgtgacgccattaagatcaatatcttctggccccttctattccagcaccagaacagctcagtaatttccaggttacacccatgtgtggacgcgaacaactcaagggctagcgagattaatctcaagaaactgcagcatttggagctgatggaggatatcgttgacttggccaaaaaagttgctaacgacagcttcctcatcggagggcttctgaggataggctgtaaaatcgagaataagatcctggccatggaggaagccctcaactggatcaagtatgcgggggacgtcacaatcctaaccaagctgggatcaatcgacaactgttggcccatgctctccatcttctttaccgagtataaataccatatcacaaagattgtaatggaagactgtaatctgttagaagagctgaagactcagtcctgtatggattgcatagaggagggcgagctcatgaagatgaagggtaacgaagaattttctaaggaacggtttgacatcgccattatctattataccagagcaatcgaatatcggccagagaactacttgctctatggtaaccgagccttatgctttctacgcacggggcagtttcggaacgccctcggtgacggcaaacgggcgacaattttgaaaaatacctggccgaagggccactacaggtattgcgacgccctgtctatgcttggggaatacgattgggcactccaagccaatataaaggctcagaaattatgcaaaaatgatcctgaagggattaaagacctgatccagcaacatgtcaaacttcagaaacagattgaagacctacagggccggactgctaacaaggatcccattaaagctttctatgagaatcgtgcgtacactccacggtccctcagcgccccgatatttactacatccctcaactttgtggaaaaagaacgggatttccgtaaaatcaatcacgagatggccaacggggggaaccagaacctcaaagtggcagacgaagcgctaaaggttgatgactgcgattgccaccccgaattcagcccccccagtagccagccgcccaaacacaagggaaaacagaaatccagaaacaacgagtccgagaagttctcatcctcttcacctctgactcttcccgccgacctgaagaacattctcgagaagcagtttagcaaatcctcgcgggccgcccaccaggactttgctaacattatgaagatgttacgcagcctgattcaggacgggtatatggcattgctcgagcagagatgcagatccgcagcccaggctttcactgagttactgaatgggctggacccccagaagattaaacagctcaaccttgccatgatcaactatgtgcttgtcgtctatgggttggccatttccctgcttggcattggacagccagaggagctaagcgaagcggagaatcagtttaaaaggatcatcgagcactaccccagcgagggattagactgcctagcctactgcggtatcggcaaagtgtacctgaagaagaatagatttttagaggcactgaatcatttcgaaaaggcacggactctcatctataggttgcccggggtgctgacttggccaacaagcaacgtcatcattgaggaaagccagccccagaagataaagatgctgttagagaagtttgtggaggagtgcaagtttcccccagtgcctgatgccatctgttgctaccagaagtgtcacggatacagtaagatacaaatttacatcacggacccagatttcaaaggcttcatcagaattagctgctgtcagtattgcaagattgagtttcacatgaattgttggaagaagctcaagaccaccacgtttaatgataaaattgataaggactttctgcaaggcatttgtctgacccctgattgcgagggggtcatctctaaaatcattatcttttcttccggcggtgaagttaaatgcgagttcgaacacaaagtgattaaggagaaggtgccaccacgtcctatcctcaagcagaaatgctcatcccttgaaaagctacgtctaaaggaagataagaagctgaaacggaaaatccagaaaaaagaagcaaagaaactggcccaggaaaggatggaggaagatctacgggaaagcaacccccctaaaaacgaagagcaaaaggaaacagtggataatgttcagcggtgccagttccttgacgacaggattctacagtgtatcaagcagtatgccgacaagattaaatctggaatacaaaacactgccatgctgctcaaggagctcctttcctggaaagtcctttccaccgaagattacaccacctgtttctccagcagaaattttctcaatgaagccgtggactatgttattagacatctgatacaggaaaataacagagtaaagacacgtatcttcctacatgtgctctctgagctaaaagaggtcgagcccaaacttgctgcttggatccagaagctgaattccttcgggctggacgctaccggcacgttcttcagccggtatggagccagccttaagcttttggacttcagcatcatgacatttctgtggaacgaaaagtatggacacaaactggactctatagaaggcaagcagctggattatttctcagagcccgcgagcctgaaggaagctcggtgtcttatctggctattagaagaacatcgcgataagttccccgccctgcacagcgccctggacgaattctttgacatcatggatagccgatgtaccgtactgaggaaacaggattcaggggaagctcctttctcaagcacaaaggtgaagaataagtctaaaaaaaaaaaacctaaggactctaaaccaatgttggttggttcgggaaccacctcagtaacaagcaataacgagattatcacctcctcagaagatcatagtaaccgtaatagcgactccgctggaccctttgctgtgcctgaccatctgagacaagacgtggaagaattcgaagcgctgtacgatcagcattctaacgaatatgtggttaggaacaagaaattatgggacatgaaccccaaacagaagtgttcaaccttatacgactacttcagtcaatttctcgaagaacacggaccacttgacatgtcgaacaaaatgttcagcgctgaatacgagttttttcctgaagagacccgtcagatcttggaaaaagctggggggcttaagccttttttgctgggctgcccccgctttgtcgttattgacaattgcattgccctgaaaaaggtggcctctagactgaagaaaaagcgtaaaaaaaagaatatcaagacaaaagttgaagagataagcaaagccggggagtatgttagggtgaaactgcaactgaaccccgccgcacgggaatttaagcctgatgtcaagtcaaagcctgtcagtgatagttcatctgcaccagcattcgaaaacgttaaacccaaacctgtgtcggcgaacagcccgaagcctgcttgcgaagatgttaaggcgaaacccgtgtcggacaatagcagtcgacaggtcagcgaagatggccaacctaagggggtatccagtaattccccaaagccgggtagcgaggatgctaactataaacgcgtgtcatgtaatagccccaagccggttctcgaagacgtcaaacctacctattgggcccagtcccaccttgtgactgggtattgtacctatctgccttttcagcgatttgacattacccagacccctcctgcctacatcaacgtcctccccggtctgcctcagtacactagtatctacacaccacttgcatctctgtctccagaataccagctgccacggagtgtgccagttgtaccgtcctttgtggccaatgatcgggccgacaagaacgcagccgcttattttgaaggtcaccacttgaacgccgagaacgtggctgggcaccagatcgctagtgagactcaaattttggaaggctcactgggtatcagtgtcaagagccattgttcgacgggagatgctcacaccgtgctttccgaatcaaatcgaaacgacgagcattgtggcaactctaacaataagtgtgaggtcatccctgaatctactagtgccgtgacaaacatccctcacgtccagatggtggcaattcaggttagctggaacattattcatcaggaagttaacaccgagccttacaatcccttcgaggagcggcaaggtgaaatttcccgtattgagaaggagcatcaagttctacaggaccaactccaggaggtctacgagaactatgaacaaataaagctgaaaggactcgaagaaactcgagatctcgaggagaaacttaagcgccatctggaagagaataagataagtaaaacagaactcgattggttcttgcaggatcttgaacgcgaaattaaaaagtggcaacaagagaaaaaggaaattcaagagaggctgaaatccctaaaaaagaaaatcaaaaaggtatcaaatgcttcagagatgtatacccaaaagaacgacgggaaggaaaaggaacacgagcttcatctggatcagtccctggagattagcaataccctcaccaatgaaaagatgaaaatcgaggaatacatcaagaaaggtaaggaagactacgaggagtcccatcagagagctgtggccgcggaggtttccgtcctcgaaaattggaaggagagcgaggtgtacaaactccaaattatggagtcccaggccgaggcatttctgaagaagctaggtctgatcagccgagatcctgccgcctacccagatatggaatcagatatccggagttgggagctatttttgtccaacgtcacaaaagagatcgaaaaagccaagtcacaatttgaagaacaaattaaagctattaagaacggatcccgcctctctgagctgtctaaagtgcaaataagtgaattgtcttttccagcttgcaatacagtacaccctgagttgctgcctgagagctcaggggatgacggacaaggcttggtgaccagtgcatccgacgtcaccgggaatcacgccgcccttcatcgcgacccttccgtcttttcagctggagacagcccaggcgaggccccgagcgctcttctccccggcccgccccctggccagcctgaggcaacccagttaactgggccaaagcgcgcaggacaagcagccctgtcagaacgtagccccgtcgctgacagaaaacagcctgtgcctcctgggagagcagccaggtcaagccagtctccgaagaagcctttcaatagcattattgagcacctcagcgtggttttcccttgttacaactctacggagctggccggctttatcaagaaggtccggtccaaaaataaaaattccctgtccggtttatccatagatgaaattgtccagcgggtgactgagcatatcttagatgaacagaaaaaaaagaagccaaatcccgggaaggataagaggacatatgagccgtcatcagccacaccggtgaccaggtcttcccaaggatcaccctctgtagtcgtagcccctagtcccaaaaccaaaggccagaaggccgaggacgtcccagtgcgaatcgccctgggagcctcctcctgtgagatctgccacgaggtcttcaagtccaagaatgtccgagtcttgaaatgtggtcacaaataccacaaaggttgcttcaaacagtggctcaaagggcaaagcgcgtgccccgcctgtcaaggccgggatctcctgaccgaggagtctccttcaggaaggggttggcccagtcagaaccaggagctccccagctgctcatcgagatag

SEQ ID NO: 137673 - DNA, 6078 bp, Artificial Sequence
  Description of Artificial Sequence: Synthetic coding sequence
atggataatttcgccgaaggggattttaccgtggccgattacgccctgctcgaggactgtcctcatgtggatgactgcgtcttcgccgccgagttcatgagtaacgattacgttcgagtcacccagttgtactgcgatggtgtgggggtgcagtacaaagactacatccaaagcgaacgaaacttagagttcgatatctgctctatttggtgttctaagcctatttccgtgctgcaggattattgtgacgccatcaagattaatatcttctggcctctgctgttccagcatcagaattctagcgtgatttcaaggctccacccttgtgtggacgccaacaatagtagggccagtgagatcaatctgaagaagctgcagcacctcgagcttatggaggatattgtcgatctggctaaaaaagtggccaatgatagttttttgatcgggggcctgctcagaatcggctgcaagattgaaaacaaaatcctagcgatggaggaggccctaaattggatcaagtacgccggagacgttacaatcctaaccaaacttgggagtattgacaactgttggcctatgttgagtatctttttcaccgagtataagtatcatattactaagattgtgatggaggattgtaacttgcttgaggaactaaagacccagtcttgtatggactgcatcgaagagggtgagctgatgaaaatgaaagggaacgaagagttctcaaaagaacgcttcgacatagctataatttattacacgcgggccatcgaataccgaccagagaattatctgttgtacggaaaccgcgctctctgcttcctaaggacaggccaattccggaatgctctgggggatggcaaaagagccacgattctcaagaatacgtggcccaaaggacattaccgatactgtgacgcactgagcatgctcggtgaatacgactgggctctccaggccaatatcaaagcccagaagttgtgcaagaacgacccagagggcatcaaggacctaattcaacaacatgttaagctgcagaaacagatcgaagacctgcagggccgaaccgctaacaaggatcctattaaggcattctatgagaacagggcctacacacccagaagcctgtccgcccctatattcactactagcttgaacttcgtcgagaaggagagggattttcgcaagatcaatcacgaaatggctaatgggggcaaccagaatctcaaggtcgccgacgaggccctgaaagtcgacgactgcgactgtcatccggaattctccccacctagctcacagccgcccaaacataagggcaagcagaaaagtcggaataatgagtctgaaaagttctcatcttcttcccccttgactctgccagctgacttaaagaacattttagagaaacaattctcgaaaagtagtcgtgccgctcaccaggatttcgccaacataatgaagatgcttcggagcttaatacaggacgggtatatggcactcctcgagcagcggtgcaggagcgccgcccaggccttcactgagctgttgaatggtttggacccccagaagatcaaacagttaaacttagctatgatcaattacgtgctggtggtatacggtctcgccattagcctgctggggattggtcagcctgaagaattgagtgaggctgagaaccagttcaaaagaatcatcgagcactatcccagtgaaggattagactgcttagcatactgcggcattggcaaagtatacctcaaaaagaataggtttctcgaggcactgaatcacttcgagaaggccagaactctaatctataggctgcctggggtgctcacatggccgaccagtaatgtcattatagaagaatcccagccccaaaaaattaagatgctcctcgagaagttcgtggaggaatgcaaatttccaccagttcccgacgccatttgctgctaccagaagtgtcatggctactccaaaatccaaatttacattacggatccagatttcaagggtttcatccgaatttcctgttgccagtattgtaaaatcgaattccatatgaactgctggaaaaagctgaaaactaccacgttcaatgacaaaatcgataaggacttcctgcaaggaatctgcttaacccctgattgtgaaggcgtgatctccaagattataattttttcttccggaggggaagtcaagtgcgaatttgagcacaaggtcataaaggagaaggtccccccccggcccattctcaagcagaaatgttcctctcttgagaaactgaggctgaaggaagataagaagctcaagagaaagattcagaagaaggaggccaagaaactcgcccaagaacgcatggaagaggacctcagggagagcaacccgccaaaaaacgaagaacaaaaagaaaccgtggacaacgtacagcgatgtcaattcctggacgaccgaatattgcagtgcatcaagcagtacgctgacaagattaaaagcggcattcaaaacacggctatgctccttaaagagctgctaagctggaaggtgctgagcaccgaggactacacaacatgttttagttcacgaaatttcctgaatgaagctgtggactatgtgatcaggcacctgatacaggaaaataaccgggtaaaaacgaggattttcctgcacgtcctttcggaactgaaagaggttgagcccaagctcgctgcctggattcagaaattaaactccttcggtctcgatgctaccgggactttttttagtagatacggtgcatctcttaaactgctggacttctctatcatgacattcctctggaatgaaaagtacgggcacaagttggactccatagaggggaaacagctggactatttttcggaacccgcatcactaaaagaggctaggtgcctgatctggttgctggaagagcatcgagacaagttcccggcattacactcagccctggacgagttcttcgacatcatggattccagatgcacagtgttgagaaagcaagatagcggagaggccccatttagctccaccaaggtaaagaataagtcaaagaagaaaaagcccaaggacagtaagcccatgcttgttggaagtggcaccacttccgtcacttcgaacaacgagatcataacaagcagcgaggatcattccaatcggaattctgacagcgctggaccttttgcggtcccagatcatttaagacaggacgtggaggagtttgaggccctctatgaccaacatagcaatgaatatgtcgtgcgcaacaagaagctctgggacatgaaccctaagcagaaatgttctactctgtacgattacttttcacagtttctggaggagcatggccctcttgacatgtcaaacaagatgttttccgccgaatatgagtttttccccgaggagacacggcaaattctcgaaaaggccgggggtctcaagcccttccttctgggttgtccaaggttcgtggtgatcgataactgtattgctctcaaaaaagtggcctcacgccttaagaagaaacgtaagaaaaagaacattaaaacgaaagtcgaagagatttcaaaggctggggagtatgtgcgcgtcaagctgcagctgaaccccgctgcacgagagttcaagcccgacgtgaagagtaaacccgtgagcgactccagttcagcacctgcgttcgagaacgtgaagcccaaaccggtgagcgccaactcccccaaaccagcatgcgaagatgtgaaagctaagccagtgtcagataactcctcaaggcaagtgagtgaagatggccagccaaaaggagtaagtagtaattcacccaaacctggtagtgaggatgcgaactataaaagggtgtcgtgcaattcccccaagccagtactggaggacgtgaagcccacgtattgggctcagtcccaccttgtcacaggatactgtacctatctgccattccagcggttcgatatcacgcagacccctcccgcatacattaatgtcctgccaggtctgcctcagtacacgagtatatacacaccgctagcttccctgtcgccggaataccaactgcctcgcagcgtccccgttgttcccagttttgtggcgaatgacagagcagataagaatgcagccgcatattttgaaggccaccatcttaacgctgagaatgtagcaggccatcagatcgccagtgagactcagatcctggagggcagtctggggatatcggtgaaatcccattgctcaacaggcgatgctcacactgtgttgtctgagtccaatcggaatgatgaacattgcgggaactctaataacaaatgcgaggtgattcctgagtctacaagcgcagtgaccaatattccgcacgtgcagatggtagccattcaggtgtcctggaacattattcatcaggaagtaaataccgagccctacaatccgtttgaggaaagacagggagaaatcagcaggatcgagaaagagcaccaggtcctacaggaccaattgcaggaagtctacgaaaattatgaacagattaaattgaagggtctggaggaaacgagggatctggaggagaaactcaaacgccacctcgaagagaacaagatttctaaaacagagttagactggttccttcaagacctcgaacgcgagataaaaaaatggcagcaggagaaaaaggagatacaggagagactgaaatctctcaagaagaagattaagaaggttagcaatgccagcgagatgtacacacagaagaatgatgggaaggaaaaagagcatgagctgcacctggaccagagcctggagataagcaacaccctaaccaatgaaaagatgaagatcgaagaatacatcaagaaaggtaaggaggattatgaggaaagtcatcaacgtgccgttgccgcagaagtctccgtactggagaactggaaggagtctgaggtctacaagttgcagatcatggagtcacaagccgaggcattcctgaagaaacttggtttgatcagccgcgacccagccgcctaccccgacatggagagcgatatcaggtcatgggagctgttcttatccaatgtgactaaggagattgagaaagccaagtcgcaatttgaagagcagataaaagccataaaaaatggatctcgcttgagtgagctaagtaaggttcagatttcggagctatcgttcccagcttgtaatacagtgcaccctgaactgttgccagagtcttccggggatgatggtcagggtttagtgacatccgccagcgacgtgacaggcaaccacgccgcactgcatcgggacccaagtgtcttctctgcaggtgattcccctggagaggcaccgtctgctctcttacctggaccacctcctggccagcccgaagcgacacagctgactggccccaagcgtgcgggacaggccgccctgagcgagaggagcccggtcgctgatcggaagcagccggtgcctcctgggcgagccgctcgcagctctcagagcccaaagaaaccttttaattccatcattgaacacctgtccgtcgtctttccttgctacaactctaccgagctcgcagggttcatcaaaaaagtgagatctaagaacaagaattccctctccgggctgtctattgacgaaattgtccagcgcgtcactgagcacatccttgacgagcagaaaaagaaaaagcccaaccccggcaaagacaaaagaacctatgaaccttcctccgcaacaccagttacacgctcaagccagggttccccctctgttgtagtcgctcccagtcctaagacaaaaggtcagaaggcggaagacgtgcctgttcgcattgccctcggtgccagcagctgtgaaatctgccatgaggtgttcaagtctaaaaatgttagagtgctgaaatgcggacacaaataccacaaggggtgcttcaagcagtggctcaaaggacagtcagcatgccccgcttgtcagggtcgagatctgttaactgaggaatccccctcaggtagaggctggccttcccagaatcaggagctcccatcctgttcaagtcgttag

SEQ ID NO: 137674 - DNA, 6078 bp, Artificial Sequence
  Description of Artificial Sequence: Synthetic coding sequence
atggataatttcgctgagggcgattttacagtggcagattatgcattgctagaggactgtcctcacgtggacgattgcgtattcgctgcggagtttatgtctaacgactacgtccgggtgacacagctgtattgtgatggggtcggagtccagtataaggactatatccaaagcgagcgtaacctggaattcgacatatgcagcatatggtgctccaaaccaatttctgtactgcaagactattgtgatgctattaaaataaatatcttctggccattgttatttcagcaccagaatagctcagtcatctctagactgcacccatgtgtggacgccaataattctcgcgcaagtgaaatcaacttgaagaaactccagcacttagaacttatggaggatattgtcgacttggccaaaaaagttgccaatgattcatttttgataggcggtttacttagaatcgggtgcaagattgaaaacaagatcctggccatggaggaagcccttaattggattaagtacgccggcgacgtgacaattctaacgaagctgggctcaattgataattgttggcccatgctgagcattttcttcacagagtacaaatatcacattaccaagatagtcatggaagactgcaatttgcttgaggaactgaagacccagagctgcatggactgtatcgaggagggagagcttatgaagatgaagggcaacgaggaattcagcaaggaaagattcgacatagccataatttattacacacgggccatcgaatataggcctgaaaactacctgctctacggaaacagggcactgtgcttcctgcgcactgggcaatttcgtaatgccctgggagacggaaaacgtgccactatattgaaaaacacttggcccaagggacactatcggtattgtgatgcgctgtcgatgttgggcgagtacgattgggcactccaggctaacatcaaggctcagaagctctgtaagaatgacccggaaggtatcaaggacctgattcagcaacatgtgaagctccaaaaacaaatcgaggacctgcagggccggactgccaataaggatccgattaaggccttttatgaaaaccgagcatacactccccgatccttgagcgctcccatttttaccacctctctgaactttgttgaaaaagagcgtgattttaggaaaattaaccacgagatggcaaacggaggcaaccagaacctaaaggtggccgatgaggccctgaaggtagatgactgcgactgtcacccagagtttagccctccaagctcacagccaccaaaacacaaaggaaagcagaagtcccgcaacaacgagtccgagaagttcagcagttctagtcccttgaccctgccagcagatctaaagaatattctagagaagcagttctccaaatcttccagggccgcccatcaggacttcgccaatatcatgaagatgctgcgctccctcattcaggatggctacatggctcttttagagcagagatgcaggtctgcagctcaggccttcaccgagcttcttaatggattggaccctcaaaagatcaaacagcttaatcttgcaatgatcaattatgtgttggtcgtgtatggactcgctatcagcttacttggcattggacaacccgaggagcttagcgaggctgagaaccagtttaagcggatcatcgagcattatccctctgagggcctcgactgcttggcatattgtggtatagggaaagtgtacctgaagaaaaaccggttcctggaggcgcttaatcacttcgaaaaggcacggacactgatctatcgtcttcccggtgtgttaacatggccgaccagcaatgtcattatcgaggagagccagccccaaaagatcaaaatgctgctggagaaatttgtagaagagtgcaagttcccacccgtccctgatgccatctgctgttaccagaaatgccacggctattccaagatccagatctatataaccgatcctgattttaagggcttcatccgtatatcctgctgccagtattgtaaaatcgagtttcacatgaactgctggaagaaattgaagacaacaaccttcaacgacaagattgataaagactttttacaaggtatctgtctgaccccagactgcgaaggagtaatttctaaaatcattatattcagtagtggtggggaagttaaatgcgaattcgagcacaaagtgattaaggaaaaagtccctcctcgtcccatcctcaagcaaaaatgttcaagcctcgaaaaattgagacttaaagaggacaagaagttgaagcggaaaattcagaagaaagaggctaaaaagttagcccaagagcgcatggaggaagacttaagggagtcaaacccacccaagaatgaagagcagaaagagaccgtcgacaatgtgcagcgctgccagttcctcgacgataggatcctacaatgcattaaacagtacgcagataagataaagtctgggattcaaaacacagccatgctactgaaggagctgctctcttggaaggtactatccactgaggattatactacttgtttctcttctcgtaacttcttaaatgaggcggttgattacgtgattagacatctaattcaggaaaataatcgtgtgaagaccagaatcttcttgcatgtgctgtctgaactgaaggaagtcgagcctaaactcgctgcctggattcagaaacttaacagctttggtctggacgccacgggtaccttctttagccgttacggcgcctcactgaaattactggatttttcaatcatgacttttctgtggaacgagaaatacggccacaagctggactctatcgaaggtaagcagttggactatttctcagagcccgccagtcttaaagaggccaggtgcctgatatggctccttgaagaacacagggacaaatttcccgctctccacagcgccctggatgaatttttcgatatcatggactcgaggtgtactgtgttgaggaagcaggactcaggcgaagcccccttcagcagcactaaagtgaagaacaaaagcaaaaagaaaaagccaaaggattcaaaacccatgttggttggaagtggtactaccagcgtgacgtctaacaacgagattatcacatcttctgaggatcattccaataggaacagcgacagcgcagggccatttgccgtgcctgaccatctgcgccaggacgtggaggagtttgaagccctatacgaccagcattctaatgaatatgtcgtgcgcaataagaaactctgggatatgaatccaaagcaaaagtgtagcaccctctacgattatttctctcagtttctggaagagcatggacccttggatatgtctaataagatgttttccgccgaatatgagtttttcccggaagaaacccgtcaaatcctggagaaggctggtggcctgaagccttttctgctgggctgcccgcggtttgtggtcatcgacaactgcatagccctaaagaaggtcgcctccaggctgaaaaagaaacgtaaaaagaagaatatcaaaactaaagtggaagaaataagcaaggccggagagtacgttcgcgtcaaactccaactgaatcccgccgctcgggagttcaagcccgacgtaaaaagcaagcccgtcagtgatagtagtagcgctcctgcctttgaaaacgtcaagccaaaacccgtaagcgctaactcaccaaagcccgcctgtgaggacgtgaaggcaaagccagttagtgataactccagtcgacaagtctcagaagatgggcagcccaagggtgtgtcatcaaacagcccgaagccaggatcagaggacgccaactataagcgagtttcatgtaactcccccaagcctgttcttgaagacgtcaagcctacttactgggcccagagccacctcgtgacgggctactgtacctacttgccgttccagcgttttgacataacgcagactccgcctgcatacattaacgtcctgcctggcctgcctcagtatacttccatttacactcctcttgcgagtctgagccctgaatatcaactgccgagatctgtccccgttgtgccatcttttgtggccaacgacagagctgataagaatgccgctgcctactttgaggggcatcatctcaacgcggagaatgtagctggacaccagattgcaagcgagacccagattcttgagggatcattaggcatatctgttaaaagccactgttctaccggcgacgcccacactgtgctgtcagagtctaatcgcaacgatgagcattgtggaaactcgaacaacaagtgtgaggttatccctgagagcacaagtgccgtgaccaacatcccacatgtgcagatggtagccatacaggtctcctggaatattatccaccaggaagtgaacactgagccttataacccgttcgaggagaggcagggagagattagtagaattgaaaaagaacaccaagtgctccaggatcagctgcaggaggtctacgagaattatgagcagattaaactgaaaggcctggaagagacccgcgatctggaggaaaagttaaagcggcacctggaggaaaataaaatttcgaaaaccgagcttgattggtttcttcaggacctcgaaagggaaattaaaaagtggcagcaggagaaaaaggagatacaggagagattaaaaagtctgaagaagaagatcaagaaggtgagtaatgcaagcgaaatgtacacacagaagaatgatgggaaggaaaaggagcacgaactacatctggaccagagtctagaaatcagcaacacgctgaccaatgagaaaatgaagattgaagaatatatcaaaaaaggaaaggaggattatgaggagtcccaccagagggctgttgccgcagaggtctccgtgctcgaaaattggaaagaaagcgaggtatacaaacttcagatcatggaatcccaggccgaggccttcctaaagaagcttggcctcatctcgagggatcctgcagcttatccagatatggaaagcgacataagaagctgggaattgtttctttctaacgtcactaaggagattgagaaggccaagagtcagttcgaggaacaaatcaaggctatcaagaatggaagcaggctgtctgaattgagcaaagttcagatctcagagctgtccttcccagcttgtaatacagtgcatccggaactactgccggaatcctctggggacgatggacagggcctggtaacgtcagccagcgatgtgaccggtaatcacgccgctctgcatcgcgaccccagcgtattctctgccggcgactcccctggcgaagccccgtccgctcttttgcccggtccaccacccgggcagccagaggctacccaactcacggggcccaagagagcgggccaagccgctctttcggagagatcacccgtggccgatagaaagcagcctgtaccgccaggcagggccgccaggagttctcaaagtccaaagaagcctttcaacagcatcattgaacacctgtctgtggtgtttccgtgctacaattctacagagcttgctggctttatcaagaaagtgcgatccaaaaacaagaattctctgtctggtctgtccattgatgaaatagtgcagagagtcaccgagcacatcctggacgagcagaaaaagaaaaaacctaatcccggtaaagacaagcgtacctatgaaccatcttcggccacccccgtgacccgtagcagccaggggtcgccatcagtggtggttgcacctagtccaaaaaccaaaggccagaaagctgaggacgttcctgtacgcatcgctctgggtgcttcaagttgtgaaatttgtcacgaggtcttcaagagcaagaatgtgagagttctcaagtgcggccacaagtaccataaaggctgtttcaagcaatggctcaaagggcaaagcgcttgtcctgcttgccagggacgggacctactcaccgaggagagtccctcaggaaggggttggcctagccagaatcaggagctgccatcatgctccagccggtag

SEQ ID NO: 137675 - DNA, 3540 bp, Artificial Sequence
  Description of Artificial Sequence: Synthetic coding sequence
atggataactttgctgaaggtgattttaccgtcgcggactatgctctgctggaggactgcccccacgtggacgattgcgtcttcgctgcagaatttatgtcaaacgattacgtgcgtgtcacgcaactttattgtgatggggtgggtgtccagtacaaggattatatccaatccgagcggaatctggaatttgatatttgctcgatctggtgtagcaagcccatttcagtgcttcaagactactgtgacgccattaagataaacattttctggcccctccttttccagcaccaaaactcatcagtcatcagcagactccacccctgcgtggacgctaataactcccgcgcatccgaaatcaatttgaaaaagctgcagcatctggagttaatggaagatatcgttgacctggccaagaaagtggccaacgactcattcctcattgggggcttgcttaggatcggttgcaaaattgaaaataagatattggcgatggaagaagcccttaattggattaaatatgcgggagatgttaccatcctgacaaaactgggaagtatcgacaattgttggcctatgctgagtatcttcttcaccgagtacaaatatcacatcacaaagatagtaatggaggactgcaatctgttggaggaactcaaaacgcaatcctgcatggactgtattgaggaaggtgaacttatgaagatgaaggggaatgaggaatttagtaaggaaaggtttgacatcgccataatatactatacacgtgctatcgagtatcggcctgaaaactacctcctgtatgggaatagggctctttgtttcctccgcactggccagtttcgaaatgcgctcggagatgggaaacgcgcaaccatcctcaagaacacctggccgaagggccactaccggtactgcgatgccctctcgatgctgggagagtacgattgggctttacaggcgaatatcaaagcacagaaactgtgcaagaatgaccccgaggggattaaggacctgatccagcagcacgtgaaacttcagaaacaaatcgaagacctgcaggggaggacagccaataaagacccaatcaaggctttctatgaaaacagggcatatacccccaggtccctttctgctcccattttcaccacaagtcttaacttcgtggagaaagagagggactttcggaagatcaatcatgaaatggctaacgggggaaatcagaacctaaaggtcgccgatgaagccctcaaagtggacgactgcgactgccaccctgagttttccccgccatcgtcgcaacctcccaagcacaaggggaagcaaaaaagccggaataacgaatcggaaaagtttagcagttccagtcccctgacactcccagcagacctgaaaaatatcctagagaagcagtttagcaagagcagtcgcgccgcacatcaagatttcgcgaatattatgaagatgctgcgcagtcttattcaggatgggtacatggctttgctggagcagcgatgcagaagcgcagcccaggcgtttaccgaactgctgaacggtcttgacccacagaagattaaacagctgaacctggctatgataaattacgttctagtcgtgtacggcctcgccattagcctactgggaattggacagcctgaggagctgtccgaagccgaaaatcaattcaagcgcattatagaacattatccctcagaaggcttggattgcttggcttactgcgggatcggcaaggtttaccttaagaaaaatcgtttcctggaagcattgaaccacttcgagaaggcaaggacactgatctaccggctgcctggggtcctcacatggcctacgtccaatgttattattgaagagagccagcctcagaagatcaaaatgctgttagagaaattcgttgaggaatgcaaattcccccccgtaccggatgccatttgctgttaccaaaagtgccatggctacagcaagatccagatctacattacggacccagatttcaaagggtttattaggatatcatgctgtcagtactgtaagattgaattccacatgaattgctggaagaagctgaaaacaaccaccttcaatgacaagattgacaaggattttttgcaaggcatatgcctgacccctgattgcgagggcgttatctctaagatcattatttttagtagcggcggggaggtgaagtgcgaatttgagcacaaggtgataaaagaaaaggtacctccccggcccattctaaaacagaagtgcagtagccttgagaagctcagactcaaagaggacaagaaactgaaacggaaaattcagaaaaaagaagcaaagaagctggcacaagagcggatggaggaggatcttcgggaatcaaatcctcccaaaaacgaggagcagaaggagacagtggacaatgtgcagcggtgccagtttctagacgaccgaattttgcagtgcatcaagcagtacgcagataaaatcaaatcaggaatccaaaatacagccatgctgctcaaagagcttctgtcctggaaggtattgagtaccgaagactacactacttgcttttctagtcgcaattttctcaacgaggctgttgattacgtcattagacacctcattcaagaaaacaacagagtcaagactcggattttcttgcacgtactcagcgagctgaaggaggtcgagcccaagcttgccgcatggatacaaaaattgaactcattcggcctggatgcaactgggactttctttagtagatatggggcaagcctgaagctgctagacttcagtatcatgaccttcctttggaacgagaagtacgggcataagctggacagcatagagggcaaacaacttgactacttttctgaaccagccagcctgaaggaagcacggtgtctcatatggctgctggaggagcaccgggataaattccccgccctacactcagctctggatgagttcttcgacatcatggattctcggtgcacagtgctgaggaaacaggactccggcgaggctccattcagttctaccaaggtgaaaaacaaatccaagaaaaagaagcccaaggattctaagccaatgctagttggcagcggcacaacctccgtcactagtaacaatgagatcatcacgagtagcgaggaccactcaaatcgtaatagcgactcggcaggacctttcgcagtccctgatcacttacggcaggacgtggaagagttcgaggccctgtatgatcagcattccaatgaatatgtggtcagaaacaaaaaactgtgggacatgaatccaaagcagaagtgttccacactgtatgattatttcagtcagttcctcgaagaacatggccccctcgacatgtcaaacaagatgttctccgccgagtacgagttttttccggaagagacacgacagatcttggaaaaggcaggcggccttaagcctttcctgctgggctgtccgcgcttcgtggtgatcgataactgcatagctctcaaaaaagttgcctctcgtttgaagtag

SEQ ID NO: 137676 - DNA, 2343 bp, Artificial Sequence
  Description of Artificial Sequence: Synthetic coding sequence
atggataacttcgccgagggtgactttacagtggccgactacgccctgctggaggattgtccacacgtggacgactgcgtttttgcggccgagtttatgtcgaacgattatgtgcgtgttacgcagctgtactgcgatggagtgggagtgcagtacaaggactatatccagagtgaaaggaacctggagttcgacatctgcagcatatggtgtagtaagcctatcagtgttctgcaggactattgtgatgcaattaagatcaacatcttctggcctctattgtttcagcatcagaactcaagcgtgatttctcgtcttcatccctgtgtggacgcaaataactccagggcctctgaaattaatctgaaaaaattgcagcatctagagctaatggaagatatcgtggatttggccaagaaagtagccaacgacagcttccttatcggcggcttgctacgcataggatgcaaaatcgagaataagatacttgctatggaggaagctctgaactggatcaagtatgccggggatgtaacaatcctgaccaagttgggatctatcgacaattgttggcctatgctgtctatattttttaccgagtacaaataccatatcactaagatcgtcatggaagattgtaacctgttagaggagctgaaaacacagtcttgcatggactgcatcgaggaaggcgaactgatgaagatgaaggggaatgaagagttcagcaaggaacggtttgatatagccatcatctactacaccagggctattgagtaccgacccgaaaattacctgctctacggtaatcgggctctctgcttcctgcgaaccggccagttccgtaatgcgctaggtgacgggaagcgggccacgattctgaaaaatacgtggccaaaaggacattatcgttattgcgacgccctctcaatgctgggcgagtatgactgggctctccaggctaatattaaggctcagaagctgtgcaaaaatgatccagaggggataaaagatctgatccagcagcacgtcaagctccaaaaacagatcgaagatcttcaggggaggacagcgaataaagatccgattaaggccttttatgaaaatagggcgtataccccccggagcctgtcggctccgatctttacaacttcactcaactttgtcgaaaaggagagggatttccgtaaaatcaaccacgaaatggccaacgggggcaaccaaaacttgaaagtcgccgacgaagctctcaaggttgatgactgcgactgccaccctgaattctccccgccaagctcccagcccccaaaacacaaaggaaagcaaaagagtaggaataacgaaagcgaaaaattctcatccagctcccctctgactctaccagctgacctgaagaacattctagagaaacagttctcgaaatccagccgagctgctcaccaggatttcgccaatatcatgaagatgctgcgatcactgatccaggatggctatatggcacttctggagcagaggtgtcgctctgctgctcaggccttcacggagctgctgaatggcctggaccctcagaagatcaagcagctgaatttagcgatgatcaactacgtgttagtggtgtatggtcttgcgatcagtcttttaggaatcggccaaccagaggaactgtctgaagccgagaaccagttcaaacgcatcattgagcactacccctccgagggcctagactgcctggcctactgcgggatcgggaaagtgtatctgaaaaagaataggttccttgaagcactcaaccactttgaaaaggcccgcaccctgatctaccggttacccggagtgctgacctggccgacctccaacgtgattatcgaggagagtcagccccaaaaaattaagatgctattggaaaagttcgtcgaggaatgtaagttcccacctgtgccagatgctatctgttgttaccagaaatgccacgggtactccaaaatccagatctatattacagaccctgactttaaagggtttatcaggatctcttgttgtcagtactgtaagattgagtttcacatgaattgttggaaaaagctcaagaccacgacgtttaacgataaaatcgacaaagatttcttgcaaggaatttgcttgacacctgactgcgagggagttatttccaagattattattttttccagtggtggggaggtcaagtgcgaattcgagcataaggtgatcaaagaaaaagtgcccccccgcccgatactaaagcaaaaatgctcaagtctcgaaaagctccgtctgaaggaggacaaaaagctgaaaagaaagatccaaaagaaggaggcctag

SEQ ID NO: 137677 - DNA, 1839 bp, Artificial Sequence
  Description of Artificial Sequence: Synthetic coding sequence
atgttgggcgagtacgattgggctttgcaggccaatattaaagcccagaagctttgtaagaacgaccctgagggcatcaaggatctgatccagcagcacgtcaagctgcagaagcagatagaggacctccagggccggactgcgaataaggaccctatcaaggcattttacgaaaatagagcatacactcccagatccctaagcgcaccaatttttacaacatccctgaactttgtggagaaggagcgcgactttaggaaaattaatcatgaaatggccaatggagggaatcagaaccttaaggttgcagatgaggccctaaaggtggacgactgtgactgtcatccagaattttctcctcctagttcacagccccccaaacacaagggaaagcagaaaagccgaaacaatgagtctgagaagttcagttctagcagcccgctgaccctgccagcggatctaaaaaacattctcgaaaaacaattttctaagagctctagagcagcgcatcaggattttgcaaatataatgaaaatgcttagatcgctcatccaggatgggtatatggctctgcttgagcaacggtgccgcagcgcggcccaggcctttaccgaactgctgaacgggctggatcctcagaaaatcaagcaactgaatctagcgatgataaactacgtgctggtggtgtatgggctggccatctcattgctgggcatcggccagccagaggaattatcagaggctgagaaccagtttaagcgaattatcgagcattatcctagcgagggactggactgcctggcttattgtgggataggcaaagtgtatctgaagaaaaatcggtttctcgaagccctcaatcactttgaaaaagcccggacactcatttaccggttgccaggcgtgctcacttggccgaccagcaatgtaattattgaagagtcacagccccaaaagataaaaatgctgttggaaaagttcgtggaagaatgtaaatttcccccggtgccagacgcaatatgctgttaccaaaaatgccatggttactctaagattcagatctacattacggaccctgactttaagggattcatccgcatttcttgctgtcagtattgtaagatcgaattccacatgaactgttggaagaagcttaaaacaactaccttcaatgataaaatcgacaaggacttcttgcagggtatttgcctcactcctgactgcgagggcgtgatctctaaaatcatcattttcagtagtggcggcgaggtgaaatgcgagttcgagcacaaagttattaaagagaaagtgcccccgcgtcccattctcaaacagaagtgctccagtctggaaaaattgaggctgaaggaggacaaaaagctaaagcgcaagattcagaagaaagaagccaaaaaacttgcccaagagcgaatggaagaagacctcagggaatctaatcctcctaagaatgaggaacaaaaggagaccgttgataacgtgcagcgctgccagttcctggacgacaggatcttacagtgtataaagcagtatgctgacaagatcaaatccgggattcaaaatactgccatgttattgaaagagctgctatcttggaaagttctcagcactgaagactatacaacatgcttttcctcaaggaattttctgaacgaggcagttgactacgttatccgacaccttatacaggagaataacagagtcaagaccagaattttcttacacgtgctgtccgaactcaaagaagtggaacccaagctggccgcctggattcaaaaactcaattccttcggaatgagtctttatattccagagcaatag

SEQ ID NO: 137678 - DNA, 1842 bp, Artificial Sequence
  Description of Artificial Sequence: Synthetic coding sequence
atggacgctgtgttggcttgccgactccgcggtcgggggaatcgtgtggccgccctacgtccccggcctcggccaggagggtctgcgggcccaagcccattcgcactgttgtgcgcaggcctgtctcccgagccacgagccggcgttggatcggaatttccagcttggtttctcggaggcagctctcagcgacggaacatggcacttttaggctccagagctgagctcgaagccgacgaggatgtgttcgaggacgccctggaaacaatatccatggccaaagaatcaatgtatcacgctctgggctactccaccatagttgtgctgcaggccgtgctaacctttgagcagcaggatattcagaatgggattagcgccatgaaagatgccttacagacgtgccagaaatataggaagaagtacacagttgtggagtcattttcatccttactgagtagggggtcgctggagcagctgagcgaggaggaaatgcacgcagagatttgttacgcagaatgcctgctgcagaaggctgcattgacgttcgtgcaagacgagaatatgatcaattttattaagggcggcttgaagattagaacatcataccagatatacaaggagtgtctgtctattctacacgaaatccaaaaaaacaagctgcagcaggaattcttctacgaattcgagggaggcgtcaagctggggtcaggggcatttaatctaatgttatctcttctgcctgcccgcatcataaggttacttgagttcatcggatttagtgggaaccgggaactgggcctgctgcagctgcgagagggggcctccgggaggtccatgcgatcggctctctgctgtttaacaattctcgcattccacacatacattagtctcattctgggtaccggtgaagtcaacgttgcggaggctgaaagattactggccccattccttcaacagtttcctaatggttccctggttctgttctaccacgccagaatcgaactcctcaaggggaacctcgaagaagcccaagaggtctttcagaagtgcatcagcgttcaggaagagtggaagcaattccaccacttatgttattgggagctcatgtggatcaacgtgtttcagcagaactggatgcaggcttattactattcggacctgctgtgtaaggaaagtaaatggtctaaagcgacttacgtgtttctgaaagccgcaatcttaagcatgctgccagaagaggatgttgtggctacaaacgagaacgtggtaactctcttccgacaggtcgactcactgaaacaaagaatcgcaggaaaatctatccctacagaaaaattcgctgttcggaaggcccggcgctactcagcctccctgcctgctcccgtcaagctgatcctcccagctttagagatgatgtacgtatggaacggcttcagcatagtgagcaaacgtaaagacttgagtgagaatctgcttgtcacagtggaaaaagctgaagccgccctccagagccaaaattttaatagctttagcgttgacgatgagtgtctagtcaagttgttgaaggggtgctgtctcaagaatttgcaacgacccctacaggccgaactgtgttacaaccacgtcgttgaatccgagaaacttttaaagtatgaccactacctggtgccctttactctttttgaattggcgagtttatacaagtcacagggggaaatcgataaagctattaagtttctcgaaacggcccggaacaactacaaggactactctctcgagtcgcggctgcactttagaatacaggccgccttacacctttggcgcaagccatccagcgactag

SEQ ID NO: 137679 - DNA, 1851 bp, Artificial Sequence
  Description of Artificial Sequence: Synthetic coding sequence
atggcgcttctaggaagccgcgctgaactggaagcagacgaggatgtcttcgaagatgcgctggagaccatttccatatcgtcccactcagatatggctacttcaagcctccactttgcttcatgtgatacccagcaagcacctaggcagagaggcgctagtaccgtctccagcagttccagtacgaaggttgatcttaaaagtgggctcgaggagtgcgcagttgctttaaatctgtttctctccaacaagttcactgatgccctggaactcctgcgaccgtgggcaaaggaaagtatgtaccatgccctgggctacagcaccattgtggtgctccaagccgtactgaccttcgaacagcaggacattcagaatggaatctctgctatgaaggacgctctgcaaacatgccaaaaataccgcaagaagtacacagtcgtcgagtcgttctctagcttgctttctagaggaagcctggagcagttgtctgaagaggaaatgcacgccgaaatatgctacgcggagtgtttgttacagaaggcagcacttacctttgtgcaagacgaaaatatgatcaacttcatcaaagggggactgaaaatccgcactagctaccagatatataaagaatgtctctctatcctgcacgagattcagaagaacaaactgcagcaggaattcttttatgaattcgaaggcggcgtcaaactgggctccggggcatttaatctcatgctttctttgttaccggcacgtataatcaggttgctcgagtttatcgggtttagcgggaaccgcgaacttgggctcctccagctgcgggagggcgcttctggtcgctctatgagatccgccttgtgttgtctcacaatcctggcttttcacacatacatatcacttatattgggtacaggagaagtgaacgttgctgaagcggagcgcttgttagcgccatttctgcaacagttccccaacggctcgttagtgttgttttaccacgcaaggatcgaattgctgaagggaaatctggaggaggcccaggaggtgttccagaagtgtattagcgtacaagaagaatggaagcagttccaccatctttgttattgggagctgatgtggattaacgtgttccagcaaaactggatgcaagcatattactatagtgacctgctgtgtaaagagtctaagtggtcgaaagcgacttatgtatttctgaaagctgctatcctgagtatgctgccagaagaagatgtggtcgctacgaatgaaaacgtagtgacccttttcaggcaggtggatagcctaaagcaaaggatagcagggaaaagcattccgacggagaaatttgcagtgaggaaggcaaggaggtacagtgcctctctgcccgcccctgtaaaactcattctgcctgctcttgagatgatgtacgtgtggaacggcttcagtattgtaagcaagcgcaaggacctgagcgagaacctcctggtgaccgtcgaaaaagcagaggccgcgttacaatctcagaacttcaactcctttagtgtggatgatgaatgcttggtaaaacttcttaagggatgctgccttaaaaacctgcaaaggcctctgcaggccgagctgtgctataatcatgtagttgaaagcgagaagctccttaaatacgaccattacctggtgccattcactctgttcgagctcgccagcttatacaaaagccagggcgaaattgataaagccatcaagttcttggagaccgcacgtaacaactataaggactatagccttgagtcgcggctccattttagaatccaggcggctctgcacctatggcggaagccatccagcgattag

SEQ ID NO: 137680 - DNA, 2010 bp, Artificial Sequence
  Description of Artificial Sequence: Synthetic coding sequence
atggatgctgtcctcgcatgccgcttgagggggagaggaaaccgggttgcagctctgagaccacggcccagacccggcggaagcgctggcccttcgccttttgcccttttatgtgcgggactctctcctgaaccacgagccggagtcggatccgagtttcccgcctggtttctaggcgggtcctcccaacgacgtaacatggccctgcttggcagccgggcggagctagaggccgatgaagatgtgtttgaggatgcattagagacgatttcgatcagtagccacagtgacatggcgacaagctccttgcattttgcttcgtgtgacacacagcaggcgccacggcagagaggcgcttctactgtgtcttcctcttcctcaaccaaggtagatttaaaaagcggtttagaggagtgtgcagttgccttaaacctctttctgtcgaacaaatttaccgacgcactggaacttctccggccctgggccaaggaaagcatgtaccacgcactggggtacagcaccatcgtggttctgcaagcagtcctaacattcgagcagcaggacattcagaatggaatctctgcaatgaaagatgcactccagacctgtcaaaaataccgcaaaaaatacacagtggtggagtcctttagttctctcctgtcccgcgggtccctggagcaacttagcgaggaagagatgcatgctgaaatctgctatgcggagtgcttgcttcagaaggcggccctgacctttgtgcaagatgagaacatgatcaattttatcaaagggggtttgaaaattaggaccagttaccagatctacaaggaatgcctgtcaatcctccatgagattcaaaaaaataaactgcagcaggaattcttttacgagttcgaagggggcgtgaagctcggttcgggcgccttcaatcttatgctaagccttttgcccgccaggattattcgcctgctggagtttataggtttctccggaaacagggagctgggcctcctacagctccgggagggtgcttcaggtaggtcaatgagatcggccctgtgttgccttacaatcctcgcctttcacacctatatctctctaattcttggaaccggtgaggtcaacgtggctgaggccgagagactgttggccccgtttctgcagcaattcccaaatgttagatccgtcttccagtcagcccaggaggtttttcagaaatgcatttctgtccaggaggagtggaagcagtttcatcacctctgctattgggaattgatgtggatcaatgtctttcagcagaattggatgcaagcttattactacagtgatctcctctgtaaagagagtaaatggagtaaggctacctacgtcttcttgaaggcagcgatcctctcaatgctgcctgaagaagatgtcgttgccacgaatgagaatgttgtcactctgttcaggcaagtggattctcttaaacagcggatcgccggtaaatctatccccacagagaaattcgccgttagaaaagccagaaggtattcagcaagcctccccgccccagtcaagcttatcctccccgccctcgaaatgatgtatgtctggaacgggttctcgattgtctccaagcggaaggacctctctgaaaacctcctagtaactgtggagaaagccgaggccgcacttcagagccagaacttcaatagtttctcagtggatgacgaatgcctggtaaagctcctgaaaggatgttgtttgaaaaacctgcagagaccactgcaagcggaattgtgctataaccatgtggtggagagcgagaaactcctgaaatacgatcactacctggtgcctttcaccttgtttgaattggcttccctatataagtcccaaggggagatcgataaggcaatcaagttcttggagactgcgcggaataactacaaagactatagcctcgagagcagactgcacttccgtattcaggcagcgctacacctatggcgtaaaccttcctccgattag

SEQ ID NO: 137681 - DNA, 2049 bp, Artificial Sequence
  Description of Artificial Sequence: Synthetic coding sequence
atggatgctgtgctggcttgtcgcctgcgcggccgcggcaatagagtggccgcactacggccccgccctcgtccagggggatctgcgggtccttctccattcgcattgctgtgtgcgggattatcacccgagcctcgggccggagtgggatctgagttcccagcatggtttctaggcggttcaagccagcggcgcaacatggcattgctggggagtcgagccgagcttgaggctgacgaggacgtatttgaggatgcactagaaactatttccatctccagccacagcgatatggccacttcatccctgcactttgcctcctgcgacacgcagcaggcccctagacagcggggcgcatccaccgtatcttccagttcttcgacaaaggtggacctcaagtccggacttgaagaatgtgcagtggctctcaacctctttctctccaacaaatttactgacgctctagaactgctgcgcccctgggcaaaggagtctatgtatcacgcgctgggctactctacaatagtcgtattacaggctgtgcttacctttgagcaacaggatatccagaacggaatcagtgctatgaaggacgctctgcagacatgccaaaaatataggaagaagtacacggttgttgaaagtttcagctctctcctgtcccggggctctctggaacaactttctgaagaagaaatgcatgcagagatctgttatgcagaatgtctccttcagaaagctgctctgacctttgtgcaggacgaaaatatgatcaactttattaaaggtggcttgaagatacgtacatcttaccagatttacaaggaatgcctctctatcctgcacgaaatacagaaaaataaactccagcaagaattcttctacgaattcgagggtggcgttaagctggggagcggcgccttcaacctcatgctctctttgctccccgcacgtattattagattgctggagtttatcggattctccggtaaccgcgagctgggacttttacaactccgggaaggggcctcaggcaggagcatgaggagcgctctgtgctgtttgaccattttggcctttcatacttatatctctctcatactaggaacaggcgaggtgaatgtcgcggaagcggagagactcctcgccccattcttacagcaattccctaacggttctttggtcctcttttaccacgcaagaattgaactcctgaaaggtaatctggaagaagctcaggaagtatttcagaagtgtatctcagtacaagaagaatggaagcagttccaccacctgtgttattgggagttgatgtggatcaacgtgtttcagcagaattggatgcaggcttactattactccgatcttctctgcaaggaaagcaaatggagcaaagcaacatatgtttttcttaaggccgcaatcctctccatgctgcctgaagaggatgttgtcgccactaatgaaaacgttgttactttatttcgacaggttgactcccttaaacagcggatcgctgggaagagtatccctactgaaaagttcgccgtgcgcaaggcacgccgttactctgcatcacttccagctcccgttaaactgattctgcctgcactggaaatgatgtacgtgtggaacggcttttcgattgtctcaaagcggaaggatctgtctgaaaacctccttgttacagtggaaaaagccgaagcggcgcttcaatcgcaaaacttcaatagttttagcgtggacgatgagtgtctcgtaaagctgttgaagggatgttgtctgaagaacctgcagagacctctacaggccgagctatgttataatcatgtcgtcgagtctgagaagttgctgaagtacgatcactacctggtgcctttcaccttatttgagctcgcctccctctataaatcccagggagaaatcgacaaagccattaaattccttgaaacagctcgcaacaactataaggactactctctggagtccagactgcactttagaatacaggcagctttgcacctgtggagaaagcctagcagtgactag

SEQ ID NO: 137682 - DNA, 585 bp, Artificial Sequence
  Description of Artificial Sequence: Synthetic coding sequence
atggctttacttggatctcgtgcagagctggaggctgatgaagatgtgtttgaagacgcactcgaaactatttcgatctcttcgcattctgatatggcaaccagctcattacactttgcctcttgtgacacccagcaagctccccgtcagcggggggcttccaccgtttcatcatcatcttccactaaagtcgacctgaagagtggcctggaagagtgcgctgtggctttgaacctgttcctaagtaacaagtttacagatgcgctcgaactgttaagaccatgggccaaagaatctatgtaccatgctcttggatattcaaccattgtggtgttacaggccgtgctgacatttgagcaacaggatatacaaaatggtatctctgcaatgaaggatgcattgcaaacgtgtcaaaaatatcgcaagaagtataccgtggtcgaaagtttcagctcattgctgagcagaggaagcctggaacagttatccgaggaggaaatgcatgccgaaatctgttacgctgaatgcctgctccagaaggctgccttaactttcgttcaacgaatgtctttttaccctgcttag

SEQ ID NO: 137683 - DNA, 1164 bp, Artificial Sequence
  Description of Artificial Sequence: Synthetic coding sequence
atggagcaaccaggtcaggatccaaccagcgatgacgtcatggactctttccttgagaagtttcagtctcagccttatcgcggaggttttcacgaggaccagtgggaaaaagaatttgaaaaagtccccttatttatgtcccgcgccccctccgagatcgaccctagagaaaaccctgacctggcatgcttacagtcaattatcttcgatgaagagcggtctccggaagaacaggccaagacctacaaggatgaaggtaacgattactttaaagaaaaagactataagaaggctgtcatctcttacacagagggcctcaaaaagaaatgcgcagacccggacctgaacgccgtcctttacacgaatcgagctgccgctcagtactatttggggaacttcaggagtgccctcaacgatgtcacagctgcccgcaaattaaaaccctgccacctgaaagcgatcattagaggtgctctctgtcatctggagctgaagcacttcgctgaggcagtcaattggtgtgatgaaggactgcagattgacgcaaaagagaaaaaacttttagagatgagggcaaaggccgataagctcaagaggatcgaacagcgggatgtccgtaaggccaacctgaaggaaaagaaagagcgcaatcagaacgaagcacttctgcaggccatcaaggctaggaatatcagattatccgaggctgcttgcgaagacgaagactctgcctcagaggggttaggcgaactcttcctagatgggctctcaacggaaaacccccacggtgctcggctgtccctagacggtcagggcaggctgtcctggcccgttcttttcctgtaccctgagtatgctcaaagcgacttcatttccgcattccatgaggacagcagatttattgatcacctgatggttatgtttggagagactccaagttgggatttggagcagaagtactgtcccgataacctggaggtctatttcgaggatgaggacagggcggaactttatagagtccctgctaaatcaaccctcttgcaggtgttacaacaccaaagatacttcgttaaggctctgacccccgcgtttctagtctgtgtcggaagctctcccttttgcaagaactttttacgcggcagaaaagtgtatcagattcgctag

SEQ ID NO: 137684 - DNA, 1515 bp, Artificial Sequence
  Description of Artificial Sequence: Synthetic coding sequence
atggccacacgggacgttgtactgtctcgggtgcctgaacaggaagaggatcggacagtgtcgcttcaaaacgcagctgctatttacgacctgctttcaatcacactagggagaagaggccagtacgtcatgctgagcgaatgtcttgaacgtgctatgaagttcgcctttggcgagttccatctctggtatcaagtcgcattaagcatggtggcttgtggcaaatctgcctatgccgtttcgttgctcagagagtgcgtgaagctgcggccgagcgatcccaccgttccactgatggccgccaaggtgtgcattggcagcttaagatggctcgaggaagccgagcattttgcgatgatggtgataagcctgggagaggaagccggggagttcctccccaaagggtatttggcactgggactgacctattccctccaggccacagacgctacactgaagagtaagcaggacgagctccacaggaaggctctccaaacgttagagcgcgcccagcagcttgcaccatccgacccccaggtcatcctgtatgtgtctctacagctggccctcgtgcgccagataagctccgctatggagcagctccaagaggccttaaaagtgcgcaaggacgatgcccacgcactgcaccttttagccctgctgttctcagcacagaaacatcaccagcacgcccttgatgtagtgaatatggcaataaccgagcatcccgagaacttcaacctcatgttcaccaaggtcaaactggaacaagtcctcaagggccccgaagaagctttggtcacctgccgtcaggttctgcggctttggcaaacactgtatagcttctcccagcttggaggcctggaaaaggacgggagcttcggtgaaggcctcactatgaaaaagcagtctggtatgcatctcaccctccccgacgcccacgatgccgactccgggagcaggcgtgcatcaagcatagctgcctcgcgcctggaggaagccatgtccgagctgactatgccaagtagcgtgctcaagcaggggcccatgcagttgtggaccacactggaacagatctggctccaggcggctgagcttttcatggaacagcagcacctgaaggaggccgggttctgcatacaggaggcagccgggctgttccccacctctcatagcgtactgtacatgagaggtcgtctggccgaggtcaaaggcaacctcgaagaggctaaacagctctataaagaggcattaactgttaaccccgacggcgtacgcatcatgcacagtttgggcttgatgttgtccagattaggccataagtcactggcgcagaaagtgctcagagacgctgttgaaagacagagcacttgccatgaggcctggcagggcctgggggaagtccttcaggcacagggacagaacgaggctgccgtcgattgtttcctcaccgccttggagttagaagccagctcccctgttctgcccttttctataattccccgtgaattgtag

SEQ ID NO: 137685 - DNA, 2577 bp, Artificial Sequence
  Description of Artificial Sequence: Synthetic coding sequence
atggctgccaagggagctcacggttcctatctcaaggtggagtccgagttagagcgttgcagggccgagggccactgggaccggatgcccgagctagtaagacaactccagactctctccatgcccggcggtggcgggaacaggcgcggctcaccctcagccgcctttactttccctgataccgatgactttggcaagctgctactcgccgaggctctccttgaacagtgtttaaaggagaatcacgccaagatcaaggattctatgccccttctggaaaaaaacgagcccaaaatgtcagaggccaagaattatctgagttccatcttaaatcacggaaggctgtcacctcaatatatgtgcgaagctatgcttatcttgggcaaacttcactacgttgaaggctcttacagagatgctatctcaatgtacgctcgcgctgggatagacgacatgtctatggagaacaaacctctataccaaatgcggctcctcagcgaggcttttgtcattaagggcctgtctcttgagagactgcccaacagcattgctagtagattcaggctgaccgagcgagaagaagaagtcatcacctgttttgaacgcgccagctggatcgcacaggtctttctgcaggagttagaaaaaaccacaaataattctacatcgcgccacttaaaaggatgtcatccactcgattacgagctgacatatttcctggaggccgcacttcagtccgcttacgtgaagaatctgaagaaggggaatatagtgaagggtatgcgagagctgcgggaggtactcaggacggtggagaccaaggctacacagaactttaaggtgatggccgctaagcatctggccggcgttcttttacacagtctttccgaggagtgctactggagccccttatctcaccccctgcctgaattcatgggaaaagaggagtcatctttcgcgactcaggctctgcggaagcctcacctgtatgaaggagataacttatactgtcccaaagacaacatcgaggaggcattgctgctgctgctcatctctgaaagcatggccaccagagacgttgtcctgtctagagtgcccgaacaggaggaggatcgcacagtcagcctgcagaacgcggcagctatttatgatttgttgtcgattacacttgggcggaggggacagtatgtcatgctgtctgagtgcttggagcgtgcgatgaagtttgcattcggagagttccatttgtggtatcaggtggcattgtccatggtcgcatgtggaaagtctgcctatgcagtgagccttctgcgggaatgcgtgaaacttaggccgagcgaccccactgtgccactgatggctgcaaaggtttgtatcggtagcctgcgctggttggaggaagcggagcactttgctatgatggtcatttctctcggagaagaagcaggcgaattcctgcctaagggctaccttgcgctgggcctcacttacagcctgcaggccacagacgccacacttaagtctaaacaggacgaattgcacagaaaagcacttcagacactggagagggcccaacaactggcccctagtgatccgcaggtgattttgtacgtgtctttgcagctggctcttgttcgccaaatcagttcagctatggagcagctgcaagaggcgttgaaggtcagaaaggacgatgctcacgctctgcacttattagcactgctgttctctgctcagaagcatcaccagcacgcactggacgtggtgaacatggccatcaccgaacaccctgagaatttcaatctgatgttcaccaaggtcaaattggagcaggtcctgaaaggtccagaggaagccctggtgacctgccgccaggtcctgcgcctgtggcagaccctgtactcattctcccagctcggaggcttggaaaaagatgggtccttcggcgaaggcctgaccatgaaaaagcagtccggtatgcaccttaccctgccagacgcccacgatgctgactccggcagtcgcagggcctcttcgatcgctgccagccgtctggaggaggctatgagcgagctgaccatgccctcctccgtgcttaaacaggggcccatgcagctctggaccactttagagcaaatctggctccaggccgccgaactgtttatggagcaacagcacttgaaggaagctggtttctgcatccaagaagcagctggcctgtttccaacgtcacacagcgtcctctacatgcgaggtcggttggccgaggttaaaggaaatctcgaagaggccaagcaactgtacaaagaggccctgaccgtgaaccctgatggcgttagaattatgcatagcctgggactgatgttgtctagacttgggcataaatctctcgcacagaaggtgctgcgggatgccgttgagagacagagcacttgtcatgaggcttggcagggcctcggcgaggtccttcaggctcagggtcagaatgaggctgctgtggactgttttctaactgcgcttgaactggaggcttccagcccagtgctgcctttttcaatcatcccgcgagaactctag

SEQ ID NO: 137686 - DNA, 2058 bp, Artificial Sequence
  Description of Artificial Sequence: Synthetic coding sequence
aaaaagaaaattaacttttttaagaaacctcacagcctgagcttaagaaagaaaagggaggaggaggttattacttgtttcgagcgagcttcgtggatcgcccaagtgttcctccaagaactcgaaaagaccactaacaattcaacctctcggcatttgaaggggtgccaccctttggattacgaactgacttattttctagaagctgcactgcagagcgcttacgtgaagaacttaaagaagggaaacatcgtgaaggggatgagagagttgcgcgaagtccttcggacggtggagaccaaggccacacagaactttaaggtgatggccgcaaaacacctggccggtgtcctactgcactccctctctgaagagtgttattggtcaccattgagccatcctttgccagaattcatggggaaggaagagtccagcttcgctacccaggctctgcgcaagcctcatctctatgagggagataatctgtactgtcctaaagacaacattgaagaggccctgctcctcctcctcatcagcgaatctatggctacccgtgacgtggtcttaagtcgcgtgccggaacaggaggaagaccgtactgtgagcctgcagaacgctgctgccatctacgacctccttagcattacgcttgggcggcgaggacaatacgtgatgctcagcgagtgcctggagagggcaatgaagttcgcgttcggcgaattccatctttggtaccaagttgccctcagtatggtagcctgtggtaaatcagcctacgctgtaagcctgttaagggaatgtgtcaagctaagaccctcagatccaaccgtcccccttatggcagccaaggtgtgcatcgggtcactaaggtggctcgaggaggccgagcacttcgccatgatggtgatcagtttaggagaggaggccggagaattccttcccaaaggatatctggcactggggctgacgtattctctacaggctacagatgccacactcaaatctaaacaagacgagttacatcgcaaagcattgcagactttagaacgggcccagcagctggcgcccagcgacccccaggtcatcttgtatgtctctctccaattggcattggttcgccagatttcctccgccatggaacagttacaggaagccctgaaagtgaggaaagacgatgcccacgctctccatctcctcgcactgttgttttctgcccaaaaacatcaccagcatgccctggacgtggtcaacatggccattacggagcatcccgagaattttaacctcatgttcacaaaggtaaaattggagcaagtcctgaagggacctgaggaggcactggttacttgtaggcaggtgctgagactttggcagactctgtattccttttcacagctgggcggattggagaaagatggtagctttggcgaggggctcacaatgaagaagcagagcggtatgcacctcacactgccagacgcacatgatgcagactctggaagcagaagggcctccagtatagcagcatcacgactcgaagaggcaatgtctgagctgactatgccatcctcagttctgaaacaggggccgatgcagctctggacgactttggagcagatttggttacaggcagcagaactattcatggagcaacaacacctcaaggaggcaggtttttgcattcaggaggcagcagggctgttccctacctcacacagtgtactgtacatgagaggccggttggccgaagtgaaggggaatctggaggaggcgaagcagctgtacaaagaagcactgacagtgaatcccgacggagtgagaatcatgcatagcctggggctgatgctgtctagactgggacataagagtctggctcagaaggtcttaagagacgccgttgaacgccagtctacatgccacgaggcatggcagggcctgggggaagtgctgcaagctcagggacaaaacgaagccgctgtggattgctttctcacagcactagaactagaggcatcatcacccgtcctccccttcagcataatcccccgggaactatag

SEQ ID NO: 137687 - DNA, 441 bp, Artificial Sequence
  Description of Artificial Sequence: Synthetic coding sequence
atggcagccaaaggagcccacggaagctacttgaaggtcgaaagcgagctcgaaagatgtcgcgcagagggccactgggataggatgcctgagctggtgagacaactccaaactctgagtatgcccggcggcggcggaaaccggagaggctcccccagtgcagcttttacctttcccgacaccgatgactttggcaagcttttgctggcagaagcgctgctggaacagtgcctgaaggaaaatcacgcgaagataaaagactcaatgccccttctggaaaagaatgagcctaaaatgtccgaagctaaaaattatctgtcttctatactcaaccatggacgtctgagcggcttggctgtactgctgagactagtttccaactcctgggcccaggccatcttgttattgcaaccccctgaagcattagggctccaagagtag

SEQ ID NO: 137688 - DNA, 1596 bp, Artificial Sequence
  Description of Artificial Sequence: Synthetic coding sequence
atgagctccgagatggagcccctgctgttggcctggtcttactttcggcgccgcaaatttcagctgtgcgctgatctgtgcacacagatgctagaaaagtctccgtatgaccaggcagcctggattctgaaggctcgcgctttaactgagatggtgtacatcgatgagattgatgtggaccaggagggaatcgctgagatgatgcttgatgaaaacgctatcgctcaggtgcccaggcctggcacctctcttaaactccccgggacgaaccagacaggaggcccctcccaggccgtccggccgattacacaggcaggtagacctattaccggattcttgagaccttccactcaatctggtcggcctgggactatggaacaagccattcgaacgcctagaactgcctatacagctcgccccatcaccagctcctccggaaggttcgtgaggcttggaaccgcttccatgcttacaagtccggatggaccctttataaatctaagtcgcctgaacttgacaaaatactcacagaaacctaagctggccaaagccctcttcgaatatatttttcatcacgaaaacgacgttaagacgattcacctggaggacgtggttctacacctgggaatatacccgttcctgctacgcaacaaaaaccatatcgagaagaacgctctggaccttgcggccctgtctacagaacacagccagtataaagactggtggtggaaagtgcagataggcaagtgctactaccgcctgggcatgtatcgtgaggccgagaagcagttcaagtctgctctgaaacagcaagaaatggtggacacattcctgtacttagctaaagtttacgtttccctcgaccagccagtcactgcattgaatctgttcaagcagggcctggacaaattccccggagaggtcacgctgctctgtggcatcgcaagaatttacgaggagatgaacaacatgagctccgctgcagagtactataaggaagtgttgaaacaggacaatacccacgtcgaagccattgcttgcatcgggagtaaccatttttattcagatcagcccgagatcgccttgcgcttctaccgccgcctcctccagatgggaatctacaacggccagctatttaataatctgggtctatgttgcttttatgcgcagcaatatgacatgaccctaacatcgtttgaacgggccctgagcctagctgaaaacgaggaggaggccgcggatgtctggtataatctggggcatgttgcagtcggaatcggggacaccaatctggcgcatcagtgcttcaggctggcgctcgtgaacaacaataatcacgccgaagcatataacaacctggcagtccttgaaatgcgcaagggacacgtcgagcaggcccgcgccctattgcagaccgccagcagtttggccccccacatgtatgaacctcactttaactttgcgactataagtgacaaaatcggggacctgcaaagaagctatgtcgcagctcagaaatctgaggccgcttttccagatcacgtggacacccagcaccttatcaagcagctgaggcaacattttgccatgctgtag

SEQ ID NO: 137689 - DNA, 636 bp, Artificial Sequence
  Description of Artificial Sequence: Synthetic coding sequence
atgtcgtccgagatggagccattactcctcgcttggtcatattttcggagacggaaattccaactttgcgctgacctgtgtactcagatgctcgagaagagtccatatgatcagaagatttcctgggcctggtggcacgtacccgtcatcccagccacctgggaggccgaagccggcgagctgctggagccccggaagcgacggcttcaacaggccgaaataacccctctttactcatctctcggaaacaaaagtaagactcctagtcagaaggccgcatggattctgaaggcccgagctcttacagagatggtgtacattgacgagattgacgtcgatcaagagggtatcgcagagatgatgctggacgagaatgccatcgcccaggtcccaagaccaggcaccagccttaagttgcctggtaccaaccagaccgggggaccttctcaggcggcaaaccacacttcttggaagacacattaccgatttccgcaggcccagcacgcagaatggaaggccagacactatggaacaggctatcaaaatacgcagaatagactccatagcccaccatatcatcaactacttaggaagatctgtcaagccgggaatggttttcatgcctacaagtcatag

SEQ ID NO: 137690 - DNA, 1518 bp, Artificial Sequence
  Description of Artificial Sequence: Synthetic coding sequence
atgtcaagcgaaatggaacccttgctacttgcctggagttatttcagacgccgtaagttccagttatgtgctgacctgtgcacacaaatgcttgagaaatccccatatgatcaagctgcttggattctgaaggctcgggctctcacagagatggtctacatcgatgagattgacgtcgaccaggagggaatcgccgaaatgatgctcgatgagaatgcaatcgcacaggtgcctcgacctggtaccagtctgaaacttccaggaacgaatcagactgggggacccagccaggccgtgcggcccatcacgcaggccggaaggcccatcaccgggttcctccgccctagcacccaatctggcaggccggggacaatggaacaagccattcggacccctcggactgcatatacagccagacccattacctcttcttccggacggtttgtccgtctggggacagccagcatgctgacatccccagacggtcccttcattaacctctccaggctgaatctgaccaagtatagtcagaaacccaagctggcaaaggccctgtttgaatatatcttccatcatgaaaatgatgtcaagaccgccctcgacctggcggcacttagcaccgagcacagccagtacaaggactggtggtggaaagtgcaaattgggaaatgttattatcggttgggcatgtatcgggaagctgagaaacagtttaagagtgccctcaaacaacaagaaatggtagacaccttcctgtaccttgcgaaagtgtatgtgagtctggaccagccagtgactgcacttaacttgttcaagcagggcctggacaagtttccaggcgaggttacactgttgtgtggaatcgccagaatctatgaagaaatgaataacatgtcttcggctgccgaatattataaagaggtgttgaagcaggacaatactcacgtcgaagccatcgcttgtataggctctaaccacttctactccgatcagccggagatcgctctgcggttttatcggcgcctactgcagatggggatctataatgggcagctcttcaataatctggggctctgttgcttttatgcccaacagtacgacatgactcttaccagctttgaacgcgcccttagcttggccgaaaacgaagaggaggctgcagatgtatggtacaaccttggacacgttgctgttggcatcggggacaccaacctggcacatcagtgctttcgcttggcgctagtcaataacaataatcacgcagaggcttacaacaatcttgcagtgctggaaatgaggaaaggtcacgtcgaacaggcacgggccctgttgcagacggcctctagcctggcaccgcacatgtacgagccccattttaactttgctacaatatccgacaagattggcgacctgcagaggagctatgtggccgctcaaaagtctgaggcagctttccctgaccacgtggacacacaacacctaattaaacagctgcgacagcattttgcgatgctgtag

SEQ ID NO: 137691 - DNA, 1428 bp, Artificial Sequence
  Description of Artificial Sequence: Synthetic coding sequence
atgagcagtgagatggaaccgcttttattagcctggtcttattttagaaggcgcaagttccagctctgcgccgatctctgcacccagatgctcgaaaagtctccgtacgatcaggcagcctggattctaaaggcccgtgcgctgacagagatggtgtacatcgacgagatcgacgttgaccaggagggtattgctgaaatgatgctcgacgagaatgcgatcgcacaggtcccaagacctggaacttctctcaagctgcctggtacaaatcagacaggaggtccaagtcaagctgtacggcccatcacacaggctggcaggcctatcaccggatttcttaggccctcaactcagtccgggaggcctggaacaatggaacaggccataaggacacccagaaccgcctacaccgctagacccattaccagctcatcagggagattcgtgaggctcggcaccgcgctgttcgagtatattttccaccatgagaatgacgtgaagacggctctcgacctggcagctctatcaaccgagcactcacagtacaaggactggtggtggaaagttcaaatagggaagtgttattatagattgggcatgtatcgggaggcggagaaacagtttaagagcgccctgaagcagcaggagatggtggacacttttctgtatctcgcaaaggtgtatgttagcctggaccagccagtcacggctcttaatctctttaagcagggacttgataaattccccggcgaggtgaccctcctgtgcggtatcgccaggatctatgaagagatgaataacatgtcctcggccgccgagtattataaagaggtgctgaagcaggacaatacgcatgtggaagccattgcatgtatcggctccaaccacttctactcagaccaaccggaaatcgctctaaggttctatcggaggcttctccagatgggcatctacaatggacagctatttaacaacctgggactctgttgcttctatgcacagcagtatgacatgactctgacttctttcgaacgggcattgagtttagccgagaacgaagaggaggctgcagatgtgtggtataacttaggacatgtcgccgtcggcatcggagataccaatctggcccaccagtgtttccggctggccctggtcaacaataacaaccacgctgaggcttacaataacctcgccgtcctggagatgcgcaagggacacgtcgaacaggccagagcgttgctgcagaccgcgagctctctcgcccctcacatgtacgaaccccactttaacttcgctacaatttccgataagattggtgacctacagagatcctatgtggccgcacagaagtcagaggcagcatttcctgaccacgtagatacacaacatctgatcaagcaattgcgccagcacttcgctatgctttag

SEQ ID NO: 137692 - DNA, 753 bp, Artificial Sequence
  Description of Artificial Sequence: Synthetic coding sequence
atgtccagcgaaatggaacccctgcttctggcttggtcctattttaggagaaggaagttccaactttgtgctgacctatgcactcaaatgcttgaaaaaagtccatacgaccaggaaatgaacaacatgtccagcgctgccgagtattataaagaagtgctcaaacaggataatacgcacgttgaagctatcgcctgcatcggctcaaaccacttttattcagatcaacccgaaatagctcttaggttctaccgccgtctgctgcaaatgggaatctataatggtcagcttttcaataatcttggactctgttgcttctatgctcagcagtatgacatgacgcttactagcttcgaaagagccttgtcccttgctgagaacgaagaggaggcagcagacgtttggtacaacctgggccatgtggccgttgggataggagacacaaatctagcgcatcagtgcttcaggctcgctcttgttaacaataacaatcatgcggaggcgtacaataacttggccgttctggagatgcgaaaggggcatgtcgaacaggcaagggctttgctgcagacagcttcaagcctcgcgcctcatatgtatgagccccattttaattttgccaccatctctgacaaaataggagacttacaacgcagctacgtcgccgcccagaagagtgaggctgccttccctgaccacgtcgatacccaacacctgataaagcagttgcggcaacacttcgcaatgctctag

SEQ ID NO: 137693 - DNA, 954 bp, Artificial Sequence
  Description of Artificial Sequence: Synthetic coding sequence
atgatcttgtcttatgaagtgatactgcacgctttggacctcgcagcgctcagcaccgaacactctcagtacaaggactggtggtggaaagtgcaaattggaaaatgttactatcggcttggtatgtatcgggaagcggagaagcaattcaagtcagccctgaaacaacaggaaatggttgatactttcctttacctggcaaaggtgtatgtgtctctggaccaaccggtgactgctctgaacctttttaagcaaggcctggataaattccctggagaagtcacgctcctctgtggcattgccagaatctatgaagagatgaataatatgagctcggcggccgaatactataaggaggtgctgaagcaggacaacacacacgtcgaggctatagcttgcatcggatcaaaccacttttattcagaccaacctgaaatcgcactgaggttctataggagacttctgcagatgggaatttataatggacaactgttcaacaacttggggctatgttgcttctatgcacagcagtatgatatgaccttaacgagcttcgagcgcgctctaagtctcgccgaaaatgaagaggaagctgctgacgtttggtacaatctgggccatgtcgctgtgggtattggagacacaaacttggcccaccagtgttttcgcctggcactcgttaacaataacaaccatgctgaggcatacaacaatctggccgtgctggagatgcggaaaggacacgtggagcaggctcgggctcttttgcagacagcctcttccctggccccacatatgtacgaaccccacttcaactttgccactatttccgacaagataggggatttgcaacgcagttacgttgccgcccagaaatccgaagcagccttccccgatcacgtagatacacagcacctgatcaaacaactgcggcagcatttcgctatgctctag

SEQ ID NO: 137694 - DNA, 1548 bp, Artificial Sequence
  Description of Artificial Sequence: Synthetic coding sequence
atgtctagcgagatggagccacttctactggcatggtcctattttaggcgacgaaaattccaattgtgtgccgatctatgtacgcagatgttagaaaaaagcccttatgatcaagagccggaccccgagctccctgttcatcaagccgcatggatcttaaaagcccgcgccctcaccgaaatggtctacatcgatgagattgacgtcgatcaggaaggaattgctgaaatgatgctggatgagaacgccatcgcccaggtgccccgtccaggaacctccctgaagcttccaggcacgaaccagaccggtgggccttcacaagccgttcggccaatcacccaggcgggccggcccatcacaggatttctccgtcccagcacacaaagcggtaggcccggcaccatggaacaggcaatccgcacccctagaacggcatataccgccagacctattacctcctcctcaggccgatttgtgcgcctgggtacagcctcaatgttaactagcccagacggcccttttatcaatctctccagattgaacctcactaaatactctcagaagcccaaactggctaaggcgttgttcgagtacatatttcaccacgagaacgatgtcaaaacggccctggatctagccgccctgagcactgaacactcccagtacaaagattggtggtggaaagtgcaaataggaaagtgttattatcggctagggatgtacagagaagctgaaaagcagttcaagtcagcactgaaacagcaggaaatggtcgacacgttcctgtatctcgctaaggtgtacgtgtctctggatcagccagtgacggcccttaatctgttcaaacaggggttagataagttccctggagaggttaccctgctatgcggtatcgctaggatctatgaggaaatgaataatatgagcagcgctgccgaatactacaaagaggtgctgaagcaggataacactcacgtcgaagctattgcctgcattggaagtaatcacttctactctgaccagcctgaaatcgcactgcgcttctatagacgcttgctccagatgggcatctacaacggacaattatttaataacctaggactttgctgcttctatgctcagcaatacgacatgaccttgacaagttttgaacgcgccctgtctctggcggagaacgaagaggaagctgcagatgtgtggtacaatctggggcacgtagccgtgggtatcggggacacaaacctcgcacaccagtgcttcaggctggccctggtgaataataataatcacgctgaggcgtataacaacctggcggtgctggagatgcgtaagggacacgtggaacaggctagggcactgcttcagaccgcctcatctctggcgcctcacatgtatgagcctcatttcaacttcgccacgattagcgataaaattggagatctccagcggtcatacgtcgccgcccagaaatccgaggcggcctttcccgatcatgtcgatactcagcatctgatcaagcagctgcggcaacacttcgcaatgctctag

SEQ ID NO: 137695 - DNA, 831 bp, Artificial Sequence
  Description of Artificial Sequence: Synthetic coding sequence
atgtatagagaggcagaaaagcaattcaaaagtgcactgaagcagcaggagatggtcgacacatttctgtaccttgccaaggtttatgtctcacttgaccagcccgttactgcactcaacctcttcaagcagggactggataaattccctggcgaggtgacactactctgcgggatagcgagaatctacgaggagatgaacaatatgtcttcagcagcagagtactacaaagaagtgctgaagcaggataatacccatgtggaggccatcgcctgcattggcagcaatcatttctactccgatcaaccagagattgccctccgattctaccggcgcctgctacagatggggatctacaacggacagctctttaacaaccttggcctctgctgcttttatgctcagcagtatgacatgactctaaccagtttcgaacgggcattgtccttggctgagaacgaggaagaagcagcagatgtgtggtataatttggggcacgttgcagtggggataggagatacaaatctggctcatcagtgtttccggttagctcttgtgaacaacaacaaccacgctgaggcttataacaatttggctgtgctggagatgcgtaagggccatgtcgaacaggcacgggcactactgcagacggcatccagcctggcgccccacatgtacgaaccacattttaattttgcgacgatctccgataagatcggcgatctgcagagaagctatgtggcagctcagaaaagcgaggccgcttttcctgaccacgtggacacacagcatttaatcaaacaactgagacagcattttgctatgctttag

SEQ ID NO: 137696 - DNA, 348 bp, Artificial Sequence
  Description of Artificial Sequence: Synthetic coding sequence
atgtcttcaccttctagccccttcagggagcagtcctttttgtgtgctgccggcgacgctggcgaggaatccagagtacaggtcttgaagaatgaggtgcggcgcgggagccccgtgctgttaggatgggtggagcaagcttacgcagacaagtgtgtgtgcggtccatccgcaccccccgctcccacgccaccgtcactttctcagcgcgtgatgtgtaacgatttattcaaggtgaacccttttcaactccagcagttcagagcggaccccagcaccgctagcctccttttatgcccgggtgggttggatcacaaactgaatcttcggggaaaagcctgggggtag

SEQ ID NO: 137697 - DNA, 348 bp, Artificial Sequence
  Description of Artificial Sequence: Synthetic coding sequence
atgagctctccctccagtccttttcgcgaacaaagtttcctgtgtgcggccggcgatgcaggggaggagagccgggtgcaggtgttgaaaaatgaggtcaggcgtggctctccggtattactaggctgggttgaacaggcttacgccgataaatgcgtctgtgggccaagcgctcccccggccccaacgcccccaagtctgtctcagcgcgtcatgtgcaacgatctctttaaggtgaatcccttccaactgcagcagtttcgggctgaccccagcacagcctcactcctactctgccctggcggcctcgatcacaaactgaatttaagggggaaggcctggggctag

SEQ ID NO: 137698 - DNA, 357 bp, Artificial Sequence
  Description of Artificial Sequence: Synthetic coding sequence
atggaaggcggcgcatacggtgcgggcaaggcaggcggagccttcgacccatatacattggtgcgccagccacatacaatcttgcgggtggtctcctggctgttcagcatagtggtgttcggatcaatcgtgaacgagggatacctgaattcagcctctgagggcgaggaattttgtatatacaaccggaaccctaacgcctgctcctacggggtggccgtgggcgtgctggcttttctcacctgtttactttaccttgccttggatgtctattttccccagattagttctgttaaggatcgtaaaaaagcggtgctcagcgatatcggtgtctctgcatgggaaatgcattcctag

SEQ ID NO: 137699 - DNA, 1389 bp, Artificial Sequence
  Description of Artificial Sequence: Synthetic coding sequence
atggccgcacaaaggcggtccctcttgcaaagcgagcaacaaccttcttggacagatgacctccccctgtgccatctatccggcgttggtagtgcctccaatcgctcatacagtgcagatggaaaaggcactgagagccatcctccagaggatagctggttaaagtttcgctctgagaataattgtttcctctacggcgtgttcaacgggtatgacggcaacagagtgactaacttcgtggcgcagcggctgtccgctgagcttcttttgggccaacttaatgcagagcatgccgaagcagacgtgagacgcgtgctactgcaagcattcgacgtcgtagaaagaagctttttggaaagcatagatgatgctctggccgaaaaagcctccttgcagtcccagttacccgaaggcgtccctcagcatcaactacccccccagtatcagaaaatactggaacggctgaagaccttggagagggaaatatcaggaggagctatggcagtggtggccgtgctgcttaataataaactgtatgtcgccaacgtgggtacaaaccgtgccctgctttgcaagtcaaccgttgacggtctccaggtcactcagctgaatgtggatcacacaactgagaatgaggatgagctttttagactctcacagctagggctcgatgccgggaaaattaagcaagtgggtataatttgcggccaggaatctacacgacgcattggcgactataaagtgaagtatggttacaccgatatcgacttgcttagtgccgccaaatctaagcctattatagctgaaccagaaatccacggcgcacaacctctggacggggttacggggttcctggtccttatgtctgaggggctctataaggccctggaagcagcccatggacccggccaagccaatcaggagattgccgccatgatcgataccgaattcgctaaacagactagtctggatgccgtggcacaggcagtcgtcgatagagtgaagagaatccattcagatacattcgctagtggcggtgaaagagcaagattctgcccccggcatgaggatatgacgttattggtgaggaacttcgggtatccactgggcgagatgagccagcccaccccatcgcctgccccagcggccgggggccgagtgtacccagtcagcgtgccatattcttcggctcagagcacaagcaagacatccgtcacactcagccttgttatgccttctcagggccagatggtgaacggagcacactcagcctccacattagacgaagctacacctacacttaccaaggatccatcacgaccagcctccgacttgaccgccatacctcagtgccaactgaacctccttgggtccctcacaccagggtag

SEQ ID NO: 137700 - DNA, 2082 bp, Artificial Sequence
  Description of Artificial Sequence: Synthetic coding sequence
atggcccagggatcccatcagatcgatttccaggtgttgcatgacctcagacagaagttccctgaggtgcctgaagtggttgtgagccggtgtatgctccagaataataataatctcgacgcatgttgcgccgtcctgagccaagaatcgaccaggtatctttatggtgaaggcgacctaaacttcagtgacgatagtgggatctccggcctacggaaccacatgacctctcttaacctggatcttcagtctcaaaatatctaccaccacggcagggagggttctagaatgaacggtagcaggactttgacccattctattagcgacggccaacttcaggggggccagtctaacagcgaattgtttcagcaagagccccagacagcgcccgcccaagtccctcagggctttaacgtttttggaatgtcatcttcaagtggagcatctaacagcgccccacacctgggctttcatctgggtagtaaagggacttcatccttaagccagcaaaccccgaggtttaatccaatcatggtcacactagcccccaatattcagaccggacgcaacaccccaacctctttgcacattcacggcgtgcctccacccgtgttgaattctcctcagggcaacagtatttatatccgtccttacattaccactcctgggggaactacgcggcagacgcagcagcattctggctgggtgtcccaatttaatccaatgaacccacagcaggtttaccaaccaagtcagcccggaccctggacgacatgccccgctagcaaccctctttcacacacctcgtcacagcagccaaatcaacaaggtcaccagaccagccatgtgtacatgcctataagcagtccgactacttcccagccccctaccatacactcatccggatcatcccagtcatcagcccatagccagtacaatattcagaacatctctaccggacctaggaagaaccagatagagattaagttggaaccccctcaacgcaacaactccagcaaactgaggtccagcgggcccagaacatcaagcacctctagctccgtcaactcccaaacactaaaccgaaatcagcccaccgtctatatagccgcaagtccacctaacactgatgaattaatgtctaggtctcaaccaaaggtgtacattagcgccaatgccgccactggcgacgaacaggtaatgagaaaccagcctactctctttatctcgacgaatagcggagcatctgcagcatcaaggaatatgagcggtcaggtttctatggggcctgccttcatacaccatcatcccccaaaaagcagggctatcggcaacaacagcgccacctccccccgcgtagtagtgacccagcccaacacaaaatatacctttaagattaccgttagcccaaataaaccaccagctgtgtctcctggggttgtgtccccgactttcgaactcacaaacctactgaaccatccagaccattacgtcgaaaccgagaacatccaacacctcacagaccccacacttgcgcacgtggatcggatctccgagaccagaaaattgtccatgggatcagacgacgccgcatacacacaagcactgctcgttcaccagaaagcccgcatggagaggttgcagcgcgagctggaaatacaaaaaaaaaagctcgataaacttaagtctgaagttaacgaaatggagaacaatctgactcggaggcgattgaagcgaagtaacagtatttcacagatacctagcctggaggagatgcagcagctacgaagctgcaaccgacaacttcagatagacatcgattgcctgaccaaggaaatagacctttttcaggcccgcgggccccactttaacccatcagctatacacaatttttatgataatatcggattcgtgggccccgtgccacccaagcccaaagatcagaggtcaattattaagacccccaagactcaggatacagaggacgacgagggcgcccagtggaattgtactgcctgtacttttcttaatcaccccgctctcattaggtgcgagcagtgcgaaatgccccggcacttttag

SEQ ID NO: 137701 - DNA, 2082 bp, Artificial Sequence
  Description of Artificial Sequence: Synthetic coding sequence
atggcccagggctcccaccagattgacttccaagttctccacgatctccgacagaaattcccagaagttcccgaagttgtggtgtcccggtgtatgctgcagaacaacaacaatcttgatgcctgttgtgctgttctgtctcaggagtctacccgttatctgtatggagagggagatctgaatttttcagatgattcagggatttcgggattgaggaatcatatgacttcactgaatctggaccttcagtcacagaatatttaccaccacgggcgggaagggagccgaatgaacggatcaaggactctgactcactcaatctccgacggccagctccagggcggtcaaagtaatagcgagctgttccagcaggaaccacaaactgcacccgcacaggtgccgcaggggtttaacgtgttcggcatgtcctcttcttcaggagcctccaactccgccccccacctgggttttcatctgggaagcaaaggcaccagctctctcagccaacagacccctcgcttcaaccctatcatggtcacactggcgccgaatatccaaactgggcgtaatacccctacctctctgcacatccatggggtgcccccaccagtgctgaactcaccgcagggtaattctatttacatccgcccctacataaccactcccggaggaaccaccagacaaactcaacaacacagtggatgggtttcccagtttaaccctatgaatcctcagcaggtgtatcagccctcgcaaccaggtccatggaccacttgtccagccagcaatcctctgtcacacactagctctcagcagccaaatcagcagggccaccagacatcacatgtttacatgcccatatctagcccaacaacgtcacagccacctacaattcacagcagcggatcttcacagtcaagtgcccacagccagtacaacattcagaacattagtaccgggcctcggaagaaccagatcgaaatcaaactggagccacctcagcggaataacagctcgaagctgcgaagcagcggaccacgcacatccagtacatcctcttctgtgaactcacagacattaaaccggaaccagcccaccgtgtacatcgccgctagcccaccaaacaccgacgagctgatgagtcggtcgcagccaaaagtctatatctctgctaacgcggcgacaggggatgaacaggttatgcgaaaccagcccacactgtttataagcacaaactcaggagcatctgcggctagccggaatatgtcaggacaagtgtcaatgggtccagctttcattcatcatcacccccccaagtctcgagctataggaaacaattcagccacatcccccagggttgtggtcacacagcccaatacaaagtacacattcaagatcactgtgtcccctaacaagccgccagctgtgagtccaggagtggtttcgcccacatttgaactaacaaacttgctgaaccacccagaccactacgtggaaacggaaaacattcagcacctgacagaccctacactggcacatgtggacagaatatccgagacaaggaaactgagcatggggtctgatgacgccgcttatacacaagcgctgctggtgcatcagaaggctcgtatggaacggctccagcgtgagctggaaatccaaaagaaaaagctcgacaaattgaaaagcgaggtcaacgagatggagaacaatcttacccgtagacgtctcaagagatctaattccataagtcagattccaagcctggaggaaatgcaacagctacgatcttgtaaccgccagctacagattgacattgattgcctcaccaaggagattgacctttttcaagcccgcggcccacacttcaacccttcggccatccataacttttatgataacatcggattcgtcggccctgtccctcccaaaccaaaagatcagcggtccatcataaagactccgaagacgcaagacacggaagacgacgagggagcccaatggaattgcaccgcctgcactttcctaaaccatcccgcgttgatcagatgcgagcagtgcgaaatgcctagacacttttag

SEQ ID NO: 137702 - DNA, 1611 bp, Artificial Sequence
  Description of Artificial Sequence: Synthetic coding sequence
atggcacaggggtcccaccaaattgacttccaggtgctccatgacttgagacagaagtttcccgaagtccctgaggtagtggtgtcacgatgtatgctgcagaacaacaataaccttgacgcctgctgcgcggttcttagtcaggaatccactcgctatctttacggcgaaggggatcttaatttttcggacgatagcggcatcagtggtctgaggaatcatatgacatccctgaatctggatctacaatcacagaatatctatcatcatggccgggagggttcaagaatgaacggaagccgcactctcacacactctatttccgacggccagctgcagggaggtcagtccaattcagagctttttcagcaggaaccacaaactgcgcctgcccaagtgccgcagggttttaatgtttttggcatgagtagctcaagtggtgccagcaacagtgccccacatttaggctttcacctgggatctaagggaacatcaagcctgagccagcagacgccccgttttaatccaatcatggtgacattggcaccgaacatccaaaccgggaggaacacaccgacatcactgcatatccacggtgtgccaccgccagtgctgaattcccctcaggggaacagcatatacattaggccatatatcacgaccccgggaggaacaactcgtcagacccagcaacactccggatgggtttcccagttcaatccaatgaatccccagcaggtatatcaacccagccaacccggcccctggaccacctgcccggcatccaaccctttatctcacaccagcagccagcagcctaaccaacagggccaccagaccagccacgtttacatgcctatttcctcacccaccacgtcacaaccacccactatccactcctccggctccagtcagagctcggcccatagccagtataatatccagaacatctccactggcccgcgaaaaaaccaaattgaaattaaactggaaccgcctcaacgcaacaattcttctaagctgcgctcttcagggccccgcacttcgagcactagttctagcgttaatagccaaacactgaacagaaatcagcccaccgtgtatattgctgcgagcccccccaacactgatgagctcatgagtcggtcccagcccaaagtatatatctccgccaatgccgccaccggcgatgagcaggtgatgcgtaaccagcctacactgttcatatcaactaattccggggcctctgctgccagtaggaacatgagtgggcaggtgagtatggggcccgcctttattcaccatcatccaccaaagagtcgcgctattggaaacaattctgcaacctcaccccgggtggtggtgacccagccaaacaccaagtataccttcaaaatcacagtttcaccgaataaacctccagccgtgtcgccaggagttgtatctccaaccttcgaactgactaatttactgaaccaccctgaccactatgtggagacagaaaacatccagcacctgacagaccctacgctggctcatgtcgatcgcatatccgaaactaggaagctcagcatgggatccgacgacgctgcctatacgcaggacatttag

SEQ ID NO: 137703 - DNA, 1986 bp, Artificial Sequence
  Description of Artificial Sequence: Synthetic coding sequence
atgcagaataataataacctggacgcatgctgcgcagtgctgagccaggaatctacacgttacctatacggcgagggcgacctgaacttctcagacgactcagggatctctgggctgaggaaccatatgacttctctgaacctggatttgcagagtcagaacatatatcatcatgggcgggagggcagcaggatgaatgggtcccgcaccctgacacattccatttcagatggacagctccagggcggtcagagcaacagcgaacttttccaacaggaaccgcaaacagcgcccgcccaggtccctcaggggttcaacgtcttcggaatgtcatcttccagcggcgcgtctaactcggcaccacacctcggttttcatctgggatcaaaaggaacaagtagcttatctcagcaaactccaagatttaatcccataatggttactcttgcccccaatatacagaccggtagaaatacgccgacctcgctgcacatccacggagtgccaccccctgttctaaacagcccacaggggaatagtatttatatccggccttatataactactcctggcgggaccacaagacagacccaacagcacagcggctgggtgtcccagtttaacccaatgaacccacagcaggtgtaccagcctagccaacccggtccttggacaacttgccccgctagtaatccgctaagtcacacttcatcacaacagcccaaccaacaaggacaccagactagccatgtgtacatgccaataagctcacctacaacatcacaaccccctaccatccatagttcagggtctagccagtccagcgcacattctcagtacaacattcagaacatcagcacgggtccacgaaagaatcagattgaaatcaaactcgagccacctcagcggaataacagctccaaactccggagctccggtccccgcacttcctccacaagtagctccgtgaactcgcagacattgaatagaaatcagcccaccgtctacatcgctgccagccctcccaatacagatgagctgatgtcacgaagtcagcctaaagtgtacatcagtgccaatgccgctactggtgatgagcaggtgatgagaaaccaacccactttgttcatctctaccaatagtggggcttcagccgcatcccggaatatgtctgggcaggtgtctatgggacccgcctttatccatcaccacccacctaagtctcgagccatcggcaacaactcagccacgtcaccaagggtggtggttactcaaccaaatacaaagtatacttttaaaatcaccgtgtctccaaataaacctccggctgtttctcctggcgttgtgagtcctaccttcgagctgacaaatcttctgaaccatccagatcactacgtggaaacagagaacattcagcacctcactgaccctaccttggctcacgtggaccgaatatcggaaacacggaagctctcaatgggctctgatgacgccgcctacacacaggccctgcttgtgcatcagaaggcccgaatggaaagactccagcgagaactagagatccagaaaaagaagctggataaacttaaatctgaggtgaacgagatggaaaacaatcttacacgacgtcgtctaaaacggagcaacagtatctctcaaattcctagcttggaggagatgcagcaactgcgctcgtgcaatcggcagctccagatcgacattgactgcctaaccaaggagattgacctgtttcaagcgaggggaccacacttcaacccatccgctatccacaatttctacgacaacataggttttgttggaccagtaccgccaaagcctaaggatcagaggtcaatcatcaagacccccaagactcaggacaccgaggacgacgagggcgcccaatggaattgtaccgcttgtacgttccttaaccatcctgcattgatcagatgcgaacagtgtgagatgccccgccacttctag

SEQ ID NO: 137704 - DNA, 2082 bp, Artificial Sequence
  Description of Artificial Sequence: Synthetic coding sequence
atggcccagggctcacatcaaatcgacttccaggtgttgcacgatcttcgccagaagtttcctgaggtgcccgaggtggttgtctctagatgcatgctacaaaataacaacaatctggatgcctgctgtgcagtgctctcccaggaaagtaccaggtacctgtacggcgagggcgatctaaatttctccgacgattctggcatctccgggctgcggaaccacatgactagcctcaacctggacctccaatctcaaaacatatatcaccatggacgggaaggcagcaggatgaatgggtctcgtacactgacgcacagcatatccgatggccagttgcagggtggtcagagtaattccgagctcttccagcaggaaccacaaacagctccagcccaagtgcctcaggggtttaacgtgttcggcatgtcttcttcctccggcgcaagcaactccgctccccatctaggcttccatctcggctctaaaggcacaagtagtctttcccagcagacccctagattcaaccccattatggttacactcgcgccaaatatccagaccgggagaaacactccgacctcacttcatatccacggtgtgcccccccctgttctgaacagtccacaaggaaactctatatacattaggccctacatcactaccccagggggaacaacccgccagacacaacagcatagtggctgggtttcacagtttaacccaatgaacccccagcaggtttatcagccttcccagccagggccctggacgacatgtcccgcatcaaatccacttagtcacactagttctcagcaacccaatcagcagggacaccagacatctcatgtatacatgcctatctctagtcccaccacgtcacaaccaccaacaattcactcctcagggagttctcagagttccgcccactctcagtacaatatccaaaacatctcgacagggccacgtaaaaatcagattgagataaagctggagcctcctcagagaaacaactcctcaaaactcaggtcttccggacccaggacctcatctacctcatccagcgtgaactcacagacactcaaccgcaatcagcctacagtgtatatcgccgcctcgcctcctaacactgatgagctcatgtcaaggtcgcaaccaaaggtgtatatctccgcaaacgcggctacaggggatgaacaagtcatgcgcaaccagccgactctctttatctccaccaactcaggggcctccgccgcctccagaaacatgagcgggcaggtttcaatggggccagccttcattcatcatcacccacccaagagccgtgcaattggaaacaactcagcgaccagccctcgtgtcgttgtgacgcaaccaaatactaaatatacttttaagatcacggtcagtccgaacaaacctcctgcagtctcccctggggtggtgagcccaacctttgagttgaccaatctgttgaatcaccccgaccactatgtggagacagagaatattcagcacttgaccgatccaaccctagctcacgtggatcgaatttccgagaccagaaagctgtcaatgggcagcgacgatgccgcctacactcaggcacttctggtgcatcaaaaggccagaatggagcggctacagagagagttagagattcagaagaagaagttggataaactcaaatccgaggtcaatgaaatggaaaataatttgaccagacgtcgcctgaagaggtcgaattcaatcagccagatcccgagtcttgaagagatgcaacagctgagatcttgtaatagacagttacaaatcgatatcgattgtcttactaaggagatcgacctattccaggccaggggcccccacttcaacccatctgctattcacaatttctatgacaacatcggtttcgtgggcccggttcccccgaagccaaaagatcaaaggtctatcattaagacccctaagacccaggatactgaggatgacgagggagcccagtggaactgcacagcttgcaccttcctgaatcacccagcgctgatcagatgcgagcagtgtgagatgccgcgacacttttag

SEQ ID NO: 137705 - DNA, 714 bp, Artificial Sequence
  Description of Artificial Sequence: Synthetic coding sequence
atgtctgactctgatctgggcgaggacgaaggccttctctccctggccggcaaacgtaaacggagaggaaacctgccaaaagagtccgtaaaaatactccgagactggctctaccttcacagatataacgcataccccagcgaacaggagaaactaagtctaagcgggcagacaaatctttctgttttgcaaatatgtaattggttcatcaatgcacgccggcgacttctgcccgatatgctacgcaaggacggtaaagaccccaatcagttcaccatttctagaagaggtggcaaggcttccgatgtggccctcccccgaggaagctcccccagcgttcttgccgtgtctgtgcctgccccaacaaatgttttgtcgctctccgtgtgtagcatgcctctccatagtgggcaaggggaaaagccagccgcaccttttcccagaggtgaactcgaatcccccaaacctcttgtgactcctgggagcacactgacgctgttgacccgcgccgaagcagggtcccctacaggtggactgttcaatactccccctcctaccccccccgagcaggataaagaggatttttctagcttccaactgcttgtcgaggtggccctgcaacgggccgcagagatggaattgcagaagcagcaggacccctctctgcctttactacatacaccgatcccgctggtgtctgagaacccccagtag

SEQ ID NO: 137706 - DNA, 714 bp, Artificial Sequence
  Description of Artificial Sequence: Synthetic coding sequence
atgagcgactcagacctgggtgaagatgaaggccttctttctcttgcaggaaaaaggaagcggcgggggaacctcccaaaggagagtgtcaagattctgagggattggctgtatttacacagatataacgcatatccctccgaacaggagaaactgagtctgtctgggcagacaaacttgtctgtcctgcagatttgtaactggttcattaatgctaggaggcggttgctgccagatatgctgagaaaagatgggaaggacccaaaccagtttacaatttcacgtcgtggtgggaaagctagtgatgtggcgttaccccggggcagtagccctagcgtgctggccgtgagtgtacctgccccaaccaacgtgctgtctctttctgtgtgtagtatgcccctgcatagcgggcagggcgaaaaacccgctgctcctttccccagaggcgagcttgaaagccctaaaccactcgtcacacccggaagtacactgaccctactgactcgggccgaagctggctccccaacaggcgggctttttaatacgccaccacctaccccacctgaacaggacaaggaggacttcagctcctttcagctactggtggaagtggcactccaacgtgcagcagaaatggagcttcagaaacagcaggatccctccttgccattgttacacaccccaatccctctggtgagtgagaatccgcagtag

SEQ ID NO: 137707 - DNA, 525 bp, Artificial Sequence
  Description of Artificial Sequence: Synthetic coding sequence
atgtctgacagcgatctcggcgaagatgaaggactactctccttggctggcaagcggaagaggcggggaaatctccctaaggagtccgtgaagatcctccgcgactggctgtacctccatcgctacaacgcctatccgtccgaacaagaaaagttatccctatctggtcaaacaaacctgtctgtgctgcagatttgtaactggtttataaacgccaggaggcggctcctgcctgatatgcttcgaaaggacggcaaagatcccaatcaattcaccatctctaggagagggggcaaggcttccgacgtcgctctgccacgcggtagtagcccgtccgttctggcagtttccgtacctgcacctacaaatgtgctgagtctatctgtgtgctccatgcccttgcacagcgggcaaggcgaaaagccggccgctccttttcccagaggagagttggagtcgccaaagcctctggttacacctggcagtacactcactctacttactagagcagaagctgggagttag

SEQ ID NO: 137708 - DNA, 714 bp, Artificial Sequence
  Description of Artificial Sequence: Synthetic coding sequence
atgagcgatagtgatttaggcgaagacgagggattactgtctttagctggcaagaggaaacggagaggtaacctcccgaaagagtctgtgaaaatcctgagagattggctttatctccaccgttataacgcatatccctccgaacaggagaagctgtcactttctgggcagacaaatctgtctgtgcttcagatctgcaactggttcattaatgccagacgtcgactcctgcccgatatgctccggaaagatgggaaggaccctaaccaatttaccatttcccggcggggcgggaaagcttctgatgttgcccttcctcgtggcagctctccctccgttttggcagtcagcgttcctgcccccactaatgtcctgagcctgtccgtttgtagcatgccactccactctggtcaaggcgaaaaaccggccgctccattcccccgcggtgagctcgaaagtcccaaaccgctcgtgacaccaggttctactctgacactgctcaccagggcagaagctggctcacccacaggaggcctgttcaacacccctcccccaacgccccctgaacaggacaaggaagactttagctcatttcaactgttagttgaggtcgccctgcagagagcagccgagatggagttacaaaagcaacaagacccttccctgcctctgctacacacacctatccctttggtaagtgaaaatcctcagtag

SEQ ID NO: 137709 - DNA, 726 bp, Artificial Sequence
  Description of Artificial Sequence: Synthetic coding sequence
atggaggcagccgccgatggcccagcagagacgcagagccccgtggagaaagactcaccggccaagactcaatcccctgctcaagatacttctataatgtcaagaaataacgccgatacaggccgagttctcgctctgccagagcataaaaaaaaacggaagggcaatcttcctgctgagagcgtcaaaatcttgagggattggatgtacaaacaccgtttcaaagcctacccctcagaggaagagaagcaaatgttgagcgaaaagacaaatctgagcctgctccagatctctaattggttcattaatgctcgcagacgaattttacctgacatgctgcagcaaaggcggaatgatcctataataggacacaagaccggaaaggacgctcacgccacccatctgcaatccactgaggcaagcgtgcctgccaagagcgggcccagcggtcctgacaacgttcagtcgctgccgctctggccgttgcccaagggacaaatgtcaagagaaaagcaaccagatcctgaatccgctccatctcaaaaactgaccgggatcgcccagcctaaaaagaaagtcaaggtgtctgttactagtccttcctctcctgagctcgtgagccccgaagagcacgcggatttttcatcgtttcttcttttagtagatgccgccgtacaaagggcggctgaacttgaattggagaagaaacaagaacccaatccatag

SEQ ID NO: 137710 - DNA, 726 bp, Artificial Sequence
  Description of Artificial Sequence: Synthetic coding sequence
atggaggcagccgcagacggacccgccgagacacagagtccagtcgagaaggactctccagctaagacccagtcaccagctcaggatacaagcataatgtcccgaaataatgcagatacaggaagggtgttggcactccctgaacataaaaaaaagagaaaaggcaaccttcccgctgagtctgtaaagatccttcgggactggatgtacaagcataggttcaaggcttacccctcagaggaagaaaaacagatgttgtccgagaagactaacttatcactgctacagatttctaactggttcatcaacgcgcgaaggcgaatcctgcccgacatgttacagcagagacggaatgaccctataattgggcacaagaccggaaaggatgcccatgccacccacttgcagagtacggaagccagtgtcccggctaagtctggcccctccggccctgataacgttcagtccctgcccttgtggcctcttccaaaaggtcagatgtcacgggaaaagcagcctgatcccgagtcagcccctagccagaagctgacgggcatcgcccagcccaaaaagaaagtgaaggtcagcgtgacgtcaccttcgagtcccgagcttgtgagtccggaggagcacgccgacttttcttctttccttctcttagttgatgctgctgtccaacgcgccgcagagctggaactggagaaaaaacaggaacctaacccgtag

SEQ ID NO: 137711 - DNA, 558 bp, Artificial Sequence
  Description of Artificial Sequence: Synthetic coding sequence
atggaagcagccgctgacggccccgctgaaactcagtccccggttgagaaagactctcctgccaagactcagtctcccgcccaggacacttctatcatgagtagaaacaatgccgacacgggcagggtccttgccctccccgaacataagaaaaaacgcaagggaaatctgcccgctgagagtgtcaagatcctgcgggattggatgtacaaacacaggtttaaagcctacccctccgaggaggaaaaacagatgctgtcagagaagaccaatttatcattattgaggatctccaactggtttattaatgccagaaggcgtattctgcccgatatgctacagcagcgtagaaacgatcccatcattggtcacaaaaccggtaaagatgctcatgctacacacctccagagcactgaggcaagcgttcccgccaaatctggacccgtggttcagaccatgtacaaggcctgcccttgcgggccatgccagagagcgagatgccaggaacgaagcaatcagatacgctccaggccactggcacggagcagccctgaatag

SEQ ID NO: 137712 - DNA, 558 bp, Artificial Sequence
  Description of Artificial Sequence: Synthetic coding sequence
atggaagctgccgccgatggcccagcagaaacacaatcccccgttgagaaggatagtcctgccaagacacagtcgccagctcaggacaccagtataatgtctaggaacaatgctgacacgggcagggttctcgcccttcccgagcataaaaagaaacggaagggtaaccttcctgcagaatcagtaaagatacttagagattggatgtataaacaccggttcaaggcttacccgagcgaggaagagaaacagatgttgtcggagaaaactaacctttcgcttctgcgcatttcaaattggttcatcaacgccaggcgacgaattctgccagacatgctgcagcagcggcgaaatgaccccataatcggccacaaaactgggaaggacgctcacgcaacacacctgcagtctacggaggcttccgtacccgccaagagcggccccgttgtgcagacaatgtacaaagcgtgcccttgcgggccctgtcagcgcgctagatgccaagagcgcagtaatcagattagaagtcgacctctggcccgcagctctccagagtag

SEQ ID NO: 137713 - DNA, 1773 bp, Artificial Sequence
  Description of Artificial Sequence: Synthetic coding sequence
atggcgggtgctgtgcctggagccattatggacgaggactattacggctccgcagccgagtggggagacgaggcggacggtggccaacaggaagacgatagcggagaaggggaagacgacgctgaggtgcagcaagaatgtctgcacaagttctccactcgagactatatcatggagcctagcatcttcaataccctaaaacgctactttcaagccggcggctcaccggagaatgtgatccagttactgtcggaaaactacactgcagtggcccagacagttaatctgctcgccgaatggttgattcagacaggcgttgaaccagtgcaggttcaggaaaccgtcgaaaaccacctgaagagcctgttgatcaaacactttgatccccgaaaggcggatagcatcttcacagaggagggagagacgcccgcatggctcgagcagatgattgcccatacaacctggcgggatctgttctataaattggcggaggcgcaccctgattgtttgatgctcaacttcactgtgaaactcatttctgacgccgggtaccagggggagatcacttcggtctctacagcctgtcagcaactggaggtattcagtagagtgcttcggactagcctggccacgatactcgacggcggtgaggagaatctcgaaaaaaacctccctgagttcgcaaaaatggtgtgccatggcgaacatacttacttgttcgctcaggcaatgatgagcgtgcttgcacaagaggaacagggaggcagcgcagtgcgccgcatagctcaggaagtgcagcgatttgcccaggagaaggggcacgatgcctcccagattacacttgccctgggtaccgccgccagctatccgcgtgcctgtcaagccctgggagctatgttgagcaagggagcgctcaaccctgcggacattactgtcctctttaaaatgtttacctcaatggatccgcctcccgtggagctgatccgcgtccccgcatttctcgatttgttcatgcaatctctcttcaaaccgggagcccgcatcaatcaggaccataaacataaatacatacacattttggcttacgcggcatctgtggtggagacttggaagaagaataaacgggtttccattaataaagacgaactcaagtcaacttctaaggcagtggagacagtacacaacctgtgctgtaacgaaaacaagggcgccagcgagctcgtggcagaattgagcaccctctaccagtgcatcagatttcccgtagtagctatgggggtcttaaaatgggtcgattggacggttagtgagcctcgctacttccagctgcagacagaccatacacccgttcaccttgctcttctcgacgaaattagcacctgtcaccagctactacatcctcaggtgttgcagttgcttgtgaagctgttcgagactgaacattcccagctcgatgtaatggaacagctcgaactgaaaaagactctactggatcggatggttcatctcctcagcagggggtacgtgctgcccgtagtcagctatattaggaaatgcctggaaaaactcgataccgatatatcattgatccggtacttcgttacagaggtcttggacgtaatcgcccccccctatactagcgacttcgtgcagctttttttacctatattggagaatgactccatcgctggcactattaaaaccgaaggagagcacgaccctgtgacagagtttattgcgcactgcaagagtaatttcatcatggtgaactag

SEQ ID NO: 137714 - DNA, 1773 bp, Artificial Sequence
  Description of Artificial Sequence: Synthetic coding sequence
atggccggagccgtccctggtgccatcatggatgaggattattacggctcagctgctgaatggggcgatgaagcggacggcggacaacaggaagatgattctggggagggtgaggatgatgccgaggtacagcaggaatgccttcacaaattttccacccgcgattacatcatggagcccagcatttttaataccctcaaaaggtattttcaagccgggggaagtcctgagaatgtgatccaactcctctctgagaattatacagcagtggcccagactgtgaacctcctggccgagtggctgattcaaaccggcgtggagcccgtacaagttcaggagacggtggagaaccatctgaagtccctgctcataaaacactttgaccctcggaaggctgacagcatctttacagaggagggtgagacaccagcctggctggaacagatgatcgctcatacaacatggagggacctgttttacaagctcgcagaagcccaccctgattgcttgatgctgaattttacagtgaagctaattagtgatgctggataccaaggggaaattacatcagtgagcactgcatgccagcagctggaggtgttctctagagtgctcagaacttccttagctaccattttggatggaggtgaagagaatttggagaagaatctgcctgagtttgcaaagatggtatgccatggggagcatacatatttgttcgctcaagcaatgatgtccgttttggctcaagaggagcaggggggtagcgctgtcagacgtatcgctcaggaggtgcagcggtttgcgcaggaaaaaggacatgacgcctctcagataaccttggccctggggaccgccgcctcttatccccgtgcctgccaggccttgggggctatgttgtcaaagggagccttaaacccagctgacattactgtgctgttcaagatgttcacctcaatggatccaccaccagtcgaactcatccgggtgcccgcgtttttggacttgtttatgcagtccttattcaaacccggagcgagaatcaaccaggatcataagcataagtatatccatatcctggcgtacgcagcctccgttgtggagacgtggaaaaagaacaagagggtctcaatcaacaaggatgagcttaagagcacctctaaggctgtggaaaccgtccacaacctgtgttgtaatgagaacaagggcgcctccgagctggttgccgaactgtccactctgtaccagtgtattcgatttcccgtggttgccatgggagtgctgaaatgggtggactggaccgtgtcagaaccgaggtacttccagcttcagactgatcacacccctgttcacttggctttgcttgacgagatcagtacatgtcaccagctgctgcatccacaggtgctgcaattgttagttaagctgttcgaaacagaacactcccagctggacgtgatggagcaattggaactaaaaaaaacactgctggatcgcatggtccacttattatctcgggggtacgtcttgccagttgtctcctatatccgaaagtgcctggaaaagctggataccgacattagtctcatccggtatttcgtcactgaggtgctggacgtgatcgctccaccctacacatcagacttcgttcaactgtttcttcccatcctcgagaacgacagtatcgccggcaccattaaaacagagggcgaacacgatccagtgacggagtttatcgctcattgtaaaagtaatttcatcatggtcaattag

SEQ ID NO: 137715 - DNA, 774 bp, Artificial Sequence
  Description of Artificial Sequence: Synthetic coding sequence
atgcctgccaggtgcgttgcagcccactgcggtaacaccacgaagtcggggaaatccctcttccgattccctaaagacagagcggtgcgtctcctttgggacaggttcgtgcgtggatgccgcgcagactggtacggagggaacgatcgttccgtcatctgttctgaccattttgctcctgcctgttttgatgtgtcaagcgtaattcagaaaaatctgcggttttctcaacggctaaggctcgtggctggggcagtcccaacactgcatcgcgtgccagcaccagctcccaaaaggggggaggagggtgatcaggccgggcggctcgacacaagaggggagttacaagcggctaggcacagtgaggccgcaccgggccccgtgagttgcacccggccacgggccggaaagcaggctgctgcatcccagatcacgtgtgagaatgaacttgttcaaacccaaccccatgctgacaatccctccaatacagtcaccagtgtcccgacacactgcgaagagggcccggtgcacaaatcaacacagatcagcctcaagcggccccgccacaggtctgtagggattcaggctaaggtcaaagcattcggcaagagactgtgtaatgcgaccacacagacggaggaattgtggagtcggacctccagtcttttcgacatatacagctccgattctgagacggatacagactgggacataaaatcggagcaatcggacctaagctacatggccgtgcaagtaaaggaggagacctgttag

SEQ ID NO: 137716 - DNA, 498 bp, Artificial Sequence
  Description of Artificial Sequence: Synthetic coding sequence
atggagccacctaagatgaatccagtcgttgagccacttagctggatgttggggacgtggctctctgatccccctggagccggaacctaccctacactacagcccttccagtaccttgaggaggttcatatatcccatgtaggacagcccatgctgaatttttcctttaactctttccaccccgatacacggaagcccatgcaccgggagtgtggcttcatccggttgaagccagacacgaacaaagtggcttttgtttcggctcagaataccggcgtggtagaggtcgaggagggggaagtgaacgggcaggagctctgcatcgcatcccattcgatcgccagaatctccttcgccaaggagccgcatgtggagcagatcacacgaaaatttagactcaactctgaagggaaactggaacagaccgtctccatggcaaccaccacacaaccaatgacccagcacctgcatgtcacgtataagaaggttaccccttag

SEQ ID NO: 137717 - DNA, 1734 bp, Artificial Sequence
  Description of Artificial Sequence: Synthetic coding sequence
atggttatctgctgtgctgccgtcaattgttcaaatagacaggggaaaggcgagaagcgagcagtgtcttttcacaggttccccctgaaggatagcaagaggctaattcagtggttgaaggccgtccagcgggacaactggacccctaccaagtactcctttctctgttcggagcactttacaaaggactcctttagtaagagactcgaagaccagcatagactccttaaacccaccgcggttccttccattttccatctgaccgagaagaaaaggggggcgggaggccatggacgaaccaggcggaaggatgcttccaaggctacaggtggggtgcgcggtcactcttcagcagccacaagtagaggtgctgccggatggagcccctcttcgtcggggaaccctatggctaagccagagagccgccggctcaaacaggccgctcttcagggtgaggctacaccccgggcggctcaggaggccgctagccaggaacaagctcaacaggcccttgagcgcacccccggggacggactggccaccatggtggccggttctcagggtaaggcagaggcctccgccaccgatgcaggtgatgaaagtgccactagctcaatagagggcggtgttactgataaaagcggtatttctatggacgactttacaccaccgggttcaggtgcttgtaagtttatcggaagtttgcactcttatagcttctccagtaagcatactcgagaaagaccctctgtccctcgcgagcctatcgaccgaaaacgcctgaaaaaagacgttgaaccctcctgcagtgggagcagcctgggtccagataaagggctggcccagtcgccaccgtccagtagcctcaccgccacacctcagaaaccaagtcaaagtccgagtgcccctcctgctgacgtgacccccaagcctgctaccgaagccgtgcagtccgagcatagcgacgcctctccaatgtccattaacgaggttatcctttctgcaagcggggcatgcaagctcatcgattctctccatagttattgcttttcctccaggcagaataagtctcaggtttgttgtctgcgcgaacaggtggaaaaaaagaacggcgaattgaaatctctccgacagagagtgtcgcgctccgatagccaggtgcgaaaactccaggagaaattagacgaactgagacgggtgtcagttccatacccatctagcctgctcagcccctcaagggagccacccaagatgaatcccgttgttgaaccactgtcttggatgttaggtacgtggctaagcgatcctcccggggccggcacctatccaacactgcaaccgtttcagtaccttgaagaggtccacatctctcacgtgggccaaccaatgctcaatttttcgtttaattcattccatcccgatactagaaaacctatgcacagagaatgtgggttcatccgactcaaacccgacactaataaagtcgcgtttgtgtccgcccagaacactggcgttgttgaggttgaagagggtgaagtgaacggacaagaactctgtatcgcctcccactccattgcacggatctccttcgccaaagaaccccatgtggagcagattacgcgtaagtttcgacttaacagcgaaggtaagttggagcagactgtgagcatggctactactacgcagccgatgacccaacacttgcatgtgacttacaagaaggtgaccccatag

SEQ ID NO: 137718 - DNA, 510 bp, Artificial Sequence
  Description of Artificial Sequence: Synthetic coding sequence
atgtcaatcaatgaagttatcctgagcgcatccggagcctgcaagctgattgacagccttcactcttattgtttctcgagcagacagaataaaagccaagtatgttgcctccgcgaacaggttgagaaaaagaatggagaattgaagtcactgaggcaaagagtgtcacggtctgacagccaggtgcgaaagctgcaggagaaactggacgagcttaggagagtgtccgtgccataccctagctctctgctcagcccatctagagaaccacccaagatgaaccccgttgtcgagccgctgagctggatgctcggcacctggttgtccgatcctccaggagccggaacgtaccccaccctgcagccattccagtacctggaagaggtccacatctctcatgttggtcaacccatgctaaactttagtttcaattcatttcatccagacacacgcaaaccaatgcacagggagtgtggcttcattaggctgaagcctgggtcttccggctag

SEQ ID NO: 137719 - DNA, 1062 bp, Artificial Sequence
  Description of Artificial Sequence: Synthetic coding sequence
atgaagcgcgatagttgggtgccgtccaaataccagttcttatgttccgaccatttcactccagatagtttggacatcagatgggggattcggtatctgaaacagactgccgttccaaccatcttttccctgccagaagacaatcaggggaaggacccttcaaagaagaaatctcaaaaaaaaaacctcgaggacgagaaagaggtctgcccgaaggccaaatccgaggagtccttcgtgttaaacgagacgaagaaaaatatcgtgaacacagatgtgccccatcagcacccagaactgctccacagcagttctttagtgaagccgcccgcccccaaaaccggctccatccaaaacaacatgctgaccctcaatctcgtgaagcagcacactgggaaacccgagtccacactggagacatctgtgaaccaggatactggtagagggggatttcacacttgcttcgagaatcttaattcgaccaccataactctgacaacatctaacagcgaatcaatccaccagtcgttagaaacccaggaagtcctcgaggttaccacaagtcatctcgcaaatccaaattttacttcaaactccatggagatcaaatcagcccaggaaaacccatttttgttctccacgatcaaccagaccgtggaggagcttaatacaaataaagaaagtgtgattgctatctttgtgcccgccgaaaacagtaagccctctgttaattcctttataagtgctcagaaggagactacagaaatggaggataccgatatcgaggacagcttgtacaaagacgtggattacggaacggaggtgctgcagattgaacattcctactgcaggcaggatatcaacaaagagcatctctggcagaaagtgtcgaagctgcactcaaagattacactgctggagctgaaggaacaacagacactgggcaggttaaagtccctggaagctcttatcaggcagctgaagcaagagaattggctttctgaagaaaacgtaaagataattgagaaccactttaccacatacgaggtgacaatgatctag

SEQ ID NO: 137720 - DNA, 1188 bp, Artificial Sequence
  Description of Artificial Sequence: Synthetic coding sequence
atgccaaggtactgcgccgctatctgttgcaagaataggagaggccgaaataacaaggatagaaagttgtccttttatcctttcccattacacgacaaggaacggctggaaaaatggcttaagaacatgaaaagggattcatgggtgcccagcaagtatcagtttttgtgctccgaccacttcactcctgacagcctcgatattagatggggaattcgctacctgaaacagacggcagtgccgacgatcttctccttgcctgaggacaaccagggcaaggatccctcaaaaaaaaaatcccaaaagaaaaacttagaagatgaaaaggaggtttgcccgaaggcaaaatctgaagaaagtttcgtgctgaatgaaactaagaagaacattgtgaacacagacgttccgcatcaacatccagaattgctccactcctcatcattggtgaaacctccggcgccgaaaaccggtagcatacaaaataacatgcttacactgaatctcgtcaagcagcacaccggaaagccggaatccacgctggagaccagtgtcaatcaggataccgggcggggaggatttcatacatgttttgaaaatttaaattctacgactattacattgacgacatcaaattcagagagcatccaccagtcgctggagacgcaggaagtcttagaggtaacaactagtcacctggccaacccaaacttcactagcaattctatggaaattaagtctgctcaggagaatccttttctgttcagcactataaatcagaccgtggaagaactgaataccaacaaggaatctgtcatcgccattttcgtccctgcagaaaattcaaagccgagtgttaatagttttattagcgcccagaaagagactactgaaatggaagatactgacatagaagattctctgtataaagatgtcgactacggcactgaagtccttcagatcgagcacagttactgtaggcaagacataaataaggaacacctatggcagaaggtgagcaagttgcatagcaaaattacattactggaactaaaagagcagcagacactaggcaggcttaagtccctcgaagctctcatcagacagttgaagcaggagaactggctctcagaagaaaacgtgaaaatcatcgaaaaccatttcacaacctacgaagtgactatgatttag

SEQ ID NO: 137721 - DNA, 669 bp, Artificial Sequence
  Description of Artificial Sequence: Synthetic coding sequence
atggttaagtgctgctctgcaattggctgcgccagtcgttgtttacccaactcaaaactgaaagggttgacctttcatgtgtttccaaccgacgaaaacataaagcgaaagtgggtattggccatgaagcggttggacgttaatgcagccgggatttgggaacctaaaaaaggtgacgtgttatgttcccgccattttaagaagacggactttgaccggtcagcccccaacataaagctcaaaccaggagtaataccctccatttttgattcaccttaccacctgcaaggcaagagagagaaactgcattgcaggaaaaacttcaccttaaagacagtcccagccacgaactacaaccaccacctcgtcggtgcttcctcgtgtatagaggagttccaaagtcagtttatctttgagcattcttactcggtcatggattctccaaaaaaactgaaacataagcttgaccatgtgatcggtgagctggaggacaccaaggaatcgttacgaaatgttctggatcgcgagaagagattccagaagtcattgaggaaaacaatcagagagcttaaagacgaatgcctaatcagccaagaaacagctaaccgactggataccttttgttgggattgttgccaggagagcattgaacaggattacatttcatag

SEQ ID NO: 137722 - DNA, 99 bp, Artificial Sequence
  Description of Artificial Sequence: Synthetic coding sequence
atggtaaagtgttgctcagccatcgggtgcgcatcgcgctgtctgccaaactccaagcttaaggggctgaccttccacgtctttcccacggacgagtag

SEQ ID NO: 137723 - DNA, 243 bp, Artificial Sequence
  Description of Artificial Sequence: Synthetic coding sequence
atggtcaagtgctgttcagcaatcggctgcgcatcaaggtgcctgccaaatagtaaacttaaaggcctcaccttccacgtgttccccaccgacgagaacatcaaacgcaagtgggtcctggcgatgaagcgcctggatgtgaacgcggccggcatatgggagcctaaaaagggagatgtactctgtagtcggcatttcaagaagaccgactttgaccgtagtgcccctaacatcaagttgtag

SEQ ID NO: 137724 - DNA, 669 bp, Artificial Sequence
  Description of Artificial Sequence: Synthetic coding sequence
atggtcaaatgctgtagtgccattggctgtgcaagtcggtgcctgccgaattccaaactaaagggtctaacctttcacgtgttccctactgacgagaatatcaagcggaagtgggtccttgctatgaagagacttgacgtgaatgccgccgggatttgggagccaaagaaaggagatgtgctgtgctcgaggcactttaagaaaacggatttcgataggagtgctcctaatatcaagcttaaacccggtgtgatacccagcatctttgacagcccttaccacctacaagggaagcgcgaaaagcttcattgcaggaagaatttcaccttgaagactgtaccggctacgaactataaccaccacttagtcggggctagttcgtgcatcgaggagttccagtcacaatttatatttgagcattcctatagcgtcatggactcaccaaaaaaattgaagcacaagctcgatcatgtgatcggagaacttgaagataccaaggagagcctaagaaatgttctggacagggagaagcgctttcagaagtccctgcgaaagaccattcgcgagctaaaggatgagtgccttatctctcaagaaaccgcaaacagactagacacattttgctgggactgctgccaggagagtattgaacaggactacatttcctag

SEQ ID NO: 137725 - DNA, 825 bp, Artificial Sequence
  Description of Artificial Sequence: Synthetic coding sequence
atgcctaagtactgccgtgctcccaattgttccaatactgccggtcgcctgggagcagacaaccgcccagtctctttctataagtttccactaaaggacggaccacggctccaagcatggctccagcacatgggctgtgagcactgggtgccatcctgtcaccagcacctttgcagcgagcattttacgccaagttgtttccagtggcgatggggagtccgttatttgagacccgatgcagtgccttccatattttctagaggtcctcccgcaaaatcccagcgcagaacacgaagcactcagaagcctgtgagcccgccaccaccactccagaagaacactcccctcccacagagcccagccattccggtgtccgggcctgtccggttggtcgtcttaggtccgactagtggctcccccaagactgtggcaacaatgctccttacacctcttgccccggcgccaactccagaacgctctcagcctgaggtgcctgcccagcaggcgcaaaccggattaggaccagtgctgggtgccctacagcggcgggtgcggcgcctgcaaagatgccaggagagacatcaagcccagctgcaggcactggaaagacttgctcagcagctccacggcgagtctctgctcgctcgggcccgcaggggccttcaaagactcaccactgcgcagactttggggcctgaagagagccagacgttcacgatcatctgcggggggccggatatagcgatggtgctggctcaggaccctgcccctgcaaccgtcgatgccaagccggaacttctcgatacacggatacctagcgcttag

SEQ ID NO: 137726 - DNA, 825 bp, Artificial Sequence
  Description of Artificial Sequence: Synthetic coding sequence
atgcctaagtattgccgcgcaccaaattgttcaaacaccgcaggcagactgggcgcagataaccgccccgtgtctttttataagttcccacttaaggacggtcctcgattacaggcatggctgcagcacatgggctgtgagcactgggtgcctagctgtcaccagcatctatgctcagaacacttcaccccaagctgttttcagtggcgctggggagtgcggtatctcagaccagatgcagtccccagcatcttcagtagaggtccaccagcaaagtcccagaggaggactaggtctactcagaaacctgtctctccgcctcccccgctgcagaagaacaccccgctcccccagagccccgccatccctgtgagcggacctgtgagactggtggtgcttgggcctaccagcggaagccctaaaacagtggcgaccatgctgctcacccctctggctcccgctccaacccccgaacgctcccaacctgaggtgcctgctcagcaggcacagacgggactaggaccggttctaggtgctttacagcgccgggtccggcgcctacagcgttgccaggagagacaccaagcccagcttcaggctttggagcggctggctcagcaactccatggggaatccctcttggcgcgagccagacggggcctacaacggctcacaacagcacagacattagggcccgaggagtctcagactttcaccattatctgcggggggcctgacattgccatggtgctcgcacaggatcctgccccagccaccgtggacgctaaacctgagctgctggatacccgcataccgagtgcctag

SEQ ID NO: 137727 - DNA, 390 bp, Artificial Sequence
  Description of Artificial Sequence: Synthetic coding sequence
atgttgctgactccacttgcacctgctccaactccagaacggtcacagcctgaagtacctgcacagcaggctcagaccggccttggccccgtactgggagcccttcagaggagagttcgacggctgcagagatgccaggaacgtcaccaggcgcagttacaggctcttgagcgccttgcacagcagctgcacggcgagtccttgctcgcacgcgcaaggaggggcctgcaacgacttacgaccgcccagacgttagggccggaggagtcgcagacattcactattatttgcggtggccccgacatcgcaatggttctggcacaggatcctgcccctgcgaccgtggacgcaaagcccgaattgttagataccaggatcccttctgcttag

SEQ ID NO: 137728 - DNA, 2712 bp, Artificial Sequence
  Description of Artificial Sequence: Synthetic coding sequence
atgacccgctcgtgctccgccgtgggctgttctaccagggacacggtgctgtcgagggagaggggcctgtctttccatcagttcccaactgacacgatacagcggagtaaatggattcgagccgtcaacagagtcgaccctaggagcaaaaaaatttggattcctggcccaggagcgatattgtgcagcaaacacttccaagaaagtgatttcgagtcatacggaatccgtcgcaaactgaagaaaggagccgtcccatcagtgtctctctacaagattccgcagggcgtgcacctcaaagggaaggctaggcaaaaaattctaaagcagccactacctgacaatagccaggaagtggccacggaagaccataattactccttgaagacaccactgaccattggggctgaaaagctggctgaagtccaacagatgcttcaagtgagcaagaagcgcttgatttctgtcaagaattatagaatgattaagaaacggaaaggtcttcgcttgattgatgcccttgttgaggagaaactgctgtcagaagaaaccgagtgtttgctgcgcgctcagttcagcgactttaagtgggagttatataattggcgtgagactgacgaatattccgcagagatgaaacagtttgcttgtaccctatatctctgttcctctaaggtgtatgactatgtccgaaagatcctcaagctaccccattcttctatcttgaggacgtggctgtcaaagtgtcagccctcacccggcttcaatagcaacattttcagcttcctacaaagaagagtagaaaacggcgatcaactgtaccagtactgttctcttctcatcaagtctatgcctctgaagcaacaattacaatgggatcccagctcccattccctccagggcttcatggatttcgggctgggcaagcttgatgccgacgaaacccctctggcctcggagaccgtgctgttgatggccgtcgggattttcggacattggaggacacctctgggctatttttttgtgaacagggcttctgggtaccttcaggcccagctgttaagattgactatcggcaagctgtctgacattggaatcactgttcttgccgtcacttcggacgccacagctcactcagtgcagatggccaaagcgctgggaatccatatagacggagatgacatgaaatgcacattccaacatccttcaagcagttcccagcagatcgcctacttcttcgactcctgtcatttgctacggttgatccgcaacgccttccaaaactttcagagtattcagttcataaatggcatcgctcattggcaacacttggttgagcttgtggcccttgaagagcaggagttgagcaacatggagaggatcccttccactctagctaatctgaaaaatcatgtgcttaaagtgaacagcgcaacccagctgtttagtgagtccgtcgctagtgccctcgaatatctgttaagtctcgacctacctccatttcagaattgcataggcacaatacatttcctccggttgataaataatctgtttgacattttcaattctaggaattgttacgggaagggattgaagggaccgctgctaccagaaacctattcaaagattaatcatgtactcatcgaagcgaaaaccatttttgtgactctgagcgacacatctaacaatcaaatcataaaaggcaagcagaaactcggatttttaggattcctcctcaacgctgaatcacttaagtggctgtatcagaactacgtgtttcctaaagtgatgcctttcccctatttgctaacctacaagttctcccacgatcacttagagctctttctcaagatgctgcgccaggtgctcgtgacatcctctagccctacttgcatggcgtttcaaaaagcgtattataacctggaaactagatacaagttccaggacgaagtgtttctttctaaggtttctatttttgacatttcaatcgccaggcgcaaggacctcgccttgtggactgtgcagcgccagtatggagtgtctgtcacgaagacagtattccacgaggagggaatttgccaggattggtcccattgttctctcagcgaggccttgttagatctgtcggaccatcgcagaaatttaatttgctatgctggatacgtcgccaacaaattgagcgcccttctgacctgtgaagattgtatcactgctttatatgcgagcgacttgaaagcgtcaaaaattggatctctcctgtttgtcaaaaaaaaaaatggcctgcacttcccctccgaatctctgtgccgcgtgattaacatctgcgagcgcgtcgtgagaactcatagtagaatggctatctttgaattagtgtctaaacagcgcgagctgtacctgcagcagaaaatactctgcgagctgtcaggtcacatcaatctgttcgtagacgtgaataagcaccttttcgatggggaggtctgtgcgattaaccacttcgttaaactgttgaaagacatcatcatctgctttctaaatatccgcgctaagaatgtcgcccagaacccactaaaacaccatagtgagagaaccgacatgaagactctgagccggaaacactggagcagtgtgcaagactacaagtgcagctccttcgccaatacgtcatccaaattccgacacctgctttccaacgatggttatccgtttaaatag

SEQ ID NO: 137729 - DNA, 2712 bp, Artificial Sequence
  Description of Artificial Sequence: Synthetic coding sequence
atgacacggagttgctccgccgtcggatgttcgacgagggacaccgtgttatcacgtgagagagggctctctttccaccagttcccgaccgataccatccaacgatcaaaatggatacgcgctgtgaatcgcgtggacccacgctctaagaagatttggattcccggcccgggagccattctgtgctcaaagcactttcaggagagcgatttcgagtcttatgggatccgacgtaagctcaaaaaaggggctgttcctagtgtgagtttgtataaaatcccacagggagttcacctcaaaggaaaagccagacagaaaatcctgaagcagcctctgccggacaattcccaggaagtggcaactgaggaccataattattcacttaaaacacctctcacgattggggccgagaagctggcagaagtgcagcagatgctccaggtatcaaaaaaaaggttaatttccgtcaaaaattatcgcatgattaagaaaaggaagggactgcggctgatcgatgccttagtcgaagaaaagttgctctcagaagaaacagagtgcctgctacgcgcgcagttttccgattttaaatgggaactctacaattggagggagacagacgagtattccgctgagatgaagcagttcgcttgtactctgtatctgtgcagctccaaggtctacgactatgtccgcaagatcctcaagctaccacacagctctatcttacgcacttggctgagcaaatgtcagccctcacccgggtttaattccaatatattcagcttcctccagagacgggtcgaaaatggcgaccagctgtatcaatactgctcgttactgattaaatcaatgccactaaaacagcagcttcaatgggacccgtcatctcacagtctgcagggcttcatggatttcggattgggaaaattggacgccgatgaaacacctttagctagcgaaaccgttctgctgatggctgttggaatttttggccattggcgcactcccctgggctacttttttgtgaaccgggcctcaggctacctccaggcccagcttctcagattgacaatcgggaaactttcagacattggcattaccgtgctggccgtaactagcgacgcgacagcacacagtgtgcagatggcaaaagccttaggtattcacattgacggagacgacatgaaatgtacgtttcagcatccaagttcctctagtcagcaaattgcatacttttttgatagttgccacctgctgagattaattcggaatgcctttcagaatttccaatctatacagttcatcaatggaatcgcacactggcaacatttagtagaactggttgcccttgaggagcaggagctcagcaacatggagcgaataccatccacattggccaacttaaaaaaccacgtgctaaaggtcaatagcgctactcagttgttcagcgaaagcgtggcaagtgccttggaatatcttctctccctggacctccctcctttccaaaactgtatcggtaccatccattttctccggcttatcaacaacctcttcgacatcttcaattctaggaattgttacggtaaaggcttgaagggacctctgctgcccgagacgtattcaaaaataaaccacgttctgatcgaagctaaaactatcttcgtcaccctaagcgacacgagcaataaccagataatcaagggtaagcagaaacttggattcttgggctttcttctaaacgccgaatcactgaaatggctgtatcagaactacgtcttccccaaggtcatgcccttcccgtatctgctcacctacaagttttctcacgaccacttggaattgttccttaagatgctccgacaggttctcgtgacttctagttcccctacatgcatggcatttcaaaaagcctactacaacctagaaacacgttacaaattccaggacgaggtttttctctcgaaggtaagcatcttcgacattagcatcgcacgacggaaggacttggcactatggacagttcagaggcagtacggggtgtcagttaccaagactgtatttcatgaggagggaatatgccaagactggagccattgtagcctttcggaggccctactcgacctgtccgatcaccgcaggaaccttatatgttacgctggctacgttgcaaataagttaagcgctctgctgacctgcgaggactgcatcaccgctttatacgcttccgaccttaaggctagtaagatcgggtctctgttgttcgtcaagaagaagaacggattgcactttccgagcgaatcactgtgtcgtgtcatcaacatatgcgaacgagtcgtgagaactcactcacgcatggccattttcgaattggtctctaaacagcgcgaactctacctccagcagaaaattttgtgcgaactctccggacacatcaacctgttcgtcgatgtgaataagcatctctttgacggggaagtgtgtgccatcaatcactttgtaaaactcttaaaggacattattatctgttttctgaatatccgggccaagaatgtagcgcagaatcccctcaagcatcacagcgagcggaccgacatgaaaaccctttccaggaaacactggtcctccgtgcaggactataaatgcagctcattcgcgaatacctcctcaaaattcaggcacttattaagcaatgacggttatccctttaagtag

SEQ ID NO: 137730 - DNA, 642 bp, Artificial Sequence
  Description of Artificial Sequence: Synthetic coding sequence
atggtgcagagctgttctgcatacggctgtaaaaatcggtacgacaaagataaacctgtttccttccacaaattccccctgacaagaccatctctttgcaaggaatgggaggccgccgttcgaaggaaaaatttcaagcctacaaagtacagctcaatttgttcggagcactttactccggattgcttcaagcgcgagtgcaataacaagctgttaaaggagaacgcagtgcccaccatttttctgtgtacggagccccacgacaaaaaggaggacctcttggagcctcaggagcagttaccaccgccacctttgcctccaccagtttcgcaagtcgacgctgccattggacttctgatgccccctctccagacccccgtcaatctgagtgtgttttgcgaccataactataccgtggaggacaccatgcaccagagaaagaggatacatcagcttgagcaacaggtggagaagcttaggaaaaaactcaagactgctcagcagcggtgtaggcgacaggagcggcagctggaaaaacttaaggaggttgttcactttcagaaggaaaaagatgatgtatcggagcgaggatacgtcattctccccaacgactactttgaaatcgtagaggtacctgcctag

SEQ ID NO: 137731 - DNA, 162 bp, Artificial Sequence
  Description of Artificial Sequence: Synthetic coding sequence
atggtccaaagttgttctgcctatggctgcaaaaaccgctacgacaaggataaacccgtctccttccataagaagaaaattttttggtctcaccgcaactctttcccccacctcctttacagactgctgtttccgaggctgatgctgcttttggactactag

SEQ ID NO: 137732 - DNA, 687 bp, Artificial Sequence
  Description of Artificial Sequence: Synthetic coding sequence
atgccgacgaactgcgctgccgcgggttgtgctactacatataataaacatattaatatcagctttcatcgtttcccactagacccgaagcgtcgcaaagagtgggtgagacttgtgcgccgcaagaattttgtgccggggaagcacacattcctgtgctctaagcattttgaagcttcctgctttgacctgacaggtcaaacaaggagactcaagatggacgcggtgcctacaatattcgacttttgcacccacatcaaaagtatgaaacttaagtccagaaatttactgaaaaagaataacagttgtagccctgctggaccaagtaatctcaaatcgaatatttcatcacagcaggtactgttggagcattcctatgcgttccggaaccctatggaggccaagaaacgcatcattaaactggaaaaagagatagcaagcctgcggaggaaaatgaagacttgtctccaaaaagaacgcagggccacacggagatggattaaggctacatgcctggtgaaaaacctggaggctaattcagtccttcccaagggcacctccgaacacatgctgcctaccgctctgagtagcctgccattggaggatttcaagatcctcgaacaggatcagcaggacaagactctccttagcctcaaccttaaacagacaaaaagcacattcatttag

SEQ ID NO: 137733 - DNA, 720 bp, Artificial Sequence
  Description of Artificial Sequence: Synthetic coding sequence
atgcccaagagttgtgctgcgaggcagtgttgcaacagatatagctctagacgaaagcagttgaccttccaccgatttccattcagccgccctgagctgcttaaagagtgggttctcaatatcggccgcggaaacttcaagccaaaacagcacacggttatctgtagtgaacattttagacctgagtgcttttctgcttttggtaataggaagaaccttaaacataacgcggtacctacggtctttgcctttcaggatccaactcagcaggtacgcgagaatacagatcctgcttctgagcgcggtaatgcatcttcctcacagaaagagaaagtgctgcccgaggcaggcgcgggagaagatagccccggaaggaatatggacacagcgctcgaggaattacagctgcctccaaacgcagagggtcacgtgaagcaggtgtcccctcggcgtcctcaggcaactgaagcagtgggacgtccaaccggacctgccggattacggcggaccccaaataaacagccatccgaccactcatacgctctgctggatctcgactccctgaaaaaaaagctctttctcactttaaaggagaacgagaagctgagaaaaaggctgcaggcccagcggctggtgatgagacggatgagcagcagacttcgtgcttgtaaaggacatcaggggctccaggcacgactcggacctgagcagcagagctag

SEQ ID NO: 137734 - DNA, 717 bp, Artificial Sequence
  Description of Artificial Sequence: Synthetic coding sequence
atgcccaaatcctgcgccgcccgacaatgttgcaatcggtactcttctcgcaggaagcaactgaccttccacaggttcccgttcagtcgccccgagctgctcaaggagtgggtgcttaacattggcagaggaaatttcaaacccaagcagcacacagtgatatgttctgagcacttcagacccgaatgcttctctgcttttgggaatcgaaagaacctcaagcacaatgctgtccccacagtgtttgcgttccaggatccaacacaggtgcgcgaaaacactgacccagcaagcgagagggggaatgccagtagtagccaaaaggaaaaagtgctgcctgaagcaggcgctggagaagattctcctggccggaacatggataccgctctggaggagcttcagctcccacctaatgctgaggggcatgttaaacaggtctcaccgagacgaccccaggctaccgaagcggtgggaagacccaccggccccgcaggcctgcggagaacacctaacaagcagccctctgatcactcctacgccttgttggatctggatagtctcaaaaagaagttgttcctgactctaaaggagaatgaaaagttaaggaagaggttgcaagcccagcgcctggtgatgagacgcatgtctagccgcctgcgcgcgtgcaagggccaccagggtctgcaagcccgactcggccccgagcagcagtcctag

SEQ ID NO: 137735 - DNA, 528 bp, Artificial Sequence
  Description of Artificial Sequence: Synthetic coding sequence
atgccaaagagttgtgcagctcgccaatgttgtaaccggtatagctctaggcgcaagcagttaaccttccaccgttttccattcagcaggcccgagctgctcaaagagtgggtgctaaacattgggcgagggaacttcaagcctaagcagcatacagttatttgcagcgagcactttaggcccgagtgttttagtgccttcgggaatcgaaaaaatctgaaacataacgccgtgccaaccgtcttcgcctttcaggatccaacacagcaagtaagagaaaataccgatccagcaagcgagagaggcaatgcgtccagtagccagaaggagaagacatcgccgtgtcggtctcaagtgctaccagaagctggtgcgggtgaagactcccctggccgaaatatggataccgctctggaggaactccagctgcccccaaacgctgaagggcacgtgaagcaggccatgctgtttaacgttgaaaatggcacccccgcttcaagagaggcgctctggctgtccgaagagtag

SEQ ID NO: 137736 - DNA, 732 bp, Artificial Sequence
  Description of Artificial Sequence: Synthetic coding sequence
atggaacatgcctttactcccctggagcccctgctgtccaccggcaacctcaagtactgcttagtcatccttaaccagccactcgacaactattttcggcacctctggaataaggctctcttgagagcttgcgccgatggtggagctaataggctctatgatatcacagagggtgagcgcgagagctttctccctgagttcatcaatggcgacttcgactccatccggcctgaagtgcgggagtattatgctaccaagggatgcgaactgatctctacacctgatcaggatcacaccgattttacgaaatgcctcaagatgctgcaaaagaaaatcgaagagaaggatctgaaggtggacgtgatcgtaactctcggagggctagctggcaggttcgatcagatcatggccagtgtcaatactctgttccaagctacacacattactccatttccaatcataattatacaggaagagtcactgatatacctgctacagcccggcaagcaccggctacatgtcgacacaggaatggagggggattggtgcggcctaatccccgtgggccaaccttgcatgcaggtgacgacaacaggactgaaatggaatctgacgaacgacgtgctggcattcggcacactggtcagtacaagcaatacatatgatgggagcggtgtggtaaccgtcgaaacagatcatccactgttatggacaatggccattaagtcatag

SEQ ID NO: 137737 - DNA, 585 bp, Artificial Sequence
  Description of Artificial Sequence: Synthetic coding sequence
atggagcacgcgttcacaccgctcgaacccctgctgtcaaccggcaacctcaaatattgtctcgtcattctcaatcagccgctggataattattttagacacctgtggaacaaggccctgttgagggcgtgcgctgatggaggagccaaccggctttacgatatcacggaaggagaacgtgagtcattcctcccagagtttataaacggcgactttgattccatcagacccgaagtccgagaatattacgcgaccaagggatgtgaacttatctctacaccagatcaggatcacactgatttcactaagtgtcttaagatgctgcagaagaaaatcgaagagaaggacctcaaaggaaaacacagattgcatgttgataccgggatggagggtgattggtgcgggctgattcccgtgggacagccctgcatgcaggtgaccacaaccggcctgaagtggaatttgaccaatgatgtgctggcattcggcacgctggtgagtactagtaatacatacgatggttccggggtggtgacagttgagactgaccatccactcctgtggacaatggccatcaaatcttag

SEQ ID NO: 137738 - DNA, 375 bp, Artificial Sequence
  Description of Artificial Sequence: Synthetic coding sequence
atggtggatgtcatcgtgaccctgggaggtctggcgggtcggtttgaccagattatggcgtctgtaaacacactcttccaggccactcacattaccccctttccaatcatcatcattcaagaggagagcttgatctatcttttgcagccaggaaaacataggttgcacgtggatactggaatggagggagactggtgtggactgattcctgtgggacagccatgcatgcaagtgacgactaccggcttgaagtggaaccttcggacctgtgattacacgaggactacctggatagctaaagacaaccctgtccctcggctaatccgtctcatccgactgaaccacatctgtaaggtacccctcgcaatcaaatag

SEQ ID NO: 137739 - DNA, 504 bp, Artificial Sequence
  Description of Artificial Sequence: Synthetic coding sequence
atggaacacgccttcacccccttagagccgttactatctacgggcaaccttaagtattgcttagttattctaaaccaacccctggataattatttccgccatctctggaacaaggcgttactaagagcttgcgccgatggaggcgccaaccggctctatgatatcactgaaggcgagagagaatcatttctgcccgaattcattaatggggacttcgacagcatccgccctgaggtgagggagtactacgcgaccaaaggctgcgaacttatcagtacccccgaccaagatcataccgacttcacgaagtgtctgaagatgctccagaaaaagatcgaagaaaaagatttgaaggtggatgtgatcgtgaccctaggcggactggctggccggtttgatcaaattatggccagcgtgaacaccctgttccaagctactcacattacaccctttcctattattataatacaggaggagtcgcttatataccttctgcagccttag

SEQ ID NO: 137740 - DNA, 693 bp, Artificial Sequence
  Description of Artificial Sequence: Synthetic coding sequence
atggcccaagggctgattgaggtcgagagaaagttcctgcctggacccggaacggaggaacgattgcaggagctcggaggcaccctcgaatatcgcgtgacattcagagacacatattatgacacgccagagctaagcctgatgcaagctgaccattggttgcggaggagagaggacagcggttgggagctgaaatgtcctggagcagcgggcgttcttggacctcacaccgagtataaggaactcacggctgagcctacaattgttgcccaactgtgcaaagtcttacgtgctgacggactgggcgccggtgatgttgctgcggtgctggggcccctgggattgcaggaagtagcctctttcgtgaccaagaggagcgcttggaagcttgtgctcctgggagccgacgaagaggaacctcaactaagggtggacctggatactgcagacttcgggtacgccgtgggggaagtcgaggctttagtgcatgaggaagccgaagtcccgacagccctggaaaaaatccaccgactgtcttctatgttaggtgttccagctcaagaaactgctcccgccaagcttatcgtgtacctccagaggtttcggccacaggactatcagcggctgcttgaggtcaattccagccgtgagcgaccccaggagaccgaggaccccgaccactgtctagggtag

SEQ ID NO: 137741 - DNA, 693 bp, Artificial Sequence
  Description of Artificial Sequence: Synthetic coding sequence
atggcccagggtcttattgaggtggaaagaaagttcctgcccgggcctggaacagaggagcggctccaagagcttggcggcacgctggagtatagagtgacttttagagatacctactacgacactcctgagctgtctctgatgcaagctgatcattggcttcggcggcgtgaggattccggatgggagctgaagtgccctggagccgccggagtcttgggaccccacactgagtacaaggaattgaccgcggagccaactatcgtcgctcaattgtgtaaagtcctccgcgccgatgggcttggagccggcgatgttgctgcagtcctggggcccctgggactacaagaagtggcatcttttgttaccaaacgctctgcttggaaacttgtgctgctgggagccgacgaagaggaaccacagctacgcgtcgacctcgataccgccgactttggttacgctgtcggcgaagtcgaagcgctggtccatgaagaggccgaggttcctactgcgttggagaagatacataggctgtcaagcatgctcggggtccccgctcaagagaccgccccagctaagcttatcgtatatctccagcgttttcgcccacaggattatcagagactgttggaagtgaactctagccgtgaaagacctcaggaaacagaggatccggaccattgtttaggctag

SEQ ID NO: 137742 - DNA, 372 bp, Artificial Sequence
  Description of Artificial Sequence: Synthetic coding sequence
atggcccagggcctcattgaggtggagcggaagtttctcccaggtcctggcactgaggagcgtctgcaggaactagggggcaccctggaatatcgcgtgacattcagggatacttattatgacacaccagagctgtcgctgatgcaggctgatcactggctgcggaggcgcgaggattccggctgggagctgaagtgccccggggccgccggggtacttggcccccacacagagtacaaggaattgaccgccgagcccacaattgtcgcacaattatgcaaggtgctcagggcagatggactgggggcgggagatgtcgccgccgtgctgggccctctcggtcttcaggaggtggcgagctttgtcacttag

SEQ ID NO: 137743 - DNA, 2070 bp, Artificial Sequence
  Description of Artificial Sequence: Synthetic coding sequence
atgaagccccccgcggcatgtgccggcgacatggctgatgccgcttcgccctgctccgtggtgaatgacctgcgttgggatctcagcgcccagcagatcgaagagagaacacgggagctgatcgagcagacgaaacgggtgtacgaccaagtaggaactcaagagttcgaagatgtttcatatgagtccactttaaaggcgttagctgatgttgaggtcacttatacagtccaaaggaatatcctcgactttccacagcacgtttctccatctaaggacatacgtaccgcttctaccgaagcagacaaaaaactttcggaattcgacgtggagatgagtatgcgagaggacgtctaccaaaggatcgtgtggctacaggagaaggtgcagaaggattctctgaggcctgaagcagctcggtacctggagcgcctgattaaacttgggagacgcaatggtctgcacctgccgagggagacgcaggaaaatattaaaagaatcaagaagaaattaagtctgttgtgtatcgactttaataagaatctgaatgaagatacaacctttctgcccttcaccctgcaagaactcggcgggctgcccgaagacttcctcaattccttggaaaagatggaagatggcaagctgaaagtaaccctcaagtacccacattactttcctcttctaaagaagtgtcatgtgcctgagacacgcagaaaggttgaggaagccttcaattgtcgatgtaaggaggaaaattgtgccatcctgaaggagttagtgacactgcgggcacagaaatctcgcttgctaggatttcatactcacgccgattatgtgcttgagatgaacatggccaaaacctcccagacagtagccacattcctcgatgaactggcacagaaactgaagcctctgggcgagcaggaacgcgccgtgatcctggagctcaaacgcgcagaatgtgaacgtagagggctgccatttgatggtcggatacgtgcatgggatatgagatactatatgaatcaggtcgaggaaactaggtactgtgtggatcagaacttgctgaaagaatattttccagtgcaagtcgttacacatggtcttcttggcatatatcaggagctgttgggacttgctttccatcatgaagagggcgcatctgcatggcacgaggacgtgaggctctacaccgcaagggacgctgcatctggtgaagtggtgggtaaattttatctcgatctctaccctagggagggcaagtacggccatgcagcgtgtttcggattacagcctgggtgcctgcgacaggacggctctcgccagattgctattgccgctatggtggcaaatttcaccaaacccaccgctgatgccccttcactgctccagcatgatgaggtggaaacttattttcacgaatttggtcatgtgatgcatcagctttgctcacaggccgagttcgccatgttttcaggcacgcacgttgaacgggactttgtggaggcaccctcacaaatgctggaaaattgggtctgggagcaggagccgctgttaaggatgagcagacactacagaaccgggtccgctgtgcctagggaactgctggagaagctcatcgaatctcggcaggctaacacaggactgttcaacctccgccagatcgtgctggcaaaggtggatcaggcgctccatacacagactgacgccgaccccgcagaggagtacgcccggctgtgccaggagatactgggagtacctgcaacccccggcaccaacatgccagcgactttcggccatctggccggcggctatgacgcacaatactatggttacctctggtctgaggtgtactccatggacatgttccacactaggttcaaacaggaaggcgtgttgaactcaaaagtcggtatggactacaggtcctgcatcttgaggcccggaggctccgaggatgcttctgcaatgctgaggcggtttcttgggagggatccgaagcaggatgctttcctgctttcaaagggacttcaagtaggaggttgcgagcccgagccacaagtgtgctag

SEQ ID NO: 137744 - DNA, 777 bp, Artificial Sequence
  Description of Artificial Sequence: Synthetic coding sequence
atgttcagtggaacacacgtcgaacgcgactttgtagaagctccctcccaaatgcttgaaaattgggtctgggagcaagaaccccttctgcgcatgtcgcgacactataggactggaagtgcagtgccacgcgagctgctcgaaaaattgattgagagccggcaggcgaatactggcttgtttaatctaagacaaattgtcctagcaaaggtcgaccaggctctgcatacacagacagacgccgacccagctgaagaatacgctcggctgtgccaagagatcctgggagtgcccgcgacccccgggaccaacatgcccgccacattcggacacctcgccgggggatatgacgcccagtactatggatatctgtggagtgaggtttactctatggatatgtttcacacacgcttcaaacaggaaggcgttctgaactctaagttccctcattatgaagtgaggcccctgaggcacgtgagcctgtgtctacctcttacctggtgcgatcccggaagcggacagcccccagagagcctgacccgaaatcgctggttgcccgctctgagagcaggccccgcactcccgggctgcaacatcgccctcggctctctccaggtggggatggattacaggtcttgtattctgaggccaggcgggtcggaggacgccagcgctatgctaaggagattcctcggccgagaccctaaacaggacgcttttctgctgtcgaaaggcctccaggtgggcgggtgtgaacccgagcctcaggtctgctag

SEQ ID NO: 137745 - DNA, 738 bp, Artificial Sequence
  Description of Artificial Sequence: Synthetic coding sequence
atggacggtactcgcacctcacttgatattgaagagtattctgatacagaggtccagaaaaatcaagttctgacactggaggaatggcaggacaaatgggtcaacggaaaaaccgccttccaccaggaacagggccaccaactgttgaagaaacatctggacaccttcttgaagggtaagagcggactgagagtttttttccccctctgtggaaaagccgtcgaaatgaagtggtttgcagacaggggccatagcgtggtgggggtggaaatctctgaactcggcattcaggaattcttcactgagcagaacttatcctactcagaagagcccattacggagatccctgggacgaaggtttttaagtcaagctcaggaaatatatccctgtattgctgctccatcttcgacctgccgagaactaacatcggtaaattcgacatgatatgggatcggggcgctctggttgcaattaatcctggggaccggaagtgttatgccgataccatgttcagtctcctcgggaaaaaatttcagtatctgttatgcgtactatcttacgatcccaccaaacatccaggccccccattctatgtgccccacgctgagattgagaggctgttcggaaagatctgtaatattcgttgtctggagaaagtggacgcctttgaagagcggcacaagtcatggggcatcgactgcctatttgaaaaactatacttactgaccgaaaaatag

SEQ ID NO: 137746 - DNA, 519 bp, Artificial Sequence
  Description of Artificial Sequence: Synthetic coding sequence
atggaaaccaggccccgcctgggcgctacctgtttactcggattctcattcctattgctggttatctcatccgacggccacaatggccttggaaaaggctttggcgatcacatccattggcgcaccctagaggacggtaagaaagaagccgccgccagcggactccccctgatggtgatcatccataaaagctggtgcggggcgtgcaaggccctgaagccaaagttcgccgagtctaccgagataagtgagttatctcataactttgtcatggtgaatcttgaagatgaagaggagcccaaagatgaagacttcagtccagatggcggctatattcctagaatcttgtttctcgatcccagcggcaaagtacatcccgagattataaacgaaaacggtaatccaagctataaatatttttacgttagtgccgaacaggtggttcagggtatgaaggaagcccaggaacggctgactggcgatgcctttcggaaaaagcacctcgaggacgaactgtag

SEQ ID NO: 137747 - DNA, 1767 bp, Artificial Sequence
  Description of Artificial Sequence: Synthetic coding sequence
atggcgagtaagaagcgagaagtgcagctacagacagtgatcaataaccagtctttgtgggatgaaatgctgcagaataaaggcttgaccgtgattgatgtataccaggcttggtgcgggccgtgtagagctatgcagcccttatttcggaaactcaaaaatgaattgaacgaagatgagatactgcacttcgctgtggcagaagctgacaatattgttactttacagcccttccgagacaaatgcgagccagtgttcctgttttccgtgaacggcaaaattatcgaaaagatccagggagctaacgcaccgctggtcaacaagaaggtgatcaacctgatcgacgaggagagaaagatcgctgctggggagatggcccgtccacaatatccagagatcccactggtcgatagcgatagcgaggtaagtgaggaaagcccctgcgagagcgtccaggagctgtatagcatcgctatcattaaacctgacgccgtcatttccaagaaggttctagagatcaagcggaagattaccaaggctgggtttatcatcgaggccgaacacaaaaccgtcctgaccgaggaacaggtggtgaatttttattccaggattgcagatcagtgcgacttcgaagaattcgtgagcttcatgactagcggcctctcatacatcctagtcgtgtcgcaaggctccaagcacaatcctccatccgaggagactgaaccacaaactgatacggagccaaacgagaggtctgaagatcagcccgaggtggaggcccaagtgacgccaggaatgatgaagaacaagcaggattccctgcaggaatacctggagaggcagcatttggctcagctgtgcgacattgaggaggacgcggctaacgtagctaaattcatggatgccttttttcccgacttcaaaaagatgaaatctatgaaactcgagaaaaccttggcactgctcaggcctaatctttttcacgagcggaaggacgatgtgttgagaatcattaaagacgaagacttcaaaatcctggagcagaggcaggtggtcctcagtgagaaggaggctcaggctctgtgtaaagagtacgaaaatgaggactatttcaacaagctgattgaaaacatgaccagcggcccctctttggccctcgtcttactgcgggataacggactccagtattggaaacagttacttggcccacgcacagtagaggaggcgattgagtattttccagaatcgctgtgtgcccaatttgctatggactccctgccggtaaatcagctgtatgggagcgacagccttgagacggcagaaagggagatccagcacttcttcccacttcagagcactcttgggttgattaaaccacatgccacaagtgaacagcgggagcagatcctgaaaattgtcaaggaagccggatttgacttgacccaggtcaaaaagatgtttttgaccccagagcagattgagaagatatacccaaaagtcacaggaaaggatttttataaggatctgctcgagatgctctccgtaggacccagtatggttatgattctgaccaaatggaacgccgtggcggaatggaggcggctgatgggccccaccgatcccgaggaagctaagctgctgtccccagacagcatcagggctcaatttggaatttcaaaattaaagaacatcgtgcacggcgctagcaacgcctacgaagctaaagaggtcgtaaatagactgttcgaagaccccgaggagaactag

SEQ ID NO: 137748 - DNA, 1767 bp, Artificial Sequence
  Description of Artificial Sequence: Synthetic coding sequence
atggcatctaagaagcgtgaagtgcagctccaaaccgtgatcaataatcaatcactatgggacgagatgttacagaataagggcctgaccgtgattgatgtgtaccaggcctggtgtggaccgtgccgggcgatgcagcccctgtttagaaagctaaagaacgaactcaatgaggacgaaatcctgcactttgctgtcgctgaagccgataacatcgtgacgctgcagcccttccgcgataagtgtgaacctgtgttccttttcagcgtcaatggcaaaatcatcgaaaagatccagggcgctaacgccccacttgtgaataagaaggtgataaatctgatcgacgaagagcggaaaattgcagctggcgaaatggcccgcccacagtatcccgaaattcctctggtagattccgactctgaagtaagcgaggagtctccctgtgagtccgtgcaagagctgtattccatcgcaataattaaacccgatgcggtgatctccaagaaggtgcttgaaataaaacggaagatcaccaaagccggctttatcatcgaggcagaacacaaaactgtgctgactgaagagcaggtagtgaatttttattcacgtattgccgatcaatgtgattttgaggagttcgtaagttttatgactagcggcctgagctacatactggtggtttctcagggaagcaagcacaatcccccaagcgaagagacagagccccagactgacacagagcctaatgaaaggagcgaggatcagccggaggtggaagcccaggtcacccctggaatgatgaagaacaagcaagatagcctccaggagtatctggagaggcagcatctagcgcagttatgcgacattgaggaagacgccgccaatgtggctaagtttatggatgcttttttccccgattttaagaaaatgaaatcgatgaaacttgagaaaacattggctctgcttcggccgaatttattccatgagcgaaaggatgacgtgctgcggatcataaaggatgaggattttaagatacttgagcaaaggcaggtcgttctcagtgagaaggaggcccaggcgctgtgcaaggaatatgaaaatgaagactactttaataagttgattgaaaacatgacatccggcccgagcctggcgttggtgttgctgcgcgacaacggactgcagtactggaaacagcttctcggacctaggactgtggaggaggctatagagtactttcctgagagtctttgtgctcagtttgcaatggactcccttccagttaatcagctctatggctcagatagtttggagaccgcagaacgcgagattcagcatttctttcccctgcagtccacactgggactgataaaaccgcacgccacatcagaacagcgcgaacagatcctgaaaattgttaaagaagcgggcttcgatctgacacaggttaagaagatgtttttgacccccgaacagatcgagaaaatctatccaaaggtgacaggaaaggacttttacaaggatctgcttgaaatgctgtccgtgggcccctccatggtaatgattttaacaaaatggaacgccgtagctgagtggcggcggctgatgggtcccactgacccagaggaagccaagctcttatcccctgacagcattagagcacagttcgggatcagtaagttgaagaatattgttcatggcgcaagtaacgcatacgaggctaaggaagtggtcaaccgtctgtttgaagatcccgaagaaaattag

SEQ ID NO: 137749 - DNA, 681 bp, Artificial Sequence
  Description of Artificial Sequence: Synthetic coding sequence
atggaagccgatgcctccgtcgacatgttttcaaaggtcctcgagcatcagttattacagaccaccaagttggtggaggagcacttggattccgagatacagaaactggatcaaatggatgaggacgagctcgaaaggcttaaagaaaagagattgcaggccctccggaaagcccaacagcagaaacaggagtggctgtcaaaaggacatggtgaatacagagaaattccctcagagcgcgatttttttcaggaggtgaaagagtccgaaaacgtagtgtgccacttttatcgtgactccactttccggtgcaaaatactggatcgtcatctcgccatcctgtctaagaagcacctggaaaccaaattcttgaaactgaacgttgaaaaggcaccatttctatgtgaacggctccatatcaaggtaattcccactttagcattgctaaaggatggaaagacccaagattatgtggtgggctttaccgacttggggaacaccgacgacttcacaaccgagaccctggagtggaggttgggctcttctgacatcttaaactacagtgggaatctcatggagccaccgttccagaatcagaagaagtttgggaccaactttacaaaactggaaaaaaaaacaatccggggtaagaagtacgacagcgattccgacgacgactag

SEQ ID NO: 137750 - DNA, 408 bp, Artificial Sequence
  Description of Artificial Sequence: Synthetic coding sequence
atggaggccgacgcaagcgtcgatatgttttccaaggttctggaacaccagttactgcaaaccacaaaactcgttgaggaacatcttgattcagaaatccagaagttagaccagatggatgaagatgagttagaacgcctgaaagaaaagaggttgcaagccttgaggaaagcacagcagcagaaacaggagtggcttagcaaaggacacggcgagtaccgagagatcccctccgaaagggacttttttcaagaggtgaaagaatccgagaatgttgtgtgccatttttatagggactctacatttcgctgtaaaattctggatagacacctcgcaattttgagtaagaaacaccttgaaaccaagtttttaaagctgaatgtggaaaaagccccattcttgtgctag

SEQ ID NO: 137751 - DNA, 627 bp, Artificial Sequence
  Description of Artificial Sequence: Synthetic coding sequence
atgagtcagaaatccttggccccaagactcaacagcgtgcctttcggccggatggaggccgacgcaagtgtggacatgttctctaaagtattagagcaccagttactgcagacgaccaagttagtggaggaacacctcgacagcgaaatacagaagttggaccagatggacgaggacgaactggagagactgaaggagaagaggttgcaggcactgagaaaagcacagcagcagaaacaagaatggttgtctaagggccacggcgagtacagagaaatcccttctgagagggactttttccaggaggtgaaggagtctgagaacgtcgtatgccacttctaccgagactcaacctttcgatgcaaaatccttgaccggcacctcgccattctgagtaagaagcacctggagacaaaattcctgaagctcaacgtggaaaaggcaccattcctttgcgagcgactgcacattaaggtcattcctacactggcattgcttaaagatggcaaaactcaggactatgtggtcggattcacggaccttggtaacacagatgatttcaccactgagacgcttgagtggagactggggtctagcgacatcctcaactaccgctggtggccctag

SEQ ID NO: 137752 - DNA, 1017 bp, Artificial Sequence
  Description of Artificial Sequence: Synthetic coding sequence
atggctgcaatggccgtcgctctgcggggattgggaggtcgatttcggtggcggacccaggcagttgccgggggggttcggggcgcggctcgcggtgctgctgcgggacagcgcgactacgatctgctggttgttggaggtggctctggcggcctcgcttgcgcaaaggaagcggcgcaacttggcagaaaggtggcagtggtcgattacgtcgagccttcgccacagggcaccagatggggactgggagggacctgcgttaacgtggggtgcatcccaaaaaaactgatgcaccaagctgcgctcctcggcggactgattcaggacgccccgaattacgggtgggaggtggcccagcctgtgcctcacgactggcgcaagatggctgaggccgtgcagaatcatgttaaatctctgaattggggccaccgcgtccagcttcaggaccgcaaggtgaaatacttcaacatcaaagcctcctttgtcgacgagcatacggtgtgtggtgtggccaaggggggaaaagagattttactgtcagcggatcatatcattatcgcaactggaggccgacctcgttaccccacccatatcgagggcgcattagagtacggcatcacttctgatgatatcttctggcttaaggagtcacctgggaagaccctcgttgtaggagcatcctacgtcgctttagaatgtgccggattcctgacagggatcggactagacactacaattatgatgaggtcaattcccttaaggggctttgatcaacagatgtcctctatggtgattgagcatatggcctcgcacggcaccaggtttctgagggggtgcgctccatcaagggtgcgccggctccccgacggccagctccaggttacctgggaagactcgaccaccgggaaggaggacactgggacctttgacactgtgctctgggcaatagctccctgtatttctgcatgtctgcctaccacagtgggtcacgcaggcaaaaaccagcgtagggactag

SEQ ID NO: 137753 - DNA, 1485 bp, Artificial Sequence
  Description of Artificial Sequence: Synthetic coding sequence
  Description of Combined DNA/RNA Molecule: Synthetic coding sequence
atggaggaccaggcaggccagagagactatgatctgctggttgtaggagggggcagtggcggacttgcctgtgccaaggaagctgctcagctcggcaggaaagtggctgtcgtggactatgtggagccctcaccccagggcacaagatggggactcgggggaacctgcgtgaacgttggctgcattccaaaaaaacttatgcatcaggctgctttgttagggggactgatccaggacgcccccaactacgggtgggaagtggcccagccagtgccacacgattggcgaaagatggccgaagctgtgcaaaatcacgtgaagtcactgaattgggggcacagggtgcagctccaagaccggaaggtgaaatatttcaacattaaggcgtccttcgttgatgagcacactgtgtgcggtgttgccaaggggggaaaggaaatcctgctgagcgcggaccatattatcatcgccaccggaggcagacctcgctaccctacacacatcgagggcgcattggagtatggaataacctccgacgacatcttctggttgaaggaatctccagggaaaacactagtggtcggagcaagctatgtagcattggagtgcgccggctttttaaccggcattgggctggatactaccattatgatgcgcagcattcctctgcgcggttttgatcaacagatgagtagtatggtaattgaacatatggcttctcacggtacacgattcctgcgcgggtgcgcccctagtagggtccggaggctgcctgatggccagttgcaagtcacttgggaggatagcaccacgggcaaagaagatacaggcacatttgacactgtactctgggctatcggacgggtccctgacacccgcagccttaatctggaaaaggccggggttgatactagtcctgatacccaaaaaattctggtggattccagagaggccacatcagtccctcatatctacgcgattggcgacgttgtggaaggaaggccagagctgactccaatcgctataatggctgggagactgctggtccagcgccttttcggtggttcgtccgacctgatggattacgacaacgtcccaacaaccgtgttcacgcctctggaatatgggtgtgtaggtctctccgaggaagaggcagtcgcacgacatgggcaggagcacgtggaggtgtaccatgcccactataagccccttgagtttactgtagcaggacgagacgcatctcagtgctacgtgaaaatggtatgtctccgcgaaccgccacaactggtcctgggcttgcactttctggggcccaacgcaggtgaagtgacacaaggtttcgctctggggataaagtgtggtgcttcctatgcccaggtcatgcggacagtgggcattcacccgacctgctccgaggaggtcgtgaagctgcggatatccaaaagaagtgggcttgaccctacagtgaccgggtgtugagggtag

SEQ ID NO: 137754 - DNA, 1575 bp, Artificial Sequence
  Description of Artificial Sequence: Synthetic coding sequence
  Description of Combined DNA/RNA Molecule: Synthetic coding sequence
atggccgccatggctgtcgcgctgcggggcctgggaggacggtttagatggagaacacaggccgtagctggaggagtcaggggcgccgctaggggggccgcagccgggcagagagactacgacctgcttgtggttggtgggggatcaggcggcctcgcatgtgctaaggaggccgcacagctcggcaggaaggttgcggtggtagactacgtggagccttctcctcagggcacacgctggggcctcgggggcacatgtgttaatgttggatgcatccccaagaaacttatgcatcaagctgcactactcggcggactgattcaggacgcacccaactatggctgggaagtggcacagcctgtgccacacgactggaggaagatggcggaagcagtacagaaccacgtgaaatctctgaattggggtcaccgggtccagctgcaagaccgcaaggtgaaatatttcaacatcaaagcctcttttgtggatgagcacacagtgtgtggcgttgccaaaggaggcaaggagatactgttgtccgctgatcacatcattatcgccaccggcgggcgtccacgctaccccacacatatagaaggcgccctggagtatggaattaccagtgacgatatcttctggttaaaggaaagcccaggcaaaacattagtcgtcggcgcatcctatgttgcacttgaatgtgccggttttctcactggtatcggcctggatacgacaattatgatgcgatctatcccactcaggggtttcgaccagcaaatgagcagtatggtcatagagcacatggcatctcacggaacacgatttctgagggggtgcgcgcccagccgggtgagaagacttcctgacgggcagctgcaggtaacatgggaggactcaacgactggcaaagaggatactggaacatttgacacagttctatgggctataggacgcgtaccagataccagaagtctgaatctcgaaaaggccggagtcgatacttcccccgatacacagaagatccttgtcgattcacgggaggcaaccagcgttccccatatatatgcaatcggagacgtcgtggagggccggcccgaattgacccccatcgcaatcatggcgggaaggctcttagtacagcgcctgtttggcggctcaagtgacttgatggactatgataacgtgccgaccacggtattcactccgttggagtacggctgcgtgggcctttccgaggaggaggcagttgcacggcacggtcaggagcacgttgaagtgtaccacgcccactacaagcccttggaatttactgtggccggccgcgacgcttctcagtgctacgtgaaaatggtttgtctgcgtgaacccccacagctggtcctgggcctgcatttcctcggccccaacgccggcgaagttacccagggcttcgcactcgggatcaaatgtggagcctcctacgcccaggttatgaggacagtgggaatccaccccacctgtagcgaagaagttgtgaaattgcgcatttccaaaagaagtggcctagaccccacagtgaccggttgcugagggtag

SEQ ID NO: 137755 - DNA, 1566 bp, Artificial Sequence
  Description of Artificial Sequence: Synthetic coding sequence
atggcagctatggcagtggcactcaggggtctaggcggcagattccgctggaggacacaagccgtggctggcggcgttagaggtgcagcacgtggagccgctggccagagggactatgatctgcttgtggtgggtggtggttcagggggcctagcctgtgcaaaagaggctgctcagctgggacggaaagttgcagtggtggactacgtggagccatctccacaaggaactcggtggggactgggtgggacctgtgttaacgtagggtgcattcctaaaaagctcatgcaccaagccgccttactcggggggcttatacaggatgctcctaattacggttgggaagttgcacagcccgtgccacacgactggagaaaaatggccgaagccgtgcagaaccatgtcaaatcattgaattggggccaccgcgtgcagctccaggatcgtaaagtgaagtactttaacataaaagcaagctttgtggacgagcatacagtttgtggcgtcgccaaggggggaaaggagatactgttgagcgcagaccatataattattgctactggtgggcgccctcgctaccccacgcatatcgagggagccctggaatatgggatcacctctgatgatatattctggctgaaggagtcgccagggaaaactcttgtcgtgggggcgtcttacgttgccctggaatgcgctggcttccttaccggtattggtctcgataccaccattatgatgaggagcatacctctccgggggttcgatcagcagatgagcagtatggtgatcgagcatatggccagccacgggacaagatttttgcggggctgtgcacctagccgggtaaggagactgcctgacggtcagctgcaggtgacctgggaggactcaactacgggcaaagaggacacagggacgttcgatactgtgctgtgggctatcggccgcgtccccgacacaagatctctaaatttagaaaaagccggcgttgatacgagtccagacacccagaagattctcgtcgacagtcgggaagctacaagtgtccctcacatatatgcaatcggcgacgttgtggagggtagaccggagcttacccccatcgcaattatggctggtaggctgctcgtgcagcgcttgtttggaggtagcagcgatctcatggattatgacaatgtacccacaacagttttcacacccttggagtatggatgcgttggactctccgaggaagaagctgtggctaggcacggtcaggaacacgtcgaggtctaccacgcacattataaaccgctcgaattcacagttgccgggagggatgctagccaatgttatgtgaaaatggtgtgtctcagagagccacctcagctcgtattaggcttacacttcctgggccccaatgcaggagaagtgactcaggggttcgccctgggcatcaagtgtggcgcaagttatgcccaggttatgagaacagtcggaatccaccccacttgcagcgaggaggtggtgaaactgagaatctccaagagatcgggtcttgatccaaccgtgactgggtgttag

SEQ ID NO: 137756 - DNA, 1569 bp, Artificial Sequence
  Description of Artificial Sequence: Synthetic coding sequence
atggctgccatggctgtggctctccgaggccttggcgggcggttccgttggcgaacgcaggcagtggccggcggcgtgcgtggtgcagcacgcggagccgccgctgggcaacgagactacgatctcctcgtggtcggcggaggaagtggcggcctggcttgtgcaaaagaagccgctcagctgggcaggaaggttgcagtggttgattatgtagaaccttcaccacagggtacacggtggggactcggtgggacatgtgtcaatgtgggttgcatccccaagaaattgatgcaccaggcagccctgctgggcggtcttattcaggatgcgcccaattacggttgggaagtggcacagccggtgcctcacgattggaggaaaatggctgaggcggtgcagaaccacgtaaaatctctgaactggggtcacagagtgcagttgcaagaccgaaaggttaagtattttaatattaaggcatcatttgtggacgagcatacagtttgcggcgtcgcgaagggaggaaaagaaatcctgctgagcgcggatcatataatcatagccaccggggggaggcccaggtacccaacacacatcgagggcgccttggagtatggcatcacgagcgatgacatcttctggctcaaggagagccccggcaaaaccctgccagtaagcgtctcgtatgtggcactcgagtgcgccggatttctaacggggattggtctagacacaacgattatgatgagatctatcccccttcggggcttcgaccagcaaatgtccagtatggtgatagagcacatggcctctcatggtaccagattcctccgcgggtgcgccccgtccagggtgcgacgcctgcctgacggtcaattgcaggtcacctgggaagattcaacaacaggtaaagaggacaccggtacattcgacaccgtcctgtgggctattgggagggtgccagacacacggagcctgaacctcgagaaagccggcgtagacactagccccgatactcagaagattctggttgactccagggaggcaacttctgtccctcatatatatgccattggggacgtggttgagggcaggccggaactgactccaatcgccattatggcgggacggctgttagtgcagcgtctattcggagggtcctccgacctgatggattacgacaacgtccccactaccgttttcacccccctagaatatggctgtgttggcctaagcgaagaggaagccgtcgccagacacggccaggagcacgtggaagtttaccacgctcattataaacctctcgagttcactgttgccggaagagatgcctcacagtgttacgtgaagatggtctgcctgagggagcctccacaacttgtcctgggcctgcattttcttggccctaacgccggcgaagtgactcaagggttcgcgttaggaataaagtgtggagcgtcatacgctcaggtgatgcggacggtggggatccatcctacttgtagtgaagaagtggtgaaactgcgtatctccaagaggagtggactggacccgaccgtgacgggctgctag

SEQ ID NO: 137757 - DNA, 1281 bp, Artificial Sequence
  Description of Artificial Sequence: Synthetic coding sequence
atgcaccaggcagccctcctgggcggattgatacaggacgctcctaactacgggtgggaagtggcacaacccgtgccacatgattggcgaaagatggcagaggcagttcagaatcatgtgaagtcactcaactggggccatcgagtgcagctacaagaccggaaagtaaagtacttcaatattaaggccagttttgtggacgaacacaccgtgtgtggtgtggcaaaaggaggcaaagaaattctattaagcgccgaccatattatcattgctaccggcggccggccacggtatcccacacacattgagggcgccctcgaatacggaatcacttcagacgacattttctggctgaaggaaagccctggcaagacctgcgtagtagcacacgcctatgtcgctctcgaatgcgccggtttcctcactggcattgggctggatacaaccattatgatgcgttccattcccttaagaggttttgatcaacagatgtcttcaatggtcatcgaacacatggctagccacgggacccgattcctgcgtgggtgtgccccaagtcgggtgcggcgcctgcctgatggtcagctgcaagttacgtgggaggactccacaacaggtaaggaggatacaggcaccttcgacaccgtcttgtgggctattggtcgcgtaccggacactaggtctctgaatcttgagaaggccggtgttgacacttctccagatacacagaaaatcctggtggactctcgagaagctactagcgtgcctcatatatacgccatcggagatgtcgtggaaggcagaccagagttaacacccatcgccatcatggccggccgcctcttggtacagcgcttattcggaggctcctccgatctgatggactacgataatgttcccacgactgtgttcactccgttagagtacgggtgtgtgggactctctgaggaggaagctgtcgcccgccatggacaggaacacgtggaggtgtaccacgcccattacaagccgctggagttcaccgtcgcaggcagagatgccagccagtgctacgtgaaaatggtgtgcctgagagagcctcctcagctcgtcttaggactccactttctcgggcccaacgcgggggaggtgacccaaggcttcgcgctgggaattaaatgtggcgcttcatacgcacaggtcatgcgaactgttggcatccaccctacttgcagcgaggaggttgtcaagttgcggatttctaagagatctggcttagaccctacggtgacgggctgttag

SEQ ID NO: 137758 - DNA, 1479 bp, Artificial Sequence
  Description of Artificial Sequence: Synthetic coding sequence
atggaagaccaggccgggcaacgggactatgatctcctcgtcgtagggggtgggtcagggggcttagcctgcgctaaggaggccgcacaactagggagaaaggtcgcggtcgtagactacgtcgagccttccccgcagggaacccgatgggggctgggcggcacttgtgtaaacgttgggtgtatacccaagaagctgatgcatcaggctgccctgctgggcggactaattcaggacgctcctaattacgggtgggaagtggcccagcctgtgcctcacgactggcggaaaatggccgaggccgtccaaaaccacgtaaagagcttgaattggggccatcgggttcagcttcaagaccggaaagtgaaatattttaatatcaaggcctcttttgtggatgaacatacagtctgcggcgtggcaaagggcggaaaagaaatactgctgtcagccgatcacattatcatcgcaacaggtggcaggccccgataccctacccatatcgaaggcgctctggagtatgggattacatcagatgacatcttctggttgaaggagagccccggcaagaccctggtggttggcgcctcctatgtcgccctggaatgtgctggcttccttacaggcatcgggctcgacactaccataatgatgcgttccataccactcagaggcttcgatcagcagatgagcagtatggtcattgagcacatggcatcccatggcacgcgctttctgagaggttgtgctcctagccgagttcgacgcttgcctgacggtcagctgcaagtcacctgggaagattccacaaccggcaaggaggacactgggaccttcgacacagtgttgtgggccataggacgcgttccagatacccggtccctcaacctcgagaaggcgggcgtggacacaagcccagacacacagaaaatcctggtagatagcagagaggccacaagtgtacctcacatatacgcgataggagatgttgtcgagggccggccagagctgactccaatcgccattatggctgggcggttgctcgtgcagcgcctatttggcggatcctctgatctgatggattatgataacgttccgaccaccgtgtttaccccactagagtatgggtgcgtcggcctgtctgaggaggaggctgtggcacggcatgggcaggaacatgtcgaagtgtaccatgcccactacaagcctctcgaattcacagtggccggccgcgatgccagccaatgctacgtgaagatggtgtgtctgcgggagccaccccaattggtgcttggactgcactttctcggccctaatgccggagaagtgacacagggtttcgcactgggtatcaagtgcggggcatcatacgcccaggtgatgagaacggtgggaattcacccaacctgttctgaggaggtcgtgaaacttcgcatctccaaaagaagcggactcgatcccaccgtcactgggtgctag

SEQ ID NO: 137759 - DNA, 429 bp, Artificial Sequence
  Description of Artificial Sequence: Synthetic coding sequence
atgtcttatatgctgccacacctgcacaacggttggcaggtcgatcaggcgatattatccgaggaagacagagtggtggtgatacgttttggccacgactgggaccctacttgcatgaagatggacgaagtactctattctattgccgagaaagtaaagaattttgctgtgatctacttagtggatatcaccgaggtgcccgatttcaataaaatgtacgagctgtacgacccctgcactgtgatgttcttttttagaaacaagcacatcatgatcgatctggggacaggcaacaataacaaaatcaattgggctatggaggacaagcaggagatggttgacatcattgagactgtgtaccggggcgctcgcaaagggcgggggctggtcgtcagtcccaaagactatagtacaaaataccggtactag

SEQ ID NO: 137760 - DNA, 276 bp, Artificial Sequence
  Description of Artificial Sequence: Synthetic coding sequence
atgagttatatgttaccccatttacacaatggctggcaagtagaccaggctatcttgtccgaggaggatcgggtggtcgtaattcggtttggccatgattgggatcccacatgcatgaagatggacgaggtcttatacagcattgctgaaaaggttaagaactttgccgtcatctacctggtggacataacagaggtgccagatttcaacaagatgtatgaactgtacgatccctgtactgtgatgttctttttttcatatcaccgcgggtggtag

SEQ ID NO: 137761 - DNA, 894 bp, Artificial Sequence
  Description of Artificial Sequence: Synthetic coding sequence
atggtccatcaagtcctgtatagggcccttgttagtacaaaatggctggcggaatctatccgcacgggaaagctgggtcccgggctgcgggtgctggacgcctcttggtactcgcctggaacaagagaagcacgaaaggaatatttagagcggcacgtcccgggagcttcattcttcgacattgaagagtgcagagataccgcatccccctatgagatgatgctgccctcagaggctggattcgctgagtacgttggaaggctgggcattagtaaccatacacacgtcgtggtttacgacggggagcacttgggttctttctatgccccacgggtgtggtggatgttcagggtctttggtcaccgcaccgtttcagtgttgaatggcgggttccgtaactggctaaaggaagggcacccagtgacttccgagcccagtagacccgagccagctgttttcaaggccacgcttgatcggtcattgctgaaaacctatgaacaagtactcgagaacctggagagcaagcgctttcagctggtagacagtagatctcaagggaggttcctgggcaccgagcccgagccggacgcagtagggctggattccggtcatatcagaggagctgtgaatatgccctttatggactttttgaccgaggacggattcgagaaggggcctgaggagctacgcgctctattccagaccaagaaggttgatctcagtcagccactgattgccacatgcagaaaaggcgttaccgcctgccatgtggctttggcggcctacctttgtggaaagccagatgtggctgtgtacgacgggtcttggtcagaatggtttagacgggcacctccggaatcccgtgtgtcccagggtaaaagtgagaaggcctag

SEQ ID NO: 137762 - DNA, 894 bp, Artificial Sequence
  Description of Artificial Sequence: Synthetic coding sequence
atggtgcatcaggttctttatcgtgctctcgtctccaccaaatggctagcagagagcatccgcacaggcaaattgggccccggtctgagagtgttggatgcaagttggtactcacccgggacccgggaggctagaaaggagtaccttgagcggcacgtccctggtgcttcattctttgacatcgaggagtgcagagacactgctagtccttacgaaatgatgctccccagtgaagccggcttcgccgagtacgttggacgcctggggataagcaaccatactcatgtggtcgtctacgacggtgaacaccttggctccttctatgctcctagggtctggtggatgttcagagtgttcgggcaccgcaccgtttccgtgttaaacggcggtttcagaaactggctaaaagaagggcaccctgtaacgagcgagccatcgagacctgaacctgccgtgttcaaggccaccttagaccgtagtctgctgaagacttacgagcaggtcctcgagaaccttgaatccaagcggttccaattggtcgattctagatctcagggtcgattcctggggactgagcccgaacccgacgccgtaggcctcgactccggacacatacgcggcgctgtgaatatgccctttatggactttctaacagaagacggcttcgagaaggggccagaagagctccgtgctctctttcagaccaagaaagtggatttgagccagcctctgatcgcgacatgtagaaagggggtgacagcctgtcatgtcgccctggccgcgtacttatgtggcaaaccagatgtcgctgtgtatgatggatcctggagcgaatggttcagacgggctccgcctgagagccgggtgagccagggtaagagtgaaaaagcatag

SEQ ID NO: 137763 - DNA, 735 bp, Artificial Sequence
  Description of Artificial Sequence: Synthetic coding sequence
atggtgcaccaggtcctttacagagcactggtgtcgaccaagtggttggcagagtctattagaactgggaagctgggtcccggactgagagtgctggacgcatcttggtacagccccggtacccgtgaagctcggaaggaatatctggaacgacatgttcccggggccagtttctttgacattgaagaatgccgggatacggctagcccgtatgagatgatgttgccaagtgaagccggttttgccgagtacgtcgggcggcttggcatctcaaatcacactcacgtggttgtctatgatggagagcacttgggatccttctatgcccctagggtgtggtggatgtttagggtgttcggtcatcgtactgtgtctgtgctgaatggaggcttccgaaactggctgaaggaggggcacccagtcacgagtgaaccctctaggcccgaaccagcagtattcaaagcaaccctcgaccgctccctcctgaaaacctatgaacaagttctggagaacctagagtcgaaaagatttcagctcgtggatagtcgaagtcagggcaggtttctgggcaccgaaccagagcctgacgccgtgggactggattccgggcatattcgaggtgccgtgaacatgcccttcatggattttcttaccgaggatggctcatggtctgaatggttccgccgagctccccctgaaagcagagtttcacagggaaagagcgaaaaggcctag

SEQ ID NO: 137764 - DNA, 375 bp, Artificial Sequence
  Description of Artificial Sequence: Synthetic coding sequence
atggttcaccaggtgctgtaccgggctcttgtgagcaccaagtggctggccgagagtatacgaaccggcaagctgggccccggtttgcgcgttctcgacgcctcctggtattcccccggtaccagagaggccagaaaagagtacctggagcggcatgtgcccggtgccagcttttttgacatcgaagagtgccgagacactgccagcccctatgagatgatgctcccaagcgaggcaggctttgcggaatatgtgggtagactgggcatctccaaccatactcacgtcgttgtgtacgacggtgagcatctcggaagtttctatgcccctagagtttggtggatgttccgagtgtttggtcaccgtacagtttag

SEQ ID NO: 137765 - DNA, 1974 bp, Artificial Sequence
  Description of Artificial Sequence: Synthetic coding sequence
atgtcccccacgcctcccctgttctcgctccccgaggctcgaactagatttactaaaagcacgcgcgaggcactgaataataagaatatcaaaccactgctctccaccttttcccaggtcccaggtagcgaaaacgaaaagaagtgcacactggaccaagcatttcggggcatcctggaggaagagatcatcaatcacagttcttgcgaaaacgttctcgctataatttcactggccatcggtggggtcaccgagggaatctgtaccgcaagtacgccttttgtactgctgggggatgtactagactgtctgcccctggatcagtgtgacaccattttcacctttgttgagaaaaacgttgccacctggaaatctaatacattctacagcgcaggcaagaactacctgctcaggatgtgcaatgacctgctaagacgactgagtaagtcccaaaacacagtgttttgcggaagaattcagctctttctggcaaggctgttcccactaagcgagaagagcggcttgaacttgcagagtcaattcaacctggaaaacgtgaccgtgttcaatacaaacgagcaggaaagtactttgggccagaagcacactgaagatcgcgaggagggcatggatgtggaagaaggtgaaatgggtgacgaggaggctcccactacctgcagtatccccattgattacaatttatatcgcaaattctggtccttgcaggactactttcgcaatcctgtccagtgttacgagaagatttcgtggaagactttcctgaaatatagcgaagaagtgttggccgtgttcaaatcctacaaactggatgacactcaggcaagccgaaagaagatggaggaactgaagactggcggcgagcatgtctacttcgccaaatttttgacaagcgaaaagctgatggacctgcagctgtctgactcaaatttcaggcgccacattttgctgcagtatctcatcctcttccagtacttgaagggccaggtcaaatttaaaagctccaattatgtgttaacagacgagcaaagcctgtggatcgaagatacaactaagagtgtgtaccagctgcttagcgaaaacccaccagacggcgagcggttcagtaagatggtggaacatatcctgaatactgaagaaaactggaattcctggaagaatgaaggatgtccttcctttgtcaaggagaggacaagtgacactaagccgacccggatcattcggaaacgcacagcgccagaagacttccttgggaaggggcctacaaaaaaaatcctgatggggaatgaagagctgacccggctgtggaatctttgcccggataatatggaagcctgcaaatccgaaactcgcgagcacatgccgacccttgaggaattttttgaggaagccattgagcaggccgatcccgagaacatggtggagaacgaatacaaggccgtcaataactccaattacgggtggcgggccctcagactgttagctcgtcgctccccacacttctttcagcctaccaaccaacagttcaaatccttgcctgaatatcttgagaacatggtgatcaagttagcaaaggaacttcctccccccagtgaggaaatcaagacgggcgaggacgaagacgaggaagataacgatgccctgctcaaagaaaacgagtcacctgatgtccgtagagacaagcccgttaccggggaacaaatagaagtgttcgcaaataagttgggggagcagtggaaaatcctggcaccctatcttgaaatgaaggacagtgagattaggcagatcgaatgtgacagtgaagatatgaagatgcgcgccaaacagctgctcgtggcatggcaagatcaggaaggcgtgcacgcaacaccggagaacctgatcaatgctttgaacaagagcggactttccgacttggcagaatctttaactaatgacaatgaaacgaattcatag

SEQ ID NO: 137766 - DNA, 4782 bp, Artificial Sequence
  Description of Artificial Sequence: Synthetic coding sequence
atggctgctgccgcagtcgtggtgccggccgagtggatcaaaaactgggaaaaatcaggccgcggagagttcctgcacctctgtcgaatacttagtgaaaacaagtcacatgactcctcaacataccgggactttcagcaggccctgtacgaactatcttatcacgtaatcaaggggaaccttaaacacgagcaagccagtaatgtcctgagtgacatatcggaatttcgcgaagatatgccttcgatcctggcggacgtattttgtatcctggacatcgagactaattgtctagaggaaaagtccaagagagactacttcacccagctggtgcttgcttgtctctacctggtcagcgacaccgtcctcaaagagaggctggatcccgagactctcgaatctctgggcctgatcaaacagtcgcaacagttcaaccagaagagtgtcaaaataaagacgaagctgttctacaagcaacaaaagttcaatttattgcgtgaagagaatgaggggtacgccaaactcatcgctgagcttggtcaagacctgtccggctccatcactagtgacctcatactggagaacatcaaaagtcttataggctgttttaatttggaccctaatcgtgtgctcgatgtgattctggaggtgttcgagtgcagaccggagcacgatgactttttcatctcccttcttgagtcctacatgtccatgtgtgaaccccagaccttatgtcatattctcggcttcaagtttaagttctaccaggagccgaacggcgaaaccccgtcaagcctgtacagggtggctgctgttctcctgcagttcaacttgatcgatctggatgatctgtacgtgcacctgctgccagctgataactgcatcatggacgaacataagagagagatagccgaagccaagcagatagtcagaaagcttactatggtcgtgcttagctccgagaaaatggatgaaagggagaaggagaaggagaaggaagaagagaaggtagaaaaaccccccgacaaccagaagttgggactcctggaagctctgctgaagattggagattggcagcacgctcagaatattatggatcaaatgcctccgtattatgcagcttcacacaagcttatcgccctggctatctgtaaacttatacatattaccatcgagcccctttaccggagagttggagtacccaaaggcgccaagggaagcccggtcaacgccctgcagaataagagggccccgaaacaggcagagtcttttgaagatttacggcgcgacgtgttcaacatgttttgctacctgggaccacatttgtcacacgacccaattctgtttgccaaagtagtgcgcattggtaaatcttttatgaaagaattccagtcagacggaagcaagcaagaagacaaggaaaagaccgaagtgatactgagttgtttactctctatcacggaccaggtgttgctgccatcgttgtctttgatggactgcaatgcatgtatgtcagaagagctgtggggaatgtttaaaaccttcccttatcagcacagataccggctgtatggccagtggaaaaacgaaacgtacaattcacaccccctcctggtaaaagttaaagcgcagaccatcgacagggcaaagtacatcatgaaacgactgaccaaggagaatgtgaagccaagtgggagacaaatcgggaaattgtcacactccaatcccacaattctgttcgactacatccttagtcagatccagaagtacgataacctgatcactcctgtggtcgattccctgaagtatctgacctctctgaactacgacgtgctggcctattgtattattgaagcgttggcgaatccagagaaggagaggatgaaacacgacgatacaaccatttccagttggctgcagagcttggctagtttttgcggagccgtgttccggaagtaccccattgatctcgccgggctgttgcagtatgtcgcgaatcagctcaaggcgggcaagtcttttgatctcttaatcctgaaggaagtagtgcaaaaaatggccgggatcgaaattacagaggagatgacaatggaacaactcgaggctatgaccggaggtgagcagttgaaggcagaaggtgggtatttcggacagatcaggaataccaaaaagtccagccagcggcttaaggacgctctgctggaccacgaccttgcgctgccactgtgcttgctcatggcccagcaacgcaacggtgtcatctttcaggaaggcggggagaagcatctgaaattggtgggaaaactgtacgaccagtgtcacgacacgcttgtgcagttcggcggcttccttgcgtctaacctcagtaccgaggattacatcaaacgcgtgcctagcatcgatgtactctgtaacgaattccacactcctcacgacgctgcattctttctttctcggcccatgtatgcgcatcacataagctcgaagtacgacgagctcaagaagagcgaaaaggggtcaaaacagcaacacaaggttcacaagtatatcacgtcttgcgagatggtgatggctcccgttcatgaggctgtcgtgtccttacatgtgagtaaagtgtgggatgacatctcaccccagttctacgccacattttggtccctaaccatgtacgacctggcagtcccacacacttcatatgagcgcgaagtaaataaactgaaagtacagatgaaagccatagatgacaatcaggaaatgccacccaataagaaaaaaaaagaaaaagaaaggtgcacagctctacaggacaagctactcgaggaggaaaagaaacaaatggagcacgtacaacgcgttttgcaacgcctgaaactggaaaaggacaattggctgctcgccaagtcaacgaagaacgaaacaattacgaaattcctccaactgtgcatattcccccgctgtatcttttctgctattgacgcggtttactgtgcgaggttcgtggagctggtccaccagcagaagactcctaacttcagcaccttactgtgctacgaccgtgtttttagcgacattatctatacggtcgccagctgcaccgagaacgaagctagccgctatgggcgtttcctttgttgcatgttggaaaccgtgacgaggtggcattccgaccgagctacctacgaaaaagaatgcggcaattatcctggttttcttacaattctgcgcgcaactgggtttgacggtgggaacaaagctgaccaacttgattatgaaaatttccgccacgtcgtacacaagtggcactacaagcttaccaaagctagtgttcattgtctcgagactggtgagtatacccacatcagaaatatactgattgtactaactaaaatcctcccatggtacccaaaagttctgaacctcgggcaagctctagaacggagagttcataagatctgccaggaggagaaggagaagagaccggatctatatgccctagctatgggctactcgggccagctgaaaagccgaaagtcgtacatgattcccgaaaatgagtttcaccacaaggatcccccgccacgaaacgcagttgcgtcggtgcagaacggtcccggggggggacccagcagtagctcaattgggtccgcctccaaatctgatgaaagctcaactgaggaaactgataagagccgtgagcggagtcagtgcggcgtgaaggcagtcaataaggcttccagcacaaccccaaaaggaaattcatccaatggaaatagcgggtcgaacagtaacaaggccgtaaaagagaacgacaaagagaaggggaaggaaaaagagaaagagaagaaggagaaaaccccagccaccacgcctgaggccagggtgctgggcaaagatggaaaagaaaaaccaaaagaagagagaccaaacaaagacgaaaaggcgcgggagactaaagagcggacccctaagtcagacaaggaaaaggaaaaatttaagaaagaggaaaaagcgaaggacgagaagttcaaaactacagtacccaacgcagaatcaaagtctacccaggagcgggaaagagagaaagagccctcacgcgaacgggatatcgcgaaggagatgaagtccaaggaaaatgtgaaagggggcgaaaaaactccagtcagtggatctctgaaatcgcccgtgcccagatcagacatacccgaaccagaaagggaacagaaaagaagaaagatcgacacacatccatctccgtcacattctagcaccgttaaagattcgctcatagaactgaaggagtctagcgccaaactttacattaaccatacccctccacccttgtcgaagtcaaaagaacgggaaatggataaaaaggatctggataagtctcgggaacgatcgcgcgaaagagagaagaaagacgagaaagaccgcaaagaaaggaagcgggaccattccaacaacgatcgcgaggtgcctcccgatttgaccaaacggcgcaaggaggaaaatgggaccatgggagtgtctaagcacaagtctgagagtccttgtgaaagcccttaccctaatgagaaggacaaggagaagaacaaaagtaagtcttcagggaaagagaaggggtctgactcctttaagagtgaaaaaatggacaagatcagttcaggtgggaaaaaagagtcccgacacgataaggagaagatcgagaaaaaggagaaacgggattctagcgggggtaaagaagagaagaaacaccacaagtcttccgataaacaccgctag

SEQ ID NO: 137767 - DNA, 4782 bp, Artificial Sequence
  Description of Artificial Sequence: Synthetic coding sequence
atggccgcagcggcagttgttgtacccgcggagtggataaaaaactgggagaaatctggaagaggtgagttcctccacctgtgtaggatactctccgagaacaagtctcatgattcctccacctaccgtgactttcaacaggcgctgtacgagctgagctaccacgtgatcaaaggaaacttgaaacacgaacaggcgagcaatgtcctgtccgacatctctgaatttagggaggacatgcctagtatcttggctgatgttttctgcatcttggacattgagacaaattgcctagaggagaaatccaaacgtgattactttacccagctggtattagcgtgtttatatctagtgagcgacacggttcttaaggaacgcctggaccctgagacgctcgaatctctgggtctcattaagcaaagccagcaatttaaccagaaatctgtgaaaattaaaaccaaactgttctacaaacagcagaagtttaatctcttgcgagaagaaaacgaaggctatgccaagctgatagctgagctcggacaggatctgagcggaagtatcacgtcagatttaatcctcgagaacattaagagccttatcggctgtttcaacttggatccaaatagagtcttggacgtcattttggaagtcttcgaatgtcggccagagcacgatgacttctttatttcccttttggagagctatatgtcaatgtgcgaacctcagacgctgtgtcacattcttggatttaaattcaagttctaccaggaacccaacggcgaaacaccgagttcactttaccgggtagcagcagtgttattacagttcaatctcattgacctggacgacctgtacgtacacctgctgcctgcagacaactgcataatggatgagcacaagagggagattgccgaggccaaacagatcgtgcgaaagctaacaatggtggtgctctctagcgaaaaaatggatgaacgggagaaggagaaggaaaaagaagaagagaaagtcgagaagccccctgataatcagaagctggggttgctcgaggccctgctcaaaatcggtgattggcaacacgcacagaacatcatggaccagatgcccccatactacgccgcgtctcacaaattaattgctctcgcaatctgtaagcttatccacattaccatcgaaccgctttataggcgtgtaggcgtgcccaagggcgctaaaggctccccagtgaacgctcttcagaataagagggcaccaaagcaggctgagagttttgaggatctgcggagagatgtgttcaatatgttctgttacttgggacctcatctcagtcatgaccccattttattcgccaaagtcgtgagaattgggaagtcttttatgaaggagttccagtccgacgggagcaaacaggaggataaagagaaaactgaggttatccttagttgcttactgagcatcaccgaccaggttcttctgccttctctctctctgatggactgcaatgcctgtatgtccgaggaactgtggggcatgtttaaaacgtttccataccagcaccgctatcgattatatggacagtggaaaaatgagacctataacagccaccccctcctcgtgaaagtgaaagctcagactattgatcgtgccaaatacatcatgaagagactaacgaaagaaaatgtgaagccaagtggccggcagattggaaaactgtcccactccaaccccaccattctttttgactatatcttatcccagatacagaaatatgataatctcataacccctgtggttgattcactcaagtacttaacatctctcaactacgacgtactggcatactgtatcatcgaggccctcgccaaccccgagaaagaacggatgaagcacgacgacactactatctctagttggttacagtcgcttgcaagtttttgcggagctgttttccgaaaatatcctatcgacctggcaggcctcctgcagtatgtcgccaaccaattaaaggcggggaaaagtttcgatctgctcatcctcaaggaggtcgtgcagaaaatggccggaattgagataacagaggagatgacgatggagcagctggaagccatgactggaggcgaacagctgaaagctgaaggagggtattttggacaaatcagaaacactaagaaaagtagtcagcggctcaaggatgccttactcgaccacgacctggctttaccactgtgcctcctgatggcacagcaacggaacggcgtgattttccaggagggcggtgaaaagcatctgaagctggtgggaaagctgtacgaccagtgtcacgacaccctcgtccaatttgggggatttctggcgagcaacctgtccactgaggactacattaaacgcgttccatcaatcgacgtgctatgcaatgagttccacactccacacgacgctgctttcttcctttcacgcccaatgtatgctcaccacattagtagcaaatacgacgagctaaaaaagtctgaaaaaggatcaaaacagcagcataaggtgcataaatacataacttcttgtgaaatggtcatggcccccgtccacgaggcagtagtttcattacacgtgtctaaagtctgggacgacatttcccctcagttctatgctacattttggagcctgactatgtatgatctcgcagtccctcatacctcttatgaacgcgaggtgaacaagttaaaggtacagatgaaggccattgacgacaatcaggaaatgcctcccaataagaaaaagaaagagaaagaaagatgtacggcgctccaggataagcttcttgaagaggagaagaagcaaatggaacatgtgcagcgggtactacaacgcttgaagcttgagaaggacaactggttgttggcaaagtcaacaaaaaatgagactatcacaaagtttctgcagctgtgtatttttccacgatgcattttttcagccatcgacgcagtatattgcgctcgctttgtggaactagtccatcaacaaaagaccccaaattttagtacacttctgtgttatgatcgggtgtttagcgacattatatacactgtggcatcctgtacagagaacgaagcatcacgctatgggcgctttctgtgttgcatgctggaaactgtgaccaggtggcattcagaccgggctacttatgaaaaggaatgcggcaattaccctggctttcttacaatactgcgcgccaccgggttcgacgggggcaataaagccgatcagcttgactacgagaattttagacatgtggtgcataaatggcactataaacttactaaggcgtccgtgcattgcctcgagactggtgagtacactcacatccgcaatatcctgatcgtcctcacaaagatccttccatggtacccgaaggtgttgaacctgggtcaagccctggagcgaagggtgcataagatctgccaggaggaaaaggagaagcgtcccgacctgtacgcattggccatgggttactcaggccagctcaaaagtcgtaagagctatatgatacctgaaaacgagttccaccacaaagatccacctccccgaaacgcggtagcgtcagtccagaatggcccaggggggggcccgagttcaagttctatcgggtctgcatcaaaatccgacgaatctagcaccgaggagactgacaaatctcgtgaacgctcacagtgtggggtcaaggcagtcaacaaagcatctagcaccactcctaaaggcaatagcagcaatggcaattcaggtagcaattccaacaaagctgtgaaggagaacgataaggagaagggcaaagagaaggaaaaggagaaaaaggaaaaaacacccgctactacaccagaggcgcgtgtgctcgggaaggacggcaaagagaagcccaaggaagaaagaccaaataaagacgaaaaagctcgggagactaaggagcggactcccaagtccgacaaagagaaggaaaagttcaagaaggaggaaaaggcaaaagatgagaaatttaagacaacagtgcctaacgctgaaagcaagtccactcaggagagagagcgggagaaagagccttcccgcgagcgggatattgctaaggaaatgaagtctaaggagaacgtcaaaggaggggagaagaccccggtgtccggctctctcaagagcccagtcccaagatctgacatccccgaaccggagcgtgagcagaaaagaagaaaaattgacacacatccaagtccgtcccacagcagcacagtgaaagacagcctgatcgagctgaaggagtcttcagccaaactgtatataaatcacaccccccctcccctcagtaaatccaaagagagagaaatggataaaaaagatctggacaagtctcgggaacggtctcgagaacgcgaaaagaaggatgagaaggataggaaagaacggaagcgtgatcattccaacaatgatagggaagtgccgccagatctgacaaagcgaagaaaagaagagaatggtacaatgggcgttagcaaacataaaagcgagtccccatgcgaaagcccttatcctaatgagaaggataaggagaagaacaagagcaaatcatcagggaaagagaaaggatccgactcatttaaaagcgaaaaaatggacaaaatttcatccggagggaagaaagaaagccgccatgataaggagaagatcgagaagaaggagaaaagagattcctctggaggcaaggaagagaaaaagcaccataaaagttcagacaaacatagatag

SEQ ID NO: 137768 - DNA, 2547 bp, Artificial Sequence
  Description of Artificial Sequence: Synthetic coding sequence
atgccttccatcctggccgacgtgttctgtattctagatattgagaccaactgtcttgaggagaaatcaaagagagattactttacacagctggtgctggcctgcctgtacctagtgagcgatactgtgctcaaggagcgactggatcccgagacactcgagagtctgggtttgattaaacagagccagcaatttaaccaaaagagtgtaaaaataaaaaccaaactgttttataagcaacaaaaattcaacctacttagggaggagaatgaagggtacgcaaaactgatagccgagctgggacaggacttaagcggaagcatcacctccgatctaatcttagaaaatatcaaaagcctgatagggtgttttaaccttgatccgaatcgcgttctggatgtcatccttgaggtctttgagtgtcgacccgaacacgatgatttcttcataagcctgctcgaatcatatatgtcaatgtgtgagccacaaactctatgccacatcttgggtttcaaattcaagttttaccaagagcctaacggagaaacccccagtagtctgtaccgtgtggcggctgtcctgttgcagttcaatctcattgatctagatgacctgtatgtccacctgcttcctgccgataactgtatcatggatgagcacaagagggagattgctgaagctaagcagatagtccgcaaactaaccatggtggttctgtcctctgaaaaaatggatgagcgcgagaaagaaaaggagaaggaggaggaaaaagtagaaaaaccacctgacaaccagaagttgggcttgctggaagctctactaaaaatcggcgactggcagcatgcccagaacatcatggaccagatgccaccctactatgctgcctctcataaactcatcgccttagccatttgcaagctcattcacatcacgatcgaaccgctctatagaagagttggggttcccaaaggggccaaggggtcccctgttaatgccctgcagaataaaagagcaccaaagcaggctgagagttttgaagatttgcggagagacgtgtttaacatgttttgttatctcggtccgcatctctcccatgatccaatcctgtttgcaaaggtcgtgagaatcggtaagtcctttatgaaagaattccaatctgatgggtctaagcaggaagacaaggaaaagaccgaagttatactctcttgtctcctgtccataaccgaccaagtcctactgccttctttgagcctcatggactgtaatgcatgtatgagtgaggagctgtggggcatgtttaaaacttttccctaccagcaccgctatagactttacggccagtggaagaacgagacctacaattcgcacccgctgctcgtcaaggtgaaggcccagacaatcgaccgggctaagtacatcatgaaacggctaacaaaagaaaacgtgaaacccagcggacgccaaattggcaagctcagtcactccaatcctacgatcctctttgactacgtctgctttgagatcctgagtcaaatccagaaatacgataacttgatcacccccgtggtggatagccttaaatacttgaccagcctcaattacgacgtgctcgcttattgcatcattgaggccctggccaatccagagaaagagaggatgaagcacgacgacacgaccatttcaagttggctccaatccctggcttccttttgtggggctgtctttcgtaagtatccgattgacctggccggactgctgcagtacgtcgccaaccagttgaaggccgggaaatcattcgatctgttgatcctgaaggaggtggtgcaaaagatggccggaatcgagataacggaagaaatgacaatggaacaactcgaagccatgaccggtggggagcagctaaaggccgagggtggctatttcggccagatacggaatacaaaaaagagctcccaaaggctgaaggatgctctgctcgaccatgacttagcactcccgctgtgccttctgatggctcagcagaggaacggagtgattttccaggaaggcggagaaaagcacctgaagttagttggtaagctttacgaccagtgccacgacacgctggtacagtttggcgggtttcttgctagcaacctaagcactgaagactacatcaagcgagtgccatccattgacgtactctgcaacgagttccatacccctcacgacgctgccttttttcttagccggcccatgtatgcgcaccatatcagctcgaaatatgacgagctgaagaagtcagagaaaggttccaagcagcagcacaaggtgcataagtatatcacgagctgcgaaatggtcatggcccccgtccacgaggctgtggtgtcactccatgtcagcaaagtttgggacgatatctccccgcaattctacgcaaccttctggagcctcacgatgtacgatcttgccgtgccccacacatcctatgagcgggaagtgaacaagctcaaggtgcagatgaaagctattgacgataatcaggagatgatcccccctcaatag

SEQ ID NO: 137769 - DNA, 570 bp, Artificial Sequence
  Description of Artificial Sequence: Synthetic coding sequence
taagaacagaaacggcgaaagattgacacacatccttccccgtcccactcaagcaccgttaaagactctctgatcgaactcaaggaatcctccgcaaaactttatatcaaccacaccccgccaccactgagtaagtcaaaagaacgcgaaatggacaagaaggacctggacaagagcagggagaggtcaagggaacgggaaaaaaaggacgagaaggacagaaaagagagaaaacgggaccattctaataacgatcgtgaggtaccacccgatctgacaaagcggaggaaggaggaaaacggtaccatgggggtgtcgaaacataagagcgagagcccctgtgagtcgccctaccctaacgagaaggacaaggagaaaaacaaatccaaatcatctggcaaggagaaggggtctgactcctttaaaagtgaaaaaatggacaagatcagcagtggtgggaagaaagaaagcaggcacgataaggaaaaaatcgaaaagaaggagaaacgcgactcgtctggcggtaaagaagaaaagaagcaccataagagttctgataagcacaggtag

SEQ ID NO: 137770 - DNA, 1056 bp, Artificial Sequence
  Description of Artificial Sequence: Synthetic coding sequence
atggctgtgcccgcggccgctatggggcccagcgcgttgggccagtccggccccggcagcatggctccctggtgctccgtgtcctctggcccaagtcggtatgtattgggcatgcaggaacttttcagaggacattcaaaaactagggagtttttagctcattccgcaaaggtccattccgtggcatggtcttgtgacggacgacgtttggcttccggctctttcgataagacagcatccgtgtttctgttagagaaggaccggctcgtgaaggaaaacaattatagaggacacggggacagcgtagatcagctgtgctggcacccatccaacccagatttgttcgtgacagcgagtggcgataagacaataaggatctgggatgttcggaccaccaagtgtatcgccaccgtaaacaccaaaggcgagaatatcaacatatgctggagccctgacggccagaccatcgccgtgggtaataaggacgacgtggtgaccttcatagacgctaagacacacagaagcaaggcagaggagcaattcaaattcgaagttaacgaaattagctggaacaatgataacaatatgtttttcttgacaaacggtaacggttgcattaacattttgagttatccagagttgaagcctgtccagtctataaacgcccatcctagcaattgtatttgtattaagtttgatcctatgggcaagtactttgcaacaggatccgcggacgcattggtctcactctgggatgtcgacgagttggtgtgtgtgcgctgtttttcaaggctggactggccagttaggacgctctcattcagccatgatggcaaaatgctggcatccgcctcagaagatcactttatagacatcgccgaggtcgaaaccggagacaaactgtgggaggtgcagtgtgagtcccccaccttcacagtggcctggcaccctaaacggccactgctcgccttcgcttgcgacgacaaagatggcaagtacgactccagccgggaggcagggactgtcaagcttttcggcctgcctaacgattcttag

SEQ ID NO: 137771 - DNA, 2052 bp, Artificial Sequence
  Description of Artificial Sequence: Synthetic coding sequence
atgtcttctgaaagttcgaaaaagcggaaaccgaaagtgatccgtagtgacggggcaccggccgagggcaagagaaaccgatccgacacagagcaggaaggcaagtattactcagaagaggcagaggtcgatctccgagatccgggacgggattacgaactgtacaaatacacctgtcaagaactgcaacgccttatggccgaaattcaggatttgaaatcaagggggggaaaagacgtcgcaatcgaaattgaagagagacgtatccagagctgcgttcacttcatgaccttgaagaagttgaacaggctggcccatatcagactgaaaaaagggcgcgaccaaacccatgaagccaagcagaaagttgacgcctatcacttgcaacttcagaatctcctgtacgaagttatgcacctgcagaaagaaattaccaagtgcctggagtttaaatctaaacatgaagagatcgatttagtgagtcttgaggagttctacaaggaagccccaccagatatatccaaagctgaggttaccatgggggatccgcaccaacagactcttgccagactggactgggaacttgagcaacggaagcgcctggcggagaaataccgggagtgtttgagcaacaaggagaaaatcctgaaggagatcgaggttaaaaaggagtatctctccagcctgcaacctagattaaactcaatcatgcaggccagcctgcccgtccaagaatacctcttcatgcccttcgaccaagcacacaagcaatacgaaacagcccgccatctgcctcccccactgtatgttttgtttgtgcaagctaccgcatacggccaggcgtgcgataagacactgtccgtcgcaatcgagggatccgtggatgaggctaaggcactgttcaaaccgccagaggacagtcaggacgacgagtcagatagcgacgctgaggaggagcagacaacgaaacgaagacgcccaaccttaggggtccagttagatgataaaagaaaagagatgctcaaaaggcatccgttgagcgtaatgttggacttgaaatgtaaggacgactctgtcctccatctgaccttctactacttaatgaaccttaacatcatgactgtgaaagccaaggtgaccaccgccatggagctgatcactccaataagtgctggtgatctgctaagtccagatagtgtgttgagctgtctctacccaggcgatcatggcaaaaagactccaaaccctgcaaaccagtaccagtttgacaaggtggggatactcacattgagtgactacgttctggaactcggccacccctacctgtgggtgcaaaaattggggggcctgcatttccccaaggaacagccacagcagacggtgatcgcagatcattctctctccgcttcccacatggagacaacaatgaaactgctgaaaacccgggtgcaatcccgtcttgcactccataaacaattcgcctctttggaacatggcattgtaccggtcaccagtgactgccagtacctgtttccagccaaagtggtgtccagactcgtgaagtgggttaccgtggcccatgaggactatatggagctacactttacgaaggacatcgtggatgccggcctagcaggggatacaaacctctactacatggctctcatagaaaggggtaccgcaaagctgcaagctgctgttgtgttgaacccgggatacagcagtatcccgcccgtgtttcagctgtgcctgaactggaaaggagaaaaaaccaatagcaatgatgataatattcgagctatggagggcgaggtcaatgtgtgttacaaggaactttgcggtccgtggcccagccatcaactcctgacaaaccagctccagaggctgtgcgtcctgctggacgtatacctggagactgagtcccacgacgattccgtcgagggaccgaaggagttcccccaagaaaaaatgtgtttgaggttattcaggggtccttcccgaatgaagcctttcaaatataaccacccccaaggatttttctcacacaggtag

SEQ ID NO: 137772 - DNA, 2052 bp, Artificial Sequence
  Description of Artificial Sequence: Synthetic coding sequence
atgagctccgagagctctaaaaagagaaaacctaaggtgatacggtcagatggagctccggctgaaggcaaaagaaatcgttcagacacagaacaggagggaaagtactatagcgaagaggctgaagttgatctcagggatcctggcagggattatgagctgtataagtatacttgtcaggagctgcagcgactgatggccgagatccaggatctgaaaagtcgcggtgggaaggacgtagcaatcgaaattgaagaacgacggatacaaagctgcgttcactttatgactctgaagaaactgaaccggctggctcacattaggctcaagaaggggagggaccaaacgcacgaggcaaagcaaaaggtggatgcctatcaccttcaactgcagaatctgttgtatgaagttatgcatctgcagaaagagatcaccaagtgtttggaattcaaatctaaacatgaggaaatagacctggtaagcctggaggaattctacaaggaagcccctccagacatctccaaggccgaggtcactatgggagacccacatcagcaaactctggcccggcttgattgggagctggaacaacggaagcgactggcagaaaaataccgcgagtgtctgtccaacaaggaaaaaatcctaaaagagatcgaggtgaagaaggagtacctctctagtctccagccaagactgaactccataatgcaggccagtctcccagtgcaggagtacctattcatgcccttcgatcaggcccataaacagtacgagacagctagacatctcccaccacctctgtacgtactattcgtccaggcgactgcatatgggcaggcctgtgacaagaccctctcagtggccatagagggtagcgtcgatgaagcaaaggctctgtttaaaccacctgaagatagccaggacgatgagagcgactccgacgcagaagaggagcagacgactaagaggcggcgaccaactttgggcgtacaacttgacgataaaaggaaggagatgctgaagcgccacccactaagcgtgatgcttgatctgaaatgtaaggatgatagtgtcctgcatctgacgttctactacctgatgaatcttaatattatgacagttaaggcaaaggtgacgactgctatggagctgattaccccaattagtgctggggaccttctttccccagactcagttctgtcttgcctttatcccggagatcacgggaagaaaacccctaatcccgcaaatcagtaccagttcgataaagttgggattctgacactctcagactacgtactagagctgggacatccgtacctctgggtccagaagctgggcggtctccatttcccgaaagagcagcctcagcagactgttatcgccgaccactctctttctgctagccacatggaaacgactatgaagctgcttaaaaccagggttcagtcccggcttgcactccacaagcagtttgcgtctctggagcatggaattgtgcccgtgacttcggactgccagtacctatttccggccaaagttgtaagccgcctggtgaagtgggttacagttgcccatgaagactatatggagctgcactttaccaaggatatcgtggatgccgggttggccggggacaccaacctttattatatggcactcatagagaggggaactgcgaagctccaggctgcagtcgtccttaacccaggatacagctccattcctccagtattccagctgtgtctaaattggaagggcgagaaaacaaacagcaatgacgataacattcgcgccatggagggagaagtaaacgtctgttataaggaactgtgcgggccctggccaagccatcagttattaaccaaccagctgcagagactctgtgttcttctggatgtgtacctggagactgaaagtcacgatgattccgtcgagggccccaaagagttcccacaggaaaagatgtgcctcaggctgttccgcgggccctcaaggatgaagccatttaaatataaccacccccagggattctttagccatcgctag

SEQ ID NO: 137773 - DNA, 2052 bp, Artificial Sequence
  Description of Artificial Sequence: Synthetic coding sequence
atgtcaagcgagagctctaaaaaaagaaagcccaaggttatccggagcgacggggcccccgcagaaggcaagagaaatcggagcgacaccgagcaggaaggtaagtattactccgaagaagccgaggtggacctcagagatcccggtagagactacgagttatataaatacacatgtcaagaactgcagagactgatggctgagatccaggaccttaagtctcggggagggaaggatgtagctatcgagatcgaagaacgccggattcagagctgcgtccatttcatgaccctgaagaagctgaaccgcttagctcacattcgactgaaaaaaggtagagaccaaacccacgaagctaagcagaaggtggacgcgtatcacctgcagctccagaacctgttgtatgaggtgatgcacctacagaaggagattactaagtgcttggagtttaagagcaagcacgaagaaattgacctggtgtcactggaggagttctacaaggaggcacccccagacatatctaaggccgaggtgaccatgggcgatccgcatcagcaaaccctcgctcggctagactgggaactggagcagcgtaaacggttggccgaaaaataccgcgagtgccttagtaataaagaaaagattctcaaggaaatcgaggtgaaaaaggaatacctttctagcctgcagccaaggctcaactctatcatgcaggcatcattaccggtgcaggagtacctgtttatgccctttgaccaagcccataaacagtacgagaccgcaagacacttgccacctccgctctacgtgctcttcgtgcaggcgactgcatacggacaagcctgcgataagaccttgagtgtggccatagaggggtctgtggacgaagccaaagccctctttaaacctccagaggactcacaggacgatgagtcagacagcgacgctgaggaagagcaaaccacaaagaggagacggcctactctgggcgtccaacttgatgataagaggaaagaaatgctgaagcgccatcctctgtccgtgatgctcgatctgaagtgcaaggacgattccgtactgcacctgactttctattatctgatgaatctgaacattatgaccgttaaggccaaagtgacaacagcaatggaacttatcacacccattagtgccggcgatctgcttagtccagattctgtgttgagctgcctgtaccccggagaccatgggaaaaaaactcccaatccagccaaccagtaccagtttgataaggtcggaattcttaccttatctgactacgtgctggaactcggccacccttacctgtgggtgcagaaattaggagggcttcattttccaaaagaacagcctcagcagacagttatagcagatcacagtctgagcgcatcacacatggagactaccatgaaattgcttaaaaccagagtgcagtccagactcgcacttcacaaacagttcgcctcgttggagcacggcatcgtgcctgtgacctcagactgtcagtacctgtttcccgctaaggtcgtttctcgccttgtcaagtgggtcaccgtggcacatgaggactatatggaactgcacttcaccaaggacatcgtcgatgcagggctggcgggagacactaatctgtattacatggcactcatcgagcgcgggaccgccaagcttcaggccgctgtggtactcaatcccggctacagctcgattcctcctgtgttccagctgtgcctaaattggaaaggcgaaaaaaccaatagtaacgatgacaacattcgggcgatggaaggggaggtcaacgtctgttacaaggagctgtgtgggccctggccaagccaccaattgttgacaaatcagctacagcggctttgtgtgctgctggatgtgtaccttgaaaccgagtcccatgacgacagcgtggagggaccaaaagagttcccccaggagaaaatgtgtttgagactgtttagagggccctcccgaatgaaaccttttaagtataaccacccacagggcttcttcagccacaggtag

SEQ ID NO: 137774 - DNA, 282 bp, Artificial Sequence
  Description of Artificial Sequence: Synthetic coding sequence
atgagttccgagagttcaaagaaacgcaaaccaaaagtgattaggtccgacggcgcacccgcagaggggaaaagaaaccgctccgataccgaacaggaagggaagtactattctgaggaggcggaggtggaccttagggaccccggccgagactatgaactgtacaaatacacttgccaggaattgcagagactgatggccgagattcaagaccttaagagccggggggggaaagacgtcgcgattgagatcgaagagagacgtatccagtcctgcgtatag

SEQ ID NO: 137775 - DNA, 486 bp, Artificial Sequence
  Description of Artificial Sequence: Synthetic coding sequence
atgtcctccgagagttcgaaaaaaaggaaaccaaaggtgatcaggagtgatggggcaccagccgaggggaagcgaaatagaagcgacacagagcaggaggggaaatactactccgaggaggccgaagttgacctgagagatcccgggcgcgattatgaactgtataaatacacttgtcaggagcttcaacggctgatggcagaaatacaggacctcaaatcacggggtggtaaggatgttgccattgagattgaagagaggcgtattcagtcttgtgtccattttatgactctcaagaagttgaatcgcctggcccacattcgcctgaagaagggacgcgaccagacgcacgaggccaagcagaaggtggatgcttaccaccttcaactgcagaatctgctatatgaggtcatgcacctgcagaaggaaattactaagtgcttggagtttaaaagtaagcatgaggaaattgatctggtgtcctag

SEQ ID NO: 137776 - DNA, 672 bp, Artificial Sequence
  Description of Artificial Sequence: Synthetic coding sequence
atgtcctcagagtcatctaagaaaaggaaacccaaggtcatccggtctgatggtgcccctgctgaaggaaagcgcaataggtcggatacagaacaggagggcaagtactactccgaggaagccgaggtggatctgagagatccaggacgcgactatgaattgtacaaatatacttgtcaggaactgcaacgcttgatggctgagattcaggatttaaagtctagaggaggtaaagatgtagccatcgaaatcgaagagcgccggattcagtcctgcgtccatttcatgactctcaaaaaactgaatcgtctggcccacatacggctaaagaagggccgcgaccagactcatgaggccaaacagaaagtggatgcttaccatctgcagctgcagaacttgttgtatgaggtgatgcacttgcagaaggaaatcacaaagtgccttgagtttaaatcaaaacatgaggaaatcgatctcgttagcctggaggaattctacaaagaagctcctccggatatctcaaaggcagaggttacaatgggcgatccccaccaacaaacactagcacgactggattgggaactcgaacagcgcaaacgactggccgaaaaataccgcgagtgtctctccaacaaagaaaaaatactcaaagagatcgaagtaaaaaagtag

SEQ ID NO: 137777 - DNA, 2052 bp, Artificial Sequence
  Description of Artificial Sequence: Synthetic coding sequence
atgagctctgagtccagtaaaaaacgcaaacccaaggtgattaggagcgatggggcacccgcagaaggcaagaggaatcggtctgacacagaacaggaaggcaaatactatagcgaagaagccgaagtggatctgcgggatccaggtcgcgactacgagctctacaagtacacttgtcaggaactccaaagactgatggcagaaatccaggatcttaaatcccgcgggggcaaggacgttgctatcgaaatcgaagagcgtcgtatccagagctgcgtgcactttatgacacttaaaaagctgaatcggctcgcgcatattagattgaaaaagggtcgcgatcagacccatgaagcaaagcagaaagtagatgcctatcatttgcaactacaaaacttgttgtacgaggtgatgcacctgcagaaagaaatcactaaatgcctggaattcaaatctaaacacgaagaaatcgacctggtatctttggaagaattttataaagaagcaccgccggacatcagtaaggccgaggttacaatgggtgatcctcaccaacagaccctcgcccgtctggactgggagctggagcaacgaaaaaggttggctgagaagtatagagagtgcctttctaataaggaaaagatacttaaggagattgaggtcaaaaaggaatatttatcgtccttacagccgagactgaatagtattatgcaggcctccctgcctgtgcaggagtatttattcatgcctttcgaccaggcacacaagcagtacgaaaccgctagacatctgccgccacccctgtacgtcctgttcgtccaggccaccgcatatggtcaggcctgcgacaagaccttgtcggttgccattgaaggaagcgtggatgaggctaaagcactttttaaaccccccgaagattcccaggacgacgagagcgattccgacgcagaagaggaacagactacaaaacgaagacgacctacactgggtgtgcagttggacgataagcggaaggagatgctgaagcgccaccccttgtctgtaatgttggacctgaagtgcaaggatgacagtgtgctgcatctcaccttttactacctgatgaacctgaatattatgaccgtgaaggccaaggtgactactgcaatggagcttatcaccccgatctcagcaggagatctgctgtctcccgacagtgttctgtcctgtctttacccaggtgaccacggaaagaagaccccaaacccagcaaaccaatatcagtttgataaggtcggaattctgaccctgagtgattacgttctagagttgggccatccatacctgtgggtgcaaaaattaggtggtctgcactttcccaaggaacagcctcaacagaccgtcattgccgaccactccctttccgcaagtcatatggagacaaccatgaagctgctgaagactagggttcagtccaggctagctttgcacaagcaatttgcctccctggagcacggtatagtcccagtgacctccgattgtcagtatctgttccccgccaaagttgtctctagactggtaaagtgggtgactgttgctcatgaagattatatggagctgcattttaccaaggatattgtagatgcaggtctagcaggggatacaaacctgtactatatggcacttatcgagcgggggaccgctaagctgcaggccgctgtagtactgaaccccgggtattccagtattccccctgtgttccagctctgtctgaattggaaaggagagaagacaaattcgaacgacgataatatccgagctatggaaggagaggttaatgtgtgctataaagagttgtgtggtccctggccgtcccatcagttattgaccaatcagctgcagcggctgtgtgtccttttagacgtctatttggagacagagtcacacgacgattcagttgaagggcccaaagagtttcctcaagaaaaaatgtgtctgcgtctgttccggggaccatcgcgtatgaagccatttaagtataaccaccctcagggctttttctctcatagatag

SEQ ID NO: 137778 - DNA, 615 bp, Artificial Sequence
  Description of Artificial Sequence: Synthetic coding sequence
atgggagccgtgacggatgatgaggtcatccgaaaaaggctgctgatcgacggcgacggggctggcgacgaccgccgaatcaaccttttagtcaagtcatttatcaagtggtgcaacagtggctcccaagaggagggttatagtcaatatcaaaggatgctgtccacattgtctcaatgcgagtttagcatggggaaaacactccttgtctatgacatgaatctgagggagatggagaattacgaaaaaatttataaagaaatcgaatgctcaattgctggagcgcacgagaaaatcgctgaatgcaagaagcagatactgcaggctaagcgcatccgcaagaaccgccaggaatacgacgctcttgctaaagtgatccagcaccatcccgatcgccatgagacattaaaggagcttgaggctctaggaaaggaactggagcaccttagccatatcaaggagtctgtggaggataagctggaactcagaagaaagcagttccatgtgcttttgtctactatacatgagctccaacagacgctggagaatgacgagaaattatccgaagttgaagaggcgcaggaggcgagcatggaaactgacccaaagccctag

SEQ ID NO: 137779 - DNA, 711 bp, Artificial Sequence
  Description of Artificial Sequence: Synthetic coding sequence
atgtccgaagctcctagggccgaaaccttcgtatttctggacctggaggccacagggctccccagcgtcgagccagaaattgcagagctgtcactgttcgcggttcaccgcagttccctggaaaacccagaacacgacgaatccggtgcgcttgtgttgcctagggtgttggataagttgaccctttgtatgtgccccgaaaggccttttaccgccaaggcaagcgagattaccggcctgtcctcggaagggttagcgaggtgtcggaaggctgggttcgacggcgctgtcgtacgaacattgcaggcctttctctctcggcaggccggtcctatctgtctggttgctcataacggattcgactatgacttccccttgctgtgtgcggagttaagacgcctgggggcacgtctcccacgagacaccgtatgcctcgatactctccccgcactgagaggtctcgatagagcacactcccatggcaccagggctcggggacgccagggttattctctggggtccttgttccacagatacttccgggcagagccatcagcggcccatagtgccgagggagacgtccacacgctccttctgatttttctgcacagagcggctgagttgctggcttgggctgacgaacaggctcgcggctgggctcatatcgagccgatgtaccttccacccgacgacccatcactggaggcatag

SEQ ID NO: 137780 - DNA, 840 bp, Artificial Sequence
  Description of Artificial Sequence: Synthetic coding sequence
atggggagggccggttctccactgccccgttcaagttggccacggatggatgattgtgggagcagaagtcggtgtagccccaccttatgctcctctctgcgaacatgttaccccagaggaaacatcacaatgagtgaggcaccccgcgccgagacttttgtcttcctggatctggaggcaaccggactgccatccgttgaacccgagatcgcagagctgtctctgtttgctgtccaccgatcctcactcgagaatcctgaacacgatgaatctggggctcttgttcttccaagggtgttggataaactgactttgtgtatgtgtccagagagaccattcactgcaaaagcatcggagattacagggttgagctcagagggtctggcccgctgtcgaaaagccgggttcgatggagccgtcgtccgaacgctccaagcttttctatcccgccaggctggtcccatctgcctcgtcgctcacaatggattcgactacgacttcccccttctgtgcgctgaactgagaagacttggtgctcgcctgccacgggacaccgtgtgcctggatacgctgcccgcgttgaggggtttggacagggcccacagtcacgggacccgagccagggggcggcaaggatacagcttagggagtctctttcaccggtactttcgggccgaaccaagcgccgctcactcagctgagggcgacgtgcacaccctgctgctgatcttcttacaccgggccgccgagctcctcgcttgggcagacgaacaggccagaggttgggcccatatagagccaatgtatctgcctcccgatgacccatctctggaggcttag

SEQ ID NO: 137781 - DNA, 711 bp, Artificial Sequence
  Description of Artificial Sequence: Synthetic coding sequence
atgtccgaggctcctagggctgagactttcgtgttcctggatctcgaagccaccggtctgccatcagtcgaacccgagatagccgagttgtctctgttcgcagtccacagatcctccctggagaatcccgagcacgacgagagcggagccctggtactgccgagagtgctggacaagctgactttgtgcatgtgcccggagcgacccttcaccgcgaaggccagcgagataacgggtctgtcttcggaagggctggctcgctgccgcaaggcaggattcgacggcgctgtcgtgaggaccctgcaagctttcctgagccggcaggccgggcctatctgtttagtcgcccacaacgggttcgactatgatttccctctactatgtgcagagctgcgtcggttaggcgctcggctgcctcgagacaccgtgtgcctggatacgcttcccgcgctgaggggcctcgaccgagcgcacagccacgggacacgcgccaggggcagacagggctacagtctgggatcactgtttcatcggtacttccgagctgagccatcagccgctcattcggcagagggcgatgttcacacgctcctcctcattttcctgcaccgcgccgccgaactccttgcatgggcagacgagcaggccagaggctgggctcatatcgaacctatgtatttaccacccgacgatccctccttagaagcttag

SEQ ID NO: 137782 - DNA, 711 bp, Artificial Sequence
  Description of Artificial Sequence: Synthetic coding sequence
atgtctgaggctcctcgcgccgaaaccttcgtcttcctggatcttgaggcaaccgggcttccttctgtggagcctgagatcgccgaattaagtcttttcgccgtgcacaggagttctcttgagaatcccgaacatgacgaatctggagctctggtcctccctagggtgctggataagttgactttgtgtatgtgcccagaaaggccatttaccgcaaaagcaagcgaaattaccgggctgtcttctgagggtttagctagatgcagaaaggccggtttcgacggggctgtggtgcggacgctccaggccttcttgtctcgtcaggccggtcccatctgtctggtggcccacaatggcttcgattacgactttccactattgtgtgcagagctgcggcgtttaggcgcgcgcctaccaagagatacagtgtgcctggacacccttccagcccttcgggggctcgacagagcgcacagtcacggtacccgggctaggggccgtcagggatatagtctgggcagtctgttccataggtactttcgtgctgagcctagcgcagcccactccgcggagggcgacgtccacacactgctcttaatctttctgcaccgggctgcagagttgctggcctgggcagatgagcaggcaaggggatgggcccacattgagcccatgtacttgccaccagatgatccgagcctcgaagcctag

SEQ ID NO: 137783 - DNA, 840 bp, Artificial Sequence
  Description of Artificial Sequence: Synthetic coding sequence
atgggaagggctggcagtccacttccccggtccagctggccacggatggacgactgtggctccaggagccggtgctctcctactctctgttctagcctgcgaacatgttatcctagaggaaacattaccatgagtgaggccccccgcgctgaaaccttcgtgtttctcgatctcgaagcaacggggctgccttcggtggaaccggaaattgctgaattaagccttttcgccgtgcaccgctccagcctcgagaatccagaacacgatgaatccggcgccctagtgctgcctagggtactagacaagctaactctttgcatgtgccccgagagaccttttaccgcaaaggctagcgaaattactggcctctcaagtgagggtttggctaggtgccgcaaggcaggattcgacggggcagtagttcgaaccctccaggcctttctcagtcgacaggccggtccaatctgcctggtcgcacataatgggttcgattacgatttccctctcctatgcgctgaactcagacgacttggggcccgtctgcctagggatacggtgtgcttagacaccctaccggctctgcgagggctggacagggcgcactctcatgggactagggcccggggcagacagggctactctttgggcagcctgtttcataggtactttcgggcagagccgtcagcagcccatagcgctgagggagatgtgcataccctcctgctgatttttctgcatagagcagctgagctgttagcttgggccgacgaacaagcccgtggatgggcccacatagaaccaatgtatctgcccccggatgatcctagcctggaggcatag

SEQ ID NO: 137784 - DNA, 711 bp, Artificial Sequence
  Description of Artificial Sequence: Synthetic coding sequence
atgtccgaagctccacgagccgaaacattcgtatttctggaccttgaggcaaccgggttgcctagcgtggagccagaaatcgccgagctatccctgttcgccgtgcataggtctagcttggagaatcccgagcatgatgaatcgggcgccctggtcctccccagggttctggacaagcttacactgtgcatgtgccccgagcgcccctttacagctaaggcatctgagattactggactgtcttctgaggggctcgcccgatgcagaaaagccggctttgacggggccgtggtgcgcacgttacaggcgttcctgagcagacaagccgggccaatttgcctggtggcgcacaatggatttgactatgacttcccactgctgtgtgcggaactgagacgcctgggagcacgtcttccccgggacacggtgtgcttagacacgctcccagccctgagaggactggaccgggctcactcccacggcacaagggctaggggcagacagggttatagcctcggctctcttttccacaggtacttccgagccgagcccagtgcggcgcattctgccgaaggtgacgttcatacgttacttcttatcttccttcatcgggcggcggagctattggcctgggcagacgagcaggctcgggggtgggcccatattgagcccatgtacctgccgccagacgatccatccctggaggcctag

SEQ ID NO: 137785 - DNA, 840 bp, Artificial Sequence
  Description of Artificial Sequence: Synthetic coding sequence
atgggcagagccggaagcccactcccccgtagctcatggccacgaatggatgactgtggatcccgtagtcggtgtagcccaacactctgttcttcactaagaacatgttatcctcggggcaatattaccatgtccgaagcccccagagcagaaacatttgtgttcctcgacttggaggctacaggattacctagcgtggaaccagaaattgcagaattaagcctgttcgcggtgcatagatcatcactcgaaaatccagaacatgacgaatcaggggcacttgtcctcccgcgggtgctcgacaaattaacactttgcatgtgtcccgaaagacctttcacagccaaagccagcgagataaccgggctgtctagcgaagggctggctcggtgtcggaaggcaggctttgatggggcggtagtgagaaccttacaggcctttctctcccgacaggcaggacccatatgtctggtcgcacacaatgggttcgattacgatttccctctactatgtgccgagctgcgccgtttgggggcgcggctgcccagggacaccgtttgcctggatactttgccggctctcagaggcctggatcgggctcacagccacggtacacgagctcgcggaaggcagggatatagcctggggtccttgttccacaggtatttccgggcggagcctagtgccgcccatagcgcagagggtgacgtgcacacgcttctgctgatttttctgcaccgagctgccgagcttctggcatgggcagacgaacaggccagaggctgggcccacatcgaaccaatgtacttaccacctgacgacccctcactcgaggcctag

SEQ ID NO: 137786 - DNA, 837 bp, Artificial Sequence
  Description of Artificial Sequence: Synthetic coding sequence
atgatagtggctgcggaagccgtggcagcgccgaggtgcgctctcgttggggatcgctccggggcggacgcaccacgtgcaaaaggtcactctcttcggacatgttacccccgggggaacattacaatgagcgaggctcctcgggccgagacattcgtttttctcgatctggaggctacggggctgccctcggtggagcccgagattgcagaacttagcctatttgccgtgcatagatctagccttgaaaaccccgaacatgatgagagtggggctttggtcctccctcgcgtgctagacaagctcaccctatgtatgtgcccagaaagaccgtttaccgcaaaggcctctgagatcacaggcctgtcttcagagggcctggctcgatgtcggaaggccgggttcgacggtgctgttgtgaggaccctccaggcctttctttccagacaggctggaccgatctgcctggtcgctcacaacggcttcgactatgatttcccactcctctgtgcggaactgcggcgattgggagcccggctacccagggacactgtgtgcctagacactctgcctgccttacgaggactggaccgggcacacagccatggtactcgcgctcgaggccggcagggttatagcctgggcagcttgttccaccgctactttagagcagaaccttccgccgcacacagcgctgaaggcgacgttcataccctcctcctgatctttttgcatcgagctgcagagctactggcgtgggccgatgagcaggccaggggatgggcccacatcgaacctatgtatctgcccccagatgatccatcactagaggcttag

SEQ ID NO: 137787 - DNA, 2172 bp, Artificial Sequence
  Description of Artificial Sequence: Synthetic coding sequence
atgttcgaggaaaaggcttcgtctccatccggcaaaatgggtggtgaggaaaaaccgatcggagctggcgaggagaagcagaaggagggaggcaagaagaaaaataaggagggcagcggagatggtggccgagccgagcttaacccctggcccgaatatatttacactcggctagaaatgtacaatatcttgaaggccgaacatgatagcattttggcagaaaaagctgagaaagactcgaaacccatcaaagtaacactgcctgatggaaagcaagtcgatgccgagtcatggaaaacaaccccttaccagattgcctgcggcatctcccaaggcctcgctgataatacagtcattgccaaagtgaacaatgtggtctgggaccttgaccggcctttggaggaagactgtactctcgaactgctaaaattcgaagatgaagaagcacaagctgtgtattggcattccagtgctcatataatgggagaagcaatggaacgagtgtatggcggctgcctttgctatggtccgccaatagagaacggcttctattacgacatgtacctagaagagggcggcgtgagtagcaacgatttcagctcgctggaagccctgtgtaagaagatcatcaaggaaaagcaagcctttgagcgcctggaagtgaaaaaagagacgctgctggctatgttcaagtacaacaaatttaagtgtcggatactgaatgagaaggtaaatactccgacaaccacagtttaccggtgcggtcccctgatcgatctgtgtcgtggtcctcacgtacggcacacaggtaaaatcaaagcgctcaagatccacaagaattcatccacttactgggaaggcaaggctgatatggagaccctgcaacgtatttacggcatatccttcccagaccccaagatgctgaaggagtgggagaaatttcaggaggaggccaaaaaccgcgaccacaggaaaattgggcgcgatcaggaactctatttctttcacgaactgagccccggaagctgcttcttcctgcctaagggggcctacatctataacgcgctcattgagttcatcagatctgagtaccgaaagagagggtttcaggaagttgtgaccccgaacatatttaatagtcgactttggatgactagcggtcactggcagcattacagcgagaacatgttcagcttcgaagtggaaaaggaattgttcgctctcaaaccaatgaactgtcctggccattgcctcatgtttgatcacagaccccgttcctggagggaactgcccctgcggctggctgacttcggtgtgctccaccgcaacgagctcagtggagcactgaccggactgacgcgagtgcgtcgattccaacaggacgacgcccacatattctgtgccatggagcagatagaggatgaaatcaaggggtgtcttgactttctgaggactgtgtattctgtctttggattctcattcaaattgaacctgtccactcgcccagagaaattcttaggtgatattgaggtctgggatcaagccgagaagcagcttgaaaattccctgaatgagttcggggagaaatgggagctgaatagtggcgatggagccttttacggtcccaagatcgacatacagattaaagacgccattggccgctaccatcagtgcgctacgatccaactggatttccaacttcccattaggttcaatctgacgtacgtgtctcacgatggagacgataaaaaaagacctgtaattgtgcaccgagccattcttgggtccgtggaaaggatgatcgcgatccttacagagaattatggggggaaatggcccttttggctcagccccaggcaggtgatggttgttcctgtgggtccaacttgcgacgaatacgctcagaaggtgcgacaacagtttcatgacgcaaagtttatggcagatatcgacctcgaccctggttgtactctcaataaaaagatacggaacgcccaactcgcccagtataacttcatcctggtcgtgggtgaaaaagaaaaaatttctggcaccgtaaacattcgtacccgcgacaataaggtacatggtgaacggacaatctcagaaacaatcgagcggctccaacaacttaaagaatttaggagtaagcaggctgaggaggagttctag

SEQ ID NO: 137788 - DNA, 1809 bp, Artificial Sequence
  Description of Artificial Sequence: Synthetic coding sequence
atgatacccttttggcaaaagcgtcaaaagaaaattgcttcgcaactcaaaagtctttgcctcatggtcaatagactgatgcgcaacttggggaagttacaccacatcaagctccctgtggagctcgcgatggagagggtgtatggaggatgcctgtgctatgggccacccatagaaaatggcttctattatgatatgtaccttgaggaaggcggagtttcatcaaacgatttcagttccttggaggccctgtgtaagaagattattaaagaaaagcaggccttcgaaaggctggaggtgaaaaaagaaacactccttgcgatgtttaagtataataagttcaaatgtcgaatcctaaatgagaaggtgaacacaccaacaacgacagtgtatagatgcgggcccctcatagatctctgcaggggccctcatgtgagacacacaggcaagataaaagcacttaaaatccacaaaaacagctctacctactgggaaggcaaagccgatatggaaacactccagcgtatttacggcatttccttccccgatcctaagatgctgaaagaatgggagaagttccaggaggaagccaaaaaccgagatcatcgtaaaatcggcagagaccaagagctgtacttttttcatgagctgtcacccggttcttgctttttcttgcctaagggagcatacatttataatgctttaattgagtttatcaggtctgagtatcgcaaaaggggatttcaggaggtcgtaacccctaatatcttcaattcccgactatggatgacaagcggccactggcaacactacagcgagaacatgttcagcttcgaagtagagaaagaattattcgccctgaagcctatgaattgtcctggccattgcctcatgtttgaccacaggccgaggtcatggcgggaactacctctgagattggcagattttggagtgctgcataggaatgaattaagcggggcgctcacaggcttaactagagtccgaaggtttcaacaggatgatgctcacatcttttgcgcaatggagcagatcgaagatgaaatcaaggggtgccttgattttctgcgcactgtgtactccgtgtttggattttcgttcaaattaaacctgtccaccagacccgaaaagttcctgggtgatatcgaggtatgggaccaagccgagaaacagctcgagaactcactcaatgaattcggcgagaagtgggaactgaactccggtgatggagcgttctacggccctaaaattgatatccagattaaagatgctattgggcgctaccatcaatgcgccacgattcaactcgactttcagctgccaatacgttttaacctgacttacgtgtcacatgacggtgatgataaaaagcggcccgtcatcgtccatagagccatcctgggctcagtggagagaatgatcgccattctaaccgagaactacggcgggaaatggcctttttggctgagccctcgacaggtgatggtggtgccagtgggtcccacatgcgatgaatatgcccagaaagtcaggcaacagttccacgatgccaagttcatggccgacattgacctcgaccctggatgtacgttaaataaaaagattcgcaacgctcagctggcccagtacaattttattctggtcgttggagaaaaggagaaaatatccggtacggtgaacatcagaactagggacaataaagtccacggggagcgcaccatttcagaaacgattgaacggcttcagcaattgaaagaattccgcagtaagcaggcagaagaggagttctag

SEQ ID NO: 137789 - DNA, 2271 bp, Artificial Sequence
  Description of Artificial Sequence: Synthetic coding sequence
atgtttgaggaaaaggctagctctccaagcgggaagatggggggggaagagaagcctatcggggcgggagaggagaagcagaaggaagggggtaaaaagaagaataaagagggatccggggatgggggccgggctgaactgaatccatggcctgaatatatatataccagattagaaatgtataatatccttaaggccgaacacgactctatcctggcggagaaggcagaaaaggacagcaagcctatcaaagtcactttgccggatggaaagcaggttgacgcagaaagttggaaaaccactccctaccagatcgcgtgcggaatctctcataccgcatcttgcaaaaatctctcatcactcgcttctctgctagcgtcagtggccatcccatcaagcggaatgccctggccccccctgttcttcctgcaggggcttgccgataacaccgtcatcgctaaggtgaacaacgtagtctgggacctcgataggccactggaggaggactgcactctggaacttctgaagtttgaggatgaagaagcccaggccgtttactggcattcaagtgctcatattatgggggaagcaatggagagggtctatggcgggtgcctgtgctacggtccaccaatagagaatgggttctactatgatatgtatctggaagaaggaggcgtctcaagcaatgatttctcgagcctggaggcactctgcaagaagattattaaagagaagcaggcatttgagcgtctggaagttaagaaggagacactgctggcgatgttcaagtataacaaatttaaatgccgcattctgaacgagaaggtcaatactcctactacaactgtctatcgctgtgggccacttatagacctgtgccgtggtccacatgtgaggcacaccggcaaaattaaagctctgaaaatccacaaaaactcctctacatattgggaaggaaaagccgacatggagaccctgcagcggatctacggaataagctttccggacccgaagatgctgaaggagtgggagaagtttcaggaggaggctaaaaatcgtgatcaccgtaagataggaagggatcaggagttatacttcttccatgagctttcccccggtagctgcttctttctccccaaaggtgcttacatctacaatgcccttatcgagtttatccggtccgagtacagaaagcgcgggttccaggaggttgtcacccccaatatattcaactctcggttgtggatgaccagcggtcattggcagcattactccgaaaatatgtttagttttgaggtggagaaagagctgttcgcattgaagcccatgaactgtccggggcactgtttaatgtttgaccacaggccaaggagctggcgcgagttgcccctccgccttgcagatttcggggtgctgcaccggaatgagctcagtggtgcactgaccggactgacaagagtgcgcagattccagcaagacgacgcacacatattctgcgcaatggagcagattgaggatgagattaagggttgcctggactttcttagaaccgtttatagcgtctttggattttcttttaaactcaatttgtcaacccgcccggaaaaatttttaggcgatattgaagtatgggaccaagcagagaagcagcttgaaaattcactgaatgagtttggggaaaagtgggaactcaacagtggcgatggtgctttttacggccctaaaattgatatacagatcaaagacgccatcggacgataccaccagtgtgccactatacagctggacttccagttgcccatcaggttcaacctgacctacgtgtcccatgatggcgacgacaagaaaaggccagtgatagtgcaccgagccatcctcggttcagtcgaacggatgattgcgatcttaacagaaaactatggtggtaagtggcctttttggctctctccgcgacaggtgatggtggttccagtcggcccgacatgtgacgagtatgcgcagaaggtgaggcagcagtttcacgacgccaaatttatggctgacattgatctcgaccctggctgcacattaaataagaaaatccgcaatgcgcaactggctcagtacaacttcatcctggtcgtaggcgaaaaggagaagattagcggtactgtgaatatacgaaccagagataacaaagttcatggcgagagaacaatctctgaaactattgaacgcctgcagcagctgaaggagttccggtccaagcaggctgaggaggaattctag

SEQ ID NO: 137790 - DNA, 2172 bp, Artificial Sequence
  Description of Artificial Sequence: Synthetic coding sequence
atgtttgaggagaaagcctcttcaccttccggcaaaatgggtggcgaagaaaaacccattggcgccggagaggagaaacagaaggaaggtggcaaaaagaaaaacaaagagggttccggagatggcggccgagcggaactgaatccgtggccggaatacatatatacaagattggaaatgtataacattctgaaggctgagcacgacagcattctggcagagaaagcagagaaagacagcaagcctattaaggtcactttgcccgatggtaaacaggtggacgccgaatcctggaagactaccccctaccagattgcctgtgggatttctcagggactcgctgataacaccgtcattgctaaggtgaacaatgtggtatgggacttggatcgacctctcgaggaggactgtaccctcgaacttctaaaatttgaagatgaagaggcccaggccgtgtactggcattcttctgcccatatcatgggcgaggccatggagcgcgtgtacggggggtgcttgtgctatggaccaccaattgagaacgggttctactacgacatgtatcttgaggaggggggtgtgtcttccaatgacttcagcagtctggaggcactttgtaaaaaaatcatcaaggaaaagcaggccttcgagcgattggaggtcaagaaagagacacttttagccatgtttaaatacaataagttcaagtgccggattctaaatgagaaagtaaatacccccacgacaactgtttaccgatgcggacctctaatcgacctctgccgcggtcctcatgttcggcatacgggcaagatcaaagccctgaagattcataagaactctagcacgtactgggaggggaaggccgatatggaaactttgcaaagaatctacggaattagctttcctgaccccaagatgctcaaggagtgggaaaagtttcaggaggaggccaagaatagagaccaccgaaagattggaagggaccaggaactctactttttccacgaactctcacctggctcatgtttctttctcccaaagggagcgtacatctataacgccctgatcgaattcattcgaagtgaataccggaaacgaggtttccaggaggttgttacccccaacattttcaactccaggttgtggatgaccagcggccactggcagcactattccgagaacatgttttcattcgaggtggagaaagagctttttgcgctcaaacctatgaattgtcctgggcattgcctcatgtttgatcatcgccccaggtcttggagggaactacccctcaggctagctgacttcggggtgcttcatcgcaatgagctctcaggagccctgacaggtctcacccgtgtccggaggttccagcaggatgatgcgcatattttttgtgccatggaacagatagaagatgaaatcaagggctgcttggacttcttgaggaccgtgtatagcgtcttcgggttctcctttaagttaaacctctccactcgccccgaaaaattcctcggcgatatagaggtgtgggatcaggctgagaagcaactggaaaatagcctcaacgaatttggggagaagtgggaactgaattcaggggatggcgccttttacggccctaagattgatatccagataaaagatgctatcggtagatatcaccagtgtgccacaatacagctcgactttcagctgcccatccgttttaatttaacttatgtgagccacgatggcgatgacaaaaagaggccggtcattgtacacagggccatccttggtagcgttgaacggatgatcgccatcctcaccgagaactacgggggaaagtggcctttttggctcagcccacgccaggtgatggttgtacccgtcggcccaacgtgcgatgaatacgcccagaaagtgcgccaacagtttcatgacgcaaaattcatggctgacattgatctggatccgggttgcaccctgaataaaaagataagaaatgcacagttagcccagtataattttatattggttgtgggtgagaaagaaaaaatcagcgggactgtgaacatcaggacccgagataacaaagtgcacggcgagaggacaatcagcgagaccattgaaagactgcagcagctaaaggagtttcggtctaagcaggccgaggaggagttctag

SEQ ID NO: 137791 - DNA, 390 bp, Artificial Sequence
  Description of Artificial Sequence: Synthetic coding sequence
atgtttgaagaaaaagcaagcagcccgagtgggaagatggggggtgaggagaagcctatcggagcaggcgaggaaaaacagaaggaaggcggaaagaagaaaaataaagagggatccggggacggtgggagagccgaactcaacccctggcccgaatatatatacacgcgtctcgagatgtacaatattcttaaagccgaacacgattcaatactggccgaaaaggctgaaaaagattctaagcctataaaagtgacgctccccgacgggaagcaggtggacgcggaatcttggaagacaactccttaccagatcgcctgcggcatctctcagggcctagctgataacaccgttatcgctaaagttaacaacgtggtttgggacctgtag

SEQ ID NO: 137792 - DNA, 1860 bp, Artificial Sequence
  Description of Artificial Sequence: Synthetic coding sequence
atggaagtggaactctctcagggcctcgctgacaataccgttattgccaaggtcaacaacgtggtctgggatctggaccggccccttgaggaggattgcactctggagctgctgaagttcgaagatgaggaggcacaagcagtttattggcactctagtgcacacattatgggtgaggcaatggaacgcgtgtacggcggctgcctgtgttacggcccacctatcgagaacggtttttactacgacatgtacctggaagagggaggcgtctccagtaacgatttctcatctttagaggctctgtgtaagaagatcattaaagagaagcaagcctttgagcggctggaggtgaagaaggagacactgttggcgatgtttaagtacaacaagttcaagtgtcggattctgaatgaaaaggttaacaccccaacgaccacagtctatcgttgcggtcctttaatcgatttgtgtagaggcccgcacgtgcggcataccggaaagatcaaggccctcaagattcataagaacagctccacatattgggaaggaaaagcggacatggagaccctgcagcggatctatggaattagtttccctgatccaaagatgttgaaggagtgggaaaaatttcaggaagaggcaaaaaacagggaccaccgcaagattgggcgggaccaagagttatatttcttccatgagctgagccctgggagctgtttcttcctgccaaagggcgcatacatttacaacgccctgattgaattcatacgctcagaatatagaaaaagggggtttcaggaagtcgttactccaaacatttttaactctagactgtggatgacttccggccattggcagcactatagtgagaatatgttttcattcgaggtcgaaaaagagctgtttgctctcaagcccatgaattgtcctggccattgtctcatgttcgaccataggcccaggtcatggagggagctccccctgaggttagccgattttggggttctgcatagaaacgaattaagcggggcgctgacaggcctcacgagagtccgccggtttcagcaggatgatgcccacatattctgcgctatggagcagatcgaggacgaaataaagggttgcctcgatttcctccgcactgtgtactccgtctttggattcagtttcaaactgaacctaagtaccagacccgaaaagttcctgggcgacatagaagtgtgggatcaggccgaaaaacagcttgaaaattctctcaatgaattcggtgagaagtgggagctgaattccggcgacggggctttctacgggccaaaaatcgatatacagatcaaagacgccatcggacggtatcaccagtgtgccactatccagctggattttcagctgccgattaggtttaatctaacttatgtcagtcatgacggggacgataagaagcgcccagtcatagtacatcgcgcaatccttggctctgtcgagcgcatgatcgccattcttactgaaaactatggtggaaagtggcccttctggttgagcccccggcaggtgatggtggtccccgtggggcctacctgtgatgaatacgctcaaaaggtgcggcagcagtttcacgatgccaagttcatggctgatattgatctggatcccggttgcacattgaataagaagatcaggaacgctcagctggctcaatacaatttcattctggtggtgggcgagaaagaaaaaatatctggaacagttaatatcagaacgagagacaacaaggtgcatggtgaacgcaccatttctgagacaatagaaagactgcaacaactcaaggaatttcgctctaaacaggctgaagaagagttctag

SEQ ID NO: 137793 - DNA, 1332 bp, Artificial Sequence
  Description of Artificial Sequence: Synthetic coding sequence
atggaacacaacccactccccacctctcctgctgaccagttcaataccggacgctactgctctggccctagcacagagtatgggttttatcacgactttttcctgggaaaagagcgatgtggtacgctagtggacctttgtcagggaccccacctgagacataccggtcagattggcggtctcaagttgctatcagccgagtatgcccacaggggtttttccgaagtcaagactccaacgcttttctccaccaagctatgggaacagtctgggcactgggaacactatcaggaagatatgtttgcagtccagccaccaggctctgatcggcctccaagttctcagtccgatgacagcacgcggcatattaccgatactctcgctctcaagcctatgaactgtcctgcccattgcctaatgtttgcccatcgccccaggagctggcgcgagctccctctccgccttgccgatttcggggccctgcacagggcggaagcgtccggcggactgggtggcctgactcggctccgctgcttccagcaggacgacgctcatattttctgtaccacggaccagctcgaagcggagatacagagctgtctggatttcctccgtagcgtttacgcagtgctgggtttctcgtttagattggctctttccactaggccatctggattccttggagatccgtgcctgtgggaccaagccgagcaggtcctgaagcaggcgctcaaggaattcggggagccttgggacctgaacagtggtgacggggctttctatgggcctaaaatagatgtccacctccatgacgcccttggcaggccgcatcagtgcggcaccattcaactggattttcaactcccactccgtttcgacctccagtacaaaggccaggccggggccctagagcgaccagtccttatccaccgagccgtgctggggtccgttgagcggctattgggggtgttggctgaatcctgcggaggtaagtggcctctctggctgtccccatttcaggtggtcgtaatccccgtaggatctgagcaagaagagtatgccaaggaggctcagcagtctttgagagcagctggcctggtgtccgatctggacgcagacagcggtctcacactgtctaggcgcatacgccgggctcagctagcccattataacttccagttcgtggtggggcagaaggaacaaagcaagcggactgtgaacataagaacacgcgacaacaggcgcttaggggaatgggatttacccgaggccgtgcagaggcttgttgaattgcagaatacccgggtgcccaatgccgaggagatattttag

SEQ ID NO: 137794 - DNA, 1332 bp, Artificial Sequence
  Description of Artificial Sequence: Synthetic coding sequence
atggaacataatccacttcccacatctcctgcggatcagtttaacaccggacgctactgcaggggaccatcaactgaatatgggttttatcatgacttcttcctgggcaaagaacgatgtggaaccctggtggatctgtgccagggaccccacttgcgccatactggtcagatcggcggcctcaaactcttatccgccgaatacgcccatcgaggtttttctgaggtgaagacccccaccttgtttagcactaagttgtgggaacagtccggccactgggaacattatcaggaagacatgttcgctgtgcagccacccggcagcgataggcctccgagcagccagtctgacgactctactagacacattactgataccctggccctcaagcctatgaattgccccgcccattgcctcatgttcgcacatcgccccagatcctggcgagaactgcccctgcggcttgccgactttggagccctacatcgagcggaggctagtggagggcttgggggtcttaccaggctccggtgtttccaacaagacgacgcacacatcttttgcaccacagaccagctggaagctgaaatccaatcctgcctggattttcttagaagtgtgtacgcagtcctcgggttctccttcaggcttgctctatccacccggcccagcgggttccttggggacccgtgcctgtgggatcaagccgaacaggtgttaaagcaagctctcaaggaattcggggaaccctgggatttgaacagtggtgatggcgccttttatggccccaaaatcgatgtacacttgcatgacgccctggggcggcctcaccagtgcggtaccattcaacttgattttcagctgccacttcgttttgacctacagtataaggggcaggccggcgccttagaaagacctgttctcatccatagggctgttcttgggtcagtggaaaggctcctgggggtgttagccgagtcctgcggaggaaagtggccgctctggctgagcccattccaagtcgtggtcattccagtgggttcagaacaagaggaatatgccaaggaggcgcagcagtcccttagggccgcgggcctcgttagcgacctggatgccgattcgggtctgactctctcaaggaggatccgacgggcgcagctggctcactacaactttcagttcgtagtgggccaaaaggaacaaagtaaaagaacagtcaatatacgtactagggacaatcggaggttaggagagtgggatctgccagaggctgtccaacgccttgtggagttgcaaaatactcgagttccaaacgccgaagagatcttttag

SEQ ID NO: 137795 - DNA, 537 bp, Artificial Sequence
  Description of Artificial Sequence: Synthetic coding sequence
atggccttgtatcagagatggcgctgcttgaggctgcaggggctgcaggcttgtagactgcacacagcagtcgtgtctaccccaccacggtggctcgccgaacggttaggactgttcgaggaactgtgggctgctcaagtgaagcggctggctagtatggctcaaaaagaacctcgcacaattaagattagtctcccgggtggtcagaaaattgatgcagtcgcatggaacactaccccataccagctcgctaggcagatcagtagcacccttgccgataccgcagtggccgctcaggttaacggagaaccttacgatctggagcgtccactggagacagattccgacctgcgttttttaacgtttgattcccccgagggtaaagctgttagcttctttctgattagaaataccgttaccaccaaaccgagagatattgaggccggcaatagtaacattctgttcttttgccggagtttcagcatctgctcatgggagggagatctgccacaaaccgtgctgacaatcagtgggtag

SEQ ID NO: 137796 - DNA, 1767 bp, Artificial Sequence
  Description of Artificial Sequence: Synthetic coding sequence
atggctctgtaccagcggtggaggtgccttcgtctccagggactgcaggcttgtcgtctgcacaccgcggtcgtgtccacccccccaaggtggcttgcagagaggttaggactgttcgaggaactgtgggccgctcaagtaaaaaggctcgcaagcatggctcaaaaagagcccagaacgatcaaaatctctcttcctggcggccagaaaattgacgccgtggcttggaatacaaccccttatcaattggcccggcaaatatccagtacgttggcagacaccgctgtggccgcccaggttaatggagaaccgtacgacctggaacggccgctggaaacagacagtgatcttcggttcctgaccttcgacagcccagaggggaaggccgtgttttggcattcctcaacccacgttcttggtgctgctgcagaacagtttctgggcgcagtactgtgtcgggggccaagtaccgagtacggattttatcacgacttctttcttggtaaggagcgtaccatccgcgggtctgaactgcctgtgttagaacggatctgtcaagaattgactgcagcggcccggccgtttcgacgcctggaagcgtcacgggaccagctgcggcagcttttcaaagcggaatatgctcatcggggtttctcagaggtgaagacgcctaccttattttcaaccaaactgtgggagcagtcgggacactgggaacactaccaggaagatatgtttgccgtccagccacccggcagcgacaggcctccttcatcacagagcgatgactctaccagacatatcactgacaccctggctctgaagccaatgaactgccccgctcactgcctcatgttcgctcaccgcccccggtcttggcgcgagctcccattgaggttggccgacttcggcgcactgcatagagctgaggcgtctggtgggcttggcggattgacgagactgcggtgcttccagcaagatgatgcacacatcttttgcactactgatcagctggaggcagagatccaatcatgcttggatttcttgcgatctgtgtacgccgtgcttggattcagtttccggctggccctaagcacccgcccgtcgggctttctaggcgacccttgtttatgggaccaagccgagcaagtcttgaagcaggccctcaaggagtttggtgaaccttgggacctcaacagcggggatggtgccttctatgggcccaagatagatgtacatctccatgacgcccttggccggccccaccagtgtggtacaattcagctcgattttcagctccctctgaggtttgatctgcagtataaaggccaggccggggccctggaaaggcctgttctcattcatcgcgccgtactgggatccgtggagcgcctgctgggcgtgctcgctgaaagctgcggaggcaagtggcccctgtggttgagcccatttcaggtggtagtgatacccgtgggaagcgagcaagaagaatacgccaaggaagctcaacagagtctgcgagcggctggacttgtgtccgatctggacgcggacagcggcctcacactctcacgtagaattagaagagcacagttggctcactataactttcaattcgtggttgggcagaaagagcaaagcaaacggaccgtaaatataaggacaagagacaatcggcgccttggtgagtgggacctgcctgaggccgtccagcgcttagttgaactccagaacaccagagttcctaacgccgaggagattttttag

SEQ ID NO: 137797 - DNA, 2157 bp, Artificial Sequence
  Description of Artificial Sequence: Synthetic coding sequence
atggctctgtaccaacggtggcggtgtctcaggctgcaggggcttcaggcctgcagactacacacagcggtggtttctacaccccccagatggctcgccgagaggctcgggctcttcgaagaactgtgggctgcacaggtgaagcggctggcatccatggctcagaaggaaccacgcacgatcaagatctctcttccagggggccagaagatcgatgctgtcgcctggaataccactccttaccagctcgcccggcaaatttcttctactttggccgatacagctgttgctgctcaggtcaacggagaaccatacgacctcgagcggcctctggagacggacagcgatctgagattcctgacattcgactctcctgaggggaaggccgtgttttggcacagctctactcacgtcctcggggccgcagccgaacagttcctgggggccgttctgtgtaggggcccatctaccgaatacggcttctaccacgattttttcctcggtaaagagagaacgatcaggggctccgagctccctgtgttagaaagaatctgccaagagttgaccgctgccgcgcgaccatttaggcggctcgaggccagtcgagaccaattgcgacagttgttcaaggataaccctttcaaactgcatctcatagaggagaaggtaactggccccactgccaccgtttatggatgtggaaccctggtggatttgtgtcaggggcctcacctgcggcacaccggacagattggaggactcaaactgctgagcaacagcagttccctgtggcgtagctccggagcccccgagacccttcagcgggtgtcaggcatctcgttccccaccaccgagctgctcagagtctgggaagcatggcgggaggaagctgagcttagggaccaccgcaggatagggaaagagcaggaactctttttctttcatgaactctcacccggaagttgcttcttcctgccccgtggtacaagggtgtataacgctctggtcgcatttatcagggccgaatatgcccaccggggcttctctgaagtgaagactcctactctcttcagcacaaagctgtgggaacagagcggccactgggagcactaccaggaggacatgttcgcggtacagcctcccggcagtgaccggcctccttcgtcccagtccgatgacagcacacgccacataaccgacaccctggcgctcaagccgatgaattgccccgcacattgtctgatgtttgcccataggccgcgctcttggcgggagcttccccttagactcgccgacttcggtgcactgcatcgggcagaagccagtggcggcttgggcgggctgaccagactgagatgctttcagcaagacgatgcacatattttttgcactactgatcaactcgaggccgagatccagagctgtttggatttcctacgtagcgtgtacgctgtgctgggtttctccttccgccttgctcttagtaccaggccttctggcttcttgggcgacccgtgtctgtgggaccaagctgaacaggtgctcaaacaagccctgaaagagtttggcgagccctgggacctcaactctggcgacggggccttttatggccccaagatcgacgtacatcttcatgacgcgctgggcaggcctcatcagtgcgggaccatccagttagactttcaactgcctctcaggtttgacctgcagtacaagggacaggccggtgctctagaacgccccgtgttgatacaccgagccgtgcttggcagcgtcgagcgactactgggagtcctggctgagagctgtggtgggaaatggccgctctggctgtccccatttcaagtcgttgtaatcccggtggggtctgagcaggaggagtacgccaaggaggctcagcagagtcttagggccgccggactggtatccgacctggacgctgactccggcttgactcttagtcgcagaatacgaagagcacagcttgcccattacaacttccaattcgtagtggggcaaaaagagcagtccaagagaaccgttaacatccggaccagagacaaccgccgattgggggagtgggatctacctgaggcagtgcagcgactggttgagcttcagaacacccgggttccgaatgcagaggaaattttctag

SEQ ID NO: 137798 - DNA, 510 bp, Artificial Sequence
  Description of Artificial Sequence: Synthetic coding sequence
atggccctgtaccagcgttggagatgtctgcggcttcaaggccttcaggcatgccggctccacaccgccgtggtgtcaacccctccacggtggctggccgagcgattgggcttgttcgaggaactgtgggcagcacaggtcaaacgcctggctagtatggcacagaaagagccacgcactataaaaatctctttgcctggtggtcagaaaatcgatgccgtcgcgtggaacaccaccccctatcagcttgctcggcaaatcagcagcacactggctgacactgctgtggcagcgcaggttaatggggaaccttacgacctggaaaggcccctagaaacggactcggacctgcgtttcctgaccttcgactcacctgaaggaaaagccgataatcctggcttgcgtgctgcttgtttcggcgcggatttaccaggcacctacagctgttgttccaccttgcccgaggcgaggggatttacaggctctgccagtcccgtcgtccagggctag

SEQ ID NO: 137799 - DNA, 4974 bp, Artificial Sequence
  Description of Artificial Sequence: Synthetic coding sequence
atgggactgcaggcaaggaggtgggcaagtggcagtcggggcgctgctggtcctcgccgcggggtgctgcaattgctgccactgccactacctttgcctctgttgctgttacttcttttgagacctggtgcagggcgcgctgccgcacagggtgaggccgaggccccaactctctatttgtggaaaacaggtccgtggggacgatgtatgggtgacgagtgtggaccaggaggcattcagacccgcgccgtgtggtgcgctcacgtcgaaggatggaccactctgcacactaactgtaagcaggcggagaggccgaacaaccagcaaaattgcttcaaagtatgtgactggcacaaagagttgtacgactggcggctcggcccctggaatcagtgtcagcccgtgatttccaagtcgttagaaaaacccctcgagtgtatcaaaggggaggaggggatccaggtcagagaaattgcctgcattcaaaaagacaaggatataccagccgaagacatcatttgtgagtacttcgagccaaaacctctattagaacaggcatgcctgatcccgtgtcagcaggactgcattgtgagcgaattcagtgcctggtctgagtgctcaaaaacgtgcggcagcggcttacaacatcgaaccagacacgttgtcgcccctccccagttcggagggagtgggtgccctaatctgactgagttccaagtctgccaatcatccccatgcgaggctgaggaactgcgatacagtctgcacgttggaccttggtccacctgcagcatgccccactcgcggcaggtaagacaggcgaggcgccggggcaaaaacaaagagagagagaaggacaggtccaaaggggttaaagatcctgaagccagagaactgataaaaaagaaacgcaaccgcaatcgtcaaaaccggcaagaaaacaagtactgggatattcagatcgggtaccagacgcgggaggtgatgtgtatcaataagactgggaaagctgctgatctgtctttctgccaacaggaaaagctgccaatgacattccaaagttgcgtgatcacaaaggaatgccaggtaagcgagtggtccgagtggtctccatgttccaagacatgtcacgacatggtttcccctgccggcacgagggtgagaacacggacaatcaggcaatttccaataggtagtgaaaaagagtgcccagagtttgaggagaaggaaccttgtctctcacagggagatggtgtcgtgccgtgcgcaacatatgggtggagaactaccgaatggacagaatgcagagtcgatcccctcctgtcccagcaggataaaaggcgcgggaaccagactgccctttgcggaggcgggattcagacacgcgaagtatactgtgtgcaggctaacgagaatctccttagccagttgtcaacccataagaacaaggaggcatcaaagcccatggatctaaaactgtgcaccggccctattcccaatacgacccagctgtgtcacattccttgtcccaccgaatgtgaggtgtctccctggtccgcctggggcccatgtacctacgagaactgtaacgaccagcaaggaaagaagggcttcaaactccgcaagagacgaattacaaatgagccgacaggaggctctggcgttaccggaaactgtccacacctgctcgaggccattccttgtgaggagcctgcctgctatgactggaaagccgttaggttgggaaattgtgaaccagataatgggaaggaatgcggtcctggtactcaggtgcaggaggtcgtgtgtataaactcagatggagaggaggtggaccgccagctttgcagggacgcgatcttccccatccccgttgcatgtgacgcaccatgtcctaaggactgtgttttatccacctggtccacgtggagcagctgcagtcatacttgttctggcaagactactgagggcaaacagatacgagcaaggagcattctcgcctatgccggcgaagagggcggcattcggtgtcccaatagctccgctctgcaggaggtgagaagctgtaacgaacacccttgtaccgtgtaccattggcagactggcccctggggtcagtgtatagaggatacaagcgtgagctcttttaatactactaccacgtggaatggggaggccagctgtagtgtgggtatgcaaacccggaaggtgatttgcgtcagggtgaacgtgggccaggtcggcccgaaaaagtgccccgaatcccttagaccggagacagtaagaccgtgcctgctgccctgtaagaaagattgcatcgtgactccttattcggattggaccagctgcccatctagctgcaaagagggggattcatctatccgaaaacagtcacggcaccgtgtgattattcagcttcctgctaacgggggtagagactgcacagatccgttgtatgaagaaaaggcctgcgaggctccacaggcatgccagagctatcgatggaagacacacaaatggcgaaggtgccagctagtgccctggtctgtgcaacaggattcccccggagcgcaggagggatgtggaccaggccgtcaggccagggctattacgtgtagaaagcaagacggcggtcaggcgggcatacatgagtgtctgcagtacgctgggcctgtgccggctctcacgcaggcctgtcagatcccttgccaggatgattgtcagctaacctcatggtccaagttctcctcatgtaatggcgattgcggtgctgtcagaacaaggaagcgaacccttgtgggcaagtccaaaaaaaaagaaaagtgtaagaactcacatctgtatcctctgattgagacccagtactgcccctgtgacaagtacaacgctcagccggtcggcaattggtctgactgtatcctgcccgaaggcaaagtcgaagtgctgcttggcatgaaggtgcaaggtgatatcaaggaatgcggccagggctatcggtatcaggccatggcttgttatgaccagaatggccggttggtagagacttcccggtgtaatagccacggatatatagaggaggcatgtattatcccctgcccgtcagattgcaagcttagcgagtggtcaaattggtcacgctgttccaagtcctgcgggagcggagtgaaggtgcgcagcaaatggctgcgtgagaagccatataacggcggtcgcccctgccccaagctggaccatgtaaaccagtttcaggtgtacgaggtggttccctgtcattccgattgtaaccagtacctctgggtgacagaaccctggagcatctgcaaagtgacctttgttaacatgcgcgagaactgcggcgaaggcgtccagacgcgaaaagtgcgctgtatgcagaacacagctgacggtccttccgagcacgtcgaggattacctgtgcgacccggaggaaatgcccctcgggtcgagggtctgcaaactcccatgtcctgaggactgtgttataagtgagtggggaccgtggacccagtgcgtactgccttgcaatcagtcctcttttcggcagcgttccgcggaccccatccggcagcccgcagatgaaggccggagttgtcccaacgctgttgaaaaagagccatgcaatttgaacaagaactgttatcattacgactacaacgtcacagattggtccacctgccaacttagcgagaaggccgtctgtggcaacggcataaaaacgcggatgctagattgcgtccgttcggacggtaagtctgttgatctgaagtattgcgaggctctgggcctagaaaaaaactggcaaatgaatacctcatgtatggtcgagtgccctgtgaactgtcaactctctgattggtccccgtggagcgaatgttcccagacatgtgggctcaccggtaagatgattcggcgccgtacagtgactcagcctttccagggggacgggcggccatgtcccagtttgatggatcagtctaaaccttgtcccgtgaaaccgtgctatcgatggcaatacggccagtggagtccgtgccaggtacaggaggcccagtgtggggaggggacacgaaccagaaacatcagctgtgtggttagcgatgggtctgcagatgacttttccaaggtcgtggacgaagagttttgcgctgacatagaacttataatcgatggcaacaagaatatggtgttggaggaatcttgctcacaaccctgccccggggactgctacctgaaggattggagctcatggtcactttgtcaattaacatgtgtcaatggcgaggatctgggttttggaggaattcaagtgcggtccagaccagtcataattcaagaattagaaaaccagcatctgtgccccgagcagatgctcgagaccaagtcatgctacgatggacaatgctatgagtacaaatggatggcatcggcgtggaaggggtcctccagaacagtatggtgtcagagatctgatggaatcaatgtgacaggaggctgcctggtaatgtctcagcccgacgccgacagaagttgtaatccaccctgttctcagccgcattcctactgctcagagacgaaaacctgccactgcgaggaaggctacacagaggttatgtcgtccaattctaccctggaacaatgtacacttattccagttgtggttctgccaactatggaggacaagcgcggagatgtgaaaacgtctagggccgtgcaccctacccagcctagctctaaccctgcaggaaggggccgaacatggtttctgcagccctttggacccgacggccgcttgaaaacatgggtctacggtgtagcggctggggcttttgtgctcctcatctttatcgtgtccatgatctacctggcctgcaaaaagcccaaaaaaccgcagagacggcagaacaaccgcttaaagccgctcacactggcctatgatggcgacgccgacatgtag

SEQ ID NO: 137800 - DNA, 4974 bp, Artificial Sequence
  Description of Artificial Sequence: Synthetic coding sequence
atgggcctgcaggctcgccgatgggcaagcggcagtaggggagcagcagggcccaggaggggcgtcctccagctgttgccactgccactgccattgccactgctgctgttacttctcctgcgccctggcgcaggcagagctgccgctcagggtgaggcagaagcacctaccttgtacctctggaagacaggcccctgggggcgatgcatgggagacgaatgtggtccaggtggcattcagacgcgagctgtctggtgtgcccacgtggaaggatggactacactgcatactaattgcaagcaagctgagcgtcccaataatcagcaaaattgctttaaagtttgcgattggcacaaggaactgtatgactggcgattgggcccctggaaccaatgccagccagtgatttcaaaaagtctcgagaagcccctggaatgcatcaaaggcgaggaagggattcaagtccgcgagattgcatgcatccagaaagataaggatatacccgcagaggacatcatctgtgagtactttgagcccaagcccctcctcgagcaggcctgccttatcccttgtcagcaggattgtatcgtgagtgaattttctgcctggagcgaatgttccaaaacctgtgggtctggactgcaacaccgaaccaggcatgtcgttgctcctccccagtttggaggctcgggatgcccaaatctaacagaattccaggtgtgtcagtcatcaccatgcgaggctgaggagctgaggtatagtttgcacgtcggcccatggagcacctgttctatgccccacagccggcaggttaggcaagcccggaggcgaggaaaaaacaaagagagggaaaaagacagaagcaaaggcgtcaaagacccagaggcccgcgagctcataaaaaagaaacgaaatagaaataggcagaataggcaggaaaataagtactgggatattcagatcggctaccagacacgggaggtgatgtgcataaataagaccggtaaggccgcagacctgagtttctgtcagcaggagaagctccctatgactttccagtcttgtgtgataaccaaggagtgccaggtgtccgaatggagtgagtggtccccgtgctccaaaacgtgccacgatatggtgtcgcccgccggcactcgggtcagaaccaggactatcagacagttccctattgggagtgaaaaagagtgccccgaatttgaggagaaggaaccctgtctgtcacagggcgatggcgtggtcccctgcgcaacctatggttggcgtactacagagtggaccgagtgccgggtagatcccctcctgtcccagcaggataagcgtagagggaaccagacagccctgtgtgggggcgggattcagacaagggaggtttactgtgtgcaggccaatgagaatttactcagtcaactgtccacgcacaaaaacaaagaagcatccaaacctatggacctgaagttatgtactggaccaatcccgaataccacccagctgtgtcatataccctgccccactgagtgcgaagtgtcgccctggagcgcctgggggccttgcacatatgaaaactgcaatgaccagcagggaaaaaagggctttaaactgcgcaagcgtaggatcactaatgagcccaccggaggatcaggcgtgaccggaaactgccctcatctgttggaagcgataccctgtgaggagccagcttgctatgactggaaggccgtgcggctgggaaactgcgaacctgataacggaaaggagtgtggcccaggtacacaagtgcaggaggttgtgtgcatcaacagcgacggcgaagaagtggatcgtcagctgtgccgagacgcaatattccctattccagtggcctgtgacgcaccatgcccaaaggattgcgtactttcaacgtggagtacctggtcctcctgcagccacacatgcagtggaaaaaccactgaaggaaaacagattcgggccaggtcaatactggcgtatgcgggagaggaggggggaatcaggtgcccgaactctagcgcgttgcaggaggttagatcctgcaacgagcacccatgcaccgtctatcattggcaaaccggtccatggggacaatgcattgaagacaccagcgtgagcagctttaataccactaccacctggaacggcgaggccagctgttcggtgggtatgcagacaaggaaagtgatctgtgttcgcgtcaacgttggacaagtggggcctaaaaaatgcccggagagtctacgacctgagaccgtaaggccttgcctgctcccatgtaagaaagattgtatcgtcaccccatactctgactggacttcttgtccctcaagctgcaaggagggcgacagcagcatcagaaaacagtcccgccaccgcgtcataattcagttgccagccaatgggggtagagactgtactgacccattgtatgaggaaaaagcatgtgaagcccctcaggcctgtcagtcctacagatggaaaacccataaatggagacgctgccaactggtcccatggtcagtgcagcaggactcacccggcgcccaggaaggctgtggccccggccggcaggccagagcgattacctgcaggaagcaggacggtggccaggctggcatacatgagtgcctgcaatacgctgggccagtgccggcactgactcaggcctgccagattccctgtcaggacgattgccaactgacgtcgtggagtaagttcagcagctgcaacggggactgtggggccgtgagaacgaggaagcggaccttagtgggaaagtcaaagaaaaaagagaaatgcaaaaactcccatctgtacccactgattgagacacagtactgcccctgtgacaaatacaacgcccagccggtaggcaattggagcgactgcatcttgcctgaagggaaagtagaagtcttgctcgggatgaaagtgcagggagatatcaaagagtgcggacagggatatagatatcaggccatggcttgttacgatcagaatggccggcttgtcgaaactagccgctgtaactcccacgggtacatcgaggaggcttgtatcatcccctgcccatctgattgcaagttgtctgaatggagtaattggtcccgctgttctaaatcatgcggatctggagtgaaggtcaggtcaaagtggctgagagaaaagccttacaacggaggtcggccatgtccaaaactcgaccacgtaaaccaggcgcaggtgtacgaggtggtcccctgccacagcgattgtaatcagtacttatgggtgaccgagccatggtctatttgcaaagtaacatttgtgaacatgagagagaattgtggggagggagtgcagaccaggaaagtgcgatgtatgcaaaataccgccgacggacccagcgaacatgtcgaggattacttgtgcgatcctgaagaaatgcccctggggtctagggtctgtaaactcccctgcccagaagattgcgtgatctccgagtggggcccttggacacagtgcgtcttgccttgcaaccagtcttctttcaggcaaagatccgcggatcccatccgccagcccgccgatgaaggccgctcatgccctaatgccgtggagaaggaaccttgcaatttgaataaaaactgttatcattacgactataatgtgaccgactggtctacttgccagttgtccgaaaaagcagtctgcgggaacggtattaaaacaaggatgctggactgcgtgcggagcgatggtaaatccgtcgacctgaagtactgtgaggccttggggctcgagaaaaactggcagatgaatacctcctgtatggtcgaatgccccgtcaattgtcaattgagcgattggagcccgtggtccgaatgtagccagacgtgcggattaaccggcaagatgattcgcaggcgaaccgtcacacagcccttccagggtgatggaaggccctgcccttcgttgatggaccagagcaagccatgccctgttaagccttgctatagatggcagtatgggcaatggtccccatgtcaggtgcaggaagcccaatgtggcgaaggaacccggacgagaaacatatcctgcgtagttagtgatggatcggccgacgatttctcaaaagtcgtggacgaggagttctgtgcagacattgagcttatcattgacgggaacaagaatatggtcctggaagagagttgctctcagccctgtccgggggactgctacctaaaggactggtcgtcatggtctctatgccagttgacctgcgtgaacggggaggacctgggcttcggcggcattcaggttcggtcacgcccggttatcattcaggaactcgagaaccagcatttgtgccccgagcagatgcttgagacaaaatcatgttacgatggccaatgttacgaatacaagtggatggcctctgcatggaaaggcagcagcagaaccgtgtggtgtcagcggtctgacggcattaacgtgacaggaggttgcttagtgatgtctcagcccgacgccgaccgctcctgtaaccctccttgctcacagcctcactcctattgctcagagaccaaaacctgtcattgcgaggagggatataccgaggttatgtcttctaacagcactctggagcaatgcacgctaattccagtcgtggtgcttcccacaatggaagacaaacggggggacgtgaagacctctcgagccgttcatcctactcagccatcaagtaacccagccgggcgcggaaggacgtggttcctacagcccttcggccccgacggtagactaaagacttgggtttacggtgttgctgcgggcgcattcgtgctccttattttcatcgtgtcgatgatttatttagcctgtaagaagcccaaaaaaccccaacgacggcagaacaacaggctcaaacctcttaccctggcctatgatggtgatgctgacatgtag

SEQ ID NO: 137801 - DNA, 2010 bp, Artificial Sequence
  Description of Artificial Sequence: Synthetic coding sequence
atgagcgctcttttatccctgtgtttcgtattacccctggcagctcctgggcacggcacccagggctgggaaccatgtacagatctgcgccctttagatattctcgccgaggtcgtcccatctgacggcgccacttcgggcatccggattgtccaggtgcacggtgccagggggctccagttaagtgtcgctgcccctcggactatgagcttccccgcctccaggattttttcccagtgtgatctttttcctgaagagttcagtatcgtcgtcaccctgcgcgtgcccaatctgccccccaagaggaatgagtatctcttgaccgtggtcgcggaggaaagcgacctcctccttcttggattacgcctgtctccggcccagcttcactttctgtttctgcgcgaagacacagccggggcctggcaaactcgggtgtccttcagaagccctgcactggtagatggtcggtggcacacactcgtgcttgctgtcagtgctggagtcttttcactcactactgactgcggattgccagtggacatcatggctgacgtgccctttcccgctacattatcagtgaaaggcgctaggtttttcgtgggcagccgccgcagggccaagggtctgtttatgggactcgttcggcagcttgtcctgcttcctggaagtgacgccactcctagactgtgtccctctcgaaatgcccctttagcagtactgtcaattcctagggtacttcaggcgcttacagggaaaccagaagacaacgaagttctgaaatacccttacgaaaccaacattagggttacactgggtccccaacctccttgtactgaggtggaggatgcccagttttggtttgatgcttccaggaaaggcttgtacctctgcgtgggcaacgagtgggtcagcgttttggccgccaaggagagacttgattacgtggaagagcatcagaacttgagtacaaattccgaaacactgggaatagaggtctttcggatcccccaggtagggttgtttgtagctaccgccaataggaaggctacctccgcagtttataagtggacggaggaaaagtttgtaagctaccagaacatccccactcaccaggcccaggcctggcggcatttcaccatcggtaagaagattttcctcgctgtggccaacttcgagccagacgaaaaaggtcaggaattcagtgtcatttataagtggtcccaccgcaaattaaaattcactccttaccagagcatcgcgacacactccgccagggattgggaggccttcgaagtggatggcgagcacttcctcgccgttgcaaatcaccgtgagggcgataaccacaatattgattccgttatttacaaatggaatcctgccacacggttatttgaggctaaccaaacaatcgcaacttctggtgcatacgattgggagtttttctccgtgggtccatattcgttccttgtcgttgctaacactttcaatggcacttctactaaggtgcattcacacctatatattcgcctgttgggcagcttccagttatttcagagcttcccaactttcggggccgctgattgggaggtgttccaaattggtgagcggatctttctcgccgttgccaacagccattcctacgacgtggaaatgcaggtgcagaacgactcttacgtcatcaatagtgtgatctacgaattgaacgtgaccgctcaggccttcgtgaagttccaagacattcttacttgcagcgcactggactgggaatttttctcagttggcgaagactattttctcgtggtcgcaaacagttttgatgggcgcacattcagtgtcaacagcatcatctaccgctggcagggctatgagggctttgtggctgtccattcccttccaaccgtgggatgcagggattgggaagctttttcaacaactgccggggcctaccttatatacagcagtgcaaaagagccactgagcagagtcttgagacttcgtaccagatag

SEQ ID NO: 137802 - DNA, 1800 bp, Artificial Sequence
  Description of Artificial Sequence: Synthetic coding sequence
atgagcgcactcctgtcactctgcttcgtccttcccctcgctgcgcccggccacggcactcaagggtgggaaccatgcaccgatttacgacctctcgacatcttggctgaggttgttccaagcgacggagccacctcaggcatccggatagtacaggtgcacggagcacgcgggttgcaactgtcagtggccgctccccggacaatgagtttcccagcttcacgcatctttagtcagtgcgatctctttcccgaagaatttagcattgtggttaccctgcgggttccaaacctgccccccaaacgcaacgagtatctgctcaccgtggtggctgaggagagcgatcttctcctcctcggcctgagactcagcccggcacagcttcacttcctctttctaagggaagacaccgctggggcgtggcagacccgcgtgtcctttaggtctcctgccctggtggatgggcgctggcataccctggtgctcgctgtttctgctggggttttcagtctaaccactgactgtggcctgccggtcgatatcatggctgacgtcccatttcctgcaaccttgtcggttaaaggggcccgcttttttgtcggatcccgccggcgcgcaaaaggactgttcatggggctagtgcgtcagctggtgctcttaccaggcagcgatgcaacacccagactgtgccccagcaggaacgcacctctggccgtcctttcaatccccagagttctccaggccctaactgggaaaccagaggataatgaagtgctcaaatacccctacgagaccaatattagagtcacactgggccctcagccaccctgtactgaagtggaggatgcacagttctggtttgacgcatcccgaaagggcctgtacctgtgtgtggggaatgagtgggtatcagtcctcgctgaggcaaaagaacgtctggattatgtggaggagcatcaaaacctgtctaccaactcagagactctgggaatagaagtctttcgtatacctcaagtgggcctgtttgtagccaccgccaatagaaaagccacatctgccgtttacaagtggactgaagagaaatttgtgtcataccagaacatccccacacatcaggctcaggcctggaggcatttcaccataggtaaaaagatttttttagctgtcgccaatttcgaaccagacgagaagggtcaggagtttagtgtgatatacaagtggtcccatcgcaagctgaagttcaccccctaccagagtatcgcaacacattcagccagagactgggaagcgtttgaggtagatggagaacacttcctggccgttgctaaccaccgggagggcgataatcacaatatcgacagtgtcatatacaaatggaaccccgccacgcgcctgttcgaggccaaccagactatagctacatctggcgcttatgattgggagtttttctcagtgggtccgtacagctttctggtggtggctaataccttcaacggcacgagtaccaaggttcattcacatttatatattcgattgctgggcagcttccaactttttcagtcttttcccacgtttggcgccgcagattgggaggtatttcagatcggggaacgcatatttctggcagtggcaaatagtcacagttacgatgtcgaaatgcaagtccagaacgactcctatgttattaactcagtgatctacgagctcaacgtaactgcacaggctttcgttaaatttcaggacatacttacttgctccggcggacgaagagggctgcacgccaggcgagccgagggttag

SEQ ID NO: 137803 - DNA, 1569 bp, Artificial Sequence
  Description of Artificial Sequence: Synthetic coding sequence
atgagtgctcttctgtccttgtgcttcgtgttgccactggccgcgcccggacacgggacccagggatgggagccctgtaccgacctgcgaccactggacatactggcggaagtcgtgccttcagacggcgcaacctccggaattaggatcgtccaagtacacggggctagggggttacagctgtcagtggcggcccctaggactatgagtttcccagccagccggattttctcccagtgtgacctgttccctgaggagttttcaatcgttgtgacactacgggtaccaaatctgccacctaagaggaatgagtatttgttgactgtcgttgctgaggagtctgatctgttactgctaggcctacgcctgagccccgcccagcctccttgtacagaggtggaagatgcccaattttggttcgatgcatcaagaaaaggcttatacctatgtgtgggaaacgaatgggtgagcgttctggccgccaaagagcgactggattacgtggaagaacaccagaatcttagtacaaattccgaaaccctcggaatagaggtctttagaataccgcaagtgggcttgtttgtcgccacggccaatcgcaaggccacctctgctgtttataagtggaccgaagaaaagttcgtgagctaccagaatattcccactcaccaggctcaagcttggcgccacttcactatcggcaagaagatctttttggcggtggctaatttcgaacccgatgagaaaggccaggagttctcggtaatctataaatggagccaccgcaagctgaaattcactccctatcagtctattgcgacccatagcgcacgcgactgggaagcttttgaagtagacggcgagcatttcctcgccgttgctaaccaccgcgagggcgataaccataatatagactcagtgatctacaaatggaacccagcaacccgcctattcgaagcgaaccaaactattgccaccagcggcgcatatgattgggagttcttctcagtaggaccatatagcttcttggtggtggcaaatactttcaacggtacctcaacgaaagtccacagtcacctgtatatccggttgctcggatcgtttcagcttttccaatcattccccacgttcggggccgctgactgggaagtttttcagattggggagaggatctttctggccgtggcgaattcccacagttacgatgtggagatgcaggtgcagaatgactcctacgtgatcaatagcgtcatatacgagctcaatgtcactgcccaggcctttgttaagtttcaagacattctgacttgtagcgcactggattgggagtttttttcagtgggggaggattactttctggtggttgcgaattcatttgatggaagaactttctcagttaatagtataatttatcggtggcagggctatgagggattcgtcgccgtccactctctccctacagtcgggtgtcgtgattgggaggcctttagtacgaccgcaggcgcctatttgatttactcatctgctaaagaacccttatcccgtgttttacgtctcagaacacgttag

SEQ ID NO: 137804 - DNA, 1605 bp, Artificial Sequence
  Description of Artificial Sequence: Synthetic coding sequence
atgatggaagccctcggattcctgaagttggaagtcaacggccccatggttaccgttgccctaagtgttgccctgctcgcgttgctgaagtggtacagcacttccgcattctcccggctggagaaactagggcttcggcaccccaagccgagccctttcattgggaatttaacttttttccgtcagggattctgggagtctcagatggagctgagaaaattgtacggcccgctgtgcgggtattatttgggacgtcgaatgtttatcgtgatctctgaaccagacatgatcaagcaggtcctcgtcgaaaacttctcaaatttcaccaaccgcatggcaagcggcctcgaattcaagagcgtggccgatagcgtcctgttcctcagagacaaacgctgggaagaggtgcgaggagcactcatgtcagccttttcacctgagaaactcaacgagatggttccgttgatctcgcaggcctgcgagttacttctggcccatcttaagcgctacgccgagagcggcgatgcctttgacattcagcgctgttattgtaattacactactgacgtagtggcctcagtggcgttcgggaccccagtggacagctggcaggctcccgaggatccgtttgtcaagcactgcaagcgcttctttgagttttgcataccaaggcctatcttggtgcttctgctgtccttcccgtcaattatggttcctctcgcacggatcctacccaataagaatcgcgacgagctgaatggctttttcaataagctgatccgtaatgtgattgctctgagagatcaacaggcggcagaggaaagacgcagagactttcttcagatggtgctcgacgcgaggcactcagcctctcctatgggggtgcaagattttgacatcgtcagggatgtattttccagcaccggctgtaaacctaatccatcaaggcagcaccaaccctctcccatggcccgaccccttaccgtagacgagatcgtcgggcaggcatttatctttttgattgctggctatgagatcatcaccaataccctgagctttgccacttatcttcttgcaaccaatccagactgccaagaaaagctactgcgagaagtggacgtctttaaagagaagcacatggccccggaattttgcagtttggaggagggactaccttacctcgacatggtaattgcggagacactgcggatgtaccccccggcctttaggttcacccgggaggccgcccaggattgcgaagtcctgggacaacggattcccgcaggagccgtcctggaaatggccgtcggagctttacaccatgatcctgaacactggccatcgccggagacttttaaccccgagcgatttaccgcagaagcccggcaacaacataggccatttacctatctgccgtttggagccggacctcggtcctgtctgggagtaaggttaggtctgttggaagtcaaactgacgcttctgcatgtgctccacaaatttaggttccaggcgtgccctgaaacccaggttcccttgcaactggagtccaaatccgccttgggacccaagaatggagtgtacattaagatcgtgagccggtag

SEQ ID NO: 137805 - DNA, 1602 bp, Artificial Sequence
  Description of Artificial Sequence: Synthetic coding sequence
atggaagccttgggctttctgaagctggaggtaaacggacccatggtgacagtggccctgtcggtggcactcctagccctcctcaaatggtattcgacgtcagcttttagccgactcgagaaactgggactgcgacatcccaagccttctccatttatagggaatctgactttctttcggcagggcttctgggaatcccagatggaactgaggaagctatatggtcccctgtgtggatattacctggggagaaggatgttcatcgtaatctcggagcctgacatgatcaaacaggtgctggtggaaaacttctcgaactttactaaccgtatggcgtccgggctcgagtttaaaagcgtggctgactcagtcctgttcctacgggacaagcggtgggaggaagttcggggagctttgatgtccgcgttttctcctgaaaagcttaacgagatggtgccactcatcagtcaggcatgcgagctgctcctagctcacttaaaacgatacgcagagtccggggatgctttcgatattcaaaggtgttattgcaattacaccaccgatgtggttgcttctgtagcttttggcaccccagtcgattcctggcaggcacccgaagatccttttgttaagcactgcaaacggttcttcgagttttgcattccacgtcccatcctggtcctgttactttcatttccgagtatcatggtgcccctggccagaatactgccaaataagaatcgagatgaactgaatggctttttcaacaaactaatcaggaatgtcattgctctgcgggaccagcaggcagctgaagaaagacgcagagacttcctgcagatggttctcgacgcaaggcatagcgcttcgcccatgggtgtgcaggatttcgatatcgttcgcgacgtcttcagctctactggatgcaagcctaatccctcaaggcagcatcagccctcccccatggcgcgtcctctgaccgtcgacgagatcgtgggacaggcctttatttttttgatagccggctatgagatcatcacaaacaccttgtccttcgccacctacctgctggcaaccaacccagactgtcaagaaaaactgttgcgagaggtagacgtgttcaaggagaagcacatggcgccagaattttgtagcctggaagagggtctcccgtaccttgacatggtgatcgccgagacgctccgcatgtatcctccggccttcaggtttacacgcgaggccgctcaagactgcgaggtactggggcagcgcatcccggctggagccgttctggagatggctgttggcgccctgcaccacgatcctgaacactggccttcaccggaaacctttaacccggaacggttcactgctgaagcccggcagcagcatagaccttttacctacctgccgtttggcgctggccctcggagctgcctgggggtgagattgggtctgctcgaggtgaaattaactctgctgcacgtgttgcataagttccgcttccaggcttgtccagagacacaggtgccactgcaactggagagcaagtcggctctggggccgaagaatggggtgtacatcaaaattgtctctcggtag

SEQ ID NO: 137806 - DNA, 1380 bp, Artificial Sequence
  Description of Artificial Sequence: Synthetic coding sequence
atggaagccctgggcttcctcaagttagaagtcaatggaccgatggtaactgtggcactttcggtagctctgcttgcgctcctgaagtggtattccaccagcgctttctccagactagagaaacttggactccggcatccgaagccatccccttttatcggaaacctcacattttttaggcagggattctgggagtctcagatggaactaaggaagctgtatgggccgctgtgcggttactacctcgggagacggatgttcatcgttatatccgaacctgacatgattaaacaagtgctggttgagaattttagtaattttactaacaggatggcaagtggacttgagttcaaaagcgtcgctgatagtgttttatttctgcgcgataagaggtgggaggaggtgcggggggccttgatgagcgcgttttctcccgaaaagctgaatgagatggtgcccctgatcagccaggcctgcgagctgctgctagcacacttgaaacgctacgccgaatccggagacgcgttcgatatacagcggtgctattgtaactatacaacagacgtagtggcctccgtggcttttggaactcccgtcgattcctggcaggccccagaagatcccttcgtgaaacattgcaagcgcttctttgagttttgtatccctagacctatcttagtgctccttttgtcatttccttctatcatggttccactcgcgcggattctaccgaataagaatagagacgagttaaacggcttcttcaacaaactgatcagaaacgtcattgccctgcgtgaccaacaggccgccgaggagaggaggcgggatttcctccaaatggtgctcgacgctagacacagcgcatctccaatgggcgttcaggacttcgacatcgtcagggatgtgttttcttctactggatgcaaaccgaatccaagcagacagcaccagccctcaccgatggccaggcccctcacagtcgacgaaatcgttggacaggcctttatttttctcattgcagggtacgaaataatcacaaacaccttgtcgtttgctacttatctgctcgctaccaacccggattgccaggagaaactgctgcgagaggtcgacgtattcaaggagaagcacatggctcctgagttctgttccttagaggaaggactaccatacctcgacatggtgatcgccgagactctcaggatgtacccaccagcctttcggttcacaagggaggccgctcaggattgcgaagtcctggggcagaggattcctgccggagcggtgctggagatggccgtgggtgcactccaccacgaccccgagcattggccatcccctgaaacatttaatccagagaggtaccggtgcagctag

SEQ ID NO: 137807 - DNA, 1383 bp, Artificial Sequence
  Description of Artificial Sequence: Synthetic coding sequence
atgatggaagccctgggctttctgaagctggaagtaaacggccctatggtgaccgtagcgttgagcgtcgctctgttggcactcctgaagtggtattctacttccgcttttagtaggcttgaaaagctaggcctgaggcatcctaagccctcccctttcatcggcaatctcaccttttttcgccaaggcttctgggaatcacagatggagctgcgtaagttatatggaccactctgtggttattatctcggtcgccggatgtttatcgtgatctccgagcccgacatgattaagcaggtgcttgtcgaaaatttctccaatttcacaaatcgcatggcctcgggcttagagtttaaatccgtggctgattcggtgctattcctacgggataaacgttgggaggaagtcaggggtgctctgatgagcgcgtttagtcctgaaaagctaaacgaaatggttcctctaattagtcaggcttgtgagctgctactggcccaccttaagcggtacgccgagtcaggtgatgcctttgacatccagcggtgttattgcaactataccactgatgtagtggcatcagtggcctttggcacccctgttgacagctggcaggctccagaagatccctttgttaagcactgcaagaggtttttcgaattttgtattcccaggcctattctggtgctactcctctcttttccctctattatggtccccctcgcgagaatactgccaaataagaacagagacgagctcaatggtttttttaataagctgattcgaaacgttattgctttgcgcgaccaacaggcagccgaggagagacgtagggattttctccaaatggtgctggatgccaggcacagtgcatcaccaatgggtgtacaggactttgacatcgttcgcgatgtattcagcagcaccgggtgtaagcccaacccaagcaggcagcaccagccatcccccatggcaaggcctctaacagtggacgagatcgtcggacaagccttcatctttcttatcgccggatatgaaattatcacgaatacactgtccttcgcaacttacctgctggccactaaccccgattgtcaagagaaactactcagagaggtggacgtgtttaaagagaagcatatggctccagagttctgttctttagaggagggcctgccgtatctggacatggtgatcgccgaaactctccgtatgtatccacctgcatttcgttttaccagggaagccgcgcaggactgcgaggtgctcggacagcggattcctgcgggcgccgtgctggaaatggccgtgggcgccctgcatcatgaccctgaacattggccatcgcccgagacattcaatccagaacgataccgatgtagctag

SEQ ID NO: 137808 - DNA, 1743 bp, Artificial Sequence
  Description of Artificial Sequence: Synthetic coding sequence
atgatggaagccctcggatttttgaagctcgaagttaacgggccaatggtgacagtggcccttagcgtggccctgctggctctgctgaaatggtactctacaagtgccttttccaggctggagaaactggggttgcggcatccaaaaccatcacccttcatcgggaatctgacgttctttcgccagggtttttgggagtctcagatggagttgaggaaattgtacggcccgctgtgtggatactaccttggccgcagaatgtttatcgtgatttctgaacctgacatgattaaacaggtcctggtcgagaacttctctaactttaccaacaggatggcaagcggactggagttcaagtctgttgctgattctgtcctcttcctaagggacaagaggtgggaggaggtgaggggcgcgcttatgtctgcatttagtccagagaagctgaacgagctcggactgctgataatgcaggagaggattaaagggcatatgggggggcaacaggctccgcagaggataccgccaaccaggctgagcaagcctagtggtatctacgtcaacctccattacgctacgttaccattctgcatggtgccactgatctcacaggcgtgtgaattgctcctggcccatctgaaaagatatgcggaatccggcgacgccttcgatattcagaggtgttattgcaattatacaacagatgttgtggcctctgtagctttcggaacacccgtcgatagttggcaggcccccgaagacccttttgtgaaacattgcaagcgattcttcgagttctgcattccccggcccatactggtgctcctgctgagcttcccctctattatggtgcctctcgctaggattctgcccaacaaaaatcgagacgagctgaatgggttttttaacaagctcatcagaaacgtgattgcactccgagaccagcaggcagctgaggaacgtagacgcgattttttgcagatggtgctggacgcccggcactcagcttcaccaatgggcgtgcaggatttcgatatagtgcgggacgtgttcagttctacggggtgtaaaccgaaccctagccgacaacatcagccctcacccatggcccgaccgctgactgttgacgagattgttgggcaggccttcatattcctgatcgccggctatgaaatcattacgaatacactatcctttgctacatacctactggcgaccaatccggattgtcaagaaaaattacttcgggaagtggacgtgttcaaggaaaaacacatggcccccgaattctgctcgctggaggagggattgccatatcttgatatggtgatcgctgaaaccctgcggatgtaccctcccgcgttcagatttacgcgagaggccgcacaggactgtgaggtgctgggccagcggataccagcgggcgctgtgttggagatggctgtaggggccctgcaccacgatcctgaacactggccgagtccggagacctttaaccctgagcggttcacggccgaggctcggcagcagcaccgcccatttacctacctacctttcggggctggcccgagaagttgtctgggcgtgcggctgggcttgctggaggtcaaactgaccctgctgcatgtcctacacaagttccggttccaggcatgtccggagacgcaggtgcccctgcaactggaatcaaagtccgcattaggaccaaaaaatggagtttatatcaagatcgtctctcgctag

SEQ ID NO: 137809 - DNA, 1605 bp, Artificial Sequence
  Description of Artificial Sequence: Synthetic coding sequence
atgatggaggccctggggttccttaaacttgaagtgaacggacccatggtcacagttgcactgtcagtggctttgctcgcactgcttaaatggtactccacatccgcgttcagccggctcgagaagctcggactgcgccaccccaagccttcgcccttcatcggcaaccttacattcttccgccaggggttctgggaatcccagatggagctgaggaagttgtatggtcccttatgtggttattatttgggccgaagaatgttcatcgtcatcagtgaacccgatatgatcaagcaggttctagtcgaaaatttctcgaattttactaataggatggcgtccggcctagaattcaagtctgtggccgatagtgtgttgtttctgagagataagcgctgggaagaagtgcggggagcccttatgtcagctttctctcctgagaaactgaatgagatggtgccgctgatctcacaagcgtgcgagcttctgctggctcacctcaagcgctacgccgaaagcggagatgcatttgacatccagcgttgttattgcaattacacgactgatgtcgtggcctccgttgctttcgggacacctgttgattcatggcaggcacccgaagatcctttcgttaaacattgcaaaaggttcttcgagttctgtattccaagacctatcctcgtgctactcttatcattcccgtcaattatggtgcctctggctagaattctcccaaataaaaatcgggacgagctgaacgggttttttaataaactcattagaaatgtgattgccctgagagatcagcaggcggcagaagagcggcgaagggatttcctgcagatggtgctcgatgctcggcattccgcctcgccaatgggggtacaagacttcgacattgtcagagatgttttcagctccaccgggtgtaaacctaaccctagcagacagcaccagcccagcccaatggctcgcccactgactgtggacgaaatcgtcggccaggcatttatatttctaatcgccgggtacgaaatcatcacaaacacactcagctttgccacttatctcctggcaacaaaccccgattgccaggagaagctcctgcgagaggtggacgtgtttaaggagaaacatatggcgcctgagttctgttccctcgaggaaggattgccgtatctcgacatggtcattgctgaaaccctcagaatgtacccacccgcattcaggtttactagggaagccgcccaggattgtgaagtactgggacagagaatccccgcaggcgccgtgttggaaatggctgtgggagccctccaccatgacccagaacactggcccagcccagagacctttaatcccgaacgcttcaccgctgaggccaggcagcaacatagaccttttacttacctacctttcggtgccggaccacgtagctgtctgggggtgaggctcggtctgctggaggtgaagcttacgttgcttcatgttcttcacaaattcagatttcaggcttgcccggagacccaggtgccactccagctggagtcgaagagcgcgctcggccccaaaaatggcgtctacatcaaaatagtgtcaaggtag

SEQ ID NO: 137810 - DNA, 453 bp, Artificial Sequence
  Description of Artificial Sequence: Synthetic coding sequence
atggaggcactcggcttcctgaaactggaggtcaacggcccgatggttactgtagcgctgtccgtggccctgctggcccttctcaaatggtattccacgtcggcgttttcccgtttggagaagttagggctaaggcaccctaaaccctccccatttatcgggaacctgacttttttccggcagggcttctgggagtctcagatggaactccgaaagctttacgggcccttgtgtggatactaccttggccgcaggatgtttattgtgattagtgaaccagacatgattaaacaggtgctcgtggaaaacttctccaacttcacaaacaggatggcgagtggcctggaatttaaatctgtagctgacagcgtgttattcctgagagataagcgctgggaagaggtccgaggggcattaatgtccgccttcagccccgaaaagctcaatgagtag

SEQ ID NO: 137811 - DNA, 1602 bp, Artificial Sequence
  Description of Artificial Sequence: Synthetic coding sequence
atggaggccctgggctttctgaaactggaagtgaacggacctatggtcaccgtggccctcagtgtggcactcctggccctgctgaaatggtattccacaagcgcattttctcggctggaaaaactcggcctacggcatccgaagccttctccctttattggcaaccttaccttcttccggcagggattttgggagtcacagatggaactccggaagctgtacggccctctgtgtgggtactacctggggcgccgtatgtttatagtcatctcggagcctgacatgataaagcaggttctggtcgaaaacttcagcaatttcactaataggatggcgtctgggctggaatttaagtccgttgccgacagcgtcctgtttctaagggataagcggtgggaggaagtgaggggtgcactaatgtctgcctttagtcctgagaagctgaatgagatggtgccactgatttcacaggcatgtgagttactcctggctcacctcaagagatatgcggaaagcggtgatgcctttgacatccagaggtgttattgcaattacaccactgacgtagtggccagtgtggcatttggaaccccggtggatagttggcaggctcccgaggacccctttgtgaagcattgtaaacgcttttttgagttttgtatccctagaccaattctggtgctgctcctgtcctttcctagcatcatggtcccccttgctcggatcctccctaacaagaatcgcgacgagctcaacggatttttcaacaagcttataagaaacgtcattgcactgcgggatcagcaagcggctgaagagagacggcgtgactttctgcagatggtactggacgcccgtcatagtgctagccctatgggagttcaggatttcgatattgtgcgcgatgttttctccagcactggttgcaaacctaatccatcacgccagcaccagccttccccaatggccagaccccttacggtggacgagatcgtggggcaggcatttattttcttgatagcagggtacgaaataataacaaacactctgtcatttgccacgtacctgctcgcaacaaatcctgactgccaagagaagctccttcgtgaggtagatgttttcaaggagaagcacatggctcccgagttctgttccctagaagaaggtctgccttatctggacatggttatagctgaaaccttgagaatgtaccctccagccttccggttcacaagagaggcagcacaggactgtgaggtacttggtcagaggattccggccggggccgtgcttgagatggcggtgggcgccttgcaccatgatccagaacattggccctctccggaaaccttcaacccagagcggttcacagccgaagcgaggcagcagcatcggccctttacgtacctgccttttggggcaggacctagaagctgtctgggtgtgagactgggcctcctggaagtcaagcttacattgcttcacgtgctccacaaattccgatttcaggcttgcccagaaactcaggtgcctcttcaacttgaaagtaagtccgcccttggacctaagaatggagtctatataaaaatcgtgtctcgatag

SEQ ID NO: 137812 - DNA, 459 bp, Artificial Sequence
  Description of Artificial Sequence: Synthetic coding sequence
atgatggaggctttggggttcctcaaactcgaagtgaatggaccaatggtgaccgtggccctgtctgtggcccttctggcattgttgaaatggtattctacttctgctttctctcggctggagaagctcggtctgcggcaccccaaacccagccccttcatcggcaatctgacttttttcaggcagggattctgggagtcacaaatggagttgaggaagctgtacggaccactgtgtgggtactatcttggacggcgcatgtttattgtcatctcagaacctgatatgatcaagcaggtcctggtggaaaatttttccaatttcactaatcgaatgcctcagtcaatcatgcccaactcgcggcatcacgtagcctcacgggggatgtggcctggtggcaggagactagcctgttacttgcatccattcaggatggctgaggggattgccgaggtctag

SEQ ID NO: 137813 - DNA, 1401 bp, Artificial Sequence
  Description of Artificial Sequence: Synthetic coding sequence
atggagttgcgaaagttgtacggccccctgtgtggatactacctcggcaggagaatgttcattgtcataagtgagcctgatatgatcaaacaggtcctcgtggagaatttcagtaattttactaacagaatggctagcggactggaatttaagtccgtggcagattcagtccttttcctccgtgacaaaaggtgggaagaggtccggggtgcactgatgtccgccttttcccccgagaaactgaatgaaatggtgccgctgatttcgcaggcttgcgagctactgctggcccacctgaagagatacgctgagagtggcgatgcatttgatattcagcgctgctactgtaattataccacagatgtcgtggcaagtgtggcatttggcacccccgtcgactcttggcaggctccagaagatccttttgtcaagcactgcaaacgcttcttcgagttctgcattcccagacctatcctggtgctactactgtctttccccagcattatggtgcctctcgctcggatactgcctaataaaaatcgcgatgaattgaatgggttctttaacaagctgatccgaaatgttatcgccctgcgggatcaacaggccgccgaagagcgccggagagatttcctgcagatggttttggacgctagacatagcgcatctccaatgggggtccaggattttgacatcgtcagagacgtgttctccagtactgggtgtaaacctaacccatccagacagcaccagcccagcccgatggcccgcccactgacagtggatgagatcgtcgggcaagcctttattttcctcattgcaggttatgagattatcactaacaccttgtcctttgctacctacctcttggctaccaatccggactgtcaggagaagctactgcgcgaagtcgatgtgttcaaggaaaaacacatggctcccgagttttgtagtctggaagagggcctgccctacctggatatggtgatcgccgaaacattgagaatgtatccgcctgcctttaggttcactcgggaagcagcccaggactgcgaagtgctgggacaaaggatccctgctggcgccgtccttgaaatggccgtgggcgcattgcaccacgatccggaacattggccctcccccgagactttcaatccagagcgcttcacagcagaggcgagacagcaacaccgccctttcacctacctccctttcggggccgggccccgtagctgtctgggagtccgtctgggcctactcgaggtcaaactaaccctgcttcatgtccttcacaagttccggtttcaggcctgtccggagactcaggtgccactgcagctggagtccaagtcagccctcggaccaaagaacggtgtgtatattaaaattgtgagccgatag

SEQ ID NO: 137814 - DNA, 1032 bp, Artificial Sequence
  Description of Artificial Sequence: Synthetic coding sequence
atgtggcccaatggctcctctctgggtccatgcttccggccaactaatattacactggaggagcggcggttgatcgctagcccctggtttgcagcttccttctgcgtcgtaggcctggctagcaatctgctcgcactcagcgtgctcgctggcgccaggcaggggggctcccatacacgctcttcgtttctcacgttcctgtgtggactagtactgactgatttcctcgggctcctggtgaccggcactatcgtggtctcacagcatgccgccctgttcgaatggcatgcagtggatccggggtgtcggctgtgtagattcatgggcgtcgtgatgatcttcttcgggttatctcctcttctacttggtgccgctatggccagcgaaagatacttagggattactcggcccttctccaggcctgccgtggcgagtcagcggcgcgcctgggctactgtggggttagtgtgggccgcagccctcgcactaggcctgcttccattgctcggggtcggaaggtatacagtccagtaccctggctcttggtgtttcctcaccctgggcgcagaaagcggagacgtcgccttcggcctcctgtttagcatgctgggaggcctgtcggtcggactgtccttcctgctgaataccgtctcagtagccactctttgccacgtgtatcatggccaggaggcagcccaacagcggccgagagactctgaagtcgaaatgatggctcaattattaggcattatggtggttgcttctgtatgctggctgccactactggtatttatagctcagactgtgctccggaatcctcctgccatgtctcccgccggtcagctctcccgaacaactgaaaaggaactgctaatatacttgcgcgtcgccacatggaatcagattctggacccctgggtctacatcctcttccgccgcgctgtcctaaggaggctgcaaccccgcctcagcacccgccctcgttccctgagcctgcagcctcagctgacacaacggtctggtctacaatag

SEQ ID NO: 137815 - DNA, 1224 bp, Artificial Sequence
  Description of Artificial Sequence: Synthetic coding sequence
atgtggcctaacgggtcctccctgggcccctgcttccgcccaaccaacatcaccctggaggagaggcgcttaatcgccagtccctggttcgctgccagcttctgtgtggtcggcttagcaagcaaccttctggcactatcggtgctggctggagcacggcagggtgggtcacatacacgttcatccttcctgacatttctctgcgggcttgtcctgactgacttcctgggcctgctggtgacagggacaatcgtagtatcccagcacgccgcattgttcgagtggcacgccgtggatcctggctgtcgcctatgcaggtttatgggcgtagtgatgatattcttcggactttcccccctcttgttgggtgccgcgatggcgagtgaacgctatctggggatcacacgaccgtttagtagacccgctgtggcaagccaacgacgggcatgggcgacggtcgggcttgtatgggccgctgctcttgctttgggtctcctccctctcctgggtgtcggcaggtatactgtgcagtaccccggatcctggtgcttcctcacactcggagcggagtcgggggacgtggcctttgggttgctcttctcaatgctgggagggctaagcgtgggcctcagtttcctgcttaatacagtgtctgtggccactttatgccacgtgtaccatgggcaagaagctgctcaacaacgtcctagagattctgaagttgagatgatggcgcaactgctggggattatggtggtggcctcggtgtgctggctgcccctgctcgtcttcatcgcgcagacagtcctgagaaacccacccgccatgtcgccagccggccagttatcccgcacgactgagaaagaactactcatttatcttcgggtggccacctggaaccagattctcgatccctgggtctatatcctgttcagaagggcggtgttaaggagactgcaacccagactctccaccaggccccgtcggagcctgactctttggccttctctggaatattctggcaccattagcgctcattgcaaccttagattgcctggctcctccgatagccgagcatccgcctcccgcgccgccggtattacaggagtctcgcattgtgcccgtccctgcatgctcttcgatccggaatttgatctgctagctggggtacagctattaccatttgagcctcccactggtaaggcactttcacgcaaggactag

SEQ ID NO: 137816 - DNA, 1422 bp, Artificial Sequence
  Description of Artificial Sequence: Synthetic coding sequence
atgagagaggtgcgggctcgcttggcagcgactcaggtggaatacatctccggaaaagtgttcttcacaacatgttctgatttgaacatgcttaagaagctgaaaagtgctgagaggctttttctcctgattaagaagcagttccccctcataatctccagcgttagtaaagggaagattttcaatgaaatgcagagattaatcaacgaggacccaggcagttggcttaacgcaatttcaatttggaagaacctccttgagctagatgccaagaaagaaaaactgagccagagggacgacaaccagcttaaacgcaaagttggtgagaatgaaatcattgcgaagaaattaaagattgagcagatgcaaaaaattgaggagaatagagattgccagctggagaaacagattaaggaggagactctggagcagcgcgactttactacgaaaagtgagaaattccaagaggaggagttccagaatgatatagagaaggcgattgatacacacaaccagaacgaccttactttcagagtctcctgtcgctgtagcggcaccataggaaaagcatttacagcacaggaagtcggaaaagttattggcattgcaattatgaaacatttcggatggaaggctgatttgcgcaacccccagctcgaaatttttattcatcttaatgacatttattcggtggtaggaatcccggtttttcgggtgagcctcgcctcccgggcatatatcaaaactgctgggctgagaagtacaatcgcttgggccatggcatcattggcagacataaaggccggagccttcgtgttggatcctatgtgcgggctgggcactatcctgctggaggcagccaaagagtggccagacgtctactacgtcggggctgatgtgagcgatagccaattgctgggaacctgggataacctgaaggcggccgggctagaagataagattgaactgctaaaaatttccgtgattgagctgccattgccctccgagtctgtcgatataatcatcagcgacattccatttggaaagaaatttaagctgggaaaagatatcaagagcattctgcaggagatggaaagggtgctccacgtgggcggaaccatcgtgctgctcctgagcgaagaccaccacaggagactgacagattgcaaggagtcaaatatcccctttaatagcaaggacagtcacactgacgagccaggcatcaaaaaatgtctaaaccccgaagaaaagactggagctttcaagactgcaagtacgagcttcgaagcatccaatcacaagtttctggatagaatgagcccgtttggttctcttgtcccagtcgaatgttacaaggtatctctcgggaagacagatgctttcatatgcaaatataagaagtcccacagcagcgggttatag

SEQ ID NO: 137817 - DNA, 873 bp, Artificial Sequence
  Description of Artificial Sequence: Synthetic coding sequence
atgagagaggtcagagcaagactggccgccacgcaggttgagtacatctccggaaaagtgttttttactacatgttcagatttgaacatgctcaaaaagctgaaaagcgccgagaggttgtttctgctgattaaaaagcagtttcccctgattatctcttctgtgtctaaagggaagatattcaatgagatgcaacggttgattaacgaggaccccggttcatggctgaacgccatttcaatctggaagaacctcctggagcttgatgctaaaaaggagaagctttcccagagggatgacaaccagttgaaacgcaaggtgggagagaatgaaatcatagccaagaagctcaaaatagaacaaatgcagaagattgaagagaacagagattgtcagctggaaaaacagatcaaggaggagaccctggaacaacgtgactttactacaaaaagcgagaaatttcaggaagaggaattccagaatgacattgagaaggccatcgatacgcacaatcagaacgacctcacctttcgggtgtcctgcaggtgttccgggacaatcggcaaggccttcacagcccaggtcctctatatggggttgagcccaggtcctcggcttcagatgcatatgagatcccagcagtgcagggaggagcgtacccctcagaccgtggcaatcaccagacctcaccagctggcactgacgaagttctcagacgtgaagggacactggagcgaatattttattaacttgaaaatcagtcagaccttgaagggtggtcggaagtctaactggaattgttactacgaaacactgtggatggaatctcgtctggaggagtctactattagggacctctacacctctaagtag

SEQ ID NO: 137818 - DNA, 1512 bp, Artificial Sequence
  Description of Artificial Sequence: Synthetic coding sequence
atgtctgaagcccgcggagagccaggaagcggtccggaagcgggggcccggttcttttgcacggcaggccggggtctggagcccttcgtgatgagggaggtgagggctcgcctggccgcaacccaggtggaatatatcagcgggaaagtttttttcactacgtgttcagatctgaatatgttgaaaaagctgaagagtgccgagcgtctctttctgctgataaagaaacagtttcccctcatcattagtagcgtttcaaagggaaaaattttcaatgaaatgcagcgattgataaatgaagaccccggctcttggctgaatgccatctcaatctggaagaaccttctagagcttgacgccaaaaaggaaaaactgagccagcgggatgacaatcagctgaaacgtaaagtgggggaaaacgagattatagcaaagaaattgaaaatcgaacagatgcaaaaaatcgaggagaaccgagactgccagcttgaaaaacaaatcaaggaagaaactctcgaacagcgggatttcaccaccaaatcagagaagtttcaggaagaggaatttcagaacgatattgaaaaagccatcgacacacacaatcagaatgacctgactttccgcgtttcatgcaggtgctctggcaccatcggcaaggcctttaccgctcaagaagtggggaaggtgatcggcattgccatcatgaagcattttggatggaaggcggacttaaggaatccacaactggaaattttcatccacctgaacgacatttatagtgtcgtgggtatcccagtgtttcgcgtgagcctcgccagtcgtgcctacatcaagaccgcaggactgaggtcaactattgcatgggctatggcaagcctggctgacataaaggcaggagctttcgtgctggatccaatgtgtggcctgggcacaatattactggaagccgccaaggaatggcccgatgtgtactacgtgggtgctgatgtgtccgatagtcagctgttgggcacttgggacaatttaaaggcagccgggctcgaggacaagatcgaacttctcaagatatccgtcatcgagctgcctctgccatctgagtccgtggacatcatcatttctgatataccattcggcaagaaattcaagctggggaaagacataaagagtatactgcaggagatggagcgggtgctacatgtcggcggaactattgtgctgctcctgtccgaagaccaccacaggaggctgacagattgcaaagaaagtaatattcctttcaacagcaaggattcccatactgatgagcccgggatcaagaagtgccttaacccagaagagaaaaccggggcgttcaagactgcgagcaccagctttgaagcctctaaccacaagtttcttgatcgaatgtcaccctttggatccctagtgcccgtagagtgttacaaagtgtccttgggaaaaaccgatgcttttatctgcaagtacaagaagagccactcatccggcctgtag

SEQ ID NO: 137819 - DNA, 486 bp, Artificial Sequence
  Description of Artificial Sequence: Synthetic coding sequence
atgaatctagccatttctatcgcacttttgctgaccgtccttcaagtgtcgagagggcagaaagttaccagcttgaccgcttgtctcgttgatcaaagtctgcgcctggactgccgacatgagaatacaagctcaagcccgatccaatacgagttttcactgactcgcgaaacaaaaaagcatgtgctctttgggactgtgggcgtgcccgaacacacgtacaggtctcgaacaaatttcacctctaagtataacatgaaggttctttaccttagtgcatttacatcgaaggatgagggaacatacacctgcgctttgcaccactccggccacagcccacctatcagctcccagaacgtgacagttctgagagacaagctggtcaagtgtgagggcatttctctgctggcccagaatacgagctggctattgcttctgcttttgtctctgtccttgctgcaggctacagacttcatgtctttatag

SEQ ID NO: 137820 - DNA, 486 bp, Artificial Sequence
  Description of Artificial Sequence: Synthetic coding sequence
atgaacctcgccatttcaattgccttgctactgactgttttacaagtgtcgagagggcagaaggtcacctcccttaccgcatgcctcgtggaccagtcactccggttagattgccgccatgagaacacatccagctcaccaattcagtatgaatttagcctcactcgagaaactaagaagcatgtcctgttcgggacagtcggcgtccccgaacacacctacagatcccgcaccaattttacctctaaatacaacatgaaagtgctgtatttgtccgccttcacaagtaaggacgagggcacctacacatgcgccctgcatcactctgggcattctccccccattagcagtcagaacgtcaccgtactcagggacaaactcgtgaagtgcgaaggcatcagcctcctggcccagaacaccagctggctccttctcttacttctgagcctctctctgcttcaggctacggatttcatgtctctttag

SEQ ID NO: 137821 - DNA, 480 bp, Artificial Sequence
  Description of Artificial Sequence: Synthetic coding sequence
atgttcccttttgcgttgctttatgttctttcagtgtcgttccgcaaaatatttattctacagttagtgggactggtgctgacctatgattttactaattgcgattttgagaaaattaaagccgcctacctaagtacgatttccaaagacctgataacttatatgtccggcacaaagtccactgaatttaataacactgtcagttgctccaaccggcctcactgtttaacagaaatccagagtttaacgtttaaccctactgccggatgtgcgtctctggccaaggaaatgttcgcgatgaagaccaaagccgcactcgctatatggtgccctggatactccgagacgcaaatcaatgcaacacaggccatgaaaaagcgacgcaagaggaaagtgactaccaacaaatgcctcgagcaggtgagccagcttcagggcctgtggcgccggtttaatcggcccctactgaagcaacagtag

SEQ ID NO: 137822 - DNA, 192 bp, Artificial Sequence
  Description of Artificial Sequence: Synthetic coding sequence
atgttcgccatgaagactaaagctgctttagcaatatggtgtcctggatacagcgagactcagatcaatgctacccaggccatgaagaaacgcaggaaacgcaaggttacaaccaacaagtgcctggagcaggtgagccagctgcaggggctctggaggcgtttcaacagaccgttgctcaaacagcaatag

SEQ ID NO: 137823 - DNA, 705 bp, Artificial Sequence
  Description of Artificial Sequence: Synthetic coding sequence
atgtcctgtattaacctgcccaccgttttgccggggtcgccaagcaaaactagagggcagatccaggtgattcttggacccatgttttccggaaagtctaccgaattaatgaggcgcgttcgacgattccaaattgctcagtacaagtgcctagtcataaaatacgccaaagatacaagatactctagttccttctgcactcatgatcgtaacacaatggaggcgttaccggcttgtctcctgagagatgttgctcaggaggctctcggcgtggctgttattgggattgatgaggggcaattcttccccgatatcgtagaattctgcgaagctatggccaatgccggcaagactgtgatcgtggctgcgcttgacgggaccttccagcggaagccgttcggcgcaatcttgaacctggtccctctagcagagtcagtggtgaagttaaccgcagtgtgcatggagtgcttccgtgaggcagcctacacgaaacgtctgggaactgagaaggaagtggaggtcatcgggggtgccgacaagtatcattcggtttgcagactgtgctatttcaagaaggcatccggtcaaccagccggccccgacaataaggagaattgccccgtgcccggaaagcccggggaggctgtcgcagcaagaaagctattcgccccccagcaaattcttcagtgttctccagctaactag

SEQ ID NO: 137824 - DNA, 705 bp, Artificial Sequence
  Description of Artificial Sequence: Synthetic coding sequence
atgtcgtgcattaacctgccaactgtgctgcctggctcgccctcaaaaacgagagggcagatacaggtgatcctcggtccgatgttttccggcaagtctacggagctgatgcgcagagtccgtcgcttccaaatcgctcaatacaagtgcctggtcatcaaatatgccaaagacacgagatattccagttccttttgtacccacgacagaaacactatggaagccctgccagcctgcctcttgcgggatgtggcgcaggaagccttaggtgttgccgtgattggaattgatgaggggcagttcttccctgacatagtggagttttgcgaagcaatggccaatgccggcaagaccgtgattgtcgcagctctggatgggacatttcagcgcaagccctttggggccattttaaacctcgtgcctctggcagagtccgttgtgaagctaacagccgtctgcatggagtgttttcgcgaggctgcttatacaaagagactaggcacagagaaggaagtcgaagtgattgggggggccgataagtatcatagcgtgtgtagactgtgttactttaagaaggctagcggacaacccgctggccctgacaataaggagaattgccccgtcccaggcaaaccaggggaggcggtggccgcacgtaaactgtttgccccgcagcagatcctccagtgcagtccagccaactag

SEQ ID NO: 137825 - DNA, 924 bp, Artificial Sequence
  Description of Artificial Sequence: Synthetic coding sequence
atgagacccggactttttaagggccaagctcctggctcccggcgccgcccaactgcaggccttgccgtggttcgggcagatagtcacaagaaggaaccgcgagctagcgggtcagcccggcccgccatgctgttgtggccgctgcgtgggtgggctgcccgggctctgcgatgctttggccccggatctcgcggcagcccagcatctggccccggccctcgccgggtgcagcggcgtgcctggcctcctgacaaagagcaggagaaagaaaaaaaaagcgttatctgcgtggagggaaacatagcctctggtaaaaccacttgtctggagttcttctccaacgctactgacgttgaagtgctgacagagcccgtgagcaaatggcggaatgtgagggggcacaatccattgggtctgatgtatcacgatgcaagtagatggggactgactctccagacatatgtgcagcttaccatgctggacagacatactaggccccaggtgtcttccgtgcggcttatggagaggtccatccatagcgctagatacatctttgttgaaaatttgtaccgatccgggaagatgcctgaggtggactacgtggtactcagtgagtggttcgattggatactccgaaacatggacgtttccgttgatttaatagtttacctgcgcaccaacccagagacctgttatcaaaggctgaaaaagcggtgccgcgaagaagagaaggtgatccccctggaatacctagaggctattcatcatctccatgaagaatggttaatcaagggctccctgtttcccatggccgccccggtgctcgtgattgaagcagaccatcacatggagcgtatgctggagttgttcgagcagaaccgcgatcgtatcctcacacccgaaaaccgcaagcattgtccatag

SEQ ID NO: 137826 - DNA, 744 bp, Artificial Sequence
  Description of Artificial Sequence: Synthetic coding sequence
atgttgctatggcctctccgcggctgggcggctcgagcactgaggtgctttggccctggttcccgaggcagtcctgccagtggacccgggcctcggcgagtgcagagacgggcctggccccctgacaaagaacaggagaaggaaaagaagtccgtcatttgcgtggagggcaatattgcctccggaaaaacgacttgtctcgaattcttctcaaatgccaccgatgttgagggactgatgtatcatgatgctagtagatggggattgaccctacagacctatgtgcagttaacaatgttagacaggcacactcgaccccaggtcagcagtgtgcgcttgatggaacgctcgattcactcggccaggtacatctttgtagagaacctctaccgcagtgggaagatgccagaagttgattacgtggtcctcagcgagtggttcgactggattctgcgcaacatggacgttagtgtggatctcatcgtgtatctaaggacgaaccccgagacctgttaccagcgcctgaagaagcgctgtcgcgaagaggaaaaggttataccgctggagtacctggaagccattcatcatctgcacgaagagtggctcattaaaggatctctgtttccaatggctgcccctgtcctggtcatcgaagccgatcaccacatggagagaatgctcgagctttttgaacagaacagggatcggatactgacgcccgagaacaggaaacactgtccatag

SEQ ID NO: 137827 - DNA, 798 bp, Artificial Sequence
  Description of Artificial Sequence: Synthetic coding sequence
atgttactttggcccttacgtggttgggctgcgcgggctttgagatgcttcggacccggcagtcgcggcagccctgcatcagggccgggccccaggagggtccagagaagggcatggccccctgacaaggagcaggaaaaggaaaaaaaaagcgtgatttgcgtcgagggcaatatcgccagtggcaaaaccacgtgcctggaatttttttccaatgcgacagatgtggaggtgttgacagaacctgtgtctaagtggaggaacgtccgggggcacaatccccttggcctcatgtaccacgacgcatcacggtggggcctcacactgcaaacttacgtgcagctgaccatgctggacaggcacacacgaccacaggtgtctagcgttcggttgatggagcgcagtattcacagcgcccgctatatctttgtggagaatctgtacagaagtggtaaaatgcccgaagtcgattacgttgtcctaagcgagtggttcgactggatattgaggaacatggatgtctctgtcgacttgatcgtctatttgcggaccaatccagagacatgttaccagcgcttaaagaaacgatgcagggaagaggagaaggtgattccactggaatatttagaggctattcatcaccttcacgaggaatggctaattaaaggaagcttgtttcccatggccgcccccgtcttggtcattgaggccgatcaccacatggagagaatgctggagcttttcgaacagaacagggatcgtattctgacgccagagaacagaaagcactgtccctag

SEQ ID NO: 137828 - DNA, 507 bp, Artificial Sequence
  Description of Artificial Sequence: Synthetic coding sequence
atgtatcacgacgcaagtcgttggggccttaccttgcagacctatgtgcagctcacaatgctggacagacacacccgcccacaagtcagcagcgtgcggttaatggagaggtccatccattctgctcgatatatcttcgtcgaaaatctgtatcgcagtggtaagatgccggaagtggactacgttgtattgtctgagtggttcgactggattctgcgaaacatggatgttagcgttgatttgatagtgtacctgcgtacaaaccctgagacctgctaccagcggctgaagaagcggtgccgcgaggaagaaaaagtaatccctttggagtacttagaggcaatccaccatctccatgaggagtggcttattaagggttccctctttcccatggcggccccggttctggttatcgaagccgaccatcatatggaacgtatgctagagctatttgaacaaaatcgagataggatccttactcccgaaaaccggaaacattgtccttag

SEQ ID NO: 137829 - DNA, 705 bp, Artificial Sequence
  Description of Artificial Sequence: Synthetic coding sequence
atgggcgctttttgccagcggccatccagcgataaggagcaggagaaggaaaagaagagcgtgatttgtgttgagggcaacatagcctcgggtaagacgacgtgtctagagttcttcagcaacgctaccgatgttgaggttctcactgaaccagtgagtaaatggcggaacgttcgggggcacaaccccctcgggttaatgtaccacgacgcatcaaggtggggattgacgttacagacttacgtccaattaacaatgttagaccgccatactcggccccaggtgagttccgtcaggctgatggagagatccattcattcggcacgttacatattcgtggagaacctgtataggtccggaaagatgccagaagttgactatgtagttttgtccgaatggtttgactggattctccgaaatatggatgttagtgtcgacctgatagtctacctacggacaaatccggaaacgtgctatcagcgcctgaaaaagcgatgcagagaagaggagaaggtgatcccattagaatacctcgaggcaattcatcacctccatgaggagtggctgattaaagggagcttgtttcccatggctgctccagtgcttgtcatcgaagcggatcatcacatggagaggatgttggagctctttgaacaaaatcgggacaggattctgactcctgaaaaccgtaagcattgtccctag

SEQ ID NO: 137830 - DNA, 507 bp, Artificial Sequence
  Description of Artificial Sequence: Synthetic coding sequence
atgtaccacgacgcttcccggtgggggcttaccctgcagacatatgtccagttaactatgcttgacagacacactcgaccgcaggtctcttccgtgagacttatggagaggtcaattcattccgccaggtacattttcgtggagaacctgtatcgcagcggcaagatgccagaggttgattacgtcgtactttcagagtggttcgattggatcttacgaaacatggatgtgtctgttgacctaatcgtttacctaagaaccaatccggaaacttgctatcaaagactgaagaagagatgtagagaagaagaaaaagtcatccccctcgaatacctcgaagcaattcatcatctccatgaagaatggctcatcaagggaagcttattccccatggctgcccccgttctggtaattgaagctgaccatcacatggaacgcatgctggaactgttcgaacaaaaccgtgacaggattttgacacccgagaaccggaagcactgtccatag

SEQ ID NO: 137831 - DNA, 651 bp, Artificial Sequence
  Description of Artificial Sequence: Synthetic coding sequence
atgacatctatttgtgtagaaggcaatattgcttctggcaagaccacttgcctcgaatttttttcaaatgccactgatgtggaagttttaaccgaacctgtgtccaaatggagaaatgttcgggggcacaacccactgggcctcatgtatcacgacgcctcaagatgggggctgactcttcagacttacgtccagctaaccatgttggatagacatactaggcctcaggtctcctctgttcgtctgatggaaagatccatacactccgctcgatacatctttgtggagaatctttacagatctgggaagatgcctgaggttgattatgtcgtgctgagcgagtggttcgattggattcttcggaatatggacgtctccgtcgacctgattgtctacttacgcaccaaccctgaaacctgctatcagcgcctcaagaaacgctgtcgcgaagaggagaaggtcattcctctggagtacctagaggccatccaccatttacacgaggaatggctgatcaaaggctcattgtttccaatggccgctccggtgcttgtcatcgaagcagatcatcatatggagagaatgctggaactgttcgaacagaaccgagacaggatcctgacaccggaaaatcgaaaacactgcccctag

SEQ ID NO: 137832 - DNA, 723 bp, Artificial Sequence
  Description of Artificial Sequence: Synthetic coding sequence
atgctgctgtggcccctccgaggttgggccgccagagcacttcggtgttttggtcctggatcacgaggctctccggcctccggccccgggcccagaagagtgcagaggcgcgcctggcccccagataaggaacaggagaaggaaaaaaagtccgtggttctcaccgaaccagtctcaaagtggaggaatgtgcgggggcacaatccacttggactgatgtaccacgacgcttcacgctggggtctgacgctccagacttatgttcagttgacaatgctagacagacatacccgccctcaggtaagcagcgtgagacttatggagcgtagtatccatagtgctaggtacatatttgtcgagaacctttaccgcagcggcaaaatgccagaggtggactatgtggtgctctccgaatggttcgattggatactgcggaacatggacgtttctgttgatttaatagtttatttgagaacaaatccagagacatgctatcagcggctgaagaagcggtgtagagaagaggaaaaagttatacccctcgagtacctggaagccatccatcaccttcatgaggaatggctgataaaaggtagcctgttccccatggcagcgcctgtgctcgttatcgaggcagatcatcatatggagaggatgttggaactcttcgagcagaaccgagatcgcatcctaacccctgagaataggaaacattgtccgtag

SEQ ID NO: 137833 - DNA, 840 bp, Artificial Sequence
  Description of Artificial Sequence: Synthetic coding sequence
atgcccgttgcgggatcagaactccctcgacgccccctacctcccgctgctcaggagcgcgacgccgagccgagaccaccccacggcgagctgcagtatctgggacaaatacagcacatccttaggtgcggcgtgcgaaaagacgatcggacagggacgggtaccctgagcgtattcggtatgcaggcccgttattccctccgggacgaatttcctctcttgaccacaaagagagtattttggaaaggggtgctcgaggagctgttatggttcatcaagggttccactaatgcaaaagaactgtcttctaagggcgtgaaaatatgggacgccaacgggtcaagggattttttagacagccttggcttcagcacgagagaagaaggagacctggggcccgtgtatggattccagtggcggcattttggagctgagtacagggatatggaatctgatcttcctctcatggccctgccaccctgccacgccctgtgtcagttttacgttgttaactccgaactgagctgccagctgtatcagagaagcggcgatatggggttaggcgtgccattcaacatcgcaagctacgcccttttgacatatatgatcgcgcacatcacaggcctgaagcccggggactttatccataccttgggcgatgcgcatatctacctgaatcacatagagccactcaagatccagctccagcgcgagccgcggccttttccaaagttgcgaatcctgcgaaaggttgaaaaaattgatgactttaaggcagaagatttccagatagagggctacaacccgcatcccacaatcaaaatggagatggcagtctag

SEQ ID NO: 137834 - DNA, 693 bp, Artificial Sequence
  Description of Artificial Sequence: Synthetic coding sequence
atgccagtggccggctcggaactgccaaggcggccgctgccccctgctgctcaggagcgggatgccgaaccaaggcctccgcacggggagctccaataccttggacagattcagcatattctacgctgtggcgtgcgaaaggatgatcgcaccggcacgggtaccctctctgtgtttggaatgcaggcaagatactccctccgcgattacagtggacaaggcgtagaccagctgcagagggtgatcgataccatcaagacaaaccccgatgatcgcaggattatcatgtgcgcatggaacccaagagacctaccactaatggcacttccaccttgtcacgccctctgccagttttacgtggtgaacagtgaactcagttgccagctttatcagcgctcaggagatatgggtttgggagtgccattcaatatagcaagttatgcacttctcacctatatgatcgcccacataactggcctcaagcctggagacttcatacacacgttgggagatgcccacatatatctgaaccacatagagccactgaagatccagctgcagcgggagccacggccctttcctaagctcaggattctacggaaagtggaaaagatcgacgattttaaagccgaagatttccagattgaagggtacaatccccatccaaccattaagatggagatggccgtgtag

SEQ ID NO: 137835 - DNA, 942 bp, Artificial Sequence
  Description of Artificial Sequence: Synthetic coding sequence
atgcctgtggctggatccgaacttcccagacggccacttccccccgctgctcaggaacgcgacgctgagccgcgcccaccgcatggagaactccagtaccttggtcaaatccagcatattctaagatgcggagtgagaaaggatgaccgcaccggcacaggtacgctgtcagtgttcgggatgcaggctagatattccctgagggatgagtttcctctcctcactaccaaaagagtattctggaagggagtgctggaggagctgctatggtttatcaagggatctaccaatgccaaagaacttagttcaaagggggtgaagatctgggacgccaacgggtccagagacttcttagactccttgggcttctctactcgggaggaaggtgatctcggtcccgtttacggtttccagtggcggcacttcggcgctgaataccgggacatggagtcggactactccggccagggtgtagaccagctgcaacgcgtaatcgacaccatcaagacgaaccccgacgacaggcgcataattatgtgcgcgtggaatcccagggatctgccactgatggctctgcctccctgtcacgctttatgccaattttacgtggtgaattctgagctgagctgccagctttaccaacgttctggtgatatggggctgggagttccatttaacatcgccagttatgcactgctgacatatatgatagcccatatcactggactcaagcccggagacttcatacatacactcggcgatgcgcatatttatttaaaccatattgagcccctgaagatccagctgcaacgggaaccacgcccattcccaaaactgcggatcctgcggaaggtggaaaaaatcgatgatttcaaagctgaagactttcaaatagaaggatacaatcctcatcccacaatcaaaatggagatggccgtgtag

SEQ ID NO: 137836 - DNA, 678 bp, Artificial Sequence
  Description of Artificial Sequence: Synthetic coding sequence
atgagtcgacctagaaagagactcgctggtacttctggaagcgacaagggactgtcagggaagcgcacgaaaaccgagaactccggggaggctctagctaaggtggaagatagtaacccgcagaagacatccgctacaaaaaattgtctgaaaaacctgtcgagtcactggttaatgaagagcgaaccagagtctcggctggagaagggggtagacgtgaagtttagcatcgaggacttaaaggcacaaccaaagcagactacttgctgggacggtgtgcggaactaccaggcacgcaattttctgagggcaatgaagctgggagaggaagctttcttctatcactcaaattgcaaggagcccgggatcgcaggcctgatgaagattgtgaaggaagcgtacccagaccatacacaatttgaaaaaaacaaccctcattacgatccctcatctaaagaggacaatccaaagtggagcatggtcgatgtccagtttgtacgtatgatgaagcggtttataccgctggcagagctcaaatcctatcaccaggcacacaaggcaacgggcggacctctgaagaatatggtcctgttcacaaggcagcgccttagtatccaaccactgactcaggaggagtttgacttcgtcctttcactggaagagaaggagcctagttag

SEQ ID NO: 137837 - DNA, 501 bp, Artificial Sequence
  Description of Artificial Sequence: Synthetic coding sequence
atgtcacggccgcgcaagagactcgccgggacgtccggatctgacaaaggactttccgggaagcgcaccaagacagaaaattctggggaagccctggccaaagtggaggattctaatcctcagaagaccagtgcaacaaagaattgtctgaaaaacttgtctagccattggctcatgaagagcgaacctgagagtcgcctcgaaaagggcgttgacgtaaagtttagtatcgaggatctgaaagctcagcccaaacagactacttgctgggacggggtgagaaactatcaggcgaggaactttttacgagccatgaagttgggcgaggaggcctttttttaccattccaattgcaaagaacccggtattgccgggcttatgaagatagtgaaagaagcatatcctgaccatacacagttcgaaaagaacaatccacattacgacccatcttcgaaggaggataatccgaaatggagcatgaagagcctcatactcttttag

SEQ ID NO: 137838 - DNA, 678 bp, Artificial Sequence
  Description of Artificial Sequence: Synthetic coding sequence
atgagccggcctagaaagagactggcgggcactagcggctccgacaaaggtctgtcagggaaacgcacaaagacggaaaattctggtgaggcattggccaaggtcgaggacagcaatccgcagaagacatccgccacaaaaaactgtctgaagaatttgagttctcattggcttatgaagtctgaacctgagtctagactggagaagggcgttgacgttaaatttagcatcgaagacctgaaggcccagcccaagcagacaacttgttgggacggtgtccgcaactatcaggcacgcaactttctgagggcaatgaaactcggggaagaggctttcttctatcacagcaactgcaaagagcctggaatcgcaggcctcatgaagattgtcaaggaggcttatcctgaccacacccaattcgaaaaaaataatccgcattacgatccttcaagcaaggaggacaatccgaagtggtctatggtcgacgtgcagtttgttagaatgatgaaaaggtttatccccctggccgagcttaaatcttatcatcaagcacacaaggccaccggcggccccctcaaaaacatggttctgttcacacgacagagactgtctattcagcccctgacacaggaggaattcgattttgtgctgtcccttgaagagaaagaaccttcttag

SEQ ID NO: 137839 - DNA, 678 bp, Artificial Sequence
  Description of Artificial Sequence: Synthetic coding sequence
atgagcagaccacgaaaaagactcgcaggtacttctgggtccgacaaaggattgtcaggaaagcggactaagacagagaactctggagaagctttagccaaggtggaggactcaaacccccagaaaacatccgccacgaaaaattgtctgaaaaacctgtcctctcattggctgatgaagagcgaaccagaatcccggctcgagaaaggagttgatgtgaagtttagcatcgaagacctcaaggcgcagccaaaacagaccacgtgttgggatggggtccgcaattatcaggcccggaacttcctgagagcaatgaagctcggagaggaggcatttttttatcactcaaattgtaaggagccagggattgccggtttaatgaagatcgtgaaagaggcatatcctgaccacacccagttcgaaaaaaacaatccacattacgatccatctagtaaggaagataatcccaaatggtctatggtggacgttcaatttgtccgcatgatgaagcgatttattccattagcagagctgaaaagttaccatcaggcccataaggctacgggcgggcctttgaagaacatggttctgtttaccaggcagaggctcagcatccagccactgacccaggaggaatttgatttcgtactatcacttgaggagaaggaaccttcatag

SEQ ID NO: 137840 - DNA, 1926 bp, Artificial Sequence
  Description of Artificial Sequence: Synthetic coding sequence
atggccctaagcctggaagagttcgtgcactctcttgatttgcgtactctgccacgcgtgttagagattcaagcaggcatctacctcgaaggatccatttatgaaatgttcgggaacgaatgctgcttttcaaccggggaagtcattaaaatcactggactgaaagttaagaaaattattgccgaaatctgtgaacagatagaaggttgtgaatctttgcagccgtttgaactgccaatgaactttcctggactgtttaaaatcgtggcggataaaaccccttacctgactatggaagaaattacgaggaccattcacattggcccatccaggctcgggcatccgtgcttttaccatcagaaagatatcaagcttgagaaccttatcattaaacagggagagcagatcatgcttaacagcgtggaggaaattgatggggagatcatggtatcttgtgcggtggccaggaaccaccagacacacagttttaacctgccactatcccaggaaggcgaattctacgagtgcgaagatgaaaggatttatacactcaaggagattgtagagtggaaaattcctaagaacagaacaagaaccgtgaaccttacagatttcagtaataagtgggattctactaacccgttcccaaaggacttttacggcacactgatcctaaagcctgtatatgagattcagggcgtcatgaaattcaggaaagacattatcagaatcttaccatccctggatgtcgaggttaaggacattacagacagctacgatgctaactggttcctccagctgctgtccacggaagacctcttcgagatgacctcaaaggaatttcctatcgtgaccgaggtgatcgaggccccagaaggaaaccatctacctcaatctatcctccaacccggtaagaccatcgttattcacaagaagtatcaagcttctagaattctggccagcgaaattagaagcaactttcccaagagacacttcttaattccaacatcctataaaggcaagtttaagcgcaggccccgggaattccctaccgcttatgaccttgaaatcgctaaatccgagaaagagccacttcacgtagtggcaaccaaagcctttcacagccctcacgataaactatcaagtgtttccgtgggagatcagttcctggtccaccagtcagagactactgaggtcctttgcgagggcatcaaaaaagtggtcaacgtactggcttgcgagaaaatactcaaaaagtcatatgaggcagcactcctgcccctgtacatggaaggtgggttcgttgaggtgatccatgacaagaagcagtatcctatttcagaactgtgcaagcaatttcgcctacctttcaacgtgaaagtctcggtacgtgatctgagtatcgaggaggacgtgctggccgctactcctgggctgcagctggaggaagatatcaccgactcctacctgctgatctcagactttgccaacccaactgagtgttgggagattccagtaggcagacttaacatgacggttcagctagtatccaatttcagtagagatgcagaaccatttttagtcaggacactcgtcgaggagatcacagaagagcagtactatatgatgagaaggtatgagagcagcgcctcacacccgccccccagaccaccaaaacatccctccgttgaagaaaccaagctgacgcttctgactttggcagaggagagaacggtcgacctacctaagtcccccaaaagacatcacgtggacatcaccaaaaagctgcatcccaatcaggctggactcgatagcaaagtgcttataggctcccagaacgatctggtcgatgaggaaaaagagcggtccaacagaggagccaccgctatcgctgagacattcaagaatgaaaagcatcagaagtag

SEQ ID NO: 137841 - DNA, 1689 bp, Artificial Sequence
  Description of Artificial Sequence: Synthetic coding sequence
atgaacttcccaggtctgttcaaaatcgtggctgataagacaccttacctcacaatggaagaaataactaggacaattcatatcggaccatctcgtctgggccacccctgtttctaccatcagaaagacatcaagctggagaatttgatcatcaaacaaggcgagcagatcatgcttaactctgtcgaggaaatagacggtgaaatcatggtttcctgtgctgtcgcccggaaccatcagacgcattccttcaatctgcccctgagtcaggagggggaattttatgagtgtgaggatgaaaggatatatactctgaaagagatagttgaatggaagatcccaaagaaccggacgagaacagtaaacctgaccgacttcagtaacaagtgggacagcaccaacccatttcctaaagatttttatggaacactgatacttaaacctgtttatgagatacagggggtcatgaagtttaggaaagacatcattcgcattttacctagtttggacgttgaggtcaaagacataactgattcctatgatgcaaactggttcctccagcttctctcaaccgaggatctgttcgagatgacatctaaagaatttcctatagtgaccgaggtgattgaagcgccagaaggaaaccatctgcctcagtccattctccagcccggaaaaacaatcgtgatccataagaaatatcaggctagcagaattctcgcttccgagatccgcagcaactttccgaaacgacactttctaatcccaacttcttacaaaggtaagttcaagcgacggccacgagagtttccaactgcgtacgatcttgaaatcgctaaaagtgaaaaagaacctctgcatgtcgtcgctaccaaagcctttcactctccccatgacaagctctcaagtgtgtccgtcggggaccaatttctggtccatcagtcagaaaccacggaggtgctgtgcgaaggtattaagaaagtcgttaacgtgttagcgtgtgagaagattcttaaaaagtcttatgaagcggctctgctccctttgtacatggaaggtggattcgtcgaggtgattcacgataaaaagcagtaccccatcagtgagctgtgtaaacagtttcgcctcccatttaatgtcaaggtgtccgtgagagacctatcgattgaagaggacgtcctcgccgctacccctggcctacaactcgaggaagacataaccgattcgtatcttcttatttccgattttgccaacccgaccgagtgctgggagatcccggtgggaagactgaacatgaccgtgcagctggtaagcaatttcagtcgagatgcagagccttttctagtgcgcacgttggttgaggagatcacggaggagcagtattacatgatgaggcgatacgaaagctccgccagccaccctccacctagacccccgaagcatccaagcgtcgaggagaccaagcttacattacttactctggccgaagagcggacagtcgacttgccaaagagcccaaagcgacaccacgtggacatcaccaaaaaattgcatcctaaccaggccggcctggactcgaaagtccttataggctctcagaacgacctcgttgatgaggagaaagaaagaagtaaccggggagcaactgccatcgcggaaaccttcaagaatgaaaagcatcagaagtag

SEQ ID NO: 137842 - DNA, 372 bp, Artificial Sequence
  Description of Artificial Sequence: Synthetic coding sequence
atgaactttcctgtgcgaaaagatattatacgcatcctgccctctttagatgtggaagttaaggatatcactgattcgtatgacgctaactggtttctgcagctgttatccacagaagatctcttcgaaatgacaagcaaggagttccctattgtcacagaagtgattgaagccccggagggcaaccacctgcctcagtccattctccagcccggaaaaaccatagttattcacaaaaaatatcaggcctcccgaattctggcttccgaaattcggagtaatttccccaagagacactttctgataccaacctcgtacaaagggaaatttaaacggagacctagagagttcccaactgcttatgatttgtag

SEQ ID NO: 137843 - DNA, 1821 bp, Artificial Sequence
  Description of Artificial Sequence: Synthetic coding sequence
atgttcggcaatgagtgctgtttcagtactggcgaggtaatcaaaataactgggctcaaggtgaaaaagattatcgcagagatttgtgaacagatcgaggggtgcgagtcactacagcccttcgagctccctatgaactttcctggcttatttaagattgtcgccgataagaccccctatctgacgatggaagaaattacacggacaatccatattggcccctcacggttggggcacccctgtttttatcatcagaaggacatcaaattggagaacttgattattaagcagggtgaacaaatcatgttgaatagtgtcgaggagatagatggtgagatcatggttagttgcgccgttgcacggaaccatcagacccactcttttaatctccccttatcccaggagggcgaattctatgaatgtgaagacgaacggatctatactctgaaagagatcgtcgagtggaaaatccccaaaaatcgcacacggactgtgaatttgaccgacttttctaataagtgggactccaccaatccatttccaaaggacttttacggaacactgatccttaaaccggtgtacgagatccaaggtgtgatgaagttccggaaagatatcattcggatcttgcccagtctggatgtggaggtgaaggatattaccgactcatacgatgctaattggtttttgcaactcctgtccacggaggacctgttcgagatgacctctaaagagtttcctatagttacagaagtaatagaggctcccgaaggcaaccacctgccccagtcgatcttgcagcctggaaaaactattgtaatccacaagaaatatcaggcctcacggattctggctagtgagatccgatccaatttcccaaaacggcactttctgatccctacatcttataaaggaaaattcaaacgccgccccagagaattccctaccgcctacgaccttgaaatagcaaagtccgagaaagaacctcttcacgtagttgccaccaaggcttttcacagcccacacgacaaattgagttccgtgtctgtgggcgaccagttcttagttcaccaatcagagactacagaagttctctgtgaggggataaaaaaggtcgtgaacgtgttggcctgtgagaaaatcctgaaaaagagctatgaggcagctctgctgcctctctatatggaggggggatttgtcgaagttattcacgacaaaaagcaataccctatatccgaactgtgtaaacagttccggctaccttttaacgttaaagtttcggtccgagacttgagcattgaggaggatgtgctggctgcgacccccggactccagctggaagaagatattacggattcctacctccttatctcagatttcgcgaatccgactgagtgctgggagatccccgtggggcgcctgaatatgactgtgcagctggtatctaacttttcgcgggatgcggagcctttcctggtgaggaccctggttgaagagatcacagaggagcaatattacatgatgagacgatatgagtcttcagcttcccatcctcctcctcgccctccaaaacacccttccgtggaagaaacgaagctcaccctcctcaccctcgccgaggaacgtacagtggacctgcccaagagccctaaacggcatcatgttgacattacaaaaaaacttcatccaaaccaggcgggcctggattccaaagtcttaattgggagccaaaatgacctggtcgatgaggaaaaagagcgaagcaacaggggagccactgcgattgctgaaacatttaagaatgagaagcatcagaagtag

SEQ ID NO: 137844 - DNA, 2043 bp, Artificial Sequence
  Description of Artificial Sequence: Synthetic coding sequence
atggccctatctctggaagaatttgttcactcactcgacctccgaaccctcccacgcgtgctggaaattcaggcagggatctacctcgagggatccatctacgaaatgttcggaaacgaatgctgctttagtacgggcgaagttatcaaaatcacggggctcaaggtgaaaaagattattgccgaaatctgcgaacaaatagaggggtgcgaatcactacagccctttgagctgccgatgaacttcccaggcctgttcaaaatcgtggccgacaagaccccttatttgaccatggaagaaattacccgcaccattcacataggtccatctagattgggtcatccctgcttttaccaccagaaggacataaaactggaaaacttaatcattaaacagggtgaacagattatgttgaatagtgttgaggagattgatggcgaaatcatggtgtcctgcgcggtggctaggaaccaccagacccactcctttaatctccctctgtctcaggagggagaattctacgaatgtgaagacgagaggatctacaccctcaaagagattgtcgaatggaaaatccccaagaacaggaccaggacagtcaatttaaccgacttttcaaacaaatgggactccaccaaccccttccccaaggatttctacggcacactgatcttgaagccagtctacgagatccaaggagtgatgaaattccgaaaagacataatacgcatcctaccatccctggacgtcgaagtcaaggatattacagacagttacgatgccaattggtttctgcagctgctctctactgaagacctgtttgaaatgaccagcaaggagtttcccatcgtgacggaggtgattgaagcacctgagggtaatcacctgccacagtctatcttacagcccggaaagacgatcgtaatccataagaagtatcaggcaagccggatcctggcctctgagatccgctctaacttccccaagcgccattttctcattcctacatcatataagggaaaattcaagcgacgcccaagagaatttcccactgcttacgatctcgaaatcgcgaagagcgagaaggaaccgctccatgtagtggctaccaaagctttccatagcccacacgacaaactgagctctgtcagcgtaggcgaccagttccttgtccatcagagtgagactactgaagtcctctgcgaggggattaagaaggtggtgaatgtgctagcctgtgaaaaaatattaaagaagtcgtatgaagccgctctcctccctctgtacatggaggggggcttcgtggaagtgattcacgataagaaacagtatcccatcagcgagctgtgtaaacaatttcgtctacccttcaacgtgaaagtgtcggtgcgcgaccttagcattgaagaggacgtattagccgcgacccctgggttacaactggaagaagacattaccgacagttatctgctgatctccgacttcgcaaatccgaccgaatgttgggaaatcccggtaggcagactgaacatgaccgtacagttggtgtcgaatttcagcagggatgcagagccgttccttgttagaacgctagttgaggaaattaccgaagagcagtattatatgatgcgacggtatgagagcagcgctagtcatccccctccgaggcctcccaagcatccatcagtcgaggaaactaagctgacacttctcactctcgcagaagagcgcactgtggatctgcctaaaagccccaaagctggcgtccagtggagggatttgggctcactccaacccctgccccctgggtttaaacagtttagcgcttctgcttcacacgtggcggggatcaccgggacacctcatcatgtgcagcggcatcatgtggacatcacaaaaaaactgcaccccaaccaagctggtctggactcaaaagttctgatagggagccagaacgacttggtggacgaagagaaggaacgcagcaatagaggcgctaccgcaatcgcggaaaccttcaaaaatgagaagcatcagaagtag

SEQ ID NO: 137845 - DNA, 1581 bp, Artificial Sequence
  Description of Artificial Sequence: Synthetic coding sequence
atggacgttcgattttacccgccacctgctcagccagccgctgcacctgacgccccgtgtctcggccccagcccttgtctggacccttactactgcaacaagttcgacggcgaaaacatgtatatgtcgatgactgagccctcccaggactatgtcccagcaagtcagagctaccccggtccttctttggaatcagaggacttcaatatccctcctataacgcctccctctctccccgatcatagtttggtgcacctgaacgaagtggagtctgggtaccatagtctgtgtcatccaatgaaccataacgggctgttgcccttccatcctcagaatatggatctacccgaaataactgtgtcaaacatgctcggtcaggacgggaccctgctctccaacagtatcagcgtgatgcctgatattaggaacccagaagggacacagtatagtagccacccacagatggccgctatgcgcccccggggccagcctgcagatatccgccagcagcccggaatgatgccgcacggccagctgactactatcaatcaatcgcagctgtccgcacagttaggcctgaacatggggggctcaaacgtgcctcacaattcaccatctcctccaggttctaagtccgccacccccagcccttcctctagtgtccatgaagacgaaggtgacgacacgagcaaaattaacgggggggagaagcgaccagccagtgatatgggcaaaaaacctaagacccctaagaaaaaaaaaaaaaaggaccctaacgagcctcagaagccagtgtccgcctatgcactcttctttcgagacactcaagcggctattaagggacagaaccctaatgcaaccttcggagaagtttccaaaatcgtggccagcatgtgggacggactcggtgaagagcaaaaacaggtctataagaagaaaacggaagctgccaagaaggagtacttgaagcaacttgccgcctatcgcgcctccttggtctcaaagagctattcagagccagtggacgtcaagacatcccagccacctcagctcatcaattccaaaccctctgtgtttcacggaccatctcaagcccattcagcactgtacctatccagtcactatcaccaacagcctggcatgaatcctcacctgaccgccatgcacccaagcttacctaggaacatcgcgcccaaacctaataaccagatgccagtcacagtctccatcgccaacatggccgtgtctccccctccaccgcttcaaatcagccccccactacaccagcacctgaatatgcaacagcaccagcccctcaccatgcaacaaccattgggcaatcagttaccgatgcaggtgcaatccgcactgcactccccaacgatgcaacaaggatttacattgcagccagactatcagacaatcatcaatccaactagtactgcagcccaggtcgtgactcaggcaatggaatacgtcaggtccggctgcaggaacccaccgcctcagcctgtggattggaacaacgactattgttccagtgggggcatgcagcgcgacaaagcactgtacttaacttag

SEQ ID NO: 137846 - DNA, 831 bp, Artificial Sequence
  Description of Artificial Sequence: Synthetic coding sequence
atgggaaagaaacctaaaacccctaaaaaaaagaaaaagaaagatccaaacgagccccaaaagccagtgtccgcttacgctctgttctttagagacacccaggcagctatcaaaggccagaatccgaatgctacctttggtgaagtatcaaagattgtggcaagcatgtgggatggtttgggcgaggagcagaaacaggtctacaagaagaagaccgaagccgccaaaaaggagtatctgaagcaactcgccgcttaccgggcgtcactggtatcaaagagctacagcgaacctgtcgatgttaagacctcacagccgccccagctcataaactcaaagccttcggttttccatggtccatcacaggcccactaccaccaacaacccgggatgaacccccatctgacagccatgcacccgtccctccccagaaatatcgccccaaagcccaataaccagatgcccgtgacagtatcaatagccaatatggccgtgtcccctccaccaccactgcaaattagtccaccactgcaccagcatcttaacatgcaacagcatcagccattaacaatgcagcagcccttgggcaatcagcttccaatgcaagtgcagtccgccttgcattcacccacaatgcagcagggtttcactttgcagcccgactaccagacaattattaacccaacgtccacagctgcccaagtggttacccaagcgatggagtatgtgcggtcagggtgtcggaaccccccaccgcagcccgttgactggaataatgattattgctccagcggcggcatgcagcgggataaggccctgtatctgacatag

SEQ ID NO: 137847 - DNA, 747 bp, Artificial Sequence
  Description of Artificial Sequence: Synthetic coding sequence
atgcctgaatttttggaagatccaagtgtgctcacaaaggataaactcaaatccgagctagttgctaataatgtgacactgcccgctggggaacagagaaaggacgtctacgtgcagctctatttgcagcatctcactgccaggaatcgccctccactgccggccggtaccaatagcaagggcccccctgacttctctagtgacgaggaaagggaacctacaccagtccttggcagcggagccgctgccgcgggacgcagcagggccgcagtaggacgcaaagcaacaaaaaaaactgacaagccaaggcaggaggacaaggacgacttggacgtcaccgagctcactaacgaggatttacttgatcagttggtgaaatacggcgtcaatcccggtccaatcgttgggactactaggaagctttatgaaaaaaaattacttaaactccgcgaacaaggtactgagagccgatcaagcacacctttgccaaccatctcttcctccgccgagaacaccaggcaaaacggtagcaacgacagcgataggtattctgacaatgaagaagactccaaaattgaactgaagttagagaaaagagagcctcttaaaggacgggcaaaaacgcctgttaccttaaaacaacgtagggtggagcacaaccaggtctctctggtactgctccctccatgcacaggcataaataacttgctgacgactttgatacatgtattggcctttaacgggtag

SEQ ID NO: 137848 - DNA, 2085 bp, Artificial Sequence
  Description of Artificial Sequence: Synthetic coding sequence
atgcctgagttcttagaggatccaagcgtcctgaccaaagacaaacttaaaagcgaactcgtggctaacaacgtcaccctccctgcaggcgaacaaaggaaagatgtgtatgtgcaactatacttgcaacacctaacagccaggaatcgccctcccctgccagctggaactaacagcaagggccctcctgacttcagctccgacgaagagcgtgaacctacaccagtactgggcagcggtgcagcagccgctgggcgctctcgcgccgcagtgggcagaaaggccaccaaaaaaaccgacaaaccccgccaggaggataaggatgacctggacgtcacagaactgaccaatgaagacctgctcgaccagctggtcaaatatggcgtgaatccaggtcctatcgtgggcaccacccggaaactgtacgaaaagaaactccttaagctccgagagcagggcaccgaatccagatcttctactccactcccaaccatctctagcagcgctgaaaacacgagacagaatggatctaatgatagcgaccgctactctgacaatgaagagggcaaaaagaaagagcataaaaaggtgaagtctactcgagacatcgtgcccttctccgagctcgggacaacccccagtggagggggtttttttcaggggatcagcttccccgaaatctccacacggccccctctcggaagcacggagctacaggccgccaagaaggtccacacatccaagggcgacttaccgcgcgaacccctggtggcaactaacttgcccggtagagggcaacttcagaagctggcctcagagcgaaacctctttatttcgtgtaagtcttcacacgataggtgcctggagaagagctcctctagtagctcccagcccgagcactctgccatgctggtttcgacagctgcctcccctagcctcatcaaggaaaccaccacaggatattataaggacatcgtggagaacatctgtggaagagaaaaatccgggatccagccactgtgccccgagcgatctcatatcagcgatcagagccctctctccagtaagaggaaagcgttggaagaaagtgagagcagccagttgatcagtcccccattagcccaggccatccgcgactacgtgaactccctgctcgtccagggcggtgtcgggtcactgcccgggacttccaatagcatgcccccactggatgtggagaacattcagaagcggatcgatcagagtaagtttcaggagaccgaattcctcagcccaccccgaaaggtgccaaggttgtcggagaagtccgttgaagagcgggactcaggctcattcgttgcattccagaacatacctgggtccgaactgatgtcgtcctttgccaagacggtggtctcgcattcacttacgaccctgggattagaggtcgccaaacagtcacagcacgacaagattgatgcttccgagttgagttttccgttccacgaaagcattttgaaagtgatcgaagaggaatggcagcaggtagataggcagctgcccagcctcgcgtgtaagtacccagtgtctagcagggaggctacccagatactctcagtgcctaaagtcgatgatgaaatcctgggatttatttccgaggcaactccactaggcggtatacaggctgcaagcaccgagtcttgtaatcaacagctggacctagctttgtgtagagcttacgaggctgccgcatcggctcttcaaatcgcgacacacacggcctttgtcgctaaggccatgcaagcagatatctcccaggccgcacagatactgtccagtgacccatcccggacccaccaagctcttggcatactgtctaaaacgtacgacgccgcctcttacatctgcgaggccgcctttgatgaagttaagatggctgcccatacaatgggtaatgcaacagtaggacggcggtatctttggctcaaagactgcaagatcaacctcgcatccaaaaataaattagcctctactccatttaagggtggcactttatttgggggggaagtgtgcaaagtgatcaaaaaacgcggtaataagcactag

SEQ ID NO: 137849 - DNA, 1245 bp, Artificial Sequence
  Description of Artificial Sequence: Synthetic coding sequence
atgcccgagtttctggaagaccctagtgttctcaccaaggacaagctgaagagcgaactggtcgcaaacaatgtgacgcttcccgctggtgagcagagaaaagatgtgtacgttcagctttatctgcaacatcttacagccagaaacagacccccgctacctgcaggcactaattcaaaaggccctccagacttttccagtgacgaggagcgtgagcccacccctgtgctcggttctggagctgctgccgccggacggtcacgagccgccgttggccgcaaggcaaccaagaagacagataagccacgacaggaagacaaggacgacctggatgttactgaactaaccaatgaggatctccttgatcagctcgttaaatacggggtgaaccccggacccatcgtgggtacgacccgcaagctttatgagaaaaaactgctgaagctgagggagcaaggaacggagagtagaagttcaacgcctctgccaacgatctctagctcggccgagaataccaggcagaatggcagcaatgatagtgatcgctactctgataatgaggaagacagcaaaatcgagcttaagctggaaaagcgagagcccttaaaaggccgcgccaaaactcccgtcaccctaaaacaaagacgggtcgagcacaaccaggtggagacttccgaacactttaggatcgacggtcccgtgatctctgaaagcactcctatcgcagagacgattatggcatcatccaatgaaagcctggtggtcaatcgagtgacaggaaatttcaagcacgccagccctatcttgcccattacagaattctcggatatcccacggcgagctccaaaaaagcctcttaccagggcagaggtcggagagaagacagaggagcgcagggtcgagagggacattttgaaggagatgttcccgtacgaggccagcacccctaccggcatcagtgcaagctgtcgcaggcctatcaagggcgctgccggacgcccactggaattgtcagatttcagaatggaggagagttttagttctaaatatgttcctaaatatgtgccactcgccgatgtgaaatctgagaagactaaaaagggccggtctatccctgtgtggatcaaaattctgctcttcgtggtggtagctgtgtttctgttcctggtgtaccaggccatggaaactaatcaggtgaacccctttagcaactttctgcacgttgatccacggaaaagcaactag

SEQ ID NO: 137850 - DNA, 1038 bp, Artificial Sequence
  Description of Artificial Sequence: Synthetic coding sequence
atgcccgaatttctggaggacccctcagtgttgactaaagataagctcaagtccgagctcgtcgccaacaacgtcaccttacccgctggtgaacagcggaaggatgtgtacgtacagctatatctccagcatctgactgcccgaaatagaccccccctgcctgcagggacaaactcaaagggcccacccgacttttctagcgatgaagagcgcgagccgacgcctgtgctgggaagtggcgccgcggccgcgggtagatcccgggctgccgttggcagaaaagcgaccaaaaagacagacaaacctaggcaggaagacaaagatgatctggacgttaccgagctgacaaatgaggatctgctcgatcagctcgtgaagtacggagtgaatccaggcccgattgtgggcaccacgcgcaagttgtacgaaaaaaagctgttgaaacttcgagagcagggaacagagtctagatcttccacccctctcccaaccatctctagcagcgcagaaaacacccggcagaatggctccaatgactccgacaggtactccgataatgaggaagacagcaaaatagaactcaagctcgaaaaaagagaacccttgaaaggaagggccaagactcccgttacactcaagcagaggagggtggaacacaatcaggtgggtgaaaagacggaggagcggagggtggagcgcgatatccttaaagaaatgttcccatacgaagccagcacccccaccgggatcagtgcatcatgtcggaggccaatcaagggggccgccggacggccccttgagctctccgatttccgcatggaggagtccttctccagcaaatacgttccaaagtatgtacccctcgccgatgtcaagtcagaaaagaccaaaaaaggcagatccatcccagtgtggatcaagatcttattatttgtagttgtagcagttttcctttttttggtctatcaggccatggaaacgaaccaggtcaatcccttcagtaatttcttgcatgtggacccaagaaagtctaactag

SEQ ID NO: 137851 - DNA, 1365 bp, Artificial Sequence
  Description of Artificial Sequence: Synthetic coding sequence
atgcccgagtttcttgaggatccatccgtgctcaccaaggacaaactgaaatcagagctggtagcaaataacgtcaccctcccggccggagagcagcggaaagacgtctatgttcaactgtacctgcaacacttgaccgcacgcaatcgtcctcccttacccgccggcaccaattctaagggccccccggacttcagtagcgacgaggagagggaaccaaccccggtgctgggctctggcgctgctgctgcgggccgctctagggcagcagttggcaggaaagccaccaagaagacagataaacctagacaagaggacaaggatgatttagacgtgacagagctgacgaacgaagacctcctcgaccaactcgtgaagtacggggttaatcctggaccaatcgtcgggacaacccggaaactgtatgagaaaaagttgctgaagttacgggagcagggtacagaaagtaggagcagtacgcccttgcctactatatcaagctcggcagagaatactcggcagaacggctctaatgactcggatcgctacagcgacaacgaggaggattccaagatagaacttaagctggaaaaaagggagcccctgaaggggagggcaaagactccggtgacccttaagcagagacgtgtggaacataaccaaagttacagccaggcaggcattactgagactgaatggacttctgggtccagtaaggggggcccgcttcaggccctgacgcgggaatcaactaggggcagtcggcggaccccacgcaagagagtcgagacctcggagcacttcaggattgacggtccagttatcagcgagagcactcccattgcggagacgattatggcatcttctaacgagagtttagtagtgaatagggttacaggaaacttcaagcacgccagcccaatccttcccattaccgagttcagcgacatccctagaagggcccccaagaagccactcacgagggcagaagtgggagaaaaaacggaggagcgaagagtagaaagagatatcctgaaagagatgtttccctacgaggcctcaaccccgactggcatcagcgcctcctgtagacgaccaatcaagggagccgcagggaggcctctcgaactcagcgatttccgcatggaggagagcttcagttctaaatatgtgccaaagtatgtgcctctggcagatgtcaaatctgagaagactaagaaaggtcgcagcattcctgtttggatcaagatactgctgtttgttgtcgtagccgtgttcctgttccttgtgtatcaggcgatggaaacaaatcaagtgaacccgttttcgaacttcctccatgttgacccccgcaaatcaaattag

SEQ ID NO: 137852 - DNA, 135 bp, Artificial Sequence
  Description of Artificial Sequence: Synthetic coding sequence
atgtcagataagcctgacatggccgagattgaaaagtttgataagtccaagctaaaaaaaaccgaaacccaggaaaaaaacccgctaccttccaaggaaacaatcgagcaggaaaagcaggctggagagagctag

SEQ ID NO: 137853 - DNA, 135 bp, Artificial Sequence
  Description of Artificial Sequence: Synthetic coding sequence
atgtcagataaacccgatatggccgaaatagaaaaatttgacaaatccaagctaaagaaaaccgaaacgcaggagaagaatcctctccccagcaaggaaacaatcgaacaggagaagcaggcgggggagtcttag

SEQ ID NO: 137854 - DNA, 135 bp, Artificial Sequence
  Description of Artificial Sequence: Synthetic coding sequence
atgtctgacaaaccagatatggctgagattgagaagtttgacaaatctaagctgaagaagactgagacacaagagaagaacccgctcccctctaaggagacgatagagcaggaaaagcaagccggtgagtcatag

SEQ ID NO: 137855 - DNA, 135 bp, Artificial Sequence
  Description of Artificial Sequence: Synthetic coding sequence
atgtctgacaagcctgacatggccgagatcgagaaattcgacaagtctaagctgaaaaagacggaaacccaggagaagaaccctctgcctagcaaagaaacaattgagcaggagaaacaagcgggagaatcatag

SEQ ID NO: 137856 - DNA, 135 bp, Artificial Sequence
  Description of Artificial Sequence: Synthetic coding sequence
atgagtgacaaacctggaatggccgagatcgaaaaattcgacaaaagtaaactgaagaagaccgagacccaagagaaaaaccccctgtctagtaaggagactattgagcaggaacgccaggccggagagagttag

SEQ ID NO: 137857 - DNA, 1299 bp, Artificial Sequence
  Description of Artificial Sequence: Synthetic coding sequence
atgggtccagccggcagtcttctcggatctggccagatgcagattactctgtgggggagcctcgcggcagtcgctatcttctttgttatcactttccttatctttctgtgctcatcctgcgaccgtgagaagaaacctcgccaacattctggcgaccatgagaaccttatgaacgttccgtcagacaaagagatgttctctagatccgttacgtctcttgctaccgatgccccagcctcctcagaacagaacggtgccctcacaaatggcgatatactcagcgaggacagcactctcacatgtatgcagcactatgaagaggtgcagacctctgcttccgacctcttggactcgcaagactctaccggtaagccaaagtgtcatcagagccgtgagttacccagaattcctcccgagtctgcggtcgatacaatgctcaccgcacgctcagtcgatggcgaccaaggcctgggcatggaggggccctacgaggtgttaaaagattctagtagccaggagaacatggtggaagattgtctgtacgagaccgtgaaggagatcaaggaggtcgctgctgccgcccatctagaaaagggtcactcagggaaggctaagtccacaagcgcaagcaaggaactgccaggtcctcagacagaaggaaaggccgagtttgcagaatatgcatccgttgacagaaataaaaagtgcagacagtcggtgaatgtggaatcaatcctgggtaacagctgcgaccctgaggaagaagctcctcccccagtacctgtgaaactgctagacgaaaatgagaacctgcaggaaaaagagggcggcgaggctgaagaatctgcaactgacaccaccagtgagaccaataaaaggttctcttcactgagctataagtcccgggaggaagacccaacactgaccgaagaggagattagcgcaatgtacagcagtgtgaacaaacccggccagctcgtgaacaaatccgggcaatcccttaccgtaccagaatccacgtataccagcattcaaggcgatcctcagcgatccccgtcttcctgtaatgacctatacgccaccgtcaaggattttgagaagactccaaacagcacgctgccccccgcaggccggccttcggaagaacctgagccggactacgaagctatccaaacgctgaatcgcgaggaggagaaggccaccttaggaaccaacggccaccacggactcgtgcccaaagagaatgattatgaaagtatttccgacttgcagcagggcagagacattacaaggttgtag

SEQ ID NO: 137858 - DNA, 8136 bp, Artificial Sequence
  Description of Artificial Sequence: Synthetic coding sequence
atggcattagtgctggaaatcttcactttactggccagtatttgttgggtctcagcgaacattttcgaatatcaggtggatgctcagccattgaggccctgtgagcttcagagagaaacggcgttcctcaagcaagcagactacgtgccacagtgcgccgaggacggaagctttcagactgtgcagtgccaaaatgacggtaggagctgttggtgcgttggtgccaatggatcggaagtcctgggctctcgacagccaggccgccctgtggcttgtctgtcattctgccaacttcaaaagcagcagatcctgctgtctgggtacattaattctacagacacatcttatctgccccagtgccaggatagcggagattatgcccctgtccagtgtgatgttcagcaggtgcagtgttggtgtgtagacgctgaggggatggaagtttacggaacccgacagttaggccgtcccaagcgctgtcctaggagctgtgagattagaaaccggagactcttgcacggggtgggagataaatcccccccgcagtgtagcgccgagggcgagttcatgccagtgcaatgcaaattcgtcaacacgactgatatgatgatttttgacctggtgcactcctacaatcgattccctgatgcatttgtcacattctccagcttccagaggcgctttcccgaggtcagcgggtactgtcactgtgcagattcgcagggaagagagttagccgaaacgggcttggaactcctactggatgagatatatgacactatctttgcgggtctagaccttccatctacctttactgaaactactctgtatcgtatactgcagcgcagatttctcgccgtgcagagtgttatatctggacggtttaggtgcccgaccaagtgcgaggtggagagattcacggctacctctttcggccacccatatgttccctcgtgcaggcgcaacggggactaccaggcggtccagtgccagactgaggggccctgctggtgcgttgatgcccagggcaaggagatgcacggaacgagacagcagggtgagccgccttcttgtgccgaggggcagtcctgcgcctcagagaggcagcaggccttgtcgcggctttactttggtacgtctggatacttttctcagcacgatctattctccagccctgagaaacggtgggcatcgcctcgggtcgccaggttcgctacgtcctgcccacccacaatcaaggagctgttcgttgatagtggattgctgagacccatggtagagggccagtcacaacaattcagcgtatccgaaaatttgctgaaagaagctattagagcgatttttccttcacgaggactggcccgattggctctgcagttcactactaatcctaaacgcttgcagcaaaatttgtttggtggaaagtttcttgtgaacgtgggtcagttcaacctttctggagctttgggtactagaggcactttcaacttctcccaattctttcagcaactggggctcgcgagttttctcaatggcggcagacaggaggacctcgccaaacccctcagtgtgggactagattccaacagctcaactggcacaccagaggccgctaaaaaagacggtactatgaacaaacctacggtagggtcgttcgggtttgagattaacctgcaggagaatcagaacgccctgaagtttctggcctcacttctggaactgcctgagtttctattatttttacaacacgctattagcgtgccagaggacgttgcccgagatcttggcgacgtgatggaaaccgtgctgtcttcacagacttgcgaacagacaccggagaggctgtttgtgccatcttgtaccactgagggctcttatgaggatgtgcagtgtttttctggcgagtgctggtgcgtgaattcttggggcaaggagctcccaggcagtcgagtgcgtggagggcaaccccgctgcccaaccgattgtgagaagcagcgcgctaggatgcaaagcctgatggggtcacagccagccggtagtaccctgttcgtgcccgcctgtactagtgagggccattttctccccgtacagtgtttcaacagtgaatgctattgcgtcgacgccgaaggccaggctatacctggtaccagaagcgctattggaaagccaaaaaagtgtcctaccccttgtcaactccagtccgagcaggcctttctgagaacagttcaagctctgctgtccaactcttctatgctgcccacgctgagcgatacatacataccccaatgtagcactgatggacagtggagacaggttcaatgcaatggcccaccggagcaagtatttgaactgtaccagagatgggaggctcagaataaagggcaggacttgacaccagccaagctgctcgtaaagatcatgagctaccgcgaagctgctagcggcaacttttctctgtttatccagagcctgtacgaagcgggtcagcaggatgtgttcccagtgctgtcacagtacccctcccttcaggatgtccccctggcagccctggagggaaagcgaccccagccccgggagaacatcctattggagccctatttattttggcagatcctcaacggacagctaagtcaatacccaggctcctacagcgatttctccacacctctggcgcactttgatctgcgaaattgctggtgtgtcgatgaggccggccaggaactcgagggtatgagatctgagccatctaaacttcccacatgccccggcagttgtgaggaggcaaagctgagagtgttgcaatttataagggaaactgaggaaattgtgtctgcttcaaatagcagccggtttcccttgggcgagagcttcctcgtggcgaaaggcattcggctgcggaatgaggacctgggtcttccccctctctttcctcctcgtgaagccttcgctgagcagtttctccggggctccgattatgccattagactggctgctcaaagcacgctgagcttttatcagcggaggcgtttcagccccgacgacagcgctggggctagcgccctgctccggagcggcccttatatgccccagtgcgacgcctttgggtcttgggagccggtgcaatgtcacgctggtaccggccactgctggtgcgtggacgagaagggcgggttcatcccaggcagtttgactgcccgatcgcttcagatccctcagtgccccaccacatgcgaaaagagccgtacatcggggctactgtccagctggaagcaagcacgctcccaagagaacccctcccctaaggacctgtttgtgcctgcctgcctggagactggagaatacgcacgactgcaggcatccggggctggcacgtggtgcgtggaccccgcatctggtgaagagctgcggccagggtcatcctcatcagctcagtgcccatccctctgtaacgtgctaaagagtggtgtcctgagtagaagggtgtccccgggctatgtgcccgcctgccgtgcggaagacggtggcttttccccggtgcagtgtgatcaggctcaaggaagttgttggtgtgtgatggattccggggaagaagttccaggcacaagggtgacaggcgggcagccggcatgcgagtcaccaaggtgccccttacctttcaatgcttccgaggtggtgggcggaacgatactgtgcgagactatctctggacccaccggcagtgccatgcagcagtgtcagctcctgtgccgtcagggaagctggtccgtcttcccccccggtcctcttatttgctccctggagtccggacgatgggagtcccagctgccccaacccagggcctgccaacgcccacaactgtggcagaccattcagactcagggtcattttcaattgcagttgccccctgggaagatgtgtagcgctgattatgccgatctcttgcagacatttcaggtgtttattctggatgaactcactgccaggggattctgtcaaatccaggtcaaaacatttggcacactggtctctatcccagtctgcaacaactcgagtgtgcaagtcgggtgtttaaccagggagaggttgggcgtcaacgtcacatggaaatccaggctggaggacatccccgtggccagcctccccgatcttcacgatatagaacgcgctctggtgggcaaagacttgctggggcgttttactgatcttatacagagtgggtcatttcaattgcacctggatagtaagaccttccccgccgagacgattaggttcctacagggagatcacttcggaacttcaccacgcacctggtttggctgtagcgaaggcttctaccaggtccttaccagcgaggcgagtcaggatgggctgggttgtgtgaaatgtcccgaaggatcctactcacaggacgaagagtgcatcccttgtcctgtaggcttttaccaggagcaggccgggtccttggcctgcgtcccttgccctgtgggccgtacaaccattagcgccggcgccttcagccaaacacaccttatgcagaagtttgaaaaagtgcccgagtctaaagtgattttcgacgcaaacgccccagtagcggtgagatccaaagtccccgactcagaattcccggtcatgcagtgtctcactgattgcaccgaagacgaggcttgttctttctttaccgttagcaccaccgagcccgaaatcagttgtgatttctatgcctggacttcagacaacgttgcctgtatgacgtcagatcaaaagcgggacgcactgggaaacagtaaggcaaccagcttcggaagtctgcgctgccaggtcaaagtacgatctcacggccaggatagtcctgccgtctatctcaagaaggggcaggggagtaccacaactcttcaaaaaaggttcgaaccaaccggatttcagaatatgctaagtggcctgtacaaccccatagtctttagcgccagtggtgccaatttgaccgacgctcatctcttttgtcttctggcatgtgacagagatctctgttgcgatggcttcgtactgacacaggttcaaggtggagccattatctgcggactactgagtagcccatccgtgttattatgcaacgtgaaagattggatggatccttctgaggcttgggcaaatgctacctgccccggagtgacatacgatcaggagtcgcaccaggtgatcctgagacttggtgatcaagagtttatcaagagcttgacacccctggaggggacgcaagatacttttacgaatttccagcaggtgtacctatggaaagactccgacatggggagccggccagagagcatgggttgtcgcaaggacactgtgccccggccggcctcccctacagaggccggcctgactacagagttgttcagccccgtcgacctgaatcaggttatcgtgaatgggaaccagtcactcagtagccaaaagcattggctatttaagcaccttttttcagcgcagcaagcaaacctctggtgcctgagccggtgcgtgcaggagcactctttctgccagctcgccgagattaccgaatccgcctcactctacttcacctgtaccctttatccagaggcccaggtatgcgacgatattatggaatcaaatgcccagggctgcagacttatccttccacaaatgcccaaagctttgtttaggaagaaggtgatcttggaagataaagtaaaaaacttttacactcgactgcccttccagaagctgatgggcatctcaattcggaataaggttcctatgtctgagaagagcattagtaatgggttcttcgaatgcgagcggcgatgcgatgccgatccctgttgcactggcttcggctttctcaatgtctcccaactgaagggtggagaggtcacttgcttgactttgaactcactcggaatccagatgtgctcggaggagaatggtggagcctggagaatcctggactgcggatcacctgacatagaggtgcacacctacccgttcggatggtaccagaagccaatcgctcaaaataatgccccttccttttgtcccttagtcgtcctgccctcattaaccgaaaaggttagcttggattcctggcagtccctcgcattgtcaagcgtagttgtggacccctctatccgccatttcgacgtcgcacatgtcagtaccgccgcaacctcgaatttttccgctgtgagggacctgtgtttaagcgaatgtagccagcacgaagcttgccttataaccaccttgcagacacagcctggagccgtccgctgcatgttttacgccgatacacaatcctgcacacattctctccagggccagaactgtcgcctcctcctgcgggaggaagctacccatatttacagaaaaccaggaatctcgctcctgagctatgaggcatcagtgccttcggtgcccataagcacccatggtcgcctcttaggccggagccaagctattcaagtgggcactagctggaagcaggtggaccagtttctgggcgtcccgtatgctgctcctcccctcgccgaaagacggttccaggctccagagccactgaattggaccggcagttgggacgcatccaagcctcgggctagttgctggcagcccggcacccggacgtctacttcaccaggtgtatcggaggattgtctttacctcaacgtcttcattccacaaaatgtcgcccctaacgcgtccgtgcttgtcttttttcataataccatggatcgcgaagagtctgaggggtggccagctattgatggatccttcctggccgccgtgggaaatctgattgtggtcactgcttcctacagagtgggagtcttcggctttctgagttcgggctctggagaagtctcagggaattggggcctcttagaccaggtagcggctctgacctgggtccagactcacattcgaggtttcggcggggatcccagaagagtgagtcttgctgccgatcgagggggggccgatgtcgcgagcattcacctactcaccgccagagcaactaattcccagttgttccggagagccgtgcttatgggggggagcgcgttaagtccagcggccgtgataagtcacgagagggcccaacagcaagccatagcactagccaaggaggtgtcctgccccatgtcaagtagccaggaagtggtcagctgtctgcgccagaaaccagccaatgtgctcaatgatgcacagacaaaattgcttgcagtgtctggccccttccactattggggcccagtgatcgatggccacttcctgcgtgagcctcccgcccgggccctgaaacgcagcctctgggtggaagtggacttgctcatcggcagcagtcaggacgatggcctgatcaacagagctaaggcagttaagcagtttgaggagtcacgcggccgtacttcatcaaaaaccgcattttaccaggcattacagaattcactaggtggggaggattccgacgctcgggtggaagcggcagctacctggtactacagcctcgaacatagcaccgatgattacgcctccttttccagggctctcgagaacgccacaagagattacttcattatctgtccaatcatcgatatggcaagtgcctgggctaagcgagcccgggggaacgttttcatgtaccatgctcccgaaaattacgggcacggctctctagaactcctagctgacgttcaattcgctcttggtctgcccttctacccggcctacgaggggcaatttagcctggaggagaagtccctgtccctcaagatcatgcagtatttcagccatttcatccgatccggaaatccgaactacccctacgaatttagtcggaaggtgcctactttcgccaccccctggccggactttgtccctagagcgggtggtgagaactacaaggagttttccgaattgctgcctaatcggcaggggctgaaaaaggctgactgctcattttggagcaagtacatcagtagtttgaaaacctctgctgacggcgctaaggggggtcaatcagccgagtctgaggaggaagagcttaccgctggatcaggtctgagggaggacttgctgagcctgcaggagccagggtcaaagacctactcgaagtag

SEQ ID NO: 137859 - DNA, 2664 bp, Artificial Sequence
  Description of Artificial Sequence: Synthetic coding sequence
atggcattggtgctggaaatctttactcttttggcatcaatctgctgggttagcgccaatatctttgagtatcaggtcgacgcgcagcctctgcgcccctgcgaactgcagcgagagacggcttttctcaagcaagctgactacgtgccacagtgtgcggaagatggatccttccagaccgtgcagtgccagaacgatggaagatcctgttggtgtgtgggtgctaacggtagtgaggtgctaggatcacggcaacccggaagaccggtcgcctgcctgtctttctgtcagctgcagaaacagcaaatactactgagtgggtacatcaatagcaccgatacatcttacctgccccaatgtcaagacagtggagactacgctcccgtgcagtgcgatgtgcagcaggtgcagtgctggtgcgtagacgcagagggtatggaggtctatgggacaagacagctcggaaggcccaaacgctgcccccggtcttgcgagataaggaaccgtaggctcctgcatggcgttggggacaagtcacctccccaatgtagcgccgaaggtgaatttatgccggtgcagtgcaaattcgtgaataccacagatatgatgatttttgacttagtgcacagttacaaccggtttcctgatgccttcgtcacgtttagctcttttcagcgcagatttcccgaagtgtcagggtattgtcattgtgcggattctcagggcagagagttggctgagaccggcctggaacttctgctcgatgaaatttacgacacgatctttgccggacttgatcttccaagcacctttaccgagactaccctataccgaatcctgcaaagaagatttctagccgtgcagagcgtgatctcaggcagattcaggtgtccgacaaaatgtgaggtcgaacgctttacagccacttctttcggacatccttatgtgccctcctgtcggcgaaacggggactaccaagcagttcagtgccaaaccgagggcccttgttggtgcgtcgacgcccagggaaaggaaatgcatggaacccgtcagcaaggggaaccgcctagttgtgccgagggccagtcttgtgcctctgagcggcagcaagcgctttcccgcctttactttggcaccagcggatactttagccagcacgaccttttcagctctcccgaaaagcggtgggcctcgcccagggtagccaggtttgccacaagttgccctcctacaataaaagagctgtttgtggactcagggctactacgacccatggtcgaaggccagtcccaacaattcagtgtatcagaaaatcttctgaaagaggccattcgggccatctttccttctcgaggactggcacgtctagccctgcagttcacgactaaccccaagcgccttcagcagaacctgtttgggggaaagtttctggtcaacgtcggccaatttaacttatccggtgctctcggcacccgcggaacctttaatttctctcaattctttcagcaactggggctggccagttttctgaatggaggcaggcaggaggacttagccaagccgctgtctgtggggctggattccaattcctcaaccgggactcccgaggccgccaagaaagacggaacaatgaataagcctactgtggggtctttcggttttgaaataaacctccaagagaaccagaatgccttaaaattcctggcttctttactggagctgcctgagtttctgctgttcctccaacacgctataagcgttcccgaagatgttgctcgggacctcggcgatgtgatggagactgtcctttcctcccagacctgcgagcaaacgccagaacggctattcgtgcctagttgtaccaccgaaggctcctatgaggatgtccaatgttttagcggcgaatgctggtgcgtaaacagctggggaaaagaattgcccggctcacgcgtgaggggagggcaacctagatgccctacagactgcgagaagcagagagcgaggatgcaatctctgatgggctctcagccggcagggagcacattgttcgtgccggcttgcacatccgagggccacttcctcccagtacaatgttttaactccgaatgttactgcgtggacgccgaagggcaggcaattcccggcactagatctgcaatcggcaaacctaaaaagtgtcccacaccatgtcagctgcagagcgaacaggctttcctgcggacagtgcaggcacttcttagcaactcttccatgctacccaccctatctgatacatacgaaggtcaattcagcttggaagagaaaagcctttcactcaaaatcatgcaatatttcagccacttcatccggtctggtaacccaaattatccatacgaattctcacggaaagtgccaactttcgccaccccttggcccgacttcgtccctcgcgctggtggggaaaattacaaggagtttagcgagctgctgcctaataggcaaggcttgaagaaggcagattgctcattttggtcaaagtacatctcatccctgaagacaagtgcagatggggctaaggggggacagtcggcagagtccgaggaggaggagctgaccgcagggtctggccttcgtgaagatctactatccctgcaggagccaggatctaagacctactcaaagtag

SEQ ID NO: 137860 - DNA, 3417 bp, Artificial Sequence
  Description of Artificial Sequence: Synthetic coding sequence
atgatgcaaaaattcgagaaggtccctgagtctaaggtcatctttgacgcgaatgctcctgttgccgttcgctcaaaggtgccagacagcgaattccccgtgatgcagtgcctgaccgactgcacggaagacgaggcctgctcatttttcacagtgtcaaccacagagccggagatcagctgcgacttctacgcttggacaagcgataacgttgcctgcatgacatccgatcagaaaagggacgccctgggcaattccaaagccacctccttcgggtcactgcgttgccaagttaaagtgaggagtcatggacaggattcccctgccgtctacctcaagaaaggggctatcatctgcgggctgttatccagtccgagtgtgctgctctgcaacgtcaaagactggatggacccttccgaggcctgggctaacgccacctgtcccggagtcacctacgatcaggaatctcaccaagtgattctgcggctcggcgatcaggagttcattaagagcctgacccctctggaaggcacacaagacacatttaccaattttcaacaggtatacttatggaaagactcagatatgggtagtcggcccgaatccatgggctgccgcaaggacactgtcccccgacccgctagcccaactgaggccgggttaacaacagagctcttttcacccgtggacctcaatcaggtgattgtaaatggaaaccagtccttatcatcccagaagcactggttgttcaaacatctgttttccgcccagcaagctaacctgtggtgcctcagtcgctgtgtccaggagcatagtttttgccagctggccgagattaccgagagtgcttctctgtacttcacttgcactctatacccagaggcacaggtctgtgacgatattatggagtctaacgcacaagggtgtaggctgatcctcccacagatgccaaaggccttatttcggaagaaggtgatccttgaggataaggtgaaaaacttttacacaagactgccatttcagaaattgatgggcatctccattaggaacaaggtccccatgtctgagaagagcatctctaacggattctttgagtgcgaacggagatgcgacgcggacccctgttgtacaggtttcggatttttaaacgtgtctcagttgaaggggggagaggttacttgtttaacccttaacagcttagggatccagatgtgtagtgaagaaaatgggggagcttggaggatcctagactgtgggtcacccgacatcgaagtccacacatatccctttgggtggtaccagaaacccatcgctcagaataacgccccctctttttgccccctggtggtacttccttcgttaactgaaaaagtatcccttgacagttggcagagcctcgctctaagcagcgtcgtggtagatccatcaatcaggcacttcgacgtggcacacgtttcaactgctgccacaagtaatttcagcgcggtgcgggacctgtgtctttccgagtgtagccaacacgaagcttgcctgattaccacactgcagacccagccaggggcagtccggtgtatgttctacgccgatacccaatcatgtacccattctctgcaaggtcagaattgccgtcttcttttacgcgaagaagccacccatatctaccggaagccaggcatcagcctcctatcttacgaagcaagtgtgccatctgttcctatcagtactcacggtagactgcttggccgctcacaagctatccaagtcggtaccagttggaaacaggtggaccaattcctgggcgtgccatatgccgcacctcctctagcagagaggcgctttcaagctcccgagcccttgaactggactggttcttgggacgctagcaagcctcgagccagctgttggcaaccgggcacacgaactagtacatcacccggagtgtcggaagactgcctgtacctgaacgtgttcattccacagaacgtggcacccaacgccagcgtcttggtcttttttcacaatactatggaccgcgaagaatctgagggttggccagctattgatggctcctttctggctgctgttggcaatttgatcgttgttacagcctcctacagggtgggcgtgttcggttttctgtcctcaggtagcggcgaagttagcggcaactggggactgttagaccaggtcgcagctctcacatgggttcagactcatataaggggattcggcggcgatcctagaagagttagcctggctgctgatcggggcggtgccgatgtcgcaagcattcacctactgaccgccagggccactaacagccagctgtttaggcgcgccgtcttaatgggaggctctgctttgagcccggctgctgtcataagccatgaaagggcccaacagcaagctatagctctggccaaagaagtatcatgtccaatgagcagctcccaggaagttgttagctgcttgaggcagaagcccgccaatgtgctgaatgacgctcaaaccaaattgctggccgtcagtggccctttccattattggggacctgtaatcgacggacactttctgcgcgagccccctgcccgcgccctgaaaagatctctgtgggtggaagtggacctcctgatcggctcctcacaagacgacggactgatcaatcgtgccaaggcggttaaacagttcgaagaaagcaggggccggactagcagcaagactgcattctatcaggccctccagaactcccttggcggagaagattctgacgcaagggtggaggccgcagccacatggtactactcattggaacactcgacagacgattatgcctctttctcacgagcccttgaaaatgccacccgtgattactttatcatttgccctatcatagacatggcttcagcatgggccaaaagagcgcggggcaatgtgttcatgtaccatgcccccgagaactacggtcacggttcactcgagctgctcgcagacgttcagttcgctctgggacttccattttatcctgcttatgagggccagttctccctggaggagaaatcactgtccctgaaaattatgcagtacttttcacacttcatcaggtctggaaaccccaattatccctatgaattctctcgcaaggtgcctacttttgctacaccatggcccgatttcgtgcctcgagccggtggtgaaaattataaagaattctccgagctcctgcccaatcgacaggggctgaagaaggccgattgcagtttttggtcaaagtatatttcctcacttaagacaagcgctgacggagcaaaagggggtcaaagtgccgaaagcgaagaggaggaactcaccgctggatccggcctgcgcgaggatctactgagcttacaggagcctggttcaaagacctactctaaatag

SEQ ID NO: 137861 - DNA, 4725 bp, Artificial Sequence
  Description of Artificial Sequence: Synthetic coding sequence
attccacggaaacctatctccaagcgtccagtacggccttccctccctcgcagcccccggtgcccgctgccatttaacgcttctgaggtagtgggcggaactattctgtgcgagacgatttcaggccctaccggctctgcaatgcaacaatgtcagctattgtgtcgtcagggttcttggtcggtgtttccaccaggaccgctgatctgcagtctcgaatctgggcgatgggaatcacagcttccccaaccccgcgcttgccagaggccacagctgtggcagaccattcagacccagggccattttcagctgcagctgccaccgggcaaaatgtgcagcgcggattatgccgatttattacagaccttccaggttttcatactcgacgaattgactgcccgcgggttttgccaaattcaggtcaaaactttcggaactctcgtcagtattccagtgtgtaataattctagtgtccaggtaggatgcttgacaagagaacggcttggggttaatgtcacatggaaatcaaggctggaggatattcctgttgccagcctacctgaccttcacgacatagaacgggccttggtgggaaaagatctactgggaaggtttaccgacctcatccagagcggatcctttcagttacatttggacagtaaaacctttcccgcagaaaccataagattcctgcagggggatcactttgggacatctcctaggacatggtttggctgcagcgagggtttttatcaggtcctcacctccgaagcctcccaggacggcctcggctgtgtgaagtgcccagagggaagctacagtcaggacgaggagtgtattccttgccctgtgggcttctaccaggaacaggctgggtccttggcttgcgttccatgccctgtggggaggacgactattagtgcgggagccttttcccagactcattgtgtcaccgattgccagcgtaatgaggcggggcttcagtgtgaccagaacgggcaataccgcgcgagccaaaaagataggggtagcggtaaggccttttgcgtggacggtgaaggccgaagactcccttggtgggaaaccgaggcacccctggaggacagccagtgtctcatgatgcaaaagttcgagaaagtgcctgaatccaaagtgattttcgacgcgaatgcgcccgtcgcagttcggtccaaagtccctgacagtgaatttccagtaatgcagtgtttgactgactgtaccgaggacgaggcatgttccttctttaccgtgagtacgactgagccagaaattagttgcgacttctatgcttggaccagcgacaatgtggcctgtatgacgtcagatcagaaacgcgacgcacttggaaattcaaaggccacgtcattcggttcattgcgttgtcaagtgaaagtacgcagccacggacaggatagtcctgctgtttacctcaaaaaaggacagggcagcacaacaactctccagaagaggtttgaacctaccggtttccagaatatgctatccggcctttacaatcccatcgtgttctccgcgagcggggctaacctgacggacgcccacctgttctgtctgctcgcgtgcgatcgcgacctgtgttgcgatggctttgtgctgacgcaggtgcagggcggggcaattatctgtggattgctgagcagccctagcgtccttctttgtaacgttaaagactggatggatccatcggaagcctgggccaatgcaacttgccccggagtgacctatgaccaagagtcgcaccaagttatcttaagattgggtgatcaggagtttataaagagcttgactccactcgagggaacccaggatacttttaccaattttcagcaggtttacttgtggaaagattccgacatgggcagccggccagagagcatgggctgcaggaaagatacagtcccccgcccagctagccctactgaggccgggctgaccactgagttgttctccccagtggacctgaatcaggtaatcgtgaacggaaatcaatccctgtcaagtcagaaacattggctcttcaagcatctattttccgctcagcaagcaaatctatggtgcctaagtaggtgcgttcaggagcactccttttgtcaactggccgaaatcacagaatccgcttccttatactttacgtgtactctttatcccgaggcccaagtttgcgacgatattatggagagcaatgcgcagggatgtaggctaatcttgcctcagatgccaaaggcattgtttcgaaagaaagtgatccttgaggacaaagtaaaaaacttctatacaagactgccctttcagaagctgatgggaatcagcattcgcaacaaagttcccatgtccgagaaaagcatatctaatgggtttttcgagtgcgagcgaaggtgcgacgcggatccttgttgtaccggattcggcttcctcaatgtgagtcagttgaaaggcggggaagtgacctgtctgaccttaaacagtcttggcatccaaatgtgctccgaggagaatggcggagcatggaggattttggactgcgggagtccagacattgaggttcacacctaccctttcgggtggtatcagaagcccatcgcacagaacaatgccccctctttctgtccgcttgtggtcctaccttccctgaccgagaaggtgtctcttgatagttggcaaagcctcgcactgtcaagcgtcgtggtggacccctctattagacactttgatgtcgcacacgtctctactgctgccacgagcaacttttctgccgtgcgggatttgtgtttgtccgagtgtagccagcatgaggcctgtctgattacaactctgcagacacagcctggtgctgtccggtgtatgttttacgcggatactcagtcatgcactcactcccttcagggtcaaaactgccgactgctgcttcgggaagaagcaactcacatttaccggaaaccagggatcagcctactctcctatgaagccagtgtcccgagtgtgcctatatccacccacggcaggctgctcgggcgtagtcaagccatccaagttgggacctcctggaaacaggtcgatcaattcctgggagtcccctatgcagccccacctttagccgaaagacgctttcaggccccagagccattaaattggaccgggtcatgggatgcgtctaaacctagagccagttgctggcaacctggaacaagaaccagcacgtcccccggtgtgagcgaggactgcctctacctcaacgtttttattcctcagaacgtggctccaaacgcttcagtgttggtgtttttccataacaccatggatcgggaggaatccgaggggtggcccgcaatcgatgggagcttcctcgcggcagttggcaatctgatagtagtgaccgcatcttatagagtcggagtattcggtttcctcagctccggctccggcgaagttagtggaaactggggcctcttggatcaagtggcagccttgacgtgggttcagactcacattcgaggctttggcggcgaccctagacgggtgagtctcgcagccgaccgaggcggggccgatgtggcttccatccaccttctcacggcgcgagccactaattcgcagctcttccgacgcgcagtcttaatgggaggtagtgccctctctccggcggcagtcatcagccatgaaagggcccagcagcaggcaatcgcgctcgctaaagaggtgtcctgtcctatgagcagcagccaggaagtggtcagttgcctgcgccagaaaccagcaaatgtgctgaacgacgcacagaccaagttgcttgccgtctcgggaccttttcattactggggtcctgtcatagatgggcattttctcagggagccgccagctcgggcactgaagaggagtttgtgggtggaagtggacctcttgatagggtccagtcaggacgatggtctgatcaaccgtgccaaagcagtgaagcaatttgaggaatcaagaggccgaacctcctcaaagactgcattttaccaggcacttcagaactctcttgggggcgaagattctgacgcccgtgtggaggctgccgccacttggtactattcccttgaacacagcaccgacgattatgccagtttttcacgcgcactggagaacgccaccagagattatttcattatatgtcctattatcgatatggcttctgcctgggcaaagcgggccaggggaaacgtgtttatgtaccatgcaccagagaattacggccacggaagcctcgagttactcgcagatgtgcagtttgcgctgggactaccattttacccagcatacgagggacaattcagcctagaggaaaagtccctcagtctcaaaattatgcagtatttctctcacttcattagatctgggaaccctaattacccctacgaatttagccgcaaagtgcccactttcgcgaccccctggccagacttcgtgcctagggccgggggtgaaaattataaagaattctcagagctgttgcctaacaggcaggggcttaagaaggcagattgctccttctggtctaaatatatttctagtttgaagacatcggctgatggagcaaaaggcggccagtccgcagaatccgaggaggaggagctgactgcaggatctggcctgcgcgaagatcttctatccctgcaggaaccaggatctaaaacatattcgaagtag

SEQ ID NO: 137862 - DNA, 1356 bp, Artificial Sequence
  Description of Artificial Sequence: Synthetic coding sequence
atggagcaaaaaccgagtaaagttgagtgcggatctgaccctgaggaaaactcggccaggtctcctgatggcaaaaggaaacgcaagaacggccaatgttcattgaaaacctcaatgagcgggtatataccaagctacctagacaaggacgagcagtgtgtggtctgtggtgataaggctacgggatatcattatcgatgtattacgtgcgaaggctgcaaggggttcttcagacgcacgatccaaaaaaacctacacccgacatacagctgcaaatacgactcgtgttgcgtaatcgataaaatcaccagaaaccagtgccaattatgcagatttaagaaatgtatcgctgtcggaatggccatggatcttgtccttgatgattctaaaagagttgctaaaaggaaactgatcgagcaaaacagggagcggcgtcggaaggaagagatgatccgcagcctgcagcaacggccagaacccacccccgaggaatgggatttaattcatatcgcaacggaggcccatagaagcaccaacgcccagggtagtcattggaagcagaggcgcaaatttctccccgacgacattggccagtctcccattgtgtccatgcccgatggcgacaaggtggacttggaagccttttcggaattcaccaaaatcatcacacctgccataacaagagttgtcgactttgccaagaagctgcctatgttttccgaactcccatgcgaggatcaaataatcttattaaaaggctgttgcatggagattatgtctctgagagcggcagtgcgatacgatcctgagagcgacactctgactctttccggcgagatggccgtaaagcgggaacagctcaaaaatggagggctgggcgttgtttccgacgccatttttgagttagggaaaagcctctctgcattcaacctggatgacacagaagtggctctgctgcaggctgttctgctcatgagcactgaccgatccggactactctgcgtggataagattgaaaaatcccaggaagcttacctcctggcctttgaacattatgtgaaccaccggaagcataatatccctcatttctggcccaaactcctcatgaaaggaccacaggtgcgacagctagaacagcagctgggagaggcaggcagtctccaaggtccggtgcttcaacaccagtccccaaaatccccacaacaaaggctcctggaactgctgcaccggtctggcatcctccacgccagggccgtatgtggtgaagacgattccagcgaagccgactcaccatcatcctccgaagaggaacccgaggtgtgcgaagatttggcgggaaacgctgcaagcccatag

SEQ ID NO: 137863 - DNA, 5940 bp, Artificial Sequence
  Description of Artificial Sequence: Synthetic coding sequence
atgtcgagctggctggggggcttaggctctgggctgggacagagcctggggcaagttggggggtcactcgcatctttgaccggccagatttctaattttacaaaggatatgctcatggagggcacagaggaagttgaggctgaattgcccgactcccggactaaggaaatagaagcgattcacgccatcctgaggagcgaaaacgaaaggctgaagaagctctgcactgacctggaggagaaacatgaagcctctgaaatccagattaagcaacagagcacatcatacaggaaccagctgcagcaaaaggaggttgagataagccacctgaaggctcggcaaatagccctacaggaccaattactaaagctgcaatccgccgcccagtcagtccctagcggcgctggggtgcccgccaccacagcatcctcgtcttttgcctacgggataagtcatcacccatcagccttccatgacgatgatatggattttggcgacatcatttccagtcagcaggaaatcaatcggctctctaatgaggtatcccgcctcgaatcggaggtaggtcactggagacatattgcacagacatccaaagctcagggcactgataacagcgaccagtcggagatttgtaaacttcagaacatcatcaaggagttgaaacagaatcgctcgcaggagattgacgatcaccaacatgaaatgagcgttctacaaaacgcgcaccagcagaagctgacagagatttctagaagacaccgggaagaactctctgactatgaggaacgcatcgaagaattagagaacctgctgcagcaaggcgggtcaggggtaatcgagactgatctgtcaaagatctatgagatgcagaaaactatccaggttctgcagatagaaaaggtggaatccactaagaaaatggagcagctcgaggacaaaattaaagacatcaataagaaactcagcagtgccgaaaacgaccgggacatcttgaggcgagaacaagagcagctcaacgtagaaaagaggcagataatggaggagtgcgagaatctaaagctcgaatgtagtaaactgcagccctctgccgtgaagcagtcggatacaatgacagaaaaggagagaatcctcgctcagtccgcgagcgttgaggaagtgttccgtcttcaacaggccctctccgacgccgagaacgaaatcatgaggctttcatccttaaaccaagacaatagtctggccgaagataatctgaaacttaaaatgcgtatcgaagtgctcgagaaagagaaatctcttcttagccaggagaaggaagaactgcagatgtcactgctcaaactgaataacgagtatgaggtgattaagagcacagcaacgagggacattagtctcgatagtgagctgcatgacctccgcttaaacctagaggctaaagaacaggagctgaaccagtctatctctgagaaagagacactgatagctgagattgaggagctggatagacaaaaccaggaggccactaagcacatgattctcataaaggaccagttatccaagcagcaaaatgaaggcgatagtataatttccaagttgaaacaggacctgaacgatgagaagaagagggtgcaccaactggaggatgacaaaatggacatcaccaaagagctcgacgtccaaaaggagaagttgatacagtccgaagtcgccctcaatgacctgcatctgacaaagcagaagctggaggacaaggtggagaatctcgtagatcagctaaacaaatcacaggaatctaacgtgagcatccagaaggagaacctagagctgaaggaacatatacgccaaaacgaagaggaactcagtaggatccgcaatgagctaatgcagtccctgaatcaggactcaaatagtaacttcaaagatacactccttaaggaacgcgaagccgaagtccgaaatttgaagcagaacctgagcgaactcgaacagctgaatgaaaacctgaaaaaggtggcctttgatgtcaagatggaaaacgaaaaactcgtcctggcatgcgaggacgtacgtcaccagctagaagaatgtctggcggggaataaccagctgagtctagagaagaatacaatcgtggaaacgctgaagatggaaaaaggagagatcgaggcggagctctgctgggctaaaaaacgtctcctggaggaagcaaacaaatacgaaaagacgattgaggagctgtctaatgctcggaatttaaacaccagcgccctacagctagaacacgaacacctgatcaaacttaaccagaaaaaagatatggaaatcgctgagctgaagaagaacatcgagcagatggacacggatcacaaagaaaccaaagatgtactgagcagttccctagaggagcagaagcaactaacccagctgatcaacaaaaaagaaatcttcatcgaaaagctgaaagaacggagctctaagttacaagaggagctggataagtactctcaggcgctgcgcaaaaacgagattttgcgccagacaatcgaggaaaaagatcgctccctggggagcatgaaagaagagaacaaccacctgcaggaggagcttgagcgattaagagaagagcaaagtcgtacagcgccagtggccgatccaaaaacactagactcagtcactgagctcgccagcgaagtgagccagctcaatactatcaaggagcacttggaggaggaaatcaagcaccatcagaaaatcattgaggatcagaatcagagcaagatgcagcttctacagtcattgcaggaacaaaagaaggagatggacgaattccgctaccagcacgagcagatgaacgccacccatacgcaactgtttttggagaaggatgaggagatcaaatctctgcaaaagacaatcgagcaaataaaaacgcagcttcacgaagagcgtcaggatattcagactgacaactccgatatctttcaggaaaccaaagtgcagtcattaaacatcgagaacggcagcgagaaacacgacctgtccaaggccgagaccgagcgccttgtgaagggtatcaaagaacgagagctggaaatcaaactcctgaacgagaagaacatctcactcactaagcagatagaccagctgagcaaggatgaggtgggaaaactgacgcagattatccagcagaaagacctggagatccaggccctacacgctcgaattagctcaaccagccacacccaggacgtagtgtatctccaacaacaactccaagcctatgctatggagcgggaaaaggtctttgctgtgctcaatgaaaaaacaagagaaaacagccatcttaaaaccgagtaccacaaaatgatggacatcgttgctgccaaagaggcggcgctaatcaagctgcaggatgagaacaaaaagctatcaacaagatttgaaagttcaggccaagacatgtttagagagaccattcagaatttaagccgaattattcgggaaaaggacattgagattgatgcactcagccaaaagtgccaaactctgctggccgttctgcagacaagttcaaccggcaacgaagctggaggcgtaaactcaaatcagtttgaagagttgttgcaggaacgcgataaactgaagcagcaggtgaagaagatggaggaatggaagcagcaggttatgacgaccgttcaaaacatgcagcatgaatctgcccagttgcaagaggagttgcatcagctgcaggcccaagtgttggtggacagtgacaataatagcaagctgcaggtggattacaccggcctgattcagagttacgaacagaacgagacaaagttgaagaactttgggcaagagctagcgcaagtccagcactctattgggcagctctgtaataccaaagatctgttgctgggtaagctggatattatttccccgcagctctctagcgcatcactgctcactccacagtccgcggaatgccttagagcttctaagtccgaagtgctcagtgagagctccgagctgctgcaacaggagctggaggaactgagaaagtccctccaggagaaagacgccactatccggaccctccaggaaaataatcacaggctttcagacagcatcgccgcaaccagtgaactcgaaaggaaggagcatgaacagaccgacagcgaaatcaaacaactgaaagagaagcaggatgtcctgcagaaactgttgaaggagaaagatctgttaataaaagccaagagcgaccaactgctgtcttctaacgagaattttaccaacaaagtgaatgagaacgaactcctcaggcaggcagtgactaatttgaaggagaggatcctcatactcgaaatggatatcggcaagctcaagggggaaaacgaaaagatagtcgaaacttatcggggaaaagagaccgaataccaagccctgcaggagacgaatatgaaattctccatgatgctccgggaaaaagagttcgaatgccactctatgaaagaaaaagcgttagcatttgagcaactgcttaaggagaaggaacagggaaagacgggggaacttaaccagctacttaatgccgtgaaaagtatgcaggagaaaacggtggtgttccagcaggaacgggatcaggtgatgctggcccttaagcaaaagcaaatggagaatacagctctgcagaatgaggtccagagactacgcgacaaagagttccggtccaaccaagaactggaaagattaaggaaccatttgctagagagcgaggattcctatacccgtgaggccctcgccgccgaggaccgcgaagctaaactccgtaagaaagtgacagtgctggaggagaaactagtatccagtagcaatgctatggagaatgcatcccaccaggccagcgttcaagtggagtcattgcaggagcagctgaacgtggtgtcgaagcagagggatgagacagcactgcagctgtccgtctctcaagaacaggttaaacagtatgcgctgagcctggctaacttgcagatggtgcttgagcatttccagcaggaagagaaggcaatgtactcagcagagttggagaagcagaagcagctgattgccgagtggaagaaaaatgccgaaaacctcgaggggaaggtaatcagcctgcaggaatgtctcgacgaggcaaatgccgctctcgattcagcctcacggttgaccgagcagctggacgttaaggaggaacagatcgaggaattgaaacggcaaaacgagttgaggcaggagatgctggatgatgtgcagaagaagctcatgagtctagctaactcttcagaaggcaaagttgacaaagtgctgatgcggaacctgtttataggtcatttccatacgcctaaaaaccaacgtcatgaggtactgaggctcatgggatccatcctgggagtacggagagaggagatggagcagctctttcacgatgatcaggggggtgttacgcggtggatgacaggctggctgggaggggggagcaagtctgttccaaataccccattgagaccaaatcagcaatcggttgtgaatagttcttttagtgagctgttcgtgaaattcctggaaaccgaatcccacccttcaatcccaccgcccaagctgtcagtccacgatatgaagcctttagatagtcccggtcggcgtaagcgagacactaatgcacccgaatcgttcaaggataccgcagaaagcagatctggcagacgcaccgacgtgaatccattcctggctccccggagcgccgcagtacccctaattaatccagccggactgggccccgggggccccggccatcttctgctgaagccaatttccgacgtgctgcctaccttcacacccctcccagccctccctgataacagtgccggtgtggtgttgaaagacttactgaagcaatag

SEQ ID NO: 137864 - DNA, 5148 bp, Artificial Sequence
  Description of Artificial Sequence: Synthetic coding sequence
atgagcgtcctgcagaacgcccaccaacaaaagctgaccgagattagccggaggcatagagaagagctcagtgattatgaagagaggattgaggagttggagaatttgctgcagcagggaggttctggtgttatcgaaacggacctgtccaaaatttatgaaatgcaaaagaccatccaggtccttcagatagaaaaggtagagtccacgaagaagatggagcagttggaagataagattaaagatattaataagaagcttagttccgctgagaatgatcgtgacatcctaaggagggaacaagaacagctaaatgtggaaaaacgccaaatcatggaggaatgcgagaatcttaaactcgagtgcagcaagctacagccatcggctgtgaaacagagcgacacaatgactgagaaagaaaggattcttgcacagtcagctagcgtggaagaagtttttagactgcaacaagctttatctgacgccgagaatgagatcatgaggctgagctctctgaatcaagaagaacttcaaatgtccctcctgaaattgaataatgagtacgaagtgatcaaatcaactgctacccgggacatttcgttagactccgagctgcacgatctgcggctgaatctagaagcaaaggagcaagaattaaaccaatccatttcagagaaagagacactcattgcagaaatcgaggaacttgaccgacagaaccaggaagctacaaagcacatgatactcataaaagatcagctgagtaaacaacaaaacgaaggggactctattatctccaaattaaagcaagacctgaacgacgagaagaagcgggttcaccagttggaagatgacaagatggatatcaccaaagagcttgacgtccaaaaagagaagctcatacagagcgaggtggctctgaacgatctgcacctgacaaagcagaaactggaggacaaggtggagaatctggtcgatcaactcaacaaaagccaggaaagcaatgtaagcattcagaaagagaatcttgaactgaaggaacacatcagacagaatgaagaggaactttctaggatccgcaatgagcttatgcaatctctcaatcaggattcgaattctaatttcaaggatacactcttgaaggagagagaggcggaggtgcgaaaccttaagcaaaacttgtctgagctggagcagctgaacgagaacctgaaaaaggttgccttcgatgtgaagatggagaacgagaagctagtgctggcgtgcgaagacgttaggcaccagctggaggaatgccttgcaggcaataatcagcttagcctggagaagaataccatcgtggagacgttaaaaatggagaaaggagagattgaggccgagctttgttgggctaaaaaacgcctgctggaggaggcaaataaatatgagaaaacaatcgaggagctgtctaacgctcggaaccttaacacttcagccctgcagctggaacatgagcaccttattaaacttaatcaaaagaaggatatggaaatagccgagttgaagaagaacatcgagcagatggacaccgaccacaaagagaccaaagacgtgctctcttctagtctggaggaacagaagcaactgactcaactgatcaacaaaaaagagatcttcatcgaaaagctcaaagaacggtcttccaagctgcaagaggagctcgataaatactcccaggctctccggaagaacgaaattctacgccaaaccatcgaggaaaaagatcgatcactcggatctatgaaagaagagaacaatcatctgcaagaagagttggaaaggctgagggaggagcaaagtcgaacagccccagtcgccgatcccaagaccctggactccgtgaccgaacttgccagcgaggtgtcccagttgaataccatcaaagagcacctggaggaggagattaagcatcatcagaagatcattgaggaccagaaccagtctaaaatgcagctgcttcagtctctacaggagcagaagaaggagatggatgagtttcgataccagcacgaacaaatgaatgccactcacactcaactgtttctggagaaagatgaggagattaaatcactccaaaaaacaatcgagcagattaagactcaactgcacgaggaaaggcaagacatccagactgacaacagtgacattttccaggagacaaaagtccagagccttaatatcgaaaatggctctgaaaaacacgacctttctaaagccgaaactgagcggctggtgaaaggaataaaagaaagagagctggagatcaagctgctcaacgagaaaaacatttcacttacaaaacagatcgatcaactcagcaaggacgaggtgggcaagttgactcaaattattcagcaaaaagacctggagattcaggccctgcacgctagaataagttccacttcacatacacaggatgtggtctatctgcagcagcaactccaggcttacgccatggagcgagaaaaagtgtttgcagtactgaacgagaagacacgggagaacagccatctgaaaacggagtaccacaaaatgatggacattgtcgcggccaaggaagctgccctgatcaagctgcaggatgaaaacaagaaactgagcaccagattcgagtcttccggacaggatatgttcagagagactattcagaatctgtcccggatcattcgggagaaggacatagaaatcgatgctctctcgcagaagtgtcagaccctgctggccgttctccaaacatctagtaccgggaacgaagcggggggtgtgaactctaatcagtttgaagagctgctccaggaacgcgacaaattgaaacaacaggtgaagaaaatggaggaatggaagcagcaggtgatgacaacggtacagaatatgcaacacgagtccgcccaattacaggaagagctccatcaactccaggcgcaagtgctcgtggactcagataacaactcaaagctgcaagttgattataccggcttaattcaaagttacgagcaaaacgaaaccaaacttaaaaattttggccaagaactagcccaagtccagcactcaatagggcagctttgtaacactaaagaccttttgctcgggaagttagacataatctctccccagctgtcttcggcatcactcctcactccacagtcagccgaatgccttcgggcctctaaatccgaagtcttatctgaaagctccgagctgctgcagcaggagctggaggagctgaggaagagccttcaagagaaagatgccacaattcgcaccttgcaagagaataatcacaggctgagtgactccatagctgccacttccgagttggaacgcaaagagcatgaacagacagattcagagataaagcagctcaaggaaaagcaagacgtactgcagaaactgcttaaagaaaaagatctgttaatcaaggctaagagcgaccagcttctgagtagtaatgaaaacttcactaataaagttaatgagaatgagctgctgcgccaggcagtcacaaatcttaaagagcgcatcttgatactcgagatggatatcggaaagcttaagggcgagaacgaaaagatcgtggagacttatcgtggcaaagaaacggaataccaggctctgcaagaaactaacatgaaattctccatgatgctgcgggaaaaagagttcgagtgccacagcatgaaggagaaagccctagcctttgaacagctgctcaaggagaaagagcagggcaaaacaggcgagcttaaccagttactaaacgccgtgaaatctatgcaggagaagaccgtcgttttccagcaggaaagagatcaggtgatgctggctcttaaacagaagcagatggagaacaccgcgctacagaacgaggtccagcgccttagagataaagaatttaggtcaaatcaagaattggaacggctgaggaatcatttactggagtccgaagacagctataccagggaagctcttgctgccgaagaccgggaagctaaattgcgaaagaaggtcactgtgctggaggagaagctggtgtcgagttctaatgcgatggaaaacgcatcacaccaagcttcagtgcaggtcgagagcttgcaggaacaactgaatgtcgtgtctaaacagcgtgatgagactgcgctgcaactctccgtgagccaggagcaggttaagcagtatgcactaagccttgctaacctccagatggtcctagagcactttcagcaagaggagaaggccatgtattctgcagagcttgaaaagcagaagcaactgattgctgagtggaaaaaaaacgcggaaaatctggaaggcaaagtcatatctctgcaggagtgtctggacgaagcaaacgccgcactggactcggctagccgcctgacagaacaactcgacgttaaagaggaacaaattgaggagcttaaacgtcagaacgagttaagacaggagatgctggatgatgtccagaagaaactgatgtctttagcgaattctagcgaggggaaggtcgacaaagtgctgatgaggaacctgtttataggtcacttccacacacctaagaatcagagacacgaggtcttgagactgatgggtagtatactaggagtgcggcgggaggaaatggagcagcttttccacgacgatcaggggggtgtgacccgctggatgactggctggctgggcggcgggtccaagtcggtcccgaacactcccctccgcccaaaccaacagtctgtggtcaactcttctttttctgaattatttgtgaaattcctcgagacagagtctcacccctccatccctcctccaaagctgagcgtccacgacatgaaacctttagattctcctggccgccggaagcgcgatacaaatgcccccgagtctttcaaagacacagcagaatcacggagcggacggcgcaccgacgttaacccctttcttgctccacgatccgccgcggtcccattgatcaatcccgccgggctgggcccgggggggcccggccacctccttttgaaacccatctccgacgtgctgccgacctttactcctctccctgctctgcctgataacagtgctggtgtagtgttaaaggatctacttaagcagtag

SEQ ID NO: 137865 - DNA, 5979 bp, Artificial Sequence
  Description of Artificial Sequence: Synthetic coding sequence
atgtccaatagacccaacaataatcccggcggctctttgcgtaggtcgcaaagaaataccgcaggagcccaaccacaggatgattctatcggaggccgcagttgcagctcctcttccgctgtcatagtgccccagcccgaggatcccgatcgggctaacacctctgaacgccagaagactggccaggtgcccaagaaggacaacagccggggggtgaagagatctgcctccccagactataacaggacgaactcacccagttcagctaaaaaacccaaagcccttcaacacaccgagagcccctccgagactaataaaccccattcaaaatccaagaaacgccaccttgaccaagagcaacagctcaaatctgcacagagcccaagtacctcgaaggcccatacacggaagagcggcgcaaccggaggctctagaagccaaaagcgaaagcggacagagagctcctgcgtaaagtcaggtagcggctccgagtctacaggtgccgaggagaggtccgcgaagcctacaaagctggccagtaagtccgcaacgagcgctaaagctggatgtagcaccataactgatagctcatcagccgccagcacctcgtcctcatcaagcgccgtggccagcgcttcctcaacagtgccaccgggtgcgagggtgaagcagggcaaagatcaaaacaaagctagacgcagcaggtctgcctccagcccgtctcctcgacgctctagtcgggaaaaggagcaaagcaaaaccggcgggtcatctaaatttgattgggctgctcgcttctcaccaaaagtgtccctgcctaaaacaaagctgagccttccgggctcttccaagagcgagacgagcaagcccgggccgtcaggcctgcaggcaaagctcgcctctctgaggaaatctacaaaaaagcgctcagaatccccccctgcagaactgccttcgctccggaggtccaccagacaaaaaacaacgggatcatgcgcttctacctctagaagaggctctgggctcggcaagcgtggtgccgccgaagcgagacgacaggaaaagatggctgacccggagtcgaatcaggaggctgtgaactccagcgccgcaaggaccgatgaagccccacagggcgccgctggggctgtgggaatgactactagtggagaatccgagagtgatgattctgaaatggggcggctccaggcccttctggaagctcgtgggttaccgcctcacctgttcggacctctaggccctagaatgagccaactctttcacagaaccatcgggtctggggccagttcaaaggctcagcagttactgcaggggttacaggcttccgacgaatcccaacagctgcaggcggtgatcgaaatgtgtcagctgctcgtgatgggcaacgaggaaacacttggagggttccccgtcaaatccgtggtgccggcactgataactctgctgcagatggaacacaacttcgacattatgaaccacgcctgtcgtgcactgacgtacatgatggaggctctaccaagatcctccgccgtcgtggtcgatgccatacctgtgtttctcgaaaagctccaggtgattcaatgcattgacgtggcagagcaggccctgactgccttggagatgctgagcaggagacattcgaaggcaattctgcaggctggtggactcgctgactgtttgctatatcttgagtttttctccatcaatgcacagcgaaatgccctcgctatcgctgctaattgctgccagtccattacgcccgatgaatttcactttgtggccgactccctgccccttctgacacaacggttgacgcaccaggacaagaagtctgtcgagtctacttgcttatgctttgctcgccttgtggacaatttccagcacgaggaaaacttgctacagcaggtagctagcaaagatttgttaaccaacgtgcaacagctgctagtcgtcacccccccaatactttcttcgggcatgtttatcatggtcgtgcggatgttttcactaatgtgtagcaactgtcctactctagcggtgcagttaatgaagcagaatatcgcggaaactctccacttccttttatgtggggcttccaacggtagctgccaggaacaaatcgacctagtccctcggagtccccaggagctgtatgagctcacgtctcttatctgcgaactgatgccatgcctgcctaaggaaggcatctttgccgtggataccatgctcaaaaaaggcaatgcccagaacactgacggtgcaatctggcagtggcgcgacgacaggggtctttggcacccttataaccgcatcgatagcagaatcattgagcagattaacgaggacacaggaactgccagagccatccaaagaaaacctaatccactggcgaactctaacacctccgggtactcagagtctaaaaaagatgatgcaagggcccagctgatgaaagaggaccctgagctagcaaagagctttattaaaacactctttggggtcttgtacgaggtatattcttctagcgccggcccagccgtccggcacaagtgtttaagagcaatactcaggatcatttatttcgccgatgccgagctgctgaaggatgtactcaaaaaccacgcggtgagctcccatatcgcatctatgctcagtagccaggatctgaaaattgtcgtcggggcactccaaatggccgaaattttaatgcagaagcttcctgacatattctccgtttacttccgccgggagggagtcatgcatcaggtcaaacacttagccgagtccgagtctctgctgaccagcccaccaaaggcttgcacaaacgggtccggatcaatgggatccacgacatccgtcagctcaggaactgcaaccgccgcgacccacgctgccgccgacttaggctccccttccctccaacattcgcgcgatgactccctggacttaagccctcaggggagattgtctgatgtgctgaagagaaagaggctgcctaagaggggaccccgacgtcccaagtacagcccacccagagacgatgataaggtcgataatcaggcgaagtcccctactacaacccaaagcccgaagagcagctttctggccagtctgaatccaaaaacctggggacggctgagcacacagtccaactcaaacaatatcgagcccgcccgaaccgcagggggcagtggactagccagggctgcctccaaagacaccatctctaataacagagagaaaatcaaaggatggatcaaagaacaggcacacaagtttgtggaacgttatttcagttctgaaaacatggacgggtccaaccctgccctgaatgtactgcagagactgtgtgcagccacagaacagcttaatttgcaagtggacggcggggctgaatgcctagtcgaaatccgctcaatcgtgtcagaatctgacgtatctagctttgaaattcagcacagcgggttcgtgaaacagctgctgctttacctcaccagcaagtccgaaaaagatgccgtatccagggaaattcggctgaagcgctttctgcacgtcttcttctcttcccccttgccgggcgaggaaccaattgggagggtggagccggtggggaatgctcctttgctggccctagttcacaaaatgaacaactgtctttcgcagatggagcagttccctgtgaaagtgcacgactttccttctgggaatggaactggcggttccttttcgctgaacaggggctctcaagccctgaaattcttcaacacccatcagttgaagtgccaactgcaacggcacccagactgcgccaacgtgaaacagtggaagggaggcccagtgaaaatagatccactggccttggtgcaagctattgaaaggtatttggtcgttaggggatacgggagggtcagagaagacgacgaggatagtgacgacgacggctctgatgaagagatcgatgagtctcttgctgctcaattcctgaactccggtaacgtccggcaccggctgcagttttacataggagaacacctgttgccatataatatgacagtgtatcaggctgtcagacaattcagtattcaagccgaggacgagcgcgaaagcacggacgacgagtccaatccactgggcagagccggaatttggacaaaaacccacaccatttggtacaagcccgtgagagaggacgaggagtcaaacaaagattgcgtcggcggtaagcgagggagagcacagacagctcccaccaaaacctcaccgagaaatgccaagaaacacgatgagctctggcacgacggcgtgtgtccgtcagtgtccaatcccttggaggtgtacctcatcccaactcctcccgaaaacattaccttcgaggacccttcgctggacgtcattctgctcctaagagttttacatgcaatctctcgctattggtattacctgtacgacaatgcaatgtgcaaagagatcatcccaacctccgaattcatcaactccaaactgacagctaaagccaaccggcagcttcaagaccctctcgtgattatgactgggaacatcccaacctggctcactgaattaggcaaaacatgcccctttttttttcctttcgataccagacagatgttattttatgttactgcgtttgaccgggatcgcgccatgcagcgcctcctggataccaatccggagataaatcagagtgattctcaagacagtcgagtcgccccacgcctagaccgtaagaaacgcaccgtcaatagggaggagctcctgaaacaggccgagagcgtaatgcaggacctaggcagttctcgcgcgatgctcgaaattcagtacgagaacgaagtcggcaccgggttaggccccacgttggagttctacgctctagtttcccaggaactgcagcgggctgacctgggactgtggcgaggggaggaagtcaccctttccaacccaaaaggctcccaggaagggaccaagtacatccaaaatttgcaaggcctcttcgccttgccttttggaagaacagcaaaaccggctcacatcgccaaagtcaaaatgaaatttcgatttctgggcaagctaatggcaaaagcaattatggattttaggctggtggacctgcccctcggattgccattttacaagtggatgcttaggcaggaaacctccctaacctcccacgacctctttgacatcgatccagtggtcgctcgctccgtctatcacctggaagatattgttcgccagaaaaaacgcttagagcaggacaagtcacagacaaaagaaagcctccagtacgcactcgaaacacttaccatgaacggctgcagcgttgaggacctgggcctcgactttaccctgcctggcttccccaatattgaactaaagaaagggggtaaagacatcccagtgactattcacaatctggaagagtacttgaggctcgtgatattttgggccctgaatgagggtgtgtccagacagttcgactcatttcgtgacggcttcgagagcgtgtttcctctgtctcatttgcaatacttttaccctgaggagctggaccagcttctgtgtggaagtaaggccgatacttgggatgctaaaacgctgatggaatgctgcaggcccgatcatgggtacactcacgactcacgggcggtcaaatttctttttgagatcctctccagcttcgacaatgagcagcagagactatttctgcagttcgtgacgggctctccacgtttgcctgttggcggatttcggtccctgaaccctccactgacaatcgtgagaaagacgtttgagtccacagaaaaccccgatgatttcctgcctagcgtgatgacatgcgtcaattaccttaaactgccagattactctagcattgagattatgagagaaaaactgcttatagcggctcgtgaaggtcaacagagtttccacctttcctag

SEQ ID NO: 137866 - DNA, 300 bp, Artificial Sequence
  Description of Artificial Sequence: Synthetic coding sequence
atgagcaatcgccctaataataatcccggcggcagcctgaggaggtcccagagaaacactgccggcgctcagcctcaggacgacagcataggcggcagatcgtgtagctcttcaagcgcagtgattgtgccccagcccgaagacccggatagggcgaatacctctgaacgtcagaagactggccaggtacctaaaaaagacaattcccgaggcgttaagcgaagcgccagccccgattacaacagaaccaattcaccgtcatcagctaagaagcccaaggccttgcaacatacagaatag

SEQ ID NO: 137867 - DNA, 6123 bp, Artificial Sequence
  Description of Artificial Sequence: Synthetic coding sequence
atgtccaacagaccgaacaataacccaggaggcagcttgcggcgaagtcagcgaaataccgccggagcccaacctcaagatgatagcataggcgggcggtctcatcttggacaggcgaagcacaaagggtatagcccacccgagagccggaaatccaactcaaaagcccccaaggtccagagcaatacaaccagcgaactctccagagggcatctcagcaaaagaagctgcagctcgtcttctgcggtgattgtgccacagcctgaagacccggatagagccaacacaagcgaaagacagaagacagggcaggtgcccaaaaaggacaattcaagaggagttaagcgatctgcatcccccgattataatcgaaccaacagtccttcaagcgcaaaaaaaccaaaagcacttcaacacaccgagtctcctagcgaaactaacaaaccccatagcaaaagcaagaaacgccacctagatcaggaacagcagttgaagagcgctcagtctcctagcacaagcaaagcccacactaggaaatctggagccacgggaggcagccgtagccaaaaaaggaagaggactgaatccagctgtgtgaagtctggaagcggttcagaatcaacaggcgccgaagagagatccgccaaacctacaaagctcgccagcaagagtgccacatctgccaaggccgggtgctccaccatcacagatagtagcagcgcagcgagcaccagtagcagtagttcagctgttgctagcgcctcctcaactgtccctcccggggcccgggtcaaacagggtaaagaccagaacaaggcgcgccgaagccggtcggcctcgtctccctcacctcgacgcagttctcgagagaaggagcagagcaagaccggtggcagcagcaaattcgactgggcagcgagattctcccccaaagtcagcctccctaaaactaaactcagcctgcccggaagtagcaagagcgagaccagcaaaccaggcccaagtggactccaagcgaaacttgcctccctgaggaaatcaactaaaaagcgtagtgagagtcctcctgccgagttaccctcgctgaggaggagcactagacaaaaaaccaccggtagttgtgcttccaccagccgccggggctccgggcttggaaagcggggcgctgctgaagctcgtagacaggagaagatggcagatcccgagagtaatcaagaagccgtgaatagttcagccgcccggacggatgaagctccgcagggagctgcggcttcttcaagtgtcgccggagctgtaggaatgaccacttccggggagtccgaaagtgatgactccgagatgggccgcctacaggccctgctggaggcccgagggctgccacctcatcttttcggaccgctgggcccccgaatgtcacagttgtttcatagaactattggctcaggcgcttcctctaaagcacagcaactgttgcaggggctccaagcctctgacgagtcccagcagcttcaagcggttatcgaaatgtgtcaattattggtgatgggcaacgaagagactcttggagggttccctgtgaaaagcgtcgttccagcattgatcacccttttacaaatggaacacaattttgacattatgaaccatgcttgcagagctcttacctatatgatggaagcactgccgcgttcctcagccgttgttgttgatgctataccggtgttcctggagaagttgcaggtcatccagtgcatcgatgtcgctgagcaggctctgactgcactcgagatgctgtctcgccggcactctaaggcaattctgcaggccggtggccttgctgactgcttgctttacctcgagttcttttcaattaacgcccagagaaatgcacttgccattgcagctaactgctgtcagagcattaccccagacgagtttcacttcgtcgccgactctcttcccctgctgacccagcggctgacacaccaggataagaaatccgtcgaaagcacgtgcttgtgctttgcgagattagtggataactttcagcacgaagaaaatctacttcagcaggtggcctcaaaagacctcctcaccaacgtccagcagctgctggtggtgacgccaccgattctctccagtggaatgtttatcatggtagtgcgaatgttttcgcttatgtgtagtaattgtcccaccctggccgtacagttaatgaaacaaaatattgctgagacgctccacttcctgctgtgcggcgcttcaaacggatcctgccaggaacagatagaccttgtgccgcgctcaccgcaggagctctacgagctgaccagcctgatttgtgaactcatgccctgcctacccaaggaggggatcttcgcagtggatacaatgctgaagaagggaaacgcccagaataccgacggtgccatctggcaatggcgggacgacagaggcctgtggcacccctacaacaggattgactcacgcatcatcgagcaaatcaatgaggacaccggcacagcacgtgctatacagcgaaaaccgaacccgctcgcaaactccaatacatcggggtatagtgagtccaaaaaggacgacgccagggcacaactgatgaaagaggatcccgaactggctaaatccttcatcaaaacgcttttcggcgtgctgtacgaggtgtactcaagtagtgccgggcccgcggtgcggcacaaatgcctgagggccattcttagaatcatctattttgccgatgcagagctgttgaaagacgttctaaagaaccacgccgtctctagccatattgcttccatgcttagcagccaggacctgaaaatcgtggttggcgccctgcaaatggccgaaattctgatgcagaaactacctgacatcttttcggtgtactttcgaagagaaggtgtgatgcatcaggtcaaacatctggccgagagcgagtccctgctgacctctccccctaaggcctgcacaaacggttccggcagcatgggcagcactacctccgtctcaagcgggactgccactgctgcgacacatgcagccgctgatctgggcagtccttcacttcaacactccagagatgactcactcgacctgtcacctcagggcaggctgagcgacgtactgaagaggaaacgccttccaaagcgtggcccccggcgtccaaagtacagccctcctcgggacgatgacaaggtcgacaaccaggctaaaagtcccactactacacagtcacctaagtctagttttttagcaagcctgaatcccaaaacctggggcaggctcagcacccaatcaaattcaaataatatcgaaccagccaggactgccggcggaagcggcctggcgcgcgctgcctcaaaagacactatcagtaataatcgcgaaaaaatcaaaggctggattaaagagcaggcccacaagttcgtggaaaggtacttctctagcgagaatatggacggaagtaatcccgctcttaacgtgctgcagaggctatgtgcggccaccgaacagttgaaccttcaggttgacgggggggccgaatgcttggtggagatccgctcaattgtgagcgaatctgacgtaagctccttcgaaattcagcactcgggctttgttaagcaattgcttctgtacctcaccagcaaatccgagaaagacgcagttagcagagaaatacgcctcaagaggttccttcacgtgttcttttcttctcctctgcctggagaagagcctatcggaagggtggagcctgttggtaatgcgcctctcctcgccctggtgcacaagatgaataattgcctctcacagatggaacagttcccagtgaaggttcacgattttcccagtgggaacggtactggtgggagcttctctttaaatcgcggctctcaggctctaaaattttttaatactcaccagctcaaatgccagttgcagcgccaccccgattgtgctaatgttaagcaatggaagggcggtcctgtgaagatagacccgcttgcacttgtccaggccatcgagaggtatctggtcgttcggggttacggtcgggttcgagaggacgacgaggactctgacgacgacgggtccgacgaggagatcgatgaaagcctggccgcccagtttctcaatagcggaaacgtgcgccatcgcctacagttctatatcggcgagcatctgctcccctataatatgacagtgtatcaggcagtcaggcagttttctatccaggccgaagacgagcgtgagtcaaccgatgacgaaagtaatcccttaggccgcgcaggaatctggactaaaactcatacgatctggtacaaaccagtcagagaagatgaggaatctaataaagactgtgtcggtggaaagaggggtagagcccaaacagcgccaacgaaaacatccccccgaaacgcaaagaagcatgatgaactgtggcatgatggtgtatgcccttctgtctctaatccactagaagtctacctgatacctactccccccgaaaatattacatttgaggacccctccttggacgttattcttctgctgcgggtcctgcatgcaatttccagatactggtactatctgtacgataacgctatgtgtaaggaaatcattcccacaagcgagtttatcaacagcaaactgacagccaaagccaaccgccagctccaggatcctttagttataatgaccggtaatattcctacctggcttactgagctgggcaagacatgccccttcttctttcctttcgacacacgtcaaatgcttttctacgtcactgccttcgaccgcgacagggctatgcagcgcctgctggataccaacccagagattaaccagagtgactctcaggactctagggtcgctccgagactggatcgcaaaaaaagaactgtgaacagggaagagttgctgaaacaagcagagtccgtcatgcaggacctgggttcatctagggccatgcttgaaattcagtatgaaaacgaggtgggcacaggacttggacccacactggaattctacgccctcgtgtctcaggaactacagagagcagatctcggcctttggcgtggagaggaggtgacactttcgaatcccaaggggagccaagaaggaactaaatacatccagaaccttcaggggctgtttgctctgccattcggacgcaccgccaaaccagctcatatcgctaaagtgaaaatgaagtttcgcttcctcggcaagctcatggccaaagctatcatggattttaggctggtcgacctgcctctgggcctgcctttctataagtggatgctccgccaagagacatcactgacttctcacgatctctttgatatcgaccccgtcgtggcacggagcgtttatcacttagaggatatcgtgcgccaaaaaaagcggctcgagcaggataagagccagacaaaggaaagtcttcagtatgcactggaaaccctgacaatgaacggctgcagcgtcgaggacctggggctagatttcacgctcccaggattcccaaatatagaattgaagaagggcgggaaggatatccctgtgacgatccataatctggaagagtatctgaggctcgtgatattttgggcgttaaatgaaggcgtttcgaggcagttcgactctttccgtgacggctttgaatccgtttttcctctgtcgcacttgcagtacttttaccccgaagagttagaccagctgttatgcggatctaaagctgatacctgggatgcgaagaccctcatggaatgttgccggccagatcacggatatacacacgattcacgagcggtcaaatttttgtttgagatccttagctcatttgataacgaacaacaacgactgttcctccagtttgtgactgggtccccccggttgccagtgggcggctttaggagcctgaatcctcccctgactatcgtcagaaagacgttcgaatcaaccgaaaacccggatgactttttaccctcagtgatgacttgcgtgaattatctgaagctgccagattactcgagcatcgagattatgagggaaaaactgctgatagcagcgcgcgaaggacagcagtctttccacctctcatag

SEQ ID NO: 137868 - DNA, 5169 bp, Artificial Sequence
  Description of Artificial Sequence: Synthetic coding sequence
atgagtaatcggccgaacaataatcccggaggctcattgaggcggagccagcgaaatacagcgggtgctcagcctcaagatgacagcatcgggggaagcaggcggggctccggacttggtaagcgcggtgccgccgaggcccggaggcaggagaagatggccgatcccgagtctaatcaggaagcggtcaactcatcagctgctcggacagatgaggcccctcagggcgcagctgctagctcctcagtggcaggcgcggttggcatgacgacctcgggcgaaagtgagtccgacgattccgagatggggcgcctccaggctttgcttgaggcccggggcctgcctcctcacctgtttggacctttgggaccccgcatgtcacagctgtttcatcgcactatcggcagtggggcctcatccaaggcacagcagttgctgcaaggcctgcaggcttccgacgagtcacagcaacttcaggcggtgattgaaatgtgccaattgctcgttatggggaatgaggaaaccttaggaggtttccccgtaaagagcgtggtccccgctctcatcacgctcttgcagatggagcataattttgatattatgaaccatgcttgcagagcgctcacttatatgatggaggccctcccaagatcctccgccgtggtggttgatgcaatacctgttttcctagagaagctgcaggtcattcagtgtattgacgtcgccgaacaagccctgaccgcgctggagatgctaagtcggcgccacagtaaggcaatcctgcaggcgggcggccttgctgactgcctcctgtacttagagtttttctctatcaacgctcagagaaatgcgcttgccatcgccgcaaattgctgccagagtatcacaccagatgaatttcatttcgtggccgatagtctccccctcttgacacagcgcctaacacaccaagacaagaaaagcgtcgagagtacctgtttgtgttttgcgcgactggtcgataacttccagcatgaggaaaacctgctgcaacaggttgcgtctaaagaccttctgaccaatgttcagcagctcctggtggtcaccccccccatcctgagttcaggcatgtttatcatggtcgtgcgaatgttcagcttaatgtgcagtaattgtcctacccttgcagtccagttaatgaaacagaacatcgctgaaacactccacttccttctctgcggcgccagtaacggcagctgccaggaacaaattgacctggtgcctcgctctccccaggagttgtacgagctgaccagtttgatctgcgaactgatgccctgcttacccaaggaaggaatttttgccgtcgacacaatgcttaagaaggggaacgcccaaaatacggatggagcaatttggcaatggagagacgatagaggtctatggcacccttataaccggatcgatagccggatcatcgaagccgctcaccaggtaggagaagacgaaatctccctgtccaccctgggacgcgtgtacactatagattttaactcgatgcagcagattaatgaagacactggtactgcgcgcgcaatccaaaggaagcctaaccctctggccaattctaacacctctgggtattctgaatcaaagaaagacgacgccagagcacagctgatgaaggaagacccagaacttgccaaatccttcataaagaccctgtttggagtactgtatgaggtatactcttcctctgctggccctgctgtcaggcataagtgtctcagggctattctgcgaatcatttactttgccgacgccgaacttctaaaggatgtcctaaagaaccatgctgtgtcgtcacacatcgcaagcatgctctctagccaggatctaaagattgtcgtgggggctttgcagatggctgagatactaatgcaaaagctgccagacatctttagtgtgtattttcgacgagaaggagtgatgcatcaggttaagcacttggctgagtctgagagtcttctgacctcacctcccaaagcctgtacaaacggaagcggatcaatgggcagcacaaccagcgtgtcctctggcacagcaacagcagccactcatgctgcagcagatctggggtctccgagtttacaacactcccgcgatgatagcttggatctaagtccccaaggcagactcagcgatgtgctaaaaagaaaaagactacccaagagaggcccacgccggcccaaatactcccctcctcgggatgatgataaggtggacaaccaagctaaatcaccgacgacgactcagagccccaagagttcctttctcgcgtcattaaatccgaagacctggggacgtctgagtacacagagcaattcaaacaacattgagcccgccaggaccgccggggggtctggactcgcccgagccgccagtaaggataccatttccaacaaccgggagaaaattaagggctggatcaaagagcaagcacataagtttgtggagcggtatttctcgagtgagaatatggacggatccaatccggctttaaatgtgctacagaggctgtgcgccgctactgagcagctgaacctgcaggtcgatggaggtgctgagtgtctagtcgaaatacgaagtatcgtgtccgaatctgatgtctcgagcttcgagatacagcattccggttttgttaagcagctacttctgtaccttacctctaagagtgagaaagacgctgtgagcagggaaatccgattaaaacgattcttgcacgtcttcttttcctcgccgttacccggcgaggaaccgatcggaagagtcgagccagtgggcaacgccccgttgctcgcgctggtgcataagatgaacaattgtttgagccagatggagcagttcccagtgaaggtccacgatttcccgtccggaaatggcaccggggggagcttctctctgaaccgcggttcacaggcgctgaaattttttaacacacaccagctgaaatgccaactgcagaggcaccccgattgtgccaatgtgaagcaatggaaaggcgggcccgtgaagatcgacccattggccctggtacaggcgatagaacgttacctcgtcgtgcgcggctatgggcgcgtgcgagaagacgacgaagacagcgatgacgatggaagcgatgaagaaattgacgaaagtctagctgctcagttcttaaacagcggaaacgtgcggcatagacttcagttctatattggggagcatcttctaccatataacatgactgtctaccaggctgtccgacagttcagtatccaggctgaagacgagagggaaagcactgacgatgaatctaaccccctcggccgagccgggatatggaccaaaactcacaccatctggtacaagcctgtcagggaggatgaggagtctaataaggactgtgttgggggaaagaggggaagagcccagacggcccccaccaaaacatcgccaagaaatgctaaaaagcatgatgaactctggcatgatggggtgtgtccctctgtcagcaaccccctggaagtgtaccttatcccaactccccctgaaaatatcacttttgaggacccctcgctagatgtcattcttctcctccgggtacttcatgccatttcccgctactggtactatctgtacgacaacgcaatgtgcaaggaaatcatccccacatccgaatttatcaattctaagcttaccgccaaagctaatcgccagctacaggatcctctcgtgatcatgacgggtaatatcccaacctggcttacagaattaggcaagacttgcccattcttttttccattcgacacacggcagatgcttttttatgtgacagcgttcgaccgcgatagagcaatgcagagacttctggatacaaaccccgagataaaccagtccgacagccaagacagccgggtggcaccccgcctcgacaggaagaagcgtaccgttaatcgggaggaactcctgaaacaggctgaatctgtcatgcaggacctagggtcctcccgggctatgctcgagattcagtacgagaatgaggttggaactggactgggcccgacactggagttctatgccttagtgagccaggaactgcaacgtgctgatcttgggctatggcggggggaagaagtgacccttagcaaccccaaaggaagccaggagggaactaagtatattcagaatctgcagggcctgtttgcgctgccctttggccgcactgctaaacccgcccacatcgcaaaggttaaaatgaaattcaggtttctgggaaagttgatggctaaggccattatggatttcagactggtggatctgccccttggcctgccgttttacaagtggatgcttcgtcaagaaacgagtctgacaagccacgatctgtttgatattgatccagtcgtagctaggtctgtgtatcatctagaagacatcgtgcgtcaaaaaaaacgtctggagcaggacaagtctcagaccaaggagagccttcagtatgccctagaaacattgaccatgaatggctgctctgttgaggacctgggactggacttcactttaccaggttttccaaatatcgagctcaagaaggggggcaaagatatccctgtgaccatacataacctagaggaatacttgaggctagtgatcttttgggccctgaacgaaggcgttagtcgacagtttgactcttttcgggatgggtttgagtccgtgttcccactctcgcacctccaatacttttacccggaggagttggaccagctgctatgcggcagtaaggctgatacatgggacgcgaagacccttatggagtgttgcaggcccgaccacggttacacacacgactcaagagccgtgaagttcctctttgagatcttatcctccttcgataatgagcagcagagactattcctgcagtttgtgacaggcagtcctaggttgccagtgggcgggttcaggtctctgaatcccccactgacaatcgtgagaaagacattcgagagtaccgagaaccccgatgactttctgcctagtgttatgacttgcgtgaattatctgaagttgccggactacagctctattgaaattatgagggagaagttgcttatcgccgccagagaagggcagcagtcattccaccttagttag

SEQ ID NO: 137869 - DNA, 450 bp, Artificial Sequence
  Description of Artificial Sequence: Synthetic coding sequence
atgtccaacagacccaataataacccgggcggcagcctgcgtaggagccaacgcaacaccgcaggtgctcagccacaggatgactcaatcggcggcaggtcatgttccagtagctccgctgttatcgtgccacaacccgaggaccctgaccgggccaatacatccgagcgacagaaaaccggtcaggtgcccaagaaggacaactcacgaggggtgaaacgctccgcatcccccgactataaccgcacaaacagcccaagctccgcaaaaaaacccaaggcacttcaacacactgaatccccatcagagactaacaagccccatagcaaatccaaaaaaagacatttagaccaggaacagcagctgaaatccgcccagtctccaagcacttccaaagctcatactagaaagtcgggcgctaccgggggctcgcggtcccagaagaggtag

SEQ ID NO: 137870 - DNA, 465 bp, Artificial Sequence
  Description of Artificial Sequence: Synthetic coding sequence
atgtctaaccggcccaacaataatccgggcggtagcctccggcgttcacagcgaaacactgctggggctcagccacaggacgattcaattggcgggcgcagctgcagctcttcatctgcagtcatcgtaccacagccagaggatcctgaccgcgccaatacatcggagcgccagaaaaccgggcaggtgcctaagaaagacaacagcagaggcgtaaaacgatctgcctcgcccgactacaatcgaaccaatagcccttcaagcgccaaaaagcccaaagccctccagcacaccgaaagcccatctgagaccaacaagcctcatagcaagtccaagaaacgccacctcgatcaggaacaacagctgaagtccgcacaatccccaagtacatccaaggctcacacacgcaaatccggtgctacaggcgggagccggtcacaaaagaggaagcgcactgagtcttag

SEQ ID NO: 137871 - DNA, 1041 bp, Artificial Sequence
  Description of Artificial Sequence: Synthetic coding sequence
atgtcgaacagacccaacaataacccaggtggaagtttgagacgctcccagaggaacactgcaggggcacagcctcaggatgattccatcggtggacgctcacacctcggacaagcgaagcataagggatactctccccctgagagccgaaaatcaaattccaaggcccctaaagtgcagtcaaacacaacctccgagttgtctagaggccacctatccaagagatcatgctctagtagcagtgctgttattgtcccgcaacccgaggatccggacagagccaatacatcagagcgccagaaaacagggcaggtaccaaagaaagataattccaggggcgtcaaacgtagcgcgagcccggattacaacagaacaaattcgccatccagcgccaagaagccaaaggctttgcaacataccgagtccccttcggaaactaataaaccacacagcaagagcaagaaaagacatttagatcaggaacaacaacttaaatccgcccaatcgccatccactagcaaggcacacacgcgtaagtccggagccaccggtgggtcccgtagccaaaagcggaagagaaccgagtcttcctgcgtgaagtctggctccgggtccgagtccacaggggctgaagaacgctcagcgaagcccaccaagcttgccagtaagagcgctacatctgctaaagccggctgtagcacaataactgactcttcatctgctgcgtcaacgtcctcatcatccagcgcggtcgcctcagcctctagtacagtccctcctggtgcccgtgttaagcaaggtaaggatcagaataaggcacggcgcagccggtctgcctcaagccctagcccacggagaagcagcagggagaaagaacagtccaagaccggcggttcctctaagttcgactgggccgcaagattttctcccaaagtgtctttgccaaagacaaagctgtcccttccgggatctagcaaatcagagacgtccaagccagggccgtccggtctgcaggcgaaggtgctcacctcgaaaaggtag

SEQ ID NO: 137872 - DNA, 1746 bp, Artificial Sequence
  Description of Artificial Sequence: Synthetic coding sequence
atggccgtggccggtgccgtttccggcgagcctttggtacattggtgcacacagcagctccgcaagactttcggcctcgacgtaagcgaggagataatccaatatgtgctgtcaatcgagtcggcagaggaaattagggagtacgtcaccgacctgttgcagggcaatgagggaaagaaaggacagtttattgaggagctcattaccaagtggcagaaaaatgatcaggagttgatttctgaccccctgcagcagtgcttcaagaaagatgagattctggatggccagaaaagtggcgaccacctgaaacgcggccgtaagaagggtagaaacaggcaagaggttccagctttcaccgagccagacaccactgccgaggtcaagacaccattcgatctggctaaagcacaagagaactcaaatagtgtcaaaaagaagactaaatttgtgaacctgtacacgagggaagggcaggacagactggccgttctgctgccaggcaggcacccgtgtgactgtctcggacagaagcataaattgatcaataattgtttgatctgcggaagaattgtttgcgagcaggaagggagcggtccgtgtctgttctgcggcactctggtgtgtacccacgaggagcaagatattttgcaaagagatagcaataagtctcaaaagctgctgaagaaacttatgtctggtgtggagaattctggaaaggttgacatttcgacgaaggaccttttgccacatcaggaactgaggattaagtctggattagaaaaagccatcaagcacaaggacaagcttctggagttcgacagaacttccattcgccgtacacaagtcattgacgatgagtctgactacttcgcctcagactccaaccagtggctgtccaagctggaaagagagactctccaaaagagggaagaggaactaagagaactgcgccacgcatcccggctgagcaagaaggtcacgattgactttgcggggaggaagattcttgaggaagaaaatagcctggccgaataccacagccgtttagatgaaacaatccaggctattgctaatggcacccttaatcagccactcacaaagcttgaccgaagctccgaggaaccactaggtgttctcgtgaaccctaacatgtaccagtctcctccccagtgggtggaccacacaggcgctgcatcacagaaaaaggcgttccgaagctccgggttcgggctagagttcaatagctttcagcatcagcttcggattcaggatcaggaattccaggagggatttgatggcggatggtgtctgagcgtgcaccaaccgtgggccagcttactggtgagggggataaaaagggtggaaggtaggtcttggtacacccctcacagaggacggttgtggatagcggcaaccgcgaaaaagcctagcccccaagaggtgtccgaactccaggccacttatcgattattgcgcggaaaagacgtggaattccccaacgattacccaagtggatgtctgcttggttgtgtggatctaattgattgcttgtcccagaagcagtttaaggaacagttccccgatatctctcaggagtctgatagcccttttgtctttatttgtaaaaaccctcaggagatggttgttaagtttccaatcaagggcaatccaaaaatctggaagctggacagcaaaatccaccaaggcgctaagaaagggctgatgaaacagaataaagcagtgtag

SEQ ID NO: 137873 - DNA, 1431 bp, Artificial Sequence
  Description of Artificial Sequence: Synthetic coding sequence
atgagtgggccaacctggcttccaccaaagcagcccgagccagcccgggcccctcagggaagggctataccccggggcacaccaggtccgcctcccgcgcacggcgctgctctgcaaccccatccaagagttaacttctgccctctccctagcgaacaatgttaccaggctcctggcggcccagaggatcggggtccagcatgggtcggatcccacggggtcctccagcatacacaaggcctcccagcagaccgagggggacttcgccctggtagcctggacgcagagattgacctgctaagctcaactctggccgaactcaacggaggacggggccacgccagtcgtagacccgatcgccaggcttatgaaccaccacctcctcccgcttataggaccggatctctgaaacccaatcctgccagccccctacctgcttctccctacggcggtcccactcctgcaagctacaccactgcctctactccagccggaccagccttcccagtgcaggtgaaggtggctcagccagtgcgcggatgtggcccaccgagacgcggcgccagccaggcaagtggacccctccctggtcctcacttcccgttgccaggacgcggtgaagtttggggacccggttatcgaagtcaacgcgagcctggacctggcgccaaggaagaggccgccggcgtcagcggccccgcaggacgaggccgtggaggcgaacatggaccccaagtccccctgtcacagccgcccgaggatgagctggataggctgacaaaaaagcttgtgcacgacatgaaccacccccccagcggagagtattttggccaatgtggtggctgcggcgaggacgtggtgggcgacggggctggcgttgtggcgctggatcgggtcttccatgtgggttgcttcgtgtgcagcacttgcagggcacagctccggggacagcatttctacgcagtcgagcgcagggcctactgtgaaggctgctacgttgcaacccttgagaagtgtgccacctgtagccagcccatcctcgaccgcatactgcgcgctatgggtaaggcctatcatcctgggtgtttcacatgcgtggtgtgccacagaggactggatggcataccgttcaccgttgatgccacttctcaaatccactgcattgaggatttccacagaaaattcgctccaagatgttcagtctgtggaggagctatcatgcctgagcctggccaagaagagactgtgagaatcgttgccctcgacaggtcatttcacataggctgctacaaatgcgaggaatgtgggctgctgctttctagcgaaggcgaatgtcaggggtgttacccattggatggacacatcttgtgcaaggcctgttctgcatggcgtatacaagaactaagcgcaacagtgactaccgattgttag

SEQ ID NO: 137874 - DNA, 1473 bp, Artificial Sequence
  Description of Artificial Sequence: Synthetic coding sequence
atggagcagaaacctagcaaggttgaatgcgggtccgatccggaagaaaattcagccagaagtccagacgggaagcggaagcgaaaaaacggtcaatgtagccttaagacctcaatgagtggctacatcccctcctatctggacaaggatgaacagtgtgtggtctgcggcgacaaagcaactggatatcactaccggtgtatcacctgcgagggatgtaaggggttctttcgcagaaccatacagaagaatctgcacccaacttattcttgtaagtatgatagctgttgtgttatcgataaaattaccagaaaccagtgtcaactttgtaggttcaagaagtgtatcgccgtggggatggccatggacctagtccttgatgacagcaaacgggttgctaaacgcaaattaatcgaacagaaccgggaaagacggaggaaggaagaaatgatccgcagcttacaacaaaggcctgagccaacacctgaggaatgggatctgattcacatcgctacagaggctcatcggagcacaaatgcccagggatctcactggaagcaaaggcgcaagtttttacccgacgacatcggacagtctcccattgtgagtatgcctgacggcgacaaggtggaccttgaggctttttcagaattcaccaagatcattacacccgcgataacccgggtggttgatttcgctaaaaagctacctatgttcagcgagctcccctgtgaagatcagatcatcctactgaagggctgttgcatggaaataatgagtctcagagccgccgtccggtacgacccagaaagcgacactcttactctcagcggggaaatggctgtgaagagggagcagcttaaaaatggcgggctcggcgtggtgtccgatgcgatctttgaactgggaaagtctttatcagctttcaacctggacgacaccgaagtcgcactgctccaggcagtgctgctgatgtctaccgacagatctgggttgctgtgtgtggataagatcgaaaagtcgcaggaggcatatctgctggcttttgagcactatgttaatcaccggaagcacaacatccctcatttttggccaaagctccttatgaaggaacgcgaggttcagtcttccatcctgtacaagggagccgctgccgaaggacgccccggcgggtcattgggagtgcaccccgaagggcagcagttacttggcatgcacgtagtgcagggtcctcaggtgcggcagctggagcagcagctcggggaggccgggtcccttcaaggacccgtgctccagcatcaatctcccaaatcaccccaacagcgtctgctcgaactgttgcaccggagcgggattcttcacgcgcgcgcagtctgcggagaagacgacagcagtgaggcagattcaccctctagtagcgaagaagagccggaagtttgtgaagatctcgccggcaatgccgcgtccccctag

SEQ ID NO: 137875 - DNA, 1473 bp, Artificial Sequence
  Description of Artificial Sequence: Synthetic coding sequence
atggagcaaaagccaagcaaggttgagtgtgggtctgaccccgaagagaattcggctcgatcacctgatggtaagcggaagagaaaaaacggacagtgtagccttaagacatctatgtcggggtatataccgtcttatctggacaaggacgaacaatgtgtggtgtgcggcgacaaagctacaggctaccattatcgatgtataacttgtgaaggatgcaagggttttttccgccggaccatccagaaaaacctgcacccaacttacagttgcaagtatgatagctgttgcgtgatagacaagattactcggaatcaatgtcagctttgccggttcaagaagtgtattgctgttgggatggctatggatttagtcttggacgactcaaaacgcgtggctaaaagaaaacttatagagcaaaatagagagcgaagacggaaagaggaaatgattcgcagcttgcaacaaaggcctgaaccaactccggaagagtgggatctaatccacatagcaactgaagcccacagatcaacaaatgcgcagggatctcattggaagcagcgaagaaagttcctcccggacgacattggccaatcccccattgtctctatgccagacggcgacaaggttgacctggaggcttttagcgaattcaccaaaattatcacaccagctatcacgcgagttgtcgacttcgctaaaaagctacccatgttctcggagctcccctgtgaggatcagatcattctgttgaagggatgttgcatggagattatgtccctgcgtgccgctgtgcgttatgaccctgaaagtgatacccttaccctcagcggagagatggccgttaagagggaacagcttaagaacggaggattgggggtggttagtgacgcaatatttgaactcggtaaatctctgtcagccttcaacctggacgatacggaggtggcactactgcaagctgtgctgctgatgagcactgatcggagcgggctcctgtgcgtggacaagatagagaagtcccaggaggcataccttctggcattcgagcactacgttaatcacaggaaacacaatataccccatttttggcctaagcttctcatgaaagagcgtgaggtccagagcagtatcttatacaagggggctgccgcggaaggtcggccaggggggtctcttggggtacatccagagggtcagcaactgctaggcatgcacgtcgttcaggggccacaggtcagacagttggaacagcagctgggtgaggcaggaagcctgcaagggcctgtgcttcagcaccagtctccaaagagcccgcagcagcgcctgctggagctgctgcatcggagcgggatcctccacgcaagagcggtttgcggcgaggatgactcctccgaggcagacagtccaagcagttctgaggaggaaccagaggtctgtgaagatctagccgggaatgccgcctcaccctag

SEQ ID NO: 137876 - DNA, 1233 bp, Artificial Sequence
  Description of Artificial Sequence: Synthetic coding sequence
atggagcagaagccatctaaggtcgagtgtgggtcagatcccgaagaaaactctgcaagaagtcctgacggaaagagaaagagaaaaaacggtcaatgctctctgaagacttccatgtcaggatacatcccttcttacctagataaagacgagcagtgtgtggtttgtggggacaaggctactgggtaccactacaggtgtatcacttgtgaaggctgcaagggattcttccgacgaaccatccagaagaatctccatcctacttactcatgcaagtatgactcatgctgtgtgatagataaaatcactagaaaccagtgtcagctctgtcgcttcaagaagtgtatcgctgtaggtatggctatggatcttgtcttggacgactctaaacgcgtagcaaaacgcaaattgattgaacagaaccgcgagaggcgtaggaaggaagaaatgatcagatccttacaacagagaccagagccaacccccgaggagtgggacctcatccatattgccactgaggcacataggtcaactaacgcccaggggtcccattggaaacaacggagaaagtttctgcccgatgacataggccagagtcctattgtctcaatgcctgacggcgataaggttgacctggaagctttcagcgaattcaccaagattataacccccgccatcacaagagtggtagattttgccaagaagctgcctatgtttagcgagctcccgtgtgaagatcagataatcctcctaaaaggttgctgtatggaaattatgtccctcagagcagcggtcagatacgatcccgagtcagatactctgactttgtctggggaaatggcagtgaagcgggaacagctgaaaaacggcgggcttggagtcgtgagcgacgccatatttgagctgggcaaatccctgagcgcatttaatctagacgacactgaggtggccttgctccaggcagtgctgctcatgtctacagaccgaagcggtctgctatgcgtagacaagatagagaagagccaggaagcctatctgcttgcttttgagcactacgtaaaccatagaaagcacaatatcccacatttttggcctaagctgttgatgaaggtgactgatctgagaatgattggggcatgtcacgctagccggtttttacacatgaaggtagagtgccccaccgagctttttccacccctgtttctggaggtgtttgaggatcaggaggtgtag

SEQ ID NO: 137877 - DNA, 1233 bp, Artificial Sequence
  Description of Artificial Sequence: Synthetic coding sequence
atggagcagaaacctagcaaggttgaatgtggtagtgaccccgaggagaactctgcgcgctctcctgatggaaaacgaaagcgtaaaaatgggcagtgctcacttaagacttcaatgtccggctacatcccaagctatctggataaggatgaacaatgcgtggtgtgcggggacaaggccaccgggtaccactaccgctgtatcacctgtgaggggtgtaagggtttttttcgtaggactatacaaaagaaccttcaccccacttattcctgtaagtatgacagctgttgtgtaatagataagattacacgaaaccagtgtcagctgtgcaggttcaaaaagtgtatagctgttggcatggcgatggacttggtcctcgatgatagtaagcgggtcgccaagagaaaactcatcgaacagaacagagagagacggaggaaagaggaaatgatccgttccttgcagcagcggccagaaccaacgcccgaagaatgggatctgattcatattgcaacagaggcacatcgaagcacaaacgctcagggaagtcattggaaacaaaggcggaagtttctccctgacgacattgggcagtccccaattgtatcgatgcccgatggagacaaggttgacctggaagccttttccgagtttaccaaaattatcacaccagctatcactcgggtcgtcgactttgctaaaaagctgccgatgttcagtgagttgccctgcgaagatcagatcatccttcttaaaggctgctgtatggagatcatgtctttgagggctgcagtgaggtacgaccccgagagcgacaccctgacgctctctggcgagatggcagtgaagcgtgaacaactaaaaaatggcgggctgggagttgtctcggacgctattttcgagcttgggaagagtttgagtgctttcaacctcgatgacacagaagtggctctgctccaggcagtgcttttaatgtctactgatagaagcggacttctgtgcgtagacaagattgagaagagtcaagaggcttacctgctcgctttcgagcactacgttaaccacagaaagcacaatatcccacacttttggccaaaactgctcatgaaagtaaccgacctgcgcatgataggtgcatgtcatgcaagtcggttcctgcatatgaaagtggagtgtcccaccgaacttttccctccgctcttcctcgaggtgtttgaagaccaggaagtctag

SEQ ID NO: 137878 - DNA, 1386 bp, Artificial Sequence
  Description of Artificial Sequence: Synthetic coding sequence
atgacgccgaactcaatgactgagaatgggttaaccgcctgggataagccgaaacattgtccggatcgagaacacgactggaagctggtgggcatgagtgaggcctgtctgcacagaaaatcgcatagcgaacgtaggtctacactgaaaaatgagcaatcctctcctcatctgattcagactacatggacctcctcaatctttcacttggatcacgatgacgttaatgatcaaagcgtcagtagcgcccagacttttcagaccgaggagaagaagtgcaaggggtacatcccttcatacctcgacaaggacgaactatgcgtggtgtgcggtgacaaagccacaggttatcactacaggtgcataacctgtgagggatgcaagggattcttccggcgaaccatccagaaaaatctgcatccctcatatagttgcaaatatgagggcaagtgtgtgatcgataaggtgactaggaaccaatgccaggagtgccggtttaagaaatgtatctacgtagggatggcaaccgatttggttttggatgactctaaacgattagctaagcgaaaattaattgaggagaatcgcgaaaagcgccggcgggaagagctgcaaaaatctatcgggcacaagccagagcccacagacgaagaatgggagttgattaagacagtcaccgaagcacacgtggccacaaacgcccagggatctcactggaagcaaaaaaggaagttcctgcccgaggatatagggcaggccccaattgtgaacgctcctgagggaggtaaggtcgacctcgaagccttctctcactttactaagatcattaccccagccatcacaagggtcgtcgattttgcaaaaaagctccccatgttttgcgaactgccatgcgaagaccagattatcttactgaagggatgctgtatggaaatcatgtcactgagagccgccgtgcgctacgaccctgagtccgagaccttaacgctaaatggagagatggctgtgacgagggggcaactgaaaaacggcggtctcggggtggtatccgatgccatctttgatcttgggatgagcctgtcatctttcaatttggatgatacggaagtcgcgttactccaagccgttctgcttatgagtagtgatagacccgggctcgcttgcgttgaacggattgagaagtatcaggattcattcctactggcctttgagcactatatcaactacagaaagcatcacgtgactcatttctggccgaagttgctgatgaaggttaccgacctccgcatgatcggagcttgccacgcgagcaggttcttgcacatgaaggtggagtgccctaccgaactgttcccacccttatttctcgaagtattcgaagattag

SEQ ID NO: 137879 - DNA, 1386 bp, Artificial Sequence
  Description of Artificial Sequence: Synthetic coding sequence
atgactccaaactctatgactgaaaatggcctgactgcctgggataaacctaagcattgccctgatcgggagcacgactggaagttggttggaatgtctgaagcttgcctacacaggaagagccacagtgaaaggcgcagtactctgaagaacgagcagagcagcccccacctcatccagactacttggaccagcagtatcttccacttggatcatgatgacgtgaatgaccagagtgtttccagcgcccagaccttccagacagaagagaagaaatgcaaaggctatattccgagctatctggataaagacgaactctgtgttgtgtgcggcgacaaagcaaccgggtaccattacaggtgtatcacatgtgagggctgcaagggcttttttcggcggacaatccaaaagaacctgcatccctcgtatagctgcaaatatgaaggaaagtgtgttattgataaggtgacccgtaaccaatgccaggaatgccgcttcaaaaaatgtatttatgttggaatggccacggacttagtgctggacgatagtaagcgtttagcaaaacggaaactcatcgaagaaaatagggagaagcgacgtagggaagaactgcaaaagtcgattggccataagcctgagccaacagatgaggagtgggagttaataaagacggttactgaggcccacgtcgccacgaacgcgcagggctcacactggaagcagaaaagaaagttcttaccagaggacatagggcaggcacctatagtgaatgctcccgagggtggaaaggtagatctcgaagcgttttcacattttacgaaaattatcactcccgctatcacgcgggtggtcgacttcgccaagaaacttcctatgttttgtgaactcccttgcgaggaccagatcatcctgctcaagggctgctgcatggaaataatgtcactgagggctgccgtgcgttacgacccggagtccgagacactgaccctcaacggagagatggcagtcacgagaggacagttgaaaaacggcggcctgggcgtagtttcagacgcaatctttgacttggggatgtccttgagctccttcaacctcgatgatactgaagtggccctccttcaggctgtcctcctgatgtctagcgacaggcccggacttgcttgcgtggaaaggatcgaaaagtaccaggacagctttttattagctttcgagcactacattaattatcgaaaacaccatgtcactcacttttggcccaagctgcttatgaaggtgactgacctcaggatgatcggggcctgtcacgccagccggttcctgcatatgaaggttgagtgccccaccgagttgtttcctccactgtttctggaagtcttcgaagactag

SEQ ID NO: 137880 - DNA, 1386 bp, Artificial Sequence
  Description of Artificial Sequence: Synthetic coding sequence
atgaccccaaacagtatgaccgaaaacggcctgacagcttgggacaagcccaaacactgccctgaccgggagcatgactggaaactggtaggaatgtccgaagcctgtcttcacaggaagtcacacagcgaaagacgtagtaccctgaaaaatgaacagtcatcaccacatctaatccagaccacatggacaagctctatattccatttggatcacgacgatgtgaacgaccagagtgttagctcagctcagacctttcagactgaagaaaaaaagtgcaaggggtacattccaagctatctggataaagatgagctgtgtgtggtgtgcggcgataaggctaccgggtatcattaccgttgcataacctgcgagggatgcaagggtttctttcggagaaccatccagaagaacctgcacccatcttatagctgtaaatacgaaggcaagtgcgtgatcgacaaggtgactaggaatcaatgccaggaatgtcgctttaagaaatgcatatacgtgggcatggccacggacctcgtgcttgacgacagcaagaggctcgccaaacggaagcttatcgaggagaaccgggaaaagcggcgacgcgaagagttacaaaagtccatcggtcataaaccagaacccactgatgaggagtgggagctgattaaaacagttacagaggcccacgtcgctacgaatgctcagggctcccattggaagcaaaagagaaagttcctccctgaagatatcggacaggctccaattgtcaacgcaccagagggtggcaaagtggatctggaggcattctcccacttcaccaagatcattactcctgcgataaccagggttgtggattttgctaagaagctgcctatgttctgtgagctcccatgtgaggaccaaataattctgctgaaggggtgttgcatggaaattatgtctctgagggctgccgtccgctatgaccccgagtcagaaacgttaacccttaatggcgaaatggccgtgacgaggggtcagttaaaaaatggaggcctgggcgtagtcagcgacgccatatttgatctgggtatgagcctgtcctcgttcaatctggacgacacagaggtggcactcctgcaggctgttttactaatgtcatctgacaggcccggacttgcatgcgtggagagaatcgaaaagtaccaagatagcttcctgctggcatttgagcactatatcaattatcgcaaacaccacgtaacacacttctggccaaaactgctgatgaaagtcaccgatttgaggatgatcggcgcttgtcatgcctccaggtttctccacatgaaggtggaatgtccaaccgagttgttcccgccactttttcttgaagttttcgaagattag

SEQ ID NO: 137881 - DNA, 87 bp, Artificial Sequence
  Description of Artificial Sequence: Synthetic coding sequence
atgaccccaaactccatgaccgaaatggctttgcaacccggcacaaatagaagcactgtgcagactgaaaataccactgggtcctag

SEQ ID NO: 137882 - DNA, 366 bp, Artificial Sequence
  Description of Artificial Sequence: Synthetic coding sequence
atgacgcccaatagcatgactgaaaatggcttgacagcttgggacaagcccaagcattgtcctgacagggagcacgattggaagcttgtcggcatgagtgaggcttgcctgcacaggaaaagccacagtgagcgcaggtcaaccttgaagaatgagcagtcatcccctcacttgattcaaaccacctggaccagcagtatcttccacttggaccatgatgatgtcaatgatcagtcagtgagctcagcacagacattccaaaccgaggagaagaagtgcaaaggctatatcccctcctaccttgacaaagacgagctttgtgtggtgtgtggcgataaggccaccggataccattacaggtgttag

SEQ ID NO: 137883 - DNA, 441 bp, Artificial Sequence
  Description of Artificial Sequence: Synthetic coding sequence
atgcaagtgctgactaagagatatcctaaaaactgtctgctgactgtgatggatcgatacgccgctgaggttcacaatatggagcaggtagtgatgattccatctctcctccgggatgtacagttgagcgggccaggtggccaggcacaggcagaggcccccgacctctacacatacttcacaatgcttaaagccatttgcgtcgacgtggatcacggccttcttccccgcgaggaatggcaggcaaaggtcgcggggtccgaggagaacgggactgctgagacggaagaggtggaggatgaatctgcctccggagaactcgatctggaagcacagtttcacctgcacttctctagtctgcaccatatcctgatgcatcttactgagaaggcgcaggaagtgacacgaaagtaccaggaaatgacaggccaagtctggtag

SEQ ID NO: 137884 - DNA, 2802 bp, Artificial Sequence
  Description of Artificial Sequence: Synthetic coding sequence
atgagggctctcgccgttttgtccgttaccctggtgatggcttgcactgaggcattctttccctttattagcaggggcaaggagctcctttggggcaaacctgaagagagccgcgtttcgagcgttttggaagagagcaagagactggtcgatactgccatgtatgcaaccatgcaacgtaatctcaagaaacgagggatactgagtcccgctcagcttctaagcttcagtaaacttcccgaacctaccagcggagtgatcgccagggccgcggaaattatggaaactagcattcaggccatgaagcggaaagtgaacctcaagacccagcaatctcagcacccaaccgatgcactctctgaagaccttctgtctataatagctaatatgagcggttgcctgccctacatgcttcctcccaaatgcccgaacacctgtttagccaacaaatacagacccattactggggcctgcaacaaccgtgaccacccccgctggggagcttccaatactgcgttagctagatggttgccaccggtgtatgaggatgggttctcccagcctcgcggctggaatccaggtttcctgtataacgggttcccactcccccctgttcgggaagtaacaaggcacgtgatccaggtctcaaacgaagttgtcaccgatgacgatcgatacagcgacctgcttatggcttggggccagtacatcgaccacgatattgcttttacaccgcagtcgaccagtaaggccgccttcggtggcggtgctgattgccagatgacttgtgagaaccagaatccatgtttcccaatccagctgcccgaggaggctaggccggccgccggcacagcctgcttgcccttttaccgttcttcagcggcctgtggaacaggcgaccagggtgctctattcgggaatttgtccaccgctaatccccggcagcaaatgaacggacttaccagtttcctagatgcatctaccgtatatggaagtagcccagccctcgagcggcagctcagaaattggacttcagccgagggtttgctcagagtccatgccaggctccgagattccggccgagcttatctcccattcgtgccaccacgtgcgcccgctgcctgtgctccagaaccaggtattccaggagagacgaggggcccctgttttctagccggtgacggtagagcatctgaagtgccctccctaactgccctgcacactctatggctgcgggagcacaaccgtctagccgctgcacttaaagcccttaatgcacactggtcagccgacgccgtttaccaggaggccaggaaagttgtcggagccctgcaccaaatcatcaccctgcgggactatattccccggattctagggcctgaggcctttcagcagtatgtggggccctatgaagggtatgattccacagccaaccccaccgtttccaacgttttttccacggccgcgttccgttttggtcatgccacgatacatcctctagtgcggcgtcttgatgcatcctttcaggagcaccctgatctgccaggcctttggctgcatcaagcgtttttctcgccttggaccctactgcgtggaggggggctggacccactgatcagaggtttgctcgccaggccggcaaagctgcaggtgcaggatcagctcatgaatgaagaattgacagagagactgttcgtcctgtcaaatagctccaccctcgatttggcttccataaacctacagaggggcagagaccacggactgcccggttataacgagtggcgagaattctgcgggctgccaaggctagaaacccccgcagacctaagcacggcaattgccagccgaagcgttgctgataagatcctggacctctataaacatccagacaacatcgatgtgtggttgggcggtctggctgagaactttctgccccgagcccgcactggcccgctttttgcatgcctgatcgggaaacagatgaaagccctgcgtgacggagattggttttggtgggagaacagccacgtattcactgacgcacagcgccgggagctcgaaaagcactccctgtccagagtaatctgcgacaacacaggtctaacaagagttccgatggacgcgtttcaggtcggcaagttccctgaagactttgagtcctgtgactcaattactggcatgaatctagaggcttggagggagacctttccccaagacgacaaatgcgggttccctgaaagtgtggagaatggcgacttcgtccactgcgaggagtctggcaggagagtgctggtgtatagctgccgccacggctacgaacttcagggccgagagcagcttacttgtactcaggagggctgggacttccagccgcctttatgcaaagacgtgaatgaatgcgccgatggtgcgcaccccccgtgccatgcctctgccaggtgtagaaataccaagggtggcttccagtgtctatgtgcggatccctacgaattgggcgacgacgggcgcacatgcgtggattccggccgtctgccgcgggtgacatggattagcatgtctctggcagccctgttgatcggcggatttgctgggcttacatccactgttatctgtcggtggacccggaccggaacaaaaagcactctgcctataagtgaaacgggtgggggcacccctgaactgaggtgtggaaaacaccaggccgttggtacgtccccccagcgggccgctgcacaggattccgagcaggagtcagctggaatggagggccgagacactcaccggctgccacgggctttatag

SEQ ID NO: 137885 - DNA, 2790 bp, Artificial Sequence
  Description of Artificial Sequence: Synthetic coding sequence
atgagggctctcgcagttctgagcgtcaccctcgtgatggcctgtacggaggccttttttccatttatcagccggggcaaggagctcctttgggggaaaccggaggagtcacgcgtgagcagtgtgctcgaggagtctaaaaggctagttgatacagccatgtacgccaccatgcagcggaaccttaaaaagcgcggtatcctgagccccgcccagcttctgagtttttcaaagctgcccgagccaaccagtggcgtgatagcccgcgccgccgaaattatggaaacctcaatccaggccatgaaacggaaagtgaacctcaagacacagcagagtcagcacccaaccgatgccttgagtgaggacctgttaagcatcattgccaatatgtcagggtgtttaccttacatgcttccacctaaatgccctaatacatgtctagcaaataaataccggcctatcactggcgcctgcaacaaccgtgaccacccccgatggggggcaagtaatactgcactggccaggtggctccccccagtctacgaggacgggttttcccagcctagaggttggaaccccggtttcctgtataatggatttcctctgcctccagtacgggaagttacccgacacgttatccaggtatctaacgaggtagtcactgacgacgacagatactctgacctgctgatggcgtggggccagtacatcgatcatgacatagccttcactcctcaatctacatccaaagctgctttcgggggcggggcagattgtcaaatgacctgcgagaaccagaatccgtgcttccccattcagctgcccgaagaagccaggcccgccgctggaactgcatgtctgccgttttatcggtcatcagccgcgtgtggcacgggtgatcagggggcactgtttgggaatctgagtaccgccaacccccgacagcagatgaacgggctgacatcatttctggacgcttcaacagtgtacggaagctctccagcactggaaaggcagctgaggaattggacatccgccgaggggctcctacgagtgcacgcaagattacgggattcgggacgagcctacctaccttttgtgccccctagagcccctgcggcgtgcgcccctgaacctggcatccccggcgagactcgtggtccttgtttccttgcaggggatggtcgggcctcagaggtgccctctcttactgcgctgcacacgctgtggctcagggagcacaatcggcttgctgccgccctaaaagctctgaatgcccactggtcagccgacgcggtctaccaggaagcgcggaaagttgtaggagctcttcaccaaatcatcacccttcgcgactacatcccaagaatcctcgggcccgaagcgtttcagcagtacgttggcccatacgaggggtacgattccacagccaatccgacagtgtcaaacgtcttttctactgccgcgtttcggttcggacatgccactatccatcccctcgtccgcagattagacgcctcttttcaggagcaccccgacctgccaggtctgtggctgcaccaggcatttttttcaccctggacactgctccgcggcggaggcttagaccctctgattcgaggcctactcgcacgacctgcaaaactgcaggtgcaagaccaactgatgaatgaggagctaactgagagactatttgtgctgtctaatagctcaacactcgacctggcgtctataaaccttcagagggggcgcgatcatggcctccccggctacaacgagtggagagagttttgtggacttccaaggttggagactcctgccgatcttagcaccgcaatcgcctcccggtcagtcgcagataagatcctggacctttacaagcatccagataacatcgacgtgtggctgggtggactggcggaaaattttcttcccagagcccgcaccgggccgctgttcgcgtgtcttatcggaaaacagatgaaagccctgcgtgatggggactggttttggtgggaaaattcacatgtcttcactgacgcccagcgacgagagttagaaaagcattcacttagccgggtgatatgtgataacaccggcctcacccgcgtgcccatggacgccttccaggtgggcaaattcccggaggattttgagagttgtgatagtattaccggtatgaatcttgaggcgtggagagaaacgtttccacaggatgacaaatgtggcttccctgaatcagtggaaaatggagatttcgtgcattgtgaggagtccgggcgtcgggtgctagtttatagctgccgacacggttacgagttgcagggcagggagcagcttacctgcactcaggaagggtgggattttcaaccaccactgtgcaaggacgttaacgaatgtgctgacggcgcacacccgccttgccacgcgtctgcccggtgccggaacacaaaaggcggctttcaatgtctttgtgcagatccgtatgagcttggtgacgacggccggacctgcgtcgactcaggaaggctcccccgtgtgacctggattagcatgtcactggctgcattattgatcggaggattcgccggactgacaagcaccgtgatttgccgctggcgggttctggggtggaaagctggcattctgacaggttgccgcgaaccctctgagggtaaggtcgcgggccattgtcggactgcctcctgcagccagaaccatcggaccacactgttccagactcaagcaaaccccaagagtgctgggcgcctgttcagccagcacggctag

SEQ ID NO: 137886 - DNA, 2802 bp, Artificial Sequence
  Description of Artificial Sequence: Synthetic coding sequence
atgagggccttggctgttctgtcggtcacattggtgatggcatgtactgaggcattttttccttttatcagccgcggtaaggagttattgtgggggaagcctgaggaaagtagagtgtctagcgtgttggaggagagcaagagactcgtggacacagctatgtacgccacaatgcagcgcaatctaaagaaacgggggattctcagccccgcccagctgctatctttctcgaaactgcccgagccaacctctggggtcattgcccgggccgcagagattatggagacaagtatccaggccatgaagaggaaggtgaatttgaagacccaacagtcccagcatccaaccgacgccctttcagaggatctgctcagcatcatagctaacatgagcggatgtctgccttatatgcttccaccaaagtgccccaacacttgtctcgctaacaaatacagacccataacaggagcctgcaacaacagggatcacccacggtggggtgccagcaacaccgcgctcgccagatggctgcctcctgtgtacgaagatggctttagtcagcctcgtggttggaaccctggatttctgtacaacggcttccctctcccacctgttagggaggtgactcgacatgtgatccaggtctctaatgaggtggtcaccgatgacgatagatattcagacctgctgatggcgtggggccaatatattgaccatgacatcgcttttaccccccagagcaccagcaaagccgccttcggagggggagcagactgccagatgacatgtgagaaccagaatccctgcttccctattcagctccccgaagaagcacggcccgcagcagggacagcctgcctcccattttataggtcttccgctgcctgtgggactggcgaccagggagcactcttcggtaacctgtctacagccaatccacggcaacagatgaacggcctgaccagttttttggacgccagtaccgtgtacggctcctcccccgccctggagcgacaacttcggaactggacctcagcagagggcctgctcagggttcacgcgagactgagagactcagggcgggcttatctgccattcgtaccgccaagggccccagcagcatgcgcgcccgaaccaggaatacccggtgagacaagaggtccgtgcttcctggcaggtgatggaagggcatcagaagttccaagtctcacagccttgcataccctttggctcagagagcacaaccggctggccgctgccctgaaagcactgaatgcccactggagcgccgacgctgtgtatcaggaagccaggaaagtcgtaggagccctacaccagatcattactctcagagactatatcccccgtatcctcggccccgaggccttccagcagtatgtgggcccttatgaggggtacgactcgactgcgaatcctactgtttctaatgttttctctactgccgcttttaggtttggccatgccactatacatcccctggtgcgacgattggatgcgagtttccaggagcacccggacctgcccggtctgtggctgcatcaggcatttttctctccttggacattactgcggggtggtggcctcgatcctttaataaggggcctcttagcgcgccctgcgaaactacaggtgcaggatcagctaatgaacgaagaactgacagaaaggcttttcgtactgagcaatagttccacattggacctagcctccatcaacctacagagggggcgagaccacggtctgcccggctataacgagtggagagaattttgtgggctccctcggttagagacaccagccgacctgtccaccgctatcgcatcaaggtccgtggctgacaaaatcctggacttatataagcaccctgataatattgacgtttggctcgggggactagcggaaaattttctccctcgcgcccgaaccgggcccttgtttgcgtgccttataggtaaacagatgaaggctctcagagacggggactggttttggtgggaaaattctcatgtgttcacagacgctcaacgccgggaactcgagaaacactccctgtcaagagtgatatgtgacaatacgggactgactcgcgtgccgatggatgcatttcaagtggggaagtttcctgaagattttgagtcctgtgattctattacgggaatgaacttggaggcgtggagggaaactttcccccaggacgacaaatgtggattccccgagtctgtggagaacggcgacttcgtgcattgtgaagaatccggacggagggtcctggtgtattcctgccgccatggctacgaactgcagggcagggaacaattaacttgtacccaggaggggtgggacttccagccccccctgtgcaaagacgttaacgagtgcgccgatggagcccaccctccttgccacgctagcgccaggtgcaggaatacaaaggggggcttccagtgtttatgcgcagacccgtacgaactgggagatgatgggaggacttgtgtagattctggccgtctgccccgggtgacgtggatcagtatgagcctggctgccctcctgataggaggcttcgccggcctgacctctacagttatttgccgatggaccagaacagggactaagtccactctgcctatctctgaaaccggtggcggcaccccagagctgagatgtggcaaacatcaggcagtaggcaccagccctcagagggccgcggcgcaagattcggaacaggagagtgccggcatggagggccgggacacccaccgcctccctagagccctctag

SEQ ID NO: 137887 - DNA, 2670 bp, Artificial Sequence
  Description of Artificial Sequence: Synthetic coding sequence
atgcgggcacttgccgttttgagcgttacgttggtcatggcctgtactgaagcttttttccctttcatctccaggggaaaagagcttctgtggggaaaacctgaggagagcagagtctcgtccgttttggaggagagcaaaagacttgtagataccgccatgtacgccaccatgcagcgcaacctcaagaagcggggtatcctcagtccagcccagttactcagctttagcaagctccccgagccgacgagcggcgtaattgcaagagccgccgagataatggaaacctccatccaggctatgaagagaaaagtgaacctaaaaacccaacagtctcaacatccaaccgacgccctgtccgaggacctcttgtccataattgccaatatgagcggttgtcttccttatatgttaccccctaagtgccctaatacatgcctggccaataaatatcggcccatcacaggcgcgtgcaacaatcgcgatcatccacggtggggggccagcaacactgcattagcccgatggctgccaccagtgtatgaggacggtttttcacagccacgggggtggaacccagggttcctgtacaatggattcccactgccccccgtgagggaagtgaccaggcatgtgatccaagtttcaaacgaagtcgtgaccgatgacgacagatactccgacttgttgatggcttggggacagtatatagaccacgacattgcttttacgccacaaagcacgagcaaggccgccttcgggggaggcgcggattgccagatgacatgcgaaaaccagaatccatgcttcccgattcagttaccagaggaggcacgccccgctgcaggtaccgcttgcttgcctttttatcgcagctccgccgcttgtgggactggagaccagggagcattgttcggcaacctcagtaccgctaatccacggcagcagatgaatggactaaccagcttcctcgatgcctcaaccgtttatgggagcagtcccgctctggaaaggcaactccggaactggacttcggccgaaggcctgctacgcgtacacgccagactccgggactcaggccgcgcttacctaccattcgtgccccctcgagcccctgcagcttgtgcccctgaacccggcatccccggagagacaagaggtccttgtttcctggccggggatggcagggcttcagaggtgccatccctgaccgccctccatactctctggctgagggagcataatagactggccgcagccctcaaggcacttaacgctcattggagcgcggacgccgtgtatcaggaagccaggaaagtggtaggtgccctccatcagattatcaccctccgggattatataccacggatccttggtcccgaagcgtttcagcagtatgtgggcccgtacgagggctacgactccacagccaatcccacagtcagcaacgtctttagtactgctgcctttaggtttggacatgcaactatccatccacttgtgaggagactggatgcctcatttcaggaacatcccgacttgccggggctgtggctgcatcaagccttcttctcaccatggaccctgctgcgcggcggaggccttgacccactgataaggggccttttagccagacccgcgaaattacaggtgcaagatcaactaatgaacgaagagctgaccgagcgactgtttgtcctttcaaacagctcaacccttgacctggccagcatcaacctgcagcgggggagggatcatggcctgccgggctacaatgagtggagagaattttgtggcctgccccgcctggaaacaccggctgacctttcaaccgccatcgcatcccgcagcgtagctgacaagatcctggatctttacaagcacccagacaacatcgatgtctggctcggagggctagctgagaattttctgccccgggcaaggaccggacctctgtttgcatgcctgatcggcaagcaaatgaaggccctgagagatggggattggttttggtgggagaattcacatgtttttactgacgcccagaggcgggagctcgagaaacattcactgagtcgagttatttgcgataacactggtctgacacgcgtgcccatggacgccttccaggtcgggaaatttcctgaggacttcgagtcctgtgacagtattacaggaatgaacttggaggcttggagggagacattccctcaggacgataagtgcgggttcccagagtccgtggagaatggggacttcgtgcactgcgaggaaagtgggcgtcgtgtactggtgtattcatgcaggcatgggtacgaactccagggacgggagcagctgacatgcacacaggaggggtgggatttccagcctcctctgtgcaaagattctggaagactgcctagggtgacatggatttcaatgtcactcgctgcattgctgataggggggtttgcaggtctaacatctacggtgatatgcagatggacaaggactgggaccaaaagcacattgcccatcagcgagaccggaggtggcacgccagagcttcggtgtgggaagcatcaggcggtcggcacttcccctcagagagcggctgcacaggattcagaacaggaatcagctggcatggaggggcgggacacgcacaggctgccacgcgccttgtag

SEQ ID NO: 137888 - DNA, 2283 bp, Artificial Sequence
  Description of Artificial Sequence: Synthetic coding sequence
atgcgcgcattagccgtactcagcgtaacactggtgatggcatgtactgaagctttcttccctttcatcagtcgcggcaaagagctgttgtgggggaaaccagaagaatcacgcgtttcatcggttttggaagaatccaaacgtttggttgacaccgctatgtacgctactatgcagagaaatctgaagaaaagaggcatactgtcccctgcccagctgttgtcgttttccaagctgccagagcccaccagcggtgtgatcgcgcgggctgctgagataatggaaacatcaatccaggcaatgaaaaggaaggtgaacctcaaaactcagcaatctcagcatccaacagacgcattaagcgaagacctgttgagcattatcgcaaatatgtctggctgcctcccgtacatgctgccacctaagtgccccaatacttgcctggctaataagtacagaccaataacgggagcttgcaataatcgcgaccaccctcgctggggggcttcgaataccgctctcgctaggtggcttcctccagtgtatgaggatggattcagtcaaccacgcggctggaaccccggattcctgtataatgggttcccactccctcccgttcgggaggtcaccagacacgtgatccaggtcagcaacgaagttgttactgacgacgatcggtattctgacctgttaatggcgtggggacagtacattgaccatgatatcgcattcacccctcagagcacttctaaggctgctttcggtggcggcgccgactgtcaaatgacatgtgagaaccaaaacccctgttttcccattcagattattactctgagagattacattcccaggatcctagggcccgaagccttccagcagtatgttgggccgtatgaaggctacgattccactgctaatccaacagtgtccaatgtattttcaacagccgcattcagatttggacacgccacgatccatcctttggtgcggaggctcgatgcctcctttcaggaacacccagacctgcctggactgtggcttcaccaagcatttttctctccctggacattgcttcgcggcggcggactcgacccattgattagagggctgttagcccgccccgctaaattgcaggtccaggatcagctgatgaatgaagagctgacggaaaggttgttcgtcctgtccaattcaagtaccctggacctcgcctccatcaacttacaacgtggccgtgatcatggtctgccaggctataatgaatggcgcgagttttgcgggttacctcggctggaaacccccgcagatctcagcacagcgattgcgtctagatctgtggctgacaagattctggacctgtataagcaccccgacaatatcgacgtgtggcttggtggtttggccgaaaattttcttcccagggccagaaccggacccctttttgcctgcctaatcggtaaacagatgaaagccttgagggacggggactggttctggtgggagaattcccacgtattcacagatgcccaaaggcgagagctcgagaaacactcgctctctagagtgatttgcgataacactggcctcacaagggttcctatggacgcatttcaagtgggaaaattccccgaggactttgaatcctgtgacagtatcactggaatgaacctcgaggcctggagggaaactttccctcaggacgataaatgtggcttccccgaatcagtggaaaacggcgacttcgtgcattgtgaggaaagcggtaggcgagttctggtgtactcctgcaggcacggttatgagctccagggtagagaacagttgacatgcactcaggagggatgggacttccagccccccctgtgcaaggatgttaatgagtgcgccgatggtgctcaccccccctgtcatgctagcgccagatgccgaaatacgaagggcgggtttcagtgcctctgcgccgatccctacgaactgggcgatgatggccgaacttgcgtggatagtggacgtctgccgcgggtgacttggattagtatgtccctggccgctttactgataggggggtttgccggactgacctctactgtaatttgtaggtggacacgtaccgggacaaagagcactctgcctatctcggagacggggggcggtactcccgagttgcgttgtggaaagcatcaggccgtcggtacgtccccccagcgcgccgcagcccaggactccgaacaggagtcagcgggaatggaaggcagggatactcaccgcctgccgagggctttgtag

SEQ ID NO: 137889 - DNA, 2283 bp, Artificial Sequence
  Description of Artificial Sequence: Synthetic coding sequence
atgcgggcgttagccgtgctgtccgtcactcttgttatggcttgtactgaggctttctttcccttcatttcaagagggaaagagctactttggggtaagcctgaggagtcccgagtctcatcggtgctcgaggagagcaaaaggcttgtggatactgctatgtacgcaacaatgcaaagaaaccttaaaaaaaggggaattctgtctccagcacagctattaagcttctcaaagcttccggaacccacgtctggtgtcattgcacgcgccgccgaaattatggagacctccatccaagcaatgaaacgcaaagtgaatctcaagactcagcaatcccagcacccaactgatgctctgagcgaggacctgttatcaatcatcgctaatatgtcgggctgcctgccttatatgctgcctcctaagtgcccgaatacgtgcctagccaataagtaccggcccataacaggagcgtgcaacaatagagatcatcccagatggggcgccagtaacaccgcactagccagatggctccctcctgtctatgaggatgggttttcccaaccacgaggctggaatcccggatttctgtacaacggcttcccattaccgccggtgcgggaggtcacaagacatgtgatccaggtgtcaaatgaggttgtgacagacgatgatagatactctgatctgctgatggcatggggccagtacatcgaccacgatatcgctttcacaccgcaaagcacttccaaagcggccttcggcggcggtgctgattgccaaatgacctgcgagaatcagaacccatgctttcccattcagataatcactttgagggattatatacccaggatcctgggtccggaggcatttcagcagtacgtcgggccttacgaaggctatgattctactgctaacccaactgtctcaaacgtgttttccacagccgcgttccgcttcggccacgccacgatccatccactcgtccggagacttgacgctagtttccaggagcatccggaccttcccgggctgtggctgcaccaagcgttcttcagtccgtggaccttgctgaggggtgggggtctcgaccccctgatcagggggctgctcgcccgtcccgcaaaattacaagtgcaggaccaactgatgaatgaagagttaacagagaggctgtttgtgctctcaaactcttcaacactggatctcgcctccataaacctgcaacgtgggcgcgatcacggcctgcctggttataacgagtggagggaattttgcggcctcccaagattggagacacctgccgacttatctacagcaattgcctcaaggtcggtggctgacaaaattctcgatctctacaagcaccccgataacatagacgtgtggctaggtggcctggctgagaatttcctccccagggccaggaccggccctctgtttgcctgcctgatcggcaaacagatgaaggctctgcgggatggcgactggttctggtgggagaacagtcatgtgttcacagatgcacagagacgcgagttggaaaagcactcactgtctagagtcatctgcgacaacactggtctcaccagggtacccatggacgccttccaggttggcaagttccctgaagacttcgagtcgtgcgatagtataactggtatgaacttggaggcatggcgcgagacatttccacaggatgataaatgtggatttcctgagagtgtcgagaacggggatttcgtccattgtgaggagtcaggccgtagggtgctcgtctatagctgcaggcacgggtacgaactgcagggtcgagagcagctgacatgcactcaggagggctgggactttcaacccccattgtgcaaggatgtgaatgaatgtgccgatggagcacaccctccttgtcacgcctccgccagatgtcgcaatacaaagggtggatttcagtgtctgtgtgccgacccgtatgaactgggagatgatggcaggacatgcgtagattccggtcgccttccacgggtgacctggatcagcatgagccttgccgcgcttcttatcggagggttcgccggtctcacgtccacagtgatttgtcgctggacaaggacagggaccaaatccactctgcctatcagcgaaacaggaggggggacccccgagttacgatgtggaaagcaccaggcagtgggcacttcacctcagcgcgccgctgctcaggactctgagcaggaatccgccggaatggagggacgtgacacccatcgattaccgagggcactttag

SEQ ID NO: 137890 - DNA, 2631 bp, Artificial Sequence
  Description of Artificial Sequence: Synthetic coding sequence
atgagagctcttgctgtgctcagcgtgaccctggtcatggcctgtaccgaggctttctttccttttatttctagaggtaaagagctattgtgggggaagcctgaggagagtagagtgtccagtgtgttggaagagagtaagcgcctggttgacacagcaatgtatgccacaatgcagcgtaatctcaagaagcgcggaatcctctctcctgcgcagcttctcagcttctcgaagcttcccgaacctacatccggtgtcattgccagagccgccgagattatggagacatctatacaggccatgaaaaggaaagtgaatcttaagacacagcagagccagcatcccaccgacgcactgtccgaggacctactgtccatcatcgcaaatatgtccggttgtctcccatatatgctgccacctaagtgtcctaacacctgtctggcaaataagtatcgacctatcactggagcttgtaataacagagatcatcctcgttggggcgcctctaacaccgcactagctcggtggctgcccccagtgtatgaggacggcttttcccaacctcgaggatggaatcctggcttcctctacaacggtttcccactgccgcccgtgcgagaagttacaaggcatgtgattcaggtctccaacgaggtggtcactgatgacgaccgctattccgatttgctaatggcctgggggcagtatattgaccatgacatcgcttttaccccacagtccactagtaaggccgcattcgggggcggcgccgattgtcaaatgacctgcgaaaaccaaaacccctgcttccctatccagcttccagaggaggctcgtcctgccgccggcacggcgtgtctgcctttttatcgttccagcgccgcatgtggaaccggggaccagggtgcgcttttcggcaacctgtcgacggccaaccccagacagcagatgaatggcctcaccagcttcctagatgcttccaccgtttatggctcgagcccagccctggagcgccaactgcggaactggactagtgcagaggggctccttagagtccatgccagactcagggattcgggaagagcctatctgccatttgtccctccccgcgccccagcggcctgtgctcccgagcccgggatcccaggggaaacacggggcccatgctttctcgctggggatgggcgggcaagcgaggtccctagtctgacagccctgcacacgctttggctgagagaacacaaccgccttgctgccgccttgaaggcactgaacgctcactggagcgccgacgccgtttaccaggaggcacggaaggtggtcggcgcactccaccagatcatcacacttagggactatatcccccgcatcctagggcctgaggctttccagcagtacgtggggccatatgaggggtacgatagcacagctaatccaacagtttcaaacgtttttagcacagccgcttttcgctttggccacgccactattcacccccttgtgaggaggctggacgcttcctttcaagagcaccccgacttgccagggttgtggctgcatcaagcattcttttccccctggactctcttacgcggcggctacaatgagtggcgcgaattttgtggcctgcctaggctcgagaccccggccgatctgagcactgccatagcgtcgagatctgtggccgacaagattttggatctttacaaacacccggacaatattgatgtgtggttaggggggctggccgagaacttcctgcccagagccagaactggacccctgtttgcttgtctaataggaaaacagatgaaagcccttagggatggtgattggttctggtgggagaattcacatgtgttcaccgatgcccagcggagagaactggagaagcatagtctttcccgagtcatctgtgacaacaccgggctcacacgggtgccaatggatgcatttcaagtgggaaagtttccagaggactttgaatcctgcgatagcataacaggcatgaacctagaagcttggcgcgagacttttcctcaggacgacaagtgcgggttccctgagtctgtggaaaatggcgattttgtccattgtgaggaaagcggccgcagggtgttggtgtattcttgtaggcacgggtacgaattgcaggggagggagcagcttacttgcacacaggagggttgggatttccaacctcctttgtgtaaagacgttaacgaatgcgcggatggtgctcatcccccctgccacgcttccgcacggtgccgcaacaccaaggggggttttcaatgtttatgtgctgatccctacgaattgggcgacgacggcagaacctgcgtggacagtggccgactaccgagggtgacatggatcagcatgtcattggccgctctgctgatcggaggctttgccggcctcacctcaacagtgatttgcagatggaccaggaccggcacaaagagtactctacccatcagtgagactggaggggggacgccagaactccgctgtggaaaacaccaagccgtcggcacttctccccagagagcagctgcccaggatagtgagcaggagagcgcaggtatggaaggccgcgatacacaccgcctccctagagccctctag

SEQ ID NO: 137891 - DNA, 519 bp, Artificial Sequence
  Description of Artificial Sequence: Synthetic coding sequence
atgcgagccttagctgtcctgagcgtcaccctggtgatggcctgtacagaagccttctttcctttcatttccagaggcaaagagctgctctggggtaagccggaggaaagccgcgtttcctctgttctcgaggagagcaagagactggtggacacagccatgtacgcaacgatgcaacgaaacctgaaaaaacgcggcatcctctcccccgcccagctgctgtctttttctaagttacctgaacctaccagcggcgtgatcgcgagggctgcggaaattatggagacatcaatccaggcgatgaaacggaaggttaatttgaaaacacagcagtcacagcacccgaccgacgccctctccgaggatttgctgtctatcatcgctaacatgtccggctgcttgccttacatgctgcctcccaaatgcccaaacacgtgcttagccaacaagtacagaccaatcaccggcgcctgcaataaccgggaccatccaagatggggcgcatctaatacagcttag

SEQ ID NO: 137892 - DNA, 462 bp, Artificial Sequence
  Description of Artificial Sequence: Synthetic coding sequence
atgaatggcctgacttctttcctggacgcaagtaccgtgtatggtagcagccccgctctagaacgccagctgcggaattggacaagcgcagaagggttgctgagggtgcatgcccgcctccgggactccgggcgcgcatatctcccctttgtaccccctcgcgcccctgcagcttgcgcacccgaacccggcattccaggcgaaacccgagggccatgttttctcgccggagatcctagacagaggggccccctgccagatgggacagcccatgccgtggctgctagagcccagcctcctgggcgaggtgcacaaggaccccagtgtgctcttgagcgaggacgcagagtacccggcggtgcccagggccgtggacgaagcgccccggaccatcatccggagggacttcatcctcaggaccctgggacccgtggcctgccggcagttagggggagtctatag

SEQ ID NO: 137893 - DNA, 525 bp, Artificial Sequence
  Description of Artificial Sequence: Synthetic coding sequence
atgcgggctcttgccgtgctctccgtcaccctagtcatggcctgtaccgaggccttcttccccttcatctctagaggtaaagagttattgtggggaaagcctgaggaatcacgtgtgtcttctgtgctcgaagagtccaagcgactggtggatactgccatgtatgcaaccatgcagcggaatctgaagaagaggggcattctaagcccagcccagctgctgagcttctctaaactccctgaaccaacaagtggtgtgatcgctagagccgctgaaatcatggaaacctctatacaagcgatgaagcgaaaggtcaatctgaaaacacagcagtcccagcatccaactgacgccctgtctgaggatctactgagtataatcgctaacatgtcgggatgcctcccttacatgcttcctcctaagtgtcctaacacctgtctggccaacaagtatcggccaatcacgggagcctgtaataatcgcaaaatgaaatataaaccggaccacagcgagactgcgaactag

SEQ ID NO: 137894 - DNA, 2295 bp, Artificial Sequence
  Description of Artificial Sequence: Synthetic coding sequence
atgcgcccagcggatttgctgcagctagttctcctgctcgatttgccccgggatctgggtggaatgggatgctcttccccaccatgcgaatgccatcaggaggaggattttagagtaacctgtaaagacatacagcgcatcccatccctgccgccctctactcagactctgaagttaatcgagacccatctccggacaattccaagccatgcgttttctaatctgcctaacattagtagaatatatgtgtcaattgatgtgacactgcagcagttagagagtcatagcttctacaatttgagcaaggtcacccacattgagattcggaacacccgtaacctgacatatatcgaccccgacgccctgaaagagctccctctactaaaatttttgggtattttcaatactggtctgaagatgttccccgaccttaccaaagtgtactccactgatatattttttatactcgagatcactgacaatccatatatgacctctatcccagtgaatgcatttcaaggcctgtgtaatgaaactctgaccctcaagttgtacaataatgggtttactagcgtgcagggctatgctttcaatggcactaagcttgatgccgtgtacctgaataagaataagtatcttacagtaattgataaagacgccttcgggggcgtgtactcaggtcctagcctgctcgatgtaagtcaaacttctgtcacggccctgccatccaagggtcttgagcacctgaaggagttgattgcccgcaatacttggacactgaaaaagctgcccctcagcctttcctttctgcacctgactagagccgaccttagctacccatcccactgctgcgcctttaagaaccaaaaaaaaatccgcggtatactggaatcgttaatgtgcaatgagagttctatgcaaagcctgagacagaggaaatctgtcaacgcgctcaattcacccctccatcaggagtatgaggaaaatctgggagacagcatagtgggttacaaggaaaaaagcaagttccaagatactcacaataatgcccactactatgttttctttgaagaacaggaggatgaaatcatcggcttcggccaggaactcaaaaacccccaggaagagacacttcaggccttcgattctcattacgactacacgatatgcggcgatagcgaagatatggtttgtactcctaagtcagatgaattcaacccgtgtgaggacatcatggggtataaattcttgcggattgtggtgtggttcgtaagtcttctcgccctcttgggcaatgtcttcgttcttctgatcttgttaaccagccactataagctcaatgtgccaaggttcttgatgtgtaatctggcctttgcggacttttgcatgggaatgtacctgctcttgatagcttccgtcgacctgtatacacatagtgaatattacaaccatgcaattgattggcagaccgggcccgggtgcaacaccgccggatttttcactgtatttgcctccgaactgtcagtttatacacttactgtgatcactctcgagaggtggtatgcgatcacttttgcaatgcgactcgacaggaaaatacgactccggcatgcatgtgcgattatggtcggcggctgggtgtgttgtttcctactcgccctcctgccccttgtaggaattagcagctacgccaaggtatccatctgcttgccaatggatacagaaactccactcgcattggcttatatcgtctttgtgcttaccctgaatatcgtcgctttcgtgatagtctgttgttgttatgtgaaaatctatattactgttagaaaccctcagtataatcccggagataaggacacaaaaattgcaaaacggatggctgtgctgatctttacagactttatctgcatggctcccatatctttttatgcactgagcgccatattgaacaagccgttaatcactgtttctaattcgaaaatcctgctagtcctgttctatccgttaaactcctgcgctaatcccttcctctacgccatatttacaaaggctttccagagggacgtatttattttgctctcaaagttcggtatttgcaaacggcaggcacaggcatatcgcggacagcgggttccgcccaagaattcaacagacatccaggttcagaaagtgacccacgagatgcgacagggactccataatatggaggacgtctacgaactgatcgagaactctcatctcacccccaagaaacaggggcagatttccgaagaatatatgcagacggtgctgtag

SEQ ID NO: 137895 - DNA, 762 bp, Artificial Sequence
  Description of Artificial Sequence: Synthetic coding sequence
atgcggcctgcagatctgctccagctggtgcttctgctggacctgccacgagaccttgggggcatggggtgttccagtccgccctgcgaatgccatcaggaggaagacttcagagttacctgcaaggacatccagcggatcccatctttgcctcccagcacacaaaccctgaagcttattgaaacacacctcaggacgatcccctcgcacgcattcagcaatctgcccaacatctcgcgaatttatgtaagcattgatgttacactgcagcaactcgaatctcatagcttttataatctgagcaaggttacacacattgagatacggaatacacgtaatctaacctacatcgacccagatgcattgaaagagcttccactcctgaaatttctagggatcttcaacactggtcttaaaatgtttcccgatctgacaaaagtgtattccactgacatcttttttattctagagatcacggataatccttacatgacctccattccagtaaatgctttccagggcctgtgcaacgagactcttacgttgaagctttacaacaatggcttcacctcagttcagggctacgcattcaacggcacaaagctcgacgccgtgtatttgaacaaaaacaagtatttgaccgtgattgacaaggacgcttttgggggtgtctattcggggccctcactgctgctgcccctcgggcggaaaagccttagctttgagacccagaaagctcccaggtcatccatgccctcctag

SEQ ID NO: 137896 - DNA, 1236 bp, Artificial Sequence
  Description of Artificial Sequence: Synthetic coding sequence
atgaggccagctgacctgcttcaactagtgttgctccttgaccttccgcgagacttggggggcatgggttgctcttcccctccatgcgagtgtcatcaagaagaagattttcgcgtaacttgcaaagatattcaaagaatccctagtctaccgccctccacacaaacgctgaagctaattgaaactcaccttaggattgtggtctggttcgtatcactcctggctctcctaggcaatgtgtttgtgcttttgattctcttgaccagccattacaagcttaacgtacctcgcttcctgatgtgcaatctggcttttgcagatttctgtatgggtatgtacttgctgctgattgcctctgttgatctctatactcacagcgaatattataaccatgcgatagattggcagaccggcccgggatgcaacaccgctggcttcttcacggtgttcgctagcgaattaagcgtttacaccctgactgtaatcactcttgaacggtggtacgcaataactttcgccatgagactcgatcgcaagattaggctgcgacatgcctgcgccataatggtgggaggttgggtttgttgtttcctccttgcattgttgcctctagtggggataagttcctacgcaaaggtcagcatttgcctccccatggatacggaaaccccccttgccctggcttatatcgtgtttgtcctgactctgaacatcgtcgcctttgttatagtctgttgctgttacgttaagatctatattacggtccggaacccccaatacaaccccggtgacaaggacacaaagatagccaaaaggatggcagtcttaatctttactgacttcatctgcatggcccccatctcgttttacgccctctctgccatccttaataaacccttgatcacggttagtaacagcaagatccttcttgtcctgttttatccactgaactcgtgtgccaatcctttcttgtatgctattttcacaaaggcatttcagcgcgacgtattcatcctgctttccaagtttggaatatgtaagaggcaggcgcaagcatatcgtggtcagcgagtcccccccaaaaactccactgacattcaggtccaaaaggtgacacacgagatgcgacagggcctgcacaatatggaggacgtgtatgagttaatcgaaaattctcacctgacccctaaaaagcaaggacagatatctgaagagtatatgcaaacagtgctgtag

SEQ ID NO: 137897 - DNA, 2295 bp, Artificial Sequence
  Description of Artificial Sequence: Synthetic coding sequence
atgcgcccggccgacctgctacaactcgtgctgttactcgacctgccccgggatctcggggggatgggttgctcctcacccccctgtgagtgtcatcaagaggaagactttcgagtgacttgcaaagacattcaaaggattccttctctaccaccctccactcagaccctgaaattaattgaaactcacctgagaactattccctcccatgccttcagcaacctcccgaacattagtcgtatttacgtatccatcgatgtgactctccagcagctggagagccattccttctataatctgtccaaggttactcatatcgaaattagaaacactcgcaatcttacctatattgaccctgacgctttgaaggagctccccctgctaaagtttctcggcatattcaacacgggactgaaaatgttccctgatttaacaaaagtttatagtactgatattttcttcatcttggaaattaccgataacccttatatgacttctatccctgtcaatgcttttcagggtttgtgcaatgaaaccctgacacttaagctctacaataatggtttcacaagcgttcaagggtacgccttcaacggcactaaattggacgcagtgtacctcaataaaaataagtacctcacagttattgataaggacgcttttggtggcgtgtattccgggccatctctgctagacgtgagtcaaacatcagtgaccgcgcttccttcaaagggtcttgagcatctgaaggagctgattgctaggaacacttggacgctgaagaaactgcccctatctttgagctttctgcacctgacgagagccgacctgtcatatccttctcactgctgcgccttcaagaaccagaaaaagatacggggtatcctggaatctctgatgtgtaatgagagctccatgcagtcattgagacagaggaagagcgtgaatgccttaaattctccgctgcatcaggagtatgaggaaaacctgggagactctatcgttggttacaaagaaaaatcgaaatttcaggatacacataacaacgcccactactatgttttttttgaggagcaagaagatgagattattggattcggtcaggagttgaagaacccacaggaagagactctccaggcgtttgattcccactacgactacaccatttgtggtgattcagaggacatggtgtgtaccccaaagagcgacgagtttaacccctgtgaggatatcatgggttacaagtttctcaggattgtcgtgtggttcgtgagcttgctggctctgctgggtaatgtgttcgttcttctgattttgctcaccagccactataagctaaatgtccccaggtttctgatgtgcaacctggcttttgctgacttttgcatgggcatgtacctgctcttaatcgctagcgttgacctgtatacacattctgagtactacaaccatgcgatcgattggcaaacaggacccggatgcaataccgccggtttttttacggtctttgcctcggagctctcagtttacacattgaccgtcatcactctggagcggtggtatgccatcactttcgccatgcgactggaccgaaaaattagactgcggcacgcctgcgccatcatggtgggtggctgggtctgctgcttcttactggcgctcctgcctctcgttggaatctcatcttatgcgaaagtctctatctgcttaccaatggatacagagacccccctggccctcgcctacattgtgtttgtgctaactcttaatatagtggctttcgtgattgtgtgttgctgctatgtgaagatctatatcactgttagaaaccctcagtacaaccccggggacaaagacacaaagatagccaagagaatggccgtcctgatcttcacagacttcatctgcatggccccaatctccttctatgccttgagcgctatcctgaataagccactgattacagtgagcaacagtaagattctgctagtattgttctacccactgaatagctgtgccaatccattcctatacgccatttttacaaaggcttttcaaagggatgtatttatcctgctatctaagttcgggatctgcaagagacaagcacaagcataccgtggccagagagttccccccaaaaactccactgacatccaggttcagaaggtcacacacgaaatgcgacaaggtctgcataacatggaggatgtctatgaactgatcgagaatagccatcttacaccaaagaagcagggtcagatttccgaggagtatatgcagacagtgctgtag

SEQ ID NO: 137898 - DNA, 825 bp, Artificial Sequence
  Description of Artificial Sequence: Synthetic coding sequence
atgagacctgctgacctgctgcagctcgtgctgttattggatctaccacgtgatctgggtgggatgggctgttctagccccccatgcgaatgccaccaagaggaagatttcagagtcacctgcaaggacatccaacgcatcccctctctaccccctagcacccagacactgaaactgattgagacccatctccggacgatcccgtcacacgccttcagcaatctgccaaatatttctaggatctacgtatcaatcgacgtgacactccaacagctggagagtcacagtttttataatctgagtaaggtgacccatattgagatcagaaacaccagaaatttaacctacatcgatccagatgctcttaaagagctgccactgcttaaattccttggcatttttaataccggcctgaaaatgtttccagatctaaccaaggtttattctacagacatattctttatcctcgagattaccgacaatccatacatgacaagcataccggttaacgcatttcagggcctttgcaatgagacactcacattgaaactctacaataatgggtttacgagcgtccagggttatgcgttcaatggcaccaagcttgacgccgtttatctgaacaagaataagtacctgacggtgattgacaaggacgccttcggcggggtatacagcgggccgtccttactggtggagaatgtggccgtaagtggcaaaggcttttgtaaatcattgttctcttggttgtatagactgcctttggggaggaaatctttgagctttgaaacccagaaagcgccgcgatcctctatgccgtcttag

SEQ ID NO: 137899 - DNA, 912 bp, Artificial Sequence
  Description of Artificial Sequence: Synthetic coding sequence
atgagtgacgccgggggtggtaaaaagccacctgttgacccacaggcgggacccgggccgggaccaggacgggcagccggagagagagggttatccgggtcatttcctctggtcctaaagaagctaatggagaaccctcccagagaggccaggctggataaagaaaaagggaaggagaaattggaggaggatgaggccgcggctgcatctaccatggccgtgagtgcgtcactgatgccccctatttgggataaaacaattccgtatgatggggaatcttttcacttagaatatatggacctcgacgagttcctgctggagaatgggatccctgcttcccctacgcacttggcccacaacctcttgcttcccgtcgcggagctcgaaggtaaagaatcggcgtcatcttctactgcgtctcctccatcttccagcactgcaatcttccagcctagtgagacggtcagcagtaccgagtccagcttggaaaaggaacgggagaccccatctccaattgatccaaattgtgtagaagtggatgtgaactttaacccagatcccgcagatctagtattgtcaagcgtgccaggtggagagctgttcaaccctcgaaagcataagttcgcagaggaggacctgaagcctcaaccaatgatcaagaaagccaagaaggtattcgttcctgacgagcagaaagacgagaaatactggacacggagaaagaaaaataatgtggccgctaagcgcagccgagacgctaggcgcttaaaagagaaccagatcacaatcagggccgcatttctggaaaaggagaacaccgcgcttcggacagaagtggccgagttgaggaaagaggtcggcaagtgtaaaacgatcgtgagtaaatatgaaaccaagtatggaccattatag

SEQ ID NO: 137900 - DNA, 555 bp, Artificial Sequence
  Description of Artificial Sequence: Synthetic coding sequence
tgatttatctttctgccaagacccggcacgtctctgggcaggatccgtaaagcagataaggagaaaggtaaagagaagctcgaagaggacgaggctgccgccgccagcacgatggcagtctctgcctcattgatgccaccgatttgggataaaaccatcccttacgacggcgagagcttccaccttgaatatatggacctcgacgagtttctgctagagaacgggatcccagcctcccctacacacttggcccataacctgcttctccccgttgctgagcttgagggtaaggaaagcgcatcaagtagtacagcctctccccccagctcctccactgccatcttccagccatccgagaccgtaagcagtacagagtcaagcctcgaaaaagaacgagagaccccatcaccaatcgaccccaactgtgtggaggttgatgtcaatttcaaccccgacccagccgacctggtgctgtcttccgtgccaggaggtgaactattcaatcctaggaagcataaatttgccgaagaagacctgaagccgcagcccatgtag

SEQ ID NO: 137901 - DNA, 822 bp, Artificial Sequence
  Description of Artificial Sequence: Synthetic coding sequence
atggacatgcctgaagtgttgaaatccttactggaacactccttgccatggcctgaaaaacgtactgataaagagaaaggcaaagaaaaacttgaagaagatgaagccgccgcggcttcaaccatggcggtgagcgctagtctgatgccgcctatttgggataaaaccatcccttatgacggcgaatcatttcacctcgagtacatggatctcgacgagttcttgttagaaaacggaattccagcctctcccactcacctggcccataacctgctgctccccgtcgctgaactcgaaggaaaagaatccgccagttcttcgactgcctccccgccctcaagttctaccgcgatttttcagccttccgagactgtgagctctactgagtcctctttggaaaaagagagagaaacaccgtctccaattgaccccaactgcgtcgaggtggatgtgaactttaatccagatcccgccgatctggttctgtcctcagttcctggtggagaactgtttaaccctcggaaacacaaattcgcagaggaagacttgaaaccacaacctatgattaagaaagcgaaaaaggtcttcgtgcctgacgagcagaaagatgagaaatattggactaggagaaagaagaataatgttgcagccaaacgcagtagagatgcccggcggctgaaggaaaaccagattaccatcagagctgcctttttagagaaggagaacacagcattgcgcacagaggtagccgagctgagaaaggaggttggcaaatgcaagactatcgtgtctaagtacgagactaaatatggccccctgtag

SEQ ID NO: 137902 - DNA, 822 bp, Artificial Sequence
  Description of Artificial Sequence: Synthetic coding sequence
atggacatgcccgaggtgctgaagtccctgctagagcacagcctgccctggcccgaaaagaggactgacaaagaaaagggtaaggaaaaactagaggaagatgaggctgctgccgcctctacaatggctgtttccgccagtttgatgccacctatctgggataaaacaattccttatgacggcgagtcatttcacctcgagtatatggacctggatgaatttttgctcgagaacggcattcccgccagtcctacacacctggcccacaatttgttactccctgtggcagagctggagggcaaggaatctgccagtagcagtacagcctctcccccctcctccagcactgctattttccaaccctctgaaaccgtttcctccacagagtcatctctggagaaggagagggaaactccgagtcccattgatccgaactgcgttgaggtcgatgtgaactttaaccccgaccccgcagacttggtgctctcttccgtccccggcggcgagttattcaaccccaggaaacataagtttgctgaagaagacctcaaaccccagccaatgataaaaaaagcgaaaaaggtgtttgtccctgatgagcagaaggatgaaaagtattggacgagaagaaaaaagaacaatgtggctgcaaagaggtcgagagatgccaggcggttaaaagaaaaccaaattacaatccgggccgctttcctcgaaaaggagaacacagctctaaggacggaagtcgccgaactgcgcaaagaggtcgggaagtgtaaaacgatagtaagcaaatatgaaaccaagtacggtcctctgtag

SEQ ID NO: 137903 - DNA, 729 bp, Artificial Sequence
  Description of Artificial Sequence: Synthetic coding sequence
atgcccggtccttggttgttactcgccctggcccttaccttaaatctgaccggagtaccgggggggagagctcagccagaggcagcacaacaagaggcggttactgccgctgagcaccctgggctggacgattttttacgccaggtagaaagactgttgttcctgagagagaacatccagagactacaaggcgatcagggcgaacacagtgcctcacagatcttccagtccgattggctgtccaagcgtcagcatcccggtaaaagggaagaagaggaagaagaaggcgtggaagaagaggaagaagaggaaggcggggctgtggggccccacaagcgacagcaccctggtaggagggaagatgaggcaagttggagcgtcgacgtcacccagcacaagagacagcaccctggtcggagatccccatggctggcctatgccgtaccaaaaagacagcacccgggaagaaggttagccgatccaaaggcccagagatcctgggaggaggaagaggaagaggaagagcgagaagaggacttgatgcccgagaaacgccagcacccgggcaaaagagccttaggtgggccttgtggacctcagggcgcttatggccaggccggcctgctccttggcctcctggacgatctgtctcgcagccagggtgcagaagaaaagcgccagcatcccggtcggagagctgcttgggtgcgtgagccacttgaagagtag

SEQ ID NO: 137904 - DNA, 3075 bp, Artificial Sequence
  Description of Artificial Sequence: Synthetic coding sequence
atgggcgaggacgatgcagcgttgcgtgcagggtctcgcggtttgtctgatccatgggctgactcagtgggggtgaggccgaggaccactgagcgccacatcgccgttcataagcgtctggtgcttgccttcgcggtgagtctcgtggctctcctggctgtcactatgctggccgtactgcttagcctgaggttcgatgaatgtggggcttcagccacccctggagctgatggagggcctagtggttttcctgaaaggggtggtaatgggagcctgcccgggtcggcaaggaggaatcatcatgccggtggcgactcctggcagcccgaggctggcggcgtggcaagcccgggcactacatccgcgcaaccccccagcgaggaggagagggaaccgtgggagccatggacacagctcaggttgagtggccacctcaagcctttgcattataatctgatgctcacggcatttatggagaactttacattcagtggagaggtgaacgtggagatcgcttgccgcaacgcaacaaggtatgtggttctccacgcttccagagtggcggtggagaaagtgcagcttgccgaagatcgagcattcggggcagtcccggtggcaggcttctttctgtaccctcagactcaggtgctggttgtcgtcctgaatcgaacactggacgctcagcgtaattataacctcaagatcatctacaacgccctcatcgaaaatgaacttctgggttttttcagatcttcttatgtgcttcacggcgaacgacgtttcctgggtgttacgcagttctccccaactcatgcaagaaaggccttcccctgctttgacgaacccatttacaaagcgacttttaagatctccattaagcatcaggctacttacctttccctgtcgaacatgccagtggaaacttctgtttttgaggaggatgggtgggtcacagaccatttttctcagaccccccttatgtcaacatactacctggcttgggccatttgcaattttacgtatagagaaaccacaaccaaatctggcgtggttgtgagattgtacgccaggccggatgcaatccggagagggagcggggactatgccttacacatcactaagcggttaatcgaattctatgaagattattttaaggtgccatattccttgccgaaattggatctgctcgccgtgcctaaacacccgtacgccgcaatggaaaattgggggctaagcattttcgtagagcaaaggatcttgttggacccctcagtcagcagcatttcttacttgttggatgtgacaatggtcatagtgcacgagatttgccatcaatggttcggtgatctcgttaccccagtctggtgggaggacgtctggctcaaggagggatttgcccattattttgagtttgtgggcacggattatttgtatccagggtggaacatggaaaaacagcgctttttgactgatgtgttgcatgaagtgatgctgcttgacggcctcgctagttcccaccctgtgagccaagaagtgttacaggccaccgatattgaccgtgtgttcgattggattgcctacaaaaagggcgccgcccttatccgcatgctggcaaacttcatgggccacagtgtgttccagcggggcctgcaggattatctcacgatacataagtacggaaatgcagctcgcaacgatctttggaatactctcagcgaggcactgaaacgcaacggaaagtatgttaacatccaggaggttatggaccagtggacccttcagatgggctatcccgttattacgatcttggggaacactaccgcagaaaacagaatcatcataacccagcagcatttcatctatgatataagcgcaaaaaccaaagctcttaagttgcagaataacagctacctatggcagataccactgacaatcgtcgttggcaatcggagccatgtctctagtgaggctataatctgggtgtctaataagtctgaacaccaccgtataacctatctggataaaggcagttggttgctcgggaatatcaatcagaccggatatttcagggtgaattatgaccttcggaattggcggttgctgatcgaccagctcattcggaatcatgaggttctgagcgtcagcaacagagctggcctgatcgatgatgcattcagtttagctcgtgcgggctacctccctcagaacatacccttggagattatccgttatttgtccgaagagaaagattttctgccctggcatgctgcctcccgtgccctttaccctctggacaagctgctcgaccggatggaaaattacaacatattcaatgagtacattttgaaacaggtcgcgaccacttacatcaagcttggatggccaaagaataattttaacggatctctggtgcaagccagttatcagcacgaagagctccggcgcgaggtgattatgctggcctgcagcttcgggaacaagcactgtcatcagcaagcttccaccctcatctcagattggatttcaagcaaccgaaatcgaatacccctgaacgtacgggatattgtttattgtactggggtctcactgctggacgaagatgtgtgggagtttatctggatgaagttccactcaaccacggccgtgtccgaaaagaagatcctcctggaagccctaacttgctctgacgaccgcaatctcctgaatcgcctgctgaatttgtccctcaattccgaggtagtcctggatcaagacgccattgacgttatcatacacgtggcaaggaacccccacgggagggatctcgcttggaaattttttcgcgataagtggaagatcctaaatacacgctatggcgaggccctgttcatgaattccaagctcatctccggagtgaccgaattccttaatactgagggagagcttaaggaactgaaaaattttatgaagaactatgacggcgtggccgccgcctccttttctagggccgtggagacagtggaggccaatgtgcgttggaaaatgctgtaccaggacgaattattccagtggctgggtaaagcgctccggcactag

SEQ ID NO: 137905 - DNA, 1197 bp, Artificial Sequence
  Description of Artificial Sequence: Synthetic coding sequence
atggaaaacgagaccgtaagcgaactcaaccaaacccaactccagccccgggcggtggtcgccctcgagtaccaggtggtgaccatcctcctcgtgctgatcatttgtggcctgggaattgttggtaacatcatggtcgtgctggtggttatgcgtacaaagcacatgcggacacctaccaactgctacctggttagcctggcggtagccgatctgatggtcctcgtggctgccgggctcccaaatattaccgactcgatctatggatcatgggtgtatgggtacgtgggctgtttatgcattacatacctccagtaccttgggatcaacgcttcttcatgctctattacagcatttacaatcgaacgttacattgccatttgtcaccccattaaggcccaatttttgtgtacttttagcagggctaaaaaaataataattttcgtttgggcctttacttctttgtactgtatgctgtggttttttcttctcgacttgaacataagtacatacaaggatgccatcgtgattagctgtggctataagatctcaagaaattattatagtccgatttacctgatggactttggtgtattttatgtagtgcccatgatcctggcaactgttctgtacggctttatagcaagaattttgttcctgaaccctataccgagcgatccaaaagagaacagcaagacatggaagaacgactccacccaccagaataccaacctgaatgtaaatacaagcaacaggtgctttaattctacagtcagctcaagaaaacaggtaaccaagatgctggccgtagttgtaattctgtttgcattgctctggatgccctatcggactctggtggtagttaactcctttctctcttctccctttcaggaaaactggtttctcctcttttgccggatttgcatttatctgaactccgctatcaatccagtgatctacaacctaatgtcacagaagttcagggctgcctttcgcaagttgtgtaattgcaagcagaagcctacagagaaaccggcgaactacagcgttgcccttaattacagcgtaataaaagagagtgaccacttctccaccgagcttgacgacatcactgtgacggatacctatctttccgctactaaagtgagctttgacgacacgtgcctggcatctgaagtgagcttcagccagagctag

SEQ ID NO: 137906 - DNA, 1197 bp, Artificial Sequence
  Description of Artificial Sequence: Synthetic coding sequence
atggaaaacgaaacagtgtcagaacttaatcagacgcagctgcagcctcgtgccgtggttgctctcgaatatcaagttgtgaccatccttctagtgctgattatctgcgggctcggaatcgtggggaatattatggttgtgctagtggtgatgcggactaaacatatgagaacccctaccaactgttaccttgtctctctggctgtggctgacctgatggttctggttgctgcaggtctacctaacattaccgattccatttatggctcgtgggtgtacggatacgttggttgcctttgtattacctatctccaatacttaggcattaacgccagttcgtgctctatcaccgccttcaccatcgagaggtatatcgccatttgtcatcccatcaaggcccagtttctctgcaccttttcacgagccaagaagatcattatttttgtgtgggcgtttacgtctctgtattgcatgctgtggtttttcctgctcgacttgaacatcagcacatataaggacgccattgtaatcagctgcgggtacaaaatctctcgtaattactacagccctatataccttatggattttggggtgttttacgtggtgcctatgatactcgccaccgttctatacggctttatcgcccggattcttttcctgaaccctatcccgtccgatcccaaggaaaacagtaagacttggaaaaatgactccacccaccaaaatacaaacctgaacgttaatacctcaaacaggtgtttcaattcaactgtctcatccaggaaacaggtcaccaagatgttggcagtagttgtgatattatttgctctgctgtggatgccataccgtacactagtggtggtgaattccttcctatcatctccctttcaggaaaactggttcctcttattctgccgaatttgcatatatctgaattccgcaatcaaccccgtgatatataatctcatgtctcaaaagtttcgagcggcttttaggaaattgtgcaactgtaaacagaaaccgaccgagaagcccgccaactactctgtggccctcaactacagcgtgattaaggagagcgaccacttctcaacagagctcgacgacatcacggtgacagatacttatttatcagccaccaaagtgtcgtttgacgacacctgtctcgcctccgaggtgtcctttagccagtcatag

SEQ ID NO: 137907 - DNA, 1128 bp, Artificial Sequence
  Description of Artificial Sequence: Synthetic coding sequence
atggaggacgaaatgccaaagaccctctacgtgggtaacctatcccgcgatgtgactgaggcattaattcttcagcttttcagccaaatcgggccttgtaagaactgcaagatgattatggacacggccggtaacgatccgtattgcttcgtggagtttcacgagcacagacacgcagctgcggcactcgccgctatgaacgggagaaaaattatgggaaaggaagtcaaggtcaactgggccacaacaccttcatcccaaaagaaggacacttcaaatcattttcacgtttttgttggcgacctgtcccctgagattactacagaggatattaaggcagcattcgccccgttcggtagaattagcgacgccagggtggtgaaagatatggccacaggcaaaagcaagggatatggctttgtgagctttttcaacaagtgggacgcagaaaatgccatacagcagatgggcggccaatggcttgggggtaggcaaatccgcaccaattgggctacccggaagcctcccgccccaaagagtacctatgaaagcaataccaaacagctgtcttacgacgaggtggttaatcagtcatcaccgtcaaactgtaccgtctattgtgggggggtcacatcagggcttaccgagcagctcatgcgccaaaccttcagtccttttggtcagattatggagattagagtcttcccagataaaggatactcttttgttcggtttaatagtcacgaatccgcagctcacgcgatagtatctgtgaatggaactacaatagaggggcatgtggtcaaatgttactgggggaaggaaactttggacatgataaatccagtacagcagcagaaccaaatcgggtatccccagccctacgggcagtggggacaatggtacggtaatgctcagcaaatcggtcagtatatgcccaatgggtggcaagtgcccgcctacggcatgtacggtcaagcttggaatcagcaagggttcaatcaaacgcaaagctcggcaccttggatgggacccaactacggggtgcagcccccccagggccagaatgggagtatgctgcccaaccaacccagcggttacagggtagcagggtatgagactcagtag

SEQ ID NO: 137908 - DNA, 1161 bp, Artificial Sequence
  Description of Artificial Sequence: Synthetic coding sequence
atggaggacgagatgccaaaaaccctgtatgttggcaacctatctcgggacgtgaccgaagctcttatcttacaactgttttctcagatcggtccatgtaaaaactgcaagatgattatggacactgcaggaaatgatccctactgtttcgtggaattccatgaacatcggcacgcagccgccgccctggctgcaatgaatggaagaaaaatcatggggaaggaggtgaaggttaactgggctaccacccctagctcacagaaaaaggatactagtagctcaacggtcgtatcaactcaacgttcccaggaccactttcacgtgtttgtgggggacctttctcctgagattacaacagaggacatcaaggcagcctttgccccctttggaaggatttccgacgcccgcgtagtgaaagacatggccacaggcaagagcaaaggatacggttttgtgtctttttttaacaagtgggacgccgagaacgccattcagcaaatggggggccaatggctcggcggaaggcagattagaactaattgggccacaaggaagccaccagccccaaaatccacttacgagtctaacaccaagcagttgtcgtacgatgaggtcgtaaaccagagctcgcccagcaactgcaccgtgtactgtgggggcgtgaccagcggcctcaccgaacaactgatgagacagacattcagcccatttggtcaaatcatggaaattcgggtgtttcctgataaaggttatagcttcgtacggttcaattcccacgaatccgccgcccacgcgattgtgtccgttaacggaacaacaattgaaggacacgtcgtgaaatgctactggggaaaggaaactttagacatgattaaccctgtgcagcagcagaatcagatcggctatccacaaccttacggccagtggggacagtggtacggcaatgcacagcagattggccagtacatgcccaacgggtggcaggtcccggcatacggaatgtatggacaggcttggaatcagcaagggttcaatcaaacccagagttctgccccttggatgggcccgaactatggagtgcagccccctcagggtcagaatgggagcatgctacctaatcagccatccgggtacagagtcgctggatacgaaactcagtag

SEQ ID NO: 137909 - DNA, 1392 bp, Artificial Sequence
  Description of Artificial Sequence: Synthetic coding sequence
ccgctggtctctagagagactccactctcatgtagtcacaataggctgaatgaccttggaggttccgaagggcagggagccgggcccggcggtgccgctgcaactgctgctgcaatggaggatgagatgccaaaaactttgtacgtggggaatctttctagagacgttaccgaggcactgatccttcaactcttcagccagataggcccttgcaagaactgcaagatgattatggacactgccgggaacgacccgtactgttttgtggagttccatgaacatcggcacgctgcggctgccttagccgctatgaatggaagaaagataatgggtaaagaggtaaaggtcaactgggctaccactcccagtagtcagaagaaggatacatcaagctccacagtggtcagtacacagcggagccaagatcactttcacgtgtttgtgggagacctctcccccgagattaccaccgaagatattaaagccgcgtttgcccccttcggtcgaatctccgacgcccgagtggtcaaagatatggctaccggaaagtccaaaggctatggctttgtgtctttttttaacaaatgggacgccgagaacgctatccagcagatgggcggccagtggctggggggacgtcaaatcaggaccaactgggcgacacgaaagcctcctgccccaaaatccacctatgagtgtagatgcatcggtgaagaaaaggagatgtggaattttggagagaagtacgcccgcttctgctcgaggagactcatagccgaaattgatgagaaacagatcaagacaaccatccaaaagagcaacaccaagcagctctcttatgacgaagtcgtgaatcagagctctccatctaactgcacagtgtactgtggcggagttacttcaggcctgaccgagcagctcatgagacagacattctcgccatttggtcagatcatggagatccgcgtgttcccggacaaaggatattccttcgttcgatttaattcacacgagagcgccgcccacgctatcgtttccgttaatgggactacaattgagggtcacgtggtcaaatgttactgggggaaagagactcttgatatgatcaaccctgttcagcagaaccagattggctacccccagccatacgggcagtgggggcagtggtatgggaacgcacaacaaatcggacaatatatgccgaacggatggcaggtaccagcgtacgggatgtacgggcaggcatggaatcagcagggctttaatcagacacagagcagcgcaccttggatggggcccaattatggggttcaaccacctcagggacagaatggcagcatgctacccaaccaaccttccgggtatagagtggccgggtatgagacccagtag

SEQ ID NO: 137910 - DNA, 258 bp, Artificial Sequence
  Description of Artificial Sequence: Synthetic coding sequence
atgatcaccgaacacacctcaaatgacccttactgctttgttgagttttatgaacatcgggacgcagctgcagcactagcagccatgaacggccgaaaaattctgggaaaggaggtaaaagttaattgggccaccacgccttcatcacagaagaaagatacgagcaaccatttccacgtgtttgtgggagacctgtcccctgagattactacagaggatataaagtctgccttcgcccccttcggtaagattagctag

SEQ ID NO: 137911 - DNA, 759 bp, Artificial Sequence
  Description of Artificial Sequence: Synthetic coding sequence
atggatgctcgcgtcgtgaaggacatggccaccggcaagagtaagggctacggcttcgtgtctttctataataagctcgacgccgaaaacgccattgtccacatgggagggcagtggctgggggggcgacagattagaacgaactgggccacgcgcaaacctcccgcccccaagagtacacaggagaataacacgaagcagctgcggtttgaagacgtggttaaccaaagtagcccaaagaactgtactgtgtactgtggaggtatcgcgagcggactgacggatcaactcatgcgccagacattttctccattcggacagatcatggagattcgcgttttccctgagaaaggatatagttttgtaaggttcagtacacacgagtccgccgcccatgctatcgtgtccgtgaatggcaccaccatcgaaggccatgtcgtcaagtgttactggggcaaagagagtcccgacatgacgaagaactttcaacaagtggattactcccagtggggacagtggtctcaagtgtatggcaatcctcaacagtatggacagtacatggccaatggctggcaggttcctccttatggagtctatggacaaccctggaaccagcaaggctttggtgttgatcagagccccagcgcagcctggatgggtggctttggcgcccagcccccccagggacaggcgcctcctcccgttattcctcctccaaatcaagctggttatggcatggccagctaccagacgcaatag

SEQ ID NO: 137912 - DNA, 1179 bp, Artificial Sequence
  Description of Artificial Sequence: Synthetic coding sequence
atgatggaagatgatggtcagcccagaacactgtacgtgggtaatctgagccgcgatgtgaccgaggtgttaatcctccagctgttcagccagataggtccatgtaagagttgcaagatgatcacagagcaaccagacagtcgaagggttaacagctcagtgggctttagcgtcctacagcatacaagcaatgacccctattgcttcgtggaattttatgagcatagagacgcagctgctgcactggcggccatgaatgggagaaagatcctggggaaggaagtgaaggtcaactgggccacgactccgagcagtcagaaaaaagatacatctaatcattttcacgtttttgtgggtgacctgtcaccggaaattactaccgaggatatcaagagcgccttcgcgccattcggcaaaatttcggacgcacgggttgttaaagatatggctaccggcaagtctaaagggtatggattcgtgtctttctacaacaaactggatgccgaaaacgcgatagtacatatgggagggcagtggttaggaggacgccagattcgcaccaactgggcgacacgcaaaccccctgcacccaagtctactcaggagaacaataccaaacaattgcggtttgaagatgttgtgaatcagagctctcctaaaaattgtacagtttattgcggtggcatagcttctggccttactgaccagcttatgcggcagaccttctctccttttggtcagatcatggagattagggttttccctgaaaagggttattctttcgtgaggtttagcacccacgagtccgcagcccatgctatcgtgagtgtgaacggcactaccatagaaggccatgtcgtcaaatgctattggggcaaggaatcccctgatatgaccaagaatttccagcaagtggattacagccagtggggacaatggagccaggtctacggaaatcctcagcagtatggccagtacatggcgaacggatggcaggttccaccgtatggtgtctatggccagccatggaaccaacagggtttcggtgtggaccagtcgccttcagcagcttggatgggcggcttcggcgctcagcccccccaggggcaggctccacccccagtgataccgccgcctaaccaagccggctacggaatggcatcttatcaaactcagtag

SEQ ID NO: 137913 - DNA, 399 bp, Artificial Sequence
  Description of Artificial Sequence: Synthetic coding sequence
atgattactgaacataccagcaacgacccatattgtttcgtggagttttatgaacatcgagacgcagcggcggctctcgctgcgatgaatggtaggaaaatcctggggaaggaggttaaggtgaattgggccacaacaccctcatctcaaaaaaaggacacttccaaccacttccacgttttcgtgggcgatttgtcccctgagattaccacagaagacatcaagtccgcctttgctcctttcggcaaaatctcagatgcccgagtggtgaaggatatggccactggtaaatcaaaaggatacggatttgtgagtttctacaacaaactggacgctgagaatgcaattgtgcatatgggaggccagtggctgggtggaaggcagatcaggacgaactag

SEQ ID NO: 137914 - DNA, 1128 bp, Artificial Sequence
  Description of Artificial Sequence: Synthetic coding sequence
atgatggaggatgatgggcagccgaggactctctatgtgggaaacctgagccgggatgtcactgaagtcctgatcctgcaactgttttctcagattggaccgtgcaagtcttgcaagatgataaccgaacacacttccaatgatccctactgtttcgtcgagttctatgagcacagagacgccgctgcggccctcgcggcgatgaacgggcggaagattcttggaaaagaagtgaaggtgaactgggccacaaccccgtccagccagaaaaaagacactagtaatcacttccatgtgttcgtgggagatctgagccctgagataaccacggaggacatcaaaagcgccttcgcaccattcgggaaaatcagtgacgcccgagtggtaaaggacatggcaacaggaaaatcaaaaggatatggcttcgtctcgttttataacaaactcgatgccgagaatgccattgttcacatgggaggccagtggttgggagggcggcagattagaactaattgggcgacaagaaagcctcccgccccgaaatctacccaggaaaacaataccaagcaactgaggtttgaggacgtggtgaaccaaagctctccaaagaactgcaccgtgtactgcgggggtatagcttcaggcttgaccgatcagctcatgagacaaacgttctccccattcggacagattatggaaatccgggttttccctgagaaaggctactcgttcgtgagatttagcacacatgaaagcgctgcccacgccatagtgtcagtaaatggcactacaatcgaaggtcatgtggtgaagtgttattggggaaaagagagtcctgatatgactaagaacttccagcaggtagactattcccagtgggggcagtggagccaagtgtacggaaacccacagcaatatggacagtatatggccaatgggtggcaggttcccccatacggcgtttatggccagccgtggaaccagcagggattcggcgtagaccagtccccctctgcagcttggatgggcggatttggagctcagcctccccagggtcaggcaccaccgccagtgattcctccacccaatcaggcaggatacggaatggcatcataccagacccagtag

SEQ ID NO: 137915 - DNA, 1776 bp, Artificial Sequence
  Description of Artificial Sequence: Synthetic coding sequence
atggccagcaaatgttcaagcgagcgaaagtcacgaacctctctgacgctcaatcagaagctggagatgataaaactgagcgaggagggcatgtccaaggctgagatagggagacgactgggtctgctgcgtcaaactgtcagccaggtcgttaacgccaaggagaaattccttaaggaggtgaagtcagcaacccctatgaacaccaggatgattaggaagcggaatagcctcatcgccgacatggaaaaggtgctggtggtttggatcgaggatcagacttcgagaaatattcctttgagtcagagtctaatacagaacaaggcccttacacttttcaactcaatgaaggcagagaggggtgttgaggcggccgaggagaaattcgaagctagtcgcggctggtttatgaggtttaaggagcgttcacacttccataacatcaaggctcagggcgaagctgcctcagctgacgtcgaagctgccgctagctatcctgaggcgcttgcaaaaatcatcgatgagggtgggtacactaagcagcagatctttaatgtggacgagaccgccttctactggaaaaaaatgccgagcaggacttttatcgcaagggaggagaaaagcgtacccggttttaaggcctccaaggatcgcctgacactgttgctaggagctaatgccgctggcgatttcaagctcaagccaatgctcatttaccatagcgaaaatccacgggcgctgaagaactataccaagtctacactgcccgtgctgtacaaatggaacagtaaagctcgtatgacagcccacctgttcactgcgtggttcaccgagtatttcaaacccaccgtcgagacctattgctccgaaaagaagatccccttcaagatattactcctgatcgacaacgcaccctcccaccctagagccctcatggagatctacgaggagattaacgtgatctttatgcccgcaaacacaacatcaattcttcagcctatggaccagggtgtgatatccacattcaagtcctactacctcaggaatacttttcacaaggcactggccgcgatggactctgatgtgagcgatggatcaggacaaagcaaactcaaaacgttctggaaagggttcacaattttagacgcaatcaagaacattcgggactcttgggaggaggtaaaactcagcactctcactggcgtatggaagaagctgatacctaccttgatcgatgactatgagggcttcaaaacttccgtggaagaagtgtccgccgacgtggtagagattgctaaggaacttgagttggaggtggaaccagaggatgtgacggaactgctgcagagtcatgacaagactctgacggacgaagaattatttttgatggacgcccagaggaagtggttcctggaaatggagtccaccccaggagaggatgccgtgaacattgtggagatgactaccaaagacctcgaatattatattaatctggtggacaaggcagctgctggttttgagcggattgacagtaatttcgaacgatctagcacggttggcaaaatgctgagcaactcaatagcctgctatagagagatcttccacgagaggaaaagccaactgatgcgcaaggcgtcacctatgtcttactttagaaagctgccgcaaccaccccagccttcagcagccactacactgactagccagcagcctagtacatccagacaggacccacccccagctaagcgcgtgagattgacagaaggttcagattag

SEQ ID NO: 137916 - DNA, 1578 bp, Artificial Sequence
  Description of Artificial Sequence: Synthetic coding sequence
atgcttggcaagcgcaaacgagtagtcctgactatcaaggataaactggatatcatcaagaagcttgaagaaggtatcagttttaaaaagctatcagtggtctatggcatcggcgagtctacagtgcgcgacatcaagaaaaacaaggaaaggatcatcaattacgctaatagctctgacccgacatccggtgttagtaagcggaaaagtatgaaatctagcacttatgaggagttagatagagtgatgatcgagtggtttaatcagcagaagaccgatgggattcctgtcagcggcaccatctgcgccaagcaggctaagtttttcttcgatgccttgggaatggagggagattttaatgcatcatctgggtggttgactaggttcaaacagagacatggcatcccgaaggccgctggcaagggaactaagcttaagggggatgagacggccgcacgcgaattttgtggcagctttcaggaatttgttgagaaggaaaatttacagccagagcagatttatggagctgatcagaccggattgttttggaaatgcctcccatccaggactctaacactggagacagaccagtccacgagcggttgtagatcaagtcgggagaggatcatcataatgtgctgcgcgaatgccaccggactgcacaaacttaatttgtgcgttgttggaaaggccaagaaaccaagggcctttaaggggacagatttgtctaacctccctgtcacctactactcacagaagggggcgtggatcgagcagtcagtatttagacagtggttcgaaaagtatttcgttcctcaggtgcagaagcacctgaaatctaagggcctgttggaaaaagccgtcctcctccttgactttccccctgccagaccaaatgaggaaatgctgtctagcgacgatggccggataattgtaaagtatctgcctccaaatgtgacatccctaatccagccaatgtcccagggagtgctggccacagtaaaaagatattacagagccgggctgctccagaaatacatggatgagggaaacgatccaaagatcttttggaaaaacctaactgttctggatgctatctatgaggtctcgcgcgcctggaatatggttaaatcgagcacaattactaaggcctggaagaaactcttcccgggcaatgaggaaaatagcggcatgaatatcgacgaaggagccatcctggctgcaaatctcgccaccgtgcttcagaataccgaggaatgcgagcatgtggatattgaaaatatcgatcagtggttcgattcacgctcctctgatagctcctgccaagtgttaacagactccgagagtgctgaggatcagaccaaagccgctgaacagaagcccagctccaaaagcaggaagactgaacttaatccagagaaacacatttcccacaaggcggccctcgaatggacggaaaatttgctcgactatctggaacaacaagatgacatgcttctttctgacaagctggtactgagaagattgcgcaccatcattagaaagaagcagaagatccaaaataacaaaaaccattag

SEQ ID NO: 137917 - DNA, 1650 bp, Artificial Sequence
  Description of Artificial Sequence: Synthetic coding sequence
atgaataagcggggaaaatacacaaccctgaatctagaagagaagatgaaggtattgtccaggattgaggctggcagatccctaaagtctgtgatggacgaattcggtatttccaagtctaccttttatgacatcaagaagaataagaaattgatactggattttgtactgaagcaggacatgcctcttgtgggtgctgaaaaacgaaaacgcacaaccggcgccaaatacggagacgtggacgatgccgtgtatatgtggtaccagcaaaaaagaagcgcaggcgttccagtgaggggggtggaactgcaggctgcagctgaacgcttcgcccgctgttttggtcgaactgatttcaaggcctcaacaggttggttgtttcgtttcagaaaccggcatgctatcggcaacaggaaggggtgcggggagcaagttctgagctccgtttctgagaacgtggaacccttcagacaaaagctgtcaatgattattaaggaggagaaactttgtctggctcagctctatagtggggatgagactgatctgttctggaaatccatgccagagaatagccaggcttcccgcaaagatatatgtttacccggcaagaagattaataaagagcggctgagcgccttcctctgcgccaatgccgacggaacgcataaactcaaatctataataatcggaaaatccaaactgcctaagtccgtcaaagaggacacaagtaccttgcccgtgatttataagcccagcaaagatgtgtggttcacacgagaactgtttagcgagtggttcttccaaaacttcgtcccagaggtgcgacatttccagttaaacgtgttgcggtttcatgatgaagatgtacgggctcttcttctgctggattcttgtcctgctcatccatcgtcggaatctttaacttcggaagatggccggataaagtgcatgtttttcccccacaacacttccacactcattcagcctatgaatcagggcgtcattctttcttgcaagaggctgtatcgttggaaacaactcgaagagagcctcgtgatcttcgaagaaagcgacgacgagcaggagaaaggggataagggtgtgtctaaaatcaaaatttacaacatcaagtctgccatctttaactgggcaaagtcatgggaggaagtcaaacagattacgattgccaacgcttgggagaacctcctgtataagaaggagcctgagtacgacttccagggactggagcatggcgattatcgagagatcctggaaaagtgcggtgaactcgagactaagctggatgacgaccgggtgtggctgaatggcgatgaggaaaaggggtgtctgctgaagaccaaggggggcatcaccaaggaggttgtccagaaggggggcgaagccgagaagcagacagcggaattcaagctctctgctgtccgcgagagtctggactacttgctcgattttgtcgatgccacacccgagtttcagcgattccattttacgctcaaagagatgcaacaggaaattgtgaaaaaacagtttcaaagtaaaattcattcaaggataggcagcttcctgaagccgagaccccataacatcaaagactctttttcaggaccctccacctcaggatccaatcattag

SEQ ID NO: 137918 - DNA, 1650 bp, Artificial Sequence
  Description of Artificial Sequence: Synthetic coding sequence
atgaataaacggggcaagtacaccactctgaacttggaggagaagatgaaagtcctcagcagaatcgaggcgggtcgcagtctgaaaagtgtgatggacgagttcggcatttctaagagcacattttacgatattaagaaaaacaagaagttaattctggactttgtgctgaaacaggacatgccgctggtgggcgcggaaaagcgcaaaagaactactggagcaaagtatggggacgtagacgatgctgtttacatgtggtatcagcaaaaaagatcagcaggggtgcccgtcaggggagttgaactccaggccgcagctgaacgcttcgcccggtgttttggcagaacagatttcaaggcctccaccggctggctgtttagattcaggaaccggcacgccatcggcaatcgcaagggatgtggggaacaggtgctctccagcgttagcgagaatgtggagccctttcggcagaagctgtcaatgatcatcaaggaggaaaaactgtgcctcgcccaactttattccggtgacgagactgacctattctggaagtccatgcccgagaactctcaggctagtcgcaaggatatttgtctgcccggcaagaaaatcaacaaagagcggctgtccgcattcctgtgtgccaacgctgatggcacccataagctcaagtctattatcatcggcaagtctaagcttccaaaatccgtgaaggaagatacaagtacactgcctgtgatctataaacctagcaaagatgtctggttcaccagagagcttttctctgagtggtttttccagaatttcgtacccgaggtgagacattttcagttaaacgtacttcggttccatgatgaggacgtgcgcgcacttctattgctcgacagctgccccgcccaccccagctctgaaagcctaacttcggaggatggaagaatcaagtgcatgttttttccccataacacttccaccctgatccagcctatgaatcagggggtgattctgtcctgtaagaggctataccggtggaagcaactcgaagagagtctcgtcatatttgaggaaagcgacgatgagcaagagaagggcgataagggagtcagcaagattaagatctataacatcaagagtgccatttttaactgggccaaaagttgggaggaggtcaagcagattactatcgcaaatgcctgggaaaatctgctctataaaaaggaaccagaatacgacttccagggtctggaacatggggattacagggagatcctcgagaagtgtggtgaactggaaaccaaattggatgacgaccgggtgtggttgaacggggacgaggagaagggttgcttgttgaagacaaagggggggattaccaaggaggtagttcagaaaggaggcgaggccgaaaaacagactgccgaattcaaactgtctgcggtgcgtgaatcgttggactaccttctggactttgttgatgccacgcctgagtttcagagattccacttcacgctgaaagaaatgcagcaagaaatcgtgaaaaaacaattccaatcgaagattcactctaggattggatccttcctgaagccacgccctcacaacatcaaagattcctttagcggaccaagcacctcgggttcaaaccattag

SEQ ID NO: 137919 - DNA, 1536 bp, Artificial Sequence
  Description of Artificial Sequence: Synthetic coding sequence
atgaacaagcgcgggaaatacaccacgctgaacctggaggagaagatgaaggtcctgtcacgtattgaagctggcaggagtctaaagtctgtgatggacgagttcggtatatctaagtcaactttttatgatataaaaaaaaacaagaaactcattctcgattttgtcctgaaacaggacatgcccctcgtgggcgctgaaaaacgaaaaagaactacaggtgccaaatacggcgacgtggatgatgcagtgtatatgtggtatcaacaaaaaagatcggcaggagtgccggtgagaggagtggaactgcaggcggcagcagaaaggtttgcacgatgcttcgggcgcacagacttcaaggcctccacaggatggctgttccggtttaggaaccggcatgccattgggaacaggaaggggtgcggtgagcaggtgcttagctctgtgtcagagaacgtggagcctttccggcagaagttgagcatgatcatcaaggaggaaaaactgtgcctagctcaactgtattctggcgacgaaactgatcttttctggaagagcatgcctgaaaactctcaggcgagcaggaaggacatttgtcttcccggtaaaaagatcaacaaagaacgcttatctgcattcctgtgtgcaaatgcggatggaactcacaagctcaaatccatcatcatcggcaagagtaagctgccgaagtcagttaaagaggatactagcacactcccggtgatatataagccctccaaggacgtatggttcacaagggagcttttcagtgagtggtttttccagaatttcgtccccgaagttaggcactttcagcttaacgtacttaggtttcacgacgaagatgtgagagcactgctgctcttggatagctgcccggcacatcccagttccgagtcattaacaagtgaagatggccgaattaaatgtatgttctttccccacaacacaagcaccctcattcagccgatgaaccagggcgtgatcttatcttgcaaacggctgtataggtggaagcagctcgaagagtcactcgtaatattcgaggagtctgacgacgaacaggagaaaggcgacaagggggtgtctaagatcaaaatatataacatcaaatccgctattttcaactgggctaagagctgggaagaggtgaaacaaattacgattgctaacgcttgggaaaatttgctctacaagaaggagcctgaatacgactttcagggcctggagcatggcgactaccgagaaatactggagaagtgtggcgagctggaaactaagctggacgatgaccgagtttggcttaacggagatgaagaaaagggttgtctcttgaaaaccaaagggggcatcacaaaggaagtggtgcaaaaaggcggagaagctgagaaacagactgcagaattcaagctgagtgcagtgagagagagcctggactaccttctggactttgttgatgccacccctgaattccagcgcttccatttcaccctctgtgagttctccgatgattcttag

SEQ ID NO: 137920 - DNA, 1644 bp, Artificial Sequence
  Description of Artificial Sequence: Synthetic coding sequence
atgacgtctgctgctccagcgaagaaaccctacagaaaggcacccccggagcatcgcgagctgagactggagattcccggaagtcggttggaacaggaagaacccctcacagatgcagagcgaatgaagctgctgcaagaggagaatgaggaattgagacgaaggcttgccagcgccacccggcgtactgaggctttggagagggagctggagatcggacaggattgtctggaactggagctgggccagtcaagggaggagctcgacaaattcaaggataagtttcgacggctgcagaactcgtatacagctagccaacggaccaaccaggaactggaggataaacttcatactctgatcaagaaggctgaaatggatcgcaagactctggattgggaaattgttgaactgaccaacaagctgctcgacgctaagaacactatcaataagctcgaagagttaaatgaacggtatcgcctggactgtaacctggcggtacagttactgaagtgcaacaagtcacactttaggaaccacaagtttgccgacttaccttgcgaacttcaagatatggtaagaaaacatctgcactctggtcaggaggcagcttcccccgggcctgcgcccagcctcgcccccggtgctgttgtcccgacttctgtgatcgctcgcgtcctggaaaagccagaatccttactgctgaactcggcacagtcgggctcagccggtcgcccgcttgcggaggatgtatttgttcacgttgacatgtctgaaggggtacctggtgaccctgcctcaccccccgccccaggatctcccacccctcagccaaatggtgaatgccacagtcttggaactgccaggggttctcccgaggaggaactgccactgcccgcattcgagaaactcaacccgtatcccaccccgtccccgcctcaccctctatatcccgggaggcgtgtaatcgaattctctgaagataaggtacgtatacctaggaattcccccctgcctaactgcacctacgccaccaggcaggccatatccctgtctcttgtagaagaaggatccgagagagctcgcccatcccctgtcccttccacacctgcaagcgcccaagcatccccacaccaccagccctcgccagcccctctgaccctctcagcacccgcatccagcgctagttcagaggaagatttattagtgtcttggcagagggcatttgttgacagaaccccaccacccgccgctgttgctcagcgtacggctttcggacgtgacgccctgcccgagctccagcgtcatttcgcgcactctcccgccgaccgtgatgaggtggttcaggcccccagcgcaaggcctgaagagagtgagctgctgttacctactgagcccgatagtgggtttccccgggaggaagaagagctcaacctgcctatctccccggaagaggagagacagtccctgctccctatcaacaggggaaccgaggagggtccgggcaccagtcataccgaagggcgtgcctggccactgcctagttctagtaggcctcagcgaagccctaagcgaatgggggtgcatcaccttcatagaaaggattcgctgacacaagcacaggagcaaggcaatcttctgaactag

SEQ ID NO: 137921 - DNA, 1644 bp, Artificial Sequence
  Description of Artificial Sequence: Synthetic coding sequence
atgactagcgcggcccccgcaaagaagccctaccgcaaggctcctccagagcatcgagagctgcggcttgaaataccggggtccaggctcgagcaggaagagcccttgacagacgcagaacggatgaagcttctgcaggaggaaaacgaggagttgagacgcagactggcctctgctactagaaggacggaggccctggagcgggagctggaaatcggacaggactgtctggagttggaactgggacaatctagggaggagctggataagtttaaggacaagtttagacgactgcagaattcctacaccgcatcccagcgcacaaatcaggaactggaggacaaattacacaccctcattaaaaaagccgagatggacagaaaaaccctggactgggagattgtggaacttacgaacaagctgctggacgcaaagaacaccattaacaagctagaggaactgaatgaacgttatagactggactgtaacctggcagtccagctcctgaagtgtaacaagtctcacttccgcaaccataagtttgccgatctgccttgtgaactccaggacatggtgcgaaagcatcttcacagcggtcaggaagccgcatccccagggccagcaccttccctggcacctggagccgtggttccgacttccgtgattgcaagagtccttgaaaagcctgagtctctactcttgaacagcgcccagtccggaagtgccggtcgacccctggcagaagatgtatttgttcacgtagatatgtccgaaggggtcccgggagaccccgccagcccccccgctcctggctcacccaccccacagcctaacggcgaatgtcatagtctgggtaccgcgagaggttcccccgaggaggaactgcctctccctgcttttgaaaagcttaacccttatcccactccatccccaccccaccccttgtatcccgggcgtagggttatcgagttctcagaggataaggttcgcataccgcggaactcccccctgcctaattgcacctacgccaccagacaggccatatcactcagtctggtggaggagggaagcgagagagctaggccttctcctgttcctagcactcctgcatctgcgcaggcaagcccacaccaccagccaagtcccgccccgctgaccctgtctgctccagctagttcagcctcatccgaagaagatcttttggtcagctggcaaagagccttcgtggaccgcacccctccaccagcagccgtcgctcagcggaccgcgtttggccgtgatgcgctgcccgagctgcagcgccactttgcccacagcccagcagatcgtgatgaagtcgtgcaagcaccctcagcccgaccggaagagagtgaattgctgctgcctactgaacccgatagcgggtttccccgagaagaagaagaactgaatcttccgatctcccccgaggaggagaggcagtctctgctgcctatcaacaggggcactgaagagggcccaggcacatctcatacggaaggacgcgcctggccccttccaagctccagtcgcccccagcgctcccccaagcggatgggggtacaccacttgcacaggaaagatagcttaacacaagctcaggaacaaggcaatctcctcaactag

SEQ ID NO: 137922 - DNA, 1674 bp, Artificial Sequence
  Description of Artificial Sequence: Synthetic coding sequence
atgacatccgctgcgccagctaagaaaccgtatagaaaagcgccaccggaacacagagaactgcggttggagatccccgggtcgaggttggaacaagaagagcctctcacagatgcggagaggatgaagctccttcaggaggaaaatgaggaactgaggcggagactggcttccgccacgcgcaggactgaggccctggagcgtgaactggagattggacaagactgcttagaactggagctcgggcaaagcagggaggagctggacaaattcaaggataagtttcgaaggcttcagaattcatacaccgccagccagcgcacgaaccaggagttagaagacaaactgcacacattggcaagcctgtcacattcttggatttttgcaattaagaaggctgaaatggatcgcaaaaccttagactgggaaattgtcgagctaacgaacaaactgcttgatgcaaaaaacaccattaacaagctggaagaacttaatgaaaggtaccgactcgactgcaatcttgcggttcagttgctaaaatgcaataagagccacttccgtaaccataaatttgccgaccttccttgtgagttacaggatatggttcgaaagcatctgcacagtggacaggaggctgcaagccctggccctgcccccagcttagcccctggtgccgtggttccaacgagcgtgatcgccagagtgctggagaaaccagaatccctgcttctaaatagtgcccagagtggctcggccgggcgccctctggcggaggatgtattcgtgcatgtagatatgtctgaaggagtaccgggtgacccggcatcaccacccgcgccaggatcaccaacaccccagcctaacggagagtgccattccctcggcaccgctcgaggctctcccgaagaggagctgcccctgcccgcttttgaaaagctgaatccgtaccccactcctagtcccccccatcccctctatccaggccgtcgggtgattgagttttccgaggacaaagtgcggatccctcggaatagtcctctgcccaattgcacatacgctaccagacaggctatctcccttagtctggtcgaggaaggatcagaaagagcccgccctagccccgtgccatccacacccgctagtgcccaggcctctccgcaccatcagccctctcctgccccactgactctgtccgctccagccagcagcgcaagttctgaagaggatctcctggtcagctggcagagagccttcgtcgatagaacgccaccgcctgcagccgtcgctcaaagaaccgcctttggtcgcgacgcactccccgagctgcagaggcacttcgctcacagcccagctgatagggacgaagtggtgcaggctccctccgcccgacccgaggagtctgagttactgctgccaaccgagcctgatagcggcttcccaagagaggaggaagaactgaatctgcccattagcccggaagaggagaggcagtccctcctgccaatcaatcggggcaccgaggaaggacctggtacctcacataccgaaggacgggcttggccattgcccagtagcagcaggccacagcggtcccccaagaggatgggggtgcatcacctgcacagaaaggattcactcacccaggcgcaggaacagggcaatctcctgaactag

SEQ ID NO: 137923 - DNA, 1674 bp, Artificial Sequence
  Description of Artificial Sequence: Synthetic coding sequence
atgacctctgcggctcccgcaaagaaaccatatcggaaggccccaccagaacaccgggaactcaggttggaaatacctggatccaggctcgagcaggaggagccgctgacagacgctgaacggatgaagctgttacaggaggaaaacgaagagttgcgccgccgcctagccagcgcaacccgccgaaccgaggctctggaacgggagctggaaattggtcaggactgtttagagcttgaactgggacagtcccgcgaggagttagacaagttcaaagacaagttccgtagactccagaattcgtatacggcctcccagcggactaatcaggagctggaagacaaactacataccttggcgtccctgtcacactcctggatttttgctatcaagaaggccgagatggatagaaaaaccctggattgggagatcgttgagctcactaacaagctgctggacgcgaaaaataccatcaataagctggaagagctcaatgagagatatcgtctggattgcaacctggccgttcaactgctgaaatgcaacaagtcacacttcaggaatcataaattcgccgatctcccctgtgagctgcaggatatggtgcgaaagcatctgcactctggccaggaggccgcatcccctggacctgctcccagtctggctcccggcgctgtggtcccaacctctgtgattgctcgcgtgctggagaaaccagaaagcctgctgctgaatagcgctcaatctggcagtgccggtcgcccgctcgccgaagatgtatttgttcacgtcgacatgagcgaaggggttcctggggaccctgcgtctccccccgccccaggctcccctacgcctcaaccaaacggggaatgtcactccttggggaccgctcggggttctccggaggaagagctgccattgcccgcttttgagaagttgaatccctaccctacgccctctcccccacacccactgtaccctgggagacgggtcatagaatttagtgaagataaggtgagaataccacgcaactcgcctcttccaaactgcacatatgctacgaggcaagctatctcgctctccctcgtggaggagggaagtgagagagctcgtccgtcaccagtcccttcaacaccagcctcagcccaggcttctccccaccaccaaccaagcccagcccccctgacacttagcgcgcccgcgagttccgcgtcatctgaggaagaccttcttgtgtcgtggcagcgggccttcgtagacagaacaccccctccagcggctgtggcccaacggacagcgttcggtcgggatgccttgcccgaactacaacgccactttgcccacagccctgctgatcgcgatgaggttgtccaggcaccatctgcacgtccggaggagtccgagctcttattgcctactgagcccgattctggcttcccacgagaagaagaggaactgaatcttccaattagtcccgaggaggagagacaatctctcctgcctattaatagaggcaccgaagagggtccgggcacaagtcataccgagggtagagcatggccactccctagctccagccggccccagaggtctcctaaacgcatgggggtgcatcatcttcaccgtaaggactctctcacacaggctcaggaacagggtaacctgcttaattag

SEQ ID NO: 137924 - DNA, 1644 bp, Artificial Sequence
  Description of Artificial Sequence: Synthetic coding sequence
atgaccagtgctgctcccgctaaaaaaccatacagaaaagcgccacctgagcaccgggagctgaggctcgagatccctggctcccgattggagcaagaagaacccctgacagatgcagagaggatgaaacttctgcaggaagagaatgaagaattgcggaggcggcttgcatctgccacgcgacggaccgaggcattagagagagagctggagatcggccaggattgtctggaactggagctcgggcagtccagggaggaactggacaaatttaaggacaagtttaggcgcttgcagaactcctatacggcaagtcagagaacaaaccaggaactcgaggacaaactgcacactttaataaaaaaggccgaaatggataggaagaccctggactgggaaatcgtagagctcactaacaagctccttgatgctaaaaatacaatcaataagctggaggagctgaacgaacgatatcgactggattgtaatttggctgtccagctcctcaaatgtaacaagtcccatttccggaatcacaaatttgccgatctgccatgcgagctgcaggatatggtgcggaaacatctccacagcgggcaggaggccgctagtcccggacctgctccctctttggcacctggcgccgttgtcccaacgtctgttattgctcgcgtcctggaaaagcctgagagcctgctgctcaatagcgcccagagcgggtccgccggaaggccgctggccgaggatgtgtttgtgcacgtcgatatgtccgagggcgtgcctggcgacccggcaagcccacctgccccgggctcccccaccccacaacccaacggtgaatgccactcactgggtaccgcccggggctccccggaagaagagctcccgctacctgcctttgaaaaactgaacccctatcccacgccctcacccccccacccactatatcccggacgcagagttatcgaattcagcgaggacaaagtcaggatccctcgaaacagtccactccccaactgcacgtacgccacacgacaggctattagcttgagtctggtggaagaggggagcgaacgcgcgcgaccatcacctgtaccttcgacgcccgcatccgctcaagcctccccacaccaccagccatcccccgcccctctcactctgtctgctcccgccagctctgcctcctccgaggaagaccttctcgtttcctggcagagggcattcgtagacagaacaccgccacctgctgccgtggcacagagaactgcattcgggagagacgctctgccggaactgcagaggcactttgcgcactctcctgctgatagagacgaagtcgttcaggcgccttccgcgcgaccagaagagagcgagctgcttctgcctaccgaacctgatagtggtttcccacgtgaggaggaagaacttaacctgcctatctcgcccgaggaggaaaggcaatcactactccccattaaccggggtacagaggaaggcccagggacaagtcacactgagggtcgggcctggcctctgccttccagttcaaggcctcaaagatcacccaagaggatgggcgtgcaccacctgcatagaaaggactcactgacccaggcccaagaacaagggaacttactgaactag

SEQ ID NO: 137925 - DNA, 1644 bp, Artificial Sequence
  Description of Artificial Sequence: Synthetic coding sequence
atgacctcggcggctccagctaagaaaccctatcggaaagccccgccagagcaccgcgaacttcggctggagatcccgggatcccgattggagcaggaggagccactgacagacgcagagaggatgaagcttctccaagaggagaacgaagaactgcggaggagactggcgagcgcaactcgtaggacggaggcgctggaaagggaattagaaattggccaagattgcctcgagctggaattaggacagagccgagaagaacttgacaaatttaaggataaatttcgccggttacagaacagctacactgcttcccagcgaactaaccaggagcttgaagacaagctgcacacactaattaaaaaggctgagatggaccgtaaaaccctggactgggaaattgtggaactaacaaacaagctgctggatgcgaagaataccatcaataaactggaggagctcaacgaacgttatcggcttgactgtaacttagccgttcagctactcaaatgcaataagtctcactttcgtaaccacaagtttgccgatctgccctgcgagctgcaggacatggtgcgcaagcacctgcatagcggacaagaagcagccagtcccggcccagcgccatcccttgctccaggtgccgtggtgccgaccagcgttatcgcccgcgtactggagaagcctgagagtctcctgctaaattccgcacagagcgggtctgccggccgccctctggcagaggacgtgttcgtgcatgtggacatgagtgagggcgttcccggtgatcccgccagcccgccagcaccgggctcgcctaccccgcaaccaaatggagagtgccacagcctggggactgccagaggatctccagaggaggagttaccactccctgcttttgagaaactgaatccctatcccactccgagtcctcctcatcccctgtacccagggcgccgcgtgatcgagttttccgaggataaggtcagaatccctcggaatagccctctgccaaactgtacctatgcgactcggcaagccatcagtctctcgcttgtcgaagagggctccgagcgcgctcgacctagcccagtgccatccacacccgcttccgcccaggcgagtccacatcatcagccctcccccgcaccactaacactctctgcccctgctagcagtgctagcagcgaggaggacctgcttgtgtcctggcagagggcttttgtggacagaacaccacccccagccgccgtggcccagcgaacagctttcggcagagatgcactcccagagctccagaggcatttcgctcactccccagccgatcgcgacgaggtggtacaagcacctagcgcccgcccagaggagtctgagctgctgctcccgactgagccagacagcggctttcctcgcgaggaggaggaactgaatttgccgatcagccccgaagaagagcgacaatctctgcttcctatcaatcggggcacagaagaggggccaggcacttcccacacagagggcagagcttggccactcccttccagttcccgcccccagcgcagccctaaacggatgggagttcaccacttgcacagaaaagacagtctgactcaggcccaggagcagggcaatctgctgaattag

SEQ ID NO: 137926 - DNA, 1644 bp, Artificial Sequence
  Description of Artificial Sequence: Synthetic coding sequence
atgacatccgcggctcccgccaagaaaccgtaccgtaaagcacctccagaacacagagaactccggttggagataccaggttctagactggagcaagaggagcctctcaccgatgcagagcgaatgaagttgctccaggaagaaaatgaggagctccggaggcgccttgccagcgccacgagaagaactgaagccttagaacgggagctggaaatcggccaggattgtcttgaactagaactggggcaaagcagagaggaactggataagtttaaagataagtttagaagactgcaaaactcatacactgcatctcagcggaccaatcaggagctagaagataagctgcacaccctgatcaaaaaagccgaaatggaccgtaaaactcttgactgggagattgtggagttgaccaacaaactcctcgatgctaagaatacaatcaataagttggaggagctcaatgaacggtaccggctggactgtaatctggcagtccaactcctgaaatgcaataagtcacattttagaaatcataagttcgctgatcttccctgcgagttgcaagatatggtccgcaagcaccttcatagcggccaagaggccgcaagtccaggtccagcccccagccttgcccccggagcggtggtacctacgagtgtaattgccagagtcctggagaaacccgaatccctactgctaaactcagctcagagcggaagcgccgggagaccattagcagaagacgttttcgtgcatgtcgacatgagtgagggtgtaccaggggatccggcatcaccacccgcacccggctctccgaccccacagcccaatggggaatgccacagcctgggaacggcccggggcagccccgaagaggagttaccactaccagctttcgagaagcttaatccttaccccacaccatcccctcctcaccccctgtaccctggaagacgggtgattgaattctcagaagacaaggtgagaattcctcgtaatagccccctcccaaattgtacttatgctactcggcaggccatctccctatccctggttgaagaaggaagcgaacgcgcccgaccgtccccagttccatccactcctgcgagtgctcaggcttcaccacatcatcaaccatctccagccccactgactcttagtgccccagcctcttcagcttcttcagaggaagacttgcttgtgtcctggcagcgggcgttcgtggacagaacaccaccacccgctgctgtggcacagaggaccgcgtttgggagagatgccctgccagagctgcaacgacactttgcacattcacccgccgatcgggacgaggtggtgcaggctccctctgccaggcccgaggagagcgagctgctcctccccacggagccagacagcggcttcccacgcgaggaagaggagttaaatttacccattagccccgaagaggaaaggcagtcattattgcctattaatcgtggcacggaagagggaccaggtacaagccatactgagggacgggcctggccattaccttcgtccagtcgcccccagaggtcacctaaaaggatgggagtgcaccacctgcaccgcaaggatagtctaacgcaggctcaggaacaaggaaatttacttaactag

SEQ ID NO: 137927 - DNA, 1674 bp, Artificial Sequence
  Description of Artificial Sequence: Synthetic coding sequence
atgacaagcgccgcgcctgccaagaagccataccgcaaagccccacctgagcatagagaactgcgattggagatccccggaagtcgattggaacaggaagaacctctgacagacgctgaaaggatgaagcttctgcaggaggaaaacgaagagctgaggcggagactggcaagtgctaccaggcgcacagaagccctcgagcgtgagttggagatcgggcaggactgtcttgagctggaactgggacaaagtagagaagagctcgataaatttaaggacaagttcagacgcttgcagaacagctatactgcatctcagcgcacaaaccaggaactcgaagacaagctgcataccctggcgagtttgtcccatagttggatattcgcaataaaaaaggctgaaatggatcgaaagaccctcgactgggagattgttgagctgacaaacaaactgttggacgccaagaataccatcaacaaactggaagagctcaacgagagataccgtctggactgtaatttggccgtacagctcttaaagtgtaataagtcccacttcagaaatcacaaattcgctgacctgccttgtgagttacaggatatggtccgcaagcatcttcattctggacaggaagctgcctcaccaggtcctgcaccatcattagcacccggtgccgttgtacccacctctgtgatcgctcgcgtcctggaaaagcctgaaagtcttctcctaaactctgcccaatccggctccgccggccgaccactcgctgaggatgttttcgtccacgtggacatgtccgaaggcgtcccaggagacccggcttcacctccagcacctgggtcacctactccccagcctaacggtgagtgccattctctaggcaccgccaggggctcccccgaagaggaactgcccctcccagctttcgagaaactgaacccctacccgactccctccccaccccaccctctctacccaggcagacgtgtgatcgaattctctgaggataaggtgcgtattccacgcaacagccccctgccaaactgcacatatgccactcggcaggcaatctcgctgagcctggtagaagagggcagtgagcgtgccaggccatctcccgtccccagtaccccagctagtgcgcaggcctcgcctcaccaccagccctcccccgcacctctgacactgagcgctcccgcctcctctgcttcctcagaagaggatctgctagtctcctggcagagagcctttgttgaccgcactcctccccctgccgccgtggcgcaaaggaccgcatttggcagggacgccctgcctgaactccagaggcatttcgcacactccccggccgatagggatgaggtcgtccaggcgccttccgcgcgccccgaggaatcggaactcctcctgcccactgagcctgacagtggctttcccagggaggaggaggagttaaacctgccaatatctccagaggaggaacggcagagtcttttaccaatcaatagaggcaccgaggaggggccagggacatcacatacagaaggaagggcatggcctctacccagcagctccagaccccagcggagtcctaagcggatgggggtgcatcacctgcaccggaaggattcccttactcaagctcaggaacagggtaatctgctcaactag

SEQ ID NO: 137928 - DNA, 582 bp, Artificial Sequence
  Description of Artificial Sequence: Synthetic coding sequence
atgacatccgccgctcctgccaaaaagccatacagaaaggctccacccgagcacagggaactccgacttgaaatccccggatcacgcctggagcaggaggagcctctcactgatgctgagcggatgaaattgctgcaggaagagaatgaggaactccgccgccgcttggcctctgcaacccggcgcaccgaagcccttgaacgggaactggaaatcgggcaggactgtctggaactcgagttgggacagagccgggaggagctggacaagttcaaagataagtttaggaggctgcagaattcctataccgcatcccagaggaccaatcaagaactcgaagataaactacataccttagcctcattaagtcattcgtggatcttcgccattaaaaaggcggaaatggatcgcaagacgctagactgggagattgtagaactgacaaataagttgctggacgccaagaatactattaataagctggaggaactgaacgaacgctatcgtctggactgtaatctggcggtccagcttctgaagtgcaacaaatctcactttcgaaaccataagtttgcagattag

SEQ ID NO: 137929 - DNA, 720 bp, Artificial Sequence
  Description of Artificial Sequence: Synthetic coding sequence
tgactgctgcaggaagaaaacgaggaactgcggcgccgactggcatccgctacccgaaggacagaagccctcgaacgagagcttgagatcggacaagactgccttgaacttgagctcggccagtcaagagaagagcttgacaagttcaaagataagttcagaaggcttcagaacagctataccgcttcgcagagaacaaatcaagaacttgaggataaattacacaccctcattaagaaagccgagatggatcggaagactttggattgggaaatcgtcgagctgacgaataagttgctcgacgctaagaacacgatcaacaaactcgaggaattgaatgaacgataccgtctggattgcaatctggccgtccagctgctgaaatgtaacaagtcccacttccgcaaccataagtttgcagatgtttctagaactcaccccctgcctgcccacatcgaccattctggccattgcaggacaccactaacccctgtctcggcacctctctccgttctgttattcccactctgtcctccacttgcatccatgagtccccttaaaccagtgaattctgcgacggggtggtgcccggtgtactgccctgggcccatcaccagcagtgggggcccagccctcctggtctccgtgaccgaaacggagcgcgaggatccgggacaggagggcgagggaagccagtcttatctgccgaaggagtactag

SEQ ID NO: 137930 - DNA, 5247 bp, Artificial Sequence
  Description of Artificial Sequence: Synthetic coding sequence
atgtcagcacgcgcagccgctgctaagtccaccgcgatggaagagacagccatctgggaacagcacaccgtcaccctgcatcgggctccaggctttggcttcggcatcgccatatctggtgggagagacaatcctcattttcagtcgggcgagacttcaattgtgatctcggacgtgttgaagggcgggcctgcagaaggtcagctgcaggagaatgaccgggttgccatggttaacggggtcagcatggacaatgtcgagcacgccttcgcagtgcaacaactgaggaagagcggcaagaacgcgaagattaccattcggcggaaaaaaaaagtgcaaatccctgtttcccgtccagaccctgaaccagtgtcagacaatgaagaggattcttacgatgaagaaatacatgacccccgctcgggtagaagcggggttgtgaatcggcgtagcgaaaagatttggccccgggatcgttcagcaagccgggaacggagtcttagccctaggtccgaccgcaggagtgtcgcatcctcacagcctgccaaacccactaaagttaccctcgtcaagtcccggaagaatgaagaatacggccttcggctggcctctcatatattcgtgaaggagattagtcaggattcactggctgcccgcgacgggaacatccaggaaggcgacgtggttctgaagatcaacgggaccgtgaccgagaacatgagtctcactgatgcaaaaacgttaatcgagaggagcaaggggaagctgaaaatggtggtccagcgggacgagagagccaccctgcttaacgtacccgacctgagtgactccatccacagtgctaacgcatccgagcgggatgacatttctgagattcagtcactggcctcggatcattccggcagatcacatgatcggcctcctcgacgaagtcgatcccggtcaccagatcagcgtagtgagccatcagaccactctcggcacagtcctcagcagcctagtaatggaagtctaaggagtcgggatgaggaacgtatctccaaaccaggagcggtaagtactcccgtaaagcacgcggacgaccacactccaaagacagttgaagaagtaaccgtcgagcgaaatgagaaacagacaccttctctccccgagccaaaacccgtgtatgcgcaggtgggccagcctgacgtcgacttgccggtcagccctagtgacggtgtgcttcctaattccacccacgaagacggtattttacgcccttctatgaagcttgtaaaatttagaaagggggacagcgtggggcttaggctcgccggcggaaacgatgtgggtatatttgtggcaggcgttctcgaagactctcccgcggccaaggaaggtcttgaagagggcgatcagattctgagagtgaacaacgtggatttcacaaatatcattagagaggaagctgtcctgttcctgctcgacttacctaagggcgaggaggtaactattctggctcagaagaaaaaggacgtatatagacgtatcgtcgaatccgacgtgggtgattctttctatatccgaactcatttcgagtacgaaaaagaaagtccttatggactctcttttaataaaggcgaagtgttccgcgttgtcgacactctgtataatgggaaactcggatcgtggctcgcaatccgtataggtaagaaccataaagaggtcgaaagaggcatcattcccaacaaaaatcgcgccgagcaactcgccagcgtccaatacactcttcccaagaccgccggtggtgatcgggcagacttttggcgctttcgggggctgaggagtagcaagcggaaccttaggaagagtcgtgaggacctgtctgcccagccggtgcaaactaagttccccgcctacgagagagttgttctaagagaagctggcttcctaagacccgtgaccatattcggcccgatcgcagatgtggcgcgggagaagctggccagagaagagcccgacatctaccagatcgccaagtcagagccccgggatgctggaacggaccagaggagcagtggaataattaggctgcacacaattaaacagattatcgatcaggataagcacgcactgctggatgtaacccctaacgcagttgatcgccttaactacgcccagtggtatccaattgtggttttcttgaatcctgattcgaagcagggagtgaagactatgaggatgaggttatgccctgaatcacgtaaaagcgcaagaaagctttacgaacggtcccataaattgagaaaaaacaatcatcacttgttcaccacgacgattaatctcaactccatgaatgacggctggtacggcgctctgaaagaagccatacagcagcagcagaatcagctcgtttgggtgtccgaaggcaaagccgatggggccacaagcgacgatctcgatctccacgatgataggttgtcctatcttagcgccccaggatcagagtacagcatgtacagcaccgatagtcgacatacctcagattacgaggatacggatactgagggaggggcgtacaccgatcaggagctagacgagactctcaatgacgaggtggggaccccacccgaatctgctattacccggagctccgaaccagtgcgggaggacagctcaggcatgcaccatgagaatcaaacctacccaccatactccccccaggctcagccacaaccaatccaccggatagactctccgggattcaagcccgcctcacagcagaaagcagaggcatcctcccctgtgccatacctcagtcccgagacgaacccagcaagcagtacgagcgccgtcaatcacaacgtcaacctgacgaacgttcgcctggaagagcccacacccgctcctagcaccagttattcacctcaggccgattcgctgcggacaccgagtaccgaagcagcacatatcatgctccgtgaccaagagccgtccctcagtagccacgtggatcccactaaggtgtatcgcaaggatccttatcccgaggagatgatgaggcaaaatcacgtactgaaacagcctgctgtatcacaccccggtcacagacccgataaggagccaaatttgacttacgaaccccagctgccctacgtggaaaaacaggcctcaagggacctggaacagcccacctatcgctatgaatcctcttcttacacagatcagttcagcagaaattacgaacacagactccgatacgaggatagggtgccgatgtacgaggagcaatggtcttactatgatgacaagcagccatacccctccagaccacctttcgacaatcagcactctcaggatctggacagcaggcaacacccagaagagtcatctgaaagaggatattttccacggttcgaggagccagccccactgagctacgatagcagaccgaggtatgagcaggctccccgcgcaagtgcccttcgacacgaagaacagccagctcccggctacgatacccacggaaggcttcgtccggaggcacagcctcatcccagtgccggccctaaaccagcagagagcaagcaatatttcgagcaatactcccgctcctatgagcaggtcccaccccagggcttcacttcccgggccgggcattttgaacctttgcacggagccgctgccgtccctccactgattccatcaagccagcacaagcccgaggccctgccctcgaataccaagccactccccccacctccaactcagacagaggaggaggaggatccggctatgaaacctcagagcgtccttacgagagtgaaaatgtttgagaacaaaagatctgcatcgctagaaactaagaaagatgtgaatgataccggaagcttcaagcctcccgaggtcgcctccaagccatccggggctccaatcattggcccaaaaccaacctcacaaaatcagtttagcgagcatgataagactctgtaccgtattccggaacctcagaaaccacagctcaagccccctgaggatattgtaagatccaatcattacgatcctgaggaggacgaagagtattacagaaagcagcttagctacttcgaccgtcgcagctttgagaataagccgcccgctcatattgccgccagtcacctcagtgaaccagcaaaacctgcgcactctcagaaccagagcaatttttcaagttacagcagcaaaggaaaaccacccgaagcagacggcgtggatcgctcctttggagaaaagcgctatgagcccatccaagctacaccccccccaccccccctccccagtcagtacgcgcagccatcacagccagtaacctcagccagcctccacatccacagtaaaggcgcccacggcgaaggcaacagtgtgtcgctcgacttccagaattccttggtcagcaaacccgaccctcccccatcacagaacaagcctgcaacattcaggcccccaaaccgggaggataccgcccaggcagccttctacccacagaaatcctttcccgataaggctcccgtgaacggaactgagcaaacccagaaaacagtaactcctgcatacaaccggtttactcccaagccttacaccagcagcgcgaggcctttcgagcgcaaattcgagtccccaaaattcaaccacaacctacttcccagcgagacggctcataaacccgacctgtcctccaagacaccgacaagccctaagactttggtgaaaagtcactcgctggcacaacccccagagtttgactcaggagtggaaaccttttctatccacgccgagaagcccaagtaccagatcaataatatctcaacagttcctaaggccatccccgtctccccttctgccgtcgaggaggacgaagatgaggacggtcatactgtggtagcaaccgccaggggtatcttcaatagcaacgggggggtgctcagctcaattgagactggcgttagcatcataatcccacagggtgccatcccagaaggcgttgagcaggagatctacttcaaggtgtgtagagacaacagcatcctgcctcccctagacaaagaaaaaggggagacactgttgagccctttagtcatgtgtggaccacacggcctcaaatttctgaagcctgtagagttaagactgcctcattgcgacccaaagacatggcagaataagtgcttgcctggcgacccaaactacctcgtcggtgccaattgcgtgtcggttctgatcgaccatttctag

SEQ ID NO: 137931 - DNA, 5007 bp, Artificial Sequence
  Description of Artificial Sequence: Synthetic coding sequence
atgtcagccagagcagccgcagctaagtccaccgctatggaggagaccgctatttgggaacagcacactgtgaccttgcaccgggcccctggtttcggattcggaattgccatttcaggagggcgagacaacccccattttcagagcggagagacctccatcgttatttctgacgtgttgaagggtggaccagccgagggacagctgcaagagaacgatagagtggccatggtaaacggagtgtcaatggataacgtcgagcatgcttttgctgttcagcagctgcggaagtctgggaaaaacgctaagatcactatcagaagaaaaaaaaaggtccagattccggtttccagaccggacccagaaccagtcagcgacaacgaagaggacagctacgatgaagaaatccatgacccccgctccgggagaagtggtgtagtgaataggaggtccgaaaagatctggcctagggataggtccgcgtcgcgcgaacggtccctgagcccacgatccgaccgaaggagcgttgctagttctcagcctgccaaaccaaccaaggtgacactcgtcaagtcccgtaagaacgaagaatacggcttgagattggcatcccatattttcgtgaaggagatttcccaggatagtctcgccgcaagggacggcaatatacaagaaggcgatgtagttttaaaaattaacggcaccgtgactgagaacatgagcttgacagacgccaaaacactgattgaacggagcaaggggaagctcaaaatggtggtccagagggacgaacgggcaacactcttaaacgtgccagatctgtctgacagcattcatagcgcgaatgcatccgagagagatgatatctccgaaatccagtcgctggcatctgaccattccggccgttctcacgaccgtccaccccgcagaagcaggtctaggagcccagaccagcggagcgagccaagcgatcactcccgccattcgccacagcagccttcaaatgggtctcttaggtcgcgtgacgaagaacgcatctctaaaccaggcgcagtgtcaacccccgtgaagcacgccgacgatcatacaccaaagactgtagaagaggtcaccgtggagaggaacgagaagcagaccccctcactgccagagcctaagcctgtttatgcccaggtggggcagccagacgtagacctgccagtgtcaccaagcgacggggtgctcccaaatagcacacatgaagacggaatcctgagacctagtatgaaactcgttaagttcaggaaaggtgattctgtagggctacgactggccgggggtaatgatgtggggatttttgtcgccggggtgcttgaggattcccccgcggccaaagaaggactcgaagaaggggatcagatccttcgggtcaacaacgtggacttcaccaacattattagagaggaggctgtactcttcctgttagacttgcctaagggcgaggaggtaacaatcttggctcagaagaaaaaagacgtataccgacgcatcgtggagtcagacgtgggcgacagtttttacatccggactcactttgaatacgagaaagagagtccctacggactgtctttcaacaaaggggaggtattccgagtggtggatactttgtataacggcaagctgggatcctggttagctatccgaattggaaagaatcacaaagaagtcgagcgcggaattatccccaacaaaaaccgggcggaacagctggcatccgtgcaatatacgctcccaaagaccgccggaggagatcgggccgatttttggcgcttcaggggcctacgctcttccaagagaaatctgcgcaagtcccgcgaggatctcagtgctcagcccgtacagacaaaattcccggcctatgaacgggtagttctccgtgaagccggatttctgcgcccagtgacgatctttgggcccatcgctgacgtcgcccgagagaaactggcacgtgaagaacctgatatttatcaaatcgccaaaagcgaacctcgcgacgccgggaccgaccagagaagttccggcattatcaggctgcataccattaaacagattatcgaccaggataagcatgcccttctggacgttactcctaacgccgttgaccgactgaattacgcacagtggtatccaatcgtggtgttcctgaatccagacagcaagcagggggtgaagacaatgcgaatgcggctgtgtcccgagagtcggaaaagtgcacgcaagttgtatgagcgcagccataagctgcgaaagaacaaccatcacctgttcaccacaaccattaatctaaacagtatgaacgatggttggtacggagcactgaaggaggcaatccagcaacagcaaaatcagctggtttgggtttccgaaggaaaggcggatggagcaacatcagacgacctggatctccacgacgatcgcctgagttacctgagcgcaccggggtccgaatactccatgtactccactgatagccggcatacctcggattatgaggacaccgatacggagggtggggcatatactgatcaggaactggacgagactctgaacgacgaggtgggaacgcctcccgagagtgctattaccagatcttctgagcccgtgagagaagactcgtccgggatgcaccacgagaaccagacatatccaccttatagccctcaggcccaacctcaacccattcaccggattgattctcctggatttaagcctgccagccaacaggtctatcggaaggatccctatccggaagaaatgatgcgccagaatcacgtgctgaagcagcctgccgtgagccacccaggccatcgacctgataaggaacccaatttgacctatgagccacagctcccctatgtagagaagcaggcatccagggacctggaacagccaacctatagatacgaaagtagctcctacactgatcaattcagccgcaattatgaacatcgcctcaggtacgaagaccgcgtgccaatgtacgaagagcagtggtcctactatgacgacaaacagccctatcccagtcgaccaccttttgataatcagcacagtcaggatctggactctcgtcagcaccccgaggagtcaagcgagaggggttatttcccaaggttcgaagagccggcaccactcagctatgacagtcggcctaggtacgagcaggcgcctagggcatctgccttgcgccatgaagaacagcccgccccgggctatgacacacacggcaggctgagacccgaagcacagccccatcccagcgccgggccgaagcccgccgaatcaaaacaatactttgagcagtactcacgcagctatgagcaagtgcctccacagggcttcacctctcgggcaggccactttgagccgctgcacggagctgcagctgtgcccccgctgattccttcctcccagcataaaccagaagccttacctagcaacactaaacctctccctcccccacctacccagaccgaagaagaagaggacccagccatgaaaccacagtccgtgctgacccgagttaaaatgtttgaaaataagcgctctgccagcctggaaacaaaaaaagacgtcaatgatactggaagctttaaaccaccggaggtggctagcaagccaagtggcgcgccgattatcggcccaaagccaacttcccagaaccagttctctgaacatgataaaacactctacaggatcccagagcctcagaaaccccagctcaagcccccagaagatatcgtgcgttctaaccactacgatcctgaggaggacgaagaatactaccgaaagcagctcagttacttcgatagacgctcctttgagaataaaccgccggcccacatcgccgcttcacatttgtcggagcccgccaaacccgcccactctcagaatcagtcgaacttctctagctacagcagtaaggggaaaccccccgaggccgacggggtcgataggagcttcggcgaaaaaagatacgagcccattcaggccacaccccctccccccccactgccgtcccaatatgctcaacccagtcagcccgtgacatctgcaagcctgcacattcactccaagggggcccacggggaggggaatagtgtgtctctggacttccaaaactccctggtctcgaagcctgatccccctccatcacaaaataaacctgccacattcaggcctccgaacagagaggatactgctcaggccgccttttatcctcaaaagtccttcccggacaaagcaccagtgaatggtaccgagcagacccaaaagacagttacccccgcctacaatcgatttaccccaaaaccttacacctccagtgcccggccttttgagcggaagttcgagtctccgaagttcaatcacaatctgttgccatccgagacggcgcacaaaccagaccttagtagtaaaacccccacatcacccaaaactctggtgaagagtcactctttggcccagcccccagagttcgacagcggggtggaaacattctccatccacgctgaaaagccaaaatatcagatcaacaatattagcactgtgccaaaagctatcccggtgtctcctagtgccgtggaggaggacgaagacgaggacgggcatacagtcgtagcgacagccaggggaatctttaactctaacgggggagtgttgagtagtatagagacaggggtgtccattattattcctcagggggccattccagagggcgttgaacaggagatttactttaaggtgtgtcgagacaactccatcctaccaccgctggacaaggagaagggagagactttactgagccctttggttatgtgtggccctcacggactaaaatttcttaaaccagtggagctgagactcccccactgtgatcccaagacttggcaaaacaagtgtttgccaggcgaccccaattacctcgtgggagccaattgtgtgagtgtgctaattgaccatttttag

SEQ ID NO: 137932 - DNA, 2982 bp, Artificial Sequence
  Description of Artificial Sequence: Synthetic coding sequence
atgcccgtgaggggcgatcgtggctttcccccccgcagagaactttctggatggttaagggctcctggcatggaggaactaatttgggaacaatatacagttacactgcagaaagatagtaagaggggctttggcatcgccgtgagcggcggacgggacaaccctcactttgaaaatggtgaaacctccattgtaataagcgacgtcctgccaggggggccggcagacggactgctgcaggagaacgatcgtgtagtcatggtaaatggtacccctatggaggacgtcctgcatagctttgccgtccaacagctgcgtaaatctgggaaagtagccgctattgtcgtgaagcgcccgagaaaggtgcaagttgcggccctgcaggcctcacctccactggaccaggacgacagggccttcgaggtaatggatgaattcgatggccgcagcttccgatcggggtactccgagagatcacgtctcaactctcacggtggcagatcacgcagttgggaagactctcctgagagggggaggccgcatgaacgggccaggtcccgagagagggacctgagtcgcgatcgatccaggggccgctctctggagcgcggacttgatcaggaccacgcacgcaccagagataggagtaggggaaggtccctggaaaggggattggaccatgacttcggacctagccgcgatagagacagggatcgctcccggggacgttctatcgatcaggactatgaacgagcttatcatcgtgcttatgatcctgattatgagcgggcgtactctcccgagtacaggaggggggccagacacgacgcccgcagtaggggaccccgaagccgcagcagggaacacccgcactccagaagcccctcgcccgagcctagaggaaggccagggccaattggggtgctgttgatgaagtctagggcaaatgaggaatatgggctccgcctaggttcccagatattcgtgaaggaaatgactcggactggcctggctactaaggatggaaacctccacgaaggcgacatcattctcaaaataaacggcacggtaaccgagaatatgagcctaacagacgcccgcaagctgatcgagaagagtagaggcaagcttcaactcgtggttctgagagatagtcagcagactttgattaacatccccagcctcaatgactctgattcggagatcgaggacatcagcgagattgagagcaacagaagcttcagtccggaggagaggcgacatcagtactcagattacgactaccacagctctagcgaaaaactcaaagagcgcccgtcatctcgcgaggacacacctagccggctgagcagaatgggtgctacacccacaccattcaagagcaccggagatatagctggaacggtagtccccgagactaacaaagaaccccggtatcaagaagatcctcctgctcctcagccaaaggccgcccctaggacttttctgaggcccagccccgaagatgaagcgatctatggtcctaatacaaagatggttcggttcaagaagggggattctgttggactgcgattagctggggggaatgacgtaggcattttcgtagccggcatccaagaggggacctctgctgaacaggaggggctccaagagggagatcagatcctgaaggtgaatacccaggacttcagggggctggtgcgggaagacgccgtgttatacctgctcgaaatacccaagggcgagatggtgactatcttggcccagagccgcgcagacgtctatcgagatattttggcttgtgggcggggcgactcttttttcatcagatcccattttgaatgcgaaaaagaaaccccccagagtttggcttttactaggggagaagtcttccgcgttgtcgatactctgtacgacggcaaactggggaactggctcgccgtcaggattggtaatgagcttgaaaaaggccttatccccaataaaagccgcgcagagcagatggcatcggtgcagaacgctcagagagacaatgccggtgaccgagcagatttctggaggatgcggggccagcgatctggcgtcaagaaaaacttacgcaagtccagggaggatcttacagcagtcgtgagcgtctcaaccaagttccctgcttacgaaagggtgctgctgagggaggccggatttaagcgcccagtggtgctctttggccctatcgccgatattgcgatggagaaactggctaacgagctccccgattggttccagaccgctaaaactgaacctaaagatgccggaagtgaaaaatcaacaggtgttgtgagactaaacactgtgcgtcagataatcgagcaggacaagcatgcactgttggacgtaaccccaaaggccgtggacctcctgaattatacccagtggtttcctatagttatctttttcaatccggactctaggcaaggcgtgaagaccatgcgacaaaggcttaacccgaccagcaacaaaagtagccggaagctcttcgatcaagccaacaagctgaagaagacatgtgctcatctgtttacagctaccatcaacctgaatagcgctaatgactcttggttcgggagtttaaaagataccattcaacatcaacaaggcgaagccgtatgggtttctgagggaaagatggaagggatggatgatgatccggaggatcgtatgagctacctgactgcaatgggggcggattatttaagctgtgattctaggctaatttcggacttcgaggatactgacggggaggggggggcctacacagacaacgaactcgacgaaccggccgaagagccactggtgagctccattactcgttcgagcgaacctgtgcagcatgaagaggtgcgcagaggcaggccacgcgccggcaccggcgagcccggtgtgtttctggccctgtcttggactgccgtatgctctggctgctgcggcagacatagctag

SEQ ID NO: 137933 - DNA, 3132 bp, Artificial Sequence
  Description of Artificial Sequence: Synthetic coding sequence
atgcccgttcgaggcgaccggggatttcccccaagaagggaactgtcagggtggttaagagcccccgggatggaggagttaatctgggagcagtacacggtcactctgcaaaaagactctaaacgaggattcggtatcgccgtctctggcggcagagacaacccacacttcgagaatggagaaacatccattgtgatttctgatgtgctgcctggcggtcccgctgatgggctgctgcaagagaacgaccgagtagtgatggttaatgggacgcccatggaggacgtcctgcactcatttgcagtgcagcagttgagaaagtcgggcaaagtggcagcgattgttgttaagaggcctaggaaggtgcaggttgcggccctgcaagcttcgccccccctggaccaggacgaccgagcctttgaagtcatggatgagttcgatgggaggagttttaggagcgggtacagcgagagatctcggctgaattctcacggggggagaagcaggtcgtgggaagatagcccggagcggggcaggcctcatgagcgcgctcggtcacgggagcgagatctgagccgcgacaggagcaggggaaggagtcttgaacgtggcctggatcaggatcacgctcggacacgagatcggtccaggggaagaagcttagagagagggctggatcatgacttcggaccgtcgcgcgatagagatagagaccgctctaggggcaggtctattgatcaggactatgaacgagcttatcacagagcatatgacccagattacgaaagagcatatagcccagaatatcgtcggggggcccgccacgatgcacggagtcgagggccacggagcaggtcacgggagcatccccatagccgtagcccatcccccgagccacgtggtcgccctggaccaattggggtccttctgatgaagtctcgcgctaacgaagaatacggtctccgattggggagtcagatctttgtgaaggagatgacgcgaaccgggctcgcgactaaggatggcaatttacatgagggcgatataatcctgaagattaatggaacagttaccgagaatatgtctctaaccgacgctagaaaattaatcgagaagtcccgtggaaaattgcaactggtggtcctcagggactcccagcagaccctgataaacatcccaagcctgaacgactctgatagcgagatcgaagacataagcgaaattgaaagcaaccggagtttctcacccgaggaaaggcgtcaccagtattcagactatgactaccattccagctcggagaaattgaaggagaggccttccagccgggaagacactccgtctcgtctttccagaatgggcgccacacccactcctttcaaatccacgggggacattgcaggcactgtggtaccggagactaataaggaaccacgatatcaggaagacccccctgctccccagcctaaggccgctccccgaacttttctgagaccaagcccagaagacgaggcaatctacggtcctaacacaaaaatggtaagatttaaaaaaggtgatagcgtcggcctgagactagcagggggcaacgacgttggcattttcgtggctgggatccaagaaggtacatctgcagagcaagaagggttacaagagggggatcaaattctgaaagtcaatacccaagatttccgagggctcgtgcgtgaggacgccgtgctgtatttgttggaaattcctaagggagagatggtaaccatcctggcacaaagccgcgcagatgtctatagggatatattagcttgcggacgtggtgactcattttttattaggtcccatttcgagtgcgaaaaggagactccccaatcgctggccttcaccaggggggaggtgtttagagtggtggatacgctgtatgatggtaaactgggcaactggcttgctgttcgcattggaaacgagctggagaaggggttgatccccaacaagtcgcgagctgagcagatggcaagcgtgcaaaatgctcagagagacaatgctggcgacagggcagatttttggagaatgcgcgggcagcgaagcggagtcaaaaagaatctgcgcaaaagccgggaagatctcactgcagtggtcagtgttagtaccaaatttccagcgtatgaaagagtgctcctccgtgaggccggatttaagaggccagtagttctgttcggtcccatcgctgacatagctatggagaaattagctaacgagctgccagactggttccagactgcgaagaccgaacccaaagatgccggcagcgaaaagtcaactggagttgtccgcctaaatactgtgcgacaaattatcgagcaggataaacacgctctcctggatgtgacacccaaggcagtagacctgctgaattacacgcagtggttcccgatcgttattttttttaatccagattccaggcagggcgtcaagactatgaggcagagacttaacccaacaagtaataagtcctctcgcaaattgtttgaccaagctaacaagctgaaaaagacctgtgcccacttattcaccgccacaattaatctcaacagcgctaacgatagctggtttggcagcctgaaagacaccatccagcaccagcagggcgaggccgtgtgggtgagtgagggaaagatggaagggatggatgacgatccagaggaccgcatgtcctacctgacggcaatgggcgctgattatctttcttgcgactctagactcatcagcgatttcgaggacaccgatggagaagggggcgcttacacagataacgaattggatgagccagccgaagaaccccttgtgagcagtatcactcgctcttcagaaccggtccagcacgaggaaatcgagatcgcccagaaacaccctgatatctatgcagtgcctataaagacacacaagcctgatccagggacgcctcagcacacttcttctagaccacctgaacctcagaaagctccatcgcggccttaccaggacacaaggggctcatatgggtctgacgcggaggaagaagagtatagacagcagttaagcgagcatagcaagaggggctattacggtcagtctgcccgctaccgggacaccgaactttag

SEQ ID NO: 137934 - DNA, 3573 bp, Artificial Sequence
  Description of Artificial Sequence: Synthetic coding sequence
atgccagtgcgtggtgatagaggatttccccctagacgagagctgtcaggttggctgagggcccccgggatggaggaacttatatgggaacagtacactgtgactctccaaaaagactctaagaggggattcggaattgccgtcagcggagggagagacaaccctcacttcgagaacggtgaaaccagcatcgttatttcagatgtactgcctggtggacccgctgacggcctcctgcaggaaaatgacagagtggtcatggttaacgggacacccatggaagacgtacttcactctttcgccgtgcagcagttgaggaaaagcggaaaagtggccgcaattgtggtgaagcgacctcgcaaggtgcaagtcgccgcccttcaggcctctcctcccttggaccaggatgaccgcgccttcgaagtgatggatgaatttgatggccggtcgtttaggagcggctacagtgaaaggtcccggttgaattcgcatggaggaagaagcaggtcttgggaggacagcccagaacgaggcaggccgcacgagcgtgctagatcaagggaacgggacctctcccgggaccggtcccggggccgctctctcgaaaggggactggatcaggaccacgcccgaacaagagacaggtctcgaggacgtagcctcgagcgtggactcgatcatgattttggcccaagcagagacagggacagagaccgcagccggggcaggtccatcgaccaggattacgaacgggcgtaccacagagcatatgaccctgactacgaaagggcctactctccggagtatcggagaggtgctaggcatgacgcccgcagtcgtggcccacgctccaggagccgagaacacccacactcaagatcaccttcacctgagcccagggggcgacccgggcctattggggtgttgctaatgaagtctcgggccaacgaagaatacggactgcgcctggggtctcagattttcgtcaaggaaatgactcggactggtctggcaacgaaggacggcaaccttcacgaaggcgatatcattttgaaaataaatggtaccgtcacagaaaacatgagcttgaccgatgctcgcaaattgatagaaaaaagccgaggcaagttgcaactggtggtgctgagggatagtcaacagacactgatcaacattccatccttaaacgactctgactccgagatcgaggacattagcgagatcgaaagtaatcggtctttctcaccagaagagagacggcaccagtactcagattacgactatcattcgtcatctgagaagctgaaagaaagaccatcatcccgtgaggacacaccatcccgcctgtcaaggatgggtgccaccccaaccccttttaagtctaccggagacatagcaggcaccgttgtaccagagaccaataaagaacccagataccaggaagaccccccggctcctcagcctaaggcagctccccgcaccttcctgcggccatcacctgaggacgaagcgatctacgggcccaataccaaaatggtgagatttaagaagggtgattctgttgggctgaggctcgccggcggaaacgatgtaggcatattcgttgcgggaattcaggaggggactagcgcagagcaggaggggctgcaggagggagatcagatcttgaaagtcaacacgcaagacttcaggggcctcgtccgggaagacgctgtcctctacttattggagattcctaagggtgagatggtgacaatcctggcacaaagcagagctgatgtatatagagacattctggcgtgcgggagaggagattctttcttcattcgttcccacttcgagtgtgagaaggaaacaccacagagtcttgcctttacaagaggcgaggttttcagagtcgtggatacactctatgatggcaaactgggaaattggctcgcggttcggatcggaaacgagctagagaaagggctcatccccaacaagtcccgcgcagagcagatggcaagtgttcagaacgcccaacgtgataatgccggtgatcgcgcagatttctggcgcatgcgtggacaaagatctggtgtgaagaagaacctgcggaaaagccgagaggatctgaccgctgtggtcagtgtttcaactaaattccctgcttacgagcgggtactgctacgggaagccggcttcaagcggcccgtcgtgttgtttggccctattgcggacatcgcaatggagaagctcgccaacgagttgccggattggtttcagactgctaaaactgagcccaaggatgctggtagcgagaaatctactggggtggttagactgaacactgtgcgccagatcatcgaacaggataagcacgccctgcttgacgtcacacccaaagccgtggacctcttgaactatacgcagtggttcccgatagtcatttttttcaacccggatagtcgccagggcgtaaaaaccatgagacagcggctcaatccaacctccaacaagagttctagaaagctgtttgatcaagccaacaaacttaagaagacctgcgcccacctgttcaccgccaccattaacttgaatagcgccaacgactcttggtttggatccttaaaagacacaatacagcaccagcagggagaagctgtgtgggtctcagagggcaaaatggaggggatggacgatgaccctgaagatagaatgtcctacctaactgccatgggggctgattacctgtcctgtgattccagactgatttctgattttgaggacaccgacggtgaaggcggggcttacaccgacaacgaactggacgaaccggcggaggagccactggttagctccattacaagatcttctgagccagtccagcatgaggaaagtatcaggaagccttctccagagccacgggcccagatgagacgcgccgcgtcaagcgaccagctgagggacaattcgccaccacctgcgttcaagcctgagcccccaaaggccaagacccaaaacaaggaggagtcatacgacttctctaagtcatatgagtataaatccaaccccagtgccgtggcaggcaacgaaactcctggcgcctccaccaaaggttatcccccacctgtagctgccaagcctacatttggaagatccatcctaaaaccgtcgacccccattccacctcaggaaggagaggaagtaggggagagctctgaggagcaagacaatgcccctaaatcagtgttgggaaaggtcaagatctttgaaaagatggaccacaaagctaggctgcagagaatgcaggagctgcaggaagcacagaatgcgcgcattgagatcgctcaaaagcaccctgacatctatgccgttccaattaaaactcacaagcccgacccaggcacaccgcagcacacctcctcccgacccccagaacctcagaaagcaccaagccgcccatatcaagacacacgcggcagctacggatccgatgctgaggaagaagagtaccggcaacaactgtccgagcatagcaaacgaggctactacggtcaatccgcgcgttaccgagataccgaactatag

SEQ ID NO: 137935 - DNA, 306 bp, Artificial Sequence
  Description of Artificial Sequence: Synthetic coding sequence
atggaggaattaatctgggaacaatatactgtgacactgcagaaagactctaagcgaggtttcggcatagctgtgtctggcggccgcgacaacccccacttcgaaaacggagagacatccatcgttatttccgacgtgctccccggcggcccagctgatggcctgttgcaggaaaatgacagagtcgtgatggtgaatgggactcccatggaggacgtgctgcacagctttgcagttcagcagttacgcaagtctggtaaggttgcggctattgtgagcacaggattcgcatttagcctaccatag

SEQ ID NO: 137936 - DNA, 486 bp, Artificial Sequence
  Description of Artificial Sequence: Synthetic coding sequence
atggaggaactgatctgggagcagtacaccgtcaccctgcagaaagacagtaagcgaggattcgggatcgctgtgtctgggggacgagataatccacacttcgagaacggagaaacctccattgtgatttccgatgtcctccccggtgggcctgccgacggattgctgcaggaaaacgaccgggtggtcatggtgaacggaaccccgatggaggacgttctccacagttttgccgtacagcaactgcgaaagagcggcaaagtagcggccattgtcgtgaagcgtccaagaaaagtacaggtggccgcactgcaggcgtcacctccattggaccaagatgaccgcgcctttgaggtgatggatgaattcgacggccggagctttcgttctgggtactccgaacgctcacggctcaatagtcatgggggcagatcacgctcttgggaggactccccagaaaggggacgcccacacgaacgcgcgtag

SEQ ID NO: 137937 - DNA, 3063 bp, Artificial Sequence
  Description of Artificial Sequence: Synthetic coding sequence
atggaagagcttatctgggagcagtacacggtaacactacagaaagacagtaagcgcggttttggcattgctgtgtcaggggggagagataatccccatttcgaaaatggcgagacctccatagtaatctctgatgtgttgcctggaggccccgccgatggactgctgcaggaaaatgacagggtggtaatggtaaatggcacacctatggaagacgtcctacacagtttcgccgtgcagcagctccggaagtctggaaaagtggctgcgattgtcgtgaaaaggccccggaaagttcaagtagccgcactccaagcctctcctccacttgatcaggatgatagagcctttgaggtgatggacgagttcgacggcagaagctttcgaagcggttatagcgagcgatctagacttaactcccacggcggccgtagccgcagctgggaggattcacctgagaggggcaggccacatgagagagctcgtagcagagaacgggatctgtctagggatcgctccagaggtcggtcactcgaacggggactcgaccaagaccatgctcgaacccgcgataggtctcgtggcaggtcactggaaaggggactcgaccacgacttcggtcccagcagagatcgagacagagacagaagcaggggaagaagtattgatcaggattatgaacgggcctaccacagggcatacgaccctgattatgagagagcatacagtccagaataccgtcgaggagccaggcacgatgctagatctcgcgggcccagatcccgtagtagggaacatccccactctagaagcccttccccagaaccaagagggcggcctggacctattggagtactgctgatgaagtctagggcaaacgaggagtacgggctgcgactgggatcacagatctttgtgaaagagatgaccagaacaggccttgcaacaaaggacgggaatctccatgagggtgacatcattctcaaaataaacgggaccgtgactgaaaatatgtcacttacagacgctcgaaagctcatagaaaagagtcggggcaagctgcagctggtcgtgctgcgtgattctcagcaaaccttgatcaacattccatccctgaatgattccgattcggaaatcgaggatatatctgagattgaatccaacaggtctttctcacccgaggagcgccggcaccagtacagcgattacgactaccactcatcttccgagaagctgaaagagcggccttcttctcgagaggatactccttcccggctctccagaatgggggctacccccacacctttcaaatcaacgggggacatcgctggcaccgtggtccctgagaccaataaggagcccagataccaggaggaccctccagccccccagcctaaagcagcaccacgcaccttccttcggccttcgcctgaggacgaagcaatatacggacccaataccaaaatggtgcgctttaaaaaaggcgattccgtggggctgaggctcgccggcggaaacgacgtcggcatctttgtggccgggatccaggagggaacatctgccgagcaggagggcctgcaggaaggggaccagatcctaaaggtcaacacgcaagatttcaggggactcgtgagagaggacgcagtactgtacttactggaaatcccaaagggagagatggtcaccattctggcgcagtccagggcggacgtgtaccgcgatatactggcctgtgggagaggagatagcttctttattcgaagccactttgagtgcgaaaaggaaacaccccagagtttagcctttacacgcggagaggtgtttcgggtagtggacacattatacgacggcaagttgggaaactggctggccgtaaggatcggcaatgagctggagaaaggcctcatacccaacaaatctagagccgaacaaatggcctctgtacagaatgcccaacgtgacaatgcgggcgatcgagctgatttttggaggatgagaggccagcgctcaggagtgaagaagaacctccgaaagagtcgggaagatctcaccgctgtggtgtccgtgtccactaagtttcctgcctatgaacgtgttctgctgagggaggccgggtttaagcgacctgtggttttattcggccctattgcggatatcgctatggaaaagctggccaacgaactgccagactggtttcagactgctaagacagagcccaaagacgccggatcagagaaatccaccggcgtggtgcgactgaataccgtgagacaaatcatcgagcaggacaagcatgcactgttggacgtgaccccaaaggctgtcgatctgctgaattatacccaatggtttcccatagttatcttctttaatcccgacagcaggcaaggagtaaagaccatgcgtcagaggcttaacccgaccagtaataaatcctctcggaaacttttcgaccaggcaaacaagctcaagaagacttgtgcccatttattcacagcaacgatcaatctgaatagcgccaatgattcttggttcggttctcttaaggacacaattcagcatcaacaaggcgaagcagtgtgggtttctgaaggcaaaatggagggcatggacgacgatccagaagatcggatgtcctacctgacagccatgggcgctgactacctgtcctgtgattcccgcttgatttccgactttgaggacactgatggcgagggcggggcctatactgacaacgagttagatgagcccgcagaggagcccctcgtctctagtatcacaagatctagtgagcccgtacagcatgaggagatcgaaattgcgcaaaagcacccagatatttacgccgtaccgattaaaacccacaaacccgatccaggaaccccccagcacacaagttcccggcctccagagcctcagaaggccccaagtcgcccgtaccaggacacccgaggatcctacggatcagacgcagaggaggaggagtatcggcagcagttgtccgagcatagcaagagaggctactacggtcaatctgcaaggtaccgagatactgagctctag

SEQ ID NO: 137938 - DNA, 3474 bp, Artificial Sequence
  Description of Artificial Sequence: Synthetic coding sequence
atgaaaaccgcccaggcccttcatcggatgtggatacaagccgtaaaaaaactccgacgctggaagggcagagcccccggtatggaggaactgatttgggaacaatatacggtcacattgcagaaggatagtaagagaggttttggaattgccgttagtgggggaagggacaacccccattttgagaatggagagacatcgatagtgatcagcgatgttttaccaggagggcctgctgacggcctgctgcaagagaacgaccgcgttgtgatggttaacggaactcctatggaagacgttttgcacagttttgcagtgcaacagctccggaagtccggcaaggtagccgccatcgtggtgaagaggccacgcaaggtccaggtcgccgccctgcaggctagccccccactggatcaggatgatcgggcttttgaggttatggatgaatttgacgggaggtctttccgctctggatacagtgagcgaagtcggctgaacagtcacggcggaaggagtcgatcctgggaggatagcccggagcgtggcagacctcatgaacgcgctagatcacgtgagagggacctctctagggacagatcccgcgggcggtcccttgagcgggggctggaccaggatcacgctcgtacccgcgacaggtcacgaggtcgatctctggaaagaggcctagaccatgattttggtccatctagagacagagaccgtgatcggtcccgaggaaggtcaatcgatcaggattatgaaagagcataccaccgggcatatgatcctgactacgaacgggcttatagtccagagtatcgccggggcgctaggcacgatgcgaggtctagggggcctagatcccggagcagagagcaccctcacagcagatccccctctcccgagcctcgggggcgacctgggccaatcggcgtgctgctcatgaagtctagggccaatgaagaatacggccttaggctggggtcccagatcttcgtgaaggagatgacccgtacggggttggccacgaaggatggcaacctgcacgagggagatattattctgaaaatcaatggcacagtgaccgaaaacatgagtctgacagatgctcgcaaactcattgagaagagcagagggaaactgcaattggtggtgttgcgggacagtcaacagactctaatcaacatcccttccctgaacgattcagatagtgaaatcgaggacattagcgagattgagagtaatcgaagcttctccccagaagagcggcggcaccagtactccgactatgactaccactcaagctccgagaagctcaaggaacgcccctcctcacgcgaggacactcctagccgcctctcccggatgggcgccacacccaccccctttaagtcgacgggggacatcgcggggacagtggtgccagaaaccaacaaagaacctaggtaccaagaggaccctccagccccacaaccaaaggctgccccaaggacgtttttgcgaccctcacccgaggatgaagcgatttacggacctaataccaagatggtgcgctttaaaaagggagatagcgtagggctcagactggctggcggaaatgatgtggggatcttcgtggctggaatccaggagggtacgagcgccgaacaggagggcttgcaggaaggtgatcagatcctcaaggtgaatactcaggacttccggggtcttgtgcgggaagatgcagtcctataccttctagaaattcctaagggagaaatggtgaccattctcgcacagtcacgggctgatgtttatagggacatcctggcctgcggaaggggcgacagctttttcatccgctcccattttgagtgcgaaaaagaaacaccgcagtctctcgcttttacacgcggtgaagtgtttcgagtggtcgataccctctacgacgggaagttgggtaattggctggccgttcgcattggaaatgaactggagaaaggactgatcccaaacaaaagccgggccgagcagatggcatccgtgcagaatgctcaacgagataacgctggggatcgcgcggatttttggcgcatgcgggggcaacgtagcggagtgaaaaagaatctgcggaaatcccgggaggacctgacggccgtcgtgagcgtttccaccaagtttcccgcttacgagcgtgttcttctacgcgaagccgggtttaaacggccagtggtgttgttcggaccgattgcagacatcgctatggagaagctggccaacgaattgcccgactggtttcagaccgcaaagacggaaccaaaagacgccggaagtgaaaaaagtactggagtggtgcggctaaataccgtacgacaaatcatcgagcaggataagcacgccttactcgacgttacacccaaggctgtggacctcctgaattatactcaatggtttcccatagtcatttttttcaatcccgattctagacaaggagtgaagaccatgaggcagcggcttaaccccactagtaataagtccagcaggaagttatttgatcaggcaaataaacttaaaaaaacgtgtgcacatctttttaccgcaaccataaacttgaattctgctaatgattcctggtttggctcgctgaaggataccatacagcatcagcagggcgaagctgtatgggtttctgaaggtaagatggagggaatggacgacgacccggaggaccgaatgagctacctaaccgctatgggtgccgactacctgagttgtgacagcagattgatctcggacttcgaggataccgacggggagggaggagcttatactgacaacgagcttgacgaaccagccgaagagcctctcgtgagctcgattactcggagttctgagcccgtccagcatgaggaggctaagacacaaaacaaagaagaatcttacgatttcagcaaatcttacgaatacaagagcaaccccagcgcagtcgccgggaatgagacaccgggcgccagcactaaagggtacccacctccggtggccgctaagccaacattcggcagaagcatattaaaaccatcgaccccaatcccgcctcaagagggcgaggaagtaggggagagctctgaggagcaggataacgcccctaagtctgtcctggggaaggtcaagattttcgaaaaaatggatcacaaggcgcggctccagcgtatgcaagagctccaagaagcccagaatgcccggatcgaaatcgctcagaagcaccccgacatctacgccgtgcccattaaaacccacaaaccagaccccggtacccctcaacacacgagctcccggccacccgagcctcaaaaagccccctccagaccatatcaggacactcgcggcagttatggttcagacgccgaggaggaagagtatagacagcagctctcagagcatagcaagagaggctattatggacaatccgccagatatcgggatacagagctgtag

SEQ ID NO: 137939 - DNA, 3666 bp, Artificial Sequence
  Description of Artificial Sequence: Synthetic coding sequence
atgaaaacagcccaggcattgcatcgaatgtggatccaagccgtaaaaaagttgcggcgctggaagggcagggttagcccaagcgccagctctcccctggtcttccctaacctcagctcttgggaaggagaaggaagtaagacaattctgactgctccggggatggaggaattgatatgggagcagtacaccgttactttgcagaaagactcaaaacggggctttggtatcgcagtgagcggagggagagacaaccctcatttcgaaaacggggagacgtctattgtcatttccgacgtcctgccaggtggacctgccgatggcctcctgcaagaaaacgacagggtggtcatggtgaacggcacccctatggaggatgtgctccatagctttgcagtgcaacaactgagaaaatccggcaaagtggctgcaatcgtggttaagcgcccccgtaaggttcaggtagcggcgcttcaggccagcccccctctggaccaggatgatcgcgccttcgaggtgatggatgaatttgatggacgctcctttcggtcgggatattccgagcggtctaggctaaatagccacggcgggcgaagccgcagttgggaagatagtccagagagagggagaccacacgagagagcccggagtcgcgagcgcgatttaagcagggatcgcagccgcggccgtagtcttgagagaggtctggaccaagatcatgcacgtacgcgtgatagatctcggggtcggagcctagagcgagggctggatcacgattttgggcctagccgggatcgagacagagacaggtctaggggacggtctattgatcaggattacgagcgggcttaccatagagcttatgatccggattatgaaagggcttactctcccgaatataggagaggggcaagacatgacgcaagatctaggggccctcgctctagatctagggagcaccctcattctagatccccgtctcccgagccacggggccgaccaggacccatcggggtgttacttatgaaatcccgggctaacgaggaatatgggctgcgactggggagtcagattttcgtgaaggagatgaccagaacaggcctcgcgactaaggatgggaatttgcacgagggcgatattatcctgaaaattaacggcactgtcaccgaaaatatgtccctcaccgatgctcggaaattgatagaaaaaagcagggggaagcttcagcttgtggtgctccgggacagtcagcagaccctcatcaacatcccctcattgaatgactcagattcagagatcgaagacatttctgaaatcgagtctaatcgctcattctccccggaagaacgcaggcaccagtacagcgattatgactatcatagtagctctgagaaacttaaggagaggcccagtagtcgcgaagataccccatctagactttctaggatgggcgccacaccaacaccgtttaagtcaaccggagacattgctgggacagtggttcccgaaaccaacaaggaacctaggtatcaggaggatcctcccgctccacaaccaaaggccgctcccagaacattccttcggcccagcccggaggatgaagcgatctacgggcccaacactaaaatggtgcggtttaagaaaggagactctgtggggctgaggctcgccggcgggaacgacgttggcatttttgtggccggaatccaggagggcacgtctgcagaacaggagggacttcaggaaggagatcaaattctgaaggtgaatactcaagacttcagagggttggtgagggaggatgctgtcctgtatctcctggagatcccgaagggagaaatggtgacaatccttgcacaatctcgggcggacgtttatcgggacattcttgcgtgcggcagaggggattcattctttatccgttcgcattttgagtgcgagaaagaaactcctcagtctcttgcgttcacacgaggcgaggtgtttcgcgtggtggacaccctgtacgacgggaagctgggcaattggcttgcggtaaggattggcaacgagctcgaaaaaggcctaattccgaacaagtcccgggccgagcagatggcttccgtgcagaacgcacagagggacaacgctggagatagggcagatttctggaggatgagaggtcaaagaagtggagtcaaaaagaatctgcgcaaatcccgggaagacctgacagcggtggtgagcgtctctacaaaattcccagcttacgagagggtcttactgcgagaggccggcttcaaacgccctgtcgtcctattcggccctattgcggacatcgccatggaaaaacttgccaacgagcttccagattggtttcagaccgccaaaaccgaaccaaaggacgcaggcagtgaaaaaagcacaggggtagtgaggctgaacacagtgcgacagatcatcgagcaagacaagcacgccctcttggacgtgacacctaaagcggtcgacctgttgaattacacccagtggtttcctatcgtaattttcttcaatccggactccagacagggtgtgaaaacgatgagacaacgtctgaaccccacaagcaataaaagtagtcggaagctcttcgatcaggcgaacaagttgaagaagacttgtgctcacttgttcaccgcaaccattaatctaaactctgccaatgattcatggttcgggtccctgaaggatacaatccagcatcagcagggcgaggcagtgtgggtctccgaaggtaaaatggaaggcatggatgatgacccagaagatagaatgtcctacctcacagcaatgggagcagactatttgtcttgtgatagtcgcctgatttctgactttgaggatactgacggagagggcggcgcctacactgacaacgagcttgatgagccagcagaggagccattagtgagttcgatcacgagatcatctgaacctgtccaacacgaagaaagcatccggaagccaagcccggagcccagggcacaaatgcggcgagccgcgtcgtcagaccagctgcgcgataactcccctccaccagcttttaaacccgagcctccaaaagcaaagacccagaacaaggaagaatcctatgatttctccaagagctatgaatataaaagcaacccgtcagccgttgcagggaacgagactccaggcgcctccactaaagggtaccccccgcccgttgctgctaaacctactttcggtcggagcatactgaagccgtctacgccaattcctccacaggaaggcgaagaagtcggtgagtcttccgaggagcaagacaacgcccctaagtccgttttgggaaaagtgaagatatttgagaaaatggaccataaggcacgcttacaacgcatgcaggagctccaggaagcgcagaacgccagaattgagatagcccagaaacaccctgacatctacgccgtgcccatcaagacccataagccggacccagggacaccccagcatacaagttcaagacctccggagccccagaaggcgccgtcccgtccctatcaggatacacgaggttcctacgggtcagacgcagaagaggaggagtaccgccagcagctgagcgagcacagcaagagaggttattacggccagtctgctcggtatcgggacacagagctctag

SEQ ID NO: 137940 - DNA, 2787 bp, Artificial Sequence
  Description of Artificial Sequence: Synthetic coding sequence
atggctgtaagatttcaggtagctgatatggaggaacttaccatctgggaacagcacactgccacattgtccaaagatcccagacgtggatttggaatcgctatttccggcggacgtgatagacccgggggatccatggtggtctctgacgtggtgccgggtgggccggctgaaggcaggctgcagacaggcgaccacatcgtcatggtaaacggagtctcaatggagaacgcaacaagcgcctttgccattcagatactcaagacatgtactaaaatggccaacatcaccgttaaacgccccaggagaatccacctgcccgctaccaaagcaagcccatcctcaccgggacgccaggacagcgacgaggacgacggcccacagagagtcgaagaggtggatcagggcagaggttacgacggagattcgtctagtggcagtgggcggtcctgggatgagcgcagtcggaggcctagaccggggaggagaggaagagccgggtcacatggccgccggtcccccggcggcggcagcgaagcaaacggtctggcactggtaagcggattcaaacgccttccccgtcaggacgtccagatgaagcccgtcaagagcgttcttgtgaaaaggcgtgattctgaggaattcggggtcaagcttgggagccaaatctttatcaaacacattacggactccggcctggctgcaagacataggggtctgcaggaaggtgatttaattctgcagatcaatggcgtttcaagtcagaatctttcattgaatgacacccgacgtctgattgaaaagtccgaggggaaactgtcccttctggtattacgggataggggacaattccttgtgaacatcccacccgcagtgtctgacagtgattctagccctctggaggacatctctgacttagcctccgaactgtctcaggctcctccctcgcatatcccaccacccccgcgacatgcccagcgaagcccggaggctagtcaaacagattcacccgttgagagcccccgcctacgcagggagagctccgtggatagcaggaccatttcagagccggatgaacaaagaagcgagctgccacgggaatcgagctatgatatctatcgcgtaccttcgagccagtccatggaggaccgcggttactcccccgatacacgcgtggtcagatttctgaaagggaagagcatcggactgaggttggctggcggcaacgacgtgggcatcttcgtctctggcgttcaggctggatccccagctgatggccaggggatccaagagggagatcagatcctccaggttaatgacgtgcctttccaaaacctgactagagaggaggccgtacagttcctcctcggactcccccctggcgaggagatggagctcgtcactcagcgcaaacaggacatcttctggaagatggttcagtctcgcgtaggtgatagcttctatatccgcacccacttcgaactagagccaagcccgcccagcgggctcggattcacgcgtggagatgtctttcacgtgttagatacattgcaccctggcccaggccaatcacatgcgagaggaggtcattggctggctgtgcgcatgggaagggacctgcgcgagcaggagagggggatcattcccaatcaatcccgggctgagcagctggcgtctctggaggctgcacaacgggcggttggcgtgggccctggctcctctgccggatctaacgcacgagccgagttttggcgacttagaggcctgagacgaggcgccaagaaaaccacgcagcggagcagggaggacctgtccgcactgactcgccagggccggtaccccccatacgaaagggtggtgctcagggaggcctccttcaagcgacctgttgtgattttgggtcctgttgctgacatcgccatgcagaaactcacagctgagatgcccgaccagttcgagatagctgaaacagtgtctcggacagattcccccagcaaaataatcaagctggacactgttcgcgtcatcgccgagaaagataaacatgctctgttggacgttacacctagcgctatcgagaggctgaattacgtacagtactatcctatagtggtgttttttatacctgagagcagacctgctttgaaagctctgcgccagtggctggcccccgccagtcgccgatccactaggcgcctgtatgctcaggcacagaaactgcggaaacattcatcacacttattcactgctaccatcccattgaacggcacttctgatacatggtaccaggagctgaaggcaattatacgtgagcagcaaactaggccaatctggactgccgaggaccagcttgatggaagcctcgaagacaatctggatttgccccaccatgggctggctgatagctccgccgacctctcctgcgattcccgtgtaaattcagactacgagactgatggagaggggggcgcatatacggatggtgaaggttacactgacggcgagggagggccttatactgatgtggatgatgagcctcccgctccagcccttgcaagatcatctgagcccgtgcaggcagatgaaagtcagtctcctcgggatagaggccgcatcagtgcccaccaaggcgcccaagtggactccaggcacccacagggccagtggcggcaggattctatgcgcacctatgaaagagaggcattaaagaagaagtttatgcgagtgcatgacgctgaatctagtgacgaggatggttacgattggggcccggctaccgatctgtag

SEQ ID NO: 137941 - DNA, 2859 bp, Artificial Sequence
  Description of Artificial Sequence: Synthetic coding sequence
atgaatctttgtggtctgatgccaatatttcccgcaccactggatcaagtggctgacatggaggaactgactatttgggagcagcacaccgcaacccttagcaaagatccaagaaggggttttggcatagccattagtgggggccgcgaccgtcccggggggagtatggtcgtcagcgacgtcgtgccgggcggaccagccgagggccggcttcagacaggggaccatatagtgatggtgaatggcgtcagtatggagaacgccaccagtgccttcgccatccagatcctgaaaacctgtacaaagatggcgaacatcaccgtgaagcgtccacgacgtatccacctccccgccaccaaggcctctccttcttcacccgggcgccaggactccgacgaggatgatggcccccaacgggtggaggaggtcgatcaggggcggggttacgacggggatagttccagcggttccggccgttcttgggatgagcgctctcggcgtcctcgccccgggcggaggggccgggcaggttcgcatggccgtcgcagtcccggcggcgggagcgaggccaacggcctggctttggtctcaggcttcaaaagattgcctagacaagatgttcagatgaaacccgtgaagtcagtgctggtcaaaagaagagacagtgaagagtttggcgtaaagctgggcagccaaatctttatcaagcacataaccgatagcggactggcagcccgtcaccgcggcctgcaggagggagacctcatcttgcaaattaatggtgtctctagtcagaacctgtctctgaatgatacccgacgtcttattgagaaatcagaggggaagctgagcctccttgtgctccgcgatagaggtcagttcctggtgaatattccacccgctgtgtccgattcggactcctcaccactcgaagagggcgtcaccatggcggacgagatgtccagcccgcccgctgacatcagcgacctggcttcggaactgtctcaggcgccaccttctcatatcccacctccacctcggcacgcccagcgcagccctgaggccagccaaactgattcccccgtggagtccccccggctgaggcgagagagctccgttgacagcaggaccatatctgaacccgacgagcagaggagcgagctgccaagggaatcgtcatacgacatttacagggtgccctcaagtcagagtatggaggacagaggctatagtcctgacacacgagtggtgaggttcctgaagggcaaaagtatcggccttcgcctggccggaggcaatgacgtgggcatttttgtgagcggggttcaagcaggtagtccagccgacggtcaaggtatccaagaaggggaccagatcctccaggtgaacgacgtgccatttcagaaccttacacgtgaagaggccgtgcagttcctgctcggacttccacctggcgaggaaatggaactggtcacgcaacggaagcaggacatcttttggaagatggttcaatcaagagttggcgactccttctacattcgtacacacttcgagctcgaaccctcaccacctagtggattgggctttacgagaggggacgtcttccatgtgctggataccctgcatccaggtccggggcaaagccacgcccggggcggccactggctcgccgtccggatgggccgggacttacgagaacaggagagaggtatcatccccaaccagagccgcgcagaacaactggcctccctggaggcagcccagcgggccgtgggggtgggcccaggcagctccgcagggagcaatgcccgcgctgaattctggaggctacggggtcttcgccggggggcgaaaaagactactcaacgttctcgagaggacctgtccgcactaactaggcagggcagatacccaccttatgaacgtgtggttcttcgagaggcgtcctttaagcggcctgtggtcatattggggcccgtcgccgatatcgccatgcagaagcttaccgccgagatgcccgatcaattcgagattgcagaaactgtgtctaggacagactccccctcaaaaattatcaaattggatactgtccgggtaatcgcagaaaaggacaaacacgcgctgctcgatgtaacaccctccgcaatcgagcggctgaactacgtccagtactatcctattgtggtgttttttattcctgagtcacggcccgcactgaaagctttaagacaatggctggcaccagcctctaggcgcagtacccgcaggttgtacgctcaggcccagaagttgcgcaagcacagcagccaccttttcacagcaactatcccactcaatggcacgagcgatacgtggtaccaggaactaaaggctatcatccgcgagcagcagacccgtccaatttggaccgctgaagatcagttggatggcagcctcgaggataatctcgacctgccccaccacggattggccgattctagcgctgacctatcatgtgacagtcgggtcaattcagattatgagacagacggagagggcggtgcatacacagatggcgagggatacactgacggtgagggaggtccatacacagatgttgacgatgaaccaccagcacccgcattggctcggagctcggaacctgttcaagcagatgagagccaaagtccacgtgatcgtgggcggatctctgctcaccagggcgcacaggtagactcaaggcatccacaggggcagtggcggcaagactctatgagaacctacgaaagggaggccctgaaaaagaagttcatgcgtgtacacgacgctgaatcctcagatgaggacggttatgactgggggcccgcaactgatttatag

SEQ ID NO: 137942 - DNA, 2802 bp, Artificial Sequence
  Description of Artificial Sequence: Synthetic coding sequence
atggaagaactgaccatttgggaacagcataccgcaactctgagcaaggacccacgacggggtttcggtattgccatctccggtggccgtgaccgtcctggcggctccatggtggtctcggatgtcgttcctggcgggcccgccgagggccgcctgcaaacgggtgaccacatcgtgatggtcaacggagtttccatggaaaatgctacctcggcctttgctatccagatactgaaaacatgtacaaagatggcaaacattaccgtgaaacggcctagacgcatccacttgcccgctactaaagcctctccttcctcacctggccggcaggactccgacgaggacgatgggccccagcgagtcgaggaagtcgatcaagggagagggtacgatggcgattcttcaagcggctccggaagatcatgggacgaaaggtcccgccgacccagacccggccggcgaggtagggccggatcgcatggtcgcagatctcccggcggaggtagtgaggccaacggcttagcccttgtgtctggtttcaagagactgccgagacaggacgtgcagatgaagccagtgaaaagcgtgctcgtgaagagacgcgattccgaggaattcggagtgaagctcgggtcccagattttcattaaacacatcacagattctggcctggctgctagacacaggggtctacaagaaggcgatctgatcctccagatcaacggcgtgtcttcgcaaaatctgagtctcaatgatactcggagactgatcgaaaagagcgagggcaaactctctctgcttgttctcagagaccgaggtcaattccttgtaaatattcctccggcggtttccgattctgacagcagtcctttggaggagggcgtcaccatggcagacgagatgtctagccccccagccgacattagtgacttagcttccgaattgagtcaagcaccgccaagccatatcccaccccccccccgccatgcacagagatctcctgaggcgtcccagacagatagtcccgtggagagtccaaggttgcgcagggaaagctctgttgattcccgtactatcagcgaacccgatgagcaaaggtccgagctgccaagagaaagtagctatgacatctaccgtgtgccctcatctcagtctatggaggacagaggatattctccggacactcgcgtggtgcgctttttaaaaggtaagagtatcgggctgcggctggctggcgggaacgatgtgggaatctttgtgtccggagtgcaggccggctcccccgctgatggccagggcatccaggagggcgatcagattctgcaggttaacgacgtgcctttccagaatctgactagagaggaggctgtccagtttttgctggggctccctcccggggaggagatggaactggtaactcaaagaaagcaggatattttttggaaaatggtccagagccgcgtgggggatagtttctatataaggactcactttgagcttgaacctagtcccccctcaggcctgggcttcactcggggcgatgtattccatgtgttggataccctgcaccccgggcctgggcagagccatgcaagaggggggcattggctcgccgtccggatggggagagatctgagagagcaggagagaggcattataccaaatcagtctcgcgccgaacagttggcatcactcgaggcagctcaaagggcggtcggggttggcccaggcagcagcgcgggcagcaatgcccgcgccgaattttggcggctgagagggctgcggcggggggctaagaagacgacccaacggtctcgagaggatctaagtgccctgacacgccaggggagatatccgccatacgagagggtggtcctcagagaagcatccttcaagcgcccagtggtgattctggggccagtggccgatatcgcgatgcagaagctaacagcagaaatgccggaccagttcgagatcgccgaaaccgtcagccgaactgatagcccatcgaaaatcattaaactggatactgtgagagtaattgcggaaaaggacaaacatgcgttgttagatgtgactcccagtgctattgagcgccttaattatgtgcagtattatcctattgtagtgttcttcatacccgaaagtcgacccgccctgaaggccctccgacagtggttagcccctgcgagtcgtagatccacaaggcggttgtacgcgcaagctcagaagttgagaaagcactcttctcacctgttcaccgccacaatcccactgaatggtacttccgatacctggtatcaggaattaaaggccattattagagaacagcaaacacggcctatctggaccgctgaggaccagttggatggtagcctggaagacaaccttgacttgccacaccatgggttggccgattcaagcgcagacctaagctgtgattcccgggttaactccgactatgagactgacggagagggcggcgcctacaccgacggtgagggttataccgatggagaagggggaccctacacagacgtggacgatgaaccacctgcccctgcgttggcacgaagcagtgagcccgttcaagccgacgagtcacagtcccccagagacaggggccggatttccgcccaccagggggctcaggttgattccaggcacccacaggggcagtggaggcaagattctatgcgaacctatgagcgagaggctttgaaaaaaaagttcatgcgcgtgcatgatgccgagagttcagatgaagacggttatgactggggaccggctacagacctgtag

SEQ ID NO: 137943 - DNA, 2652 bp, Artificial Sequence
  Description of Artificial Sequence: Synthetic coding sequence
atggtcgtcagcgacgtggtgcctggaggtcccgcagaaggccggctacagacgggcgaccacatcgtgatggtcaacggggtttctatggaaaacgctacatcagccttcgctattcagatactcaagacctgtacaaagatggctaacattacagtgaagcgcccacggagaatacatctgccagctacaaaggccagccccagcagccctggccgacaggacagcgatgaggatgacgggccacagagggtcgaagaggtggatcagggacgcggctatgatggagactcttcctcagggagcggccgatcttgggatgagcgctcgcgtaggcctaggcccggtcggcgcggacgcgctggcagccatggcaggcgcagccctggcggaggtagcgaggccaacggtctggcactggtgtccggattcaaacgcctgcctcgccaggatgtgcaaatgaaaccggtgaagtccgtgctggttaagcggcgtgatagtgaagagtttggcgtcaagctggggtctcagatctttatcaagcacataaccgattctggcctcgccgctcgccaccgtggcctccaggagggcgacctcattctgcagataaacggcgtgtcatctcaaaatctgtccctcaacgatacacggaggctgattgaaaagtctgaaggaaaactgagcctgctggtacttagagaccggggtcagttcctcgtgaatatacccccagccgtttccgactcagattcctctccccttgaagacatcagcgacctggcctccgaactaagccaggctccaccttctcacatacccccgccccccagacatgcccaacgctctcctgaagctagccagaccgatagtcctgtggagtccccgcgcttgcgccgggagtccagcgtcgatagtaggacaatttctgaacccgacgaacagcgcagcgagctgccgcgagagtcatcctacgacatctatagagtcccttctagtcaatcaatggaagatcggggatacagccccgacactagggtggtcaggtttctcaagggcaagagcatcggcttgaggcttgctggaggcaatgacgtgggcatcttcgtgtcgggcgtccaggccggctcacctgctgacgggcagggtatacaggagggcgatcagatcctgcaggtcaacgatgtaccctttcagaacttgacgcgcgaggaagctgtgcagttcctgctgggcttaccccccggggaggagatggaactggtgacccagaggaaacaagacattttctggaagatggtgcaatccagagtgggcgattcattttacatccgtacccactttgagcttgagccttcaccacccagtggcttaggttttacccgaggggacgtatttcacgtgctggatactctacaccctggcccaggacagagccacgcccgcggcggccactggcttgccgtcaggatgggtcgggatcttagagaacaggaacgcggcatcattcctaaccagtctcgggccgagcaactggcttccctcgaggccgcgcagagagctgtgggggtcggtcccggttcttccgcaggctccaatgcccgcgctgagttctggagactgcggggcctgagacgcggtgccaagaagacgactcaacggtcccgagaggacctcagcgccctgactcgtcaaggtagataccccccttatgagagggtcgtgctgcgggaggcctcctttaaacgacctgtcgtgattctggggccagtcgctgatatcgcaatgcagaaactcactgccgagatgccggaccagtttgagatagccgaaaccgtgagcagaacagacagcccctcgaagatcataaagctcgatactgtgagggtgatcgctgaaaaggacaaacacgctctgttggacgtcactccttccgccatcgaaaggttaaactatgtccagtactacccaatcgtcgtcttctttatcccagaaagccgccccgccctcaaagctctccgccagtggctagcacccgctagccgaagaagcacaagaaggttgtacgctcaggctcagaagctgagaaagcactcctctcacttattcaccgctaccatccccttaaatggtacctcggacacctggtatcaggagctgaaggctattattcgggagcaacaaacaaggcccatctggaccgccgaagatcagttggacggttctcttgaagataatctcgacttgcctcatcatgggctggccgattccagcgccgaccttagttgcgattcacgcgtcaatagtgactacgagaccgatggggagggaggggcatatactgacggggagggctacaccgatggggagggcggaccttatactgacgtggatgatgaaccaccggcacccgccttggcacgatcttccgagcctgttcaggccgacgaatcccaatctccgagagatcgggggcgaatctctgcacaccagggtgctcaggttgactcacgccacccccaggggcagtggaggcaggatagcatgcgtacatacgagagggaagccttgaaaaaaaagttcatgcgagtgcacgacgcagagagcagtgatgaggacggctatgattgggggccagccacagacctctag

SEQ ID NO: 137944 - DNA, 2760 bp, Artificial Sequence
  Description of Artificial Sequence: Synthetic coding sequence
atggaggagctgaccatctgggaacagcataccgccacgctctcaaaagacccacgtcgaggcttcggaatcgctatctcaggtggccgtgatcgccccggggggagtatggtcgtaagtgacgtagtgcccggcgggcctgccgagggtcggctgcagacaggggatcacatagtaatggtaaatggtgtctctatggaaaacgcaacatccgccttcgcaattcagatcctcaaaacatgcactaagatggccaatatcacagtgaagagacctcgacgcatccatctgcctgctaccaaggcgtccccttcttctccaggtagacaggactcggacgaggacgacggtccccagcgcgtggaggaagtggatcaggggcgaggatacgatggtgacagcagcagtggctcaggccgctcttgggatgaacgcagtcgtcgccctaggccgggaaggcgcgggagggcaggcagtcatggtcggaggtcacccggcggcggaagcgaggcaaacggactcgcccttgtgagcggattcaaaagattaccaagacaggatgtgcaaatgaagcccgtgaagtctgtcctggttaaaagacgggatagcgaagaattcggagtgaagctaggctctcagatttttatcaagcacattaccgactcagggctcgcggcgcgacacagaggcctccaagaaggtgatctgatcttacaaatcaacggcgtcagctctcaaaacctctctctcaatgacaccagaagacttatcgaaaagtctgagggaaagcttagcctgctcgtgctcagggataggggccagttcttagtgaacattccaccagcagtgtccgacagcgactcctcacctctcgaggacataagtgacttggcatccgaactgtcccaggcccccccaagccatattcctccacccccccgacatgcgcagcggtccccggaagctagccagacggattctccggtagagagcccccgattacgccgcgagtcttcagtggattccagaactatctctgaacctgacgagcagcgcagcgagctgccccgggaatcaagctatgacatctatcgcgtgcctagtagccagtctatggaggaccgtgggtactctcccgacacccgcgtcgtccgattcctgaagggaaagagtatcgggctgcgcctggcagggggaaatgacgtggggatatttgttagtggtgtgcaggctggctctccggccgatggacaaggaattcaggaaggggaccagattctgcaggtgaatgacgtcccttttcagaacctcactagagaggaggctgttcagtttctgctcgggctgcctcctggcgaagaaatggagctagtgacccaaagaaaacaagacatcttttggaaaatggtccagagccgggtcggggattctttttacatcagaacccactttgagctcgaaccttcgccaccttctggcctcggttttactcgaggagacgtgttccacgtcctggatacactccatccaggacctgggcagtctcatgccaggggtggccattggttggctgtccgcatgggaagggatctgagggaacaagagcgcggcattattcccaatcagtccagagccgagcagctagcttctctagaagcggctcagcgcgctgttggagtagggccagggagcagtgccggaagtaatgcacgcgcagaattttggcgcttgcggggactgaggcgtggcgcaaagaagaccactcagcggagccgcgaagacctcagcgcactcaccagacagggccgctatccgccctacgagcgagtggtcctgagagaagcttctttcaaacgtcccgttgtgatcctcggtcccgttgccgacatcgctatgcagaaattgacagcggagatgccagaccagttcgaaatcgccgaaactgtgagccggacagatagtcccagcaaaataatcaagttagatactgtacgagtgatcgcagaaaaggacaagcacgccctgctggacgtgactccaagcgcaatcgagcggctgaattacgtacagtactaccccatcgtggtttttttcatccctgaaagtcgcccggccctgaaagccctcaggcagtggctcgccccggcaagcagacgctccacgagaagattatacgctcaggcccaaaagctgagaaagcactcatctcatctcttcacagccactattccactaaacgggacctctgatacctggtatcaggagctcaaggccatcattcgagaacagcagacacggcctatctggactgcagaagatcagcttgatgggtcacttgaggacaacttagacttgccccaccacggccttgctgattcttccgctgatctatcatgtgattcaagggtcaactccgactacgagaccgacggggagggcggcgcttataccgatggggaaggatacacagatggcgagggcgggccatatacagacgttgatgatgaacctcccgcacccgccctggcccgctcatccgaacccgtccaggcagatgagagccagagccctagggatcggggtcgaatctcagcacatcagggcgcccaggtggacagccgccacccacaaggccagtggaggcaagatagcatgcgcacttacgagcgggaggccctgaagaagaaattcatgcgggtgcacgacgcagaatcgagcgacgaggatggttacgattggggccctgcgacggatctttag

SEQ ID NO: 137945 - DNA, 1623 bp, Artificial Sequence
  Description of Artificial Sequence: Synthetic coding sequence
atggtgcgaacagacgggcacaccctgtctgaaaaacgaaattatcaggtcacaaacagcatgttcggcgctagcaggaagaaatttgtagagggagtggattcggactatcacgacgaaaatatgtactacagccagagcagcatgttcccacataggtccgaaaaggacatgctggcatcaccctcaacctccggacagcttagtcagttcggcgcctcattgtacggacagcagtcagccctgggactgcccatgaggggtatgagtaataatacacctcagctgaacaggagcctgagtcagggcacccagctgccctcgcacgtaacacctactacaggagtgcccactatgtccctccacacacccccaagcccctcaaggggaatccttccaatgaatcctcggaacatgatgaatcactctcaagttgggcagggcatcgggattcccagcaggaccaactctatgagtagttccggccttgggagcccgaatagatccagcccctcaattatctgcatgcccaagcagcagccttcgcggcagccctttaccgtgaattctatgtcagggtttggtatgaatagaaatcaagcttttgggatgaataactccctgagcagcaatatattcaacgggacagatggatccgagaacgtcacaggccttgacctgagtgatttcccagctttagccgaccggaacagaagggaaggatccggcaatcccacacccctgattaaccctctggctgggagggccccctatgtgggaatggtgacaaagcctgccaatgagcagtcgcaggacttctccatccacaacgaagacttcccagccttgcctggcagtagctataaagacccaaccagcagtaacgatgactctaaatcaaacctgaatacatccggaaaaacaaccagctctacagatgggccaaaatttcctggggacaagtcttctaccacgcagaacaataatcagcagaaaaaggggatccaggtgctccccgacggacgggtgaccaacatacctcagggtatggtcaccgatcagttcggaatgatcggtctgctgaccttcattagagcagccgaaaccgaccccggtatggtgcaccttgctctgggaagtgacctaaccacattggggctgaacctgaattcacccgaaaatttgtaccccaagttcgccagtccatgggccagtagcccttgccgtccccaggatatagatttccacgttccctccgagtatctcaccaatattcatataagggataaacttgctgctatcaaattaggaagatacggggaagatctgttgttctacctctactacatgaacggaggggacgtcctgcagctgttggccgccgtggaattatttaacagagattggagatatcataaggaagagcgcgtgtggatcactagagcccccggcatggagccaaccatgaagaccaacacctacgagaggggcacatactacttttttgattgcctgaactggaggaaggttgctaaagaatttcaccttgaatacgataagcttgaagagagacctcacctgccctccacttttaactataacccagctcagcaggcattctag

SEQ ID NO: 137946 - DNA, 3627 bp, Artificial Sequence
  Description of Artificial Sequence: Synthetic coding sequence
atggatctgcacatgatgaactgcgaactgctggccacatgttcagcgcttggttatctggagggggacacatatcacaaagaacccgactgtctggaatctgtcaaggacttgattagatacctgcggcacgaggacgagacaagggatgtgaggcagcagttgggtgctgcgcagattctccaaagtgacctgcttccaatcctgactcaacaccaccaggacaaaccgctgttcgacgctgttatacgtctgatggtcaacctgacacaacctgccctcttgtgctttgggaacctgcctaaagagccatcattccgccatcacttccttcaagttttgacatacctgcaagcttataaagaagcttttgcatccgagaaagctttcggtgtgctcagcgagaccttgtacgagctgctgcagctcgggtgggaggagaggcaagaggaagataatctgctcattgagcggatattactactcgtacggaacattttacacgtgcccgcggacctcgatcaggaaaagaagattgacgacgatgcttctgctcacgaccagctcctctgggccatccacctgtctggattagatgacctcctgctatttctcgcctcttcctccgcagaggagcaatggagtctccacgtgcttgaaatcgtgagtctgatgtttagggatcagaaccccgagcagctggctggcgtgggccaggggagacttgcgcaggagagatccgcggattttgcagagctcgaagtgttgagacagcgggaaatggcagagaagaaaacccgggcactgcagcgtgggaaccgacactcgcgattcggcggctcctacatcgttcagggtctcaaatccattggcgagagggacctgatttttcataaaggcctgcacaatttgaggaattacagttccgacctaggaaaacagccaaagaaggttccaaagagacgtcaggctgcaagagagctgtctattcagagacgaagcgccctaaatgtccgtctgtttttacgggatttctgctccgaatttcttgagaactgttataacaggctcatgggctccgtgaaagaccatctgctgagagaaaaagcccaacagcacgatgagacttattatatgtgggctcttgcttttttcatggcctttaatcgcgctgcctccttcagacccggcctggtgtcagaaacgctctcagttagaacctttcactttatagaacagaacctgacaaactattacgagatgatgcttacagatcggaaagaagccgcctcctgggcaaggcggatgcacctggcactgaaagcataccaggagttgctggcgacagtaaacgagatggatatttctcccgatgaagcggtgagagagagttcacgcatcattaaaaataacatcttttatgtaatggagtacagggaactcttcttggccctcttcagaaaatttgatgaaaggtgtcaaccccggagctttttgcgagatctcgtggaaaccacgcacctattcctcaaaatgctggagagattttgccgcagcagagggaacctagtggtgcagaataagcagaagaagcggcgcaagaaaaagaaaaaggtactggaccaggcaatagtgagcggcaacgttcctagttccccagaggaggtggaggccgtctggcctgccttagctgagcagttgcaatgttgcgcacaaaactctgagctaagcatggactcagtagtgccgttcgatgccgcctccgaagtgcccgtggaagagcaaagagcggaggccatggtgaggattcaagactgtctcctggccggccaggctccacaagccctgacactgctcaggtccgccagagaggtgtggcccgagggggatgtgtttggctcacaggacatcagtcccgaagaagaaatacagcttctgaagcagatcttgtctgccccactgcctcggcagcaaggaccagaagagcggggggccgaggaagaagaggaagaagaagaggaagaagaagaagagctccaggttgtacaagtgtccgagaaggagttcaattttctggactacctgaagcggttcgcgtgtagtaccgtggtgagagcatacgtactcttgctgagaagctaccagcagaatagcgcgcataccaaccactgcatagtaaagatgctgcatagattagctcacgacctaaaaatggaggctcttctctttcagctttcggtgttttgtctctttaaccgcctgctgtcagatccagccgctggcgcctacaaggaactggtgactttcgctaagtacattctcggcaaatttttcgcactcgcagcagtcaatcagaaggctttcgttgaactcttattttggaagaatacggcagttgtgagggaaatgaccgagggatacgggagtctggacgatagaagctccagccgacgggcacctacgtggtcccctgaagaagaagcgcacctcagggagctttacctcgccaacaaagatgtagaagggcaagacgtggtcgaggctattctggcccatttgaacactgtacctcggacaagaaaacagatcatccaccacctggtacagatgggtcttgctgactcagtcaaggacttccaacgcaaaggcacccatatcgtgctttggactggggatcaggagctggaacttcagcgattatttgaagagttccgcgactccgacgacgtgctgggccatattatgaaaaatattaccgccaagcgatcaagagcccggattgtggacaaactgctcgcgctggggctggtggccgagcggcgggaattgtacaagaagcggcagaagaaacttgcaagttcaatccttcccaatggggctgagtcgctgaaggacttctgccaggaagacctcgaggaggaagagaaccttccagaagaagacagtgaggaggaggaggaaggcggtagcgaggccgaacaggttcaggggtctctggtcctgagcaacgaaaacctcggacaatctcttcatcaggagggattcagcattcctttactgtggttgcagaactgtctcatcagggccgctgatgacagagaagaagatggatgcagccaggccgtcccccttgtacccctcaccgaagaaaacgaagaagccatggaaaacgagcagttccagcagctgctgaggaaactgggcgtgcggcctccagcctcaggccaagaaacattttggcggatcccagccaaactgtctcctactcaactgagaagagccgcagcaagcctgtctcaacctgaggaggagcagaagctacagcccgagttgcagccaaaggtccctggcgaacaggggagcgatgaggaacactgcaaggagcacagagcacaagcactgagggccctgctgttggctcataaaaagaaggccggcctggcttctcccgaagaggaagatgccgtaggcaaggaacctctaaaagctgcccctaaaaagcgacagctgctagacagcgatgaagagcaggaagaagacgagggtagaaaccgcgctcctgaactcggggcacccgggatccagaagaagaaaagataccaaatagaggacgatgaggacgattag

SEQ ID NO: 137947 - DNA, 906 bp, Artificial Sequence
  Description of Artificial Sequence: Synthetic coding sequence
atgctggagccacaggagaacggtgtgatcgatttgcctgattatgaacacgttgaagatgagactttccccccctttccaccaccagcctcgcccgaaaggcaggacggagaagggaccgagcctgatgaagagtcaggaaatggggctcctgtgcgggtacctcctaagcgaactgtgaagagaaacatacccaagctggacgctcagagacttatcagcgagagagggctcccggcgctgaggcacgttttcgataaagcaaagttcaaaggaaagggtcacgaggccgaggatctgaaaatgttgatacggcacatggagcactgggcccaccgcctgtttcctaaactacaatttgaagactttatcgatcgcgtggagtatcttggctctaagaaagaggtccagacttgtctgaagcgcatacgtttggatctacccatcctccatgaggattttgtttccaataacgatgaagtggctgagaataacgagcatgacgttacgtctactgaactggatcccttcctgaccaatttgtctgagagcgagatgttcgcctcagaacttagtagatccctcaccgaagagcaacagcagaggattgaacgaaacaagcagctcgccctcgagcggcgccaggctaagctcctgtccaacagtcagaccctgggcaacgacatgctcatgaatacccctcgtgcccacactgtggaggaggtaaacacagatgaagatcagaaagaggagagcaacggcttaaatgaggacattctagataacccttgcaacgacgccatcgctaacactctgaatgaggaagaaactctgctggatcagtccttcaagaatgttcagcagcagctggatgctactagtcggaacataaccgaagctagatag

SEQ ID NO: 137948 - DNA, 603 bp, Artificial Sequence
  Description of Artificial Sequence: Synthetic coding sequence
atgttgatccgccatatggagcactgggcccatcggctttttccaaagctgcagtttgaagacttcatagaccgtgttgagtacctcgggtcaaagaaagaagtgcagacttgcctcaagcgcattcgcctggacttgccgattctgcacgaggatttcgtgagcaacaacgatgaagtagccgaaaacaacgagcacgacgttacgtcaaccgaactcgatccatttctgaccaacctgagtgagtccgaaatgtttgcatccgagttgtctaggtctttaactgaagagcagcaacagcgcatcgagcgcaataagcagcttgcccttgagaggagacaggccaagttattgagtaactcacagacattaggtaatgacatgctcatgaacacaccaagggcccatacggtggaggaagtcaacacagatgaggaccagaaagaagaatctaatgggttgaatgaggatatcttggataatccatgtaatgatgctattgctaatacgctaaacgaggaggaaaccctactggaccagagcttcaaaaatgtccagcagcagctggacgccacatctagaaatatcactgaggcacggtag

SEQ ID NO: 137949 - DNA, 537 bp, Artificial Sequence
  Description of Artificial Sequence: Synthetic coding sequence
atgatgatccacggcttccagtcctcacatcgcgacttctgttttggtccctggaaacttaccgcgtcaaagacccatattatgaagtctgcagacgtagaaaaactggcagacgagctgcacatgccgtccctacctgagatgatgttcggggataacgttctgcgtattcagcatggctctgggttcgggattgagttcaacgctactgacgctttacggtgcgtcaacaattaccagggaatgttaaaagttgcctgcgccgaagagtggcaggagtctaggacagaaggagagcattcaaaggaggttattaagccttatgattggacatatacgaccgattacaaaggcaccctgctgggggaatctctgaagttaaaagtggtcccaacaacagaccatatcgacactgaaaagcttaaagctcgcgagcaaattaaattttttgaggaggttctgttattcgaagatgaactgcacgatcacggcgtgagctccttgagtgtcaaaatccccggggggggtcacttgtag

SEQ ID NO: 137950 - DNA, 819 bp, Artificial Sequence
  Description of Artificial Sequence: Synthetic coding sequence
atgatgattcacgggtttcaaagctctcacagggatttttgctttggcccttggaaactgaccgccagtaagacccatatcatgaagtccgccgacgtggagaagctggctgacgagcttcacatgccaagcctaccagagatgatgtttggggataacgtgcttaggatccaacacggtagtggcttcggaattgaattcaacgccactgacgctctgagatgtgtgaataactaccaaggaatgctgaaagtggcctgtgcagaagagtggcaggagagtcgcactgaaggagaacacagcaaggaggtaataaagccgtacgattggacatatactacagattataaagggaccctcctgggggaatccctgaagctgaaagtcgttccaacaaccgaccacatcgacaccgagaagctgaaggccagggagcaaattaaattcttcgaagaggttctgctttttgaggatgaattgcacgatcatggagtgtcatctctgagcgtgaagattagagtcatgccatcctcattttttctgctgctgcgcttctttctcagaatcgatggggtgctcataaggatgaacgacactcgcctgtaccacgaggccgataagacttacatgttacgcgaatacaccagcagagaaagcaagatttctagcctgatgcacgtcccaccatccctgttcacggaacccaacgaaatcagtcaatacctgcccattaaagaggctgtctgcgagaagcttatctttcccgaaagaatcgatcccaaccctgcggactctcaaaagtcaacccaggttgaatag

SEQ ID NO: 137951 - DNA, 1143 bp, Artificial Sequence
  Description of Artificial Sequence: Synthetic coding sequence
atgacagaggaggtgattgttatcgcaaagtgggactacactgcccagcaggatcaagaactggatataaaaaaaaatgagcgtctgtggcttctggatgacagcaagacctggtggagagtgagaaacgctgcgaaccgaacaggatatgtcccttctaattacgttgagaggaaaaactcgcttaagaagggcagcttggtcaaaaacctcaaggataccctaggtttaggaaagaccagaagaaaaacttcagctcgggacgcgtcgcccactccgagcaccgatgccgagtatcccgccaacggttctggagcagaccggatctacgacttgaatatcccagccttcgtgaagttcgcatacgtggccgaacgagaggatgagctaagtctagtgaaggggagccgggtcactgtcatggagaagtgttccgacgggtggtggaggggatcttacaacgggcaaattgggtggttcccctccaattatgttctcgaagaggtagatgaggccgccgctgagagccccagtttcctgagcctgcggaaaggtgcctctctgtctaatgggcagggctctcgggtcctgcatgtggtccagacactctaccccttcagttctgtcacagaggaggagctgaatttcgaaaagggagaaacaatggaagtcatcgaaaaacctgaaaatgatcctgagtggtggaaatgcaagaacgctagagggcaggttgggctggttcctaagaattacgttgtagtactaagcgatggcccggcattacaccccgcccatgctccccagatctcttacacaggtcctagcagctccggcaggttcgctggaagggaatggtattacggcaacgtgactcgccaccaggcagaatgtgctttgaacgagaggggtgtggaaggcgatttcttaatccgcgactcagagtcaagcccgtctgatttcagcgttagtcttaaggcgtcaggcaaaaataaacatttcaaagtccagttggtggataacgtctattgtattggccaaagaaggtttcacacaatggatgagctcgtggagcactataagaaagccccaatttttacctcggagcatggggagaaactttacctggttagagcgcttcaatag

SEQ ID NO: 137952 - DNA, 756 bp, Artificial Sequence
  Description of Artificial Sequence: Synthetic coding sequence
atgatatacaccatgaagaaggtgcacgcactgtgggctagtgtctgtctactcctgaaccttgcacccgccccactcaatgcggactctgaggaagacgaggagcacaccataataacagacacggaattgccccctctgaagctgatgcactccttctgtgctttcaaagcggacgatgggccctgcaaggcaatcatgaagaggttcttcttcaatatctttaccaggcagtgtgaggagttcatctacggcggctgtgagggcaaccaaaaccgcttcgagtcactggaggaatgtaagaagatgtgcacccgcgacaatgcaaaccggatcattaagactactctgcagcaggagaagccagacttttgctttctggaggaggatccaggaatatgtagaggctacatcacaagatacttttataataaccaaacaaagcagtgcgaacgctttaagtatgggggctgtttgggcaacatgaacaactttgagactctcgaagagtgcaaaaacatttgtgaggatggaccaaatggctttcaggtggataactacggtacacagctaaacgccgtgaacaatagcctcaccccacagtccactaaagtacccagcttgtttgtgaccaaggaggggacaaacgatgggtggaagaatgccgcacatatctatcaggtgtttttaaacgccttttgtattcatgcaagtatgtttttcctcggcttggactccattagttgcctatgttag

SEQ ID NO: 137953 - DNA, 915 bp, Artificial Sequence
  Description of Artificial Sequence: Synthetic coding sequence
atgatttatactatgaagaaagttcatgccctgtgggcttccgtgtgtttgctcctgaacctggcccctgcccctctgaacgctgattctgaagaggatgaagagcatacaattatcaccgacacagagcttccccctctcaagctcatgcactccttctgcgcatttaaagctgacgacggcccatgtaaagctatcatgaaaaggttcttttttaacatctttaccaggcagtgtgaggagttcatttacggagggtgcgaggggaatcagaatcggtttgaatctctggaggagtgcaaaaaaatgtgtacacgcgacaacgctaacaggattattaaaacgacccttcagcaagagaagcccgacttttgtttcctcgaggaggatccggggatctgtcgagggtacattacccggtatttttacaacaaccaaacaaaacagtgtgagcgctttaagtatggtggttgcctcggaaacatgaataacttcgagaccctggaagaatgtaagaacatttgtgaggacggtccaaatggctttcaggtcgataattacggaacacagttaaatgccgttaacaacagtctcacaccacaaagcaccaaggtgccatccttatttgagttccacgggccttcttggtgcctgactccagctgacagagggctttgtagagctaatgaaaacaggttctactacaatagcgtcatcggcaagtgccggcctttcaaatattccgggtgtggagggaatgaaaataatttcaccagtaaacaagagtgcctgagggcctgtaagaaaggctttatccagaggatctcaaagggggggctcattaagacaaagagaaaaagaaaaaagcagagagtaaaaatcgcttacgaagaaatcttcgtgaaaaacatgtag

SEQ ID NO: 137954 - DNA, 756 bp, Artificial Sequence
  Description of Artificial Sequence: Synthetic coding sequence
atgatatacaccatgaagaaagtacacgctttgtgggccagcgtgtgtctgcttctcaatctcgctcccgctccattaaacgctgactccgaggaagacgaggaacacacaattattaccgacacggaactcccaccactgaagctgatgcacagcttctgcgccttcaaggccgatgatggaccctgcaaggctattatgaagagatttttctttaacatatttacccggcagtgcgaagagtttatctacgggggctgcgaagggaaccaaaacaggtttgaatccctcgaggaatgtaagaagatgtgcacaagggacaatgcaaacagaatcatcaaaacaactctacaacaggagaaaccagacttctgttttcttgaagaggaccccggcatttgcagggggtacatcacccgatatttttacaacaatcagacaaagcaatgcgagagattcaaatatggcgggtgcttaggcaacatgaacaattttgagactttggaagaatgcaaaaatatatgtgaggacggcccgaacgggtttcaggttgataactacgggacccagctgaatgcagtcaataattctctgacaccacagagcactaaggttcctagcctcttcgtgactaaggagggtaccaatgacggatggaagaatgctgcgcacatttaccaggtctttctcaacgcattttgcattcacgcaagtatgttttttctgggactggacagtatcagttgcctctgttag

SEQ ID NO: 137955 - DNA, 231 bp, Artificial Sequence
  Description of Artificial Sequence: Synthetic coding sequence
atgatttacactatgaagaaagtccatgcactctgggcctccgtgtgtttattgctgaatttagcccccgcaccacttaatgccgactcagaagaagatgaggagcacaccatcatcaccgatactgagcttcccccccttaagctcatgcattctttttgtgcattcaaggcagatgatggaccttgtaaggccattatgaagcggttttttttcaacatattcacctag

SEQ ID NO: 137956 - DNA, 186 bp, Artificial Sequence
  Description of Artificial Sequence: Synthetic coding sequence
atgatttacacaatgaaaaaggtgcacgccctctgggcctcggtgtgtttgctcctgaatctcgctccagcacctctgaatgccgattctgaggaagatgaggagcatactattattaccgacacagaactccctccgctcaaacttatgcacagtttttgtgccttcaaagcagatgacggatag

SEQ ID NO: 137957 - DNA, 321 bp, Artificial Sequence
  Description of Artificial Sequence: Synthetic coding sequence
atgatatacactatgaagaaggtgcatgctctatgggccagtgtatgcttgctgctcaatctagccccagcaccgctgaatgccgactcagaggaagatgaggaacatacaatcattactgatactgaattgcccccactaaagctaatgcactcattctgtgccttcaaagctgacgacggaccttgtaaggctataatgaagcggtttttcttcaacatttttactagacagtgtgaggaattcatttacggcggttgcgaaggtaatcagaaccgcttcgagtccctcgaggaatgcaagaagatgtgcactcggtag

SEQ ID NO: 137958 - DNA, 867 bp, Artificial Sequence
  Description of Artificial Sequence: Synthetic coding sequence
atgatctacacgatgaagaaggttcatgccctgtgggcatccgtgtgtctgttgttgaacctcgctcctgccccattgaatgctgattcggaggaggacgaggaacacactattatcacagataccgaactgccaccattgaaactcatgcatagtttttgtgcattcaaagccgatgacggtccctgcaaagctatcatgaaaagattcttctttaatatcttcacccggcagtgtgaggagttcatctatggcgggtgtgaaggcaatcagaaccgattcgaatccttagaagaatgtaaaaaaatgtgcacccgcgataacgctaataggattatcaagaccaccttacaacaggagaaaccggatttctgtttcttagaggaagacccaggcatatgccgtggatacatcacccggtacttttataataatcagaccaagcagtgtgagaggtttaagtatggcggctgtctgggtaacatgaataattttgaaactctggaagagtgcaagaacatctgtgaggatggacctaatggctttcaggtggacaactacgggacccaacttaatgcggtgaacaattccctgactcctcaatcaacgaaagtaccgtctctgttcgaatttcacggcccctcttggtgtctcacaccagccgaccgcggattgtgtagggccaatgaaaacagattctattataactccgtgatcggcaaatgtcgcccctttaaatattcagggtgtggaggtaatgagaacaactttacttcaaagcaagaatgcttgcgggcatgcaaaaaaggcttcatccaacgcatctctaaaggagggcttatcaaaactaagcgaaagcgtaaatag

SEQ ID NO: 137959 - DNA, 321 bp, Artificial Sequence
  Description of Artificial Sequence: Synthetic coding sequence
atgatatacaccatgaaaaaggtccacgcactgtgggcttctgtctgtttgctgctaaacctggccccggccccgcttaacgcagacagcgaagaggatgaggagcacaccatcatcacagacactgaacttccccctctgaaattaatgcattcgttctgcgccttcaaggccgatgacggcccctgcaaagccatcatgaaacggttcttctttaatatattcactagacagtgtgaggaatttatctacggcggctgcgaaggaaatcagaaccgcttcgagagcctcgaagagtgcaagaagatgtgtacccgttag

SEQ ID NO: 137960 - DNA, 318 bp, Artificial Sequence
  Description of Artificial Sequence: Synthetic coding sequence
atgatctatacgatgaaaaaagtccacgccctgtgggcatctgtgtgtttactgcttaatttagcccctgcccccctgaacgctgactccgaggaagatgaggaacatacgatcataaccgatacagagctgcctccactcaaactcatgcattctttttgcgctttcaaggcagatgacggtccatgcaaggcaatcatgaagcggttttttttcaatattttcactagacagtgtgaagagttcatttatggaggttgtgaggggaatcaaaacagattcgaaagcctggaagaatgcaagaagatgtgtacgtag

SEQ ID NO: 137961 - DNA, 966 bp, Artificial Sequence
  Description of Artificial Sequence: Synthetic coding sequence
atgggtgaaccccagggatccatgcgaatcctcgttaccggtgggtcaggactggtggggaaggcgatacagaaagtcgtagccgacggtgccggactgcctggcgaggactgggtgtttgtatcttcgaaggacgcagacctcaccgacaccgcccaaacaagagcactattcgagaaggtccagcctactcatgtaattcacctggctgcaatggttggtggcctcttccgtaacattaagtataacctcgatttctggaggaaaaatgttcacatgaatgacaacgtgctccattctgcattcgaagtaggagcacggaaagtagtctcctgtttgtcgacgtgtatctttcccgacaagaccacctatcctatcgatgaaaccatgatacacaatggccctccacacaacagcaacttcggctattcgtacgctaagaggatgatcgatgtgcagaaccgggcttacttccagcagtatggctgcacattcacagctgttatacccacaaacgtttttggccctcacgacaattttaacattgaggatgggcacgtgctgcccggcctgattcacaaagtccacctggccaagtcttcagggtccgcacttacggtgtggggaaccggcaacccacggaggcagtttatttactcccttgacctggcacagttgtttatttgggttctgcgggaatacaatgaagtagagcctattatactgagtgttggggaagaagacgaggtatctattaaggaggcggccgaggccgtcgtcgaggcgatggattttcatggagaagtgactttcgacactaccaagagtgacggacaattcaaaaaaacagccagtaactcgaagctgagaacctacctgcctgattttcggtttacaccatttaagcaagccgttaaggaaacatgcgcctggtttacagacaactatgagcaggcccggaaatag

SEQ ID NO: 137962 - DNA, 360 bp, Artificial Sequence
  Description of Artificial Sequence: Synthetic coding sequence
atgggcgagccacagggatctatgaggattctggtgactgggggaagcggtttggtggggaaggccatccagaaagtcgttgcagacggcgctggtttgccaggtgaagattgggtattcgtgagctcgaaagacgctgacctgactgacacagctcagactagggcactcttcgagaaggtgcaacccacccatgtcatccaccttgccgccatggtggggggtctgtttcgtaacattaagtacaatctagacttttggagaaagaatgtacatatgaacgataacgtcctccatagtgccttcgaggtgggtgcgaggaaggtcgtgagttgtttatcgacttgcatattcccatag

SEQ ID NO: 137963 - DNA, 807 bp, Artificial Sequence
  Description of Artificial Sequence: Synthetic coding sequence
atgggagagccccagggatccatgcggatcttagtgacaggcggcagcggcctcgtcgggaaggccatccagaaggtggtagccgacggtgcaggccttcccggggaggattgggtgtttgtttcctccaaagatgcggatctgactgatacagcccagacgcgcgccctgtttgaaaaggttcagcctactcatgtcatccatttggccgcgatggtaggcgggctcttcaggaacatcaagtataacctcgatttttggcggaagaatgtccatatgaatgataatgtgttgcattccgcattcgaagtgggcgccagaaaggtcgtcagctgtctgtctacgtgcatcttccccgacaaaaccacttacccaatcgacgaaactatgatacacaacggccccccccacaatagcaactttgggtattcgtacgccaaacggatgattgacgtgcagaatagagcatactttcagcaatatggatgtacattcactgccgtcatccctactaacgtgttcggaccccacgacaattttaacattgaggatggtcacgttctccctggcctgattcataaggtgcacctggccaaaagttccggttccgccttaaccgtctggggcaccggtaatccccggaggcagtttatctactctctggatctcgctcaactattcatctgggttctgcgggagtacaacgaggtagaacctatcatcctgtctgtgggtgaggaggatgaggtgagtattaaggaggccgctgaggcagtggtcgaggcaatggacttccacggcgaatag

SEQ ID NO: 137964 - DNA, 966 bp, Artificial Sequence
  Description of Artificial Sequence: Synthetic coding sequence
atgggagagcctcagggaagtatgcgcatattggttactggcggctccggactggtaggcaaggcgatccagaaggtggtcgcagacggcgccggccttccaggtgaagattgggtgttcgtctcgtccaaagatgctgacctcacagataccgcccagacacgcgctctcttcgagaaggttcagccaactcacgtaatacatctcgcggcaatggtgggcgggctcttcaggaatattaagtataacctcgatttttggaggaagaatgtgcatatgaacgataatgtattacactcagcgttcgaagtgggagcccggaaagtggtgtcctgcttgtctacctgtatttttccggacaagactacctaccccatagacgagacaatgattcacaatggcccgcctcacaactctaacttcggatactcctatgccaaacgcatgattgacgtgcagaatcgcgcgtatttccagcagtatgggtgtacgttcactgcagtgatcccaaccaatgtctttggtccacatgacaactttaacattgaggatgggcatgtgctgccggggctgattcacaaggtgcacctcgcgaaaagcagtggaagcgcactgaccgtgtggggaaccggcaaccccaggcgacagtttatttactccctggatctcgcccagctgttcatctgggtgctcagagagtataatgaagtggagcctattattcttagtgtaggagaagaggatgaggtgagtatcaaggaggccgcggaagccgtggtggaagccatggatttccacggcgaggtgacttttgataccactaagtctgatggccaatttaaaaagacagcatcaaacagcaaactgcgtacatatctgcccgacttcaggtttactcccttcaaacaggccgtaaaggaaacttgtgcatggttcaccgataactatgaacaagcacgcaaatag

SEQ ID NO: 137965 - DNA, 597 bp, Artificial Sequence
  Description of Artificial Sequence: Synthetic coding sequence
atgggcgaaccacagggttctatgcgaatccttgtcaccgggggatccggcttggtaggaaaggctatccagaaagtcgttgccgatggagctggtctgcccggagaggattgggtcttcgtgagtagtaaggacgccgacctgactgacaccgcacagaccagggcactgttcgagaaggtgcagcctactcatgtcatccacctggccgcaatggtgggaggtctgttccggaacatcaagtacaacctcgacttttggagaaaaaatgtgcacatgaacgacaacgttcttcacagtgcgtttgaagtcggtgccagaaaagtcgtgtcgtgtctctctacttgtatttttcccgacaagaccacctatcccatcgacgaaacgatgatacacaacgggccccctcataattcaaacttcggctacagctatgcaaagaggatgattgacgttcagaatagggcctatttccagcagtatggatgcacgtttactgctgtaatccccaccaacgttttcgggcctcatgacaattttaacatagaggacggacacgtgctccctggcttgatacataaggtccatctcgcctag

SEQ ID NO: 137966 - DNA, 2658 bp, Artificial Sequence
  Description of Artificial Sequence: Synthetic coding sequence
atggtggaaaagtcttctattgacgagaattcaatttctctggaaaaggaggtgcggcacgtccaagaacaaaacttggacatcctgaagaccgatctatctctcaaaagctttagcgaggagatttactctgagtcttgcgcgctgcttcctacttcaagcgccgatattgaagaaactgatctgtccgagaaatcctgtcctttggagaacggcggacgaagtagcatcagtcacctgaagaaagctgccagcgaggagaagccgctgggagtgggcgagatggaggaggagtgtacactggaaccggaattagctgcttttccgaagcaggatggcgggactcaggaatatacggatgccacactggaagaccaccgcggcgacgtgcaggaagccgatacactgcatagacaacttagcctctctcagtgttttcccctgttgatgaccgaagagcagcagaatccgggagaacaaatctcgactaatattcacgctagcggcgaagagaagtgttatgaggaagttcaagtgcagaatgaggcatcatttagcaccctggaaggggaaatgatcgaaacttcattctcccagaacattcccaagttggatgaggctcacaccacagaggccgccgagtctgaaacaagcttaacacagtatctgctcgctgctggcaaaagggaagtgcctgagactaaggataccagggatcaggcgaagttggtgcaaagcgagtcaattacttcaatggaggttgaagaggttacctttaatactgtgtacgaatactataaccagaagcaggaatcactcggcagaccactaagtcccgaatccgatataagcattggcgtgggctcaaccacctccgaggaaattagtgaactagaccagttttacacaccaccgtccagcgtggaatatttcgaaagtcccaagtcccccgacctgtatttcaacccatcagacattactaagcagagcagcatacattcagggggcgaaacagtcgaaaggtactcgaccccccttggcgaggtcgcagagcggtactccaccccctcagagggggaggtgggagagagatacagcaccccgcctggggaaaccttggagaggtattctacacccccaggggagacactcgagcggtacagtactcccccaggagaggctcttgaacgctacagcatccccactggggggcctaaccccacggggactttcaaaacctacccttccaagatcgaacgagaggacggtacacctaatgagcatttttacacccccaccgaggaacgcggcagtgcatacgaaatctggcgaagcgactcttttggcacccctaacgaagctattgaaccaaaggacaatgagatgcctccgtcgtttatcgagcccttaactaagcgcaaagtttatgagaacactaccctgggcttcatcgttgaggtggagggattaccggtcccaggggtcaaatggtataggaataaatccctattggagcccgacgaaagaatcaaaatggagagggtggggaatgtttgctcgctggagatatctaacattcagaaaggggaagggggagagtacatgtgccacgctgtgaacattataggcgaggcgaagtcttttgccaacgtggacataatgccacaggaggaacgcgtcgtagccctgccaccacccgtcacccaccagcatgtaatggagttcgacctggagcatactacttctagtaggaccccaagcccacaagaaatcgtcctggaggtggaactgtcagagaaggatgtaaaagaatttgaaaaacaggttaagattgtgaccgtgcccgagtttactccagatcacaagtctatgattgtcagtttagatgtgcttcccttcaattttgtcgacccaaacatggactccagggaaggagaggataaggagcttaagatcgatctggaggtttttgagatgcctccacgcttcatcatgcccatttgtgatttcaagattcccgagaattccgacgcggtcttcaaatgttctgtcatcggaattcccacgcccgaggtgaagtggtataaggaatacatgtgcatcgagcctgacaacataaaatacgtaatttcagaagagaaggggtcccatacgctcaaaatccggaatgtgtgtctgagcgacagcgccacgtacaggtgtagggccgtgaactgcgtgggggaagcgatttgtagaggctttttgacaatgggagatagcgagattttcgccgtcatcgccaagaaatccaaggttactctgtctagcctgatggaagagctggtactgaaatcaaactacactgatagtttcttcgaattccaagtcgtggagggccctcctcggtttataaaagggatttccgactgctatgcacctatagggacagccgcatacttccaatgtctggtgcggggatccccacgcccaacagtgtactggtacaaggacggtaaacttgtacagggacgtcgatttacggtggaagaatcagggactgggttccacaatttgtttatcacaagcctggtaaagtcagatgagggcgaataccggtgcgtggccaccaacaagagtggcatggccgagtcgttcgccgctttgactttgacctag

SEQ ID NO: 137967 - DNA, 16815 bp, Artificial Sequence
  Description of Artificial Sequence: Synthetic coding sequence
atgactacacaggctcccacatttacacagcccctacagtctgtggtcgtcttggaaggcagcacagccactttcgaagctcacatttctggcttcccagtaccggaggtgtcctggtttcgagatggacaggtcatatccacctcgactctgccaggcgtccaaatatctttttccgatggacgggcaaaactgaccatcccggccgtgaccaaagctaactcaggccggtattcgctgaaggcgacaaacggatcaggacaggccacttcgaccgcggagctcctggtcaaagccgaaacagctccacctaacttcgttcagcgcttgcagtcaatgaccgtaaggcagggctcacaagtccgtcttcaggtcagagtcactggaattccaacaccagtggtcaagttctaccgggatggcgccgagatccagagttctctagactttcagatctcccaggagggagacttgtacagcctgctcatcgcagaagcctatccggaggactctgggacctactccgtgaatgcaaccaattcggtcggtcgggccacttctactgctgagttgctagtgcagggagaggaagaagtacctgccaagaagacgaaaacgatagttagcacagcacagatctcagagagccgacagactaggattgagaaaaagattgaggcacactttgatgcaagaagtattgcaaccgttgagatggtaatcgacggagctgccggtcagcaactccctcacaaaacaccccctcgcatccctcccaagccgaaaagccgctcacccacccctccctccatcgcagctaaggcccaactggcccgtcagcagtccccatcccccatcagacacagccctagtccagtacgtcacgtgagagctcctaccccgagccctgtgcgaagcgtgtcccctgccgcacgcatctccacttctcccattcgcagcgtcaggtcacccctcctgatgaggaagacgcaagctagcacagtggccactggaccagaggtgcctcccccatggaaacaggaagggtatgtggccagcagtagcgaagctgagatgagggagaccacactgacgacctccactcagatccgcacggaagagaggtgggaaggtcgctatggggtccaagagcaagtgacaatcagtggagctgcaggggccgctgcaagtgtctcggcttccgcctcttatgcagcagaagcagtggcaaccggcgccaaagaagtgaagcaggacgccgacaagagtgccgctgtggccaccgtcgttgcagcagtggacatggcacgggtaagagagcctgtcatcagcgcagtggagcagactgcccagcgtaccacgaccactgctgtgcacatccagcctgcccaggaacaggtgagaaaggaggcagagaaaaccgccgtgaccaaggtggtcgttgccgccgataaggctaaagagcaagagctgaaatcacgaaccaaagaagtcataacgacaaaacaggaacagatgcatgtcacacacgaacaaatccggaaagagacggagaagacgtttgtccccaaggtcgtaatatcagccgccaaggctaaagagcaggagacaagaatttctgaggaaattactaagaaacagaaacaggtcacgcaggaagcaatacggcaggaaaccgagattacggccgcatcgatggtcgttgttgcgacggccaagtccactaaacttgaaacggtgcccggcgcacaagaggagactacaactcagcaagatcagatgcacctcagttacgagaagattatgaaagagaccaggaagactgtggtgcccaaagtgattgtggccaccccgaaagtgaaggaacaggacctggtatcaaggggcagagaaggaatcaccacaaagcgcgagcaggtacagattacccaggagaaaatgcgcaaggaagcggagaagacggccctctcaactatcgctgttgccaccgcaaaggccaaggagcaggagaccattttgagaacgagagagaccatggcaacacgacaggagcagatccaggttacacacggaaaggtggacgtcggcaagaaagcagaggcggtggctaccgtggttgcggccgttgaccaggctcgtgtaagggaacctagggaacctggccatctggaggagtcctatgcccagcagaccacactggagtatggatacaaagagcgcatcagtgctgctaaggtggctgaaccaccgcagcgacccgcatcagaaccacacgtggttccaaaggcagttaaacccagagtgattcaggccccatctgagacccacatcaaaacaactgaccagaaagggatgcacatttcgtcccagatcaagaaaaccaccgatctgaccacagagcgattagtccacgttgataaacggccacgcaccgcctccccacatttcacagtttccaaaatctctgtgccaaaaaccgagcatgggtacgaagcatccattgctggctctgcaatcgcaaccctccagaaggaactgtccgctacctcaagcgcgcagaagatcaccaaaagtgtgaaagcacctacggtgaaaccctccgagacgcgcgttagagccgaacctactcccctgccacagttcccctttgccgatacaccggacacatataagagtgaggccggggttgaagtgaagaaagaggtgggcgttagtattaccggcacaaccgtcagggaagagagattcgaagtgcttcatgggcgcgaagccaaggtgactgaaaccgcaagagtccccgcccctgtggaaatcccagtcactccacccactttggtctccggcttgaagaatgtgacagttatcgagggggaatctgtgactctggagtgccatatctcaggctatccatccccaacagtgacctggtatcgggaagattaccagattgagtctagtatcgacttccagataactttccagtcaggaatcgcgagattgatgataagagaagcattcgctgaggattctggtagattcacttgttctgccgtcaacgaggccggaaccgtatctacatcctgttacctggccgtgcaggtgtcagaggaatttgagaaggaaactacggcagtgacagagaagtttacaacggaggagaaaagatttgtggaatccagagacgtggtcatgacagatacctctctcactgaggagcaggcaggcccaggcgaaccagccgccccttattttataacgaagcccgtggtgcagaagctggtggaggggggaagcgtagtctttggatgccaggtgggagggaaccccaagccccacgtttactggaaaaagtccggggttcctcttaccactggatataggtacaaagtcagctacaacaaacagacaggtgagtgtaaattagtgatttcaatgacattcgctgacgatgccggggagtacaccattgtcgtgcgcaataaacacggagaaacctcggcgtccgcatccctgctggaagaggcagattatgaactcctgatgaagagccagcaggagatgttgtaccagacccaggttaccgcctttgtgcaggagccaaaggttggggagacggcaccaggcttcgtgtactctgaatacgagaaggaatatgagaaggaacaggcactgatcagaaagaaaatggccaaagacactgtcgtggtgaggacatatgtagaggatcaggagtttcacatctcgtcatttgaagagaggcttattaaagagatagagtaccggatcatcaagactacactggaagagttgctggaggaggacggcgaggaaaaaatggcggtggatatttccgaatctgaagccgtcgaatctgggttcgatagccgcatcaagaactacagaattctggaaggcatgggtgtaacattccattgtaaaatgtccgggtacccactgcctaaaatcgcctggtataaagatgggaaaagaatcaagcacggcgaacggtaccagatggactttcttcaggacggacgtgccagtctgcggattcctgttgtgttaccggaagatgagggtatctacacagcttttgccagcaatatcaaaggaaatgccatctgcagcggcaagctgtacgtggagccagctgccccgcttggcgctcctacctacattccgacattggagcctgtaagccgtattcgatcactgtctcccaggagtgtttcacgtagcccaatccgaatgagccccgcccgaatgtctccggccaggatgagtcccgccaggatgagtccggcacgtatgagccctggcaggaggctcgaagaaaccgacgagtcccaactggagcgcctgtataaacccgtgtttgtgctgaagcctgtgagctttaaatgtctcgagggccaaaccgctagattcgatttaaaagtggtgggacggcctatgcccgaaacattttggttccacgacgggcagcagattgttaacgattacacccataaagtagtcataaaagaggacggaacacaaagcttgatcatagtgcctgctactccctccgattctggtgaatggaccgttgtggcccagaaccgggccggtcgcagttcaatctcggtcatactcaccgttgaagctgtagaacatcaagtgaaacccatgttcgtagaaaagctaaagaatgtgaatattaaggagggtagtcgcttagagatgaaggtgagagcaaccggaaaccccaaccccgatatcgtgtggctgaagaacagcgacattattgtgcctcataaatacccaaagatcagaattgaaggtacaaaaggcgaagctgcattgaagatcgattctaccgtgagccaggatagcgcatggtacaccgccacggccattaacaaggctgggagagacactactagatgtaaggttaacgtggaggtagagttcgctgaaccggaaccggaacggaagttgattatcccgcgggggacctacagggccaaggagattgctgctccagaattagagcccctccacctgagatacggacaggaacagtgggaagagggagacctgtacgacaaggagaaacagcagaagcctttcttcaagaagaagctcacaagtcttcggttgaagagatttggtcctgcccacttcgagtgcaggttgacacccatcggcgaccccacaatggtggttgaatggctccacgatggcaaacccctggaagcggcaaatagattgaggatgataaatgaatttggctactgcagcctggactatggcgtcgcgtattctagagactccgggattataacttgcagggccactaataaatatgggacggaccatacttctgccacactaatcgtgaaagatgaaaagtccctggttgaggagagtcagctgcctgaaggcagaaaaggactgcagagaatcgaggagctggaacgtatggcccatgagggagccttaacaggggttacgacagatcagaaagagaagcagaagcccgatattgtgctttatcctgagcctgttagggtgctggagggcgaaactgctaggttcaggtgtcgggttacaggatacccccaacctaaggtgaattggtacctgaacggccaattgataagaaagtcgaagcgatttcgggtgagatacgacggtatccattatctcgacattgttgactgtaagagctacgatacaggtgaagtcaaagttaccgctgaaaacccggaaggcgtcattgagcacaaagtcaaattggagatccaacaacgcgaagatttccgatcggtgctgagacgggctcctgagcccagaccggaattccatgttcatgagcccggcaagttacagttcgaagtgcaaaaagtggacagaccggtcgataccactgaaaccaaggaggtcgtcaagctaaaacgcgccgagcgcatcactcatgagaaagtgcctgaggagagtgaagaactgcgctccaagtttaaacgccgaacagaagaggggtactacgaggcaattaccgccgtggagctcaaatcccgcaagaaggacgaatcttacgaggaactactgcgcaaaaccaaggacgaactgttgcactggacaaaagaattaactgaggaggagaagaaagcactggccgaggagggcaaaattaccatccctacgtttaagcctgacaagattgaactcagccccagcatggaggcccctaaaatttttgaaagaatacaatctcagacagtggggcaaggctccgatgcgcacttccgggttagagtggtgggaaagccggatcctgaatgtgagtggtacaagaatggtgtcaagatagaaaggtctgaccggatttattggtactggcctgaggataatgtctgcgaactcgtaatacgggatgttacggccgaggattctgcaagtattatggtcaaggcaataaatattgctggtgagaccagctctcacgcatttctgctggtacaggctaagcagctgatcacattcacccaagagctgcaggacgtagtcgcaaaagagaaggacaccatggccacctttgaatgcgagacctcagagccgtttgtaaaggtgaaatggtacaaggatggcatggaagtacacgagggcgacaagtaccgaatgcactcagatcgtaaggtacacttccttagcattcttactatcgacacctctgacgcggaagattatagctgcgtactggtggaggatgagaacgtaaagaccacagctaagctgatcgttgagggcgccgttgtcgagttcgtgaaggagctgcaagacattgaggtgcctgagtcctattctggagagctggaatgcatcgtctctcccgaaaacatcgaaggaaagtggtaccacaatgacgtcgagttgaagtccaatggaaagtacaccatcacatcaagacggggaaggcagaacctcactgtgaaagacgttactaaggaagatcagggagagtattcctttgtcattgacggcaagaagaccacctgcaagctgaagatgaagcctagacctattgctatactgcagggtctgagtgaccagaaggtgtgtgagggcgatatcgtgcaattggaggtaaaagtgtcactcgaatccgtagagggagtttggatgaaagacggtcaggaggtccagccaagtgaccgcgtccatattgtgatagacaagcagagtcacatgttactaatcgaagacatgactaaagaagatgctgggaattactcattcactataccggctctcggtctgagcacctctgggcgcgtttcagtttacagcgtggatgtgatcactcccctgaaagatgttaacgtcatcgaagggacgaaggccgtactggagtgcaaggtctccgtacccgacgtgaccagcgtgaaatggtacctgaatgatgagcaaattaaacccgatgacagagtgcaggctattgtgaagggaaccaaacagcgcctggtcatcaatcgaactcacgcttctgacgaaggtccgtataagctgattgtgggtcgcgtggaaacaaactgcaatttgtccgtagaaaagattaaaattatacggggcctgagggatctcacttgtactgaaacccagaatgtggtatttgaggtcgaactgagccattctggcatcgacgtcctgtggaacttcaaagacaaagagatcaagccatcttcaaaatacaaaattgaagctcatggaaaaatctataagctgactgtactcaacatgatgaaggatgatgaaggtaagtacactttttacgccggcgagaacatgacctcgggcaaactgaccgtagcaggaggcgccatcagtaagcctcttaccgatcagactgtggcagagagtcaggaagcagtgttcgagtgcgaggtggcaaaccccgatagtaagggtgaatggctgcgagacgggaaacacctccctctgaccaataatataaggtctgagtccgatgggcacaagagacgactgataattgctgccaccaagcttgatgatataggcgagtacacctacaaggttgcaacatccaaaaccagcgcaaagttgaaagttgaagccgtcaagatcaagaagacattaaaaaacctgaccgtgaccgaaacccaagacgcagtatttacagtcgaactcactcaccccaatgtgaagggtgtgcagtggattaagaacggtgttgtcctcgaatccaatgaaaaatacgctattagcgttaaggggacaatttatagtctaaggattaaaaactgtgcgatcgtggatgaatctgtttatggattcagactcgggcggttgggagccagcgctcgcctgcatgttgaaacagtgaaaatcattaagaagcctaaagatgtgaccgcgctggagaacgccacagtagctttcgaagtgtccgtctcccatgacacggttcctgttaaatggttccataagagcgtggaaatcaaaccctccgataagcatagactcgtgagcgaaagaaaggtgcataaactcatgctgcagaatatctctccgagcgatgcaggagagtacaccgccgttgttggacagcttgagtgcaaggctaaactgtttgtcgagaccctccacattaccaagactatgaaaaacatcgaggttcccgagaccaagaccgcctctttcgagtgcgaagtgagtcattttaatgtccctagtatgtggcttaagaacggcgtggaaattgagatgtccgagaagttcaaaatcgtcgttcagggaaaacttcaccagctcattatcatgaatacgagcacagaagactcagccgagtatactttcgtgtgcggcaacgaccaggtctcggcaacactgaccgttacaccgattatgatcacatcgatgctgaaggatatcaacgcagaggaaaaagacacaattactttcgaagtgaccgtcaactatgaaggcatttcatacaaatggttgaagaacggtgtggaaattaagagtacagataagtgtcagatgaggactaagaaattgacgcattcactgaacattcggaacgtgcacttcggggatgccgccgattacactttcgtggcgggaaaggcaactagcactgctactctttacgttgaagctaggcacatcgagtttcgaaagcatatcaaggacatcaaggtgctcgagaagaaacgcgcaatgttcgagtgcgaggtgtccgaacccgacatcacagtgcaatggatgaaagatgaccaagagctacagatcactgatcgaatcaaaatacagaaggagaagtacgtccatcgactgctgattccctccacaaggatgtctgacgccggcaaatacactgtcgttgccggtgggaatgtgagcacagccaagttatttgtggagggccgtgatgttcgcataagatccattaagaaggaagtacaggtgattgaaaagcagcgagccgttgtcgaatttgaagtcaatgaagacgacgttgatgcacattggtacaaggacggcattgagatcaattttcaggtgcaagagcggcataagtacgtggtggagcggcgcatacaccgcatgttcatttccgagacgagacaatctgacgcaggcgaatatactttcgtggctgggcgcaaccgcagctctgtcacactgtacgtgaacgcgcccgagcctcctcaagtcctgcaggagctgcagcccgtaactgtgcagagcggtaaaccagcgagattctgtgctgtcataagcggccgaccccaaccgaagatctcctggtacaaggaagagcaactcctgagcacaggattcaaatgtaagttcttacacgacgggcaggaatacacactgcttctcatcgaagccttcccagaagatgcggccgtctacacgtgcgaggctaagaacgattatggggtcgccactacgtcagcttctctgtctgttgaagtacctgaggttgtgtccccagaccaggagatgccagtatatccccctgcaatcatcacaccgttacaagacacagtgacctctgagggacagcctgctcgatttcagtgtagagtgagtggtacagatttgaaggtctcctggtacagtaaggataagaagatcaagccttctcgcttttttcgcatgacacaatttgaagatacatatcagctcgaaattgccgaagcttatcccgaggacgaaggcacctacacatttgtggcttcaaacgcagtcggccaggtttccagtaccgcaaatctttccctagaagcccctgagtccatactgcacgagcggatagaacaggagatcgagatggagatgaaagagctgttttctgaaggggaatctgagcactcggagagggacacaagagacgcgtttagtgacagtgaagacattgatcacaaatccatggccgctaaacggtatgcatcccgcatcagttccacctccagttggcctgaatacttcaagccgtcattcacgcagaaactgacctttaagtatgtgttagagggagagccagtggtcttcacttgtcggttaatcgcttgtcctacaccagagatgacgtggtttcacaataatcgcccaatacccaccggccttcgccgaataattaaggctgagtcagatctgcaccaccattcctccagcttggaaatcaagcgtgtccaggatcgggactctggatcttatcgcctccttgctattaacagtgagggttcagccgaaagtactgctagtctgctggtaatccagaagggccaggatgagaagtacctagagttccttaaaagagcagaaaggacccacgagaatgtagaggccttagtcgaacgaggcgaagatagaattaaagtggatctgagatttacaggtagcccatttaacaagaagcaagacgtggaacaaaagggaatgatgagaacaatccattttaaaactatgtcgtcagccaaaaagacagactacatgtacgacgaggaatatctggaatcaaagagcgatattcgcgggtggctgaacgtcggcgagtccttcctcgataaagagacgaaagtgaagcttcaaagattgcgggaggcgcggaagactctgatggagaaaaagaaactgtcactgctggacacgtcctctgagatttcatctcgaacgctgaggtccgaggcaagcgacaaagatatcctttttagcagggaggacatgaagatcagaagcatgtctgacctcgctgaaagctacaaagtagaccattctgccgagagcattgtacaaaaccctcacgccctgtctaatcaaatggatcagaacatcgagtctgaggagcttccgacgtcttttcagaccattgtagacgaagagatctttcagacagaaataaggatgagtcaggaagcacttgttaaagagtcacttcccaaggaccacctctatggggagattcttgtcaacgagaatacacaagcccgcggccagctcgaggaaatcatggccaataccactattggcgaaagtagtacatatatcaccaacgtgtgtgagaaagaagaggtctacgagacgcctgagaatgtgagtcaggcaataacgccacatgcaagcgagagctttggcactctggtgaatgtcgaggaaagcgaggaaattgcatccgagaggatcaaaaaggacgatctacgtgagttacaattgtctgcatcaacccgcatcgatgagtttaagacagaacagaaggaagaaaatatgagattctttgaaaatagcttccggaagagaccccaacggtgccctccaagtttcctccaggagatcgaaagccaagaggtgtacgaaggtgacagttgcaactttgtgtgccacttccagggatatcctcagccaatcgtaacatggtacaacaacgatatgccgatccctcggaaccagaatttcattatccacagtctggagaactattccattttgacgctgtccagcgtacaccatcagaacgaagggagcatcacctgcgtgttgtttaatcaatacgggactgtgaaaaccacgagcatgctgaaggtgaaggctaaacagaaacacgacgtaaaggctcacaaggtgcccgtgtttcacgactacctggacgaggaggaggagctggctctagtctttgatcaagctaaaggggcccacccgagcatgtcgcaggagggccagacaaacctgcaccttttaaaaaccaacccgcccgtgccaccctctggggacacagagctgctttcctttcccgtcgagattcaagttaccgcagcgacacccatcccagagcaagacaaggagtctaaagaagtgtttcagaccgaagaacttgagccaaaggctatgcctcaagaccaggtaactcagtcacctaaacaccgattcgtgtttctctccgatatcactaacgagccccctaagatgttgcaggagatgcctaagcacgcacgatgcagagaaggagacagtatcattctggagtgtttaattagcggagagccccagccagtggttacctggttccagaatggcgtgctgcttaaacagaatcagaagttccagtttgaagaggtgaactgctctcaccagctgtatatcaaagacgtcaatagccaggatagtggcaagtacaaatgtgtggcggagaacaatagcggggccgtagagtctgtaagtgacctgactgttgagccagtaacttacagagaaaattcacaattcgaaaatatcggcgagatttatggaaaatactctcgggaccagcagctgcaggaccagggggagtcagtgcgcgcccacttttacgactatcccgccggtcctttcactccctggactaatgtgaaagagtactcagtcagggattatttccagtccctcgagaccatcgagcaaatagatcaaaaagagcaggtgcgctgcattccctcaagggaaaagatcccacgctttgtgcacggcgctagtagaaccataaaaatttcgaaaccaatacgtgctgagttcattcaatgtcaggctgagggcaaagagaggcatgtctccgaaaaatccaagcttcaccaagcagaaggcacagtctaccctttcgtagacgacttctccgatgtgacaatcaagaaagagattcgaaacaacttcgggaaattgggcagatctgagaaggaaaacgttcaagagtgcgcccagagtgactacttaccaaatatccatagtgaacgcatctccgatagctacaatactaaggatagttctgcaattgtgtacgaagaatctctcggcgaggaaatccattatccaggcaaaaaagttaagcaccggattattgaattcgaaaagctgcacgtcgaaaagggtgtgctggagaagaggcctacccgtacctccattgtgaatccgccccagaaaaagatcgacgacaaggctttcagcctcaagcagcgtgagagcaggtccagtaatctaaatgcaaacatgtatcaggctgagaaaatgagtccaaatactgaatccgacagctccaacatagctatcaacctcaaactgctgagtagccagacacacaaagaatttgacgcccaagagagagaacaacaagaaaagatttctcttatcgataagcctgctatcagcaaaagagcagagcatgagtctcccattaccttcgatctgaagcagtttcacactcagattaagcacactgacgtgaagttccaggagctggattccgggcagccagaagaggcgtattttaaaattcagcaccccgcagatactgagaatattgttttcgacctaaagcagatgtactctcatatcggcgatcccgcgctcgagttccaggggcaagagactagggagcagcaagaaatccattacaaggagaagatccccagccccgagacactgcagcctgatactcataatatcagcaagtcagttcagaacaacgtgtttgcctctcaggaaatttcatccagccaggagctaagcaaccgaactatggtggagaagagctctatagatgagaatagcatctcgttagaaaaagaagtcagacacgtgcaagaacagaacttggatatcctaaaaaccgacctgtccctcaaatcgtttagtgaggaaatttattccgagtcttgcgctctgctgcctactagcagcgccgacattgaggaaacggacctgtctgagaagagctgtcccctggagaacggaggtcgcagtagcatctctcacctcaaaaaagcagcatccgaggaaaaacctctgggagtgggcgagatggaggaggaatgcactctggaaccggaacttgctgctttcccaaaacaggacggaggcacccaggaatatacagacgccaccctggaagaccacagaggcgatgttcaggaagctgatacactccacaggcaattaagcctgtcgcaatgcttcccccttctcatgacggaggaacagcagaatcctggggagcagatctcgactaacatacatgcgtccggcgaagagaaatgttatgaggaggtgcaggtccagaacgaggcctcattctctacgctagagggtgaaatgattgagacgtctttcagccagaatatccctaagctcgacgaggcccacaccactgaagcagcagagtctgaaacctcacttactcagtatctcctcgcagctggcaaacgggaggtgcccgagactaaggacaccagggatcaagctaaattagtgcagagtgagtcaatcacctctatggaagtggaagaggtcaccttcaacactgtgtacgagtactacaaccaaaaacaagagtcccttggccgacccctgtcacctgagagcgatatctccatcggagtgggctcaaccacttccgaagagatttcggaactagaccagttctatacccctccttcctcggtggagtattttgaatcaccaaagtcacctgacctgtattttaatccttcagatataactaaacagagttctatccatagcgggggggagaccgtcgagcggtacagtaccccactgggcgaggttgctgaacgatatagcactccctcagagggggaggtcggagagcgatacagcacacctcctggagagactcttgagagatacagcacgccacccggggaaacgctggagcgttatagcacaccacccggcgagaccctggagcgctattccaccccccccggcgagactctggagcgctattcgacccccccaggggagactctggagcggtacagcacacctcctggcgaagccttagaacggtactctatccctaccggtggacctaaccccacaggtacgttcaagacttatccaagcaagattgagagggaggatggcacaccaaatgagcacttctacactccaacagaggagaggggctccgcatacgagatctggagaagcgactcatttggcactcccaatgaggccatcgagcctaaggataacgagatgcctcccagctttatcgagcccttgacaaaacgtaaagtttacgaaaataccactttgggattcattgtcgaggtggaaggtctgcccgtgccaggtgtgaaatggtatcgaaacaagagcttgcttgagcccgatgagcggattaaaatggaaagagtcggtaatgtttgctcattggagatttcaaacattcagaagggtgagggcggcgagtacatgtgtcacgcggttaatattattggcgaagccaagtcattcgccaacgtggacataatgccccaagaagagcgggttgtggcactccccccacctgttacccaccagcacgtgatggagttcgaccttgaacatactaccagttctcgaactccttcccctcaggagattgtgctagaggtggagctctccgagaaagatgtaaaggaattcgaaaagcaggtgaagatcgtaaccgtgcccgaattcacccccgaccacaaatccatgattgtgtcactcgacgtgctcccgtttaactttgtagatcctaatatggactctcgagagggcgaagataaggagctcaagattgatctggaggtgttcgagatgccccccagatttattatgcctatttgcgatttcaagattcccgagaacagtgacgcggtcttcaaatgcagtgtaatcggcatcccaaccccggaggtgaaatggtataaagaatatatgtgcattgagccagacaacattaagtacgtgatttctgaggagaagggaagtcataccttgaaaatacggaacgtgtgcctttccgatagtgctacttatcgatgccgcgccgtgaactgcgtgggcgaggcaatatgtagaggtttcctgaccatgggcgatagcgaaatcttcgctgtgatcgctaagaagagcaaagtgacactgagtagtttgatggaagagctggtgctgaagtcaaactatacagacagcttcttcgagtttcaggtggtggagggccccccccggtttataaaaggtatctccgactgttatgctcccatcgggaccgccgcctacttccagtgtctggttagagggtctccacggccaactgtttattggtacaaagatggaaagcttgtgcaaggcaggcgcttcactgttgaagaaagtgggacaggcttccacaatttgtttatcaccagcctggttaagagtgatgaaggtgagtacagatgtgttgctaccaacaaatctgggatggctgagagttttgccgccctgacattgacatag

SEQ ID NO: 137968 - DNA, 1419 bp, Artificial Sequence
  Description of Artificial Sequence: Synthetic coding sequence
atgtacatctacgaggcttccgaggaagcggttctggaggagaaggttcttgtgacccagccccaaaaaaccaaacctaaactggctaaagttcctgagcctccaaaaaaggtggtccccgaggacaagatttatgtcaccattcccaagaagcgagagacccccgccacaaaagaaccggatactaccaggggaattttcccagaggtcgaacctcctgaggccattccggagattccagagcatccacccacggaggaattcgaagtgttcaaagaagtgattccagaaggtgaaactccaattgtaaagcgaagaaagactccttcccctactgcaccggaagcaatgaaggaagtggtgcctgagatgaagatttttgaagatgtcccagaagagcctgagacgcccaggatgaaaacacctgaggccccacaagaaatcattcctgccaagaccgtcccatccaagaagagagaacctccttcagtgaaagtgcctgaagcactgcaggagatagtgcccgagaaaaagacactcgtggtgccccttagaaagcctgaagtgctgcccgacgaagtgccagaggccctgcgcgaagtggtgcctgagaagaaggtacaccccccacagcgagccgaggtcgtgcctgtaaaggtccacgaggccccaaaggaaattatccctgaaaagaaggtatcagtcgttcccccgaaaaaaccagaggtgcccccagtaaaggtgcctgaggcttctaaggaggtcatacgagaggagaaagtacctctcgccccccctaaggagcccgaggtacctcctgttaaagttcctgagcccccgaaagaggttgtccctgagaagaaagccccagtggcccctcctaaagagcccgaagtgccgcccgtcaaggttccagaagccccaaaagaagttgtgccagaaaaaaaagttcccgtgccccctcccaaaaagccagaagtaccacccactaaagtccctgaggtgcccaaagccgcagtgccagaaaagaagctacccgaggccataccacccaagccagagtcacctcctcctgaggtgccagaggttctgcctcctaaggaggtggtgcccgaaaagaaagtgccggtgccacccgctaagaaacctgaggcacccccccccaaggtccccgaagccccaaaagaagtggtgctggagaaaaaggccagcgttgccgttccgaagaagccggaagctcccagagccaaggtccccgaggccgctcaagaggtcgttccagaaaagaagatccctaaagccccaattaagaagcctgaggcgccagctgttaccgtccccgaggtaccacaggaaatcgttcccgagaagaaaaccctcgtgttgcctaagaagcctgaggttccacctgttacctag

SEQ ID NO: 137969 - DNA, 1122 bp, Artificial Sequence
  Description of Artificial Sequence: Synthetic coding sequence
gtggttccagaaaagaaagtgccactggtggttcccaaaaagcccgaggcgccacctgccaaggttccggaggtgcccaaagaagtggtgcccgagaaaaaggtggcagtcccaaagaagcccgaggtgccaccagccaaagtgccagaagtgcctaagaaacccgtcctggaagagaaaccagcagtccccgttccagaacgggccgagagtccgcctccagaagtgtacgaggagccagaggaaatcgcacctgaggaagaaatcgcgcccgaggaagaaaagccagtgccggtcgctgaagaggaggagccagaagtcccccctcccgctgtgcccgaagaacctaagaagattattccggagaaaaaagtaccggttatcaagaagccagaggctcctcctccaaaggagccagaaatgccaaaaaaggtggttccggttaagaaagttccaaccgtgaagaagccggaaacccccgcagcgaaggtgcctgaggttccaaaaaaactggtgccagtcaagaaggaacccgtgcccgtcacaaaaaaaccagaggtcctccctgagaaggtgcccaaagtccccgagaagatcatcccggagaaagaggtgagcgtgcctatccccgctgaacctgaggtaccacctgccgaggttgaagaaactcccgaagaaatcatttatgaggagaaggcctccattactatcggccgtaaggagacccctccagttgaagaacgcgaaattgagaagtatatcaagcccgaggagccggagccagaaccccagcccgaggagatccctgtgaaggagccagagcctgagaaagtgattgagaagcctaagcttaagccccgtcctccacctccgccacccgctccccccaaagaagacgtcaaagagaagattttccagctgaaggctattcccaaaaaaaaagtgcccgaaaaaccccaagtgcccgagaaggttgagctgacacccctgaaggtgcctgaacccccaccacctaaacccgtcgaagaggtagaggtccccaccgtgaccaagcgggagaggaaaattcctgagcccactaaagtgcctgagataaagccagctatccctctgcccgcttag

SEQ ID NO: 137970 - DNA, 543 bp, Artificial Sequence
  Description of Artificial Sequence: Synthetic coding sequence
aaagtcccagaagtgcctaaaaaacccgtgctggaagagaagcccgcggtgccagtgcccgagcgcgccgagtcacctccacccgaggtgtacgaagagccagaggagattgcaccagaagaagagattgcaccagaagaggagaagcctgtgccagtggccgaggaggaggaaccagaagtgcccccgcctgccgtgcctgaggaacccaaaaaaatcattcctgagaagaaggtgcccgttatcaagaaaccagaggcccctccccccaaggagccagagcccgagaaggttatcgagaagcctaagttaaagccccggccccccccacctcctccagcccccccaaaagaggatgtcaaagagaagatttttcagctgaaggccatacccaagaaaaaagtgccagaaaagcctcaggtcccagagaaggtggagctcacaccacttaaagtccccggtggggaaaagaaggtccggaagctcctgccagaacggaagcccgaacctaaggaagaggttgtgctcaagtcgggcatctag

SEQ ID NO: 137971 - DNA, 438 bp, Artificial Sequence
  Description of Artificial Sequence: Synthetic coding sequence
gaggatacttaccagctagagattgcagaggcctatcccgaggacgagggcacctatacatttgttgcatcaaacgccgtgggccaggtgtctagtacagccaatctgtcgctggaggccccagagagcatattacacgaacggatcgagcaggagattgagatggagatgaaagaactgtttagtgagggcgagtcagagcactctgagcgggatacgcgggatgctttcagcgatagcgaagatattgaccacaaaagcatggccgcaaagaggtatgccagccgcatcagctcgacaagctcttggcccgagtacttcaagccctctttcacccagaagctgacattcaagtatgtactagaaggcgaaccagtggtcttcacctgtaggcttattgcatgtccaacccctgaaatgacttggtttcacaactag

SEQ ID NO: 137972 - DNA, 546 bp, Artificial Sequence
  Description of Artificial Sequence: Synthetic coding sequence
atgttcttcgcctcacataccgaggaggaggtaagtgtgacagtacctgaggtacagaaggagattgtgactgaggagaaaatccacgtggccatctcaaaacgggtggagcccccacctaaagtcccggaactgcccgagaaacccgcccccgaggaggttgcaccggtgccaatccccaaaaaggtagagcccccggctcctaaggtccctgaggtgcccaaaaaaccagtgcctgaggaaaaaaagcccgtacccgtccctaagaaggagccagcagcaccacctaaggtacccgaagtgcctaaaaagccagtgcctgaagagaaaatacccgtacctgtggcaaagaagaaagaggcaccccctgcaaaagtcccggagatacccaaaaaaaaggtgcctgaagagagaaaaccggtgcctcggaaggaggaagaggttcccccaccccccaaagtcccagcactgcctaagaaacccgttccggaagaaaaggtggccgtgccagttcccgtggcgaagaaagcccccccccctcgctag

SEQ ID NO: 137973 - DNA, 2490 bp, Artificial Sequence
  Description of Artificial Sequence: Synthetic coding sequence
gttgaggagttcatcaaacttgagcaacatagagttgaggaggagcatagggttgaaaaagttcaccgggtaattgaagtgtttgaggccgaggaggttgaggttttcgaaaagcccaaagcccctccgaagggaccagagatctctgagaaaatcatcccccctaaaaagcctccaaccaaggtagtgccacgaaaggaaccacccgcgaaggtgcctgaggtgccaaagaaaatagttgtggaagagaaagtacgggtgcccgaggaacctagggtcccacccaccaaagcaccggaagtccctaagaaaatcgttccagaggaaaaggttcgggaggccgtcttgaaaaagccagaagtcccccctgctaaagtgcctggaatgcccaagaaatccgtacaagaggaaaaaagccccattgttatttctgaggacacagaaatgtatatttatgaggcgtccgaggaggccgtcctggaagagaaagtattggtcactcaaccacagaagaccaaacctaaactcgccaaagtgcctgaacctcctaaaaaagtggtaccggaggataagatctatgtaactatccctaaaaaacgggagactccagccaccaaagaacccgacacaaccagaggcatattccctgaggttgaaccccctgaggctatccccgagatcccagagcatccccccactgaagagtttgaggtcttcaaagaagtgattccagagggcgagacccctattgttaaacgtagaaaaactcccagtcccactgcgcccgaggcgatgaaggaagtcgtgcctgagatgaaaattttcgaggacgtgccagaggagccagagactcctagaatgaagacccccgaggcccctcaggaaataatccccgccaagacagtgcctagcaaaaagagggagcctccatcagttaaggtgccagaagccctgcaggagattgtgccagaaaagaagacactagtggtgcctctaaggaaacctgaagtgctgcctgatgaggttccggaagccctaagggaggtggtccctgagaagaaggtccaccctcctcagcgggccgaagtggtccctgttaaagtgcacgaagctcctaaggaaatcattcccgaaaaaaaggttagtgtggtccctccaaagaagccagaagtgcctccagtaaaggtgccggaggcaagcaaagaggttataagggaggagaaggtgccgctcgcccccccgaaggagcccgaggtgccgcccgtaaaagtcccagagccacccaaagaggtggtacccgaaaagaaggccccagtggcccctccgaaggaacctgaggtcccaccagtgaaagtgccagaagcaccaaaggaggtcgtgcccgagaaaaaagtccccgtgcctccccccaagaaaccagaagttccccccacaaaagtgccagaggtaccaaaggctgccgtgcctgagaagaagcttcccgaggcaatccctccaaaaccggagagcccccccccagaggttcccgaggtcctcccccccaaggaggtagttcctgaaaagaaggttcctgtcccccctgcgaaaaagcctgaagccccaccacctaaagtgcctgaagctcctaaggaggtcgttttggaaaaaaaagcatcagtggccgtacctaagaagcccgaggctcctagggctaaggtccccgaagccgcccaggaagtagtacccgaaaaaaagatacccaaagcacccataaagaaacctgaagccccagccgtcaccgtcccagaggttccacaagagattgtgcccgagaagaagactcttgtgctaccaaagaagccggaggtcccccccgtgaccgttcccgaagctccaaaagaggtggttctcgaaaagaaggtgcccagtgcaccgcccaagaagcccgaagtccctcccgtgaaagtccccgaggcacctaaagaagtcgtgcctgaaaagaaggtgcccgtgcccccaccgaagaaaccggaggtcccccctactaaagttccggaagttcctaaggccgctgtgccggagaagaaagttccggaggctatccccccaaaaccagaatctccaccgccagaggtaccagaggtcttgccaccgaaggaagtcgtgccggaaaaaaaggtaccagtcccccccgccaaaaagcctgaagcacccccccctaaggtacctgaggcacccaaagaggtcgtcttggaaaaaaaggccagcgtcgccgtgcctaagaagccagaagctccacgggccaaagtgcccgaagcggctcaagaagtcgttcccgagaagaagatccctaaagcacctattaaaaagcctgaagccccagcagtcacagtccccgaagtgccacaggaagcggcagagaaagagatcccagtggctccccctaaaaagccggaggcacccatcgttcccgtgccagaagcccaggaggtcgtgcccgagaaaaagtag

SEQ ID NO: 137974 - DNA, 504 bp, Artificial Sequence
  Description of Artificial Sequence: Synthetic coding sequence
atggctacctccgaactaagctgcgaagtaagtgaagaaaattgcgagcgcagagaagccttctgggctgaatggaaagatcttaccctgtcgacccgcccggaagagggatgctccctgcacgaggaagatactcaacggcacgaaacttaccaccagcaggggcaatgccaggtgttggtacagaggtcaccttggctgatgatgcggatgggcatcctaggtcggggactccaagaatatcagcttccctatcagagagtcctgcctcttccaatattcacacctgctaagatgggtgccaccaaagaagagcgggaggacacccctattcagttacaagaactgttggccttggagaccgcactcggaggtcaatgtgtagaccgccaggaggtggcggaaattaccaagcagttgccacctgtcgtcccggtgtctaagcccggtgcacttcgcaggagcttgagtagatcaatgagccaggaggcacaacgggggtag

SEQ ID NO: 137975 - DNA, 744 bp, Artificial Sequence
  Description of Artificial Sequence: Synthetic coding sequence
atggcaggaggagtgctcccactgcgtggactgagggccctttgcagggtgctgctctttctgagtcagttctgtatcctgtcaggaggggagcagagccaggctctggctcagagtatcaaagatcccggccctactaggacttttacagtggttcccagggccgcggaaagcaccgaaatacctccctatgtcatgaagtgtccgtctaacggcctctgcagcaggcttcctgcagattgcatcgattgtactactaacttttcttgcacatacggaaaaccggttacatttgattgcgctgtaaagccctccgtgacatgtgtggaccaagactttaaaagccaaaaaaatttcattatcaatatgacttgccggttctgctggcagttgcctgaaacagattacgagtgcacaaatagtacatcttgtatgaccgtttcttgtcctagacagcggtaccccgcaaactgtacagtcagggatcacgtccactgtctcggtaataggactttcccaaagatgctttactgtaactggacaggggggtacaagtggtccaccgcattagcactgtcaataactcttgggggcttcggcgccgataggttctatctgggccaatggcgggagggcctagggaaattgtttagctttgggggtctggggatctggacacttatcgacgtcctgttaattggagttgggtatgttggtcccgctgacggttccctttatatttag

SEQ ID NO: 137976 - DNA, 666 bp, Artificial Sequence
  Description of Artificial Sequence: Synthetic coding sequence
atggccggcggcgtcctccctctgaggggacttcgggctctttgccgggtgcttttatttctgtcgcagttctgtatcctctctgggggtgaatcaactgagattccaccctatgtgatgaagtgccccagtaatggcctctgctccagactgccagccgactgtattgactgtaccactaatttttcctgcacctacgggaagccagtgacttttgattgcgcagttaaaccatctgtaacctgcgtggatcaggacttcaaatctcagaagaattttattatcaacatgacatgtcgcttctgctggcagctgcctgagacagattacgagtgtaccaatagcacttcatgcatgaccgtgtcctgcccaagacagagataccccgccaactgcaccgtgagggatcatgtgcattgccttggtaatcgcaccttccccaagatgctgtactgcaactggacagggggttacaagtggtctactgcgctcgcactgtccatcactttgggaggcttcggagcagaccgtttctatctgggccagtggcgggagggattgggcaaattattcagctttggcggcttggggatctggacgctcattgacgttctgttaattggggtgggatacgtaggaccagccgacggatcactatatatttag

SEQ ID NO: 137977 - DNA, 1251 bp, Artificial Sequence
  Description of Artificial Sequence: Synthetic coding sequence
atggcttcttcgtcgggctcaagcccacggcccgcgcctgatgagaacgagttccctttcgggtgccctcctactgtgtgccaggaccccaaggaaccgcgcgctttatgttgtgccggatgtctgtccgagaatcccaggaatggcgaagatcagatctgccccaagtgccgaggggaagacttgcagagcatcagcccgggttctagacttcggacccaggagaaggcccaccccgaggttgcagaggcaggcatcgggtgcccgtttgccggggttggctgttcatttaaagggagccctcaaagcgtccaggagcacgaagtaacctcacagactagccatttgaacttgctgctgggcttcatgaagcaatggaaagccagactgggctgtggtctagagtccggtccaatggcccttgagcagaatctgagtgatttacagctgcaagcagcggtagaagtggctggtgatctggaggtggactgctaccgggccccttgttcagaatctcaggaagagctcgccctccagcacttcatgaaggaaaaactgcttgctgagctggagggaaagctgagagtcttcgaaaatatcgtcgcagttttgaacaaagaggtggaagccagccacttggctctggccactagcatccaccagtcccaactggacagagaaagaatacttagcttggagcagcgagttgttgagttacagcagaccctagcacagaaggaccaggctctgggcaaactagagcaaagcttgagacttatggaggaggcatcgttcgatggaacattcctctggaaaataacaaatgtgaccagacgttgtcatgagtctgcctgcggcaggacagtaagcctgttcagcccagccttttacacagccaagtacggctataagctgtgcttacgcctttacttgaacggggatggaaccggcaagaggacacacctatcactgttcatagtcattatgcgaggcgagtacgatgccctgctaccatggccctttagaaataaggtgaccttcatgctccttgaccagaataatcgagaacacgctatcgatgcgttccggccagatctgagctcggcgagcttccaacgacctcaatcggagacgaacgtggcgagcggctgtccactctttttccctctctccaagctgcagtctcctaaacatgcttacgttaaagatgacacgatgtttctgaaatgtattgtggagacctccacctag

SEQ ID NO: 137978 - DNA, 1251 bp, Artificial Sequence
  Description of Artificial Sequence: Synthetic coding sequence
atggcaagctcaagtgggtccagcccgcgacctgcccccgatgagaacgagttccctttcggatgtccccctacggtgtgccaggatccgaaagagcctcgcgccctgtgctgcgccggctgtctgtcagagaatcctcgcaatggggaggaccaaatctgtccaaaatgtcgaggcgaggacctgcagagtatctcccccggtagccggctccgcacccaggaaaaggctcacccagaagttgccgaggcgggaattggctgcccgtttgctggcgtcggttgtagctttaaaggctccccacagtctgtccaggaacatgaagtcacctctcaaacaagtcacctgaatttgttgctcggcttcatgaagcagtggaaggctcgcttgggatgtggactggaatctggccccatggccttggagcaaaaccttagcgatcttcagctgcaggcagcggtggaagtggccggagacctcgaggtggactgctaccgtgctccttgcagcgaatctcaagaggaacttgccctgcaacattttatgaaagaaaagttgctggcggaactggagggcaagctgagagtttttgaaaatattgtcgcggtacttaataaggaggtggaggcaagccacctcgccctagcaaccagcatccatcagtctcagctggacagggaaagaatcctgagcttagaacaaagggtcgtggagttgcagcagaccctggctcaaaaagatcaggccttaggcaaactggaacagagtctgcgacttatggaggaggcatctttcgacgggacttttttgtggaaaataacaaacgttacccgtagatgtcatgaatccgcgtgcggccgcactgtctctttgttcagccctgccttttataccgctaagtatggctataaattgtgcctgcggctgtatttgaacggcgatggcacaggaaaacggacacacctgagcctctttattgtgatcatgcgtggggagtacgatgctctgcttccatggccgttcaggaataaagtgacctttatgctgcttgaccagaataacagagaacacgccattgatgcctttcggcctgacctgagtagtgcttcctttcagagaccacaatccgaaactaacgttgcttctggatgtccactgttttttccattatctaaacttcagtctcctaaacacgcatatgtgaaagacgatactatgtttctcaaatgcattgtcgaaacctctacatag

SEQ ID NO: 137979 - DNA, 885 bp, Artificial Sequence
  Description of Artificial Sequence: Synthetic coding sequence
atgaaacagtggaaggccagactcgggtgtggattggagtccggcccaatggctctggaacagaacctttccgaccttcaactacaggccgctgtggaagttgcaggggacctcgaagtggactgctaccgggccccgtgctcagaaagtcaagaggagttagcgctgcagcactttatgaaggaaaagctcctggcagagttagaagggaagctgagggtgtttgagaacattgttgccgtgctaaataaggaggtcgaggcctcacatctggcactcgcaacctcaattcaccagtcgcagctagacagggagagaattctgtctctggaacagcgggttgtggaactccaacagaccctcgcccagaaagatcaagctctgggcaaactcgagcaatccttacgccttatggaggaggcctcgtttgacgggacatttctatggaagatcacgaacgtgacccgacgctgccacgagagtgcgtgcggaaggaccgtgtcactcttttcccccgccttttacaccgctaagtacggctataaactgtgcctgcgcttataccttaacggcgatggcacagggaaacggacgcacctatccctgtttatcgttataatgaggggggagtacgatgctctgctaccctggccatttcgcaataaagtgacatttatgctgctggatcagaacaatagagagcatgctatcgatgccttcaggccggacctcagtagtgcctccttccagcgtccccagtctgagacaaatgtggcgtctggctgcccgttgttctttccactctccaaattgcaatcccccaaacacgcatatgttaaggacgataccatgttccttaagtgcatagtggagacctcaacatag

SEQ ID NO: 137980 - DNA, 2076 bp, Artificial Sequence
  Description of Artificial Sequence: Synthetic coding sequence
atgaacgccgcagtcgtgaggcgcactcaggaggcgctggggaaggtgatacggcgcccccccttaaccgagaaactgctgtctaaacctcccttccggtatcttcacgatatcatcacagaagttataaggatgacaggcttcatgaaaggcctctacactgatgccgaaatgaaaagtgataacgttaaagacaaagatgctaagatctccttcttgcagaaggcgatcgacgtggtcgtgatggtgtccggggagcccctgttagccaaaccagcgcgaatagtggccgggcatgagccagaaaggacgaacgaactgctgcagatcatcgggaagtgctgcctgaataagctgtccagcgacgacgctgtgcgcagagtgcttgcaggcgaaaagggcgaggtgaaaggccgcgcatcacttactagcagaagccaggagttagataacaagaatgttcgtgaagaggagtccagggtgcataagaacacggaagaccgcggcgatgccgagatcaaggaaaggagcacttcacgggatagaaagcagaaggaggagctaaaggaagaccgcaagcctcgggaaaaagataaagataaagaaaaagccaaagaaaacggtggcaataggcaccgggagggcgaaagggagcgggctaaggcccgagccagacctgacaatgaaagacagaaggacagaggaaacagggaacgagaccgagattctgagcgcaaaaaagaaacggaacggaagagcgagggcggcaaagagaaggagcgactgagggaccgggacagggagcgcgaccgggataaaggcaaggacagggatcgacgacgcgtgaaaaacggtgaacactcttgggacctagacagagagaaaaaccgggaacacgacaagcccgaaaagaaatccgccagctccggcgagatgtccaaaaaattgagcgatggaaccttcaaggatagtaaggccgaaacggaaactgagatatctacaagagcatcaaaatcactgaccacaaaaaccagcaagcggaggagtaaaaacagtgtcgaaggccggaaagaggacaatatctccgcaaagtcccttgatagcattgtctccggcatcaacaatgaaccgaatcaggaaacaacaacttcagagattgggactaaggaagctaacatcaactccacgagcatctctgacgataactccgccagcctgaggtgtgagaacatccagccaaatccaactgagaagcaaaaaggtgatagtacgagtgacgccgagggcgatgccggccctgcaggacaggataagagcgaagtgccagagactcccgaaatccccaacgagttgtcttcaaacattagacgcattccacgacctggttctgcacgccccgcgccaccccgtgtgaagcggcaggactcaatggaggcactccagatggatcggtcaggtagtggaaagaccgtatccaatgtcattactgaaagtcataattctgataatgaagaggatgatcagtttgtcgtggaagccgcgcctcagctctctgaaatgagcgagatagagatggtgaccgcagtcgagctggaagaggaggagaaacacggaggcctagtgaaaaaaattcttgagacaaaaaaggattacgagaaactgcagcagagtccaaagcctggagagaaagagcgtagcctgtttgaaagcgcctggaaaaaggaaaaggacattgtgagcaaggaaatcgagaagctacgaacgagcatccagaccctatgcaagagcgccctccctctgggaaagatcatggattacatccaggaagatgttgacgctatgcagaatgagctgcagatgtggcattctgagaacaggcagcatgctgaagcactgcagcaggagcaacgcatcaccgactgtgctgtcgaacctcttaaggccgaattggcggagttagagcagctgataaaggaccagcaagacaagatctgtgcagttaaggccaacattttaaaaaatgaagagaagattcagaagatggtttacagtattaacctgacaagccgacggtag

SEQ ID NO: 137981 - DNA, 1878 bp, Artificial Sequence
  Description of Artificial Sequence: Synthetic coding sequence
atgaatgccgccgtggtgcgtcgtacacaagaggccttaggcaaagtaatcaggcgacctcccctgactgaaaagttactgtccaagcctccattccggtacctccacgacataattaccgaagtaattcggatgactggattcatgaaggggctgtataccgatgctgagatgaagtccgataatgtaaaggacaaggatgcaaaaatctctttcttgcagaaagctatcgacgttgtggtgatggtgtccggggagcctctccttgcaaaacccgcaagaatcgtggctggacacgagcccgagagaaccaacgaattgttgcagatcattggcaagtgctgcctgaataagctctctagcgacgatgcagttcgccgtgtgctggctggggaaaagggagaggtgaagggaagggcctcacttaccagccggtctcaagagctggataacaaaaacgttagggaagaagagagccgggtgcacaagaacacagaggatcgcggggacgccgagattaaggagagatctactagtagagatcgcaaacagaaagaggagctcaaggaggacagaaaaccgcgggaaaaggacaaagacaaggagaaggcgaaggagaatggtggtaaccgacatagagagggcgaacgagaacgcgcaaaggcacgggcacgcccagacaatgagagacagaaagataggggcaatcgtgaacgggatcgcgattctgaacgcaagaaggaaaccgaacgcaaatctgaggggggtaaggagaaggaacggctccgcgatcgagaccgagagagagacagggataagggaaaggaccgcgacagaagaagggtgaagaatggagaacatagttgggatctggatcgcgagaaaaatagagagcacgacaagcccgaaaagaagagcgcttccagtggagagatgtccaagaagctcagcgatgggaccttcaaggatagcaaggcggagactgagacggaaataagcactagagcctccaagagcctaaccaccaagactagcaagcgtcggtccaagaattctgtggagggagacagcacctccgacgctgagggggacgccggacccgccgggcaagacaagtccgaggtcccagagacccccgaaattcctaacgagctcagctctaacatccgccgcataccccgacctggctcagcccggccagctcctcctagagtaaaaagacaggattcaatggaagcattacaaatggatcggagcggtagtggcaagactgttagcaacgtcattaccgagtcacacaattccgataacgaggaagatgatcagttcgttgtggaagcggccccccagctctctgagatgtccgagatcgaaatggtcactgccgttgagctggaggaggaggaaaagcacggcgggctcgtgaagaaaattctggaaaccaagaaggactacgaaaaacttcagcagtcgccaaagcctggggaaaaggaacgcagtctgttcgagtctgcctggaaaaaggagaaagatatcgtttccaaagaaattgaaaagttacggacctccatccagacattatgtaagagtgccttgccactgggaaagatcatggactatattcaggaggacgtggatgcaatgcaaaatgagctgcagatgtggcattctgaaaataggcagcatgcagaggctctccagcaggaacaacggattaccgattgcgccgtggaacccctcaaggcagagctggctgagcttgagcagctgattaaagaccaacaggataaaatctgtgctgtgaaagcaaatattctgaaaaatgaggagaaaattcagaagatggtgtattcaatcaatctcacctcacgcagatag

SEQ ID NO: 137982 - DNA, 2076 bp, Artificial Sequence
  Description of Artificial Sequence: Synthetic coding sequence
atgaacgccgccgtggtgagacgaacacaggaggccctgggcaaggttattcgcaggcctcccctgacggaaaaattgctgagcaaaccccccttccggtatttacacgatatcattacagaagtaataaggatgactggcttcatgaagggcctgtacactgatgctgagatgaagagcgacaatgttaaagataaagacgctaagatttcatttcttcagaaagccattgacgtagtggtgatggtgtctggtgagcccttgctagctaaacccgcccgtattgtagcgggacatgaaccagagagaaccaacgagctgctgcagatcataggcaaatgctgcctaaataaactttcttccgatgacgcggttcgaagggtcctggccggcgaaaaaggcgaagtgaagggccgggcttctctgacctctaggtcacaggagctggacaacaaaaatgtgcgggaggaagagtccagagtgcataaaaataccgaagataggggagatgccgagattaaagaacgctcgacctcccgggaccggaagcagaaggaggaattaaaggaagatcgtaagcccagggaaaaagataaggataaggagaaagcaaaagaaaatgggggaaaccgtcatagggaaggcgagcgagaacgagccaaggcccgcgctcgaccagacaacgagcgacaaaaggatcgcgggaatagggagagggaccgcgactcggaacgcaagaaggagaccgagagaaaatctgaaggggggaaggagaaagagaggctgcgcgatagagatcgagagagggacagagataaaggcaaggatagggatcgccgcagggtgaagaatggagagcactcctgggacttggaccgagagaagaatagagaacatgataagccggagaaaaaatccgcgtcctccggggagatgtccaagaagctcagtgacgggaccttcaaggattccaaggccgagacggaaacagaaatttccacacgggctagcaagagcttgaccaccaaaacatccaaaaggcgctctaagaattctgtggagggccgtaaagaggacaatatctccgctaaaagtttggatagtattgtgagcgggatcaataatgaacccaaccaggaaaccacaactagcgagatcggcaccaaggaagcaaatatcaactcaacctcaatttctgacgacaactccgcttcccttcggtgtgagaacatccaacccaatccaaccgagaagcaaaagggaaaaaacgggtcagagcgagaaggcgatgctgggccagcagggcaagacaagtcagaggtgccagagacaccagagatacccaatgagctgtccagcaacattcgacggatacctcgccctggatccgctcgcccggccccgccacgcgttaaacgccaggacagcatggaggcactgcagatggataggtccggatccgggaagaccgtctccaacgtcatcaccgagagccacaactccgacaatgaggaagatgaccagttcgtagtagaggcagccccccaactgtcagaaatgtctgaaattgagatggtgaccgcagtggaactggaagaggaggaaaagcacggtggcttggtcaagaaaatcctcgaaacgaagaaagattacgagaaattacagcagagccccaagccaggagaaaaggagaggagcctcttcgagagtgcctggaagaaggaaaaggacatcgtgtcgaaggaaattgagaagcttaggaccagtatccagaccctctgcaagtcggcacttcctcttggaaagattatggattacatccaggaagatgtcgatgccatgcagaatgagctgcaaatgtggcactctgaaaaccgtcagcacgcagaggccttacagcaggaacaacggatcactgattgcgccgtggaaccactgaaagccgagctcgctgagctcgaacagcttataaaagatcagcaggataaaatctgtgccgtgaaggccaacattttgaagaacgaggaaaagatccagaagatggtctattctattaatctgacctccaggcggtag

SEQ ID NO: 137983 - DNA, 1878 bp, Artificial Sequence
  Description of Artificial Sequence: Synthetic coding sequence
atgaatgctgctgtggttcgacggactcaggaagcactgggaaaagtgattcgtcgccccccgttgaccgagaagctgctctccaaacccccgttccggtacttgcacgacatcattactgaagtgatcaggatgactggattcatgaaaggactgtacaccgacgcggagatgaaatctgataacgtcaaggacaaggacgccaagataagttttctgcagaaggcaattgatgtcgtggttatggtgtcaggcgagcctctgttggctaagcctgccagaatagtcgccggccatgagcccgagcggacaaatgaactgctgcagattatcggcaaatgttgtctgaataaattgtcatcagacgacgcagtgagaagagtgctcgcaggagaaaagggagaagtgaaggggagagccagcttgacctccaggtcccaagagctggataataagaacgtaagggaagaagagtcgagagtacacaagaacactgaggaccgcggagatgcagagataaaggagcgatctacttctcgcgatcgcaaacaaaaggaagagctcaaagaggaccggaaaccccgggagaaggacaaggataaagaaaaagctaaagagaatgggggcaaccgacaccgtgaaggagagagggagcgagccaaagctagggccaggccagacaacgagagacagaaagatagaggtaatcgcgaacgggatagggattccgaacggaagaaagagactgagagaaaatccgagggcggaaaagagaaagaacgcttgcgggatagagaccgggaaagggacagagacaaagggaaggaccgtgatagaaggcgagtgaaaaatggggagcacagctgggacctggaccgagaaaagaatagagagcacgataagcccgaaaagaaatctgctagttctggtgagatgtcaaagaaattgagcgacggaaccttcaaggattcaaaagccgaaaccgaaacagaaatatccacacgggcctcaaaaagcttgactaccaagacgagcaagcgtcgttcaaaaaactccgttgaagggaccgcaaagctgatcctagagggtgacgctggacctgccggacaggacaagagcgaggtgccagaaactcccgaaatcccaaacgaactcagtagcaatatcaggaggataccccggccaggatccgctcgaccagccccaccccgagtaaaacggcaagattccatggaggcgttacagatggatcggtccggtagtgggaagacagtttcgaatgtcatcactgaaagtcataattccgataacgaagaagacgaccagttcgttgtggaggccgcgccccaactcagcgagatgtcggaaattgagatggtgaccgccgtcgagctcgaggaagaagagaagcacggggggctggtgaaaaagattctggagacaaagaaagactatgaaaaacttcagcagagcccgaaaccgggggaaaaagaacgctcgctgttcgaatctgcctggaagaaagaaaaggatatcgtcagcaaagagatcgagaagcttcgaacaagcatacagacgctgtgtaaatccgctctgcccctgggaaagattatggattacattcaggaagacgtagatgctatgcagaatgagctacagatgtggcactccgagaacagacagcacgcggaggctctgcagcaagagcagaggatcactgactgtgcagtagaaccattgaaggcggaactggccgagctggaacagctgattaaggatcagcaagataagatttgtgcggttaaggcgaatattctgaaaaacgaggagaagatccagaagatggtgtattcaataaatctgacgtcccggaggtag

SEQ ID NO: 137984 - DNA, 1674 bp, Artificial Sequence
  Description of Artificial Sequence: Synthetic coding sequence
atggcctattcagaggaacataaggggatgccttgtggatttatcagacagaacagcgggaacagtatctcgctcgatttcgaaccctcaattgaataccagtttgtagagcgcctggaggagcggtataagtgtgcgttctgccacagtgtacttcataatcctcaccagactgggtgcggacacagattttgtcagcattgcatcttatcactcagggaattgaacacggttccaatttgccctgtagacaaggaggttattaagtctcaagaggtctttaaagataactgctgtaagagagaggttttaaatttgtacgtgtattgttccaatgcccccggttgtaacgccaaggttattttggggcggtaccaggaccatcttcagcagtgtctattccagccggtgcagtgttccaacgaaaagtgccgggagcctgttctacgtaaggatctgaaggaacacctctctgctagctgccagtttaggaaagagaaatgcttatactgcaagaaagacgtcgtcgtgatcaacctccagaaccatgaggaaaacttgtgtcccgagtatcctgttttttgccctaacaactgtgctaaaattatactcaaaaccgaagtggacgaacatctggctgtgtgccccgaagctgaacaggactgcccctttaagcattacggatgcgccgtgaccgataaaaggaggaaccttcagcagcacgagcacagtgcactcagagagcatatgcggctggtcttagagaaaaacgtccagttggaggaacagattagcgacctccacaagagccttgagcagaaggagagcaagattcagcagctggccgagaccatcaaaaaactggaaaaagaatttaagcagttcgcacagttgttcggcaaaaacggatcgtttctgccaaatattcaggtcttcgcctcgcatatcgataaatccgcctggctcgaagcccaggtgcaccagctgttgcagatggtaaatcagcagcaaaacaagttcgacctgcggccactcatggaagccgtagacactgtcaagcagaagataaccctcctggaaaataatgatcagcgcctagccgtcctggaggaggaaacaaataagcatgatacccatatcaatatccacaaggcgcagctgtctaagaatgaggagcgctttaaactgctggaggggacttgttataatggcaaactgatctggaaggttaccgattacaagatgaaaaagagagaggccgtggacggccacaccgtatcaatctttagccagagtttttatacctctcgatgtgggtaccgcttatgtgccagggcctacctcaacggggacgggagtgggcggggatcacatttatctttgtattttgtagtgatgaggggagagttcgactcccttcttcagtggccttttcggcagcgtgtgaccctcatgctgctggatcaaagtggcaagaagaatattatggaaacctttaagcctgatcccaacagcagctcattcaagaggcctgatggagagatgaacattgcgtccgggtgccctagatttgtcgcacactccgtgcttgagaatgcaaaaaatgcctatatcaaggatgacactctgttcctcaaagttgcagtagacttgacagatctggaggatctatag

SEQ ID NO: 137985 - DNA, 1674 bp, Artificial Sequence
  Description of Artificial Sequence: Synthetic coding sequence
atggcttatagtgaagagcacaaagggatgccttgtggcttcattcgccaaaattctggtaattctatcagtctggatttcgaaccatccattgagtatcagttcgtagagagactcgaggagagatacaagtgtgcattttgccactctgtgctgcacaatccacaccagactggatgcggacaccgtttttgtcagcattgtattctgtcgttgcgggagctcaatacggtgcccatctgccctgttgacaaagaggtcattaaaagtcaggaggtcttcaaggataactgctgtaagcgtgaggtgctgaacctgtacgtgtactgcagcaacgctccaggctgcaacgcaaaggttattcttggcaggtatcaggatcaccttcagcagtgcctgttccagcctgttcagtgctccaacgagaagtgccgcgagcctgtgcttaggaaggacctaaaagagcacctgagcgctagttgccagttcagaaaggagaagtgtctttactgcaagaaagacgtcgtggtcatcaacctccagaaccacgaagaaaacctttgtcctgagtacccagttttctgtccaaataattgcgccaaaatcatacttaaaaccgaagttgatgaacatctggctgtctgtcccgaagctgagcaagactgtccattcaagcactacggatgcgccgttaccgacaaacgacggaatctgcagcagcacgagcactcagctttgcgggaacacatgagactggtgttggaaaagaatgtccagttggaagaacagatctctgatctgcataaatcattggagcaaaaagagtccaagatccagcaactggcagaaaccatcaaaaagctggaaaaggaattcaaacaattcgcccaactcttcggaaagaacggctcgttcctgcctaacatacaagtgttcgcaagtcacatagataagtcggcttggcttgaagcacaggtgcaccagctgttgcaaatggtcaatcagcaacagaataagtttgatctgagacccctcatggaggctgtcgacacggtgaagcagaagattacgctcctagagaacaatgaccagcgcctagcagttctggaagaagaaaccaacaaacacgatacacacatcaacattcacaaagcacagctctccaagaatgaggagcgattcaaactcctcgagggcacctgttataacggaaaactgatatggaaggtgaccgactacaagatgaagaagcgtgaggctgtggatggacacacagtgagcatcttctcccagagcttttacacatcccgatgtgggtaccgactttgcgcccgcgcctatctgaatggtgatggttcaggccggggtagtcacctctccctctacttcgtggtgatgcgcggcgagttcgattccctgttacagtggccctttcggcagcgtgtcactctcatgttgctggaccagtcaggtaagaagaatatcatggagacatttaagccagacccgaattcctctagcttcaaaagaccagacggcgagatgaacatcgctagtggttgtccgcgttttgtggcacatagtgtgttggaaaacgctaagaacgcctacattaaagacgacaccctgttcttaaaagttgccgtcgatttgactgatctggaagacctctag

SEQ ID NO: 137986 - DNA, 1674 bp, Artificial Sequence
  Description of Artificial Sequence: Synthetic coding sequence
atggcttatagcgaagaacataagggcatgccatgcgggttcatccgacagaactctggtaactcaatcagcttggatttcgaaccaagtattgagtatcagtttgtggagcggctcgaggagcgctacaagtgtgccttttgccattcagtccttcacaacccgcaccagaccggctgcggccacagattctgccagcactgtattcttagcctccgcgagctcaacaccgtgcccatctgtcctgtggacaaagaagtgataaaaagccaggaggtgttcaaagataattgctgtaaaagagaggtgctaaatctgtacgtctattgctcaaacgcccccggctgcaatgccaaggtcatcctagggaggtaccaggaccatttgcagcagtgtctttttcagcctgtgcagtgcagcaacgaaaaatgccgggaaccggtgctgcgaaaggacctcaaagaacatttgtctgcgagttgtcagttccgcaaagaaaagtgcctgtattgcaaaaaggacgtcgttgtgattaatctgcagaatcacgaggaaaatctgtgtccagaataccctgtgttttgtcccaataactgcgctaagatcatattaaaaactgaggttgatgaacacttggctgtgtgtccagaggccgagcaagactgtcctttcaagcattacgggtgtgcagtgaccgataaacgcaggaacctgcagcagcacgagcactccgccctgagggagcacatgagactagtgctggagaagaatgtgcagctagaggaacagatctcggatttgcacaaatctctcgagcagaaggaatcgaagattcagcagctcgccgaaactattaaaaagctcgagaaggaattcaagcagtttgcccagctgtttgggaagaacggatcattcctgcccaatatccaagtcttcgcatcacacatcgacaaatccgcctggctggaagcacaggttcatcagctgctgcagatggtgaatcaacagcagaataaattcgacctgcgcccactgatggaagccgtcgacaccgtcaagcaaaagatcaccctccttgaaaacaatgaccagaggttagcagtacttgaagaagagactaacaaacatgacacccatatcaacattcataaggcgcagctaagtaaaaacgaggaacggtttaagctgctcgaaggaacctgctataatggtaagctgatttggaaagtcacggattataagatgaagaaacgtgaggctgtggatggtcatacagtgtcaattttttcccagagcttctacacttcacggtgcggttacaggctgtgcgctcgagcttatttgaacggcgacggatcaggacggggatcccatttgtccctgtactttgtcgtgatgaggggggagttcgattcactgcttcagtggcccttccggcagagagtcactctcatgttattggatcagagtggtaaaaagaacatcatggagacctttaagccggaccctaactcctcgagcttcaaacgtcccgatggtgagatgaatatcgcctccggctgtccacgtttcgtggcccacagcgttctagagaatgcgaaaaacgcctatatcaaagacgacactctctttctcaaggtcgccgttgatttgaccgatcttgaagacttatag

SEQ ID NO: 137987 - DNA, 1356 bp, Artificial Sequence
  Description of Artificial Sequence: Synthetic coding sequence
atggcctatagcgaagagcacaagggcatgccctgcgggtttatccggcagaattcaggcaactcaatcagtctggatttcgaaccttccattgagtatcaatttgtggagcgcctggaggagcgatacaagtgtgccttttgccacagcgtgctgcacaatcctcatcagacagggtgtggtcacagattttgccagcattgtatactctcactacgggagctgaacactgtccctatttgtcccgtggacaaggaggtgatcaagtcacaggaggtcttcaaagataattgctgcaaacgagaggtgctcaacctttatgtctactgttcaaacgctcctgggtgtaacgcaaaggtcatacttggaagataccaagataaaagacgaaacctgcagcagcacgagcacagtgctttgagggaacacatgaggctcgtcctcgagaaaaatgttcaactggaggaacagatctccgacctgcacaagtcacttgaacagaaggaatccaaaatccagcagttagcagagacgatcaagaagctggaaaaagagttcaagcagttcgctcagttgtttggcaagaacggtagctttttaccaaacattcaggtgttcgctagtcatatagacaagtccgcgtggctcgaggcacaggtccaccagctgctgcagatggtgaaccagcagcagaacaagtttgacttaagaccattgatggaggccgtggatactgtgaagcagaagataaccctgctggaaaataacgatcaaaggcttgctgtgctcgaggaagagacaaacaaacacgatacacacattaatattcataaggctcaactctccaagaatgaagaacggttcaaactcctggaaggtacatgctataacggaaaattgatatggaaagtgactgactacaagatgaagaaaagggaggccgttgatgggcacacagtctcaattttttctcaaagtttctatacttctagatgtgggtatcgcttgtgcgctcgcgcttacctgaatggggatggctcagggaggggttcccatctatccttgtacttcgtggtgatgagaggcgaattcgactccttgctgcaatggcccttccgccagagggtgacgctgatgctgctggaccagtccggcaaaaagaatattatggaaaccttcaaaccagatccaaattccagttcatttaaacgtccggacggcgaaatgaatattgcctctggttgtcctcgcttcgtggctcattctgtgctggagaacgcgaagaacgcctatataaaggatgatacactctttttgaaggtcgctgtcgacctgaccgacctcgaggacctatag

SEQ ID NO: 137988 - DNA, 1569 bp, Artificial Sequence
  Description of Artificial Sequence: Synthetic coding sequence
atgtccttgctgaactgtgaaaatagctgtggctccagccagtccgaatctgactgctgcgtcgcgatggcgagttcttgcagcgcagtgaccaaggatgactccgtcggagggactgcctccacaggtaacctgtcttcttcatttatggaagagatccagggctacgatgtcgaattcgatccccctctggagagcaaatacgagtgccctatctgcctgatggccctccgcgaagctgtgcagacaccttgcggacaccggttttgcaaggcatgtattatcaaatctatcagggacgctgggcacaaatgtcctgtggataacgagatactgctggaaaaccagctatttccagacaacttcgccaaaagggagatcttatctttgatggtcaagtgtcccaacgagggctgtctgcacaagatggagctgagacatctggaagatcatcaggcacactgtgaattcgcccttatggactgcccccagtgtcagaggccattccaaaagttccacattaatatccacattcttaaagactgccccaggagacaggtttcctgtgacaattgcgccgcaagcatggccttcgaggacaaagaaattcatgaccagaattgccctctggcaaacgtcatatgcgaatattgtaacaccattctgatccgtgagcagatgccaaatcattatgacctggattgtccaacggcccccattccttgtaccttcagtactttcggctgtcatgagaaaatgcagagaaaccacctagcacggcacttacaagaaaatacacaatcccacatgagaatgttagcccaggcggtgcactcccttagcgtgatacctgattcgggatatataagcgaggtgcggaatttccaggagaccattcatcaacttgaagggaggcttgtccggcaggatcaccagatccgtgagcttaccgccaagatggaaactcagtctatgtacgtctccgagctcaagagaaccatccgcactctggaggataaagtggctgaaattgaggcccagcagtgcaacggaatctacatctggaaaatcggcaactttggcatgcatctcaagtgtcaggaagaggaaaagcctgtagtgattcatagtccggggttctatacaggcaaacctggatataaactctgcatgcggctgcatctgcagctgcctaccgcacagcgctgcgcaaactatatttctctgtttgtgcataccatgcaaggagaatacgatagtcatctcccttggcctttccaggggaccattagactgacgattctggaccaatcagaggcccccgtgcgacagaatcacgaggaaatcatggacgcgaaaccggaactgctcgcgtttcagcgtcctacaattcccaggaaccccaaaggctttgggtatgtcactttcatgcacttggaggcactcaggcagcgcacattcattaaggacgatacactgctggtgcgatgcgaagttagtacgcgtttcgacatgggtagcctgagaagggagggcttccagccacgttctacagatgccggcgtgtag

SEQ ID NO: 137989 - DNA, 1569 bp, Artificial Sequence
  Description of Artificial Sequence: Synthetic coding sequence
atgagcttgttaaattgcgagaatagctgcgggagcagccaatctgagagtgattgctgcgtggctatggcctcaagctgttccgctgttacaaaagacgacagtgtcggcgggaccgctagcacagggaatctcagctccagtttcatggaggaaatccagggatatgatgtggagtttgaccccccacttgagtctaaatacgaatgtcccatttgtctcatggctctgcgggaagcagtgcagactccatgcggacacaggttctgtaaagcttgtattatcaaatcaataagggatgcgggtcataagtgtccagtggataatgagatcctgctagaaaatcaattattcccagacaactttgctaagagggagattctgtccctcatggtgaagtgcccaaacgagggctgtctccataaaatggagctccggcatctggaagaccatcaggcgcactgtgaattcgctctcatggactgcccacaatgtcagagaccattccagaagttccacatcaatatacacatcctgaaggattgcccacgcagacaggtgtcctgtgataactgtgccgcctcaatggctttcgaagacaaggagatccacgatcaaaactgtcctctggccaatgtgatctgcgagtattgtaacactattttaatccgagagcagatgccaaatcactatgacttggactgtccaacagccccgatcccatgtactttttcgacattcggttgccacgagaagatgcaacggaatcacctcgcccggcatctgcaggagaacacacagagccatatgcgcatgctggcgcaggccgtgcacagcctttccgtcatcccagattccggctacatctccgaggttaggaactttcaggagaccatccaccagctggagggtcgtctagtccgacaggatcaccaaatacgggagcttaccgccaaaatggaaacccaaagcatgtatgtctcagagttaaaacgaacaatacgtactttagaggataaggtggccgagatagaggcacaacagtgtaatggcatatacatttggaagattggcaactttgggatgcacctcaagtgtcaggaagaagaaaaacccgtggtcattcatagcccaggtttctacactgggaagccaggatataagctctgtatgcgactgcacctgcagcttcctacagcccagcggtgcgccaattacatctctctgtttgtacataccatgcagggagagtatgatagccatctaccctggccctttcagggaacgattagacttaccatcctggaccagagcgaggctcccgtgagacaaaatcatgaggagattatggacgctaaaccagagcttctggcatttcagcgaccaacaatcccaaggaatccgaaagggttcgggtacgtgacttttatgcacctcgaggccctgcgacagcggacattcatcaaggatgataccctgttagtgagatgtgaagtgagtactcggttcgatatggggtcacttcgaagagaggggttccagccacggtctaccgatgcgggtgtgtag

SEQ ID NO: 137990 - DNA, 2013 bp, Artificial Sequence
  Description of Artificial Sequence: Synthetic coding sequence
atgtccagcggtaaatccgccaggtacaataggttctctggagggccttcaaacctgccaaccccggatgtgacaactggtacaagaatggagacaaccttcggccccgccttttcagcagtcacaacgattacaaaggctgacggcactagcacatacaagcagcattgtcgcaccccctcctcatccagcacgctggcttattccccacgagatgaggaagactctatgcctccaattagcacaccacggcgctccgactctgccatctcggttcgatctttgcacagcgagtcttcaatgtcactcagaagtaccttttcactgcccgaagaggaggaggaaccagagcccctggtgttcgcagaacagccgagcgtgaagttatgctgccagctttgttgtagtgtatttaaggaccctgtcattactacatgtgggcacacattctgccgacgttgcgcactcaagtcagaaaagtgtcctgtagacaatgtgaagcttactgttgtggtcaacaacatagcagtagctgagcaaattggggagctctttattcactgtaggcacgggtgtcgcgtggccggttctggcaaacccccgattttcgaagtcgaccccagagggtgtcctttcacaataaaattgagtgcgagaaaggaccacgagggttcttgtgactacaggcccgtgagatgcccgaacaacccgtcttgccccccattactgcgtatgaacctggaagcccatctaaaggaatgcgaacatattaagtgcccgcacagcaagtacggatgcacatttattgggaaccaggacacttacgagacccacctggagacgtgccgctttgagggcctgaaagagtttctgcagcagaccgatgatcgctttcatgagatgcacgtcgcactggcccagaaggatcaggagatcgcattcttacgctcaatgctcggcaagctctccgagaagatcgaccagctcgaaaagagccttgaactgaagtttgacgtgctagatgagaatcagagcaaactgagtgaggaccttatggagtttcggagagacgcgagcatgctaaatgacgagctgagtcacatcaacgccaggttaaacatggggatcttaggctcatacgacccacaacagatatttaagtgcaaggggacctttgttggccatcagggacccgtctggtgcctgtgtgtttattcaatgggcgatttgctcttcagcgggtcatccgacaagaccattaaagtgtgggacacctgcacaacctataaatgtcagaagacgctcgaaggccatgacggcatagtacttgcgctctgcatccagggctgtaagctttatagcggctcggcagactgcacaataatagtctgggacattcagaatcttcagaaagtgaacaccattcgcgctcacgataaccctgtctgtacccttgtttcatcccacaatgttctgtttagcgggtccttaaaggcaatcaaggtctgggacatcgttggcacggaattaaaactcaaaaaagagctcactgggctcaatcactgggtccgggccctggtggctgcacagagttatttatactccgggtcctaccaaacaatcaaaatctgggacattcggactcttgattgcatccacgtgttgcagacgtccggagggagcgtctattccatagcggtgaccaaccatcacatcgtctgcggcacttacgagaacctcattcacgtgtgggatatcgagtccaaggaacaggtgcggaccctcacaggccacgtggggacggtgtatgccttagccgttattagcacccctgaccagaccaaagtgttttctgcctcttatgatcgcagcctgcgggtgtggagcatggataatatgatctgcacccaaactctgctcagacaccaaggttctgtcacggcattggcagtgagcagggggcgcctcttttcaggagctgtggactccacagtcaaagtgtggacatgttag

SEQ ID NO: 137991 - DNA, 2115 bp, Artificial Sequence
  Description of Artificial Sequence: Synthetic coding sequence
atggctagggaactccgggccctcctgttgtgggggcgccgattgcggcctttgcttcgtgccccggcactggccgcagttcccggtggcaagcccatcctctgcccacgtagaacaaccgctcagctcggtccccgccgcaatccagcttggagcctccaggccggacgcttattctcaacgcagactgcagaagataaggaggagccgcttcatagtatcatttctagcacagaaagcgtgcagggtagcacctcaaaacacgagtttcaagctgaaactaagaagctactggacatagtcgcccgcagcctgtactccgaaaaggaggtcttcatccgggaactgattagcaatgcctcggacgctttggagaagttgcgccataaactggtcagtgacgggcaggctctgcccgaaatggaaatccacttgcagacgaacgctgaaaaagggaccatcacaatccaggatacaggaattggcatgacccaagaggaattagtgagcaacctgggaactatcgcccgtagcggttctaaggccttcctcgacgctctgcaaaatcaggccgaggcatctagcaaaattatcggccagttcggcgttggtttttactctgcattcatggtggccgaccgggttgaggtgtactccaggagcgctgcgccaggctcgctggggtatcaatggctgtcagacggatccggggtttttgagatcgctgaagcatcaggggtgaggacaggaaccaagataattatccatttgaaatcagactgcaaggaattcagttctgaagctagagtgagagacgtcgtcacaaaatatagcaatttcgtgagcttccctctttatctgaacgggcgcagaatgaatactttgcaagctatctggatgatggaccctaaggatgttcgcgagtggcagcacgaggagttttatcggtatgtcgcccaagctcacgataagcccagatacaccctgcactataaaactgatgcaccactgaacattagaagtattttttacgtgcctgacatgaaaccatcaatgttcgatgtctcaagggagctcggctcatctgtcgcactgtacagtagaaaggttctcattcaaacaaaagctacagacattcttcctaaatggctcaggttcattagaggagtggtcgactctgaagacatccctcttaacctgtcccgggaactgctgcaggaatctgccttgatcagaaagcttagggatgtacttcaacagcggttgatcaagtttttcattgaccagagtaaaaaagacgcggagaagtatgctaagttttttgaagactacggcctgttcatgagggagggaatagtcactgccaccgaacaagaggtgaaggaggatatcgccaaattgttaagatacgagagctctgccctccccagcggacagctgactagtctctcagagtacgcctccaggatgcgggcgggtacacggaatatctactacttgtgtgctcctaacaggcatctggcagaacactcgccatattacgaagcgatgaagaaaaaagacaccgaggtgctgttctgctttgagcagttcgatgagctgactttattgcatctgagagagtttgataaaaaaaaattgattagcgtagagaccgacatcgttgttgatcactacaaggaggaaaagttcgaggaccgttcccccgcagctgagtgcctgagcgaaaaagagacggaggaacttatggcgtggatgagaaatgtacttggcagtcgcgttaccaatgtcaaagtcaccctgcgcctggatacgcaccccgccatggttactgtgctggagatgggagcggcacgccacttcctacgcatgcagcagctcgcaaagacacaggaggagagagcccagttgctgcaacccactctggaaatcaaccctcgccacgcactgattaagaaactcaaccaacttagggcttctgaaccaggacttgcgcagttacttgttgatcagatttacgagaacgcgatgatcgcggcaggcctggtggatgaccctcgagcgatggtgggccgtctgaacgaactcctcgtgaaggcactggaaagacactag

SEQ ID NO: 137992 - DNA, 1956 bp, Artificial Sequence
  Description of Artificial Sequence: Synthetic coding sequence
atggccagggagctccgcgccctacttctgtggggacgacgcctgcgccctttgctgagagcgccagcccttgccgcagtgccaggcggctctacaagtaagcacgagtttcaggcggaaacaaagaagctgctcgacatcgttgcgcggtccttgtactcagaaaaggaagtgttcataagagagctcatctctaacgcaagcgacgccctggaaaaactgcgacataagttggtgagcgacggtcaggccttaccagaaatggaaattcacttacagacaaatgcagagaaaggcactatcaccatccaggatactggtatcggcatgacccaggaggagctggtaagtaacctgggaaccattgcacggtctggctctaaggctttcttggacgctttacagaatcaggctgaggcaagttcaaagattattggccaatttggagtagggttttacagcgctttcatggtcgccgaccgagtcgaggtttacagccggtctgcggcccccgggtctctgggataccagtggcttagtgacggatctggtgtttttgaaatagcagaggcatctggggtgagaaccggaaccaagatcattatacaccttaaaagtgactgtaaggaattcagcagcgaggctagagtgcgcgacgttgtgaccaagtactccaattttgtctcctttccgctgtatctgaatggtcgccgcatgaacacactgcaggcaatctggatgatggacccaaaggacgtgcgggagtggcaacacgaggaattttaccggtatgttgcacaggcccacgacaaacctcggtacacactacactacaaaacagatgctccactgaatatccggagtatcttctacgtccccgacatgaaaccctcaatgttcgacgttagccgggaacttggatcaagcgtcgccctgtattctaggaaagtgcttatacagaccaaggctacagacatcctgcccaaatggctcaggtttatccggggcgttgtggatagcgaggacataccactcaacctctctagggaactgctccaggagtccgccttgattagaaaacttagggacgtgctgcaacagaggctcattaaattctttatcgatcagtcgaagaaggacgccgagaagtatgccaaattcttcgaggactatggactgttcatgagggagggcatcgttactgctacagagcaggaggtcaaagaggacatcgccaagctcttgagatacgagtcctctgctctgccgtccggccagctcacaagtttatcagagtacgcatctcgcatgagggcaggcaccaggaacatctattatctttgtgcccctaacaggcatctcgcagagcactccccttactacgaagcaatgaagaaaaaagacacggaggttctgttctgcttcgaacagtttgacgagttaactctgttgcatttgagagagtttgacaaaaaaaaactaatatctgtggaaacagatatagtcgtggaccactacaaagaagagaaattcgaggatcggtcaccagcagcagaatgtttgagcgaaaaggagacagaggaactgatggcctggatgcgcaacgttctggggagccgcgtcaccaatgtaaaggtcaccctgagactggacacacatcctgctatggtcaccgtgctcgagatgggggccgcccgacacttccttcgaatgcagcagctggcaaagacccaggaagaacgcgcgcagttattacaaccaactctggaaattaacccacgccatgcccttatcaagaagctaaaccaactgagggcaagcgagccgggcctggctcagttactggttgaccagatatacgagaacgccatgattgccgcgggtttggttgatgatcctcgcgccatggtgggacgtctgaatgaactcctggtgaaagctctcgagcggcattag

SEQ ID NO: 137993 - DNA, 1911 bp, Artificial Sequence
  Description of Artificial Sequence: Synthetic coding sequence
atggagggacgaggcccctaccgaatctacgacccaggaggaagtgttccctctggagaggcgtcagccgcattcgagcgattggtgaaagaaaacagtaggctgaaagagaagatgcagggaatcaaaatgcttggggagttgctggaggagtctcagatggaggccacacggctcagacagaaggccgaagagctggtcaaagataacgaattgctcccgcccccctctccatccctggggagctttgatcccctcgccgagcttactgggaaggactctaatgtgactgcctcacccaccgcccccgcttgccccagtgataagcccgccccagtccagaagccaccctcctccggcactagctccgagtttgaggtggtgactcctgaggaacagaactccccagaatcctcttcccacgcaaacgctatggcactcggaccactgcctagagaagacggcaaccttatgctgcacctccagagactggaaaccaccttgagcgtgtgcgccgaagagccagaccacggccagctgttcacccacctgggtcgtatggcactggaatttaatagattggcttctaaagtacacaaaaatgaacaaaggacttccatactgcagacactctgtgagcaactgaggaaggagaatgaagctttaaaggccaagctggataaggggttagaacagagggatcaggccgcggagcggctccgagaagagaacctggagttaaaaaagctattaatgtctaatgggaataaggagggtgccagtggccgccctggatccccaaagatggaaggaacaggtaagaaggccgttgcaggacaacagcaagccagcgtgacagcaggcaaagtgcccgaagtcgtggcacttggtgccgcggagaaaaaagtcaaaatgttagagcagcagcgttcagaactccttgaggttaacaaacaatgggatcagcacttccgcagcatgaagcagcagtatgaacagaagatcaccgagctccggcagaaactggcagatcttcagaagcaggtgacagacttagaggccgaacgagagcagaagcagagagatttcgatcggaagttattgctggcgaagtctaaaatcgagatggaagagactgataaagagcagctgactgcagaagccaaggaactgcgtcagaaggttaaatatctgcaagatcagctgtcccctttgaccaggcagcgagagtaccaagaaaaggagattcaaaggctgaataaagctttggaggaagcactgtccatccagacaccgccttcatcaccccccactgcatttgggtctcctgaaggggccggcgctttgcttcgcaagcaagaacttgtgacccaaaacgagctcttaaagcaacaggttaagatcttcgaagaggatttccaaagggaacgcagcgatcgggagaggatgaacgaagaaaaggaagaactaaagaagcaggtcgaaaagctgcaagcccaggtcacattatctaacgcacagctgaaagcttttaaggacgaagagaaggcaagagaagccctccgccaacagaaacgcaaagcaaaagcgtccggcgagcgctaccatgtcgaaccccacccagaacatctctgcggcgcctatccttatgcctacccacccatgcccgcgatggtgccccaccacgggtttgaggactggtcccaaatacggtacccccccccgcccatggccatggaacatcctcctcctcttcccaatagtcgtctgttccacctcccggagtacacatggagactgccgtgcggcggagtgagaaatccaaatcagagcagtcaagtcatggatccacctaccgctagaccaacagagcccgaatctcccaagaacgatagggagggacctcaatag

SEQ ID NO: 137994 - DNA, 1911 bp, Artificial Sequence
  Description of Artificial Sequence: Synthetic coding sequence
atggaggggcggggtccgtatcggatttatgatccaggaggttcagtgccttctggggaagcaagtgccgcattcgagagactggtgaaggagaacagccgattgaaggagaaaatgcagggcattaagatgctgggggaactcctggaggaatcccagatggaagccaccagactgagacaaaaggccgaggaattagtgaaagataatgaacttctgcccccaccctcgccaagtttgggcagtttcgaccctctggcggagctgaccggaaaggattccaatgtgactgcaagccccaccgccccagcatgcccatcagataagcccgcccccgttcagaagccccccagctctggtacaagctctgaatttgaagtggtgaccccggaggagcagaattctccagagtcctcctctcacgccaatgctatggcactgggacccctgccgcgcgaggacggcaatctgatgctgcacctacaacgtctggagaccacgctctccgtctgtgcggaggagccagaccatggtcaactgtttacccacttagggcgcatggcccttgagtttaatcgcctcgctagcaaggtgcacaagaacgagcagcgtacaagcatcttacagacactttgcgaacagcttaggaaggagaatgaggcgctgaaagccaaactggacaaaggtctagaacagagagaccaagcagccgagagactgagggaggaaaatctggaactgaaaaaactcttaatgagtaacggcaacaaagagggagctagtggcaggccgggcagccctaaaatggagggaaccggaaaaaaggccgtcgctggacaacagcaagcatccgtgaccgcagggaaagtacccgaggtagtggctctgggagctgcagaaaagaaggtcaagatgcttgaacagcagcggagcgaactactggaagttaacaagcagtgggaccagcactttcgatccatgaaacaacagtacgagcagaagataactgaactcaggcagaaactggctgacctccagaaacaggttacagatctggaggcagagcgagagcagaaacaacgggatttcgaccggaaattactgctggccaagagcaaaattgagatggaggagaccgacaaggagcaacttacggcagaggccaaggaactgcgtcagaaagtcaagtatctccaggatcagctgtcacctctcactagacagcgagaatatcaggaaaaggaaattcagcgcttgaataaggcactagaggaagccctatcaatccagacccctccatcctctcctcccactgccttcggaagcccagagggtgccggagcactgttgcgtaagcaggagctcgtcacgcagaatgagcttctgaagcagcaggtgaagattttcgaagaggatttccagagagaaaggagcgatagagagaggatgaatgaggagaaagaagagctaaagaagcaagttgaaaagttacaggcccaagtgaccctttctaacgcccagctgaaagcttttaaagatgaggagaaggcccgggaagcgttgcggcagcagaaacgcaaagcgaaggctagcggcgaaaggtaccatgtggagcctcaccctgagcatttgtgtggcgcatatccatacgcatatcctccaatgccagcgatggtacctcatcacggcttcgaagactggtcccaaatccggtacccacctccgcccatggccatggagcacccgccccctctgcccaacagccggctgtttcacttgccggaatacacatggcggctaccctgcggaggcgtgcggaacccaaaccaaagctcccaagttatggacccccccaccgcgagacctacggagcccgagagccccaagaacgatagggagggaccccagtag

SEQ ID NO: 137995 - DNA, 1590 bp, Artificial Sequence
  Description of Artificial Sequence: Synthetic coding sequence
atgctgggtgagcttctggaggagagtcagatggaagcaacccgcttgagacaaaaagctgaagaattggtgaaagacaatgagctgttacccccgccaagtccttcactcggcagctttgacccgcttgccgagttgaccggcaaggatagtaacgtcacagcatcacctacagctccagcctgcccctcagacaaacctgccccagtgcagaagcccccctctagcggtactagctccgaattcgaggtcgtcactcccgaagagcagaactcacctgagtcgtcaagtcacgctaacgccatggccctggggcccttgcccagagaggacggaaatctcatgttacatctacagcggctggagacaacgctgtctgtgtgtgctgaagagcccgatcatggccaactgtttacccacctcgggaggatggcacttgaattcaaccggctcgcttcaaaagttcacaaaaatgagcagcgcacttctatactgcagacattatgtgagcaactgcggaaggaaaatgaggcactcaaagctaaactggataaggggctcgaacagagggatcaagctgcggagaggcttagggaggagaaccttgagttaaagaagttgctcatgagtaacggtaataaggagggggcttccgggaggccagggtcgcccaagatggaggggactggcaaaaaagcagtagccggtcagcagcaggcatcagtgaccgcgggaaaggtccccgaagtggtggctcttggggccgctgagaagaaggtgaagatgttggagcaacagaggagcgagctgctggaagttaacaagcaatgggaccagcacttccgcagcatgaagcaacagtatgaacagaagatcaccgagctcagacagaagctggccgacctacaaaaacaagtgactgatctggaggcggaaagggagcagaaacagcgtgatttcgatcgcaagctccttctagccaaaagtaagattgagatggaggagacagacaaagaacagctcacagcagaagcgaaagagctgcgacagaaggtgaaatacctccaggaccagttgtctccgctgacacgtcaaagagaatatcaggagaaggaaatacaacgcctcaataaagcgttagaggaagcactctccatacagacacccccaagctcccctcccaccgcctttggatctcccgaaggtgcaggggccctcctgaggaaacaagaactggtaacacagaatgaacttctcaagcaacaagtgaagattttcgaagaagactttcaaagggagagatctgaccgggaacgtatgaacgaagagaaagaagagctgaagaaacaagttgagaaactccaggctcaggtaacactgagcaatgcccagcttaaggctttcaaagatgaagagaaggcccgggaagcacttagacagcagaaaaggaaagcaaagcccgaatatacttggcgcctgccttgcgggggcgttcgcaacccaaaccagtcctcccaggtgatggaccctccgaccgcgaggcctaccgaaccggaatctcccaagaatgatcgggaaggaccacagtag

SEQ ID NO: 137996 - DNA, 1908 bp, Artificial Sequence
  Description of Artificial Sequence: Synthetic coding sequence
atggaggggcggggaccatacaggatctatgacccaggtggttcagtaccatcgggtgaggctagcgcagcatttgagcgccttgttaaggaaaacagcagattgaaagaaaaaatgcaggggatcaagatgctcggggagttgttagaagagtcacagatggaggccaccaggctcagacaaaaggcagaggagttggtgaaggataacgaattgctgccgcccccaagcccctccctcggcagcttcgatccgctggcagagctgaccggcaaagactctaacgttacagcatctcccactgccccagcctgccccagcgataagcctgcccctgtccagaagcctcccagcagcggtacatcttccgagttcgaggtggtaacccctgaggagcagaactcgccagagagtagcagccacgcgaatgctatggctttaggtcctctgccaagagaggatggcaacctcatgctgcacttgcagaggctggaaactacattgagtgtgtgcgcggaggagcccgatcacggtcagctgtttactcatctcggtaggatggccttggaatttaaccgcctggcgtccaaggtgcacaagaacgagcagaggacctccatactgcaaactctgtgtgaacagctccggaaggagaatgaagccttgaaggccaaacttgacaagggcctggagcagcgtgatcaagctgccgagcgcttacgcgaagagaatctggagttgaaaaagctgttaatgagtaacggtaacaaggaaggtgcctccggccgaccggggtcacccaagatggagggaaccggtaagaaagccgtggcagggcagcaacaggcatcagtgaccgcaggaaaagtccccgaagttgttgccctcggtgcggccgagaagaaagtgaaaatgctcgagcagcaaagaagcgagctcttagaagtgaacaagcagtgggaccagcattttagaagtatgaagcagcagtatgagcagaaaattacagagctcaggcaaaaacttgctgacctgcaaaaacaagtgacagacttggaagccgagcgggagcaaaagcagcgcgatttcgacagaaaattacttctggccaaatctaaaattgaaatggaagagacagataaggaacagttaaccgcggaagcaaaagagctgcggcaaaaggtgaaatatttgcaggaccagttatcacctttgactcgccaacgtgagtaccaggagaaggagatccagcggctcaacaaggctctggaggaggccctgtctattcagacccctccgtcctccccccccacagcttttggcagccctgaaggagcgggagctttgctgcggaaacaggagttggtcacccagaatgagctgctaaagcagcaggtcaagatttttgaagaggacttccagcgcgagagaagcgatcgggagcgaatgaacgaggaaaaagaagaactgaagaagcaagtcgagaagttacaagctcaggtaactctgtctaatgcgcaattaaaagccttcaaggatgaggagaaggcccgcgaggcattgcgacagcagaaacggaaagccaaggcgtccggcgaacgctaccacgtggagccacaccccgagcacttgtgtggcgcctatccctacgcctatccccctatgcctgccatggtgccccatcacggatttgaggattggtcacaaattcggtatcccccacctcctatggctatggaacacccacctccgctgccaaacagcaggctgtttcacctccccgaatatacgtggcggttaccttgcggtggcgttcggaatccaaatcagtcttctcaagtgatggacccacctactgcaagaccaaccgagcccgagcctgcagacctgcgcctccccaggaattag

SEQ ID NO: 137997 - DNA, 1479 bp, Artificial Sequence
  Description of Artificial Sequence: Synthetic coding sequence
atggaagccacacgtttgcgccaaaaagccgaagagctagtgaaggacaacgaattgctcccccccccttccccgagcctgggatcctttgatcccctggctgaacttacaggcaaagactccaacgtgaccgcctcccctactgcaccagcttgccccagcgataagcctgctccagtgcagaaacccccaagcagtggtacgagcagcgaatttgaagtcgtcacgcctgaagaacagaactcccctgaatctagcagtcacgctaacgcaatggccttggggcctctgcctcgagaagacggtaacctgatgctgcatctgcaacgattagaaaccactctgtccgtgtgcgcggaggaacctgaccacggccagctgttcacccaccttggccggatggccttagagtttaataggttggctagcaaggtgcacaagaacgaacaacggacctcaattcttcagacattgtgtgaacagctcagaaaagagaacgaggcactcaaggctaagctggacaagggccttgagcaaagagatcaggcagcagagaggctacgcgaggaaaatctggagctgaagaaactcctcatgtcaaacggcaataaggagggggcttccggacgccctggaagtcccaaaatggagggtacagggaagaaagcggtggcaggacaacaacaggcctcagtcactgcagggaaggttccagaagtagtggctctgggagccgcagagaaaaaagtgaagatgcttgagcagcaaaggtctgagctcctggaggtcaacaagcagtgggatcagcactttcgctcaatgaaacagcagtacgaacagaagatcaccgagctgcggcagaagttagccgacctgcaaaagcaggtcaccgatcttgaggcagagcgggagcaaaaacaacgagacttcgatcgcaaattgctgcttgccaagagcaagattgaaatggaggaaaccgataaggagcagctcactgccgaggccaaagagcttagacagaaagtcaaatacctgcaggatcagctgtctccactgacccggcagcgggagtatcaggagaaagagattcagcgcttaaataaggcactggaagaagccctcagtatccagactccaccatcctcacctccaaccgcgtttgggagccccgagggcgctggggctctcttgcgcaagcaggaactcgttacccaaaacgagctgctgaagcagcaggttaagatctttgaagaagacttccaaagggaaagaagcgaccgtgagcgcatgaatgaggagaaagaggagctgaaaaagcaggtggaaaaactccaagcccaggtgaccttatccaatgctcagttaaaagctttcaaggatgaggagaaagctcgggaggccctgagacagcagaagcggaaggctaaaggcacccaccgtggctgtccccgacacctgcctgagcgaaaggtcaagtag

SEQ ID NO: 137998 - DNA, 435 bp, Artificial Sequence
  Description of Artificial Sequence: Synthetic coding sequence
atggaaggccggggtccctatcggatttatgatcccggaggaagcgtccctagcggtgaggctagcgctgccttcgagaggctcgtaaaggagaacagtaggctcaaggagaagatgcaaggaattaaaatgctgggggagttgctggaggagtcccaaatggaagccaccaggctgagacaaaaagcagaggaattggtcaaagacaacgagttgctccccccaccatccccttccctcggctcttttgatcctctcgccgagctgacggggaaggattccaatgtcacagcatcccctactgctccagcctgtccctcggacaaacccgcccccgtccaaaagccaccttcgtcaggcacaagctctgagttcgaggtagttactcctgaggaacagaactctcctgagtctagcagtcacgccaacgcatag

SEQ ID NO: 137999 - DNA, 1752 bp, Artificial Sequence
  Description of Artificial Sequence: Synthetic coding sequence
atggaggccaccagactgcgtcagaaggccgaagaactggttaaagataacgaacttctgccgccgccgagcccgagtctgggttcttttgacccattagctgagctgactggcaaagactcaaatgtaaccgctagcccaaccgctcccgcttgcccttccgacaaaccagcccccgtgcagaagccccccagttcaggaacgtcaagcgaattcgaggtggtcaccccagaggagcagaattctccagaatctagcagtcacgcaaatgccatggcgctgggacccctgcccagagaagatggcaatctaatgctccatctgcagaggctcgagaccacattgtctgtgtgtgctgaggaaccggaccatggccaactattcactcatctggggcgtatggcattagagtttaatagactcgcatccaaagtgcataaaaacgagcaaaggacctcaatcctgcagaccctctgtgagcagctgcgcaaggagaacgaggcactaaaggctaagctcgataaaggactggagcagcgagatcaggccgcagaaagactgcgggaagaaaatttagagctcaagaaactcctcatgagtaatgggaacaaggagggagcttctggccgacccgggtcccctaagatggaggggaccggcaaaaaggctgttgccgggcaacaacaggcttccgtcaccgctgggaaggttccggaagttgtagcgctgggggcagcggaaaagaaagtgaagatgttggagcagcagagatccgaactactggaagttaataagcagtgggatcaacactttagatcaatgaagcagcaatatgagcagaagattaccgagctgcgccagaaattagccgatcttcagaagcaggttactgatctcgaagctgagcgggaacagaagcagagagattttgaccgaaaacttctcctggccaagtctaaaattgaaatggaagagaccgataaggagcagttaacagcagaggccaaggagctcaggcagaaagtgaaatacctccaagaccagctgtcccccctgacgagacagagggagtaccaggagaaagaaattcagcgcctgaataaagccttagaggaagctctgagcattcagaccccaccatcatcaccgcctacagcctttggcagccctgaaggagctggcgcactcctgcgcaagcaggagcttgtgactcagaatgaactgctgaagcagcaggtgaagatattcgaagaagacttccagcgggagaggagtgaccgggagagaatgaacgaggaaaaagaggagcttaaaaagcaggtggagaagctgcaggcccaggtgacactgtccaacgcgcaactgaaagctttcaaagatgaggagaaagcacgggaagccctgaggcagcagaagaggaaggctaaggcatccggtgagaggtatcacgtcgaacctcaccctgaacacttgtgcggtgcatatccttacgcttacccccctatgcccgctatggtgccgcaccacgggttcgaggattggtctcagattaggtaccctcccccccctatggctatggaacatccgccaccacttccgaattctagactcttccacctccctgagtacacttggcgcctcccgtgtggaggagtgagaaacccaaaccagtctagccaggtgatggatcctccaaccgcccggcccacagagccagaatcacccaagaatgatcgagagggtcctcagtag

SEQ ID NO: 138000 - DNA, 402 bp, Artificial Sequence
  Description of Artificial Sequence: Synthetic coding sequence
atggagggccggggcccttataggatttatgaccctgggggctcagtgccaagtggggaggcaagtgccgcctttgaacgactggtgaaagaaaattccagactgaaggagaagatgcaaggcatcaaaatgctgggagaattattggaggagtctcagatggaggctacaaggttgcggcagaaagcagaagaacttgtgaaagacaacgaactgctgccacccccctctccatccctgggctcatttgatcctctggccgagttaaccggaaaggattcaaatgtgacagcaagcccaaccgcccccgcgtgcccttctgataaaccagctccagtgcagaagccccctagctccggtacctcaagcgagttcgaagttgtcacccccgaggaacaatag

SEQ ID NO: 138001 - DNA, 1911 bp, Artificial Sequence
  Description of Artificial Sequence: Synthetic coding sequence
atggaaggccgcggtccatatcgcatctatgatccaggaggctctgtgccctcgggcgaggccagcgctgcctttgagcgtttggtgaaggaaaatagtcgcctgaaggaaaaaatgcagggaataaaaatgttgggcgagctgctggaagagtctcagatggaggcgacaaggctccggcaaaaagcagaggagctggttaaggacaacgaattgctgcctccgccctcaccttccctgggcagttttgaccctttggccgagttgacaggcaaagactcaaatgtcacagcatcacctacggcacctgcctgtcccagcgataagccagccccagtgcagaagcctcctagtagcgggacttcttcagagttcgaggtagtcacccccgaggagcagaactcccccgagagctcatcacacgccaacgccatggcactggggcctctgcctcgcgaagatggcaatctgatgcttcaccttcaacgtttggagactacactgtccgtttgtgcagaggaacccgatcatggacagctgtttactcaccttggacggatggcccttgagttcaatagactggcctccaaggtacataagaacgagcagcgaacctccattctgcagactctctgcgagcagctgaggaaggaaaacgaagccttgaaggctaaactggataaaggtctggagcaacgggaccaggccgcggaacggctaagagaagagaaccttgagctcaaaaaactgctcatgagtaacggaaacaaagagggagcctccggacgaccagggtcccccaagatggagggcaccggtaaaaaggccgttgcgggccagcagcaggcatcagtaacagcaggtaaggtgcctgaagtagttgcactgggagccgcagaaaagaaggtcaaaatgctcgaacagcagagatcagagctgcttgaggtcaacaagcagtgggaccagcactttcggtcgatgaaacagcagtacgagcagaagatcacagaactgagacagaaattggcagatctacagaagcaggtgaccgatttggaagctgaacgagaacagaagcagcgggacttcgaccggaagctgttgctcgccaaaagtaaaattgagatggaagaaactgataaagagcaactgaccgcagaagcaaaagaactgcgccagaaggtgaaatacttgcaagatcagttgtccccgttgacccgccagcgagagtaccaagagaaagagatccagaggctgaataaagcactggaagaggctctgtcaattcagactccacctagcagtccccctacagcattcgggagccccgaaggcgccggggctttactccgcaaacaagaactggtgacacagaatgagcttctgaaacagcaggttaaaatctttgaggaggacttccagagagaaaggagcgatcgggaacggatgaacgaagaaaaggaggagttgaagaagcaggttgagaagttacaggctcaggttaccctttcaaacgctcagctgaaagcatttaaagacgaggagaaggcgcgggaagcactgcgacaacagaagagaaaggctaaggctagcggcgaaaggtatcacgtggagccacaccctgagcatttatgcggagcctacccctacgcctacccccctatgccggccatggtccctcaccatggcttcgaagattggtcgcaaattaggtatccacctccaccaatggccatggagcaccctcctcccctgcctaacagtcgtctgtttcacctacctgaatatacatggagactgccctgtggtggggtaagaaacccaaatcagagttcccaggtcatggatcctccaacagcccggccaacagaacccgagtcacccaagaacgatcgggaggggccgcaatag

SEQ ID NO: 138002 - DNA, 774 bp, Artificial Sequence
  Description of Artificial Sequence: Synthetic coding sequence
atggaagccacaaggctgcgccaaaaggcggaggagcttgtcaaggataatgaactgttaccccccccctccccctcgctgggcagcttcgacccacttgcggagctaacaggtaaagactcaaatgtgaccgcatcacctacagcgcctgcatgtccgagcgacaaaccagcacctgtgcaaaaacctccgtcatcaggcacatcatctgagtttgaggtggtgacccctgaggaacaaaactcacccgaatcaagttcgcatgcaaatgctatggcgctcggcccactaccgcgagaggatggcaacctgatgttacatctccagcggcttgagactacactgtccgtctgcgctgaagaaccggatcacggtcagttgtttacacacctaggaagaatggcgctggagttcaataggctggcctccaaggtccataagaacgaacagcgaacatccattctgcagacactctgtgaacaactccggaaggagaatgaggcattgaaggctaagctggataaaggattagagcagcgggaccaagcagctgagcggcttcgcgaggaaaacctggaattaaagaagttgctgatgagcaatggcaacaaggagggcgcctccggccggccaggttcacccaaaatggagggcactggtaagaaggctgtggcaggtcagcaacaggcctcggtcacagcgggtaaagtccccgaggtggtggcattaggcgccgcagagaagaaggtgaagatgctcgaacagcagcggtag

SEQ ID NO: 138003 - DNA, 1911 bp, Artificial Sequence
  Description of Artificial Sequence: Synthetic coding sequence
atggaaggccgcggaccgtaccggatatatgatcccggaggtagcgttccaagcggagaagctagtgccgcatttgagaggcttgttaaggaaaactccaggttgaaagagaagatgcagggcattaagatgttaggagagcttctcgaggagtcgcagatggaggctactagacttcgccagaaggccgaagagttggtgaaagacaatgagctgctcccgcctccatccccatcactggggtcctttgaccctctggctgagctgactgggaaggatagcaatgttaccgctagtccaactgccccggcctgcccatcagataaaccggcccccgtgcagaagcctcccagctcaggcacctcttcggagttcgaggtcgtgaccccagaggagcaaaacagtccagagtctagttcccacgccaacgctatggccctcgggcccctgccccgggaggatggaaatctcatgcttcacctccaacgcttggaaacaaccctcagtgtgtgtgctgaagagccagaccacggacagctgtttacgcacctcggccgcatggctttagaatttaataggctggccagcaaagtgcacaaaaatgaacaacggacatccatcctgcaaacgctctgtgaacaactccgtaaagagaatgaggccctgaaggctaagctagacaaaggacttgagcaacgggaccaggctgcagagagactcagagaagagaacctggagctcaagaaactgctgatgtcaaacggcaacaaagagggcgcctctgggcggccgggctcccctaagatggagggaacaggaaaaaaagccgtggccgggcaacagcaggcatctgttacagctggcaaggttcccgaagttgtggcactgggagcggccgagaaaaaggtgaaaatgctggaacagcagcgaagcgagttgttagaagtcaacaagcaatgggaccagcacttcagaagcatgaaacaacagtatgagcagaagatcacagagctccgccagaagcttgcggatctgcagaaacaggtgaccgatctcgaagccgaacgagagcagaaacagcgtgattttgatcgcaaactgctcctggccaagtccaagatcgagatggaggagactgacaaagagcagctaacagctgaggccaaagagttacggcaaaaagtcaagtacttgcaagatcagttatctccactcacaaggcagagagaataccaggaaaaagaaatccagaggctgaataaagcgttggaggaggccctgtccattcagacacccccctcttcgccgccaactgcgttcggaagtcctgagggagcaggagcgctgctgaggaagcaagagctcgtaacccagaacgagctcctgaaacagcaggtgaagatattcgaggaagactttcagcgtgagaggtcggatagagaacgtatgaacgaggagaaggaagagctgaaaaagcaagtggaaaagctgcaggcccaagtgaccttgagtaacgcacaactcaaagcatttaaggatgaggagaaggctcgcgaggccctgaggcagcaaaagagaaaagccaaagctagtggggaacggtatcacgtggaacctcatccagaacacctctgtggagcatatccatacgcctatcctccaatgcctgcgatggtgcctcaccacggattcgaagactggtcccagatccgctatcccccccctcctatggctatggagcaccccccgccactgcctaatagccggctttttcaccttccagagtacacctggaggttaccatgtggcggagtcagaaatcccaaccagtcctcacaggtgatggacccccccacagcccgccccacggaaccagagagccctaagaacgaccgcgagggaccacagtag

SEQ ID NO: 138004 - DNA, 1719 bp, Artificial Sequence
  Description of Artificial Sequence: Synthetic coding sequence
atggagggccgcggaccgtaccgcatttacgatccagggggatcagtcccatcaggtgaggcgtccgcagctttcgaacgactggtgaaggagaacagccgtttaaaagagaagatgcaggggatcaaaatgctgggcgagttactggaagaatcccagatggaggctactcgtctacgccagaaggccgaagaactcgtgaaagacaacgagttgttgccgcctccgtctccatcccttggctcttttgatcccctggcagaattgaccgggaaggacagcaacgtgaccgcatctcctactgccccagcgtgccctagtgacaagcccgctccggtgcagaaaccgccatcttctggaactagttctgaattcgaggtggtaactcctgaagaacaaaactcaccagagtcatctagccacgcaaatgcgatggcccttgggccactacctagggaggatgggaacctcatgctgcatttgcagcgcttggagactactctctccgtgtgtgccgaagagccagaccatggacaactattcacccatcttggccggatggccctggagtttaatcgcctggcttccaaagtgcacaagaatgaacagcgaacaagcatccttcagacattgtgcgagcagcttagaaaggagaatgaggcccttaaagccaagcttgataaagggttggagcagcgggaccaagcggcagagcggctgagggaggagaaccttgaactgaagaagttgctgatgtccaacgggaataaagaaggcgcatctggacgtccgggatccccaaagatggagggaacaggcaaaaaggcagttgccgggcagcagcaagcatccgttaccgccgggaaggttcctgaggtcgtcgccttaggggccgcggagaagaaagtcaagatgttggagcagcagcgtagtgagttgcttgaagtcaacaaacaatgggaccagcatttcagatccatgaaacagcaatatgaacagaagatcaccgagctgcgccagaagctagcagatctccagaagcaggttaccgacctggaagccgagagggaacagaagcagagagacttcgacagaaagcttctgctggctaagagcaagatagaaatggaggaaacagataaggagcagctcacggcagaagcgaaagaactccgccagaaggtgaaatacttgcaggaccagctgtccccactgactaggcagagggaataccaggagaaggagatccagaggttgaataaagctctggaagaggccctgagtatccagacacccccctccagcccgcctaccgccttcgggagtcccgagggcgccggcgctctgctgagaaaacaagagctggtcacccagaacgaattactcaaacagcaggtgaaaatcttcgaagaagacttccaaagagaaaggtcggatagggagcggatgaacgaggaaaaggaggagctaaaaaagcaggtcgagaagctccaggcgcaggtaaccctttccaacgctcagttgaaagcatttaaagacgaagaaaaggcgcgggaagcactcagacagcagaaaagaaaagcaaagccagagtacacctggaggctcccgtgtggtggcgtaagaaatccaaaccaatcaagccaggttatggatcctccaacagctcggccgaccgagccggaaagccccaagaatgatcgggaagggccgcagtag

SEQ ID NO: 138005 - DNA, 1908 bp, Artificial Sequence
  Description of Artificial Sequence: Synthetic coding sequence
atggagggaaggggcccctatcgcatatatgaccctgggggatccgtaccgagtggcgaagcaagcgcagcctttgagaggctggtgaaagaaaactcccgcctcaaggaaaaaatgcagggcatcaaaatgctgggagagctcctcgaagaatcacagatggaggccacccgactacgccagaaagccgaagaactggtcaaagataacgaactgcttccacctcccagcccaagcctaggtagtttcgaccctctcgctgagctgactggcaaggactctaatgtgaccgcttcacccactgctcccgcatgcccatccgataaacccgcccctgtacagaagccgccaagctctggtacctcctccgaattcgaagtggtgacccctgaggaacagaacagtccagaaagttcgagtcacgccaatgctatggccctgggcccgctgcccagagaggatggcaacctgatgctgcacctgcagcgacttgagacaactctgtctgtctgtgctgaggaacccgaccacggccagctgtttacccatctcggccggatggctctagaatttaatagactggcttccaaggttcataagaatgagcagcgcacttcaatactgcagacactctgcgagcagctccggaaggagaacgaggctctgaaggccaaacttgacaaagggctggaacagagagaccaggcagcagagcggctccgggaggagaatctggagctgaagaagctgctgatgagcaacggaaataaagagggcgcgtctgggcggcctgggagcccaaaaatggaaggtacagggaagaaggccgtggcgggtcaacagcaggctagtgttacagctggaaaagtccctgaagtcgtggcccttggggccgccgagaagaaagtgaaaatgctggagcagcagcgcagtgaactgctcgaagtcaacaagcagtgggaccagcatttccgaagcatgaaacagcaatatgagcagaaaatcactgaacttcgccagaagctcgccgaccttcagaagcaggtaaccgatctagaggcagagagagaacagaaacaacgggactttgaccgcaaattactgctggctaaaagcaaaatcgagatggaagaaacagataaggaacagctgacagcagaagccaaggaactccgacagaaggtaaagtaccttcaggaccagctaagccccctgactaggcagagagaataccaggaaaaggaaattcagagattaaataaggctcttgaagaggccctgagcatccagacaccccctagcagcccacccaccgcgttcgggagtccagaaggagctggagcattgctgagaaaacaggaattggtcacacagaacgagctcctcaagcagcaggtgaagattttcgaggaggacttccagagggagcgctcagacagagagcgaatgaatgaagagaaggaggaactgaagaagcaggttgagaaactgcaggctcaagtaaccttatccaacgcccagttaaaggcatttaaggatgaggaaaaagcccgggaagccctccgccagcaaaagcgaaaggcgaaagcctcaggcgaaaggtatcacgtggagcctcatcctgaacacctgtgtggcgcctatccatatgcatacccccccatgcctgctatggtgccccaccacggtttcgaagactggtctcagatccggtatcctccaccaccaatggcgatggaacatccacctccactgccaaattcccgcctgttccacctgcccgagtacacctggcggctcccctgcggaggtgttcgtaacccaaatcagagttctcaggtcatggatccacccaccgctaggccgactgagcctgagcccgcagatcttaggctgccacggaattag

SEQ ID NO: 138006 - DNA, 1671 bp, Artificial Sequence
  Description of Artificial Sequence: Synthetic coding sequence
atggagggccgcgggccttaccgcatctacgacccaggagggtccgttccctctggcgaagcctcagctgccttcgagcgcctggtgaaagaaaactctcggctcaaagagaagatgcagggcattaagatgctgggggaactgttagaggagagccagatggaagcgactcgcttgaggcagaaggccgaagaactggtcaaggacaatgagctcctgcctccaccttctcctagcctcgggtcatttgaccccctggctgaactcacgggaaaggatagtaacgtgaccgcttctccgactgccccagcctgtccctcagacaaacccgcgcccgttcagaagcccccttcttcaggaacctccagcgagtttgaagtggttacccccgaggagcagaatagccccgaaagtagtagccatgcgaatgccatggccttagggcctctgccccgtgaagatgggaatttgatgctacatcttcaaagacttgaaacaacattgtctgtgtgtgcggaagagccagaccatgggcaactgttcacacatctgggcagaatggcgcttgagttcaatcgactcgcatctaaggttcacaaaaacgagcagaggacgagcattttgcagactctgtgcgagcagctgaggaaagagaacgaggccctgaaggccaagcttgataaggggctcgagcagagggaccaggccgccgaaagactccgggaagagaatcttgagctgaaaaagctgctgatgagcaatggaaacaaggaaggggctagtgggcgccccggctcacccaagatggaagggacagggaagaaagctgtcgcaggccagcagcaggccagcgttacagcaggcaaggtccctgaggtcgtggccctgggagctgccgagaagaaagttaagatgctcgaacagcagcgaagtgagttgctggaggtgaacaaacagtgggaccagcacttcagatccatgaagcagcagtatgagcagaaaattaccgagctgcggcagaagctggccgatctccaaaagcaggtaaccgacctggaggctgagagagagcagaagcagagggattttgataggaagctacttctcgcgaaatcgaaaatcgagatggaggagacggataaggagcagctcacagccgaggccaaagaactgcggcagaaagtgaagtatcttcaggaccagttgtctcccttgacacggcagagagagtaccaggaaaaagagatacagagactgaataaggcgctcgaggaggccctgtcaatccagaccccaccctcatcgcctcccacagctttcggaagtcccgagggcgctggtgccctccttagaaagcaggaactggttacccagaacgagctgctgaaacaacaggtgaaaatctttgaggaagacttccagagagaaaggtccgacagggaaaggatgaatgaagagaaggaggagttgaagaaacaggtggaaaagctgcaggctcaggtgactttgtctaatgctcagttaaaagcctttaaagatgaagagaaggccagggaggccttaagacagcagaagagaaaggccaagagcttgcagaagatgactgtgaggggtctgagcgaaaccagactgtgccaccttgcaccccccagcagctgccgggcatcttag

SEQ ID NO: 138007 - DNA, 1797 bp, Artificial Sequence
  Description of Artificial Sequence: Synthetic coding sequence
atgcaagggattaagatgttgggcgaactgttggaggagtctcaaatggaggctaccaggctccgccagaaagccgaagagctggtgaaagacaatgaactgctgcccccaccctccccaagcctgggttcttttgatcccctggctgagttgaccgggaaggactctaatgtgaccgcgagtcctacagcgccggcctgcccgtccgacaaacctgcacccgtgcaaaagcctcccagtagcgggacaagtagcgaattcgaggtggttaccccagaagaacagaattcacctgagtcctcaagccacgccaacgcaatggctcttggtccgttgcctagggaggacggaaatcttatgctgcacctacagcggctggaaaccactcttagtgtgtgcgcggaggagcctgatcatgggcaattgtttacccatctgggcaggatggcgctagagtttaatcgcctggcgagcaaagtccataaaaacgagcagagaacttcgatactccagaccctgtgtgagcaactcagaaaagagaatgaagctttaaaagcaaagctggacaaagggctagagcagagagatcaagccgcagaacgcctaagggaggagaatttggagttgaaaaaactgctcatgagcaacggcaataaagaaggggcaagtggcagacccggatcccccaaaatggaaggcactggcaaaaaggcggttgctggtcagcagcaagcatccgtgaccgccggcaaggtcccagaggttgtggcattaggcgccgccgaaaagaaggttaagatgctcgagcagcagagaagcgagctgctcgaggtcaacaagcaatgggaccaacatttccggtccatgaaacagcagtacgagcagaagattaccgagttgagacaaaagctcgctgacctgcagaagcaggtcacggatctggaggccgagagagagcaaaaacaaagggatttcgaccggaagctgctgctggccaagagcaagatcgaaatggaggaaaccgataaggagcaactgacagctgaggcgaaagagttacggcagaaggtcaagtacctccaggatcagttgtcccccctgacacgtcaaagggaatatcaagagaaagagatacagcggctcaacaaagctctagaggaagcgttatccatccagacacctcctagctcccctccgacagcttttggatctcctgaaggagcaggagctctacttaggaaacaggaactcgtcacccaaaatgagcttctgaagcagcaggtgaaaatctttgaggaggacttccagcgtgagcgctctgacagagagaggatgaatgaagaaaaggaagagcttaagaagcaagtcgagaagctccaggctcaggttaccctgtctaatgcccaacttaaggccttcaaggacgaggagaaggcccgcgaggcgctgcggcagcaaaagagaaaggccaaagccagcggcgagaggtatcatgttgagccacacccagaacatctgtgtggcgcctatccctacgcgtatccacctatgcccgccatggtgccccaccatggattcgaggattggagccaaataaggtatccacccccaccaatggccatggagcaccctcctcctctccccaacagtcgactgttccacttacccgagtacacctggagactcccatgtgggggggtccgcaaccctaatcaatccagtcaagtcatggacccccctacggctcgtccaacagaaccggagagccctaagaacgatcgcgagggcccccaatag

SEQ ID NO: 138008 - DNA, 1542 bp, Artificial Sequence
  Description of Artificial Sequence: Synthetic coding sequence
atgcttggtgagctgctggaggagtcccaaatggaagccacaaggttgcgccagaaagcggaggaactggttaaggataacgaactgctgcctcccccttctccttcactggggtcattcgaccccctggccgaactgactggtaaagactcaaatgtgactgcaagccctaccgcacccgcttgcccaagcgataaaccagcaccagtgcagaagccaccctcttccggcacctcatccgaattcgaggtggtgaccccagaagagcagaacagcccagagtcctcctcacatgccaatgccatggcactgggtccactgccccgtgaggacggaaacctcatgctgcacctccaaagacttgaaacgaccctttccgtctgtgccgaagagccagaccatggtcagctcttcacacatctgggccggatggcgctggagtttaatcgactcgcgagcaaagtccacaaaaacgaacagaggacaagcatccttcagacactgtgtgagcagttacgtaaggaaaatgaagctttaaaggccaaactcgataaaggtttggagcagagagaccaagctgctgagagactgcgagaagagaatcttgaacttaaaaaattgctgatgtctaacggaaacaaggagggcgcctcgggtagacctggtagtccgaaaatggaaggaaccggtaagaaagccgtggctggccagcaacaggcaagcgtgacagctggaaaggtgcccgaggtggtggccttgggcgctgccgagaagaaggtcaaaatgctagagcagcagcgctccgagctgctcgaggtgaataaacagtgggaccagcacttccgcagcatgaaacaacagtatgagcagaaaatcactgaactgcgacagaaattagctgacctgcagaaacaggtgacagatttggaagcggagagagaacagaaacaacgcgactttgatcggaagttgctcctcgctaagtctaagattgagatggaggagacggacaaggagcagctgactgctgaagccaaggaattaagacaaaaagtcaaatatctgcaggaccagctgagtcccctaaccagacagcgcgagtaccaggagaaagagatccagcgcttaaacaaagcccttgaggaggcgctatccatccagaccccaccatcatctccgccaacagcatttggctcacccgaaggcgctggtgcactcctcagaaagcaggaactggtgacacagaacgagcttctcaaacagcaggtgaaaatcttcgaggaggacttccagcgagaaaggagcgatcgggagcggatgaatgaggagaaggaggagctaaaaaagcaggtcgagaagctgcaggcgcaagtgaccttgtccaacgcccagctcaaggcattcaaggatgaggaaaaggcgagagaggcactgaggcaacaaaaacgaaaggccaaaagcctccagaagatgactgtgagagggctttccgaaaccagactatgtcacctagcaccgcctagctcttgtcgcgctagttag

SEQ ID NO: 138009 - DNA, 1509 bp, Artificial Sequence
  Description of Artificial Sequence: Synthetic coding sequence
atgcttggggaactcctggaggaaagccaaatggaggccaccaggctacgccaaaaggcagaggagctagtgaaggataacgagctcctgcccccgccttctcccagcttaggttccttcgaccccctggctgagctgaccgggaaagacagtaacgtaactgcaagcccaaccgctccagcctgtccaagtgacaagccggcaccagtgcaaaagccaccatctagtggcactagctcagaattcgaagtggtcacacccgaggagcagaattcaccagaatctagctcacacgccaatgcaatggccttgggtccgctgccccgcgaagacggtaatttaatgctccatctgcaaaggctcgaaacgaccttgagcgtctgcgccgaagaaccagatcacggccaactgttcactcacttgggaagaatggcgctcgagtttaatcggctagctagcaaggtacacaaaaacgaacagagaacgtcaatactccagacgctgtgcgaacagctacgcaaggaaaacgaggccctgaaggccaaactggataagggtctagagcagagagatcaagctgctgaacgtctgcgcgaagaaaacctcgagttaaaaaagctgctcatgagcaatggaaacaaggaaggcgccagcgggagacccgggtctccaaagatggaaggcacaggtaagaaggccgtggcaggtcagcagcaggcctctgtcaccgccgggaaggttcctgaagtggtggctcttggcgccgcggaaaagaaagttaaaatgctcgagcagcagcggtctgaactcctggaagtgaataagcagtgggatcagcacttccgctccatgaagcagcagtatgagcaaaagataaccgagctgaggcagaagctggccgacctacagaaacaggtgacggacctggaggcggagcgggagcagaagcagagagactttgatcgcaaactgctgttggctaaaagtaagattgaaatggaagagaccgataaagagcagcttaccgcagaggccaaggagcttcggcagaaggtgaagtacctgcaggatcagttgtcaccccttacccgacagagagagtatcaggagaaagagatacagcgtctgaacaaggctctcgaggaggcgcttagcattcaaactccaccatcttcccctcctaccgcatttgggtcacccgaaggggccggcgcgctgctgaggaagcaggagcttgtgacgcaaaatgaactcttaaagcaacaggtgaaaattttcgaggaggactttcagcgggaaaggtccgaccgggagagaatgaatgaagaaaaggaggaactcaagaagcaagtcgagaaattgcaggcccaggtaaccttatccaacgcccagttaaaagccttcaaagacgaggagaaagcccgtgaggctctgagacagcagaagcggaaggctaaaggcacgcatcggggatgcccccgccatctaccggagcgtaaagtgaagtag

SEQ ID NO: 138010 - DNA, 1290 bp, Artificial Sequence
  Description of Artificial Sequence: Synthetic coding sequence
atgagcagggaccctgggtcaggcggttgggaggaggcaccccgggccgccgcggctttatgcaccctgtatcatgaagcagggcagcgcctgagacgacttcaggaccaactggccgctagagacgcgcttattgctaggctgcgtgcgaggctagccgctctcgaaggagacgccgccccatccctcgtggacgcgctgctagagcaagtagcaaggtttagggagcagttgcggcgccaggaaggcggcgctgccgaggctcagatgcggcaagagatcgaaagactgacagagcgcttagaggagaaggaacgggagatgcagcagctgttgtcccaacctcagcatgaaagagaaaaggaggtggtgctcctccgcagatccatggctgagggggaacgagcaagagccgcaagtgacgtgctgtgtaggtctttagctaacgaaactcaccagctgagacgcacactcaccgctacagcccacatgtgtcagcacctcgccaaatgtctggacgaacgacagcatgcacaaagaaatgtcggagagcgcagcccggaccagtcagagcacactgatggacacacttccgtgcagagcgtgattgagaaactgcaggaggagaataggttgctgaaacagaaagtaacacacgtggaggacctgaatgccaaatggcaaagatataatgcaagtcgggatgaatatgtccgtgggctgcacgcgcagctgcgcgggctccagatcccgcatgagcctgaactgatgagaaaggagatcagtagactcaatagacagcttgaagagaagatcaacgactgcgccgaagtgaagcaggaactggcggcttccagaacagccagggatgccgctctagaaagagtgcagatgttggagcagcagattctggcttacaaggatgacttcatgtccgagcgggccgaccgggaacgtgcccagtcacgcatacaggaacttgaggaaaaggttgcatctctcctccaccaagtaagttggaggcaggacagccgcgagcccgatgccggcaggatacatgcagggagtaagaccgctaagtatttggcagccgatgcgttggaacttatggtgcctggcgggtggcgccccgggactggatcacagcaaccagaacctccggccgaaggagggcatccaggcgcagcccagaggggccaaggtgacttgcaatgcccccactgcttgcagtgtttttcagatgagcagggcgaggagcttctgcgccatgttgccgagtgctgccagtag

SEQ ID NO: 138011 - DNA, 969 bp, Artificial Sequence
  Description of Artificial Sequence: Synthetic coding sequence
atgcagcaactgctgagtcagccccaacacgagcgggagaaagaggtcgtcctgctgaggaggagcatggctgagggcgagcgagctagggccgcctccgatgttctgtgccggtccctcgcaaatgagacgcatcagctgaggcgcaccctcactgccactgcccatatgtgtcagcaccttgccaagtgtctggatgagcgccagcacgcccagaggaacgtgggcgagagaagtccggatcagagtgaacacacggatggccacaccagtgtacaatctgtcatcgaaaagcttcaggaagaaaacaggcttctcaagcagaaagtgacgcacgttgaagatttgaacgctaagtggcagcgctacaacgcctcaagggatgaatatgtgcggggtctgcacgcccagctgaggggtctgcagattccccatgaaccggaattgatgcgaaaggagatttctcgactgaacaggcaactcgaagaaaagattaatgactgcgccgaagtcaaacaagagctggcagcatcccgtacagccagagacgccgcccttgagcgcgttcagatgttggagcaacagatcttagcttacaaggatgacttcatgtccgagagagcagaccgcgagagggctcagtcgagaatccaagaactggaggagaaagtggcatctttgctccatcaggttagctggagacaggattcccgggagccagatgccggacgaattcacgccggctctaaaacagctaaatatctggccgctgacgcgctggaactgatggttcccggtgggtggcgtccaggaaccggcagtcagcagcccgagccaccagccgaaggcggtcacccgggcgctgcccaacgcggccagggagatctgcagtgtccgcactgtttacagtgttttagcgacgagcagggggaagaattgctccggcatgtggcggagtgttgtcaatag

SEQ ID NO: 138012 - DNA, 837 bp, Artificial Sequence
  Description of Artificial Sequence: Synthetic coding sequence
atggcagaagctaggagtcagccatcggccggcccacagctgaatgcactgcctgatcacagcccactgcttcagcccggcctggccgccctccgccgccgtgctcgtgaagccggagtgccacttgccccgctgccactcacagacagttttcttctgcggttcctgcgagcgagggattttgatttagatctggcctggagattactgaagaactattacaagtggcgggcagagtgtccagaaatctccgcagacttgcatccaagaagcataattgggctactaaaggcagggtaccacggggtgcttcggtcccgggatccaactgggtccaaggtcctgatttaccggatcgcacattgggaccctaaggtatttactgcatatgatgtgttccgggtttcgctcattactagcgagctgatcgttcaggaggtcgaaacccagcgtaatgggattaaagctatctttgatctggaaggatggcagtttagccatgctttccaaatcactccctcagtcgctaagaagattgcagcggtgctaactgacagtttccctctcaaagtacgcggcattcatctgattaatgaaccagtgatcttccacgcagtttttagcatgatcaagccctttctgactgagaagatcaaggagagaatccacatgcacggcaataattacaagcagtccttgttgcagcacttcccagacatcctcccactcgagtacgggggtgaggaattttcgatggaggacatatgccaggaatggactaatttcattatgaagagtgaagactatctgtcgagcataagtgagtcaatccagtag

SEQ ID NO: 138013 - DNA, 2361 bp, Artificial Sequence
  Description of Artificial Sequence: Synthetic coding sequence
atgacaagcatattccacttcgccataatttttatgcttatcttacagataagaattcagctctcagaggaatccgaatttctggttgacagaagcaagaatgggctcatccacgtccctaaagacttgtcccagaaaactacaattctaaatatatcccaaaactatatcagcgaactgtggacctcagacatcctttcactaagtaagttaaggatcttgatcatctcgcataaccgcatccaatatcttgatataagcgtgtttaagtttaaccaagaactggagtacctggatctatcacataacaaactggttaagataagttgtcaccccacagtgaacttaaaacatctggacctgagcttcaatgccttcgacgccctgccaatctgcaaagaattcggtaatatgagtcagctgaagttcctgggcctgagtactacccacttagagaaatcatccgtcctccctattgcacacttaaacattagcaaagtgcttctggttctcggggaaacctacggagaaaaagaagatccggagggcttacaagactttaacactgaaagcctccatattgtctttccaacgaataaagaattccactttatcctggatgtgtcagtcaagaccgtcgccaatctggagctgagcaacatcaaatgtgtgctcgaggacaacaaatgtagctacttcctctcaattctggccaaactccagaccaatccaaaactctccaatctgacccttaacaatatagagacaacatggaactcattcatacgcatcctgcaactagtttggcacaccacagtgtggtacttctcgatcagtaatgtaaagctacaaggtcaattagacttcagggactttgactactctggaacttctctaaaagccctctctatccatcaggtggtgtccgacgtgttcgggtttccgcagagctacatctacgagatcttctcgaatatgaacatcaaaaatttcaccgtgtcagggacgcggatggtgcacatgctgtgcccaagtaaaatcagcccattcctacatttagacttttccaataatctcctgacagacacagtgtttgagaactgtgggcatctcaccgagctggagacccttatcctacagatgaaccagctcaaggagttgtccaagatcgccgagatgacgacacagatgaagtccctgcagcagctggatataagccagaactcagtctcctatgatgagaagaagggcgattgtagttggactaaatcgctcctgtcccttaacatgagctctaatattctcaccgacaccatcttccgttgtcttccccccaggattaaggtattagacctccactccaacaagattaaaagcatccccaaacaagtcgttaagctggaggccttacaagagctcaatgtggccttcaacagccttacagatctccccggctgcggttccttctcaagcctctcagtcttgatcatcgatcacaattcagtctcacacccaagcgctgacttttttcagagctgccagaagatgcgatcaattaaggccggagacaatccgttccagtgcacatgtgaattgggcgaattcgtcaagaacatcgatcaggtgtccagcgaagtgcttgagggctggccggactcctacaagtgtgattacccagagtcataccgtggaacactgcttaaggatttccatatgagcgaactgtcttgtaatatcaccctgctgattgtcacaattgtggccaccatgctcgtgctggccgtgaccgtcactagtttgtgctcatacctggatctcccatggtatttacgcatggtgtgccagtggacgcagacccgacgaagggcgaggaacatcccactggaggagctgcaacgaaacctgcagtttcacgcgttcattagctacagtggccacgatagtttctgggttaagaatgagctgctgccaaacctagagaaagaagggatgcagatttgcctgcacgaacgcaacttcgttcccggcaaaagtatcgtagaaaacatcattacctgcatcgagaagtcttacaaatccatcttcgtgctgagcccaaacttcgtgcagagcgaatggtgtcattacgaactctactttgctcaccacaacctatttcatgaaggcagcaactctttgatcctgatcctgctggaaccaatcccccagtattcgatcccctccagctatcacaaactgaagtctctcatggcaaggagaacatatctcgagtggccaaaagagaaatctaaacggggattgttctgggctaatcttagagccgctattaatataaagctgacagaacaggcaaaaaaatag

SEQ ID NO: 138014 - DNA, 2361 bp, Artificial Sequence
  Description of Artificial Sequence: Synthetic coding sequence
atgacatctatattccattttgctattatattcatgctgatactgcagattaggatccagctgtcagaggagtccgagtttctggtcgacagatcgaagaatgggctaattcacgtcccaaaggatctcagccaaaagactacgattctgaacatttcacagaactatattagtgaattatggactagcgatatccttagcctgtccaagctgcgaatactgatcattagccacaaccgaatccagtacctcgacattagcgtcttcaagttcaaccaggaacttgagtacctggatctctcgcataacaaactagtgaaaatcagctgtcacccaacagttaacctgaaacacctcgatctgtcattcaacgctttcgacgcactgccaatctgcaaagaattcggcaatatgtcacagctcaagtttctcggtctgagcactacacacctggaaaaatccagtgtcttacctatagctcacctcaatatatcgaaggtcctgttggtgttgggcgagacttacggcgagaaggaggacccagagggattgcaggatttcaataccgaatctctgcacatcgtattcccaactaataaagaatttcatttcatcctggatgtgtctgtgaagacagttgccaatctcgagctctcaaatatcaagtgcgtgctcgaggataataaatgtagttactttttaagtattctggctaaactgcagacaaatcccaagctttccaatctcacgctcaacaatatcgagaccacctggaattctttcatccgcatacttcagctcgtgtggcataccacggtctggtacttctcgatatctaacgtgaagctccagggacagttggatttccgcgattttgactatagcggcacctccctgaaagctttgtctatccaccaggtggtctccgatgtgttcggctttccgcagtcatatatatatgaaatattctcaaacatgaacataaagaactttactgtcagcggcacccggatggtacatatgctatgtccatctaagatttcaccatttctgcatcttgacttcagcaataaccttcttaccgacactgtgtttgaaaattgtggacacctgactgagctcgagaccctgatcctccaaatgaaccagctgaaagaattgtccaaaatcgctgagatgacaacccagatgaagtctctgcagcagctggatatatctcaaaactcagtgtcgtacgatgagaaaaagggcgattgctcgtggacgaagtcactgttgagcctcaatatgagctctaatattttgacggataccatttttaggtgtctgccaccccgcattaaggtgcttgacctgcattcaaataagataaagtccattcctaaacaagtggtcaagctggaagcactgcaggagctcaatgtagccttcaactccttgacagacctgcccggatgcggatcattctcttccctcagtgtcctgatcatcgaccacaactcagtgtctcatcctagtgccgacttttttcagagctgccaaaagatgcggtctatcaaagccggtgataacccctttcagtgcacctgcgagctgggtgaatttgtaaagaacattgaccaagtctcatccgaggtactcgagggatggcctgatagttacaaatgcgactatcctgagtcctatagaggtacacttctgaaggacttccatatgagcgagctctcctgtaacatcacattgcttatcgtaaccatcgtggcaaccatgttagtgctggccgtgacagtgacaagcctttgctcttatctggaccttccatggtacctgaggatggtctgtcagtggacacagactaggcggagagcccgaaacattcctctggaagaactgcagagaaaccttcagtttcacgcattcatatcttatagtggacacgattcattctgggttaaaaacgaacttcttcccaatttggagaaggagggaatgcagatctgtctccatgaacgtaatttcgttcccggtaagtccattgtggaaaacataataacctgcattgagaagtcttacaaatccatattcgtcctttctccaaactttgtgcagtcagagtggtgccactatgagctgtattttgcccatcacaacctgtttcacgaaggtagtaactcccttatactgatccttttggaacctataccccagtactctattccgtccagctaccacaagcttaagagccttatggcccgtcgcacttacctggagtggcccaaggagaagagcaagcgtggtttgttctgggcaaacctgcgtgccgcgatcaatataaagctgacagaacaagccaaaaaatag

SEQ ID NO: 138015 - DNA, 486 bp, Artificial Sequence
  Description of Artificial Sequence: Synthetic coding sequence
atgactagcattttccactttgccatcattttcatgctcattcttcagatccgcatacagctttcagaagaatccgagtttcttgtagacaggagtaagaacggcctcattcatgtcccaaaagacttgtcccagaaaacaacaattctcaacatctcccagaattacatttccgagctctggactagcgacattctgtctctttctaagctgcgtattctgatcatatctcacaataggatccagtaccttgatatctctgtgtttaagttcaaccaggagctggaatatttggacctgagccataataaattggtgaagattagttgccacccaacagtgaacctgaaacacctcgatctgagtttcaacgcattcgacgccctgccaatctgcaaggagtttggtaatatgagccaactaaagttcttaggtctaagcactacacacctggaaaaatcatcagtactcccgatcgcacactag

SEQ ID NO: 138016 - DNA, 147 bp, Artificial Sequence
  Description of Artificial Sequence: Synthetic coding sequence
atgacttctatttttcacttcgccatcattttcatgctgatccttcagatcaggattcagctctcggaggagtctgagttcctggttgacaggtctaaaaacggactgattcatgtaccaaaggatcttagtcagaaaactacgtag

SEQ ID NO: 138017 - DNA, 72 bp, Artificial Sequence
  Description of Artificial Sequence: Synthetic coding sequence
atgactagtatttttcacttcgctataatctttatgctcatcctgcagataaggatccagctgtcagagtag

SEQ ID NO: 138018 - DNA, 273 bp, Artificial Sequence
  Description of Artificial Sequence: Synthetic coding sequence
atgacgagcatttttcactttgcaatcatctttatgttgattctgcagattcgtatacagttatcagaggagagtgagtttctggttgataggtctaagaacggactgatccacgtaccaaaggatctgtcacagaaaacaacaatccttaatatcagccagaactacatcagcgagctgtggacgagcgacatcttgtcactttctaaactgcgaatcctgataataagtcacaacagaatccagtacttggatatatccgtgttcaaatag

SEQ ID NO: 138019 - DNA, 2355 bp, Artificial Sequence
  Description of Artificial Sequence: Synthetic coding sequence
atgccacatacattgtggatggtgtgggtgctgggtgtgatcatctcactgtcgaaagaagagtcaagcaatcaggcatctctgagctgtgataggaatgggatctgtaaaggcagctctggatctctgaacagtattccatccggcctcaccgaggccgtgaagtcacttgatctgagcaataaccgcatcacttatatctccaactcggatcttcagcggtgcgtgaaccttcaagcgctggtgctgacatcaaatggcattaatacgatcgaggaagatagctttagttcccttggttcattggaacacctggatttatcgtataactacctctccaaccttagttctagctggtttaaaccactctcttcattgacctttctgaacttactagggaatccatacaagacattgggcgaaacgagcctgttttcccatttaacaaagttacagatactgagagtaggtaatatggatacattcaccaagatccaaagaaaagacttcgctgggctgacatttctcgaagaattggagatagacgcctctgacctgcaatcttacgagcctaagtctctcaaatcaatccagaacgtttctcaccttattcttcatatgaagcagcatatcctgctgcttgagattttcgtggacgttacatcttcggtggaatgcctggaactgagagacacggatttagatacatttcactttagcgagttaagcactggcgagaccaatagtttgatcaaaaagtttacatttcggaatgtcaagatcactgacgagagcctctttcaggtgatgaagctgctcaatcaaatctctggattgctggagttagagttcgacgactgtaccttaaatggtgtaggaaactttcgtgcttctgacaacgatagagtaattgatcctgggaaggtcgagactttgaccattcggcgcctgcatattccacggttctatctgttttatgatctttcaaccctttacagcctgactgagagagtcaagagaatcacagtcgagaactctaaagtctttctggtgccttgtctgctttcacaacacctaaaatctctggagtatcttgacctgtccgagaatctgatggtggaggagtatcttaagaattcagcttgcgaagatgcctggccaagccttcagacactgattctgcgccagaaccatcttgcttcactagagaagaccggtgagacactgctaactctgaagaacctcactaatatcgatatttccaagaatagctttcacagcatgcctgagacatgccaatggcccgagaagatgaagtacctcaatctcagctctacccggatccattccgttaccggctgcataccaaaaacactcgaaattctggacgtaagcaacaacaacctgaaccttttttccctgaacttgcctcagcttaaggagctgtacatctctcgcaataaactgatgaccctccctgatgcgtcgttgttgccgatgttgctggtcctgaaaatctcccgcaacgccattaccaccttcagtaaagagcagctcgattctttccataccctgaagacactggaggcaggagggaacaacttcatctgtagctgtgaattcctgagcttcacccaagagcaacaggctctggccaaggttttgatcgattggccagccaattacctctgtgacagtcctagccacgtgagggggcagcaggtgcaagacgttcgtctgtccgtatcagagtgccatcgaactgccctggtgtcaggcatgtgttgtgcactgttcctcctgatcctgttaactggagtgctatgccacaggtttcatggcctgtggtatatgaaaatgatgtgggcatggctgcaggctaagaggaagccaaggaaagccccaagccggaatatttgctacgatgcattcgtgtcctactctgagagagacgcgtactgggtcgagaatcttatggttcaggagttggagaactttaacccacccttcaagctgtgtctccacaaaagagactttatccccgggaaatggatcatagacaacatcatcgactcaatagaaaagagccataaaacagtgtttgtccttagtgagaacttcgtcaaatccgagtggtgcaagtatgaactggacttctcccatttcaggcttttcgacgagaacaacgatgcagccatcctcatactcctcgagcccatcgaaaaaaaggcgataccgcagagattctgtaaactaaggaagataatgaacaccaaaacctaccttgagtggcccatggacgaagcccagcgggagggattctgggtaaacttgagagcagccattaaaagctag

SEQ ID NO: 138020 - DNA, 2715 bp, Artificial Sequence
  Description of Artificial Sequence: Synthetic coding sequence
atgcgccagactcttccctgtatttacttctggggcggcctcctaccatttgggatgctttgtgccagctctacaacaaagtgtacagtgtcccacgaagtggcagactgctctcaccttaaactcacacaggtgccagacgacctgccaactaatatcactgtcctgaatctgacccataatcagctacgcagactacccgctgccaatttcacacggtatagccagctaacttcacttgatgtgggattcaacaccatttcaaaactggaacctgagctctgccagaagctgccgatgctgaaggttctgaatcttcagcacaacgagcttagccagctgtccgacaagacctttgccttttgtacaaatttaacagagctccacctgatgtctaattcaattcagaagataaaaaataatcctttcgtgaaacaaaaaaatcttatcacccttgacctctcacacaatggcctgagttccaccaagctgggcacccaagtccagctggagaacttacaggagcttctgctgagcaacaacaagatccaggcgttaaaaagcgaggaactagacatatttgctaactcgtccctaaagaagttggaactgtcctcgaaccaaattaaagagttttcccctggctgttttcacgcaatcggacgtctgttcgggctctttttgaacaatgtccagctgggtccatccttgactgaaaagttgtgcctagagcttgccaacacttcgatacggaacttatccctgagtaactcacagctcagtacgacctcaaataccacctttctggggctgaagtggactaaccttacgatgttagacctatcctacaataaccttaatgtggtcggtaacgatagctttgcctggcttcctcagctcgagtatttcttcctggagtacaacaatattcaacacctcttcagtcacagtctacatggccttttcaacgttcgctatctgaacttaaagagaagcttcactaaacagagtatctcccttgcatctcttcctaaaattgacgatttttccttccagtggcttaagtgtctcgaacacctcaatatggaagacaacgacatccctggcataaagtccaacatgttcactggcctcattaacctcaagtatctctcattgtctaactcattcacctctctgcggacactcacaaatgagacctttgtgagtcttgcccactctcccctgcacatcttaaacctcacaaaaaacaagatttccaagatcgaaagtgatgcgttttcctggctggggcatttggaagtcctggacctcggacttaacgaaatcgggcaggagcttaccgggcaggagtggcggggtctggaaaacatcttcgagatctacctctcttacaacaaataccttcaattgacacgcaattcattcgccctggtacccagcttacagaggctcatgttgaggcgcgttgctctcaaaaatgtggacagcagcccatcccctttccagcctttgcgaaacttgacgatactagatctgtcaaacaacaacatagccaatattaatgatgacatgcttgaggggctggaaaagctggaaatcctcgatctgcagcataacaatctggcccgcctttggaaacatgcaaatcctggtggaccgatctatttcctgaagggcttatctcatctccacatcctgaacctagaaagcaacggcttcgatgagataccagtggaggtattcaaagacctgtttgagctcaagatcattgaccttggtttgaacaatctcaacaccctgcctgcctccgtgtttaataatcaggtgagcttgaagtcactgaacttacagaaaaaccttatcacaagcgtggaaaaaaaggtgttcgggcccgcttttaggaacctcacagagctcgacatgcgctttaaccccttcgactgtacatgcgagtctattgcctggttcgtcaactggatcaatgagactcacaccaatattcctgagctatccagccactatctctgcaacaccccaccacactatcatggattccccgtgagattgtttgatacatccagttgcaaggatagcgctccattcgagctgttctttatgatcaatacaagcatactgcttatctttatctttatcgtcctactcattcacttcgagggatggcgcatatctttttactggaatgtcagcgttcacagggttctagggtttaaggagatcgaccggcagaccgagcagttcgagtacgctgcctacataatccacgcctacaaggataaggactgggtgtgggagcatttctcgtccatggaaaaggaagatcagtctcttaaattttgtctggaggaacgtgacttcgaagctggcgtctttgagcttgaggcaatcgttaatagtataaagcgctctcggaagatcatatttgtaataacgcaccatctccttaaggaccccctctgtaagcggtttaaggtgcaccatgccgtgcagcaggccatcgagcagaaccttgacagtatcatcctagtcttcctcgaggaaatccctgactacaagctcaatcatgccttatgtcttaggcgaggtatgttcaagagccactgcattttgaattggccggtgcagaaggagcggatcggtgctttccgacacaaactgcaggttgcactggggtctaaaaattcggtccattag

SEQ ID NO: 138021 - DNA, 1884 bp, Artificial Sequence
  Description of Artificial Sequence: Synthetic coding sequence
atgctggacctttcttacaataatttaaacgtcgttggtaacgatagttttgcttggttgccgcagctggagtacttcttcttggaatacaacaatatacagcacttgttctctcacagtctgcacgggctgtttaatgtgaggtatctaaatttgaagagatcttttaccaagcagtctatcagtctcgcatctctgccgaagatagatgattttagctttcagtggctcaagtgtctggaacacctgaatatggaggacaacgacatacccgggataaagagcaacatgtttactggcctgattaacttgaagtatctctctctatccaatagtttcacatccctgcggacattgacaaacgagacatttgtttcactcgcccactcacccctacacatactcaatctgacaaagaacaaaatttcgaagattgagagtgacgcttttagctggctaggccacctcgaggtccttgatctcgggcttaacgagatcggccaggaacttaccgggcaagaatggcggggtttggagaatattttcgaaatttacctatcttacaacaagtatctacagttgactcggaattcattcgcactggtaccctctttgcagcgcctgatgcttcgccgagtggccctcaaaaacgtggacagctccccaagccccttccagccattacgtaacctcaccatcttggatctttccaacaacaatattgccaatattaatgacgacatgctggagggcctggagaagttagagattctggatctgcagcacaacaacctggcccgcttatggaagcatgctaatcccgggggaccgatctatttcctcaaaggtctcagtcaccttcacatcttaaacctcgaaagcaacggattcgacgaaataccagtcgaagtgtttaaggacctgttcgaactgaagatcatcgatctgggcttaaacaatctgaataccctgcccgctagtgtgttcaacaatcaggtgagtcttaaaagcctgaacctccagaagaatctgataacctccgtagagaagaaagtctttggtcccgcctttcggaatcttaccgaactggacatgaggtttaatcctttcgattgtacctgcgaatcaatcgcctggttcgtgaactggatcaatgaaacccacactaacatccccgagctatcatctcactacctgtgcaatactccaccccattaccacggtttccccgtcagactgttcgacacatcttcatgcaaggacagtgctccgttcgaactgtttttcatgatcaatacatctatcctgctgatcttcatctttatcgtcctgctgatccacttcgaagggtggcggatttcattctactggaatgtctccgtgcatagagtgctcgggtttaaagagatcgaccgccagactgagcaatttgagtatgcggcatacatcatccacgcatataaagataaggactgggtgtgggagcatttcagctcaatggagaaggaagatcagtccctaaaattctgtttagaggaaagagatttcgaagctggagtttttgaactggaggccatagtaaatagtatcaagcgttcaaggaaaataatttttgttattactcaccacttgttaaaggatccgctttgtaagcggttcaaggtgcaccatgctgtgcagcaggccatcgaacaaaatctcgattccattatcctagtgttcttagaggagatccccgactacaaactgaaccacgccctgtgccttcggagaggtatgtttaagtcacattgcatcctgaattggccggttcagaaagagaggattggggctttccgccataaactgcaagtcgctcttggctcaaagaacagtgtgcattag

SEQ ID NO: 138022 - DNA, 2613 bp, Artificial Sequence
  Description of Artificial Sequence: Synthetic coding sequence
atgcggcagacactgccatgtatctacttctggggagggttactgcctttcggcatgctctgtgcctcctctacgaccaaatgtacagtcagccacgaagtggccgattgtagccatcttaaactgactcaagtcccagacgatctgccaacaaatatcactgtcctcaatctgacacacaaccaactgagacgactgcctgcagccaacttcacaaggtatagtcagcttacttctttggatgtgggatttaacacaatcagcaaactggaacccgagctttgccaaaaactgcctatgcttaaggtgctcaatcttcagcacaatgaactctcccaattgagcgacaagaccttcgcattctgcacaaatttgaccgagctgcatctcatgagcaatagtatccagaagattaaaaataatccatttgtgaagcagaagaatcttattactttggatttgagccacaacggactcagctctacgaagctgggtacccaggttcaactcgaaaacctacaggagctccttctgagcaacaacaaaattcaggctctgaaatcagaagagctagatattttcgcaaactcatctttaaagaagcttgaactgtcctctaaccagatcaaggagttttctccgggatgttttcatgcgattgggaggttgttcggcctcttcctcaataacgtacagctcggcccttctttgaccgaaaagctgtgtcttgaacttgccaacacatctattcgcaacctgtccctgagtaatagccaactctcaaccacttccaacacgacttttctcgggcttaaatggaccaacctgaccatgctcgacctttcttataataacctgaacgtagtcgggaatgacagctttgcatggctgccccagctggaatactttttcctggaatacaataacattcagcacctgttctcccattctctgcacgggctatttaacgttagatatctgaatctgaaaaggtcatttaccaagcagagcataagtctcgcttctctacctaaaatcgatgacttctcttttcagtggctcaaatgcctagagcacctcaatatggaggataatgacataccaggcattaagtcgaacatgttcaccgggcttattaatttaaaatatctaagtctctctaactcatttacatccctccggacactcacgaacgagacatttgtgtccttggctcacagtcctctccacatcctgaatttgactaaaaataagatctccaaaatcgagtccgatgccttttcttggttggggcacttggaggtgctggacctgggactgaacgagatcggccaggaactgaccggccaggaatggagaggactggagaatatctttgagatctatctgagttacaacaagtacctgcagctcacccgcaacagctttgctctagtccccagtctacagcgtctgatgctcaggcgggtcgcccttaagaatgtcgattctagtccatccccctttcagcctcttcgcaacttaactatcttggacttgtccaataacaatattgccaacatcaatgacgatatgcttgaaggactggagaaattggaaatcttagacttacagcacaacaacctggctaggctgtggaagcacgcaaaccccggcggtcccatctatttccttaaagggctaagccacctccacatcctgaatctcgagagtaacgggtttgatgagatacctgtcgaagtgtttaaagatctttttgaactgaagattattgaccttggactcaataatcttaacactctgcctgcatctgtcttcaacaaccaggtgtctctgaaatccctcaatcttcagaagaatctgatcacatccgtggaaaagaaagtctttggacccgcctttagaaacttaacggaactcgatatgagattcaatccttttgattgcacatgtgagtccatcgcttggttcgtgaactggattaatgaaacccacactaacattccagagctcagctcacattatctctgcaatacccccccacactatcatggatttccggtacggctcttcgatacatcatcttgtaaggacagtgccccttttgaactgtttttcatgataaacacaagcatacttctgatcttcatatttattgtcctcctcatccattttgagggctggcgcatcagtttctactggaatgttagcgtgcatcgcgtgctcggctttaaagaaatcgaccgacagacggagcagttcgagtacgcagcttacataattcacgcctataaggataaggattgggtctgggagcacttctcgagcatggaaaaagaggatcagtcactgaagttttgccttgaagagagagattttgaggccggagtcttcgaacttgaggcgatagtgaacagtatcaagcgatctagaaagattatctttgtaatcactcatcatctgttgaaggaccctctttgtaagcgatttaaagtgcaccatgcggtccagcaggccatcgagcagaacctcgacagtatcatcttggtgtttctggaagagatccctgactacaaactgaaccacgccttatgcctgcgccgggccaagtag

SEQ ID NO: 138023 - DNA, 2391 bp, Artificial Sequence
  Description of Artificial Sequence: Synthetic coding sequence
atgacaaaagataaggagccaatcgtcaaatcttttcacttcgtctgcttaatgattatcattgttgggaccagaatccagttctccgacggcaatgagtttgcagttgacaagtcgaagcgcggcctgatccacgtgccgaaggatctccccctcaaaacaaaggtgctggacatgagccaaaattacattgcggaactgcaggtgagtgatatgagctttctctcagagctaaccgtcctcagattgtcacataaccgtattcaattattagacctgtcggtgttcaagttcaaccaggaccttgagtacctggacttatcccacaaccaactgcaaaaaatctcctgtcaccccatcgtgtccttcagacacctggatctaagcttcaatgatttcaaggctttacccatctgcaaggagtttggtaatctgtctcaactgaatttccttggtctttccgcaatgaaattacagaagttggaccttctgcctatagctcacctccatttgagttatattttactcgacctgcggaattactacatcaaagagaacgaaaccgagtcactgcaaatcctgaatgccaagaccctgcatctcgtttttcaccctacaagtctgtttgccatccaggttaatatttctgtgaatacgcttggctgtctccagctgaccaatatcaaactcaatgacgacaactgccaggtcttcatcaaattcttaagtgagctgactcgggggtcaacactgctgaatttcaccctgaaccatatcgaaacaacctggaagtgcctggtgcgggtgttccagttcctctggcctaaacctgttgaatatctaaatatttataacctcactatcattgaatccatccgcgaagaagattttacttacagcaagacgaccttaaaggcccttacaatcgaacatatcaccaatcaggtattccttttttcacagaccgcgttatacaccgttttttctgagatgaatattatgatgctgactatatccgacacccctttcatccacatgttgtgccctcacgctcccagtaccttcaaattccttaacttcacacagaacgtttttacagacagcatcttcgaaaagtgtagtacgctcgtaaaactggagacgctcattcttcagaagaacggactgaaggacctcttcaaagtgggtctgatgacaaaggacatgccatcccttgagatcctggacgtctcttggaacagcctcgagagtggcaggcataaagagaattgcacttgggtcgagagcattgtggtgttgaacttgagctctaatatgctcacagatagcgtgttcaggtgcctgccgccccgcatcaaggtgttggacctccactctaataaaatcaagtctgtgccaaagcaggtcgtaaagctggaggcactccaggagctaaacgtcgcctttaattcactcactgacctccccggatgtggatctttttcctctctaagcgtgctgattatcgaccacaactcagtctcacatccctccgctgatttctttcaatcctgccaaaaaatgaggtccatcaaagcaggagacaaccctttccagtgtacatgtgagttgagagagtttgttaagaatattgatcaagtttctagtgaggtgctggaaggatggccggactcctacaaatgtgactatcccgaatcctaccggggatcacccctaaaggactttcacatgtcagaactgagctgtaatataactctactgattgttaccattggggccacgatgctcgtcttggctgtgacagtcaccagtctgtgcatctacttggacctgccatggtacctccggatggtgtgtcaatggacccaaaccagaagacgcgcacgaaatatcccattagaagagctccagcggaatctacagttccacgctttcatctcttactcagaacatgactcagcttgggtcaaatcggaactggtaccctatttagagaaggaggacatacagatttgcctccacgaaaggaacttcgtgccaggcaagagcatcgtagagaatattatcaactgcatcgaaaagtcttacaagagcatttttgtactgtccccaaactttgtccagtcagaatggtgccactacgagctgtacttcgctcaccacaacctgtttcacgagggctccaataacttgattctgatcctactggagcctattccccagaattcaatccccaacaaatatcacaagctcaaggccctcatgacccaaagaacctacctgcaatggcctaaagaaaaaagtaagcgggggctgttttgggccaacattagggcagcgtttaacatgaagctcacactcgttacagagaataacgacgtcaagtcctag

SEQ ID NO: 138024 - DNA, 2391 bp, Artificial Sequence
  Description of Artificial Sequence: Synthetic coding sequence
atgaccaaagataaagagccgattgtgaagtcattccatttcgtgtgcctcatgattattattgtcgggactcggattcagttttctgatgggaacgagtttgcggtggataaatcaaaaagaggcctaatacacgtgcctaaggatctgccactgaaaaccaaagtgctcgatatgagccagaactacattgcagaattgcaggtctccgatatgagctttctgtccgaattgaccgtactgcggctttctcacaaccgaattcaacttttagatctgagcgtgttcaagttcaatcaagacctggagtacctagatctgtcccacaaccaattacagaaaatcagctgccacccaattgtctctttccgccacttggatctcagtttcaatgacttcaaagcactgcccatttgtaaggaattcggcaatttaagtcagctgaattttctcggcctatccgccatgaagctccagaagctcgaccttcttcctatcgctcacctgcatctttcttatatcttgctcgacctgaggaactattacatcaaagagaatgagactgagtccctccagattctgaatgccaaaacactccacctggtgttccatcccaccagcctctttgcgatccaggtgaatatttccgtcaacactctggggtgtcttcaactcacgaatattaagctcaatgatgataactgccaggtctttatcaaattcctgagtgaactgacgagagggtcgaccctcttaaattttaccctcaatcatatagagaccacatggaaatgcctggtccgcgtcttccagtttttgtggccgaaacctgtggagtatctcaacatctataatcttactatcattgagagcatccgggaagaagatttcacctactctaagactaccctaaaggcactgacaattgagcatatcaccaaccaggtctttctatttagccagaccgctctctacactgtcttcagtgagatgaacattatgatgctgaccataagcgatactccattcatccatatgttgtgtccacacgccccatcaacctttaagttcctcaatttcactcagaacgtgttcacagactccatattcgagaagtgtagcaccctggtcaagctggagacactgatcttgcaaaagaacggtctgaaggacttatttaaggtgggcctgatgaccaaggacatgcctagccttgaaatactagatgtctcttggaattcattggagagtggaagacacaaggagaattgcacgtgggtagagagcatcgtggtcctgaatctctcctctaacatgctgactgattcggtttttaggtgcctcccaccacgcattaaagttttggaccttcacagcaataagataaaatccgtcccaaagcaagtagtgaagctcgaggcccttcaggagctgaacgttgcgtttaactccttaaccgatttgcctggttgtggctcattcagctcactgtctgtgctgattatcgatcataacagcgtctctcacccttcagccgacttctttcaaagctgccagaagatgcgctcaattaaggccggtgacaatcctttccagtgcacttgcgagcttagagagttcgtcaagaacattgatcaagtgtcctccgaggtcctggagggctggcccgattcatacaagtgcgactaccccgagtcctatcgtgggtcaccattaaaggattttcacatgtctgagctgagttgtaacatcaccctcttaatcgttacaataggcgctacgatgctggtgcttgccgtgaccgtgacctcattgtgtatttatctcgacctgccttggtatcttcgaatggtgtgccagtggacacaaacaagacggagagcgcgtaatatccctctggaagaattgcagcggaatctacaattccacgcctttatttcctactcagaacacgatagcgcctgggttaaaagcgagctggtcccctacttggaaaaggaggatattcagatttgcttgcacgagcggaacttcgtgccaggcaagtccatcgtggagaatattatcaactgcattgaaaagtcctataaatctatatttgtgctgagccccaatttcgtacagtcggagtggtgccattatgaactgtactttgcacatcataacttgtttcatgagggcagcaacaatctgatactcatccttctcgaaccaattccccagaattccatccccaacaaataccataagctaaaagccctgatgacccaaaggacatacctacagtggccaaaggaaaaatccaaaagagggctattctgggcaaacattcgggccgcctttaatatgaagcttacactagtaactgaaaataacgatgtcaagtcctag

SEQ ID NO: 138025 - DNA, 453 bp, Artificial Sequence
  Description of Artificial Sequence: Synthetic coding sequence
atgaccaaggataaagagcccatcgtgaaatcttttcactttgtgtgccttatgatcattatcgtggggacacgcatccagttcagtgacggcaatgaattcgctgttgacaagagtaagcgtggactgatccatgttcctaaggatttaccccttaaaacaaaagtactcgatatgagtcagaactatatagccgagcttcaggtgtcagacatgagcttcctgtccgaactgacagtactcaggttgtcccataatagaattcagctactggacctctctgtatttaagtttaaccaggatctcgaataccttgatctgtctcacaatcaacttcagaagatctcttgccatcccatcgtctcctttagacacctggacctgtccttcaatgattttaaggccctgcctatctgcaaggagttcgggaatttgtcacaactgaatttttag

SEQ ID NO: 138026 - DNA, 1443 bp, Artificial Sequence
  Description of Artificial Sequence: Synthetic coding sequence
atgaccaaggacaaggagccaattgtgaagtctttccacttcgtgtgcctcatgattattatcgttgggacccgaatacagttctccgacggcaatgagttcgcagtagacaaatcaaaacgcgggcttattcatgtgcccaaagacctcccactgaaaactaaagtcttggatatgtcgcagaactacattgccgaactccaggtctctgacatgtcgttcctctctgaacttacagtcctaagactgtctcacaataggatccagttgctagatctcagcgtttttaagttcaaccaagacctggagtacctcgacctctcccataaccagctgcagaaaatttcatgccaccccatcgttagctttcggcatctcgacctgagctttaacgacttcaaggcgctgcccatttgcaaggagtttggcaatctgtcccaactgaatttcctcgggctgtcagcaatgaagctgcagaagttggacctccttcctatcgcccatctgcacctcagctacattttattggacctgaggaactattacattaaggagaacgagacggagtcgctacagatcctgaatgctaagacgctgcacctggtgtttcacccaacatccctttttgccatccaggtgaacataagcgtcaataccctcggatgtcttcagttaacaaacataaaactgaatgatgataactgccaggtgtttattaagttccttagtgaactgactagaggatcaacacttctgaactttacgcttaatcatatcgagacaacctggaaatgtttggtgcgcgtcttccaatttctctggcccaaacctgtggagtacctgaacatctataacttgactataatcgagtccatccgcgaggaggatttcacttactcgaaaacaactcttaaggctctgactatcgaacatatcactaaccaagtgtttttgttttcccagaccgccttgtataccgttttttcagagatgaatatcatgatgctgaccatctcagatacccccttcattcacatgctgtgtccacacgctccatctaccttcaaattcctcaacttcacccaaaatgtcttcacagacagcattttcgagaagtgtagcaccctagtgaaacttgaaaccctgatctttgttctgtctccaaactttgtgcagtctgagtggtgccactatgaattgtattttgcacaccataacctattccacgaagggagcaataacctgatcctcattctgctggaacctattccccaaaatagcatcccaaacaagtatcacaagttaaaagcgctaatgacccaaaggacttaccttcagtggccgaaggaaaagtctaagcgcggactgttctgggcaaatatcagggctgccttcaacatgaagctgaccctggttacggagaataatgatgtaaagtcttag

SEQ ID NO: 138027 - DNA, 276 bp, Artificial Sequence
  Description of Artificial Sequence: Synthetic coding sequence
atgactaaggataaggaacctattgtgaaatcttttcatttcgtttgtcttatgataattattgtaggcactcgtatacagttcagcgatggcaacgaattcgctgtggacaagtcaaagcggggactgatacatgtgcctaaagatctcccgctgaaaactaaggttcttgatatgtcccagaactacatcgccgagttgcaggtttcggacatgtcctttttgtcagaactgacagttttacggctttcccacaatcgcattcaactgctgtag

SEQ ID NO: 138028 - DNA, 3150 bp, Artificial Sequence
  Description of Artificial Sequence: Synthetic coding sequence
atggttttcccaatgtggacgctgaaacgccagatcctcatactgttcaatatcattctcatctccaagctgctcggagcacgctggtttcctaaaactctcccatgtgatgtgactcttgacgtgcccaaaaatcacgtcatcgtggactgtacggacaaacacctaactgagataccgggcggcatacctactaacactaccaacctcactctcactatcaatcacatcccagacatctcacccgccagttttcataggctggaccatctagtcgaaatcgatttccgatgcaactgcgtgcctatcccactgggcagcaagaataacatgtgtattaaaaggttacagatcaaacctagaagcttttcaggtttgacatacctgaaatccctatatctggacggcaaccaattactggagattccccaggggcttcccccttcactgcagttgctgtcacttgaggccaacaacatttttagcatcaggaaggaaaacctgaccgagctggctaacattgaaattctgtaccttggacagaattgctactacagaaacccatgctatgttagttatagcattgagaaagatgccttcctgaacctgaccaaattaaaagtgttatccctgaaggacaataacgtgactgcagtccctaccgtactgcctagtacgctcaccgagctgtacctttataacaatatgattgccaagatccaggaggatgattttaacaacctgaaccagctgcagatcctggatcttagcggcaactgtcctcggtgctacaacgcacccttcccttgtgccccttgtaagaacaattctcccctccagatccccgtgaacgccttcgacgcattgacggaattaaaagtgcttcggttacatagtaatagtctacagcacgtgccccctaggtggtttaagaatataaataaactgcaggagctcgatctgtcacaaaacttcctggcaaaggagattggcgatgccaagtttctgcactttttgcctagtcttatacagcttgacctgtcattcaacttcgagctccaagtgtaccgagcaagtatgaatttgtcacaggctttctccagccttaagtctctcaaaattttgcggatccgcggatatgttttcaaagagctgaaatccttcaatctgtccccactgcacaatttgcaaaacctcgaagtgcttgacctcggcaccaactttatcaaaattgctaatctgtccatgtttaagcagttcaagcgcctcaaggtgatcgacctaagcgtgaataaaatttcccctagtggcgattcgtctgaggtgggtttctgttctaatgctagaacatccgtggaatcctatgaaccacaggtgctggagcaactgcattacttccgctacgacaagtatgcccggagttgccgatttaagaacaaggaggcaagcttcatgtctgtgaacgaatcctgctataagtacggacagacattggacctgagtaagaattccattttctttgtgaagtcctcagacttccagcacttgtcctttcttaagtgcctgaatttgagtggcaacctaatctctcagacgttgaacgggtccgaatttcagccactggcagaactcaggtatttggacttttcaaataaccgcctcgatctgctgcactccactgctttcgaggaactgcataagctggaagtcttggacatctcctctaattcccactacttccaatctgaagggataacccacatgcttaattttactaagaatctgaaagtgctacagaaacttatgatgaacgataacgacatcagttcttccaccagccggacaatggagtccgaaagcctgcgtacactggaatttcgaggcaaccaccttgacgtgctgtggagagagggcgacaaccgctatctacagcttttcaagaacttgctgaaactcgaagaactcgatattagcaagaactccctgagcttcctgccttccggagtgttcgacgggatgccacctaacctgaagaacctcagcctggcaaagaatggcctgaagtccttctcctggaaaaagctgcaatgtctgaagaatctagagaccttagacctttcacacaatcagctgacaacagtgcccgagaggctatcaaactgctccagaagcttaaaaaacctgatcctgaaaaacaaccagatccggtccctcaccaagtacttcttacaggatgcatttcagctgaggtacctcgatctcagcagcaacaagatacagatgatccagaaaacctccttccccgagaacgtgctcaataatctgaaaatgttgctcctccaccataaccgctttctttgtacctgtgatgcagtgtggtttgtgtggtgggtgaatcacacagaggtcaccatcccctatttggccacagacgtgacatgtgtgggccctggagctcacaaaggccagagtgtgatttccctggatctctacacttgtgaacttgacctgacgaatcttatactgttttcccttagcataagtgtaagtctgttccttatggtcatgatgaccgccagccatctctacttctgggatgtgtggtatatttaccatttctgtaaagccaaaataaagggctatcaacgtctgattagccccgattgttgctatgacgccttcatcgtttacgacaccaaggaccctgccgtcaccgaatgggtgctggcggagctcgtggcaaagttagaggacccacgcgagaaacactttaatctgtgcctggaagagagagactggcttcctggacagcctgtgctggaaaatctcagtcagagcattcagctgtctaaaaaaaccgtgttcgtgatgacagataagtacgcgaaaactgagaattttaagatcgcattctatttgagccaccagcgccttatggacgaaaaagttgatgtcatcatcctgatcttcctggaaaagcccttccagaagtctaaatttctccagctgcgcaaacggctgtgcggatcgtccgtactggaatggccaacaaatccccaggcgcacccctatttctggcagtgtctaaagaacgccttagctaccgacaaccatgttgcctattcccaggtattcaaggaaactgtgtag

SEQ ID NO: 138029 - DNA, 1074 bp, Artificial Sequence
  Description of Artificial Sequence: Synthetic coding sequence
atgcgcagacagctgaggagcagacgggccccctcatttccttactcatatcggtaccgcctggatgacccagacgaggcaaatcaaaactacctcgcagacgaagaagaagaggctgaagaggaagccagagtcaccgtcgtgccgaaatctgaggaagaggaggaggaagaggaaaaagaggaggaggaggaagaagagaaggaggaggaagaaggccaagggcagcctaccggcaatgcctggtggcagaaactgcaaattatgagcgagtacctgtgggacccggagcggcgtatgtttttagcgagaactggtcagtcctggtccctgatcctacttatttacttctttttttacgcgtctcttgctgccgttattactttgtgcatgtacacgctgttcctgaccatctccccgtacataccgacgttcacggaacgggtaaaaccgcccggtgtgatgattcggccttttgcccatagcctgaacttcaattttaatgtaagcgagccagacacttggcagcactacgtgatttcactgaatggctttttgcaggggtacaacgatagcctccaggaagaaatgaacgtagactgtccccctggtcagtatttcattcaagacggtaacgaggacgaagataaaaaagcttgccagtttaaacgatcttttcttaagaattgttctggtttggaagatccgacttttggctacagtactggccagccatgcatattgctcaagatgaaccggattgtcgggtttcggcccgagttgggcgaccccgtgaaagtttcttgcaaagtccagaggggagatgaaaatgacataaggtcaataagctactatccggagagtgcaagttttgatctacggtattatccctattacggtaagctcacacatgttaactataccagtcccctggtggcaatgcacttcaccgatgttgtgaaaaaccaggccgtgcctgtacagtgccagctgaaaggcaagggtgtcatcaacgatgtcatcaacgacagattcgtgggccgggtgatattcaccttaaacatcgaaacatag

SEQ ID NO: 138030 - DNA, 3180 bp, Artificial Sequence
  Description of Artificial Sequence: Synthetic coding sequence
atgaaagagtcatccttgcagaactctagttgtagtctgggcaaggagaccaagaaggagaatatgttcctccagagctctatgctgacttgcatttttcttctcatcagtggaagctgtgagctatgcgccgaagaaaacttttctaggtcttacccttgtgatgaaaaaaagcagaacgacagcgtgatagccgagtgctctaatcgccggttgcaggaggtcccccaaaccgttggcaagtatgtaactgagctggatctgtccgacaatttcattacacacatcacaaatgaaagcttccaaggccttcagaatttgactaaaattaatctgaatcataacccaaacgtgcagcaccagaacggcaatccagggatccagagtaatggactgaacattaccgatggcgcttttctgaacctgaagaatttacgagaactgcttctggaggataatcagttgcctcagattccctccggcttacccgagagtctcactgagctgagcctgatccaaaacaatatttataacattacaaaagagggaatctctcgactgatcaatcttaagaatctgtacctggcctggaactgttacttcaataaggtttgtgaaaagacgaatatcgaggatggagtgttcgagacattgacaaatttagagctcctgtccctgtccttcaacagcctctctcacgtcccccccaagctgccatccagtctgagaaaacttttcctctccaacacccagattaaatacatcagcgaggaagactttaaaggactaataaacttgacactccttgatctgagcgggaattgtccgcggtgtttcaatgctccattcccgtgcgttccatgcgatgggggcgcttccatcaacatagacaggtttgcgtttcagaatctcacccaattgaggtatttaaacctcagcagtacctccctgcggaagatcaatgcagcctggtttaagaatatgcctcacttgaaggtattggatctggagtttaattaccttgtgggagagatcgcaagcggcgcctttctaaccatgctcccgaggctggaaatcctggacctgtctttcaattatatcaagggtagttacccacagcacataaacatatctcgaaatttttcaaaactgcttagcctgcgtgccctccacctacgaggctatgtcttccaggagctcagggaagatgactttcagcccctaatgcaactgccaaatctgtctacaattaacctgggtataaatttcatcaaacagatcgatttcaagctcttccaaaatttctcgaatctggagatcatctacctcagcgagaaccgaatttcccccctggttaaggatactcgccagagttatgctaatagcagctctttccaacgccatattcgaaagagacggagtactgactttgagtttgatccccattccaatttctaccactttacccggccccttatcaagccccagtgcgctgcatatgggaaagcacttgacctatccctcaatagcatcttctttattgggcctaaccagttcgaaaatctgcctgatatcgcctgcttgaacctgtcggcaaattcaaacgcccaggtgctgagtggcaccgaattttcagccattcctcacgtcaaatacctagatctcaccaataaccggctcgacttcgacaacgcctctgccttgacagagctgtccgacctggaagtgctggacctgagctataatagtcactattttcgtattgcaggggttacgcaccacctggagttcatccagaatttcactaacctaaaggttctgaacctcagtcataataacatttacaccctaaccgacaaatacaatctcgaatctaaatccctcgtagaactagtgttcagcggaaatcgattggacattctgtggaacgatgacgataatcgatacatttcaatttttaaagggttaaaaaacctgaccagattggatctgtccctcaaccggctgaagcatatccccaatgaagcttttctcaatctgccggcatcgctgacagaactccatataaatgataatatgctaaaattttttaactggacccttttacagcaattccctcgcctagagctcctggacttacgcggcaacaaattactgttcctgacagacagtttgtctgatttcacttcttctctgcgcactctactcctctctcacaaccgaattagtcatctcccatccggttttctatcagaagtgtcctcgctgaagcatctcgatctttcctccaatctgttgaagacaattaataagagcgctctcgagaccaagaccactaccaaactgagcatgctggagcttcatggtaacccctttgagtgcacttgcgatatcggtgacttcaggagatggatggatgagcacctcaatgtgaagattcccagactggtcgacgtgatctgtgctagtcctggcgaccagaggggaaagtctatcgttagcttagaactcaccacatgcgtgagcgacgttactgctgtcatactgttctttttcacctttttcattaccactatggtaatgcttgcagccctggcacatcacctcttctattgggacgtgtggtttatttataacgtgtgcctcgctaaagttaagggctatagaagtctgtctacatcccaaactttctacgatgcctacatatcttacgatacaaaggatgcaagtgtcacagattgggtgataaatgagctgaggtaccacctggaggagagtagagataaaaacgtcttgctctgtttagaggagcgcgattgggacccaggcctggccatcatagacaacctgatgcagtccattaatcaaagcaaaaagactgtcttcgtcctgactaaaaagtatgcaaagagttggaacttcaaaacggccttctacctagcccttcagcgcctgatggatgaaaatatggacgtcatcatcttcatcctcctggagcctgtgctgcagcatagtcagtatctcagactgcgacagaggatctgtaaatccagtatcctgcaatggcccgataatccaaaggctgagggactattctggcagactctcagaaatgtggttctcacagagaatgattcccgttataataatatgtacgtggatagtattaagcagtactag

SEQ ID NO: 138031 - DNA, 3099 bp, Artificial Sequence
  Description of Artificial Sequence: Synthetic coding sequence
atgggcttttgtagatcggcactgcacccactatctctcctcgtgcaggccatcatgttagcaatgaccttagccttgggaacactacctgcattcttgccctgtgaactgcaacctcatggtctcgtcaactgcaactggcttttccttaagagtgtcccacatttcagcatggcagctccaagggggaatgtgacttctttatccctgtcctctaatcggattcaccatttacatgatagcgactttgcgcacctgcccagcttgcgccatttaaatctcaagtggaactgccctcccgtgggcctctctcctatgcacttcccatgccatatgactatcgagccctcgacatttttggccgtgcccactctcgaagagcttaatctgtcatacaataacattatgacggttccggcccttcctaaatctctgatctccctgtcactcagccatacaaacatcctgatgttggactctgcaagcctcgcaggccttcacgcccttcgctttttatttatggacggtaattgttattataagaacccatgtcggcaagctttagaggtcgctccaggggcactgctcggactagggaatcttacgcatctgagcctgaagtacaataacctaaccgtcgtgcctcgaaacctgccttcttcccttgagtacctcctcctgtcatataacaggattgtcaagctggcaccagaggacctggcaaatctcacagccctcagagtcctggatgtggggggcaactgccggcggtgtgaccacgcccccaatccctgcatggaatgtccgagacacttccctcagctgcaccctgacactttctcacacttgagtcggctcgaaggcctggtcctgaaggattctagtctgtcttggctcaacgcttcttggttccgcggtttgggtaatttgagagtcctggatctgagcgaaaatttcctgtataagtgcattaccaagacaaaagcctttcaggggctaacccagctgcggaagctgaatctgagcttcaattatcaaaaacgtgtgagcttcgcacacctgagtctggcccctagctttggctcactcgtggcactcaaagagttagacatgcatggtatattcttccggtccctggacgaaaccactcttcgcccgctcgcccgtctgccaatgctgcagacgctgcgcttacagatgaacttcatcaaccaggcccaattaggaatttttcgggcctttcccggtctgcggtacgtggatctctccgataatcggatatctggggcaagcgaactgacggcaacaatgggcgaggccgatggaggagagaaggtgtggctccagcccggggatctggccccagccccagtcgacacaccaagctccgaagactttcgacccaattgcagtaccttgaattttaccctggatttgtctcggaataaccttgtaactgtgcagcctgaaatgttcgcccagctgtctcatctccaatgtctccgactctcccacaattgcatttcccaggccgtcaatggttctcagtttctcccccttactggcctgcaagttctggacctctcccataacaagctggatctctaccatgagcattccttcaccgagctgccccgactggaggcattggatttgagctacaactctcagccttttggaatgcagggcgttggccataatttcagctttgtggcgcatctccgtacactccggcatcttagtttggctcataacaatattcacagccaagtaagtcaacagctttgttcaacgtctcttcgagcattagacttttctgggaatgccctcggccacatgtgggccgagggggacctgtacctgcatttctttcaaggcctttccggattgatttggttagatctctcacaaaatcgtcttcacaccttactgcctcaaactctccggaatttgcctaagagtcttcaggtcctcagactgcgggataattatctggccttctttaaatggtggagccttcactttctcccaaaacttgaggtactggacttggctggcaatcagctgaaggccctcacaaacggaagccttcccgcaggtaccaggcttaggcgcctcgacgtctcctgtaatagtattagcttcgtcgcccccggtttcttcagcaaagccaaagagctcagggagcttaacctgtccgctaatgctctgaagacagtggatcactcttggtttggtcccttagctagtgccctgcagattctcgatgtgtcagccaatccactgcactgtgcatgcggtgccgcctttatggattttttgctggaggtgcaagctgccgtccccggcctgccttccagagtcaaatgtggtagtccaggacaactgcaaggcctgtcaatctttgcgcaagacctcaggttgtgcctcgacgaagcactatcgtgggattgcttcgctttgtccttactcgcagtcgcattggggctcggagtgcctatgctgcatcacctgtgtggctgggatctgtggtactgcttccatctgtgtttggcatggctcccttggagagggaggcagagtggacgagatgaagacgcgctaccctacgatgcttttgtggtcttcgacaaaacgcagtcagctgttgctgactgggtgtacaacgaactgaggggacagcttgaagagtgccggggaaggtgggccttgaggttatgcctcgaggagagggactggctgcctggcaaaaccctgttcgagaacctctgggctagcgtatatgggagtaggaagacactgttcgtgcttgcgcacaccgatcgagtatcaggactgcttcgtgcaagtttcctactggcacagcagagactgttagaggataggaaagatgtcgtagtgttggtgatcctgagccctgacggtcgacgaagtaggtatgtccgactgcgtcagcggctgtgtcggcagagcgtgttactctggccccatcagccttccggacagagaagcttctgggcccaacttggcatggcccttaccagagataaccaccacttctataacagaaatttttgtcaaggaccgacagcggagtag

SEQ ID NO: 138032 - DNA, 2139 bp, Artificial Sequence
  Description of Artificial Sequence: Synthetic coding sequence
atggcctgtactgggccgagtctgccttcagccttcgatattttgggtgccgcagggcaagacaagttgctttatcttaaacacaaactaaagactccaagacctggctgtcaaggccaggacctgttgcatgccatggttttgctgaagctgggtcaagagaccgaagccagaatctccctcgaggccctcaaggccgatgcagtcgcccgacttgtggcccgacagtgggctggagtggatagcaccgaagatccagaagagccgccagacgttagctgggcagtcgcgagactgtaccacctactggccgaggagaagctttgccccgcttctctccgtgacgtggcttatcaagaggcagtgaggaccttgagttcgcgcgacgatcacaggctgggagaactgcaggacgaggctcggaatcggtgcggttgggatattgcaggggatccaggatccatacgcactctccagagcaatctgggctgtctgccacccagttctgctttgccaagtggcaccagatcactgcctaggcccatagatggagtgtctgactggagtcaggggtgctccctgcgcagtacaggttctcccgcttccctcgcctccaatttggaaatttctcaatcaccaaccatgccctttctcagcctccaccgaagcccacatggcccgagcaaactctgcgatgaccctcaagccagcctggtgccggagcccgtcccgggagggtgtcaagagccggaagagatgagttggcctccctctggcgaaatcgctagtcctcccgaactccccagctcccccccccctggactccctgaggtggcccccgacgccacttcaacaggcttgcctgatacaccagccgcgcccgaaacaagcaccaactaccctgtggagtgcaccgaaggctctgccgggccgcagtctctgcctttgcctatactggaacctgtgaagaatccgtgcagtgtaaaagatcagacccctttacagctgtcagtcgaagacacaacaagccccaacacaaagccctgtccacctacccccactactcccgaaacctcaccaccccccccaccacctccaccttcatctactccctgctctgcccatctgacacctagctctctgttccctagtagcttggagtcttcttcagaacagaagttctataactttgtcatcctgcacgcgcgagctgatgaacatatcgcactgcgagtccgggagaagctcgaagcactgggggtgcccgacggcgccacattctgcgaggactttcaggtccctggccgaggggagctgagttgcctccaagacgcgattgaccacagtgctttcatcatcctgctgctcacgtccaactttgattgccgcctgagccttcaccaggtaaaccaagccatgatgtcgaacttgacgcgccaaggttcaccggattgcgtgattccattcttgccgttggaatcctcgcccgcccagctgtcaagcgatactgcatcactcttatccggtctggttagattagatgagcacagtcagattttcgcccgtaaggtcgctaatacgttcaagccgcatcgccttcaagcacggaaggcgatgtggaggaaggaacaggacacaagggccctcagagaacaaagccagcaccttgacggggaacggatgcaggccgctgcactcaatgcggcctattctgcgtacctacagagttaccttagctaccaggcgcagatggagcagttgcaggtggcatttggatcacacatgtcgttcgggactggagccccttacggcgctcggatgcccttcggcggtcaagtcccactgggagcacctcccccattccccacctggccagggtgtccacagccccctccactccacgcctggcaggccgggaccccaccacccccatctccacaacctgcggcctttccccagagcctacccttccctcagtccccagcattccctaccgcttcccccgcccctcctcaatccccagggctgcagccgcttataatccaccacgcccagatggtgcagctgggacttaataaccacatgtggaatcaaagagggtcacaggctcctgaggacaaaacccaagaggccgagtag

SEQ ID NO: 138033 - DNA, 3042 bp, Artificial Sequence
  Description of Artificial Sequence: Synthetic coding sequence
atgggtctgggaactctgtctcctaggatgctcgtgtggctcgtcgcttctgggattgttttttacggagagttatgggtctgtgccggacttgactacgactatactttcgacggcaatgaagaagataaaaccgagaccatcgactacaaagatccatgcaaggccgccgttttttggggtgacattgccttggacgatgaggatctgaatatcttccagattgaccgtaccattgacctgacacagaatccattcgggaacctgggacatacaacaggcggtttgggcgaccacgccatgtccaaaaagaggggcgcgctctaccagttgattgatcgcatcaggagaatcggttttggtctggaacagaataacaccgtgaagggcaaggtgcccctgcagtttagcgggcaaaatgaaaaaaaccgagttcctcgggcggccacgtcccgcactgagcggatttggcctggcggagtcatcccctatgtaatcggcgggaactttactggatcacagagagcgatgtttaagcaggcgatgcggcactgggagaaacacacctgtgtcacattcattgagcggagtgacgaagaatcatatattgtcttcacctaccgcccatgcgggtgttgctcatacgttggcaggcggggaaatggaccacaagccatcagtatcggcaagaactgcgataagtttggcatagtagtccacgagctgggacacgttatcggattctggcacgaacacactaggcccgacagggataaccacgtcacaattatccgcgagaatatccaaccgggacaggagtataatttcttgaaaatggagccaggcgaagtaaattccctcggtgagcggtatgacttcgatagcattatgcactacgccagaaataccttctcacggggaatgtttctggacaccatcctaccatcccgggatgacaatggtattaggccggcaattggacaacgaacaagattgtccaagggtgatatcgcacaagctcgcaagctctaccggtgccccgcctgtggagagaccttgcaagagtcaaacggcaacctaagcagtcccgggttcccaaatggctatcctagttacacccattgtatctggcgggtatctgtgacaccaggggagaagatagtattaaattttactacgatggatctgtataaatccagcctctgctggtacgattacatcgaagtgagggacggctactggagaaaaagcccccttctgggacgtttttgtggggacaaactccctgaagtcctgacatctaccgattcacggatgtggatcgagttcagaagctctagcaactgggttggaaaaggattcgcagctgtttacgaggccatttgtgggggcgagataaggaaaaacgaagggcaaattcagtcaccaaattatccagacgactatcgccccatgaaggagtgcgtgtggaagatcaccgtgagcgagagctatcatgtggggctcacgtttcaatccttcgagatcgaacgccatgacaactgtgcatacgattatctcgaggtgcgagacggtacatctgagaactccccactcatcgggaggttttgcgggtacgataaaccagaagacattaggtctacatccaatacactgtggatgaaattcgtgagtgacggcaccgtcaacaaggccgggttcgccgctaacttttttaaggaagaggatgaatgtgcaaaacccgatcggggcggatgtgaacagaggtgcctgaatactttaggcagctaccaatgtgcttgtgaacctggttatgaactcgggcccgaccgacgatcttgcgaggctgcctgcggagggctgctcacaaagttaaatggcacaattactacccctggatggccaaaggaataccctcctaacaagaactgtgtttggcaggtcgttgcgcccactcagtatcgtatatccgtaaaattcgagttttttgaactggaaggcaatgaggtttgtaaatacgactacgtagagatctggagcggcttatcgagcgagtccaagctgcatggtaaattttgtggcgctgaggtgccagaggtgatcacttcacagtttaataatatgcggattgagttcaagtcagacaatacagtgtccaagaaggggttcaaggcacatttctttagtgataaagacgagtgcagcaaggacaacggagggtgtcagcatgagtgcgttaacacaatgggttcgtatatgtgtcagtgtaggaatggattcgtgttgcatgacaacaagcacgactgtaaagaagcagaatgtgagcagaagatccactcgcctagcggactgattacatctcctaactggcctgacaaatacccaagccgtaaagaatgcacttgggaaatctccgcaaccccgggtcacaggataaaactggcattcagcgaattcgaaatagagcagcatcaggagtgtgcttacgatcatcttgaggtcttcgacggcgagacagaaaagagcccgatcttggggaggctgtgcggaaacaaaatccctgatcccctcgtggcaaccggcaacaaaatgttcgtaagatttgtcagcgacgcctccgttcaacgcaagggattccaagctactcacagcactgagtgcggcggccggctgaaggctgagtccaaaccacgcgatctgtacagccacgcacagttcggagataataactatccgggacaggtcgactgtgaatggcttctcgtgagcgagaggggcagtaggcttgagctcagcttccagacttttgaggtggaggaggaagccgattgtggatacgattatgtggagttgttcgatggactggattctaccgctgtgggactgggacgcttttgcgggtctggacctccagaggaaatatacagcattggggactccgtcctcattcactttcacaccgatgatactatcaacaagaaaggctttcatattaggtataagagtatccgctatccagataccactcatacaaaaaaatag

SEQ ID NO: 138034 - DNA, 1179 bp, Artificial Sequence
  Description of Artificial Sequence: Synthetic coding sequence
atgggtttgggcacactttccccgaggatgctggtgtggctcgtggcgtcaggtatagttttttacggcgaactatgggtctgcgctgggttggactacgactatacctttgacggaaacgaggaggataaaacagaaacaatagactacaaagatccatgtaaagccgccgtgttttggggcgatatcgcgctggacgacgaggatcttaacatctttcagatcgaccgcacaatagatcttactcagaatccttttgggaacctgggtcacaccacagggggcctgggcgaccatgctatgtcaaaaaagcgcggcgccctgtaccagctgatagatcggattaggaggattgggtttggcctggagcagaacaatactgtcaaaggcaaagtgcccctgcagtttagcggccaaaacgagaagaaccgggtgccccgcgccgcaacatcaaggacggaaaggatttggcccgggggcgtgattccctacgttattgggggtaactttacgggttcccagcgggctatgtttaagcaagccatgcggcactgggaaaagcatacctgtgtgaccttcattgaaagatccgatgaagagtcctatattgtgttcacttatcggccctgcggctgctgttcatacgtgggccggagagggaatgggcctcaggccatcagtattgggaaaaactgcgataagttcgggattgtggtccatgaattaggtcacgtcatcggcttctggcacgaacacaccaggcccgaccgggacaatcatgtcacaattattcgtgagaatatccagcccgggcaggaatacaacttcctgaagatggagcccggtgaggtaaattcccttggggagaggtacgacttcgacagtatcatgcactacgctcgcaataccttttctaggggaatgtttctcgatacaatcttgcctagcagagacgataatgggattcgccccgcgattggccagagaacccggctgagcaaaggcgacattgcccaagcccgcaaactctacagatgccctgcttgtggagagaccctccaggagagcaacggaaacctgtcgtctccaggctttccaaatgggtacccatcgtacacacactgtatctggagagtctccgtgacaccaggagaaaaggtagtgtttagcctctgctag

SEQ ID NO: 138035 - DNA, 3048 bp, Artificial Sequence
  Description of Artificial Sequence: Synthetic coding sequence
atgccccgagcgacagctcttggggcactggtctccctacttctgttgctccccctgccgcgaggggcagggggactaggagagaggcccgacgcaactgcggactactccgagctggatggcgaggaaggcactgagcagcagctggagcattatcacgatccatgcaaggccgcagtgttctggggcgacatcgccctggacgaggatgacttaaaactcttccacatcgacaaggctagagattggaccaagcagaccgtcggtgccacaggacacagcaccggggggctcgaagagcaggcctctgagtctagtccagacaccacagctatggacacgggaaccaaagaggccggcaaagatggcagagaaaatacaaccctgctgcacagcccaggtacactccatgctgcagcgaagacattctccccccgggtgcggagagcaaccaccagtagaacagagcgtatatggcctgggggggtgatcccatacgtaatcggtgggaacttcactggatctcaaagggctatatttaaacaggccatgaggcactgggagaagcacacctgcgtgactttcatcgaacggacagacgaggaatccttcattgttttctcctacaggacgtgtggctgttgcagttatgtgggccgccggggaggtggtccacaagcaatcagcataggcaaaaattgtgataagtttgggatcgtcgctcacgagcttggtcacgtcgtgggattctggcatgagcacaccaggcccgacagggatcagcatgtaaccataataagggagaacatacagcccggacaggaatacaacttccttaaaatggaagcaggagaggtgagcagccttggggagacctatgactttgactcaattatgcactacgcccgaaacaccttctcccggggagtgttcctcgataccatacttcctaggcaggatgacaacggcgtccgtcccacaatcggacaaagggtgcgactctcacaaggggatattgctcaagctcgaaagctttacaagtgccccgcctgtggcgagacactgcaggataccacagggaattttagcgcaccagggttcccgaatgggtacccctcatattcccactgcgtgtggcgcatatctgttacccctggagaaaaaattgtgctcaatttcacctcaatggatctgttcaaatcccgcttgtgttggtacgattatgtcgaagtgcgggatgggtactggagaaaggccccactgctcggacgcttttgtggcgataaaatccccgagccactggtgagtaccgacagcaggctttgggtggagttccggtcgtcttctaatatcctaggaaagggattttttgccgcctacgaggccacatgcgggggcgatatgaataaagacgctggacaaatccaatcccccaattatcccgatgactaccggcccagcaaggagtgtgtttggcggattactgtgtccgaggggtttcacgtggggctgacgttccaagcttttgagatagagcgccacgattcttgtgcatatgattatctggaagtccgcgacggaccaaccgaggagtctgctctaatcggacatttttgcggatacgagaaacccgaggatgtgaagtcatctagtaatcggctgtggatgaagtttgtgtcggatggatcgatcaataaagccggcttcgctgctaacttcttcaaggaagtcgatgaatgtagttggcctgatcacggaggctgcgagcaccggtgcgtgaatacactgggatcgtacaaatgtgcttgcgaccccgggtatgagcttgctgccgacaagaagatgtgtgaggtggcctgtggaggattcatcacgaagctgaatggaacgattacctcccccgggtggcccaaagaatatccgacaaataaaaattgtgtgtggcaggtagtcgcccctgctcagtatcgtattagcctacagtttgaagtgttcgagttagagggcaatgacgtctgcaagtatgacttcgttgaagtgcgatccgggctttcccctgatgcaaaactgcatgggagattttgtgggtccgaaactcctgaggtcattacttctcagtctaataacatgcgagtcgaattcaaaagcgataatacggtctcgaagcgcggatttagagcccacttcttttctgacaaggatgagtgtgccaaggataatggcggatgccaacacgagtgcgtcaacacatttggctcatacctctgtagatgccggaatggctattggcttcacgagaatggccatgattgcaaagaggcaggctgcgctcacaaaattagctcagtagagggaacactcgcaagtccaaattggccggataagtacccctcacgcagagagtgtacatggaacatctcctccaccgcaggacacagggtgaagcttactttcaacgagttcgagattgaacaacatcaggaatgcgcctacgaccatttggaaatgtatgatggccctgactctctggctccaatcttgggacgcttctgtggaagcaaaaagcctgacccaactgtcgctagcggaagtagcatgtttttacgattctactccgacgcctcagtgcagcgcaaggggttccaggccgtacacagtaccgagtgcggaggtcggctcaaggccgaggtccagacaaaggagctgtattcacacgcgcaattcggggataataattatccttccgaagccagatgcgattgggttattgtggctgaggacggttatggtgtggagctgacctttagaacattcgaggtagaagaagaggctgattgtggctacgattatatggaggcctacgacggctacgatagtagcgctccaagacttggcaggttttgtggatccggccccctggaggaaatctacagcgctggagattccttgatgataaggttccgaaccgacgatacaataaataagaaaggattccacgctcgatacacaagtaccaaattccaggacgctttacacatgaagaagtag

SEQ ID NO: 138036 - DNA, 2298 bp, Artificial Sequence
  Description of Artificial Sequence: Synthetic coding sequence
atgtccggcgatcacttgcacaacgattcacagattgaagcagatttccggctgaatgatagccacaaacataaagataagcacaaagatagggagcatcgtcataaggagcacaaaaaagaaaaagatagggagaaaagcaagcattcaaactccgaacataaagactcagaaaagaagcacaaagagaaagaaaaaacaaaacacaaggacggcagctctgaaaagcacaaagataagcataaggatagggataaggagaagagaaaggaagaaaaggtacgagccagtggggacgcaaagattaagaaggaaaaggagaacggcttttcctctcccccgcagatcaaggatgagcccgaggacgatggttacttcgtgcctcccaaagaagacattaagccattgaaacggccccgcgatgaggacgacgccgattataagccgaagaagatcaagaccgaagacactaagaaggagaaaaagcgcaagctggaggaggaagaggacggtaagttaaaaaagccaaaaaataaggacaaggacaaaaaggtgccagagcctgacaacaaaaaaaaaaaaccaaagaaagaggaggagcagaagtggaagtggtgggaggaagaaagatatcctgaggggataaagtggaaatttttggagcataaaggtccggtctttgctccaccttacgaacccctccccgagaacgttaaattctactatgacggcaaagtcatgaagctgagccccaaagcagaggaagtggctaccttttttgcaaaaatgctggaccacgaatacaccactaaggagatctttcgaaagaatttcttcaaagactggcgaaaggaaatgaccaatgaggagaagaacatcattactaatcttagcaagtgcgacttcactcagatgtcccagtactttaaggctcagacagaggcgcgcaaacagatgagcaaggaagagaagctgaagattaaggaggagaatgagaaactcctcaaggagtatgggttctgcatcatggataaccataaggagaggattgccaattttaagatcgagccacctgggctgttcaggggacggggaaatcaccctaagatgggaatgctgaagcgccgaataatgcccgaagacatcataatcaattgtagtaaagacgcaaaggttccaagtcctccccctggtcacaaatggaaggaggttagacacgacaacaaggtcacttggctcgtttcctggacagaaaacatccagggaagcattaagtacataatgctgaatccttccagtagaattaagggcgagaaagactggcagaagtacgagacagcacgtcgactgaagaaatgtgtagataagattcgaaatcaatacagagaagactggaagtctaaagagatgaaagtgcgacagagggctgtcgctctgtactttattgataaactagcactgagagcaggcaacgagaaggaagagggcgagaccgccgacacggtgggttgctgctccctgcgtgtggagcacatcaatctgcacccagagcttgacgggcaggagtacgtggtggaatttgacttccttgggaaagacagcattcgttactataataaagtgcccgtcgaaaagagggtgttcaaaaacctgcagttgtttatggaaaacaaacagccagaagatgacctgttcgatcgactcaatactggcattctcaacaagcatctccaggatttgatggaaggacttacagcaaaagtgttccgcacgtacaatgcaagcatcacactgcaacagcaacttaaggagctgaccgctcccgacgagaatataccggccaagattttaagctacaaccgggctaatcgagccgtggctatcctatgtaatcatcaacgcgccccacctaagacattcgagaaatccatgatgaacctgcaaacgaaaattgatgcaaagaaagagcagctagctgacgctcgccgagatctgaagagcgccaaggccgacgccaaggttatgaaagatgccaaaacaaaaaaagtggtagagagtaagaagaaggcagtacagcgcctggaggaacagctgatgaaacttgaggttcaggcaactgatcgcgaagagaacaagcagattgcacttggaacttctaaactgaactacctggaccctcggattactgtggcctggtgtaagaaatggggagtcccgatcgaaaaaatttataataagacacagcgagaaaagttcgcctgggcgattgacatggctgacgaggattatgagttttag

SEQ ID NO: 138037 - DNA, 1806 bp, Artificial Sequence
  Description of Artificial Sequence: Synthetic coding sequence
atgagagttgtgagattgctaaggctgagggcagccctcacacttcttggggaagtaccccgacggccggctagccgcggcgtccctggcagtaggcgaactcaaaaaggatctggcgctaggtgggagaaggaaaagcacgaggacggggtgaaatggcgccagctggaacataaagggccatacttcgcccccccgtacgagcctctgcctgacggagtgcggtttttctatgagggacgccccgtccgactttctgtggcagcggaggaggtggccaccttctacggaaggatgctggaccacgagtacactaccaaagaggtgtttagaaaaaatttcttcaatgactggcgcaaagagatggctgttgaagagcgagaggtgattaaatctttggataagtgcgacttcacagagattcacaggtacttcgtggacaaagctgctgcacgcaaggttctctcacgggaggagaagcagaaactgaaagaggaagcagaaaagctccagcaagaatttggctattgcattctggatggacatcaagagaaaatcggaaacttcaagattgaacctccgggactttttcgaggtcgaggggaccatcccaagatgggtatgttaaaaagacggatcaccccagaagatgtcgtgatcaactgtagcagagactcgaaaatcccagaacctcctgccggacatcagtggaaagaggtacggagcgacaacacagtgacttggttggccgcctggaccgaaagtgttcagaattcaattaagtacattatgctgaacccgtgttcaaagctcaaaggagaaactgcttggcagaagtttgagactgcacgtcgtctgaggggatttgtggacgagattcgaagccagtacagggccgattggaagtcaagggagatgaagacgagacagagagccgtggccctgtatttcatcgataagctcgcacttcgtgccggcaacgaaaaagaagacggggaggccgcagatacagtgggttgctgtagcctgagagtggagcacgtccagttgcaccctgaagccgacgggtgtcagcacgtcgtcgaattcgatttcctgggtaaggactgtatccgctattacaacagagtcccagtcgaaaagccagtttataaaaatctccagctttttatggaaaacaaggacccccgcgatgatctgtttgataggttaacaaccacatcattgaacaagcatttacaagaactgatggatgggttgaccgccaaagttttcaggacatataacgcctccatcaccctccaagagcagctgagggccctgacacgggctgaggactcaattgcggccaaaatactgagctataaccgggcaaatcgggtggtggctatactatgtaaccaccagagggctactccgtctactttcgaaaagagcatgcaaaacctccagaccaagatccaggccaagaaagaacaagttgcggaagcaagggcggagcttcggagagcccgggcagagcataaggctcagggtgatggcaagagcagaagtgtgctcgagaagaagcgcagattattggagaagctgcaagaacagctggcgcagttgtccgtgcaggctaccgataaggaagagaacaaacaggtcgcattgggcacctcgaaactcaactatctggatccgcgcatctcgatcgcctggtgcaagcgatttcgggtccccgttgagaagatctactctaagacccagagagaacggttcgcctgggctttggctatggcaggtgaggacttcgagttttag

SEQ ID NO: 138038 - DNA, 1512 bp, Artificial Sequence
  Description of Artificial Sequence: Synthetic coding sequence
atgctggaccatgagtacactacaaaggaagtcttcagaaaaaatttctttaatgactggaggaaggagatggccgttgaggaacgcgaagtcattaaatctcttgataagtgcgattttactgaaatacaccgctatttcgttgataaagcagccgcccggaaggtgctgagtcgagaggagaagcagaagctcaaggaagaggcagagaaactgcagcaggaattcggctactgcattctcgacggacaccaggagaagattgggaattttaaaattgagcctcccgggttgtttagagggaggggggaccacccaaagatgggtatgctcaagagaaggattacaccggaggatgtagtgattaattgctcacgcgatagcaagatccctgaacctcctgcgggccatcaatggaaagaggtgaggtctgacaataccgtgacttggcttgcggcatggactgaatccgtgcagaattcgattaaatatattatgctgaacccttgttctaagctcaaaggcgagaccgcgtggcagaagtttgagactgcaaggcgcctgagaggctttgttgacgaaattcgctctcaatatagggccgactggaagagtcgggaaatgaagactcggcagagggctgtggccctgtatttcatcgataagctcgccctgagagccggcaatgagaaagaggatggtgaggccgccgatacagtgggctgctgttcgctccgcgtggaacacgtccaacttcaccccgaggccgatggctgtcagcatgtggtggaattcgacttcttaggaaaggattgcatacgctattacaatagagtgcccgtggagaaaccagtttacaagaatttgcagctctttatggaaaataaggacccacgcgatgacctattcgaccgacttacaacaacctctctaaacaaacatctgcaggaactgatggatggcctcaccgcaaaggtgtttagaacgtataatgcttcaatcacactgcaggaacagcttcgggctcttacccgcgccgaagattctattgccgccaagatcctgagttacaaccgcgcaaatcgagtggtggcaattctgtgcaaccaccagagggcaacccctagcaccttcgagaagtctatgcaaaatttacagacaaaaatacaggcaaagaaggagcaagttgcggaggcacgcgctgagttgcggcgggccagagccgaacacaaagcccagggggatggaaagagtcggtccgttctggagaaaaagcggagacttctggagaagctccaggaacagttagcccaactgagcgtccaggctactgataaggaggaaaacaaacaggtggctcttggcactagcaagctcaactacctggatccacgaatcagcattgcatggtgcaaacggtttcgggtccccgtcgagaaaatttactccaagactcaaagagagcggttcgcatgggctctcgccatggctggcgaggattttgagttttag

SEQ ID NO: 138039 - DNA, 1512 bp, Artificial Sequence
  Description of Artificial Sequence: Synthetic coding sequence
atgttggaccacgagtacaccacaaaggaagtgttcaggaagaatttctttaacgattggcgcaaagagatggcagtggaggaacgagaagtgataaagtctctcgacaagtgcgatttcacggaaatccaccgatactttgtcgataaggcggccgcccgcaaggtgctctcccgcgaggaaaagcaaaagctcaaggaagaagctgagaagctgcagcaggaattcggatactgcattctcgacggccatcaagaaaaaatcggcaatttcaaaattgagcctcccggactgttccgtggacgtggcgaccatcctaagatgggtatgttgaagaggcggattactcccgaagatgttgtgataaactgtagccgcgactctaagattcccgagccaccggctggccatcagtggaaggaggtaagatcagataatacagtgacatggcttgccgcctggaccgagagcgttcagaactccattaagtatatcatgctgaacccctgcagcaagttaaagggggaaacagcctggcaaaaatttgaaaccgcgcgccgcctccggggttttgtggatgagatccggagccaataccgggcagattggaagagcagagaaatgaagactagacaacgggctgtggcattgtatttcatagacaagctggcactgcgggccggcaatgaaaaagaagatggagaggccgctgacacagtaggatgctgctccctgagggtggagcacgtccagttacatcccgaagcagatggatgccagcatgttgtggagttcgatttcctgggcaaggattgcatccgttattataatagagtcccggtggagaaacctgtctataagaatctgcagctcttcatggagaacaaggatcctcgagatgatctgttcgaccgtcttacgaccacctctttaaataagcacctgcaggaattaatggatggcttgactgccaaggtgtttcggacttacaatgcgagtataacactccaggagcagcttcgcgccctaacccgggcggaagattccatcgccgcgaaaatcctctcttataacagagccaacagagtggtcgccatcctgtgtaaccaccagcgcgcaactccgagcacgtttgaaaagtctatgcaaaacctacagaccaaaattcaggccaagaaagaacaagtggctgaagctcgcgccgagcttcgccgggcgagggcagagcataaggctcagggcgacggaaaatctcggtctgttctggagaagaagcggcggctgctggagaagttgcaggagcagctggcacagctgagcgtccaagccaccgataaggaggagaataagcaagttgccctgggaacaagtaagttaaactatctggacccaagaatctctatagcatggtgtaagcggtttcgcgtgccggtggaaaagatttactctaaaacacaacgggagcgcttcgcatgggccctggcaatggccggagaggactttgaattctag

SEQ ID NO: 138040 - DNA, 1512 bp, Artificial Sequence
  Description of Artificial Sequence: Synthetic coding sequence
atgctggatcatgaatacacgactaaggaggtgtttcggaaaaatttcttcaatgattggaggaaagagatggctgtcgaggaacgcgaggtcataaagagtctggataagtgcgacttcactgagatccatcggtacttcgtggacaaggcagccgcgcgaaaagtcctgagtcgcgaggagaagcagaagctgaaggaagaagccgagaaactccaacaggaatttggttactgcatacttgatggacaccaggagaagatcggaaatttcaagatcgaacctcccggcctgttccgcggcagaggagaccaccctaagatgggtatgctcaagaggcgtataaccccagaggacgttgtcattaactgcagtcgggattctaagatcccagaacctcccgccggacatcagtggaaggaggttcggtcagataacacggtgacatggctggccgcttggaccgaatcagtgcaaaattccatcaagtatatcatgttgaacccctgctccaagctcaaaggtgagactgcttggcagaagttcgaaacggccaggagactccgcggattcgtggatgaaattagatcccagtaccgggcggattggaaatctcgggagatgaaaacacgtcagcgagctgtcgccttatactttattgacaaactcgctttacgggcgggaaacgagaaggaggatggtgaagccgccgatactgtgggctgctgtagtttacgggtcgaacacgtccagctccacccagaggctgacggctgccaacatgtcgttgagttcgacttcctgggaaaggactgcatccggtattataatcgcgtcccggtggaaaaacccgtttacaaaaacctccagctctttatggaaaacaaagacccccgggacgatcttttcgaccgcctgacgaccacatctctgaacaaacatttgcaggaactgatggatggactcaccgcaaaggtcttccgcacctacaacgcaagcatcacactgcaggaacaactacgggccctcactagggccgaggacagtatcgcagctaagatcctttcctataatcgcgctaacagagtcgtcgctatcctctgtaatcatcagcgcgccactccctcaacctttgaaaaatctatgcagaatctccagacaaagatccaggcgaagaaagaacaggttgctgaagcacgtgccgaactcaggagagcccgcgccgagcacaaggcccagggggacggtaagtctaggagcgttctagagaagaagcgtaggctgcttgagaagctgcaggagcagctggcacagctgtcggttcaagcaaccgataaggaagaaaataagcaggttgcgctgggaactagtaagctgaattacttggacccccggatatccatcgcatggtgtaagcggttccgcgtcccagtcgaaaaaatttattctaagacccagcgagaacggttcgcctgggcactggcaatggccggagaggatttcgaattttag

SEQ ID NO: 138041 - DNA, 4569 bp, Artificial Sequence
  Description of Artificial Sequence: Synthetic coding sequence
atgtctcgtaacgataaggaaccattcttcgtgaagttcctcaagagctcggataactccaagtgttttttcaaggcgctggagagcataaaagaatttcagagcgaggaatatcttcagattataaccgaggaagaagcgctcaaaattaaagaaaacgacaggagtctgtacatttgcgacccattcagcggggtcgtttttgaccacctgaaaaaactgggttgtcgaatcgtcggccctcaggtagtcatcttttgtatgcaccaccagaggtgcgtgccaagagctgagcacccggtctataatatggttatgtctgacgtgacgatcagttgcacatcccttgagaaagaaaaacgggaggaagttcataaatatgtccagatgatgggtggccgggtgtacagggatctaaacgtttcagtcacacacctgatcgccggtgaggtcggaagtaaaaaatatctggtcgcggcaaacctgaaaaaaccgattctcctacccagttggatcaaaactctttgggagaagtcacaggagaagaagatcacgagatacactgacataaatatggaagattttaagtgccctatcttcctcggctgtatcatctgtgtgactggcctatgtggcttagataggaaagaggtccagcagttaaccgtcaaacacggcgggcagtacatgggtcaactcaagatgaacgagtgcacccatttgattgtccaagaaccaaagggccagaaatatgaatgtgccaaaaggtggaatgttcactgcgtcaccacccagtggttctttgactctatcgaaaaaggattttgccaggatgagagtatctacaagacggagccccgaccagaagctaagacaatgcccaactcgagtacccccacttcccaaattaataccatcgacagcaggactctgtccgacgtgagcaacatttccaatatcaatgcttcctgtgtttccgagtcgatctgcaactctttgaattcaaagctagaaccgacactggaaaatctggaaaacctggacgtgagcgcctttcaagcccctgaagaccttcttgacgggtgccggatctacttgtgtggattcagcggacgcaagttagacaagttgcggcgcctgatcaattctggtggcggcgtgagatttaaccagctgaacgaagatgttacccatgtaattgtaggggactacgatgatgaactcaaacagttttggaacaagtctgcacaccgaccacatgtggtcggcgctaagtggctcctcgagtgctttagcaaaggctacatgcttagtgaagagccatatattcacgccaattatcagcctgtagaaataccagtgtcacataagcctgaaagcaaagcagcccttcttaagaagaagaatagtagctttagcaaaaaggatttcgccccctccgaaaaacacgaacaggctgatgaggacctcttaagtcagtacgaaaatgggtcttcaacagtcgttgaggcgaagacttctgaagctcggcccttcaatgactctactcacgcagagccattaaatgacagtactcatatctctttacaagaggagaaccaaagttcggtgagccactgcgtgccagacgtctctactattaccgaagagggccttttcagtcaaaagagcttccttgttctgggtttttcgaacgaaaatgagagtaatatcgccaacattatcaaggagaatgccggtaaaattatgagtctgctctccagaacagtcgcggattacgcagtggttccactacttgggtgcgaggtggaggccacggtgggtgaggtagtaacaaatacctggctcgtaacctgtatcgactatcagactctctttgacccaaagtcgaatccgctgtttactcctgtacccgtgatgacggggatgactcctctagaggactgtgtgatctctttttcccagtgcgccggtgctgagaaagagtcgctcacctttctggcaaatttactgggcgcatccgtgcaggagtatttcgttaggaaatccaacgctaagaaaggaatgttcgcatcgacccacctgatcctgaaggaacgcggcggctccaaatacgaggccgccaaaaaatggaacctgccagcagtgaccatagcctggctcctggagaccgcccggactggtaaaagggctgacgagagccatttcctgatagagaactccactaaagaggagagatccctggaaaccgagattacaaatgggatcaatctgaactctgatactgcagagcatcctggcaccagactccagacacaccggaagacagttgtgactcctctggacatgaataggtttcaatctaaggcgtttcgggcggtcgtgtcccaacacgcacggcaagtggccgctagcccggccgtaggacagccactacaaaaggaaccctcactgcacttagatactccaagtaaatttctgagcaaggataagttattcaagcccagctttgacgtgaaggatgctcttgctgccctggaaacccccgggaggccatcacagcagaagagaaaaccatccacacccctgtcagaagtgattgtgaagaatttgcagttggccctggcaaatagtagtcggaatgccgtagctctgtcagcatcaccccagctgaaagaggcccagtccgaaaaggaagaggcaccaaaaccactgcacaaagtggtggtgtgcgtatcaaagaagctgtcaaagaaacagtccgagctaaatggcatcgccgccagtctgggcgctgattatcgctggtcgtttgacgagactgtcactcacttcatttatcagggacgtcctaacgacaccaaccgggagtataagtctgtgaaagagcgcggcgtgcatatcgtgtcagagcattggcttttggattgcgcccaggagtgtaagcatctgcccgagtcactgtacccccatacctacaatcccaagatgagcttggacatcagtgccgtgcaagacggtagattgtgtaatagccgtctgctgagtgcagtttcatcgactaaagacgacgaaccggatcctctgattcttgaggagaatgacgtggacaatatggctaccaacaataaagaatcggccccttctaacggctctggtaaaaacgactctaagggcgtccttactcagaccttggagatgagagagaactttcaaaagcagctgcaggaaatcatgtccgcaacttccattgtgaaaccccaggggcaaagaactagcctgtccagatccggatgtaatagtgccagttccacacccgatagcactaggtctgcacggtcgggacgcagtcgggttttagaggctctgcgccagtcacgacagacggttcccgacgtgaatactgaaccgtcccagaacgaacagatcatatgggacgatccaaccgcaagggaggagagggctagactcgccagcaatctgcagtggccctcttgtcctactcaatactcagagctccaggtggatatccaaaatttggaggatagtccatttcagaagcctctccacgacagcgaaattgctaagcaagcagtttgcgatcccggtaacatcagggtgactgaggctcctaaacatccaatttctgaggagttagaaacaccaatcaaggattcccacctgatccccacgccgcaggcgcccagcatcgcattccctcttgctaacccccccgtggcaccccacccgcgggaaaagattattactattgaagaaacacacgaagagttgaagaagcaatacatattccaattgtctagcctgaaccctcaggagagaatcgattactgccacttaatcgagaagttaggaggcctagtgatcgagaaacagtgttttgatccgacctgtacacatattgtggttggtcatccattgcgcaatgaaaagtatctggctagcgtggctgccggtaaatgggtgctacaccgttcgtatctggaggcctgccgaaccgcaggtcatttcgtgcaagaagaagattatgagtgggggtcttcctcaatactagatgtcttaaccggaattaatgttcaacagcggaggctggctcttgctgcaatgcgctggcgcaaaaaaattcagcaaaggcaagagtccggcatcgtggagggcgcattttccggttggaaagttatacttcatgtcgatcagtcacgcgaagccggatttaagagattgcttcagtccggaggcgctaaggttttgcccggacactccgtgccgctgtttaaagaggcaacacatcttttctcggatcttaacaaactgaagcccgatgatagtggcgtgaatattgcggaagccgccgcccagaatgtatattgtctgaggactgaatacattgccgattacctcatgcaggaatcccctccacacgtggaaaattactgcctacccgaggccatatccttcatccagaataataaggaactcggcaccggactaagccagaagcggaaagcgcctaccgaaaagaacaaaatcaaacggccacgggtgcactag

SEQ ID NO: 138042 - DNA, 3138 bp, Artificial Sequence
  Description of Artificial Sequence: Synthetic coding sequence
atggggagccagcctcccctgggcagcccgctttcccgcgaggagggggaagcccccccccctgctcctgcatcagaggggcgcaggcgcagcaggcgggtgaggctacgggggagctgcagacatcgtccttcctttctgggttgccgcgaactggctgccagtgcccctgcaaggcctgccccagcctcatccgaaattatggcatccgccgcgaaggaattcaaaatggataattttagtcccaaagcaggcaccagcaagctccaacaaactgtgcctgccgacgcatcgccagattctaaatgccccatttgtctcgatcggttcgataacgtgtcataccttgacaggtgtttgcacaaattctgcttccgttgtgttcaagaatggtccaagaacaaagctgaatgccctctttgcaagcaaccttttgactcaatattccacagtgtgcgggcagaggatgatttcaaggaatacgtactacgaccatcctacaacggcagcttcgtgacccccgaccgtcggtttagatacaggactacactgactagagagcgcaacgcgtctgtatacagcccttccgggcctgttaacaggagaactacaacacccccggactcaggagtgctctttgagggattgggtatctcgacaaggcctagggacgtcgaaattcctcaatttatgaggcagatcgctgtccggaggccgacgacagctgatgagcgcagcctccggaagattcaggagcaggatatcatcaacttccgcaggactctctatagggcgggtgccagggtgaggaatatcgaggatggcggtcggtaccgtgatatctccgcagagttctttcgacggaatcctgcttgtctgcaccgtttggtgccgtggttaaaacgggagctgacagtgctgtttggtgcacatggcagcctcgtcaatatagtgcagcatatcattatgtccaatgtgaccagatatgatttagaatctcaggcctttgtaagtgatctgcgcccatttctgctaaacagaacagagcatttcatccacgagtttatcagtttcgccaggtccccctttaatatggcggctttcgatcagcatgccaattatgattgccctgctccctcatacgaagagggatctcatagcgatagcagtgttatcacaatcagccctgatgaggcagagacgcaagaactggacatcaatgtagcaacagtgagccaggccccctgggacgacgaaactcccgggccttcctacagcagttccgaacaggtgcatgtaaccatgtcttcgttactgaatactagtgattcatccgatgaagaactggtcactggcggagcaacttcccagatccagggggtgcagaccaacgacgatttaaacaatgactcagacgactcttcagacaattgtgtgatcgtggggtttgtgaaacctctagctgagaggaccccggagcttgtggaactcagctccgactctgaagatcttgggagttacgaaaaaatggaaaccgtgaagacccaggagcaggagcagagttatagtagtggagattccgatgtaagtagatgctcctccccccactcagtgctggggaaagatgagcagattaataaaggccattgcgactcttccaccagaattaaaagcaaaaaagaggaaaagaggtctacctcactctcatcccctcgaaatcttaactccagtgttcgaggagatagagtttactccccctacaatcatagacaccggaaacgcgggagatcccgttcctctgattcccgcagtcagagcagatccggacacgaccagaagaatcaccgtaaacaccacgggaaaaagcgaatgaagagcaagcgatcacggtcgagggagagcagtagaccaagaggccgtagagataagaagcgcagcaggactagagattccagctggtcccgtcggtcacagactttgtccctctcttctgaatccacgtcgaggagtaggagcagatcctccgatcacggaaagaggcgatccaggtcaagaaatcgggacagatattacctcaggaacaactacgggtctcggtacaagtgggagtacacttattactctcgaaacaaagaccgggacggttacgaatcatcatacaggcggcgcaccctctcacgggcacactatagccggcagagcagctctccagagttcagggtacagtcatttagcgaaagaactaacgcacgtaagaagaacaaccacagcgaaagaaagtattactattacgagcgccaccggagccgctcattgagcagcaaccggtctaggactgcttctaccggcactgatagagttaggaacgagaaacccggcggaaagagaaagtacaagactagacatctggaggggaccaatgaagtggctcaacccagtagagaattcgcatctaaagctaaagatagtcattatcagaaatcgagttccaaactagacgggaactataagaacgagagtgacaccttctctgattcccgatcttctgacagggaaactaagcacaagcgaaggaaacgcaagactcgctccctgagcgtggagattgtgtacgaaggcaaggccacagacacgacaaagcaccacaagaaaaagaagaagaaacacaaaaaaaagcacaaaaagcaccatggagataatgcatccaggagcccggtcgtgattactatagacagcgatagtgacaaggattctgaagtgaaggaggacacagaatgcgataattccggtcctcaggaccctctgcagaatgagttccttgccccatcactcgaaccctttgaaaccaaggacgtagtaaccattgaggccgagttcggcgtcctagacaaagagtgcgacattgccaccttgagtaacaacctcaataatgctaataaaactgtggacaatattcctcccctggcagcaagcgtggagcaaacattggatgtgcgagaagagtcaactttcgtttcagatcttgaaaaccagccgtcaaatattgtctctttacagactgagccttcaaggcagctgccttcaccccggacgtccctgatgagcgtctgcctcggccgggattgcgacatgtcctag

SEQ ID NO: 138043 - DNA, 2943 bp, Artificial Sequence
  Description of Artificial Sequence: Synthetic coding sequence
atgatcatggcatcagctgcaaaagaattcaagatggacaacttttccccaaaggccgggacaagtaaactgcagcagacggtgccagcagacgcttccccagactcaaagtgcccaatatgcctggacagattcgataatgtctcttacttagaccgctgtctgcacaagttctgctttagatgcgttcaggagtggagcaagaataaagcagaatgtccactgtgcaaacagccctttgactccatattccactcagtgagggcagaggatgattttaaagaatatgtcctcagaccttcatacaacggttcttttgttaccccagatagaagattccgctacaggaccaccctgacgcgggaacggaacgcctcggtgtacagcccgagtggccctgtcaacaggcggacaaccaccccccctgattcaggagtgcttttcgagggattgggcatctcaactcgacccagagacgtggaaatcccccagtttatgagacaaattgccgtgcggaggccaaccaccgctgatgaacgctccctgaggaagattcaggagcaggacatcatcaatttcagacgaacactgtacagagcaggggctagagtgcgcaatatagaagatggcggccgctatagagacatctccgcagagttttttagaagaaaccctgcctgcctgcatcggctcgtcccctggctgaaacgcgaactgactgtgctgtttggcgcacacggatccctagtaaacatcgtgcagcacatcataatgagcaacgtgactagatatgatcttgaatcacaggcctttgtcagcgacctgaggccatttttactcaatcggacggaacattttatacacgaatttatttcttttgctaggtctccctttaatatggctgcgttcgatcagcacgctaactacgactgccctgctccaagttacgaggaagggtctcatagtgactcttcagtcataaccatctcacccgacgaggcagagacccaagaactcgacattaacgtggcaactgtgtcgcaggccccgtgggatgatgagaccccagggccctcttactcatcctcagagcaggtccacgtgactatgtccagcttgctgaacacttctgattcaagtgatgaggagctagtgacaggcggagccacatctcaaatccagggagtgcagacaaatgacgatttaaacaatgactccgatgatagctccgataattgtgttattgtgggcttcgttaaaccgctagcagagaggactcctgagctggttgagctcagttcagactccgaggatctgggaagttatgagaaaatggaaaccgtgaagacacaggagcaagaacagagctatagttccggagatagcgacgtgagtcgttgcagcagtccccactccgtcctgggaaaagacgagcagatcaacaagggccattgcgacagctctacacgcattaagtcaaagaaagaagaaaaacggagtacctccctcagctcaccccgaaatttaaattcctcagtgcgcggggatcgtgtatatagtccatacaaccacagacatagaaaacgcgggcggagccgttcttccgacagccgttctcagtccaggtcgggccatgatcaaaaaaaccatcggaaacatcatggtaagaagcgcatgaagtcaaaaagaagcagatcccgtgagtcatcccgcccacggggtaggagagataagaagcgctcgcgtacgcgcgacagcagttggtcacgacggtctcagaccctgagcctgtcatccgagtcgacctcgcgcagcaggtctaggtcctcagatcacgggaagcggcgcagcaggtcgagaaaccgagaccggtactacctgcgtaacaattatgggtctcggtataagtgggagtacacctactacagccggaacaaagacagggatgggtacgagtcaagctatcgcaggaggactcttagccgtgcccactacagcaggcagtcaagctcaccagagttccgcgtccaaagcttttcagagaggactaacgccagaaagaagaacaaccactctgagcggaagtattattactatgaacgtcacaggagtagaagcttatccagcaatcgctcacgaacggcaagtacaggtaccgatcgcgtgagaaacgagaagcctgggggcaagaggaagtataaaacacgtcatctggagggcaccaatgaggtggcccaacctagtcgcgagtttgcttcgaaagccaaggattcccactatcagaagagctccagtaaactagatggaaactacaaaaacgaaagtgatacattctcggacagtcgttcttctgacagagagacgaaacataaacgccggaagcggaagacacggtcactgtccgtggagatagtctatgagggcaaggctaccgatacaacaaagcaccataagaaaaagaagaagaagcacaagaagaaacataaaaaacaccatggtgataacgctagcagatctcctgttgtcatcactatagatagcgattctgacaaagatagtgaagtcaaagaagacacagaatgcgacaacagcggcccacaggatcccctgcagaatgagtttctggccccaagcctcgagccttttgagactaaagatgtggtgactattgaggccgaattcggcgttttagacaaggagtgcgatatagccaccctgtctaacaatctgaataatgcaaacaaaacggtcgataacattcccccactagccgcgtctgtggaacaaaccctggacgtgcgggaagaatcaacgttcgtatcggatctggaaaatcaaccttcaaatatcgtgagcttgcagacagagcctagcaggcaactgccgagtccacggacgagtcttatgtccgtctgtctaggccgcgactgtgacatgtcgtag

SEQ ID NO: 138044 - DNA, 999 bp, Artificial Sequence
  Description of Artificial Sequence: Synthetic coding sequence
atgaagctaggtcgggctgtgctgggactgctacttctcgcgcctagtgtggttcaggctgtggaaccaatcagccttgggctggcccttgctggagtgctgaccggatacatttatcccagactgtattgcttgttcgccgagtgctgtgggcagaagcggagccttagccgtgaagctttacagaaagacttggatgacaatctctttggccagcatctcgcaaaaaagatcatactcaatgccgtcttcggattcatcaataaccctaaacccaaaaagccattaaccctgtccttacacggttggaccggcaccggaaaaaacttcgtgtcaaagatcatcgccgaaaatatctatgaaggcggtctgaattcagattatgtgcatctcttcgtggctacgttacactttccccacgcctctaatatcactctgtataaagatcagttacaactgtggatacggggtaatgtctctgcgtgtgccaggagcatatttatcttcgacgagatggataaaatgcatgccggtttaatagacgctataaagccattcctcgattactacgacctcgtcgatggtgttagttaccagaaagctatgttcatcttcttgagcaatgcaggagctgagcggatcactgacgttgccctcgatttctggcgaagcggcaaacagagggaagacattaagctaaaggacattgaacacgcactttccgtgagcgttttcaataacaaaaattctgggttctggcacagttccctcatcgatagaaatctgatcgattatttcgtgcctttccttccattagagtacaaacacctcaaaatgtgcattagagtggaaatgcaatccagaggctatgaaatcgacgaagacatcgtgagccgggtcgccgaggaaatgaccttctttccaaaggaagagagggtgttctcagacaaaggttgtaaaaccgtcttcacgaaactggactactattacgacgactag

SEQ ID NO: 138045 - DNA, 906 bp, Artificial Sequence
  Description of Artificial Sequence: Synthetic coding sequence
atgaaactcggtcgagccgtactaggactcctgttgctggcccccagtgtcgtacaggctgttgaacctatcagcctcggcctggcactggccggggttctcacaggctatatctacccaagactgtactgtctattcgcggaatgctgcggccagaagaggtcccttagcagagaggccctacagaaagatctggacgataatctgtttggtcagcacttggccaagaagattatcctgaacgcggttttcggcttcattaacaacccaaagcctaagaagccgctaacgttaagcttgtttgtggccactctgcactttcctcacgcatccaacattaccctgtacaaggatcagctccagctgtggattcgcggcaatgtgagtgcttgtgcaaggtccatcttcattttcgacgaaatggataagatgcacgctggcctgatcgacgcaatcaagccgtttcttgactactacgatcttgtggacggggtttcctaccaaaaagcaatgtttattttcctgtctaatgcaggcgctgagcggattaccgatgtcgccctggacttttggcggtcaggaaagcaacgagaagacatcaagcttaaggacatcgagcacgctctgtcagttagcgtatttaataacaaaaactcagggttctggcactccagtttgatcgatcggaacctcattgactactttgtgccctttctgcccctggagtataagcatctaaagatgtgtatcagggtagagatgcagtccagaggatatgaaatcgacgaggacatcgtgtctcgggtggctgaagagatgacttttttccccaaggaggaacgcgtgttctcggacaaggggtgtaagactgtgtttacaaagctcgactactactatgatgactag

SEQ ID NO: 138046 - DNA, 1011 bp, Artificial Sequence
  Description of Artificial Sequence: Synthetic coding sequence
atgctgcgtgcaggatggctgcgcggagcggccgcactcgccctattactcgctgctagagttgtggccgctttcgaaccaattactgtaggactagccatcggagcggccagtgctattacaggttacttgagctacaatgacatttattgccggttcgcggaatgctgtagagaagagagacctctaaatgcctctgcactcaaactggacctcgaggaaaaactgtttgggcagcatctggcaactgaagtgatcttcaaggccctcacaggttttagaaataacaaaaaccccaaaaagccccttacactgagccttcacggctgggccggcactggcaaaaactttgtaagccagatcgttgctgaaaatctgcatcctaaagggctcaagagcaatttcgtgcacctatttgtgtccacccttcacttcccgcatgaacagaaaatcaagctgtatcaagaccagctgcaaaaatggatccgcggaaatgtgagtgcctgcgctaactccgtttttattttcgatgagatggacaagctacatccaggaatcattgacgctattaaacccttcctggactactacgagcaagtggacggcgtcagttatcgcaaggctatctttatcttcctttcaaatgcagggggcgacttaatcaccaaaactgctttggacttttggcgagccgggaggaagcgtgaggacatacagctgaaagacttggaaccagtgctgagcgtgggtgtgtttaacaacaagcacagcggcctgtggcactctgggctaattgacaaaaatctgatcgactactttatcccattcttgcctttagagtacaggcatgtaaagatgtgtgtgcgagcggaaatgagagcaaggggatccgctatcgacgaagatatcgtgacacgggtagcagaggagatgacattctttccccgcgacgaaaagatctattctgacaaaggatgcaagacagttcagtctcgactcgactttcactag

SEQ ID NO: 138047 - DNA, 426 bp, Artificial Sequence
  Description of Artificial Sequence: Synthetic coding sequence
taacgtgtcgtagccgctttcgaacctattaccgttggtctcgctattggcgcagcatccgctattaccggctaccttagctataacgacatctactgtcggttcgctgagtgttgcagagaggagaggcccctgaacgcgtccgcattaaagcttgacttggaagagaaactcttcgggcagcatctagccacagaagtaatcttcaaggcactgacagggtttcgaaacaacaaaaacccaaagaagccgctgacactctccctccatggctgggcagggacaggcaaaaattttgtttctcagatagtggccgaaaatcttcatcctaagggacttaagagcaacttcgtgcacctttttgtaagcacactgcatttcccacacgaacagaaaatcaagctttaccaaagcagtctgacctag

SEQ ID NO: 138048 - DNA, 918 bp, Artificial Sequence
  Description of Artificial Sequence: Synthetic coding sequence
atgctccgtgcgggatggctgaggggggctgcagctctcgccctgctgctcgccgctcgagtggtcgcagcgtttgaacctataaccgtggggttggcaattggcgccgcgtctgccatcacagggtatctcagctataacgacatttattgccgattcgccgaatgctgtagagaagagcgccccctgaacgctagcgccctgaaattggacctggaggaaaagttgtttggacagcacctagcaacagaagtgatttttaaggcactaactgggtttcgtaataacaaaaaccctaaaaagccacttacccttagcttgttcgtgtcgactcttcactttccccatgagcagaaaattaagctctaccaagatcagttgcagaaatggattagagggaacgtgagcgcttgcgccaattcagtgttcatcttcgacgagatggacaaactgcatcctggtatcatcgatgcaatcaaacctttccttgattattacgagcaggtagacggcgtgtcctataggaaggctattttcatcttcctcagcaatgccggcggtgatctgatcaccaagacggcactggacttttggagagcaggcaggaagcgtgaggacattcaattgaaagacctggaacctgtgctgtcggtgggggtgtttaacaataagcacagcgggctgtggcatagcgggttgatagacaagaatctgattgactatttcattcccttcctgccactcgagtataggcacgtgaagatgtgtgtccgcgccgagatgcgggcccgaggcagcgccattgacgaggatatcgtgacccgcgtcgccgaagagatgacctttttcccccgggacgaaaaaatctactcagacaaggggtgtaaaaccgtgcagtccaggctagatttccactag

SEQ ID NO: 138049 - DNA, 1011 bp, Artificial Sequence
  Description of Artificial Sequence: Synthetic coding sequence
atgctccgtgggccctggcgccaattgtggttgttctttctcctgctacttcccggtgcccccgaaccccgtggcgcaagccggccctgggaaggcacagatgaaccggggagcgcttgggcttggcctggttttcagcgcctccaggaacagctgcgggctgccggcgcactgtcaaagagatattggactctcttctcctgccaggtctggcctgacgattgtgatgaagacgaagaggcagccacaggccctttagggtggaggctgcctctcctgggtcagcgctacttggacctactgacgacctggtattgctcatttaaggactgttgtcctcgaggtgactgtagaatcagcaacaattttacaggtctggagtgggacctgaacgttcgcctccacggacagcatctggtccagcaactcgtcttacggaccgtcaggggctatttggagacaccacagccagaaaaagctctcgctctctctttccacgggtggtcaggaaccgggaagaatttcgtagcaagaatgttggtcgagaacttataccgagatggactgatgagcgattgtgtgcgaatgttcatcgccacgtttcacttcccccatccaaagtacgtagatctgtacaaagagcagctgatgtcacaaatccgtgaaactcagcagttatgccaccaaacactatttatattcgacgaagcggagaaactgcacccgggcctgttggaggtgttggggccccacctggagaggcgtgcccctgaggggcatagagccgagagcccctggaccatttttctgttcctttccaatctgaggggcgatatcataaatgaggtggtgctcaagctgctcaaggccggttggagccgggaagagataacgatggagcatctggagccccatctgcaggcagagatcgtagaaaccatcggcttctcgtttcttacaactaggtggcctcacctggatttacccacatccagcgttgcgccaacgtag

SEQ ID NO: 138050 - DNA, 462 bp, Artificial Sequence
  Description of Artificial Sequence: Synthetic coding sequence
atgttgcggggcccttggcgtcagttgtggctgtttttcctgctattgctgcccggtgcgcctgaacctcggggcgcttcaagaccttgggaaggcacagatgaaccaggcagcgcgtgggcttggcccggatttcagagactgcaggagcagctgagagccgctggggccttatctaaacgctattggacactcttctcctgccaggtttggccggacgactgcgacgaggacgaggaagctgcgactggaccattaggatggagactgcctctcctcggtcagcgctatctcgatctattaacaacttggtactgtagcttcaaggattgttgtccaaggggagattgtagaatctccaataacttcaccggaaagaactttgtggccaggatgctggttgagaacctgtatcgcgatggcctgatgtcagactgcgttcggatgttcatcgccacatag

SEQ ID NO: 138051 - DNA, 1194 bp, Artificial Sequence
  Description of Artificial Sequence: Synthetic coding sequence
atgttaagaggaccctggagacagctctggcttttttttctgcttctactgcctggggctccagagcccaggggggcctctcgcccgtgggagggcacagatgagcccgggtccgcctgggcttggccgggcttccaaaggttacaggagcagctgcgggccgctggcgcgctgagcaagaggtactggaccctgttttcatgtcaagtttggcccgacgactgtgatgaagatgaagaagccgccaccggcccgctcggctggcgcttgccacttctcggacagagatatctggacctcttgaccacatggtactgtagttttaaagattgctgtcctcgaggagactgccgaatctccaacaattttaccggcctggagtgggatctgaacgtgcgcttgcatggccagcacttggttcagcagctcgttcttcgaacggtcaggggttatctggagactcctcaaccagagaaagccctggcactgtccttccacggctggagcgggacagggaaaaactttgtcgcccggatgctggtggagaacctataccgtgatggccttatgtctgattgcgtacgtatgtttattgccaccttccactttccacaccctaaatatgtcgatctgtacaaggagcagctcatgagccagattcgtgagactcagcagctgtgtcatcagaccttatttatctttgacgaggccgagaagttgcaccccggactcttggaagtcctgggaccccatcttgaacgtagggctcccgaagggcacagggcagaatctccctggaccattttcctttttttgtccaatctccgcggagatattattaatgaagtggtgcttaaacttttgaaggccggctggagccgtgaggagattactatggaacaccttgaaccccaccttcaggcagaaattgttgaaactatcgacaatggtttcggacattcaaggctggtcaaggaaaacctcattgattactttattccatttctccccctggaatataggcatgtgagattatgtgccagagatgcatttctcagtcaggagctgttgtacaaagaggaaactttggacgaaattgctcaaatgatggtgtatgtgccgaaagaagagcaactcttttcctcccagggctgtaaatcaatcagccagagaattaattacttcttatcctag

SEQ ID NO: 138052 - DNA, 525 bp, Artificial Sequence
  Description of Artificial Sequence: Synthetic coding sequence
atgggtctctgcgtgcctttcgccgtgactacctcttttctgtcattaggactggagtgggacctgaatgtgcggttgcacggacagcacctcgttcaacagttggtgcttcggaccgtgcgtggatatctcgaaacacctcaacccgaaaaggccctcgccctatcttttcatggctggtccggtacagggaagaattttgtggctcggatgctggtcgagaatctgtaccgcgatgggctcatgtcagactgtgtaaggatgtttatcgctaccttccactttccacaccctaagtatgttgatttgtacaaagaacagctcatgtcccagattcgtgagactcagcaattgtgccatcagactctctttatctttgatgaggctgagaaactccatcctgggctgttggaagtcctggggccacatctggagcgtagggcaccagagggccatcgtgcagaatcaccctggacaatctttctgtttctttccaacctgcggggggatattattaacgagtag

SEQ ID NO: 138053 - DNA, 1866 bp, Artificial Sequence
  Description of Artificial Sequence: Synthetic coding sequence
atggaattccccggaggcaacgataactatctgaccattacgggcccaagccatccttttctcagtggtgctgagacctttcatacaccttctctgggagacgaagaattcgagatccctccaatttccttggattccgatccatccctcgccgtatccgacgttgtcggccacttcgacgatcttgctgacccttcctcttctcaagatggaagtttttccgcccagtacggagtgcaaaccctggacatgcctgtgggcatgactcatggactcatggagcagggcggcggccttctgtctggaggattaacgatggacttggatcattctattggtactcaatattcagccaatccaccagtgactattgacgttcctatgactgatatgacatctggcctgatgggacattcacagctgacaacaatagaccaaagtgaactgtcttcccagctggggcttagcttgggcgggggaaccatcctgccaccagcccagagccctgaagacaggcttagtacaaccccgagccctacatctagcctgcacgaggacggtgtggaagattttagacgtcagctgccatcacagaagactgtggtcgtcgaggccgggaagaaacagaaggctcccaagaagaggaagaagaaagaccccaacgagccacaaaaaccagtctctgcttatgcgctgtttttccgggatacacaggccgccatcaaaggccagaatcctaacgccacctttggggaggtaagcaagatcgtggcctcgatgtgggactccctgggggaggagcagaagcaggtgtacaagcgcaagaccgaagcagccaagaaggagtacttgaaagcacttgcagcgtacaaagacaaccaagaatgtcaggccacggtcgagacagtggaactagaccctgctccccctagccagacgccaagcccaccacctatggctactgtagatcccgcctctccagccccggccagcatcgagccgccggccctgagtccatcaatcgtcgtaaactctacgctgagctcctatgtggctaaccaagctagcagcggcgctggtggccagccaaatattactaagctgattatcactaagcaaatgttgccttcctcaatcacaatgtcccagggcggaatggtgaccgttattcccgctacggtggttacttcaagagggttgcagctgggccagacaagcaccgctacaattcagccgtcacaacaggctcagatagtcacccgcagcgtccttcaggcagccgctgccgccgcggccgccgctagcatgcaacttcctcctccacggttgcaacctccccctctgcagcagatgcctcagccccccacgcaacagcaggtcactatactccaacagcctccccccttacaggctatgcagcaaccgcctcctcaaaaagtgaggatcaatctgcagcagcaacccccgcccctgcagataaagtcggtgcccctgccaacccttaaaatgcagaccacattagtgcctcccaccgtcgagtcctctccagagcggcccatgaataacagtcctgaagcgcataccgttgaagctccatcgccagaaaccatctgtgagatgatcactgatgtagtgccggaggttgagtcacccagccagatggatgtggagctggtgtccgggagtccagtggctttgtccccgcagccccggtgtgtgagatcaggatgtgaaaatccccctatcgtttccaaggactgggacaacgagtattgcagtaacgagtgcgtagtgaaacattgtcgcgatgtctttcttgcctgggtagctagtagaaattccaatacagtagtgttcgttaaatag

SEQ ID NO: 138054 - DNA, 1866 bp, Artificial Sequence
  Description of Artificial Sequence: Synthetic coding sequence
atggagttccccggagggaatgataattatctgaccataacgggcccatcccaccccttcctgagcggagcggaaacgttccacaccccatccctgggcgacgaggagtttgagatacctcctatttccttagattcagaccccagcctcgccgtatccgacgtggttggtcattttgatgacctcgctgacccatccagctcccaggacggatccttcagcgctcagtatggtgtccagacactggacatgcccgttggaatgacacacgggctgatggagcagggaggggggctactgtccggcggcttgactatggatcttgatcacagtattggcacacagtactcagctaacccacccgtcactattgatgttccaatgaccgatatgaccagtgggttaatgggtcacagtcagctgaccaccatcgaccaatccgagctgagtagtcagttggggctgtctctggggggtggtaccattttgccgcctgcacaatccccagaggacaggctgagtacaacccccagccccacctccagcctccacgaggacggagttgaggattttcggagacaactccctagtcagaaaacagtcgttgtggaagcgggcaagaaacaaaaggcacccaagaagcgcaaaaaaaaagaccccaacgaaccacagaagcccgttagcgcctacgcgttattcttccgtgacacacaagccgcaatcaagggccagaacccaaacgccaccttcggggaagtatccaaaattgtcgcgtccatgtgggacagcttaggcgaggaacagaaacaagtgtacaagcgcaagacagaggctgcaaagaaggagtacttaaaggctttggcggcttacaaagacaaccaggaatgtcaagcgacggtggagaccgtagagttggaccctgcgcctccttcacagacaccttcacctcctcccatggctacagtggacccagccagcccagcgccagcatcaatagaacctcccgccctttctccttcaatcgtagtcaattcaacactctctagttacgtggctaaccaggccagtagtggagcagggggtcagcctaatattaccaaactgataatcacaaaacagatgttgccaagcagtattaccatgtcacagggtggaatggtgactgtcattcctgcgactgtcgtgacctcgcgggggctgcaattggggcaaaccagtactgccactattcagccctctcaacaagcccaaatagtgaccagatcagttttacaagccgccgcggccgccgctgccgccgcaagtatgcagcttcctccacctagactgcagccaccaccactgcagcagatgccacagccccctacccagcaacaggtgactatattacaacagccccccccactccaggccatgcagcaaccaccacctcagaaggtacgcatcaatctccagcagcagccgcctccactgcaaatcaagtccgtgcctctgccaactctcaagatgcagacgaccctggtcccgccaaccgtggagtcctcccctgagaggcccatgaataattccccggaagcacacacagtggaagcgccgtctcccgaaacaatctgcgaaatgatcactgatgtcgttcccgaagtggagagccctagccagatggacgtggaactggtgagtgggtccccggtagctctctcaccacagcctcgctgtgtgagaagtggctgtgaaaatccccccattgtgtccaaggactgggataatgaatattgctctaatgagtgcgtggtgaaacactgtagagacgtcttcctggcctgggttgcctctaggaattcgaatacagtggtttttgtgaagtag

SEQ ID NO: 138055 - DNA, 1797 bp, Artificial Sequence
  Description of Artificial Sequence: Synthetic coding sequence
atggagacctttcatacccccagcctgggtgatgaggaatttgagattcctcccatctcccttgacagcgatccctccctggccgtaagcgatgtagttgggcattttgatgacctggcagacccttcgagctcacaggacggaagcttttccgctcagtacggagttcagacgctggatatgcctgtaggtatgacccacggcctcatggaacaagggggggggctgctgagcggaggtcttacaatggacctggaccattccatcggcacacagtacagcgccaatccccctgtaacgatagatgtacctatgactgatatgactagcggcttgatggggcatagtcagttgaccactatagatcaatcagagctttcttcacagctggggctaagcttaggtggaggaacaattctcccgcctgcccagtccccagaggatcgtttgtcaactacaccgagtccaacaagttctctgcacgaggatggtgtcgaagattttcgcagacagcttccttctcagaaaaccgtggtagttgaggctggtaagaagcagaaggctccgaagaagaggaaaaagaaagacccaaatgagcctcagaagcccgtgagcgcatatgccctattctttagggacacccaggccgccatcaaaggccagaatcctaacgctactttcggcgaggtttccaagatcgtggccagtatgtgggatagccttggcgaagagcagaagcaagtatataagaggaagaccgaggccgcaaaaaaagagtacctgaaggccttggccgcgtataaggacaatcaggagtgtcaggccacggtggagaccgtggagcttgatccggctccgccatctcaaaccccgagtccccccccgatggcaactgtggacccggcttcacccgcgcctgcctccatagagccgcccgcgctgtccccctctattgtggttaatagcacactttctagctatgtcgccaaccaggcttcctctggggccgggggccagccaaacatcactaagttgatcattacaaagcaaatgttgcccagcagcatcaccatgagtcagggaggcatggtgacagtgatccctgctacagtagtcaccagtcggggcttgcagctggggcaaacatcaacagcaacgatccagccctctcagcaggcccaaatcgtgacccgcagcgtgcttcaggcggccgcagcggctgccgccgccgctagcatgcagctaccgccaccccgcctgcagcccccgcctctacagcagatgccccagccccctacacagcagcaggttacaatccttcagcagccccccccgcttcaggcaatgcagcaaccaccaccgcagaaggtgaggatcaacctgcagcagcaaccaccccctctccagatcaaatcagtccccctacccaccctgaaaatgcagacaactctcgtgcctcctacagtggagtcaagcccagaacggccaatgaacaattcccctgaggcacacaccgtggaggctcccagccctgaaacaatatgtgaaatgatcaccgacgtggtccccgaggtggagtcccctagtcagatggatgtggagcttgtctctgggtcaccggttgcccttagcccacagcccaggtgcgtcaggtcaggctgcgaaaatccccccattgtttcaaaagactgggacaatgagtactgctctaacgagtgtgtagtgaagcattgcagggatgtgttcttggcgtgggtcgcttcacgtaatagcaacactgttgtgttcgtaaaatag

SEQ ID NO: 138056 - DNA, 1650 bp, Artificial Sequence
  Description of Artificial Sequence: Synthetic coding sequence
atgcgaaacctcaagtctcatctctctccatggatcctgatccctcactggctctcccagatgtggctcgccacactcatgacctggcagttcttttcccctgatttggatcatagtattgggacacagtattcagctaacccacctgtgaccatagacgtacccatgacagatatgaccagcgggttaatgggtcactctcaactcaccaccatcgatcagagtgagctgtcgagccagcttgggttgtcactcgggggcggaacaattttaccacccgcccaaagtccagaagatcgacttagcactactccaagcccgacctccagtttgcatgaagatggcgtcgaagacttccgacgtcagctaccctctcagaagaccgtagtggtggaggcgggaaagaagcagaaggcaccaaaaaagaggaagaaaaaggatccaaacgaaccacagaagcccgtgtctgcatatgccttgttctttcgtgacacccaggccgccatcaagggccagaatccaaatgccacattcggtgaggtaagcaagattgtggcgtccatgtgggatagtctgggagaagaacagaagcaggtgtataagcggaagaccgaagctgcaaagaaggagtacttgaaagccctcgctgcctataaggacaatcaggagtgccaagctaccgtcgagacggttgagctcgatcctgcaccaccatctcaaactccatcaccaccccccatggctacagtggatcctgcaagccccgccccagcctccattgaaccgccggctctctctccatcaattgtggtaaactcgacactctcttcctacgtggcaaatcaggccagcagtggcgccggtgggcaacctaatatcacaaagttaatcattacaaaacaaatgctgccctctagcatcactatgagccagggaggcatggtgaccgtcatccccgccacagttgtcacgagtcgagggctccagcttgggcagacgtctaccgctacaattcaacccagtcagcaagcacaaatagtgacccgtagtgtactgcaagccgctgctgcagcagcagccgccgcgtccatgcaactgccccctcctcgtctccagccgcctccgctgcaacaaatgcctcagcctccgacacagcagcaggtgactattctgcagcaacccccgccgctgcaggctatgcagcaaccacctcctcagaaagtccggatcaaccttcaacagcaaccaccccctttgcagattaagtctgtccctctgccaaccctgaaaatgcagaccaccttagtcccccctacagtcgagtcttctcccgaacgacctatgaataactcgccagaggcccataccgtcgaggcaccaagcccagaaacgatctgcgagatgattacagacgttgtgccggaggtcgaatcccctagtcagatggacgtggagctggtaagcggatccccagtggccctttcccctcagcccaggtgcgtcagaagcgggtgcgagaatcctcctatagtcagtaaagactgggataacgagtactgttccaatgagtgcgttgtcaagcactgccgcgacgtattcttggcatgggtggcatcccggaatagcaacaccgtggtttttgttaagtag

SEQ ID NO: 138057 - DNA, 1020 bp, Artificial Sequence
  Description of Artificial Sequence: Synthetic coding sequence
atgatgccattttgtcacaacatcattaatatctcctgtgtgaaaaacaactggtctaacgatgtgcgcgcctcactgtattcactgatggtgctcatcattctcaccactctggtggggaacttgatcgttattgtgtctatttcacatttcaagcagctgcacacacccacaaattggctcatccattctatggccaccgtcgacttcttattggggtgccttgttatgccctacagcatggttcgatctgccgagcactgctggtatttcggggaagtgttctgtaagatccacacctctactgatattatgcttagctccgcgtccatttttcacctctccttcatcagcatcgacaggtattacgctgtctgtgatccgcttagatataaagcaaagatgaatatcctagtaatctgtgtaatgatattcatatcctggtccgtcccggctgtgttcgccttcggaatgatcttcctggaactgaacttcaagggtgcagaagagatctactataagcatgttcactgtcggggcggatgttccgtgttcttctcgaagataagcggagtactgaccttcatgacgtcattttacattcctgggtccattatgttatgcgtttattacagaatctacctgatagcaaaggaacaagcccgtctcatctcagacgcaaatcagaagctgcagatcggtctggaaatgaaaaacgggataagtcagagcaaggaaaggaaggctgtcaagaccctcggtattgtgatgggagtgttcttaatctgttggtgtccctttttcatttgcactgtgatggaccccttccttcactacattattcctcctacactgaatgacgtactgatctggtttgggtacttgaacagtaccttcaaccccatggtttacgccttcttctatccctggttccggaaggctctgaagatgatgctatttggaaaaatttttcaaaaagactcctctcgatgtaagctgttcctggaactgtctagttag

SEQ ID NO: 138058 - DNA, 921 bp, Artificial Sequence
  Description of Artificial Sequence: Synthetic coding sequence
atgtacagcttcatggccgggagcatattcatcaccatcttcggcaatctcgctatgattatctccatctcctatttcaagcagctgcataccccaaccaacttcctaatcttaagtatggccataacggactttctacttggcttcacgattatgccttatagcatgatcagatcagtggagaattgttggtattttggtctgacattctgcaagatttattactcttttgacttaatgctgtccattacttctatcttccatctgtgtagtgtggccattgatcgcttttatgctatctgctacccactgctgtacagcacaaaaattaccatcccagtaattaaaagactgctcctgctctgctggtccgtcccaggcgcattcgcctttggtgtggtctttagtgaggcttatgctgacggcatcgaagggtacgacatcctggtagcctgctcgagttcatgccctgtcatgtttaataaactctgggggactacactctttatggccgggttttttaccccgggctcaatgatggtgggcatctatggaaagatttttgccgtgagtcggaagcacgctcatgctatcaataatttgcgggaaaatcagaataaccaggtcaagaaagacaaaaaggctgctaagacgcttggaatagtgatcggcgtgttcctcttgtgctggtttccttgctttttcaccatccttctggatccgtttctgaatttctccaccccagtagtcctgtttgacgccttgacttggttcggatacttcaacagcacctgtaatcccctgatctatgggtttttttacccatggttcagacgggcccttaagtacatcttgctcggcaaaatcttctcatcctgtttccacaataccatcctctgtatgcagaaggagtctgaatag

SEQ ID NO: 138059 - DNA, 1056 bp, Artificial Sequence
  Description of Artificial Sequence: Synthetic coding sequence
atggctgtgtcaagcgaacaacatgaactgagccactttaaacgcacccaaacaaagaaggagaagtttaattgctcagagtacggcaataggtcatgccccgaaaatgagagaagcttgggcgtgcgtgtggcaatgtattcttttatggccgggtccatcttcattaccatcttcgggaacttagccatgataatatccatcagttatttcaaacagctgcacacacccacgaacttcctcatcctctccatggcgataaccgatttcctgctgggttttacaatcatgccatactcaatgatccgcagtgtagagaactgttggtattttggattgaccttctgcaaaatctactacagcttcgatctgatgttatctatcaccagcatctttcacctgtgctctgtcgccatagatagattctatgctatttgctaccctctactgtacagtacaaagataactatccccgtcatcaaacgcctgctgctgctgtgctggtccgtcccaggagctttcgctttcggcgtggtgttctccgaggcttatgccgacgggattgagggatatgatattttagtcgcctgcagctcaagttgcccggtgatgtttaataagctgtggggcacaacactttttatggccggatttttcacacctgggagtatgatggtgggcatctacggcaaaatatttgcggtatccaggaaacacgcccacgcgatcaataatcttagagagaatcagaacaaccaggtgaaaaaggacaagaaagccgcaaaaacccttgggatagtgatcggagtgtttctgctctgctggtttccctgtttcttcaccatcctcctcgatcccttcctgaacttttcaacacctgtagtgctgttcgacgccttaacgtggtttggctatttcaattccacctgtaaccctctgatctacgggtttttctacccatggttccgcagggctttaaaatacatcctgctggggaaaattttctcatcgtgtttccataataccatcctgtgtatgcagaaggaaagcgagtag

SEQ ID NO: 138060 - DNA, 921 bp, Artificial Sequence
  Description of Artificial Sequence: Synthetic coding sequence
atgtattcctttatggcaggaagcatttttatcaccatctttggcaatctcgctatgattatatccatctcctacttcaaacaactgcatacaccaaccaattttctgattctgtccatggctatcaccgactttttgctgggctttaccatcatgccatactccatgataagatccgtggaaaattgttggtacttcgggctgaccttttgtaaaatctattattccttcgacttgatgttgtcgataacttctatcttccatctgtgtagtgttgctattgaccgattctacgcaatctgttacccattgctgtactcaactaagatcactattcctgtgataaagaggttgttgctcctgtgctggtctgtgcccggagccttcgcattcggggttgtgtttagtgaagcttatgccgatggaatagaaggctacgacatcctagttgcgtgttccagttcttgtccagtgatgtttaataagctttggggcaccactctttttatggctggtttctttaccccaggaagcatgatggtcggtatctacgggaagatctttgcggtgtcaagaaaacacgcacatgccatcaacaacctccgcgaaaatcaaaataatcaggtaaaaaaagacaaaaaagcggcaaagacactcggtatagttatcggggtgttcttgctgtgctggtttccttgcttttttactattctgctggatcctttcctgaatttctctactcccgtggtactgttcgacgctctgacatggttcggctatttcaactccacatgtaatcccctgatctacggattcttctatccttggttccgcagggcgttaaaatatattctgctcggaaaaatattttccagctgctttcacaacaccatactgtgcatgcagaaagagtccgagtag

SEQ ID NO: 138061 - DNA, 1038 bp, Artificial Sequence
  Description of Artificial Sequence: Synthetic coding sequence
atgtcttctaatagcagcctcctggtcgccgtgcagctctgctacgcaaacgtcaacggaagctgcgtgaaaattcctttttcccccgggtctcgcgtcattctgtacattgtgttcggatttggtgccgtgttagccgtgtttggcaacctccttgtgatgatctcaattttgcacttcaagcagctccactctcctactaactttctcgtcgcctctctcgcttgcgccgatttcctggttggggtgaccgttatgccattttctatggttcggacggttgaaagttgttggtacttcggcagatctttctgtacattccatacatgctgtgacgtagcgttttgctatagttcactcttccacctgtgcttcattagtattgacaggtatatcgccgtcactgatccacttgtttatcccactaagttcactgtgtctgtgtccggaatatgtatttcagtttcctggatcctccctctgatgtactcgggtgcggtgttttacactggcgtgtatgatgatggactggaggagttgagcgatgccctgaattgcattggtggctgccagacagtggtgaatcaaaactgggtgcttacagacttcctgtccttcttcattccaacattcattatgatcattctctacggtaatatattcctcgtggctcgacgccaggccaaaaagattgagaatacgggatcaaaaacagaaagttctagcgagagctataaagcacgcgtggccagacgagagcgcaaagctgccaagaccctcggagtaacagtggtggcctttatgattagctggctcccttactccatcgatagcctcatcgacgctttcatgggctttattaccccagcttgcatttacgagatctgttgctggtgtgcttattacaacagcgcgatgaatccgttaatctacgcattattttacccctggttcaggaaggccattaaagtaatcgtgacgggccaggtgctcaaaaacagctccgctacaatgaaccttttctccgaacatatttag

SEQ ID NO: 138062 - DNA, 957 bp, Artificial Sequence
  Description of Artificial Sequence: Synthetic coding sequence
gtgaacgggtcatgcgtgaaaataccctttagccctggaagccgagtgatcttgtacattgtgttcggattcggggcagtgctggccgtctttggcaacctcctcgtaatgatctcaatcctgcatttcaaacaattgcactccccaacaaactttcttgtggcgagcctcgcctgtgctgacttcctcgttggtgtgactgttatgcccttcagcatggtccgcacagtggagagttgttggtattttggtcggagtttctgtacattccacacttgttgcgatgtggctttctgttattcaagcctgttccacctctgctttattagcatcgatagatatatagccgttacggatcctctggtataccctactaagttcacagtatcagtgtcagggatctgcattagcgtctcatggattctcccacttatgtactccggtgctgtgttttacacaggggtctacgacgatggcctcgaagagctcagcgacgcactcaactgcattggcgggtgccaaaccgtggtgaatcaaaactgggtgctcactgacttccttagcttcttcattcctaccttcatcatgatcatcctatatggcaacatcttcttagtcgctcggagacaggccaaaaagatagaaaatacagaatcatataaagcacgcgtggcgcgtagagaaagaaaagccgccaagaccctgggtgtaacagtggtggcattcatgatcagttggttaccatatagcatcgatagcctgattgacgccttcatgggatttatcactccggcatgcatctacgaaatttgctgttggtgcgcatactataactccgccatgaatccactgatttacgccctgttttacccttggtttcgcaaggcgatcaaagtgatcgtcacagggcaggttctgaagaattcttcagcaacgatgaacctcttcagtgaatag

SEQ ID NO: 138063 - DNA, 1410 bp, Artificial Sequence
  Description of Artificial Sequence: Synthetic coding sequence
atgcctatcagagcattgtgcaccatctgctcagacttcttcgaccattcaagagatgtcgccgccatccactgcggccacacctttcacttgcagtgtttgattcagtggttcgagaccgcgccgtcccgtacatgtccacaatgccgcatccaggtgggaaagcggacaattatcaacaaactctttttcgatttggcccaggaagaggagaatgtactggatgccgagttcttaaagaacgagctggacaatgtgcgggcgcaactgagtcagaaggataaggaaaagcgcgatagccaggtgatcattgacactctgagggacacgctggaggagcggaatgcaacagtcgtatcactgcagcaggcactgggcaaggccgagatgctgtgttctaccttgaagaagcagatgaaatacctagagcagcagcaggatgaaacaaagcaggcgcaggaagaggcccgccggctacggtcaaaaatgaaaaccatggagcagattgagcttttgctgcagtcccaacgtcctgaggttgaggaaatgatccgtgacatgggtgtgggacagtccgctgttgagcagctggctgtctactgcgtctcgctaaagaaagagtacgaaaacctgaaggaagcccgcaaggccagcggggaagtggctgataagctgaggaaggatctcttctcttcacggtctaagctgcaaacggtgtatagcgaactggaccaggcgaagctcgaactgaaaagcgctcagaaagatctccagtcagccgacaaggagataatgagtctcaagaaaaagctaaccatgctgcaagagacgcttaacttgccacctgtggctagtgaaaccgtcgatcgactcgtgttagagtcacccgcccccgtggaagtcaacttgaagttacgccgccctagtttcagagacgacatagacctgaacgccactttcgacgtggacacccctcccgccagacctagctcttcacagcatgggtactacgagaaactgtgcctggagaagagtcatagccccatccaagacgttccaaaaaaaatctgcaagggacctcgtaaggaatctcaactgagtctgggaggccagagctgcgctggggaaccagacgaagagttggtgggcgctttccctatttttgtgcgcaatgctatccttggacagaaacagccaaagagacctaggagcgaatcatcttgttcaaaagatgtggtgcggacaggatttgacgggcttggtggccggacgaagtttatacagccaaccgacactgtcatgatacggccattacccgttaagccaaagacaaaggtgaagcagagggtgcgggtaaaaaccgtcccatctctgttccaagctaaactcgacacctttctttggagttag

SEQ ID NO: 138064 - DNA, 4059 bp, Artificial Sequence
  Description of Artificial Sequence: Synthetic coding sequence
atggcctcagatagtcctgctcggagcctggatgaaatcgatctcagcgctctacgggaccctgccgggatattcgagctggtggaactggtaggaaacggcacatacggacaggtgtataagggccggcacgtcaagacagggcagctggccgcaatcaaagtgatggatgtgacaggggatgaagaagaggaaattaagcaggaaatcaatatgctcaagaagtattcccaccaccgcaacatagccacatattacggagctttcataaaaaaaaatccccctggcatggatgaccagttgtggctggttatggaattctgcggcgctggaagtgtcacggacctgattaagaacaccaaggggaacaccttgaaagaagagtggattgcctatatctgtagggagatcctgcggggcctgtcgcatctccaccagcataaggtgattcacagagacattaaaggacagaatgtcctgttaaccgaaaatgctgaggtcaagctcgttgacttcggcgtcagcgcccagctggaccgaaccgttgggcgtcgaaatacctttattggcaccccgtactggatggctcctgaggttatagcttgcgatgaaaatccagatgccacgtacgattttaaaagtgacctctggtccttgggcatcaccgctattgagatggcggaaggagcccctccactctgcgatatgcacccaatgagggcactgtttctgatcccccgcaatcctgcacctagactaaaatccaagaagtggtcaaagaagttccagtcctttatagagtcgtgtctcgtcaaaaaccattcacagaggcctgcgacagagcagctaatgaagcaccctttcattcgcgaccagccaaacgaaagacaggtgcgaatccagctcaaggaccacatcgaccgaacaaaaaagaagcggggtgagaaagacgaaaccgagtacgagtacagtggatcagaagaggaagaggaagagaacgactctggagagcctagctccatcctgaatctgcctggcgaatctaccttacgcagggactttctaaggctgcaattagccaacaaagaaagatcagaagcccttcgacgccaacaactcgaacagcaacagagggaaaatgaagaacataaaaggcagttgctggccgaaaggcaaaagagaattgaagaacagaaggagcaaagacggcgccttgaggagcaacagaggagagagaaagaattgcggaagcagcaggagagagaacagcgtagacattacgaggaacagatgcgtagggaagaagagcggagacgggctgagcacgaacaagaatatatccgaaggcagttagaggaagaacaacgtcagctggagatcctccagcaacaactcctgcacgaacaggctctgctgttggaatacaaaagaaaacagctcgaggagcaaaggcaggccgagcgcctacagcggcagctcaagcaggaacgagattacctcgtgagtttgcagcaccagcgccaggagcagagaccagtagagaaaaaaccactgtaccactataaagaaggtatgtccccctcagagaaaccagcttgggcgaaagaggttgaagaacgttcccgcctgaacaggcagagctccccggccatgcctcacaaggtggccaacagaatatccgacccgaatctgcctccccgtagcgagagcttttccattagcggcgtgcaacctgcccgtacgccaccaatgctcagacccgtggaccctcagattccccatctcgtggccgttaaaagccaagggcccgctttaacagctagtcagagcgtgcatgagcaaccaactaaggggttatccggctttcaggaggctcttaacgtgacctcacacagggtggaaatgccaagacaaaactcggaccccacgtcagagaatccaccgctccccacacgtattgaaaagtttgatcgatcctcttggctccgccaggaggaagacatccccccaaaggttcctcaaaggacgaccagcattagcccggcccttgctagaaagaacagccccggaaacggtagcgcactcggtcccaggctgggctcgcagcccatcagagcttcgaaccccgatctgcggcgaactgaaccaattctggaatcacctttgcaacgcacctccagcggaagcagcagcagcagctctaccccctcaagccaacccagctcgcagggagggtctcagcccgggtcccaggcgggctcatccgagcgcaccagagtgcgagctaactcaaaatcagaggggtctccagtacttccccacgaaccagcgaaagtcaaaccagaggaaagccgtgacatcacacgaccttctaggcctgctgatttaacggcattagcaaaagagctcagggagttgaggatcgaagagacaaaccggccaatgaagaaggtgacagactactctagctctagtgaagaatcagaaagcagcgaggaggaagaagaagatggggaaagcgagacacatgacggcaccgtcgctgtatcagatatacctagacttataccaacaggggcacccggaagcaatgagcaatataatgttggaatggttggcacgcacggactggaaactagccatgcagacagtttctcagggtctatctcacgcgaaggcaccctgatgattagggaaacatctggagaaaagaaacggtcaggacacagtgacagtaatggatttgcaggccacataaatctgcctgacctggtacagcaatcccacagccctgccggtacccccactgagggactgggaagggtgagtacccatagtcaagagatggacagtggcaccgagtatggaatggggtctagcacgaaagccagctttactccattcgtggatcccagagtctaccagacttcccctacggatgaggacgaggaggatgaggaatcctccgcggccgcattgttcacatccgagctgttacggcaggaacaggctaagttgaacgaagcgcggaagatcagtgtggtgaacgtgaatcctacgaacattcggccacactccgacacacctgaaattcgtaaatataaaaagaggtttaacagcgagattctgtgtgccgctctgtggggagtaaatcttctggtggggaccgagaacggtctcatgctgctggatagatcgggccaggggaaagtgtacaatctgattaatcgcagacggtttcaacaaatggacgtcctcgagggcctgaacgtgttagttacaatcagcggtaagaaaaataagctgcgtgtgtactatctcagttggttgaggaaccggatcctgcataacgaccctgaagtggaaaaaaaacagggatggatcactgtgggagacctggaaggatgtatccattacaaagtggtgaagtacgagagaattaaattccttgtgattgctctcaaaaatgcagtggaaatctacgcatgggctccaaagccctaccacaagttcatggcgttcaaaagtttcgccgatctgcagcataaaccattactggttgatctcaccgtcgaagagggccaaagactgaaggtcatttttggaagccacacaggatttcacgtgattgatgtggattccggtaactcatatgacatttacattccctctcacatacaaggcaatataaccccacacgcaatcgtcattctgccaaagacggacggtatggaaatgcttgtgtgttacgaggatgagggagtgtacgtgaacacctatgggcgaattactaaagatgtagtgttacaatggggagaaatgcccacctccgtggcatatatccactccaaccaaattatgggatggggagagaaggcaatcgaaattaggagcgtcgagacaggacacctggatggggtgtttatgcacaagagggcccagcggctgaagtttctgtgtgagcgcaatgataaggtcttttttgcctcggttagatcgggaggctcaagtcaggtgttttttatgaccctaaatagaaattcaatgatgaactggtag

SEQ ID NO: 138065 - DNA, 3831 bp, Artificial Sequence
  Description of Artificial Sequence: Synthetic coding sequence
atggccagcgatagccccgcccgttcattggacgagatcgacctgtctgccctcagggatccagcaggaatctttgagcttgtcgagctagttggaaacggaacatacggacaggtgtacaagggcaggcatgtgaagaccggacagcttgcggcaataaaagtgatggatgttactggcgacgaagaggaagaaatcaagcaggaaattaatatgcttaaaaagtacagccaccacagaaacattgctacatattacggtgcattcatcaaaaaaaatccgccaggaatggatgatcagctctggctggtcatggaattttgcggggccggctcagtgactgaccttatcaaaaataccaaaggcaatacgctaaaggaagaatggatcgcctacatttgcagagagatccttcgtggcttgagtcacctgcaccaacacaaggtgattcaccgtgacatcaagggtcagaacgtcctgttgacagagaacgcggaggtgaaactggtggactttggtgttagcgcccagctggatcgcacagtgggccgccggaatacctttatcgggaccccctactggatggctcccgaggtcattgcctgtgatgaaaatccagatgccacctatgacttcaaatccgacctgtggtccctaggaattacagccatagagatggcagagggggccccccccctctgcgacatgcacccaatgcgtgcgttgttcttgatccccaggaacccagccccgcggctgaagtctaagaagtggtcgaaaaagttccaatcgttcatcgagagctgcctggtgaagaaccactcccagcgacctgccacagagcaactgatgaagcatcctttcatccgcgaccagcctaatgaaagacaggtacggatccagctcaaggaccacatcgatcggacaaagaaaaagcgaggagaaaaggacgaaaccgagtatgagtactcaggctccgaggaagaggaggaagaaaatgatagtggtgagccatcttcaatcctgaacttaccaggagagtcaacactgagaagggactttttgagactgcagctggctaataaggagagatcagaggctctccgccggcagcagctggaacagcaacagagagaaaatgaggagcacaagagacagctccttgctgaacgacagaaacgcattgaggagcaaaaggaacagcgccgacgcctcgaagagcagcagcggagagagaaggagctacggaagcagcaggaaagggagcaacggaggcattatgaggaacagatgagacgcgaagaggaaagacggagagccgaacacgaacaggagtataagcggaagcagctggaagaacagagacaggccgaaaggctccagaggcaactaaaacaggaacgggattacctggtcagcttacagcaccagcggcaagagcagcggcctgtagagaagaaacccctataccactacaaggaaggcatgagcccctcagagaagcccgcatgggcgaaggagatccctcatctggtcgctgttaaatcccaagggccagctctgacggccagccagtccgttcatgagcaaccgacaaaaggactttcgggctttcaggaagccttaaacgtaacttctcatagggtggagatgccaagacagaattcagatcctaccagtgaaaatccacctctccccaccaggattgaaaaatttgatcgatcttcgtggctgcggcaggaggaagacatcccgccaaaggtcccacagcgcacaacaagcatctctcctgcactggcgcggaaaaattctccaggtaacggaagtgccctggggcccaggttaggctctcaacctatacgcgctagcaaccctgacctccgccgcacggaacccattttagaaagtcctttacagcgtacaagcagtggctcatctagttcttcatccaccccgtccagccaaccaagctctcagggcggatctcagcccggatcccaggccggaagtagcgaaagaaccagggttagagcaaactctaaatcagagggttcgccagtattaccacacgaaccagccaaggtgaagccagaagaaagtagagatattactagaccgagtcgcccagcttcgtacaaaaaagccattgacgaggatcttacggctctcgccaaagaactgagagagctgagaatcgaagagacaaacaggcccatgaagaaggtaacggactattcgtctagctccgaggagagtgagtcctccgaagaagaggaagaggacggcgaatctgaaacgcatgacggtaccgtagccgtgtccgacatcccccgacttattcccaccggagcaccaggctcaaacgagcagtacaatgtcggcatggtagggactcacggactggagacaagtcatgccgatagcttcagcggttcgatttcaagggagggtaccctaatgattcgagaaacatccggcgaaaagaagagaagcggtcattccgatagcaacgggttcgcaggccatatcaatttaccagatctcgtacaacagtctcattcccccgcaggaactcctacggaaggcctggggagggtcagcacacacagccaagagatggattctggaacagagtacgggatggggagttccacaaaggctagtttcacccctttcgtcgatccccgcgtataccaaacctcacctacagatgaagatgaggaagatgaggagagttccgccgctgccctcttcactagcgagctcctgagacaagagcaggcaaagttaaacgaagcgaggaagataagcgtggttaatgtcaaccctacaaacattagaccccactctgacaccccagagatccgcaaatacaagaaacgatttaattcggagatactctgcgcggctctgtggggcgttaacctgctggtcggaacggagaacgggttaatgctgctggaccgctctggtcagggaaaggtgtacaacctgattaaccggaggaggttccaacaaatggacgtgctggagggtttaaatgtgttggtgaccatctcgggtaaaaaaaataaactgcgggtgtactacctatcatggctgcgaaacagaattttacacaacgaccctgaggtagaaaaaaagcaggggtggatcacagttggcgatctggaagggtgcatacactataaggtggtgaagtatgagagaattaaattcttggtcatagcattgaaaaatgcggttgaaatatacgcatgggctcccaagccctatcataagtttatggcatttaagtcgttcgctgatctgcagcataaaccactccttgtggacctgacagttgaagagggacagcgactcaaagtgattttcggctcacacaccgggtttcatgtgatcgacgtcgacagtgggaacagctatgacatctatatccctagtcacatacaaggcaacataaccccacatgcaattgtgatcttaccgaagaccgacgggatggagatgctggtctgctacgaggacgagggggtgtatgtaaacacatatgggcgcattacgaaggatgtagtgttgcagtggggcgaaatgccgacaagcgtggcctatattcactctaatcagataatgggatggggagagaaagcaatcgagatcagatctgtggaaacaggccacttagacggtgtgtttatgcataagagagcacaacgccttaagttcttgtgcgagcgaaacgataaagttttttttgcctccgtgcgcagtggaggcagctctcaggtgttttttatgaccctgaataggaacagcatgatgaattggtag

SEQ ID NO: 138066 - DNA, 3996 bp, Artificial Sequence
  Description of Artificial Sequence: Synthetic coding sequence
atggcgtccgactcacccgcccggtcccttgacgaaatcgatcttagtgctcttcgggatcccgcaggtatcttcgagctcgtggaattggtcggaaatggtacctatggacaggtttacaagggccgtcacgtgaaaactggccaactcgctgctatcaaggtgatggacgtcaccggggacgaagaagaggagatcaagcaggaaataaacatgctgaaaaagtactcccatcatcgaaatatcgcaacatattacggggcatttattaagaaaaacccgccaggtatggatgaccagctctggctagttatggaattttgcggagccgggtctgttaccgatttaattaaaaacacaaaagggaatacactcaaagaggagtggattgcttacatttgtagagagatcctccgaggattgtcacacctgcatcagcataaagtgattcatagggatattaaagggcaaaatgtccttctgactgagaatgcggaggtgaagctagtggactttggagtgtcagcgcagctggatcgtacagtaggaagacgtaatacctttatcggcacaccttactggatggcgcccgaggttatagcttgtgacgaaaatcctgacgccacttacgacttcaagtccgacctgtggagcctgggcataacagcgatcgagatggccgaaggagcaccaccgttgtgtgacatgcatcccatgcgggccctgttcctgataccacgcaatcctgctccacgattaaagagcaaaaagtggtccaaaaagttccaaagtttcattgagtcctgtctggtgaagaatcactcgcagcgcccagcgaccgagcagctgatgaagcacccatttatccgtgatcaacccaatgagcggcaggtccgtatccagttgaaggaccatattgatagaacaaaaaaaaagaggggagagaaggacgagacagaatatgaatacagcggctcagaagaggaggaggaggaaaacgacagcggcgaacctagctcgatcctcaacctgccaggcgaatctaccttacggcgggactttttacgcctgcaactcgctaataaagagcggtcagaggccttacgcaggcagcagcttgaacagcagcagcgtgagaatgaagaacacaagcgtcaactgctcgctgaacggcagaaacgaattgaggagcagaaggaacagcgacgcagactcgaagaacagcagcggagagaaaaagagctgagaaaacagcaggagcgagaacagcgcagacattacgaagagcaaatgcggcgcgaggaggaacgtaggcgggccgagcacgaacaggagtacaaaagaaagcagctcgaagagcaacgccaggcagagcgcctgcagcgccagctcaagcaggaaagggattatctagtgagcctgcagcatcagcgccaggagcagcgccctgttgagaaaaagcctttgtaccactataaagagggcatgagcccaagcgaaaaaccagcgtgggctaaagaggtggaggagaggagcaggcttaaccgccagtccagccccgcgatgcctcataaggtcgccaaccgcatttccgaccccaatctgccacccaggtctgaatcattctcgattagcggcgtgcagcccgctcgcacccctccaatgctccggcctgtggacccacagataccccatctggttgcagtgaagagtcagggccccgcactgactgcttcccagtccgtgcatgaacagcccacgaaggggttatcaggcttccaggaagctctgaatgtcacttcccatcgcgtcgaaatgccccgacagaatagtgatcctacatcagaaaatccccccctgcctacacgcattgagaaatttgatcggagttcctggctgcgtcaggaagaggatatcccacctaaggttccgcagcgcactacgtccattagccctgctctggctaggaagaactctcccgggaacgggtccgctctggggccacgattgggctcacaacctattagggccagtaacccagacctaaggcgcacggaacccattttggagtctcctctgcagcgaacttctagcggctcctctagttcaagtagcacgccctccagccagccttcatcccagggcgggtcccagccagggtcgcaggccggcagttctgagagaacgagagttagggccaacagtaagtccgagggctccccggtgctcccccacgaaccagctaaggtgaaacccgaggagtcccgggatattacccgcccgtcgagacctgcttcatataagaaggcaatagatgaagatctgactgccctggcaaaggaattgcgggagttacgcatcgaagagaccaaccgccctatgaaaaaagtcacagactactccagctcctcagaagagtctgaatcttctgaagaagaggaagaggacggcgaatctgagacacacgacggaacagttgcagtgagcgacatcccccggctgattcccactggagctccagggtctaatgaacagtacaacgtcggcatggtgggcactcatggccttgaaacctctcatgccgatagtttcagcggatctatctccagggaagggaccttgatgattagagaaacctccggggaaaaaaagcggagcggacactctgactcaaacggtttcgccgggcacattaacttgcctgatctggtccagcagtcacatagccccgctggcactcctacagaagggctgggccgggtgagcacccattcccaagaaatggactcaggcacagagtatggaatggggagctccaccaaggcttcatttaccccttttgtggacccccgagtttaccagacaagtccaacggacgaagacgaagaagacgaggagtcatccgctgccgcactgttcacttctgagctccttcggcaagagcaggctaaattgaatgaggccagaaaaatctctgtggtcaacgtgaatcctaccaatatacgcccgcacagcgacaccccagaaattagaaagtataaaaaacggtttaactcagaaatattgtgcgctgcgttgtggggagtgaatctgctggtaggaactgaaaacggtctcatgctgctcgataggtctgggcagggaaaggtttacaatctaataaacaggagacgcttccagcagatggacgtgctcgaaggcctaaatgtgctggtaaccattagcgggaaaaagaataaactgcgggtctattatctgtcttggctacgaaatcgaatcctgcacaacgatccggaagtcgaaaagaaacagggctggataaccgtgggtgacctggagggctgcattcattacaaggtggtcaaatacgaaaggattaaatttttggtaatagcgctcaagaacgccgtagaaatatatgcttgggcaccaaaaccgtatcataaattcatggccttcaagtccttcgctgatttgcagcataagccgctcctggtggatctgactgtagaggagggccagagattgaaagttatattcggttctcacaccggatttcatgtgatagacgttgactccggcaattcttacgatatctacattccttcacatatacaagggaacatcaccccccacgcaatcgtgattctgcccaaaaccgatgggatggagatgctcgtctgttatgaagacgagggggtgtacgtgaatacgtatgggagaatcacgaaggatgtggtactgcagtggggagaaatgcccacatctgtcgcctatattcatagcaaccaaattatgggctggggcgaaaaggccatcgagatcagaagcgttgaaactggtcacttggacggcgtttttatgcacaaaagggctcagagactgaaattcctgtgtgaacgaaatgataaggtgttttttgcgagcgttaggtccggcggctctagccaggttttttttatgacactaaacagaaacagtatgatgaactggtag

SEQ ID NO: 138067 - DNA, 4017 bp, Artificial Sequence
  Description of Artificial Sequence: Synthetic coding sequence
atggccagtgacagccccgccagatcattggacgagattgacctctccgctctgagggaccctgccggaatctttgaacttgtggaactcgtcgggaacgggacctacgggcaagtatacaaagggcgccacgtcaagacaggccagctcgcagccattaaggtcatggacgtcacaggcgatgaggaggaggaaattaagcaggaaatcaacatgttgaagaaatacagccatcaccgcaacatcgcaacatattacggcgcattcattaagaagaatcctcctggtatggatgaccagctgtggctcgtgatggaattctgtggggccggcagtgtgacagatttgatcaagaataccaaagggaatactctgaaggaagaatggatagcctatatttgcagggagatcttgcgcggcctgtcacacttgcatcagcacaaggtgatccatcgcgacatcaaaggacagaacgtgctgctgacagagaatgcagaagtaaaaattgtcgattttggagttagtgctcagttggaccggaccgttggcaggaggaacacgttcataggtaccccttattggatggcacccgaggtgatcgcttgtgacgaaaatcccgatgccacctacgactttaaaagtgatctgtggtccctgggaattactgccatcgaaatggccgagggcgcgccaccactgtgtgacatgcaccctatgcgggcactgttcttgattcctagaaatccagccccgaggctgaaaagcaagaaatggagcaaaaaatttcagtccttcatcgagagttgccttgtgaagaatcactcacaacgtccagcgactgagcagctcatgaagcaccccttcataagggaccagcccaatgaaaggcaggtgcggattcaactgaaggaccatatcgatagaactaagaagaaaagaggcgaaaaagatgaaactgagtacgagtactcaggctccgaggaggaggaggaggagaatgatagcggagaaccgagctcgatactcaatttgcctggtgaatcgaccctgcgtagggacttcctacggctccagttggccaacaaggaacggtctgaggccttgagaaggcaacagttggaacagcaacagagagagaatgaggaacacaaaaggcagctcctggccgaaaggcagaaacgcattgaggagcagaaggagcaacggaggaggctggaagagcagcagcgtcgggagaaagaactaaggaagcagcaggagcgggagcaaaggagacattacgaggaacaaatgagaagagaagaagaacggaggagggctgagcacgagcaggaatataaacgcaagcagctggaagagcagcgccaggcagagagacttcagagacagctcaagcaggagcgggactatctggtgtccctgcagcatcagcggcaagagcagaggccagtggagaagaagcctttgtaccactataaagagggcatgagccccagcgaaaaacctgcgtgggcaaaggaagtggaagagcgctcacgcctgaaccgtcaatcatctccggcaatgccacacaaggtggccaacaggatttctgatccaaacttgcccccacgctctgagtccttcagcatctctggtgtgcaacccgccagaacaccccccatgctgcggccagtggatccccaaatcccgcacctggtcgccgtcaaaagtcagggcccagccctgaccgcttcacagtccgtccacgagcagccaacaaagggactatccggattccaagaggcccttaacgtgacaagccaccgtgtggaaatgcctcgacagaactcagatcccactagcgaaaatccgccgttgccaaccagaattgagaaatttgatcgctccagctggctgagacaggaagaggacatcccgccaaaggtacctcagcgcactacaagtattagtccagctttagctcgcaagaactcccccgggaacgggtccgccttaggaccaaggctaggaagccaacctatcagggcatccaacccagaccttcggcggacagagccaatcctcgaaagccccctgcagaggacttccagtggctcctcttcttcctcaagcaccccgtcatcccagccctcctcacaagggggctcacagccgggaagtcaggcaggatcctcagagcgtacacgcgtgcgagccaactcaaagagcgagggatctcccgtgttaccccacgagcctgctaaggtgaagccagaagagagccgagatataacacgcccctctagacccgcggtctcggcatttctgagcaaatctttcgagctacttatttatcaggatctgaccgccctcgctaaagaacttcgcgaactcagaatcgaggagactaatcgaccgatgaagaaagtgactgactatagcagctctagcgaagaatccgagagtagcgaggaagaagaggaagacggcgaaagtgagacccacgacggcactgtagccgttagcgacattcccaggctgataccaactggggcgcctggaagtaatgagcagtataatgtaggcatggtcggaactcacggtctggaaacatcacatgcagatagcttctctggtagtatttctagggaagggacactgatgatcagggagacgtctggagaaaagaagcgcagcggacactcagatagcaacggattcgctgggcacattaatctgcctgacctggtacagcagtctcacagcccagccggcaccccaactgaaggtctgggaagggtgtctacccattcacaagagatggattctggcactgagtatggcatgggatcttcaacgaaagcatccttcacgccctttgtggatccgcgtgtgtaccagacttcacctaccgatgaagatgaggaagacgaggaatccagcgccgccgcactctttacgtccgagctattgaggcaggaacaggcaaagctaaacgaggcccgaaaaattagcgtggtgaatgtgaaccctacgaacattagaccccattccgatactccagagattcgtaagtacaagaaacgcttcaatagcgagatcctgtgtgctgcactctggggcgtgaatctgttggtgggcacagaaaatgggttaatgctcttggatagaagtggtcaggggaaagtctacaatttgataaatcggcggcgctttcagcagatggacgtgttggagggactaaacgtcttagtcacgattagcggaaaaaagaacaagctacgagtgtattatctgtcttggttaaggaatcgcattttgcacaacgaccctgaggtggagaaaaagcagggctggatcacggtgggcgatttggaaggctgcatccactacaaggtagtgaagtatgagaggattaagtttctggttatagctttaaaaaacgccgtggaaatctatgcttgggcccctaaaccataccataagttcatggcattcaaatcattcgccgatctccagcacaaaccactgctagtggacctgactgtggaagagggtcagcgtctcaaagtcatttttggcagccatactgggtttcacgtgattgacgtggactctggaaatagctacgacatctatataccttcccacatccagggcaatatcactcctcatgccatcgtgatcttacctaaaaccgatggaatggaaatgctggtgtgctatgaagatgaaggagtttatgttaatacctatggaagaatcacgaaggatgtggttttacagtggggcgaaatgcccaccagcgtggcttacatccactccaaccaaatcatggggtggggagagaaggcaatagagatcaggtctgtggagactggacatttggacggggtattcatgcacaagcgggctcagagactgaaattcctatgtgagcgaaatgacaaagtgtttttcgccagcgttcgatcgggaggcagctcgcaggtgttctttatgactctcaatagaaattcaatgatgaactggtag

SEQ ID NO: 138068 - DNA, 4083 bp, Artificial Sequence
  Description of Artificial Sequence: Synthetic coding sequence
atggcgtctgactcacccgcgaggagcttggatgaaatcgacctgtcagctttacgagaccctgcaggaatattcgagctcgtagaattagtagggaatgggacctacggccaagtgtacaaggggcggcacgtgaagaccggacagctggccgctattaaggttatggacgtgaccggagatgaagaagaagaaattaaacaggagattaacatgctaaaaaagtactcccaccacaggaacattgcaacctattacggcgcctttattaaaaaaaaccctccgggcatggacgaccagctatggctggttatggagttctgcggggccggatccgtcaccgacctgataaaaaacactaagggcaacaccttaaaagaggagtggatcgcctacatttgtagagagatattgcggggccttagtcatctgcatcagcacaaggtgatccaccgtgatattaaaggtcagaacgtcctccttacagaaaacgcagaggtgaagcttgtcgatttcggagtatccgcgcaattagatagaaccgtgggacggcgcaacactttcataggtaccccctactggatggcccctgaggtcatcgcctgcgacgagaaccctgacgcgacctacgatttcaagtccgacctgtggagcctgggcatcactgcaattgagatggccgaaggagccccgcccctgtgcgatatgcatccgatgcgagccctcttcttaattccccgtaaccccgcccctcgccttaagtccaagaaatggtctaagaaatttcagagctttatcgagtcttgcctcgtaaaaaatcactcccagcgacccgcaactgagcaactcatgaagcacccttttatccgggaccaacccaacgagcgtcaggtccggatacaactgaaagatcacattgacagaacaaagaaaaagagaggcgagaaggatgaaaccgagtacgagtattccggatctgaagaagaagaggaggagaatgactcgggtgaaccatcctcaattctcaacctacccggggaatccaccctgaggcgtgacttcttgcggttgcagctggcaaacaaagagagatccgaagcactgcgcagacagcagcttgaacagcagcagcgagagaacgaagaacataagaggcagctgctggccgagcgccagaagcggatcgaagagcagaaggagcagcgccggcgtctggaggagcaacagcgccgggagaaagagctcagaaaacaacaggagagagagcagcggaggcactacgaagaacagatgcgtagggaagaagaacggcgccgcgccgagcatgaacaggagtatatccgcaggcaacttgaggaggagcagaggcagctggagattctccagcagcagctcctgcacgagcaggcacttctgctcgagtacaagcgcaagcagttagaggagcagcgacaggccgagcgtttgcagaggcagctgaagcaagaacgggattatcttgtctctctgcagcaccagcgccaggaacagagacctgtggagaagaaaccactgtaccactacaaagaaggcatgagcccttctgaaaagcctgcctgggccaaagaagtggaggaacgatcccgcttgaatcggcagagttctcccgcgatgcctcacaaagtggccaatcgcatctccgatcccaacctgcctccacgctccgaaagttttagtatctccggcgtacaacccgctcgaactcccccaatgttacgtcccgtcgaccctcaaatcccgcacctggtagccgttaagtcccaggggcccgccttaacagcatcccagtctgtccatgaacagcccacgaagggactttccggtttccaggaagctttgaacgtgacatcgcatagagtggagatgccgcgacagaattccgatccaacaagcgagaatccacctttgcctacacgcatcgagaaatttgaccggtcgagctggctgcgccaggaggaggacattccccccaaggtgccccagcggaccacttcgattagccccgccctagctcggaagaatagtccaggtaacggtagcgcactgggccctcgtctgggatcgcaacccattcgggctagcaacccagatctgagacgaacggaacctatcctcgaatctcctttacaacggactagctcgggcagctccagcagctcaagcacccccagttctcagccctcctcgcagggaggcagtcagccaggttctcaagcaggctctagcgagcggactcgagtgagggctaattctaagtcggagggttcccccgtgctcccgcatgagccggctaaagtgaagcctgaggaaagccgcgacataaccaggccctccagacctgcctcttacaagaaggctatcgacgaagacctgacagctttggccaaggaactgagggagctgcgcattgaagaaacaaaccgccctatgaagaaagtgactgactattcctccagcagcgaagagagcgaaagctctgaagaggaggaagaggacggcgagagcgaaacacacgacgggaccgtggctgtcagcgacattcccaggctgataccaacaggcgccccaggaagtaatgagcaatataatgtgggaatggtgggcacccatggactggagaccagccacgccgacagcttctcaggaagcatatctcgagagggaactctcatgatccgggaaaccagcggcgaaaaaaagcgctctggccacagtgacagcaatgggtttgcgggccacataaatcttcccgacttagtgcagcaatcccatagccctgctggaacgccgactgaaggactcgggagagtgtcaactcacagccaggaaatggacagcggtacagagtatggcatgggtagttccacaaaggccagtttcaccccgtttgtggaccctagggtctatcagacctctcccacagatgaagacgaggaggatgaagaatcatctgcggctgccctgttcaccagtgaactgctacggcaggagcaggccaaattaaacgaggcaagaaagatctccgttgtgaatgtaaacccaacaaatattcgcccccatagtgataccccggagattagaaagtacaagaaacggtttaattcggaaatcctgtgtgctgccctgtggggcgtgaacctgctggtcggcactgaaaacggccttatgctcctcgaccggagcggccagggcaaggtgtacaacctaattaacaggagacggtttcagcagatggatgtgcttgagggcctcaatgtcctggtcactatctccggcaagaagaacaagcttagggtctattatctttcatggctgagaaatagaattctgcacaacgacccagaggtagaaaaaaagcagggatggataaccgtgggagatttagaaggatgcatccactataaggttgtaaagtatgaaaggatcaaatttctggtgatcgcactgaaaaatgcagtggaaatttacgcctgggcaccaaaaccctatcacaagttcatggcatttaaatctttcgcagaccttcagcacaagccactccttgtggacctcactgtggaggaggggcagagactgaaggttatcttcggtagtcacacagggttccatgtcatcgatgtcgactccggcaacagttacgatatctatatcccaagccatattcagggaaacataacgccacatgcaatagtgatattacctaaaaccgatgggatggagatgctcgtgtgctacgaggatgaaggcgtttacgtgaatacttacgggcggattactaaggacgtcgtcctgcagtggggagaaatgccaacatcagtagcatatatccattccaaccagatcatgggttggggcgagaaagcgatcgagatcaggagcgtggagactggccatcttgacggagtatttatgcataaacgcgcgcagagactgaagtttctttgcgagagaaatgataaggtcttcttcgcatccgtgaggagtggtgggtcatctcaggtcttcttcatgacattaaatagaaatagtatgatgaattggtag

SEQ ID NO: 138069 - DNA, 3894 bp, Artificial Sequence
  Description of Artificial Sequence: Synthetic coding sequence
atggcatccgactccccagcacgctcgttagacgagatcgatctcagtgccttgcgcgacccagccgggatctttgagctggtggagcttgtgggaaatggaacctacggacaagtttataagggcaggcacgttaagactggacaactagccgcgatcaaggtgatggacgttaccggggacgaggaggaggagatcaagcaggaaatcaacatgttaaagaagtactcccatcacagaaatattgctacctactacggcgcctttattaaaaagaatcccccagggatggacgaccagctgtggctggtaatggaattttgcggagccgggtcggtcacagacttgataaaaaataccaagggcaatacgctgaaagaagaatggatcgcttatatctgcagagaaattctgagaggcctgtctcacctccatcagcacaaagtcattcaccgggacatcaagggtcagaatgtgctgctgaccgaaaacgctgaggtgaaactggtcgatttcggagtgtcggctcagctggaccgcaccgtggggcgccggaacacatttattgggactccatattggatggctcccgaagtgatcgcctgcgatgaaaaccctgacgccacctatgacttcaaatcagacctgtggtccctggggattaccgccatcgaaatggcggagggagcccctcccttgtgcgacatgcacccaatgcgggccttattcttgatcccccgcaatccggccccgagactgaagagcaagaaatggtcaaagaagtttcagtcctttattgagagctgcctcgtaaagaaccattctcagcgcccagccaccgaacagttaatgaaacatccttttatcagagatcagccaaacgaacgccaggtacgcattcaactgaaggaccatattgatcggacaaaaaaaaaacgcggagaaaaagacgaaacggagtacgaatatagtggctctgaagaggaagaggaggagaatgatagtggagaaccctcctccatattgaatctgccgggtgaatctacactcagacgggactttctgagattgcagctggccaataaggaaagaagtgaagcccttcgaagacagcaattggagcagcaacagagggaaaacgaagagcataaaagacagctgctggcggagcggcagaaacggatcgaggaacagaaagaacagcgcaggagactggaggaacagcagcggcgggaaaaggaactgaggaagcagcaggagagggagcagagaagacactacgaagagcagatgagaagggaggaggagcgacgcagggcggaacatgagcaagaatacattcgaagacagctggaggaggaacagcgccaactcgaaattttgcagcagcagttgcttcatgagcaagcccttctgctcgaatataagcgtaagcaactggaagaacagcgtcaggctgagcggcttcagagacagttgaaacaggaacgggactacttagttagccttcaacaccaacggcaagagcagcgaccggtagagaaaaaacctctctaccattacaaggagggtatgagtccttctgaaaagcctgcctgggcgaaggaaattcctcacctcgttgcagtgaagtcccaaggtccagcattgacggcttcccaatcagtacatgagcagccgaccaagggcctttccgggtttcaggaagccttgaatgtaacctctcacagggtagaaatgcctcggcaaaacagtgatccaacctcagaaaaccccccgctgccgacacgtatcgagaaatttgatcgatctagttggctccggcaggaggaggacattccccctaaagtgccacaaaggaccacctctatatcaccagcacttgcccggaagaactctccaggcaacgggtcagccctgggaccgcgcctcggaagccagcctatcagagcatctaatcctgacctgagaaggacagaacccatcttggagtctccactacagcggaccagtagtggcagcagcagctcgtcaagcacaccctccagtcagccatcatcgcaagggggctctcagcctggctcacaggcaggctctagcgaacggactcgagtgcgggccaacagcaagtctgagggctcaccagtgctgccgcacgaaccagccaaggtcaagcctgaggagtccagggatattacaagaccaagtcgacctgccgacttgacggccctggccaaggaactgagagagctccggattgaggagacaaataggccgatgaagaaggtgaccgattactcctcctcttctgaggaaagcgagagtagcgaggaggaggaggaagacggggagtctgagacacacgacggaacggtggccgtcagcgatataccacgcctgatccctacaggtgcacccggttctaacgaacagtataacgttggtatggttggaactcacggcctggagacctcccacgccgattctttttccgggagcatatcccgagagggcacacttatgattagggaaacctctggagaaaagaagaggtctgggcattcagacagcaatggctttgccggccacatcaacctgcctgacctggttcaacagtcccattcacctgctggcacaccgacagaaggactgggccgagtgtctacacatagccaggagatggattccggcaccgaatacggcatgggttccagtactaaagcttcatttactcctttcgtcgaccctagagtttatcaaacatctccaactgatgaggatgaagaggatgaagagagctcagcggcggcgctcttcacaagcgaattactacgccaggaacaggcaaagcttaacgaggctcgcaagattagtgtagtcaacgtaaaccctaccaacatacggcctcattccgatactcccgaaatcaggaagtataaaaaacggtttaactccgaaattctctgtgcagccctgtggggtgtaaacctgttggtggggacagagaacggactgatgttattggaccgctcaggccaggggaaagtctacaacttaatcaaccggcgcaggtttcagcagatggacgtgcttgaggggctcaatgtgctggtgactatttcgggtaagaagaataaactgcgcgtctactacctatcttggctgcggaacaggatactccataacgatcccgaggtggagaaaaagcaaggctggattaccgtcggggatctcgaggggtgtattcattacaaagtggtcaaatacgagcgcattaaattccttgtgatcgcattgaagaatgcggtggagatttatgcatgggcgccaaaaccttaccataagtttatggcattcaaatcgtttgcggatctgcagcataagcccctcctcgttgacctcactgtcgaagaggggcagcgactgaaggtgatcttcggaagccacactggctttcacgtcattgacgtagatagcggaaactcttacgatatctatattccgagtcatatccaaggcaatatcactccccacgcaatcgttatcttacctaaaaccgatggtatggagatgctggtttgctatgaggacgaaggtgtatacgtgaatacctacggccgcataaccaaagatgtagttcttcagtggggcgaaatgcctacatcagtcgcttacatccattccaaccagataatgggatggggagagaaggcaatagagatcaggagcgtcgaaacaggccacttggatggggtattcatgcacaagcgggctcagcggttaaagttcctgtgcgagaggaatgacaaggtgttcttcgcttctgtgaggagcgggggatccagccaagtttttttcatgactctaaaccgaaattctatgatgaactggtag

SEQ ID NO: 138070 - DNA, 3972 bp, Artificial Sequence
  Description of Artificial Sequence: Synthetic coding sequence
atggcttcagattctcctgccagaagtctggacgagatagacttaagcgccctgcgagaccccgctgggatcttcgaacttgtcgagctggtgggaaatggaacctatggacaggtctataaaggacggcacgtgaaaactggacagctggctgcgattaaagtgatggacgttactggggacgaggaagaggagatcaagcaggagatcaacatgctgaagaaatacagccaccataggaacatagcaacatactatggtgcgttcatcaagaagaacccccctggtatggacgaccagctttggttagtgatggagttctgcggagctgggtctgtgactgacctgataaagaataccaaaggcaacactttgaaggaagaatggattgcatacatctgcagggagattctgaggggactctctcaccttcatcagcataaggtcattcacagagacatcaaggggcagaacgttctgctgaccgagaatgcagaggtgaaacttgttgacttcggagtgtcggctcagctggaccggaccgtggggcgtcggaacactttcattggcaccccatactggatggctcctgaagtgattgcatgcgacgagaaccctgacgccacctacgacttcaaatccgatctatggagcctcggcataactgccatagaaatggcagagggcgccccgccactgtgcgacatgcaccctatgcgggcgttgtttctgattcccaggaatcccgcgcccagactcaagagcaagaaatggtccaagaagttccagtcttttattgaaagctgtttagttaagaaccacagccaaaggcccgccacagagcagcttatgaagcatcctttcattagggatcaacccaatgagcggcaggtccgtattcaactcaaggaccacatagatcgcacaaagaagaaaagaggcgagaaggacgagacagagtatgagtactctggcagcgaggaagaagaggaggagaacgactctggtgaacctagttcaatactcaacctaccaggggaatctacacttaggcgggactttttaaggctgcagcttgctaacaaagagagatctgaggcattacggagacagcagctggagcagcagcagcgagagaatgaagagcataaacgccagttactggcagagcggcagaagcgtattgaagagcagaaggaacagcgtcggcgcctcgaagagcagcaaaggcgcgagaaggaactgcgcaagcagcaggagcgggagcaaaggcggcactacgaggaacagatgcggcgtgaagaggaaagacggagggccgaacatgaacaggaatataaaagaaaacaattggaagagcagaggcaggccgagaggctccagagacagcttaaacaggaacgagattaccttgttagtctgcaacaccagcggcaggagcagcggccagtcgaaaagaaaccactttaccactacaaggaaggcatgtctccttcagagaaacctgcttgggccaaggaggtagaagaaagatctcggctcaaccgccagagcagtcccgccatgccgcacaaggtggcgaaccggatcagtgatccaaatctgccgcccaggagcgagtctttctcgattagtggggtgcagcctgcgaggacaccccccatgcttcgacctgtcgatcctcaaattccacacctggtggctgttaaatcacaaggcccagcacttaccgcctcccaatctgttcacgaacaaccaacgaaggggctgtcaggattccaggaggccctcaatgttacttctcatagagttgaaatgccgaggcaaaactcagaccctacctctgagaatccgcctctccccacaaggatcgaaaagtttgacaggtcctcctggctgaggcaggaggaagacattccaccgaaggttccgcagcgaaccacctccatctccccagccttggctcgcaagaacagccctggcaatggctccgcactagggcctagactcggatctcagccaatccgggcgagcaaccctgatctgcgtaggacagaacctattctcgaatcaccattgcagcgcaccagcagtggttcctcctcaagctcttccacaccctcatctcagccatcaagtcaagggggatcacagccaggttctcaagccgggtccagtgaaagaactagggttcgggctaattccaaatcagagggcagtcctgttttgcctcacgagcctgctaaggtgaaacccgaagagagtcgagatatcacgcggcctagtcggcccgctgatcttactgcactagcaaaagagctacgtgagctccgcatcgaggagaccaatcggccaatgaaaaaggtaaccgactacagctcctcgagcgaggaatccgaatcatcagaagaggaggaggaagacggcgaatccgagacccacgatgggacagtcgctgtttccgacatccctcgattaatccccaccggagcacctgggtccaacgaacaatacaatgtcggcatggtgggtacacatggactcgagactagtcacgcagacagcttctctgggtctatctcacgcgaagggaccctgatgatccgcgaaacctccggcgagaagaaacgaagcgggcactcagactccaatggctttgcgggtcatataaatttgcctgatttggtccagcagtcacattctccggctgggacccctaccgaaggtctgggtagggtctcaacccacagccaggagatggatagcggtaccgagtacggcatggggtccagtactaaagccagtttcacacctttcgtagacccacgcgtttaccagacaagccctaccgacgaagacgaggaagacgaagagagctctgccgccgccctcttcacgtctgaactgttacgtcaggagcaggccaagttaaacgaagcaagaaagatcagcgtcgtcaatgtcaaccccacaaacatccgccctcatagcgacaccccagagatccgtaaatataaaaaacggttcaattctgaaatcctgtgtgcagccttgtggggggtgaacttgctggtgggaacagagaatgggctaatgcttctggatcgttcaggtcaaggtaaagtatacaacctgatcaatcggcggcgttttcagcagatggatgtcctagaaggcctaaatgtactcgtgacaatcagtggaaaaaagaacaagctcagagtctactatctaagttggctgaggaaccgcattctgcacaacgatccagaggttgaaaagaaacagggatggatcactgtcggagatctcgaaggctgcatacactacaaagttgtcaagtacgaaagaatcaagtttctggtaattgcattgaaaaatgctgtggaaatctatgcatgggcacctaagccttatcacaagttcatggcgtttaagagtttcgcggacctccagcacaagcctttgctggtggacttgactgtcgaagaggggcagcgcctaaaggtgatttttggcagccatacggggttccacgttatagacgttgatagcggcaatagctacgacatctacatcccatcccacattcagggcaacattacgccgcacgcaatcgttatcctgccaaagacggacggcatggaaatgctggtgtgttacgaggacgaaggagtgtacgtaaacacatatggtcgaattacaaaagatgttgtcctgcaatggggagaaatgccgacatcagtggcttacattcactcgaatcaaataatgggttggggagagaaggccattgaaatacggtccgtggaaaccgggcatctggatggcgtgttcatgcacaagcgcgcccaacgattgaaattcctctgtgagcggaacgacaaagtcttcttcgcctccgtcaggtcaggagggtcctctcaggtttttttcatgaccctgaatcgtaatagtatgatgaattggtag

SEQ ID NO: 138071 - DNA, 3807 bp, Artificial Sequence
  Description of Artificial Sequence: Synthetic coding sequence
atggcctccgactcacccgccaggagcctggatgagattgacctatccgcactgcgtgatcccgcaggaatcttcgaactggtggaattggtaggcaatgggacttatggtcaagtctataaaggccggcacgtgaaaacaggccagttggccgctatcaaggtgatggacgttaccggcgacgaggaggaggagattaaacaggagattaacatgctgaagaaatatagtcatcaccggaacatagctacatactacggagcattcatcaaaaagaaccctccaggcatggacgaccaactatggctggttatggagttctgcggggctgggagcgtgaccgacctaattaaaaacaccaaaggtaatacacttaaggaggagtggattgcctacatatgccgggaaattctgcggggattatcacacctgcaccagcacaaggtgatccatcgcgacatcaagggtcagaatgttctgctgactgaaaatgccgaggtaaagctagtcgatttcggggtcagcgctcaactcgaccggactgtgggcaggaggaatacctttatcggcacgccctactggatggctccagaggtgattgcttgcgacgaaaatcccgatgccacttatgatttcaagtcagatctctggtccttgggcatcactgctattgagatggctgaaggggcaccgcctttgtgtgacatgcacccgatgcgagcattgtttcttatccctcgcaatcctgcaccacggctgaagagcaagaagtggtcaaaaaagttccagtcgttcatcgagtcctgtctcgttaaaaaccactctcagaggcccgccaccgagcaactcatgaaacacccttttattagggaccagcccaacgagcgacaagtaagaatacagctcaaggatcacatcgatcggaccaagaaaaaaagaggcgagaaggatgagacagaatacgagtattccggaagtgaggaggaggaggaggagaacgatagcggggaaccgtctagcatacttaatctgcccggcgaaagtaccttgcgacgagactttcttagactgcagttggctaataaggaacggagcgaggccctgcgccggcagcagctggaacagcagcagcgcgaaaacgaggagcacaagagacaacttctggctgaacgccagaagcgaattgaagagcaaaaagaacaacggagaagactggaggagcagcaacgcagggagaaggagctgcgcaaacaacaggagcgggagcagcggcgacactacgaagaacagatgcgacgtgaggaagaacgtaggagagccgaacacgagcaagagtacaagcgcaaacagctagaagagcagcgccaggctgagagactccagcgacagttgaaacaggagcgcgactatttagttagtttgcagcaccagaggcaggaacagaggcccgtggagaagaagcccctctatcattacaaagagggaatgtcaccatccgagaagccagcttgggctaaagaaatcccacacttggttgcagtcaaaagtcagggacccgccctgacagcctctcagtctgtacacgagcagcccacaaaagggctatccggctttcaggaggctctgaacgtaacctcacatagagtggagatgccccgacagaacagcgaccccaccagcgagaatcccccccttcctacccggattgagaaatttgacaggtcaagctggttgcggcaggaggaagacataccaccaaaggtgcctcagcgcacaacgtcgatctccccggctcttgcccgcaagaatagccctgggaacgggtccgcgcttgggccacgattaggcagtcaaccaatcagagccagcaatcccgacctgagaagaaccgagcctatcctggagtccccgctccagagaacctcgagcggcagctccagttcatcttccacaccttcaagtcagccaagttcccagggtggcagccagccaggtagtcaagcaggtagcagcgagcggactagggtgagagccaactctaagtctgagggctccccagtgctgccccacgagcctgcgaaggtgaaaccagaggaatcacgcgatattacacggccttctaggccagcagatctcactgcccttgctaaggagcttagggaactgcgcattgaagagacgaacaggcctatgaaaaaggtgacagactacagttcttcctccgaagagagcgaatcatccgaggaggaggaggaggacggagaaagtgagactcacgacggaacagtggctgtgagcgatattcctcgactgatccctaccggcgcccctggcagcaacgagcagtataatgtgggcatggtgggcacccatggtctggaaacctcacatgctgatagctttagcggctccattagcagagaagggacgttgatgatccgagaaacatccggagagaaaaaaagaagtggccactctgatagtaacggctttgcaggccacatcaaccttccggacctcgtgcagcagagccacagtccagctggcacacctaccgaaggcctcggtagagtcagcacccacagccaggaaatggacagcgggaccgaatatggcatgggaagcagtacgaaagcaagtttcaccccttttgtcgacccacgagtctatcagacgagtcctacagacgaagatgaagaggacgaggagtcctcagccgcagctttatttacctccgaactgctccggcaggaacaggcaaaactgaatgaggctaggaaaatctccgtcgtaaacgtgaatcctacaaacattcgcccacactccgacacccctgagatcaggaagtataagaagcgctttaacagcgagatcctctgtgcggccttgtggggcgtcaacttactggtcgggactgagaacggtcttatgctcctagatcggagtgggcagggaaaggtctataacttgatcaatcgcaggaggttccaacagatggacgtgctagagggtctaaacgtcctcgtaacaattagtggcaagaagaataagctgcgagtgtattaccttagctggctacggaataggatcctacacaatgaccccgaggtggaaaagaaacaggggtggatcaccgtgggggatcttgaaggatgtattcattataaggttgtgaagtacgaaaggatcaaatttctggtgatcgctcttaaaaacgctgttgaaatctatgcctgggccccaaagccttaccataagtttatggcgttcaagagctttgccgacctgcagcataaaccccttctggtggacctcaccgttgaggagggtcaaagactgaaggtcatctttggtagtcacaccggatttcatgtgatcgatgtggatagtggcaattcctatgatatctacatcccgagtcatattcagggcaatatcaccccccatgccatcgttatactgcccaaaacagatggcatggaaatgctggtgtgttacgaggacgagggagtgtatgtgaacacgtacggcagaataaccaaggacgttgtgctgcagtggggagagatgcccacttccgtcgcatacattcatagcaatcagataatgggttggggcgagaaagcaattgagatccgctcggtagagactgggcacctggatggagtgttcatgcataagcgggcccagcggctaaagtttctgtgcgagcggaatgataaggtcttttttgcgtccgtaaggtcagggggttccagccaagtgtttttcatgacgctcaaccgcaacagtatgatgaactggtag

SEQ ID NO: 138072 - DNA, 3918 bp, Artificial Sequence
  Description of Artificial Sequence: Synthetic coding sequence
atggcctctgactcgcctgcaaggagcttggatgagatcgacctgtccgcccttcgagatccggcaggaatttttgagctcgtggaactggtgggaaacggaacatacgggcaagtgtacaaagggcgccatgtgaagacgggccagttggccgccatcaaggttatggatgtgaccggagacgaggaggaagagattaagcaggagatcaatatgttgaagaagtattcgcatcatcggaacattgccacatactacggcgcttttatcaaaaagaaccctccaggaatggacgatcagctgtggctcgtgatggagttctgcggtgctgggagtgtcacagatctcattaaaaataccaaagggaacacccttaaggaagaatggatagcctatatttgccgcgagatcttgaggggcctgtctcatctgcatcagcacaaggttatccaccgcgacattaaagggcagaatgttttgctgacagagaatgccgaagtgaaactggtcgattttggcgtttcagcacagctagacagaacagttgggcggagaaacactttcattgggactccctactggatggcacctgaagttatcgcttgcgatgaaaatcctgacgctacatacgatttcaagtctgatctctggagcttaggcatcacagccattgagatggctgagggcgctccaccactgtgcgatatgcatcccatgcgggcactgttcttgataccaaggaatcctgctcccagactgaaaagcaagaaatggagcaagaagttccagtctttcatcgaaagttgtctcgttaagaaccactcgcagcggcccgctacagagcaactcatgaagcaccctttcatacgggatcagcctaacgaaaggcaggtccggattcagttgaaggatcacattgaccgcaccaagaaaaaaaggggcgagaaggatgagaccgagtatgagtactctggctcagaggaagaagaagaggagaatgattccggagagcccagttccatcctgaacctgccaggtgaatctaccctccgcagggacttccttcggctacaattggcgaacaaggagaggagcgaggcactcaggaggcaacagctggaacagcagcagcgcgaaaatgaagagcataagaggcagcttctggctgagcgtcagaaaaggattgaggagcagaaggagcaaaggcgccgattagaggagcagcagagaagggagaaggaacttaggaagcagcaggagcgggaacagcggcgacattatgaggaacagatgagacgagaggaggagcggcgacgcgccgaacacgagcaggaatacatacgtcggcaactggaggaggagcagcggcagctggaaattctgcagcaacaattgctccacgaacaagcattactgctagaatataagaggaaacaacttgaggagcagcgccaggctgaaagactccagcggcagctcaagcaagaacgtgattatctggttagcctccaacatcagcggcaggagcagcgtcccgttgagaagaagcccctctaccactataaggaagggatgtccccttccgagaaaccggcttgggcgaaagaaatccctcatctcgtggcagtcaagtctcagggaccggcccttacggcatctcaaagtgtccacgaacagccaactaaaggcctgtcaggctttcaagaggcgctcaacgtgacctcacaccgcgtggaaatgcctaggcagaattctgaccctacctctgaaaacccacccctaccaactaggatcgagaaatttgaccgttcctcttggctgagacaggaagaggacatacctcctaaagttccccagagaaccaccagcatcagtcctgctctggcaaggaaaaactctcctgggaatgggagcgcgctgggaccaagacttggaagtcagcctatcagggctagtaaccccgatctgagacggacggagcccatcttagaatctcctttacagcgcacatcgagtgggagctcatccagtagctccacaccttcttctcagccctccagccaggggggctcccagccaggcagtcaggccggctcaagtgaacgtacacgggttagagctaactccaagtcggagggcagccccgtgctgcctcacgagcccgctaaggtcaagcccgaagaaagcagggatatcacccgccccagccgccccgctagttataagaaggctatcgacgaggacttgacagccctggcaaaagaacttagagagctgaggatagaggaaactaatcgccccatgaagaaggttactgactattcctcatctagcgaagaatccgaatcaagtgaagaagaggaagaagacggcgaatctgagacacacgatggcactgtggccgttagcgacatccctcgcctgatccccactggggcaccagggagcaacgagcagtacaatgtgggcatggtgggtactcatggtctggagacatcccacgctgactccttctctggtagcatatcacgggaaggaacgcttatgatacgtgaaacctctggagagaagaagaggtctgggcatagtgacagtaatggctttgctgggcatattaacctccccgacctggtgcagcagagccatagtccggctggcacccccacagagggcctcggtagggtgagtacccacagccaagaaatggattcaggcactgagtacggcatgggctcctcaactaaggcatcattcactccttttgtagatccccgggtgtaccaaacctctcctaccgatgaagatgaggaagacgaggaaagcagcgctgccgcactgtttacatctgaactgttgcggcaggagcaggctaaactcaatgaagcacggaaaatctccgtagtaaacgtgaacccaaccaacatccgccctcactctgatactcctgagatccgtaaatataaaaaaaggttcaactctgaaatactctgcgccgcgctgtggggcgttaacctactagtcggaacagaaaatggactgatgctcctcgataggagtgggcagggcaaagtatacaacctgatcaataggcgacgcttccagcaaatggatgtactcgaaggattgaacgtgctggttaccatatctgggaaaaagaataaattaagggtctattatctcagttggctaaggaatcgcatactgcataatgacccagaggtggagaagaagcaaggctggatcactgtgggcgacttagaaggatgcattcactacaaagtggttaaatacgaaaggattaaatttctagtgatagccctcaagaatgctgtggagatctatgcgtgggctcctaaaccctaccacaagttcatggccttcaaaagcttcgcggacctgcagcacaagcctctgcttgtggatctcactgtcgaagaggggcagaggcttaaggttatcttcggatcacatactgggttccatgtgatcgacgtggactctgggaattcatacgacatctatattccttcgcatatacagggaaatattaccccccatgcaattgtgatcctgcccaagacggacgggatggagatgctcgtgtgctatgaagacgaaggcgtttacgtcaacacatacgggagaatcactaaggatgttgtgctccagtggggagagatgccgactagcgttgcatacatccactcaaaccagattatgggttggggcgagaaagccatcgagatcaggagtgtagagaccggtcaccttgacggagtttttatgcataaaagagcccaacgattaaagtttctgtgtgagcgtaacgataaggtctttttcgcatcagttagatcgggaggaagctcccaggtcttcttcatgactctgaatcggaatagcatgatgaattggtag

SEQ ID NO: 138073 - DNA, 3939 bp, Artificial Sequence
  Description of Artificial Sequence: Synthetic coding sequence
atggcatccgacagcccagccagaagtctggatgaaatcgatcttagtgccctcagagaccccgccggcattttcgaactggtggagctcgtagggaacggaacttacggccaagtctacaagggaaggcacgttaaaaccggtcagctcgctgcaatcaaggtcatggacgtgaccggcgacgaggaggaagagattaaacaggaaatcaatatgctaaagaagtatagtcatcatcggaatattgcgacctattatggtgcattcataaaaaagaatccccctggcatggacgaccagctgtggctggtaatggagttttgtggggccggttcagttactgacctcattaaaaacaccaagggtaatacactgaaagaagagtggatcgcctatatctgccgagaaatcctcagggggttgagccacttgcatcagcacaaagtcatacacagggatataaaaggacaaaacgtgcttctcactgagaatgccgaggtgaaaatagtcgactttggagtgtctgcccagttggaccgtaccgtgggacgtcggaacacttttattgggactccatattggatggcaccagaggttatagcttgtgacgagaaccccgatgccacctacgacttcaagagcgacctgtggtccctcggaatcacggccattgagatggcggagggcgccccacccctgtgtgatatgcatcccatgcgagccttatttctgattcctcgtaatcccgccccacgccttaaatctaagaagtggtccaaaaaattccagagctttatagaaagttgtcttgtgaagaaccactctcaaaggcccgcaaccgaacaactgatgaaacatccttttatccgagatcaacctaatgagcgacaagttcggatccagctcaaggaccacatagaccgcaccaaaaagaagcgcggggaaaaggacgagactgaatacgaatattcggggagcgaagaagaagaggaggaaaacgatagcggagagccttcttcaatcctgaatttgcccggagagtccaccttgcgaagggatttccttaggctccagttggccaataaggagcggagcgaggccctccgccgtcagcagttggagcagcagcagcgggaaaatgaggaacataaacgccagctgctcgcagaacgccaaaaaaggatagaagaacagaaagaacagagaaggaggctcgaggaacagcagcggcgggaaaaggaactgcgcaagcagcaggaacgagaacagcgcagacactacgaggaacagatgcggcgcgaggaagagcgccgtcgcgctgagcacgagcaggagtacatcaggaggcagctggaagaggaacagcggcagctggaaatcttgcagcagcagttgctccatgaacaggccttgttgctggagtacaagaggaagcagctggaggaacagcggcaagccgagagacttcagcgccagctgaagcaggaacgagactacctagtgagcctacagcatcagcgccaggagcagaggcccgtagagaagaagcccctgtatcactataaagaagggatgagcccttccgagaagccagcctgggctaaggagattccgcacttggtggccgtaaagtcccaggggcccgcgctaacggcctcccaaagtgtgcacgagcaaccaaccaaagggctgtccgggtttcaggaagcactcaacgtcaccagtcaccgcgtggagatgccacgtcagaactccgatcctacctccgagaaccctcccctcccaacgcgcattgagaagttcgaccgaagtagttggctgcgtcaggaagaagatattccacctaaggtgccgcagcgaacaacctccatcagtccggctctggcccggaagaactctccaggcaatgggtctgccttgggcccgaggttgggctctcagcccatcagggccagtaatcctgacctccgtagaacagaacctatattggaatctccactgcagaggacaagcagcgggtcatcgtcatcctcatctacaccatcgtctcaacccagttcccaggggggctcacagcccggcagtcaggccgggtcaagcgaaaggactcgtgttcgtgcaaactctaagtctgagggttctcctgtgctgccccatgagcccgctaaggtaaaaccagaagagtcacgagacattactagaccctctcgcccagcggtgtctgcatttctctctaagtcattcgaactgctgatttatcaggatttgacggctctagctaaggaattgagggagctgcggatcgaggaaactaaccgacccatgaagaaggtgacggactattcaagcagctcggaggagtcagagagtagcgaggaagaggaagaggacggcgagtccgagacacatgacgggaccgtggccgtgtccgatattccgcgactcattccaactggagcccctggctccaacgaacaatataacgtaggcatggtcggtacacatggtctggagacaagtcatgccgacagctttagcggttcaatctcccgggaaggcaccttaatgattcgagaaacatccggtgagaagaagagatcgggccatagtgatagcaacgggttcgctggacatataaatctccccgatctcgtacaacagtcgcacagcccagccggcactccgaccgaaggcctaggacgcgtgagcacccactcccaagagatggactccgggaccgagtatggtatgggttcttcaacgaaggcatccttcaccccctttgttgatcccagagtttatcagacatcccctacggacgaagatgaggaagacgaagagtcatccgcagctgcccttttcacaagcgagctgctgcggcaagagcaggcaaagctcaacgaggctcgcaagatttcagtcgtcaatgtcaatccgaccaacattagaccccatagcgacacccctgagatacgtaagtacaagaagcgctttaacagcgagattctgtgtgcagctctctggggtgtcaaccttctggtgggtactgagaatggccttatgctgctcgatcggagcggccaggggaaggtttataatttgatcaatcgtaggcgatttcaacaaatggatgtgctggaggggctgaatgtgctggtaaccatttcgggcaagaagaacaaactaagagtgtattacctctcatggctgagaaacagaatcctccataacgaccctgaggtagagaagaaacagggatggattaccgtgggcgacctggaggggtgtattcactacaaagtggtgaagtatgaacgcattaaatttctggttattgcgctaaagaatgcagtagagatttatgcctgggccccaaaaccctaccacaaatttatggctttcaagtccttcgctgacttacagcataagccactcctggtggacctgactgtcgaggagggccagagattaaaagtcatcttcggtagccacacaggtttccatgtgattgacgtcgacagtggcaacagctatgatatttacataccttcccacatccaggggaacattactccccacgctattgtgatcctcccgaagactgacggaatggagatgctggtttgttacgaggatgaaggcgtgtatgttaacacgtatggaagaatcactaaggacgtcgtgctgcagtggggagagatgccaacttccgttgcctacatccattccaaccaaatcatgggctggggcgaaaaagccatcgagatcagatccgtggagacaggacatctggatggagtgtttatgcacaagcgcgctcagagactcaagttcctgtgcgagaggaatgataaagtattcttcgctagtgttcgatcaggcggatctagccaggtgttcttcatgacgttgaataggaattcgatgatgaattggtag

SEQ ID NO: 138074 - DNA, 1725 bp, Artificial Sequence
  Description of Artificial Sequence: Synthetic coding sequence
atgcccccgcagctgcaggaaactcgaatgaaccggagcatcccagtggaggttgacgagtcagaaccttaccccagtcagctcctcaaacccatccctgaatacagcccagaagaagaatccgaaccccctgcccctaatattcggaatatggcacccaactcattgtcagcgccaacaatgctgcacaattcatccggtgatttttcacaagcccattcaactctcaaacttgccaatcatcagcggcccgtctcacgtcaggtgacctgtttgaggacacaggtgctggaggattctgaagactcattttgccgtcggcatccggggttgggaaaggcattcccttccggctgcagcgctgtctctgagccagcttctgaatctgtggtaggcgccctgcccgctgaacaccaatttagctttatggagaagcgaaaccagtggcttgtttcccaactttcagccgcgtccccagacacgggccatgactccgacaagagcgaccagagcctgcccaatgcttcggccgacagcctcggtggctcacaggagatggtgcagcggccacaaccacaccggaaccgagcgggcctagacctgcccactattgacaccgggtatgattcccagccacaggacgttctagggatccggcagctggaacgtccgctgccactgacaagtgtgtgttacccgcaggatttacctcgacctctgcgttcccgcgagttcccgcagttcgagcctcagaggtatccagcctgcgcccaaatgttgcccccgaatctttcacctcatgctccttggaattatcactaccactgccctggatcaccagaccatcaagtcccatacggacacgattatccgcgggctgcctatcagcaagtgattcagcctgccttgcccggacagcccctccctggtgcttctgtgcggggccttcatcctgtccagaaggttattcttaattatccatccccttgggaccacgaagaaagacccgcccagcgcgactgttcctttccaggtctcccacgccaccaggaccagccacaccatcaaccacccaaccgcgctggggccccaggcgagagcctcgagtgccctgccgaactccgaccacaggtcccccaacccccgtcccccgccgctgttccacgccctccttctaacccacctgcgagagggactctgaagacatcaaatctgcccgaagagttgcgaaaggtgtttatcacctactcaatggacaccgccatggaagtggtgaagtttgtgaatttccttctggtcaacgggttccagactgctatcgacatctttgaagatcgaatcagggggatcgatattatcaagtggatggagagatacttgcgcgataaaacagtgatgattatcgtggcgatttcccccaaatacaagcaggatgttgaaggcgcggaaagtcaacttgacgaagacgagcatggcctgcacaccaagtacatccaccggatgatgcaaatcgagttcatcaaacagggcagcatgaatttccggttcattcctgtcctctttccaaatgctaaaaaagagcatgtgcctacttggctccagaacacccatgtgtactcatggcctaaaaacaagaagaacatccttctgcgcctgctgcgtgaggaggagtacgttgcacccccacgcggtcctcttcctacactccaggtggtccctctttag

SEQ ID NO: 138075 - DNA, 1695 bp, Artificial Sequence
  Description of Artificial Sequence: Synthetic coding sequence
atgaaccgctcaatccctgtagaagtcgacgagtcagagccgtatccttcccagctgctcaagcctatccccgagtacagtccagaggaagagagtgagccacctgcacctaatattcggaacatggctcccaatagcttgtctgctcctacaatgcttcacaactcttccggggacttttcgcaggcgcattctaccttgaagcttgcaaatcaccagcggcccgtgtcacgtcaagtcacctgcctgagaacacaggtgttggaagacagtgaggacagcttctgccggaggcacccagggctaggcaaagcctttcccagcggttgctccgccgtttctgagcccgcctcagagtcagtggtgggcgcgcttccggccgagcaccagtttagcttcatggaaaaacgtaatcagtggctagtgtcacaattgtccgccgccagtcctgacaccggccacgatagcgataagtcagaccagtctctgcccaatgccagcgctgattctctgggtggatcccaggagatggtgcaaagaccccagccccacagaaatcgtgccgggctggacctgcccacaatcgatactggatacgattctcaacctcaagatgtcttgggtatccgtcagttagagcgcccactgccattaacatctgtgtgctatccccaggacttaccaaggcctctgagatccagggagtttccccagttcgagccccagcggtatcctgcatgcgcacaaatgctgccgccgaacctgtccccgcacgccccatggaactaccactaccactgccctggttctcccgatcaccaggtgccctacggccatgattaccccagggctgcatatcagcaggtgatccagccagctctccccggtcagcctctgccgggggcttctgtaagggggttgcatccagttcagaaagtaatcctgaattacccaagcccttgggaccacgaagaacgcccagctcaaagagactgttcattccctggcctgccgaggcatcaggaccaaccccaccatcaaccgcccaaccgggcgggagcgccaggggaatctcttgagtgccctgccgagctaaggcctcaggtcccacagcctcccagtcccgcagccgtgccccggccgccctctaacccacctgcaaggggaaccctgaagacttcaaatttaccagaggagttacgcaaggtgtttatcacctacagcatggacacagctatggaggttgtgaaattcgttaactttttgctggttaatgggtttcaaacagccatagacatctttgaggaccgaattcgtggaattgatatcatcaaatggatggaacgctatctccgcgacaccgttatgatcattgtagcaatctcgccaaagtataaacaggatgtggagggagccgagtcacaacttgacgaggacgaacatgggctgcacacaaagtacatccatcggatgatgcaaatcgagtttattaagcagggaagtatgaattttcgctttatccccgtgctatttcccaacgccaagaaagaacacgtaccgacgtggttgcagaatacacatgtctattcatggcctaaaaacaaaaagaacattttgctgagactcctgcgggaagaagagtacgtggctccgccgagagggcccctgccgaccctgcaggtggtaccactgtag

SEQ ID NO: 138076 - DNA, 1698 bp, Artificial Sequence
  Description of Artificial Sequence: Synthetic coding sequence
atgaatcggtccatccccgtggaagtagacgaatctgaaccctatcccagccaactactcaagcctatccccgaatacagcccagaggaagagagtgagcctccagcaccaaatatccggaacatggccccaaacagcttaagcgcacctacaatgctacacaattcatcaggggactttagtcaggcccactctaccctgaaacttgcgaatcatcagaggcctgtgtctagacaggtgacttgcctcagaactcaggtactggaggactccgaggacagtttctgtcgacgccaccccggcctggggaaagcctttccttccggctgttctgcagtctctgagccagcttctgagagtgtagtgggagcgctgcctgccgagcatcagttctcattcatggaaaagcgcaaccagtggctcgttagccagctgagcgccgcctcacccgacactgggcacgatagtgacaagagcgaccagtccttgcccaatgctagtgccgattcactagggggcagtcaggagatggtccagcggccacagcctcatagaaatagggcagggttagatcttcctaccattgacacaggatacgattcccaaccacaggacgttctaggcatccgccagctggaaagacccttgcccctgaccagtgtttgctatccgcaagaccttccaaggccactccgctctcgcgaattcccccagtttgagccacagcggtatcctgcgtgcgctcaaatgttaccccccaatctgagccctcatgccccttggaactaccactatcattgccccggatcgccagaccatcaggttccttacggccatgactacccccgcgcagcatatcagcaggtcattcagcctgctttaccagggcaacctctaccgggcgcatccgtccgaggtctccaccccgtgcagaaggtgatcctcaactatccctcgccgtgggatcatgaggagagaccagctcagcgggattgcagctttccaggccttccccggcaccaagaccagcctcaccatcagcctcctaatcgggcaggggctccaggggaatccctagaatgccctgccgaactgagaccacaggttccacagcctccgtctcccgctgctgtccctcggccaccctctaaccccccagctagaggcaccttgaagacctccaatctgcctgaagagctgagaaaggtcttcattacctatagcatggatacagcaatggaggtcgtcaaattcgttaatttcctgctggtgaatggatttcaaacagcgattgatatcttcgaggacagaataaggggcatcgatatcatcaagtggatggaacgctatttgcgtgataagactgttatgatcatcgttgctattagtccaaaatataaacaagacgtagagggagccgagagccagttagacgaggacgagcatggccttcataccaaatacattcataggatgatgcagatcgaattcatcaaacagggctccatgaacttccggtttattccagtgctctttcccaacgctaagaaggagcatgtccccacttggttgcaaaacactcatgtctattcatggcccaagaataaaaaaaacattctgctccgtttactgagggaggaggagtatgtcgcaccgccacgagggcccctgcccacactgcaggtagttcccctgtag

SEQ ID NO: 138077 - DNA, 1725 bp, Artificial Sequence
  Description of Artificial Sequence: Synthetic coding sequence
atggcgcctcaactcgaagaaacccggatgaaccgaagcatccccgtagaggtggatgagtccgagccctatcctagtcagctcctcaaacccattcccgagtactcacctgaagaggagagcgaaccccccgcccctaatatccgcaatatggcccctaatagcctgtcggctcccacgatgctccataactctagtggggacttcagccaggcacactcaaccctgaagctggccaatcaccagaggcccgtgtcacgccaggtgacctgcttgcgtacccaagtattggaagatagtgaggattcattctgtcggaggcatcctggcctaggcaaggcgttcccgtctggttgtagtgcagtctctgaacccgctagcgaatcagtcgttggggcgttgccagcggaacaccagttcagtttcatggaaaagaggaaccagtggctcgtctcccagctctccgctgcttcccctgatactgggcacgactctgacaagtccgatcagagtctccctaatgcatctgctgatagtctaggagggagtcaggagatggtgcagcgtccgcagcctcaccggaacagagccggtctggatttgccaaccatcgacacaggttacgactcacagccacaggatgtgctcgggatccgacaactcgagcgaccactgccgctgacatccgtctgctaccctcaggaccttccacggccactgcggagccgtgagttcccacagttcgagccccagcgataccccgcttgcgcacaaatgctgccaccgaacctgagtccgcacgcgccctggaactatcactaccactgcccaggctcccccgaccatcaggtcccctatgggcacgactatccccgagcagcgtaccaacaggtcatccaacccgcccttccaggccagccgctgcccggtgcctccgtgcgcggtttacaccctgtgcagaaagtgatcctcaattaccccagcccctgggatcatgaggagaggcccgcgcaaagggattgtagttttcccggactgcccagacaccaggatcagcctcaccaccagccacctaaccgcgccggcgccccaggcgaatcccttgagtgccctgccgaattgcggcctcaggtccctcagcccccgagccctgcagccgtgccgcgacccccctccaatccacctgccagaggcaccttaaagacctccaacctgcctgaggagctcaggaaggtattcattacttattcaatggacacagccatggaggtagtcaagttcgtcaactttctgctggtgaatgggttccaaactgccatcgatatctttgaggacaggatccgggggatcgatatcataaaatggatggagcgctacctgcgagacaaaaccgtgatgatcattgttgctatatccccaaagtacaagcaggatgtggagggcgctgagtctcagctggatgaggacgaacacggtctgcataccaaatatatccaccgaatgatgcagatcgagtttatcaagcaggggagcatgaactttcggttcattcccgtgctctttccaaatgctaaaaaagagcatgtgccgacttggctccagaatactcatgtctactcatggcctaaaaataagaaaaacatcctgctgaggctgctgcgagaagaggagtacgtcgcccctccccgcggccccttgccaacgctgcaagtggtgccattatag

SEQ ID NO: 138078 - DNA, 462 bp, Artificial Sequence
  Description of Artificial Sequence: Synthetic coding sequence
atggaggtggttaagttcgtgaattttttactggtcaacggattccagacagccatagacatttttgaggaccgtataagaggtatcgatatcatcaagtggatggagcgctatctccgggacaaaactgtgatgatcattgtggccattagccccaagtacaagcaggatgtggagggcgccgaatcccagctcgacgaagatgagcacggattgcatacaaaatatatccatcggatgatgcaaatcgaattcatcaaacaaggcagtatgaattttcggttcatcccagtgttgttcccaaatgcaaaaaaagaacacgtccctacttggcttcagaacacacatgtgtactcctggcccaagaacaaaaagaacatcctgctccgactgcttagggaagaggagtatgtggccccgccacggggtccactgcctactctccaagtggtcccgctctag

SEQ ID NO: 138079 - DNA, 330 bp, Artificial Sequence
  Description of Artificial Sequence: Synthetic coding sequence
atgattattgtggccatctcgcctaaatacaagcaggatgtagagggcgccgagagtcaactggatgaagacgagcatggcttgcatacaaagtatattcacaggatgatgcaaatcgaatttattaaacagggaagcatgaactttcgattcatacccgtcttgtttcccaatgcaaaaaaagaacatgttccaacttggctgcaaaacacgcatgtgtactcttggcccaagaataaaaagaacatcctgctcaggttgctgagagaggaagagtacgtggctcccccgagaggtcctttaccaacgttacaagtggttccactctag

SEQ ID NO: 138080 - DNA, 1596 bp, Artificial Sequence
  Description of Artificial Sequence: Synthetic coding sequence
atgatttcccccgatccccgtccaagccctggccttgcacgttgggcggagtcctatgaagctaaatgtgagcgtcgccaggaaatccgtgaaagtaggagatgtcgaccaaacgtcacaacttgccgccaggtgggaaaaactctcagaatacagcagagagagcagctacaacgggctcgcttacagcagttttttaggcggagaaatctcgagcttgaggagaaagggaaggctcagcatcctcaggcccgcgagcagggcccctctcgaaggccaggtcaggtcacaggaacttcttctgaggtgttccccgcccagcatccccctccctccggcatctgcagagacttgagcgaccacctgtcctctcaggccggggggttgccgcctcaagataccccaatcaagaagccacccaagcaccatcggggaacgcagacaaaagcagagggccccaccataaagaacgacgcatctcaacagacgaattatggagtcgcagtcctggacaaagaaatcattcaattgagcgactacctgaaggaggccttgcaacgagagctggtcttgaagcagaaaatggtgatcttgcaagacctgctgtctacactcatccaggcttcagattccagctggaaaggacagttgaatgaagacaagctgaagggaaagctgcgcagcctagagaatcagctatacacatgtactcaaaagtactctccatggggcatgaagaaagtgctcctggaaatggaggatcagaagaacagttacgaacagaaggcaaaggagtctctgcagaaagtgctggaggagaaaatgaacgccgagcagcagctccaaagcacacagaggtccctggcactagccgaacagaagtgtgaggagtggcggtcacaatatgaggctctgaaggaagattggaggaccttggggactcagcaccgtgagctggagtcccagttgcatgtgctgcagagtaagctccagggcgccgatagccgcgatctccagatgaaccaggcactgcgcttcttagagaacgagcatcagcagctgcaggctaaaattgagtgcttgcagggggacagagatctgtgctccctcgacacacaggatctacaggaccagctgaagcggtcggaagccgagaaactgactctcgtcacacgcgttcagcagctgcagggcttgctccagaaccagtcattacaactgcaagagcaggagaaactgctcacgaaaaaggatcaagccctgcctgtgtggagccctaaatcctttccgaatgaagtcgaacctgaaggcacgggtaaagagaaagactgggatctgcgagatcagctccagaaaaagacactccagctgcaagccaaggagaaagaatgtagggagctccactcagagctggacaacctgtctgatgagtacctctcatgtttacgtaagctgcagcattgtcgcgaagaactcaaccaaagtcagcagttacctcctcgacggcaatgtggccgctggctgcccgtactgatggtggttattgctgccgccttggcggtattcctggccaataaggataacctgatgatctag

SEQ ID NO: 138081 - DNA, 549 bp, Artificial Sequence
  Description of Artificial Sequence: Synthetic coding sequence
atgaagaaggtccttttagagatggaagaccagaagaattcgtacgagcagaaggcaaaagaaagtttgcaaaaagtacttgaggaaaaaatgaatgcggaacaacagctgcagagcacccagcgctccttggccctggctgagcagaagtgcgaggagtggagatctcaatatgaagctctgaaagaggattggcggaccctcgggactcagcacagggagctggaatcccagctccatgttttacagagcaagttgcagggcgctgattcaagagatctacagatgaaccaggccctgaggtttctcgaaaacgagcatcagcagctgcaagccaagatagagtgtctccagggagatcgggatctttgttcactcgatacgcaagaccttcaagatcaacttaaaaggagtgaggccgaaaagttgactttagtcacccgcgtccagcagctgcaggggctgctgcagaaccagtcactccagctacaagaacaggagaagctgctcaccaagaaggggcaacagatctattaccacaagttctag

SEQ ID NO: 138082 - DNA, 1656 bp, Artificial Sequence
  Description of Artificial Sequence: Synthetic coding sequence
atgattagtccagaccccagaccatcgccaggcctggccagatgggccgaaagttatgaagccaagtgcgaaaggcggcaggagattcgcgaatctcgacgctgcaggcccaacgtcactacttgccgccaggttggcaagaccctgcgcatccagcaaagagaacagctacagagggctcggctccagcaattcttccggcgtcgcaacctcgaattggaagaaaaagggaaagcgcaacaccctcaggcccgggagcagggcccctccaggaggcctggtcaggtgacggttctgaaggagcctttgagctgtgcgcgtagaatttcatcaccacgagagcaggttacagggacatctagcgaagtcttccctgcccagcacccacccccttctgggatctgtcgagacctctccgaccacctgtcctctcaagcgggtggactgccaccccaggacactccaattaagaagcctccaaaacatcacagaggcacacagaccaaagcagaggggcccactattaaaaatgatgcttctcaacagacaaattatggcgtggctgtgttggataaggaaatcatccagctgtccgattatctgaaggaagcactgcagcgtgaattggtgctcaagcagaagatggtcatcttacaggaccttctgagcacccttattcaagctagcgacagcagctggaaaggccagttaaacgaagacaagctgaagggaaagctacggagcctggaaaatcaactgtatacttgtacacagaagtactccccatggggaatgaagaaagttctcctggaaatggaggatcagaaaaactcctacgagcagaaagccaaggagagcctgcagaaggtgctggaggagaaaatgaatgccgaacagcaactccagtccacgcagcggagcctggcattggccgagcagaaatgcgaagaatggcgatcacagtatgaggccctgaaggaagattggaggacactgggtacccagcatagggaactagaaagccaactgcacgtactgcagtccaagctgcagggggccgattccagagacctgcagatgaaccaagccttgaggtttttggagaacgaacatcagcagctacaggccaagattgagtgcctgcagggggatcgcgacttgtgctcactggacactcaggatctccaggatcagttgaagcgcagcgaggcagagaaattgactttggtaactagggtgcaacagctgcaggggctcctgcaaaaccagtctcttcagttgcaggaacaggagaagctactgaccaaaaaggaccaggccctgccagtctggtcgccaaaatccttcccaaatgaagtagaacctgaaggaactgggaaagagaaggattgggacctgagagatcaacttcaaaagaaaactttgcaattgcaggccaaagagaaggaatgccgcgagctgcattccgaactggacaacctctccgatgaatacctgtcatgcctgcggaaactgcagcactgcagagaagagttaaaccagagtcaacagctgcctcctcgacgccagtgtgggcgttggttgcccgtgttgatggtcgttatcgccgcagctttagcagtcttccttgccaacaaagacaacctgatgatttag

SEQ ID NO: 138083 - DNA, 1656 bp, Artificial Sequence
  Description of Artificial Sequence: Synthetic coding sequence
atgatctcccccgatcctaggccatcacctggcttagcgaggtgggctgaatcctatgaggcaaagtgcgaacggagacaggaaatccgtgagtcaagaagatgtcggcctaatgttacaacttgccgccaggtgggaaaaaccctcaggatccaacaacgggagcaactgcagagagctcggctacagcaatttttcagaagaaggaaccttgagctggaagaaaagggaaaggcccaacatccccaggcccgcgaacaggggccttccaggagaccagggcaagtgactgtgctaaaagagcctcttagctgtgcaagacgcatcagcagtcccagagaacaggtgaccgggactagttctgaggtgttccctgcgcagcatcccccaccctctgggatatgccgagacctttccgatcatctgagctcccaggccggcggcctgccgccccaagatacccctattaaaaaaccgcctaaacaccacaggggtacccagacgaaagcggaggggcctactatcaagaacgatgcctctcagcaaaccaattatggtgtggctgttttggataaagaaatcattcagctctccgattacttaaaggaggctctgcagcgcgaactggtgctgaagcaaaagatggttatcctgcaagatctactcagcacgctcatccaggctagcgactcttcctggaaaggacaactgaacgaagacaaactgaagggaaaactgcggtcactggaaaatcagctctatacctgcacccaaaagtattcaccatggggcatgaaaaaagtgctcctggaaatggaggatcagaagaactcatacgagcagaaggcaaaggaatctctccagaaagtcctcgaagaaaaaatgaacgcggaacaacagctacagtccacccaacgtagtctcgccctagctgagcagaaatgtgaggaatggaggagccagtacgaagcgttgaaagaagactggcgtacgctcggaacccaacaccgcgagttagagtcccagctgcacgtgctgcagtcaaagctgcagggcgccgacagccgtgacctccagatgaatcaggccctccggtttctcgagaacgagcatcaacaactgcaggctaaaatagagtgtctgcagggggatagggacctctgctctctggacactcaagacctccaggaccaattgaagaggtccgaggctgagaaactgacactcgtcactagggtgcaacagcttcaaggcctgctccagaaccagtccctgcagttacaagagcaagagaaactcctgacaaagaaggatcaggcactcccagtgtggtcccccaagagcttcccgaatgaagtagagcctgaggggacaggcaaagagaaggactgggacctgcgtgaccagcttcaaaagaagaccctgcagctacaggccaaggagaaggaatgtcgagagctacacagcgagctggacaacctgtctgatgagtatctcagctgtctgcgcaagttacagcactgtcgggaagaactaaatcagtcacaacaactcccacctaggcgacagtgtggtcggtggcttcccgttctcatggtggttattgcggctgccctcgcagtttttctggcgaataaagacaatctgatgatttag

SEQ ID NO: 138084 - DNA, 1596 bp, Artificial Sequence
  Description of Artificial Sequence: Synthetic coding sequence
atgatatctcccgatcctcggccttctccaggcttggccagatgggccgagtcctacgaagccaagtgtgagaggcggcaggaaattcgagaatcacggcgctgcaggccgaacgtcaccacgtgtcggcaagtgggaaagacgttgcggatacagcagcgagagcagctgcagagggccaggcttcaacaattctttcgaagaagaaaccttgaactggaagagaaaggcaaggcccaacatccacaggcgagagagcagggcccttcacgcaggcccggccaggtgaccggaacatcaagtgaggtttttcccgcccaacacccgccaccatccggcatctgccgggacctctccgaccacctgagctctcaggccggtggactgcccccccaggataccccaattaagaaacccccgaaacatcaccgggggacacagactaaagccgaaggccctactatcaagaatgatgcttcgcaacagacgaactatggagtggctgtcttagataaggaaatcatccaactgtctgactacctcaaggaagcccttcaacgtgaactggtacttaagcagaagatggtcattctacaggaccttctatctacactgatacaggcatcggattcttcctggaaggggcagctgaacgaggataagctaaaagggaagttgaggagtctcgagaaccagctgtacacatgtacacagaagtactcaccgtggggcatgaaaaaggtccttctggaaatggaggatcagaagaactcatacgaacagaaagctaaagagagcctacagaaagtcttggaggagaaaatgaatgcggagcagcaattacagtccactcagagaagcctcgccctggccgagcagaaatgtgaagaatggcggtctcagtatgaggccctgaaggaggattggcgaaccttgggcacccagcaccgcgagctggagagccagttgcatgtgctgcagtctaagctgcagggtgctgatagtagggacctgcagatgaaccaggcactgcggtttttagagaacgagcaccaacagctgcaggctaagatcgagtgtctgcagggtgaccgcgatctttgttctttggatacccaggacctgcaggatcagttaaaacggtcggaggcagagaaacttacattagtgactcgtgtccagcaattgcagggattactgcagaaccagagcctgcagctgcaagaacaggaaaaactgcttaccaaaaaagaccaggccctccctgtatggagccctaagagtttcccaaatgaagtggaaccagagggaacggggaaggagaaggattgggacttgagggatcagcttcagaaaaagacactacaactgcaggccaaagagaaggaatgccgggaactccacagtgagctagataacttaagtgatgagtatctgagctgtctcagaaaactgcaacattgcagagaggagctgaatcagtcccagcagctccccccccggagacagtgcggccggtggctgcccgtcctgatggttgtaattgctgccgctctcgccgtgtttctggccaataaagataacctgatgatttag

SEQ ID NO: 138085 - DNA, 1215 bp, Artificial Sequence
  Description of Artificial Sequence: Synthetic coding sequence
atgataagcccagatcctagacctagccctggactcgctagatgggctgaatcttacgaggctaaatgtgaaagacgccaagaaattagagagtcaaggcgatgtaggccgaatgtgacaacctgtcgccaggtgggtaaaacactgcgcattcagcagcgggaacagctgcaacgtgcacgattgcagcagtttttcaggcgaagaaacctggaactggaggaaaagggaaaagcacagcacccccaggctagggaacagggtccttctcgcagaccagggcaggttacaggcactagctcagaagttttccccgctcagcacccccctcctagtgggatttgccgcgatctttctgaccatctcagttcccaggccgggggactgcccccccaggacactccaatcaagaagccccccaagcatcacagggggacgcagacgaaagcagaaggccccactattaagaacgacgctagccagcaaaccaactacggcgtggccgtactcgataaggaaattatccagctcagcgattacttgaaggaggctctgcaaagagaactggtgctgaaacagaagatggtgatactgcaggatctcctgtcaacactcatccaggcaagtgactcctcctggaaaggccaactcaacgaggataaactcaagggaaaactgcgttccctggaaaaccagctttacacatgcactcagaagtattctccttgggggatgaaaaaggtgctgttggagatggaagaccagaagaactcctacgaacaaaaggctaaggaaagcttacagaaagtcctggaggagaagatgaacgcagaacagcagctgcagtctacccagcggtctcttgcattggccgaacagaagtgtgaagaatggaggagccagtacgaggcactcaaagaagactggcggactctgggtacacaacaccgcgagctcgaatctcaattacatgttctccagtctaagttgcagggcgctgactctagggacctccagatgaaccaggcgcttcgcttcctggagaacgagcaccaacagctgcaggccaaaattgaatgtttacaaggggatcgcgacttgtgtagcctggacactcaagatttgcaagaccagctcaagcgctcagaggcagagaagctgaccctggtgactagggtacagcagcttcaagaggccgctgggtggactacatag

SEQ ID NO: 138086 - DNA, 963 bp, Artificial Sequence
  Description of Artificial Sequence: Synthetic coding sequence
atgattagccccgatccacggccttcgcctggcttggcccgttgggcagagtcatacgaggccaagtgcgagcgtagacaggaaatcagagagtcacgccggtgtcgcccaaatgtgacaacttgtcggcaggttgggaagaccctgcgaatccaacagcgcgaactcgaggagaaaggcaaagctcaacaccctcaagccagagagcaaggaccatcacgacgaccaggccaggttactgtactgaaagagccccttagctgtgccaggcgcatttcaagcccacgcgagcaggtaacaggcacgagcagcgaagtgttccccgcacagcatccgccgcctagcggaatatgtcgcgacttaagcgatcatttgagctcccaagccggaggattgccgccgcaagatacacccattaagaaacctccgaagcaccaccggggaacgcagaccaaagccgaaggtcccacaatcaagaatgatgctagccaacagaccaattacggagttgccgtgttagataaggagatcatccagctgtccgattatctcaaagaagccctccagcgcgaactagtgctgaagcagaagatggttattttgcaggatcttttatcaacactaatccaggctagtgattcttcctggaagggccagcttaacgaagacaagttgaaaggcaagctaaggagcctcgaaaaccagctgtatacttgcacacaaaagtactcaccttggggtatgaagaaagtcctgctggaaatggaagatcaaaagaattcctatgaacaaaaggccaaagagagtctgcaaaaggtacttgaggagaaaatgaatgcagagcagcagcttcagtccacccaagtatggggatgccatattgacatggggttgggcacacccggatcccttggcaataaaggttctcagctgcacaactcattggaaccatctcccctatag

SEQ ID NO: 138087 - DNA, 81 bp, Artificial Sequence
  Description of Artificial Sequence: Synthetic coding sequence
atgatttctcctgatccaaggccctctccaggactggcccgctgggccgaatcgtacgaggccaagtgcgagcgaaggtag

SEQ ID NO: 138088 - DNA, 1671 bp, Artificial Sequence
  Description of Artificial Sequence: Synthetic coding sequence
atgcagaaattcatagaggcagattattacgagctggattggtattatgaggagtgctccgatgtcctctgcgctgaacgcgtgggacagatgaccaaaacctacaacgatattgacgcagtgacacgacttttggaggaaaaggagagagatttagagctggctgcgcggattggtcaatcgctacttaagaagaacaagacgctgactgagcgtaacgagctgctggaagagcaagtcgaacatattagggaggaggtgtcccagctgaggcacgagttgagcatgaaggacgagttgttgcagttctataccagtgccgctgaggagtcagagccagagagcgtatgtagcacccctctcaaaagaaacgaatcatcatcgtccgttcagaactactttcatttggatagtctacagaaaaagctaaaggaccttgaagaggaaaacgtggtgctccggtccgaggccagccagttgaagaccgagactatcacttacgaagaaaaggagcaacaactggtaaatgactgtgtaaaggaacttagagatgctaatgtgcagattgcctccatttcggaggaactggcaaagaaaaccgaggacgccgccagacaacaagaggagatcacccacctgctgtctcagatcgtggacctgcaaaagaaggccaaagcatgcgcagttgagaacgaagagctggtccagcatctcggagccgctaaagacgcacagcgtcaactgacagcagagcttcgagagcttgaggataagtatgccgaatgtatggagatgttgcacgaagctcaggaagagctcaaaaatttaagaaataaaacaatgcccaacactacctcccggagataccactcacttgggctgtttccaatggactctctggctgcagaaatcgaaggcacaatgcgtaaggagctccagctggaggaggccgaatcgcctgatatcacacatcagaagagagtatttgagaccgtccgcaatatcaaccaagtcgtgaagcaacggtcccttacacccagcccaatgaacatccctggcagtaaccagagcagcgcaatgaattctttgctttcatcctgcgtgagcacccccaggtcttcattctacggttcagatatcggcaatgtggtgttagacaataagaccaacagcatcatcctggagaccgaggcggctgatttggggaacgatgaaaggtctaagaaaccaggaacccccggcactccaggaagccacgatctagaaaccgctctgagacgactgagtctgcgacgtgagaattacctgagtgaaaggaggttctttgaagaggagcaggaaagaaagctccaggagctggccgagaaaggggagctcagatcaggctcactaactcccaccgagagcataatgtctttaggcacccactcaagattttctgaattcaccggatttagcgggatgtctttctcgagccgctcttacctgccagaaaagcttcagattgtcaagcccttggaaggagaccatgcagggcctcggccactttctgttctgcttggcgattcattatggagcctgatccatctcagaaaagcaggccacttgtgtcacgcatactcattctttttcagagactctcatcccagatgctggttcgaattcctgtag

SEQ ID NO: 138089 - DNA, 438 bp, Artificial Sequence
  Description of Artificial Sequence: Synthetic coding sequence
atgactgtgcataacctttacctgttcgaccgcaacggcgtgtgcctgcattactctgagtggcatcgcaagaaacaggctggcatccctaaggaagaggagtacaagctcatgtatggaatgttattctccattagaagttttgtgagcaaaatgtcgcccctggatatgaaagatggcttcttggcctttcaaacttctagatacaagctacactattatgaaaccccgacaggaatcaaagtggtcatgaatactgacctgggcgtgggtcccatcagggacgtccttcaccacatctactctgctttgtacgtggagctcgtggtgaagaatcccctgtgtccacttgggcagactgttcagagcgagttgtttagatctcgcctcgatagctatgtccgctcccttcctttcttctccgcccgggccggttag

SEQ ID NO: 138090 - DNA, 438 bp, Artificial Sequence
  Description of Artificial Sequence: Synthetic coding sequence
atgaccgtgcacaacctgtatctttttgatagaaacggcgtctgtctgcattactccgaatggcaccgtaagaagcaggctgggattccaaaggaggaggaatacaagcttatgtatggtatgctcttcagtatccgttcctttgtgtctaaaatgtcccctcttgatatgaaggatgggttcttggcctttcagaccagccgatacaagttacattactatgagacgcctactggaattaaagtagtaatgaacactgacctcggggtgggccccatcagggacgttctccatcatatttacagtgccttgtacgtggagttggtggtgaagaaccctctttgtccccttgggcagaccgtacagagtgagctgtttagatcccgcctagacagctacgtccggtctctgccgtttttctctgccagagctggatag

SEQ ID NO: 138091 - DNA, 3402 bp, Artificial Sequence
  Description of Artificial Sequence: Synthetic coding sequence
atgagtcccactcaatgggacttccccgtagagctgtgctgtagacctatggcatttgtcacactcaccggcttagacgtggtgtacaacgccgtccaccgcgccgtttgggacgctttttgtgcaaacagacgagccgatagggtgcccattagtttcaaggtgctgccgggagatcacgaatacccaaagtgccggccaaaacggacctcgtatgaatggtacatccctaaggggattctcaaaacaggctggatgaacaagcacctgaacctcgtgcccgctctggtcgtggtgttctatgagctggattgggatgagccgcagtggaaggaaaaacagtccgagtgcgcgacgcgggtcgagatagtgcggcagtcactgcagggtcggaatactaaggtggccgtggttctgattcagaagaaaactccgctgcctccgggggaagacgtcattgcctctgaaagggccgcggctctttgcaatgcatgcgaactctctgggaaatcactcttcgtcttgcctcacactgatcacctggtgggctatattatccggcttgaaaatgcattctatgagcatgcacagacgtactactacacagagattcggcgcgtgaaatcccataaagaattcctgaacaaaacaacccaccagctgttgttcgtcaggcaccagttcaagattgcatttttcagcgagctgaagcaggacacccaaaacgccctgaagaactaccgaacagcttacaacttggtgcacgaattgcgggctcacgaaaccaatatcctcgaaataaagaccatggctgggtttatcaattataagatatgtcggctgtgcttccagcataacaccccattggatgcgatcgcgcagtttcgcaagcatattgatctctgcaagaagaagataggcagtgccgaactgagcttcgaacacgatgcttggatgagtaagcagttccaggccttcggtgatctcttcgacgaagccattaaacttggtctgactgctatccagacccagaatcccggattctattaccagcaggccgcctactacgctcaggagagaaagcaattagcaaagaccctctgtaaccatgaggcttcagtgatgtaccccaatcccgatccgctcgagacccagaccggtgttctggacttctacggacagcggtcttggcgccaaggcattctgtcttttgatctgtctgaccccgagaaagagaaagtggggatcctggcgatacaactgaaagaacggaacgtagtgcactccgagatcataatcacccttctaagcaacgcagtcgcacagttcaaaaagtacaaatgtccacgcatgaaaagccatttgatggtccagatgggggaagagtactactatgccaaagattacactaaagctctcaagcttctcgactacgttatgtgtgattaccgcagcgagggctggtggacgctgcttaccagcgtgctaaccaccgctctcaaatgctcttatctcatggcccaactgaaagactatataacctactctttagaactgttggggagggcctccaccctgaaagacgatcagaagtctagaatcgagaagaacttgatcaatgtactgatgaacgagagtccagatccagagccagactgtgacatcttggcagtgaagactgctcagaaactgtgggcagacagaatatcactggcaggctccaacatttttaccatcggggtccaggatttcgtgccctttgtccagtgcaaagcaaaattccacgctccgtcctttcatgtggacgtgccggttcagttcgatatatacctgaaggcagactgccctcatcccattaggttctcaaagttgtgcgtgtcttttaacaatcaagagtataaccaattctgtgtgatcgaagaagctagcaaggccaacgaggtcctggagaacctgacccagggaaagatgtgtttagtgcccggcaaaaccagaaaactgctctttaaattcgtggctaagacagaggatgtgggcaagaagattgaaattactagtgtagacttggccttaggtaacgagactggacgctgtgtcgtactgaattggcaggggggaggcggcgatgctgcaagcagccaagaggctctccaggccgcccgtagcttcaagcgcagacctaagttgccggataacgaagtgcattgggactccattatcattcaggcgagtacaatgatcattagccgcgtcccgaatatttctgtccatttactacacgagccgccggccctgacaaacgaaatgtactgtctcgtggttactgtgcagtctcatgaaaaaacccaaatacgggatgttaaactgacagcgggcttaaaacccgggcaggacgcgaacctgacccagaaaacgcatgtgacactgcatgggaccgaattatgcgacgaatcatatccagctctgttgacagatatccccgtgggggatctgcacccaggagaacaactcgaaaaaatgctgtatgttcggtgcggcactgtcggctcccgaatgtttctggtctacgtgtcgtacctcattaatactacagttgaagagaaggaaatcgtgtgtaaatgccataaagacgagacagttacaattgagacagtgttcccatttgatgtggcagtgaagtttgttagtacaaagtttgaacacctggagcgagtctacgcggatattccatttcttttaatgacagacctgctttcggccagtccatgggcgctgaccatcgtgtcatcagaactccagctggctccaagtatgactacggttgaccaattggaatcacaggtggacaacgtgattctgcaaactggagagagcgcctctgaatgcttctgcctccagtgtccttctctgggcaatattgagggaggggtggcgaccggacattacatcatcagctggaaaaggacctccgcgatggagaatatcccgataattaccaccgtcatcaccttgccgcacgtgattgtggaaaacatccccctgcatgtcaacgcagacctaccgagttttgggcgggtgcgggagagccttcctgtgaaataccatctgcagaacaaaaccgatttggtgcaggacgtcgaaattagcgtggagccgagtgacgccttcatgttttcgggcctaaaacagatcagactcagaattctgcctgggactgagcaggagatgttatacaatttctaccctctgatggcgggctaccaacaactgccctctttgaatataaatctattacggttccccaactttacaaatcagctgctgaggcggtttattcccacaagcatctttgttaagccgcaggggaggctcatggacgacacaagtattgctgccgcatag

SEQ ID NO: 138092 - DNA, 3261 bp, Artificial Sequence
  Description of Artificial Sequence: Synthetic coding sequence
atgagccctactcagtgggactttcctgtggagctctgctgccgacccatggcttttgtcaccctgaccggcctggacgtcgtctataacgcggtccacagggcggtttgggacgcattctgcgccaatagacgggccgacagagttcctatatctttcaaagtgcttcccggtgaccatgaataccctaaatgcagacctaagaggacctcttatgagtggtacatccctaagggtatcttgaagaccgggtggatgaacaagcaccttaatctcgtacccgcactcgttgtggtgttttatgaactggattgggatgagcctcagtggaaagaaaaacaatctgagtgtgcgacgcgtgtggaaatcgtacggcagtcactccagggaaggaacaccaaggtggcagtggtgctcatccagaaaaagacgccgcttcctcccggggaggacgtcatcgcctctgagcgggctgcagccctctgtaatgcttgcgagcttagcgggaaatccttgtttgtccttccacatacagatcatctcgtcggctatattattcgacttgagaatgccttctacgaacatgcccagacatattactacacagaaatccgcagagtcaagagccacaaggaattcctgaataagactactcatcagctactgtttgtgcgacatcagtttaaaattgcctttttctcagagctgaaacaggacacccaaaatgcattaaaaaattataggacagcctataacctggtacacgagcttcgcgctcatgaaactaatatactggaaattaaaaccatggccggattcatcaattataagatctgtcgactctgcttccagcacaatactcccctcgacgctatcgcacagtttcgtaagcatattgatctttgtaagaaaaagattggctcagccgagctttcttttgagcacgacgcatggatgtctaagcagtttcaggccttcggcgatctcttcgacgaagctataaagctcggcctgacggcgatacagacccagaatccaggattctactaccagcaggcagcctactatgcgcaggaacggaagcaactggccaagactctgtgcaaccacgaggcgtccgttatgtacccgaatccagaccccctggagactcaaactggcgtcctggatttctacgggcagcgctcttggcgtcagggaatactgagttttgatctgtcagaccccgagaaggagaaggtgggtatcctggcgattcagttaaaagaacggaacgtggtgcattctgagatcatcatcaccctcttaagcaacgccgtggctcaattcaaaaaatacaagtgcccccggatgaagtcccacctcatggttcaaatgggagaagagtattattacgccaaggactacaccaaggcactcaaactgcttgattatgtgatgtgtgattaccgtagcgagggctggtggaccctgctgacgtctgtgttgaccactgccctcaaatgctcatacctgatggctcagctgaaagattacatcacatacagcctcgagcttcttggtagggcctcaacgctcaaggacgatcagaagagtagaatcgaaaaaaacctgataaatgtgctcatgaatgagagcccagatcctgagccagattgcgacatcctggcagtgaagactgcgcaaaagttgtgggctgatagaatcagcctcgcaggaagcaacatcttcacgattggcgtacaagattttgtgccattcgtccagtgtaaggctaagttccacgcaccatcatttcatgtcgatgtgcctgtgcagtttgatatttatctcaaagccgattgtccccaccctattagattcagcaagctgtgtgtttcgttcaataaccaagaatacaaccagttttgcgtcatagaagaggcctccaaggccaacgaagttttagaaaatctcactcagggtaaaatgtgtctggtcccgggcaaaacccgtaagctgctttttaaattcgtagcaaaaacagaagacgtaggcaaaaagatcgagatcacctcggtggatctagcccttggtaatgaaaccggacggtgcgtggtcctcaattggcaaggtggcggtggggacgcagcatcatcccaggaggccctccaggcagcaaggtctttcaagcgcagacctaaactcccagacaatgaagtacattgggattccatcattatccaggcaagcacaatgatcatcagtagggtcccaaacatctctgtgcatctgctgcacgagccgcctgctttgactaacgaaatgtattgcctggtagtaaccgttcagagtcacgaaaaaacacaaataagggacgtaaagctgacagcaggtctgaagcctgggcaagacgccaacctaacccaaaagacgcacgtgactcttcatggcaccgaactgtgcgatgagtcctatcctgcactgctgactgatattccagtcggtgatctccatccaggcgagcagctcgagaagatgctctacgttagatgtggcactgttggctctagaatgttcctggtctacgtgtcatacctgatcaacacgacggtagaagaaaaggagatagtatgtaaatgccacaaggatgagactgtgacaatcgaaaccgtctttccattcgacgtggctgtcaagttcgtgtccaccaagttcgaacatctcgagcgtgtctacgcagacattcctttcctactcatgacagacctactgtctgcatcaccctgggcccttaccatcgtgtcctctgaactgcagctagcaccgagtatgacgactgtggatcaactggaatcacaggtggacaacgttatactgcagactggggagtccgcttcagaatgtttctgcctacagtgtcctagcttggggaatatcgaggggggagttgcgacaggccactacataatttcctggaaacgaacatcggcaatggaaaacatcccaattataactactgttattacactgccccatgtgattgtggaaaatattccccttcacgtaaatgccgacctacctagcttcgggcgggttcgagaaagtcttcccgtgaagtaccatctgcagaataagacagatctggtacaggacgtggaaatcagcgtggaaccctctgatgcattcatgttctctggtctgaagcaaatccggctgcctgctcaggcattttacacttaccagtacttctgccaggcaactggctctacccatgggtag

SEQ ID NO: 138093 - DNA, 3057 bp, Artificial Sequence
  Description of Artificial Sequence: Synthetic coding sequence
atgagccctacgcaatgggacttcccagtcgagctctgttgtaggcctatggcgtttgtgaccctgacaggactggacgttgtttacaacgccgtacatcgagccgtctgggatgcattctgtgctaatagaagagcggatcgcgtgcctattagttttaaagtcttacccggggatcatgagtatcccaagtgcagaccaaaacggactagctacgaatggtacattccgaagggtattctcaaaaccggctggatgaataaacacctaaatcttgtgccagccctcgtggtggtattctacgagctggactgggacgagccccagtggaaagaaaagcagtctgaatgcgcaaccagagtggaaattgtgagacagtctctacagggtagaaataccaaggtggccgtcgtgctgatccagaaaaagacgcctctcccacctggagaagacgtcatcgcctccgagcgtgcggccgctctctgtaatgcatgtgagttaagcggtaagtctttattcgtcctgcctcacaccgaccaccttgtgggctacatcattcgccttgagaatgcgttttacgagcacgcgcagacgtactattacaccgaaatccgcagggtcaaatcgcataaagaatttctgaataagacaactcatcaactgctgttcgtgagacatcagttcaaaattgcattcttctctgaactgaaacaagatacccaaaatgcactcaaaaactacaggactgcatacaacctcgttcacgagctgagggcacacgaaacgaatatccttgagattaaaactatggccggcttcatcaactacaagatatgcagactgtgcttccagcataacacacccctcgatgctatcgctcagttccgcaagcacattgacctctgcaaaaagaaaatcggctccgcagaactgagcttcgagcatgatgcctggatgtcaaaacagttccaggccttcggcgatctatttgatgaagcaattaaactggggcttacagccatccaaacgcagaatccgggcttttattaccagcaggcagcatactacgcacaggaacgcaagcagctagccaagactctgtgcaaccatgaggcgagcgtgatgtaccccaaccctgatccactcgagactcagactggtgtgctggatttctacgggcagaggtcctggcggcagggcattcttagtttcgacctctcagatccagaaaaagagaaggtgggcatcttggcaatccagttaaaggaacgcaatgtggtgcacagcgagatcattattaccctgctgtctaacgcggttgctcagtttaagaagtataagtgcccaagaatgaagagccacctgatggttcaaatgggcgaagagtattattacgccaaagattacactaaagcgctaaagttgctggactacgtgatgtgcgattaccgttcagagggctggtggacactcctgacctccgtactgacgacagccttgaagtgcagttacctgatggcacagcttaaggactacattacatattctttggagttgctggggagggctagtacattaaaagacgatcagaaatcacggattgaaaagaacctcatcaacgtcctcatgaacgagagccccgatcccgagccagactgtgatatcttagccgttaagacagcacagaaattgtgggccgatcgcatatccttagccggtagtaacatcttcaccattggagttcaggatttcgtaccctttgtgcaatgtaaagcaaaatttcacgccccaagctttcacgtagatgtgcccgtgcaattcgatatttacctgaaggctgactgtcctcatccaatccggttctctaagttgtgcgttagtttcaataaccaggagtacaaccagttctgcgtcatcgaagaagctagcaaagccaacgaggtgctcgagaatcttacacaggggaagatgtgcctggtccctggtaaaaccaggaagctgctcttcaagttcgtcgcgaaaaccgaagacgtgggcaaaaagatagagattacatcagtggatttggccttgggcaatgaaaccggcaggtgcgtcgtcttgaactggcaaggcggaggcggagatgcagcaagctcccaagaagctctacaggccgccaggagcttcaagaggcgccccaagctgccggacaacgaagtgcactgggacagcatcatcattcaggcatctactatgatcatctcccgggtgccaaatatctctgtacacctgctccacgagccccctgccctgacaaacgagatgtattgcctggtcgtgaccgtgcagtcccatgagaagactcagatccgcgatgtcaagctgactgccggcctgaaacccggccaggatgcaaatctcacccagaaaacgcacgtgactctacatgggaccgagctgtgcgacgagtcatatcctgctctccttacagacatccctgtgggcgacctccatcctggtgagcagcttgagaaaatgctgtatgtcaggtgtgggactgtgggatcccgcatgtttttagtttacgtgagctacctgatcaacactactgtagaggagaaagagatcgtgtgcaagtgtcacaaagacgagaccgtgacaattgaaaccgtcttcccgttcgacgtggccgttaaattcgtgagcactaagtttgaacacctcgaacgggtttatgccgatattcctttccttcttatgacagacctgctgtcagcttcaccctgggccctcaccatcgtctctagtgagctacagctcgctccgagcatgacaaccgtcgaccagcttgaaagccaggtggataacgtgattttgcagactggtgagagcgcaagcgctttatattacctcctcgaaaaggacttgtctaatggtgaataccctcatcatcataactgccaccatagcgctgcccgtgattgtggtgaatacccaagtccctgcgaatgtaggagcgcagtgatttgggcttgccaaagagtggtcacgtgtcaggtgtccccaactgagtag

SEQ ID NO: 138094 - DNA, 2091 bp, Artificial Sequence
  Description of Artificial Sequence: Synthetic coding sequence
atggaggacgctggcggcggtgaggaacaggggttgctattccaagaggaaactattgatctgggtggtgatgaatttgggtctgaggaaaacgagacggcaagtgaagggagtagccctcttgccgacaaactcaacgagcacatgatggagagcgtgctcattagcgacagtcccaatagcgagggcgacgccggggacctcggcagagtgcgtgatgaagccgagccaggcggtgagggggaccctgggccagagccagcaggaacaccatccccttctggggaagccgacggggattgcgctcccgaagatgcagctccctcgtcaggtggagcccccagacaagatgcggcacgagaggtcccaggctctgaagccgcgcgacccgagcaagagccccccgttgctgaacctgtgcctgtttgtacgatcttttctcagcgggccccgcctgcgtcaggcgatggcttcgagcctcaaatggttaagagtccgtcctttggcggagcttctgaagcttcagctagaacacccccacaggtcgtgcagcccagtccttctctgtcaacatttttcggagacaccgctgcatctcactccctggcttctgacttctttgatagctttacaacctctgctttcatcagtgtgagtaaccctggagctggctctcctgctccggcctcccctccccctctggcagtacccggcaccgagggacgacccgagccggtcgcaatgagagggccccaggccgcagctccccctgccagccccgagccctttgcccatatccaggccgtgtttgccggatcagatgacccattcgcaactgctttgagcatgagtgaaatggacaggagaaacgatgcctggctccctggtgaggccacaagaggcgtcctgcgcgccgtcgctacccagcagagaggagcagtgttcgtagacaaagaaaatctcacaatgccgggcctacgctttgacaacattcagggcgatgcagtaaaagacctcatgctcaggttcctgggcgaaaaagctgctgcaaagagacaagtgctgaatgctgacagcgtggagcagtcattcgtgggccttaaacagcttatctcatgccgtaactggagggctgccgtggacctgtgtggacggctgcttaccgcacacggccaggggtatgggaaatcaggacttttgacctcacacaccaccgacagcctccagctatggttcgtcaggttagcactgttggtcaagcttggtctattccagaacgccgagatggagtttgaaccattcggtaaccttgaccaacctgacctgtactacgagtattacccccatgtgtacccaggccgacgaggaagtatggtgcccttttccatgcgcatcttacacgctgagctgcagcagtacctgggcaaccctcaagaatcactcgatagattacacaaagtaaaaacagtctgcagtaagatcttggcaaacctggagcagggcctcgctgaagacggcggtatgtcgagcgttacccaggagggccggcaaggctgttcttacctcgtggctagcattcgactatggaggtcaaggttgggccgggttatgtattctatggccaattgcctgctgctgatgaaggactatgtgcttgctgtcgaggcttatcattccgtgatcaaatactatccagagcaagagccccaactgctctctggcatcggccgcatctcactgcagatcggggacatcaagaccgcggagaaatattttcaagatgtggagaaggtgacccagaaactggatggcttgcaagggaaaataatggtccttatgaacagcgcttttctccacctaggacagaataactttgcagaggctcaccgatttttcacagagatcttacggatggacccgaggaatgccgtgcagatgctatccgccagccaccctactggaaaagaaccttctcctaaggatgccgaggaacatcctgaaggccaccgcgattctgctgaacccgggcccgcccgcccaatggtcccccagcgcgctccccccgggcctgcattgtgcgcccagccgtag

SEQ ID NO: 138095 - DNA, 2208 bp, Artificial Sequence
  Description of Artificial Sequence: Synthetic coding sequence
atggaggatgctgggggcggcgaggaaacaccggcgccagaggcgccccatccaccgcagctggctcccccagaggagcagggtctcttgtttcaagaggaaaccattgacttgggtggagacgaattcggcagtgaggagaatgagaccgcatcggaaggcagctcgcccttggccgataaactgaacgaacatatgatggagagcgtgttgatttccgactctccgaattcagaaggggatgccggagacctcggcagagttcgggatgaggcggaacccggcggggagggcgacccgggaccagaaccagccgggactccttctccatcgggcgaagcagatggcgattgcgcccccgaggatgccgccccaagcagtggcggtgcaccacggcaggatgcagcaagggaagttcccggatccgaggctgctaggcctgaacaggagccgcctgttgctgaaccagtacccgtgtgtacaatctttagtcagcgggctcccccagccagcggagacggatttgagcctcaaatggtgaaatcaccctctttcggtggtgcctctgaggcgtcagcacgcacaccgcctcaggtggttcagccatcccctagcttgagcaccttctttggcgacactgctgcctctcacagcttggcttccgatttcttcgatagcttcaccacctctgctttcatcagcgtctctaacccaggagcaggcagtccagccccggccagccctccccctttggccgtgcctggcacggaaggacgacccgagccggtcgccatgagaggcccgcaggcggccgctccgcccgcctcgccagaaccttttgcacacatccaggcagtgttcgccgggagcgacgacccctttgccacagcactgtcgatgtccgagatggaccgcagaaacgacgcatggctgcccggagaagccacccgcggagttctgcgagcagtcgcgactcaacagcgcggagcagtctttgtggacaaggaaaatctgactatgcccggtcttaggtttgacaacattcagggcgacgccgtcaaagacctgatgctgcggttccttggtgagaaagctgctgcaaagcggcaggtactcaacgctgactccgtggaacaaagtttcgtaggacttaagcagctgatctcctgtagaaactggagagcagccgtcgatctctgtggccggctattgactgcgcatggccaaggttacggcaaaagcggtctcctcaccagtcacaccactgactcactgcaattgtggttcgtgcggctggccctgctagtgaaactcggtttattccaaaacgctgagatggagttcgagccattcggtaacttggaccaacctgatctgtactacgagtattaccctcatgtgtatccagggagacggggctccatggtccccttttcaatgcgaatactgcacgcagaactgcagcagtatttaggcaacccccaggagagccttgatcgtctgcacaaggttaagactgtgtgctccaagatactcgccaacctcgagcaggggctggccgaagacggcggtatgagcagcgtaacacaggagggcagacaggcctctatacggctctggcgtagccggctagggagggtgatgtatagtatggcaaattgtctcctgctgatgaaagactatgtcctagccgtggaggcatatcactctgtcattaaatactaccctgagcaggaacctcagctgctttccggaatcggtcgcatttcattgcagattggggacataaagaccgccgagaagtacttccaggatgtcgagaaggtcacacagaagctggacggccttcagggaaaaatcatggtgctgatgaacagtgcgttccttcacctcgggcagaataattttgccgaggcacatagattctttacagagatcttgcgaatggatccccgtaacgcagtggccaataacaatgctgctgtctgtctgctttacctgggcaaattgaaggactctttgaggcagctggaggcaatggttcagcaggatcctaggcactatctgcacgaatctgtgttgttcaaccttaccactatgtacgaacttgaatcgagtaggagcatgcagaaaaaacaggccttactggaagcagttgccggcaaggagggggactcgttcaacacacaatgcctgaagcttgcttag

SEQ ID NO: 138096 - DNA, 2208 bp, Artificial Sequence
  Description of Artificial Sequence: Synthetic coding sequence
atggaagacgcaggcggcggggaggaaactccagctcccgaggctccccatcccccacagctggcaccgccagaagagcaaggcctcctgtttcaggaggaaactattgacctggggggggacgagttcggaagcgaagagaacgaaaccgcttcagaaggcagctcccctcttgctgataagctgaacgagcacatgatggagtcagtgttgattagcgacagtcccaacagtgagggcgatgctggagacctcggcagggtaagggatgaggccgagcctggaggcgagggcgatccaggtcccgagccagctggtaccccatccccgtctggggaggctgacggtgactgtgcacctgaagacgcagcaccatcttctggcggagctcccaggcaagacgccgcccgggaggtgcccggaagtgaagctgcacgacctgaacaggaacctcccgtcgctgagccagttcctgtgtgcaccatattctcacagagggccccaccagcttcgggcgatgggttcgaaccccaaatggtgaagagccccagctttggcggtgcctcagaggcttccgccagaactccgcctcaggtcgtgcagccgagtccctcgttatccactttttttggggataccgctgcaagtcactcgcttgctagtgatttctttgatagcttcaccacatctgctttcatttccgtctcaaatcctggcgcgggctctcctgcccccgcttcaccgcctcctctcgccgtcccggggacagagggaagacccgaaccagtggcgatgagggggccgcaagctgctgctccccctgcctccccggagcctttcgcacatattcaggcagtgtttgcaggtagcgacgacccttttgctaccgcactgtccatgtccgaaatggaccggagaaacgacgcctggctcccaggtgaagctaccagaggagttcttcgggcggttgctacccagcagcggggcgccgtgttcgtcgacaaggaaaatctgacaatgcccgggctgaggttcgacaatattcagggagatgccgtcaaggacctaatgttgcgatttttgggagagaaagccgcagcaaaaaggcaggtgctcaacgccgactcagtagagcagagttttgttggcttgaagcagcttatttcctgtagaaactggagagccgctgtggacttatgcgggaggctgctaaccgctcacgggcagggatacgggaagtctgggctgctgacgagccacacaacagactcactccagctctggtttgtccggcttgctctactcgttaagctggggctgtttcagaacgcggaaatggagtttgagccatttggcaaccttgatcagccagatttatattacgaatattaccctcatgtgtacccaggacgaagaggaagcatggtgccatttagcatgagaatacttcatgccgagttacagcaatacttgggaaatcctcaggaatcactggataggttgcacaaggtcaagacggtctgttctaaaatactggctaatttagaacagggactggcagaagacggcggaatgtctagtgtgacacaggaaggaaggcaggcaagcattcggctttggagatcccgcttgggccgagtgatgtacagcatggctaattgcctgctactgatgaaagactacgtcctcgcagtagaggcatatcatagcgtgattaagtactaccctgagcaggagccgcagctgctctcaggcattggaaggatttccctgcagattggggatattaaaacagcggagaaatattttcaggacgtcgaaaaggtcacccagaaattagacggactgcagggtaagatcatggttttgatgaacagcgcctttctccatctcggacagaacaacttcgcagaggcacaccgcttctttaccgagatcctgaggatggatccccggaatgcagtagcgaataataatgcagcggtgtgcttgttatacctcggaaaattaaaggactcactgcggcagcttgaagcaatggttcagcaggaccctagacactacttgcacgagagcgtgttgtttaatttaactacgatgtacgaactggagagctcccggtctatgcagaagaagcaggctctcctggaagccgtggcaggcaaagagggggactccttcaatacccagtgtctgaaactggcttag

SEQ ID NO: 138097 - DNA, 423 bp, Artificial Sequence
  Description of Artificial Sequence: Synthetic coding sequence
atgagtggaagtttctatttcgtgatcgtgggtcaccacgataacccggtgtttgagatggaattcttgccggccgggaaggcagaaagcaaggacgaccataggcacctgaaccagttcattgctcacgcggccctagatctcgtggacgagaatatgtggctgtccaataatatgtatctaaaaacagtggataaatttaatgagtggttcgtgtctgcgttcgtgacggccggccacatgcgattcatcatgctgcatgacattcgccaagaggatggcataaaaaacttcttcacggacgtgtatgatctgtacattaagttttctatgaatccattctacgaaccgaacagtcctatccgaagcagcgcctttgaccggaaggtccagttcctcgggaaaaagcacctattgtcgtag

SEQ ID NO: 138098 - DNA, 423 bp, Artificial Sequence
  Description of Artificial Sequence: Synthetic coding sequence
atgtcaggatccttttacttcgtaatcgtgggccatcacgataacccagttttcgaaatggaattcttaccagccggaaaggcagagtctaaagacgaccacagacacctgaaccaatttatcgcgcacgctgccctggacctggttgatgagaatatgtggctttcaaacaacatgtatttgaagacagtggacaaattcaacgagtggttcgtttctgccttcgtgaccgccggtcatatgcgcttcatcatgttgcacgatatcaggcaggaagatggcataaaaaattttttcactgacgtctatgacctatatatcaaattctccatgaacccgttctatgagccaaacagccccatccggtctagcgcctttgatagaaaagttcaatttctcggcaagaagcacctgctgagttag

SEQ ID NO: 138099 - DNA, 423 bp, Artificial Sequence
  Description of Artificial Sequence: Synthetic coding sequence
atgtctggatctttctacttcgtgatagtgggacatcatgacaacccagtcttcgaaatggagttcctgcccgccggcaaagctgagtcgaaagacgatcacaggcacctgaatcaatttatagcacacgccgcactggacctggtggacgagaatatgtggttaagcaataacatgtacctcaaaacagtggacaagtttaatgaatggttcgtctccgctttcgttacagcaggccacatgcgcttcattatgcttcatgatatcaggcaggaagacgggattaagaacttttttacggacgtgtacgacctttacattaagttttcgatgaatcctttctatgaaccaaactcccccattcggagtagcgcatttgaccgcaaagtgcagtttttagggaagaagcaccttctgagctag

SEQ ID NO: 138100 - DNA, 423 bp, Artificial Sequence
  Description of Artificial Sequence: Synthetic coding sequence
atgagcggctcattttattttgttatcgtcggacatcatgataaccctgttttcgagatggaattcttgccggcagggaaagccgagagcaaagatgaccatcggcatctgaatcaatttatcgcccacgcagctctggatctggtcgatgaaaatatgtggctcagcaacaatatgtacctgaagaccgtggataaatttaatgagtggttcgtgagcgcttttgtcacagctggccatatgcgcttcatcatgctgcacgatattcgccaggaagatggcattaagaactttttcaccgacgtctatgacctctacatcaaattctcaatgaatcctttttatgaacctaacagtcccatccgttcttctgcctttgatcggaaggtgcaatttctagggaagaagcacctgctttcgtag

SEQ ID NO: 138101 - DNA, 444 bp, Artificial Sequence
  Description of Artificial Sequence: Synthetic coding sequence
atgagcggcagcttttactttgtgatcgtggggcatcatgataatccagtttttgagatggagtttttgccagccggtaaggctgaaagcaaagacgaccaccgccatctcaatcagttcatcgcacatgcagcactggacctggtggacgaaaatatgtggctatcaaataatatgtatctgaagaccgtcgacaagttcaacgagtggtttgttagcgcgttcgtcacggcaggccatatattgaccttcttggtcaaaatgagattcataatgctccatgatataagacaggaggatggcatcaagaattttttcacggacgtttacgatttgtacatcaagttttcaatgaaccccttttacgagcccaactcgccaatcaggagctctgcttttgaccggaaggtgcagttcttagggaaaaaacatctcctgagttag

SEQ ID NO: 138102 - DNA, 525 bp, Artificial Sequence
  Description of Artificial Sequence: Synthetic coding sequence
atgtcaagctggaaacaggatcgatcaggtttgcggagcacagaattgaacgtgctcgagtatcagcccctatgcgcagtgagaagccatatcctcaagactatgtctggaagcttttattttgtgatcgtcggtcatcacgacaaccccgtttttgagatggagttcctgccggcgggcaaagccgagagcaaggacgaccacaggcatctgaaccagtttattgcccatgctgccctggacttggtggacgaaaatatgtggctctccaataacatgtatctcaaaaccgtcgacaaatttaatgaatggtttgtcagcgcatttgtgaccgcagggcatatgcgttttatcatgcttcacgatatcaggcaggaagatggcataaagaatttttttaccgatgtgtacgacctgtacattaagttctcaatgaacccattctatgagcccaacagccccatacgatcctcagcttttgatcgcaaggtgcagttccttggtaagaaacacctgctgtcatag

SEQ ID NO: 138103 - DNA, 225 bp, Artificial Sequence
  Description of Artificial Sequence: Synthetic coding sequence
atgtccgggagtttctatttcgtgatcgtcgggcaccacgacaatccagtgttcgagatggagtttcttcctgccggtaaggccgagagcaaggatgatcataggcacctgaatcagttcattgcacacgccgctctggatttggttgatgaaaacatgtggctgtcgaacaatatgtaccttaagaccgtggataagtttaatgaatggttcgtgtccgcctag

SEQ ID NO: 138104 - DNA, 423 bp, Artificial Sequence
  Description of Artificial Sequence: Synthetic coding sequence
atggccgtttgtatcgccgtgatcgccaaggagaactatcccctttacatccgcagcacgcccacagagaacgaacttaaattccattacatggtacatacctccctggacgtagtcgatgagaaaatcagtgcaatgggaaaagctctcgtcgaccagagagagctctacctggggcttctttacccaacggaggactataaggtatacggatacgtgactaactcaaaggtgaaattcgtgatggtggtcgacagctccaacactgcactgcgtgataatgagatccgaagtatgttcaggaagttgcataatagctacactgatgtgatgtgtaaccctttttacaatcccggagatcggatccagtctagccgggccttcgataatatggtcacttctatgatgatccaggtctgctag

SEQ ID NO: 138105 - DNA, 357 bp, Artificial Sequence
  Description of Artificial Sequence: Synthetic coding sequence
atgagtcgccaggccaacagggggaccgaatcaaaaaagatgagcagtgagctgttcaccctgacctacggggccctggttacacagctgtgcaaggattacgaaaacgatgaagacgtaaacaagcagttagacaagatgggctttaatatcggcgtgcgacttatcgaagacttcctggcccgtagtaacgttggaagatgccacgatttccgggaaactgcagacgttatcgccaaagagaggaaaatgtttttgggcaagcagaacaagacaaagaggcaggctaaactgtacgatgctgtcaaggaaagaggggccgcttcatgcactgacgcctcacctctactgagttag

SEQ ID NO: 138106 - DNA, 405 bp, Artificial Sequence
  Description of Artificial Sequence: Synthetic coding sequence
atgggcttcaatatcggagtcaggctcatcgaggatttcttagctcggtccaatgtcggaagatgccacgactttagagaaacagctgacgtgatcgcgaaggtggcttttaaaatgtatctgggaatcaccccctctatcacaaattggtcaccagccggcgatgagttctcgctgatcttggagaacaatcccctcgttgactttgtggagctgccagacaaccattcttctctcatttattctaatctcctgtgcggcgtgctgcggggcgccctggagatggtgcagatggccgtggaggctaagtttgtgcaagacactttgaaaggcgacggcgttactgagatccgcatgcgctttattaggcgcatcgaggacaacctgcccgctggcgaggagtag

SEQ ID NO: 138107 - DNA, 405 bp, Artificial Sequence
  Description of Artificial Sequence: Synthetic coding sequence
atgggcttcaatataggggtgaggctcattgaagattttctggctcgatccaacgtggggcggtgccacgatttcagagagacagcggatgttatcgccaaggtcgcgtttaaaatgtacctcggtatcacaccctccatcacaaattggtcccctgcaggagatgagtttagtctcatccttgaaaataaccccctggtggacttcgtagaactacctgacaaccacagctcattgatatattctaacctactctgcggtgtgcttagaggagccctcgagatggtccagatggcagtagaagcgaagtttgtccaagacacactgaagggagacggtgtgacagaaatccggatgagattcatccgacgcatagaggataacttgccagctggtgaggaatag

SEQ ID NO: 138108 - DNA, 543 bp, Artificial Sequence
  Description of Artificial Sequence: Synthetic coding sequence
atgtctagacaagcaaaccgggggaccgaatctaaaaagatgtcttcggaactgtttaccctgacctacggcgctctggtaacacaactgtgtaaggattatgagaatgatgaagatgttaataagcaactggacaagatggggtttaatatcggagtacggctgatcgaagacttcctggcgcgcagtaacgtgggtaggtgtcacgatttccgggaaactgccgatgtgatcgctaaggtcgcctttaagatgtatctggggattacccctagtatcactaattggtcccccgcgggcgacgagttctctctcatattggaaaataatccgctcgtcgacttcgtggagctgcctgataaccactcctctttaatctattctaacctgctctgcggcgtcctgcgaggtgctctggagatggtgcagatggccgttgaagccaagttcgtgcaggataccctcaaaggggacggggtcaccgagatccgaatgcggtttattaggcgcatcgaggacaacctcccagccggagaagagtag

SEQ ID NO: 138109 - DNA, 498 bp, Artificial Sequence
  Description of Artificial Sequence: Synthetic coding sequence
atggcaatcttctctgtgtacgtcgtcaacaaggcaggcggtttaatataccagctggacagttatgccccaagggccgaggctgaaaaaacctttagctatcccctggatttgctgctgaaattacatgacgagcgcgtgctggtagcgttcggccagagggatggtatcagagttggacacgcagtgctggctattaacggcatggacgtcaacggtcggtacacagctgatggaaaagagatgctcgaaacggatacatttaagctccactgctaccagactttgactggtatcaaatttgtggttctggcagacccccgccaggccggcattgacagtcttctgagaaaaatctacgagatttatagcgattttgccctgaagaatccgttttacagtctggagatgccgataagatgcgagctgttcgaccagaaccttaagctcgccctggaggttgcagagaaagctggtacgttcgggcctggctcatag

SEQ ID NO: 138110 - DNA, 660 bp, Artificial Sequence
  Description of Artificial Sequence: Synthetic coding sequence
atggcgatttttagcgtctatgttgtcaacaaggctggaggtttgatttaccagctcgattcatacgcccctcgggccgaggctgagaagaccttcagttatccgttggatctgctcctgaagttgcacgacgaaagggttcttgtagccttcgggcagcgagatggtattagggtgggacatgctgtcttggccattaatgggatggatgtgaatggcaggtacaccgccgacggcaaagaggtgctagagtacttgggaaatcccgcgaactaccccgtgagtattcgattcggcagaccgcgcttgacctctaacgaaaagctgatgctcgcgagtatgttccactctctttttgcgatcggctcacaattatcccctgaacagggatcgtcgggtattgagatgttggagactgatacattcaagctgcattgttatcagactcttactgggattaagtttgttgtgttggccgacccacgccaagccgggatcgattccttgcttagaaaaatctacgaaatctattctgattttgcactcaaaaaccctttctattcactcgagatgccaattcggtgcgagctgtttgaccagaacctgaagctcgccctggaggtcgccgagaaggccggcacctttgggccaggatcttag

SEQ ID NO: 138111 - DNA, 4308 bp, Artificial Sequence
  Description of Artificial Sequence: Synthetic coding sequence
atggcccaatgcgtccagagcgtgcaagaactgatccccgatagctttgtgccttgtgtggccgccctgtgttcggatgaggccgagcgactgacgcgcctgaatcatctgtccttcgccgagcttttgaaacccttctccaggctcaccagtgaggtccatatgagggaccccaacaaccagttgcacgtcattaaaaatttgaagatagcagtgtccaacattgtgacccaacccccacaacccggagccattcggaagctgcttaatgacgtggttagcggctcacaacccgcagagggactcgtagccaacgtgataactgctggcgattacgatcttaacatctcagcgactactccctggttcgaaagttatagggagacttttctacagagcatgcctgccttggatcacgagtttctcaatcattatctcgcctgtatgctcgtggcatcctctagtgaagccgagccagtggagcagtttagtaagctcagccaggagcagcaccgtatccaacataattcagattactcttaccccaagtggtttatccctaacacacttaaatattacgtgcttctgcacgatgtttcagccggagacgagcaacgggcagagtcgatctacgaagagatgaaacagaagtatggtacgcagggctgctatttgttaaaaatcaactctcgtaccagtaacagagctagcgatgagcaaattccagacccctggtctcagtaccttcagaagaacagcatacaaaatcaggagagctatgaagatgggccatgcaccatcacatcaaacaagaactctgacaataacttgctctccttggatggactagacaacgaagtgaaagacggtctgccaaataacttcagagctcacccactgcaactagaacagtcttccgaccccagcaatagtatagacggacccgatcatctccggtcagcttcgtccctgcacgagaccaaaaagggtaataccggaattatccacggtgcttgtcttaccttgacagaccatgataggattaggcagttcattcaagagttcaccttccgggggcttttgccccacatcgaaaaaacgataaggcagttgaacgaccagctgatctctcgtaaagggttatcaagatcccttttttccgcaaccaaaaagtggttctccggctcaaaagtaccagagaaatcaatcaatgacctgaagaataccagcgggctcctgtatccccccgaagctccagagctgcagattcgaaaaatggccgacttgtgcttcctggtgcagcactatgacttagcgtacagttgctatcatacagccaagaaagactttctgaatgatcaggcgatgctgtacgccgcgggggctctagaaatggctgctgtttcagccttcttgcagccaggcgcccccaggccctatcctgcccactatatggacactgctatccaaacttacagagatatatgtaagaatatggtcttggccgagcggtgtgtgctcctgtctgctgagctgttgaaatcccaatcaaagtatagcgaggccgctgccctccttatacgcctcacttccgaggactcagatcttagatcagctttgctgttggagcaagctgcccactgcttcatcaacatgaagtctcccatggtgcgcaaatacgcttttcatatgattctggccgggcatcggtttagtaaagctgggcaaaaaaagcacgcgttaagatgctactgtcaggctatgcaagtatataaaggtaagggttggtctcttgccgaggaccatataaattttacaatcggccggcagagctacacgttgcgccagctcgacaacgcggtctcagctttcaggcatatcttgatcaatgaatctaagcaatcagctgcacagcagggtgcttttctgagggaatatctgtacgtctacaaaaacgtctctcaactgtcccctgacggcccgctcccccagctccccttaccgtacatcaactcatccgccactagagtcttcttcgggcacgatcgccgaccagccgatggcgagaagcaggctgccacacacgtttctctggaccaggaatacgactcagagtcctctcagcagtggcgcgagctggaggaacaggtggtgagtgtggtcaacaagggagtgataccaagtaattttcaccccacccagtattgcctaaacagctacagtgacaatagccggttcccgctggcagtagtggaggagccgattacggtggaggtggcattcaggaacccactcaaggttttgctgctgctaaccgatctgtccttgctttggaagtttcaccccaaggacttttcggggaaggacaatgaggaggtcaagcagctggtcacctcagagcctgagatgatcggagccgaggtgatttctgaatttcttattaacggcgaggaatctaaggtggccagacttaaattattcccccatcacatcggggagttacacattttgggcgtggtttacaatttaggcacaatccagggctctatgaccgttgacggaatcggtgcactgccaggatgccatactggaaaatattcgctgtctatgagtgtgaggggcaaacaggatttggaaatccaaggccctcgtctcaacaacacaaaagaagaaaagacaagcgtgaaatatgggcccgatcgccggctggatccaattatcaccgaggaaatgcccctgctggaagtcttcttcatacatttccccacagggctcttatgtggggagattcgcaaagcttacgtggaatttgttaacgtgtcaaagtgccccctgactgggttgaaggtcgtgtcaaagagacccgaatttttcacttttggcggcaacaccgccgtgttgacgcccttgagtccgtcagcttctgaaaattgttcagcctacaagaccgtagtcacagatgcaaccagtgtgtgtaccgccttaatctcgagcgctagcagcgttgattttggaatcggaactggaagtcagccagaagttatcccggtgccacttcctgacactgttctgctgcctggcgctagcgtgcaactgcccatgtggcttagagggcctgacgaggaaggcgtccatgaaatcaattttctgttctactacgaaagcgtgaagaaacagcctaagattcggcaccgcattctccgccacaccgcaattatctgtacgtctagaagcctcaacgtgagggccactgtctgtcggtctaacagcctggaaaatgaagaaggaaggggaggcaatatgctggtctttgtcgacgtggaaaacaccaacacatctgaggcgggagtcaaagagtttcacatcgttcaggtcagctccagctcaaaacactggaagctccagaagagtgtcaatctatccgagaacaaagacacgaaactcgcgagcagagagaaaggcaaattttgctttaaggccatccgctgtgagaaggaggaggccgccacccagagtagcgagaaatatacattcgccgatattatcttcgggaatgagcaaatcatcagtagtgcttccccttgtgctgactttttttataggtctctttctagtgaactgaaaaagccccaggcgcatctaccggtccacactgagaagcagtcaaccgaagacgcggtgcggctgatccagaaatgcagcgaggtcgacctaaatattgtgatcttgtggaaggcatacgtagtggaggatagcaagcagctcatcctggaaggccagcatcacgtgattttacgcacgatcggaaaagaagcgttttcataccctcagaagcaggaacctcccgagatggagctgctaaagttcttccgacccgagaacattaccgtctcatctagaccatccgtggaacagctcagctcattgattaagaccagcttgcactaccccgagtcatttaaccacccattccaccagaaatctttgtgcctcgtgcccgtgacattactcttatctaactgctcaaaggccgatgtggatgttatagttgaccttcgccataaaactaccagtcccgaagctctcgaaatccacgggtcatttacctggctgggccagacacaatataaactccagctgaaatcccaggagattcatagcttgcagctaaaagcatgtttcgtgcacacgggggtgtataatctgggcacgcctagggtattcgcgaaactctcggaccaggtgaccgtgtttgaaacctctcagcagaactccatgcccgccttaattattatatctaatgtgtag

SEQ ID NO: 138112 - DNA, 3420 bp, Artificial Sequence
  Description of Artificial Sequence: Synthetic coding sequence
atgtcagtcccagactacatgcagtgtgctgaggaccaccaaacacttctggtggtggtgcagcccgtaggaattgtttctgaagaaaacttttttcgaatttataaacgtatctgtagcgtgtcccagatttcagtacgggactcccagcgtgtcttgtacattcgatacaggcatcactaccctcctgagaataatgaatggggtgactttcagacccaccgaaaagtcgtgggactgattaccataaccgactgtttcagtgccaaagattggccacagaccttcgaaaaattccacgtgcaaaaagagatttatggatctactctttatgactcacggttattcgttttcggactccagggcgagattgtcgagcagccccgaaccgacgtggcattctatcctaactatgaggactgtcagacagttgagaaaaggatcgaggactttattgagtctttgtttattgtcctggagtcaaaacgcctggaccgagctaccgataaaagcggcgacaaaataccactgctgtgcgtccccttcgagaagaaagactttgttgggcttgatacggatagcaggcattataagaaacggtgccaggggagaatgcgaaagcacgttggggacctctgtctgcaggccggcatgctccaggattctctggtgcattatcacatgtctgtcgaactcctcaggagtgtcaatgactttctctggttaggagccgccttggaaggcttgtgctcggcctctgttatatatcattaccccggcggcacgggaggaaagtcaggcgctcgccgctttcagggcagtactctccctgccgaggccgctaatagacacagacccggggccttgaccacaaacggaatcaacccagacacatccactgagattggaagagccaagaactgcctgtcccctgaggatataatagacaagtacaaggaagcaataagttattacagtaagtacaaaaacgccggcgttattgagcttgaggcgtgcatcaaggccgtgcgggtactcgccattcaaaagagatcaatggaagccagcgaattcctccagaatgccgtgtacatcaatttaaggcagctgagtgaagaagagaagatccagcgttatagcatcctgagcgagttatacgaactgatcgggttccataggaaaagcgccttctttaaaagagtggcagccatgcagtgcgtcgccccttccattgccgaaccgggttggcgggcttgttacaaacttcttctagaaacactcccggggtatagtttgagcctggatccaaaggactttagtcgagggacccatcgtgggtgggcagctgtgcaaatgcggttactgcacgaactcgtctatgcgagccgccgtatgggaaaccccgccctgagtgtaagacatctctctttcctcctgcagactatgctggacttcctaagtgaccaagaaaaaaaagatgtggctcagtcactggagaattacacaagcaagtgccctggcacaatggagcccatagcacttcctggaggcctgacccttcccccagtgcctttcaccaagctgcctatcgttagacacgtgaaattattaaacttgcctgccagtctccgtcctcacaagatgaaaagcctgcttgggcagaacgtgagtactaaaagtccctttatttacagccccatcatcgcacacaaccgcggagaagaaaggaacaagaagattgacttccaatgggtgcagggggatgtctgtgaggtccagctgatggtttacaatcccatgccctttgagctgcgggtggagaacatgggcttgttgacatctggtgttgagttcgagagcctccctgcggcccttagtctccctgcggagagcggtctgtatccagtcaccctcgtgggagtgcctcagactactggcactattactgttaacggctaccacacaactgtttttggcgtcttctctgactgccttctggacaatttaccaggcattaagacaagcggttccaccgtggaggtgattccagcactgccacgcctgcaaattagtactagtctgccccggtccgctcactctctgcagcccagttctggcgatgagatctcaactaatgtatccgtccagctttacaacggcgagtctcagcagctgatcatcaaacttgagaacatcggtatggaaccgctggaaaaactggaggtgacctccaaggtccttaccacgaaggagaaactgtacggtgacttcctgtcttggaagctggaagaaaccctggctcagttccccctgcagcccggtaaggtggccaccttcacgataaacatcaaggtgaagctggacttttcctgtcaggaaaacctgctgcaggacctttcagacgatggaatctcggttagtggcttccccttgtcgtcccccttcaggcaagtcgtgagaccacgagtagaagggaagcctgtaaaccctcctgagagtaataaagccggcgactattctcacgtgaagacattggaagccgttttaaatttcaagtactccggaggtccaggccatacggaggggtactatcggaatctgtctctgggtctgcatgtcgaggtggagcctagcgtgttctttacgcgtgtgtcgacattacccgctacaagcaccagacagtgccatctgctgttggacgttttcaattctaccgagcacgaactcacagtgagcactcgctcctctgaggcactgattctgcatgccggagaatgccagagaatggccattcaggtggataaatttaatttcgagtcgtttcccgagagtcctggcgaaaagggacaattcgctaaccctaaacagctcgaggaagagaggcgcgaagcccgcggactggagattcactccaaactgggcatttgctggcgaataccctcattgaagcggtctggagaggcaagcgtagaggggctcctcaatcagttagtccttgaacaccttcaactggccccgctgcagtgggacgtcctggtggatggccagccctgcgatcgggaggcagtagctgcctgccaagtgggcgacccagtgagactggaagtcagactgactaatcgctctcccagaagtgtggggccttttgctctgacagtcgtcccctttcaggaccaccagaacggcgttcacaactatgacctgcacgacacggtgtccttcgtcgggtcaagtacgttttacctcgatgccgtccaaccttctgggcaatctgcttgtctaggcgccctgctgtttctatacactggcgactttttcctgcacatcaggttccacgaagacagcacttccaaagagctgccgccctcctggttttgcctgccatccgtgcacgtgtgcgccttagaggcacaggcatag

SEQ ID NO: 138113 - DNA, 3741 bp, Artificial Sequence
  Description of Artificial Sequence: Synthetic coding sequence
atggtgccagccggagatcaagaccgggctcctcacagagggaagcccgctcaggctggagctagaaccagccgcgcctcgagggcattgcggtcatggcgcagatctcaggctgcgagggccacagtgacccatcctagagggggccacgataggggctctcatggggggtacagggaggggcatcggggctgtagacgggaccctcagtgggcaagcgccggaccgcctccactttcttttaccgaagaggtcaagtttgagctgcgagcacttaaggactgggatttcaagatgtctgtccctgattacatgcagtgtgccgaagatcaccaaacgctgctagtcgtcgtgcaacccgttgggatcgtcagtgaagagaactttttccggatttacaagcggatctgcagcgtgtctcagatatcagtccgtgactcccagagggtgttgtatatcaggtacaggcatcactaccccccagagaataacgaatggggggattttcagacccacagaaaggtcgtaggcttgattacaatcaccgattgcttcagcgccaaggactggccacagacctttgagaaatttcacgttcagaaagagatctacgggagcaccctgtatgactcccggctgtttgtgtttggactccagggcgaaatcgtcgagcagccacgcaccgacgtcgcattttatcctaattacgaggactgtcaaaccgtggaaaagcgcattgaggacttcatagaatcgctatttatcgttcttgagagtaaacgtctagaccgagcgacagataagtccggtgataagatccctctgttgtgtgtcccatttgaaaaaaaagatttcgtgggcttggatacggactctagacactataaaaagagatgccagggacgcatgcggaagcacgttggtgatttgtgtctccaggccggaatgctccaagactctttggttcactatcacatgtctgtggaactcctacgatctgtgaacgattttctgtggctgggggcagcacttgaaggcctgtgctcagcctccgtgatatatcactatccaggcggtacaggcggtaagagtggggcacggaggttccaggggtcgactctgcctgccgaagctgccaaccggcatcggcccggagcccaggaggtcctgatagacccgggcgctctcacaacaaacggtatcaatcctgatacgagcaccgagataggccgggcaaagaattgtcttagcccagaagacataatcgataagtataaagaagctatctcatattactcaaaatataagaatgccggcgtcatagagctcgaagcatgcatcaaggctgtgcgcgtcctagctatccaaaagcgctcaatggaggccagtgagtttttgcaaaatgcagtgtatattaacctacgtcagttgtcggaggaggaaaagattcagcggtattcaatactgagcgagctttatgagcttataggattccacagaaagtctgcttttttcaagagggtggccgcgatgcagtgtgtggctccctcaattgcagagccgggatggcgtgcatgttacaagcttctgctggagactcttcccggatatagcttgtctctcgatcctaaggatttcagtaggggcacccatcgtgggtgggccgctgtgcaaatgcgattgctgcatgagttggtatacgcttccaggcgcatggggaacccggcactgtccgtgcggcacttgagctttttacttcagacaatgttggactttctttctgaccaggaaaagaaggacgtcgcacagagcctcgaaaattacacatcaaagtgcccagggactatggagcccattgccctccccggcggtctgaccctgccaccagttccatttacaaagttgccaattgttcgtcacgtcaaactgctgaatctgcccgccagtttgaggcctcacaagatgaaaagcctgctcgggcaaaacgtaagcacaaagtctccctttatctatagccccatcatagcacataaccgaggggaagagcgcaacaaaaaaattgactttcagtgggttcagggagacgtctgtgaggtgcagctgatggtgtacaatccaatgcccttcgaattacgagtagagaacatggggttacttacaagtggagtcgaattcgaaagcctcccagctgcgctttctctcccagctgagagtggcctgtatccggtcacattggtaggcgtgcctcagactacgggtactataacagtgaacggataccacaccaccgtctttggcgttttctctgattgtctcttagataatcttccaggcatcaagacctcggggagcactgtggaagtgattccagctctcccgcggctgcaaatctccacgtccctgccccggtctgcccattctctgcagcctagcagcggcgatgaaatcagcactaacgtctctgtccaactgtacaacggagagtcgcagcagctaataattaagctggagaacatcggtatggaacccctcgaaaagctggaagttacatctaaggtcctcacaacaaaggagaagctgtacggagactttctgagctggaagcttgaagaaacccttgcacagttcccactgcagcccgggaaagtggctaccttcactatcaacatcaaggttaagcttgatttctcttgtcaggagaatttactccaggacctgagcgacgatggcatctccgtatccggattccctttgagcagcccatttcggcaagtggtcagaccacgcgttgaagggaagcccgtcaaccctccggaaagcaacaaagcgggtgactattcccacgtgaagactctggaggcagttctgaattttaaatattctggcggtccagggcatacagaaggatattaccgtaatctgtcactcggtctgcatgtcgaagttgagccatccgtattctttactagagtgtcgacactgcctgccacttctactagacagtgccacttactgctcgacgtctttaactcaaccgagcatgagctgaccgtctctacgaggagttcagaggctctgatactccacgcgggcgaatgccagcggatggcgattcaggtagataaatttaatttcgagtcattccccgaatcccctggggaaaagggacagttcgcaaatcctaaacagctggaagaggaaaggagggaggccaggggattagaaatacacagcaaactcggcatctgttggaggattccgagtttgaagcggtccggagaggcctcagttgaaggactccttaaccagctggttttagagcacctgcagctagcaccccttcagtgggacgtcctagtggatggacagccgtgcgatagagaggctgtggccgcatgccaggtcggggaccccgtacgtttggaggtgcggctcactaatagaagccctcgttccgtggggccatttgcactgacagttgttcctttccaagatcatcagaacggtgtgcacaattacgatcttcacgacacagtgtcttttgttggctcctccaccttttaccttgatgcagtgcaaccaagcggccaaagcgcctgtctcggagctctcctgtttctgtacaccggcgatttttttctgcacatcaggttccacgaggatagtacttccaaagagttgccccccagttggttttgtctacccagtgtccatgtctgtgctcttgaggcccaggcttag

SEQ ID NO: 138114 - DNA, 3447 bp, Artificial Sequence
  Description of Artificial Sequence: Synthetic coding sequence
atgtccgttcccgactatatgcaatgtgccgaagaccaccagactttactggtggtggtgcaacccgtggggatcgtctcagaggagaatttttttcgcatctacaaacgcatctgctctgtgtcccaaatctctgtgcgcgactcacagagggtcttatacattagatataggcaccattaccctcctgagaacaacgagtggggcgacttccaaacacataggaaggtggttggcctgattacgattactgactgcttcagtgctaaggattggccacagacttttgagaagtttcatgtgcagaaggaaatttacggatcgacactatacgatagccgcctgttcgtgttcggcttgcagggcgaaatcgtggagcagcccagaacagatgtggcgttttaccccaactacgaggattgccagacggtcgagaagagaatcgaagacttcatcgaatctcttttcatagtcctggagtccaaacggttggaccgtgccactgataagagcggtgacaaaatcccacttctttgtgtgccattcgaaaaaaaagacttcgtgggactcgatacggactctcggcattacaagaagagatgccaggggcgcatgcggaagcatgtcggcgatctgtgccttcaggcaggtatgctccaagattctttagttcattatcacatgtccgtcgaactactccgatccgtcaacgacttcttgtggctcggtgctgcgcttgaaggcttgtgttccgcttctgtcatctatcactaccctgggggaaccgggggtaagagcggggctcgaagattccagggctcgacgctcccagcagaggctgcaaaccgccaccgcccaggggctcaggaagtgctgatcgaccccggagcactgaccaccaacggaattaaccctgatacgtcaaccgaaattggcagggccaagaactgcctcagcccggaagatataattgacaagtacaaggaggccatttcctattattccaagtacaagaacgccggggtgattgagctggaggcctgcataaaggccgtaagggtacttgcaatccaaaaacgtagtatggaggccagcgagttcctgcagaatgctgtctacataaacttgcggcaactgtcagaggaagaaaaaatccagcgctatagtattctgagcgagctttacgagctcatcggcttccaccgaaagtcagcattcttcaaaagagtagccgcgatgcaatgtgtggctccttccatcgcagaacctgggtggcgggcatgctacaagctgctgcttgagactctacctggatattctctgtcacttgaccctaaagatttctctcgaggtacgcatcgaggctgggcagcggtgcagatgcgattgcttcatgagctggtttatgcatctcggaggatgggcaaccctgctttaagtgtgcggcacctgagtttcctcctacaaaccatgctcgactttctctccgatcaagaaaaaaaagacgtggcccagtctttggaaaattatacatcgaaatgtcccgggactatggaacctatcgcactgcctggagggctgacgctaccccccgttccatttactaagctaccaattgtgaggcacgtgaaattgttaaacttgcccgcatctctcagaccccataaaatgaagtctctgttgggacaaaacgtctcaactaaatcaccttttatttactctccgatcatcgcccataacaggggtgaagagcgtaataaaaagatcgattttcagtgggttcaaggcgatgtctgtgaagtgcaactgatggtttataaccccatgccctttgagctcagggtagagaatatgggactcctcacctccggtgtggagttcgaatctctgccagcggcactgtcattgccggcagagtcaggcctttaccctgtgactctggtgggagtgccccagacaactggtacaattacagtcaacggataccatactacagtctttggggtgttttccgattgcctactggacaatttgcccggcattaagacctctgggagcacagttgaggtgattccagccctccctcgactgcagatctctaccagtctgcctcgctctgcccactcccttcagccctcctccggtgacgagatttccaccaacgtctcagttcagctctataacggggaatcgcaacagttgatcatcaagctggagaatattggcatggagcccttagaaaaactggaagtcacgagcaaagttctcacaacgaaggaaaagctgtacggggactttctgtcttggaaacttgaagagaccctggctcagtttccattgcagcccggaaaggttgccacctttacaattaacattaaagtcaagttggacttctcctgtcaagaaaatctgttgcaagacctcagcgatgatggcatttcagtgagcggttttcctctgagctctccgtttcgtcaggtggtcaggccacgagtggaagggaagcccgttaaccctcccgagagcaataaggctggtgactattctcacgtgaaaacactggaagcagttctaaattttaagtatagtggggggccaggccatactgaaggatactatcgtaatctgagtttaggcttacacgtggaggtggagccatccgtgttctttacacgggtgagcacattgccagcaacttcaacgcgccagtgccacctgctgcttgatgtgtttaactcgactgagcatgaactcaccgtgtcaacgcgttcatcggaggccttgatcctgcacgccggggaatgccagaggatggccatccaggtagacaaatttaatttcgaaagttttcctgaatcccccggcgaaaaagggcaatttgcaaacccgaaacagttggaggaggagcgccgagaagcaagagggcttgaaattcactcaaagctaggaatatgctggcggattccttcactgaaaagatccggagaggcgtccgtagaagggctgctgaaccagctggtgctcgagcatctgcagttagcgccactgcagtgggacgtactggtggacggccagccctgcgacagagaagcagtcgctgcatgccaggtgggggaccctgtccggcttgaagtaaggttgacaaaccgcagcccccgcagtgtggggccatttgcacttactgtagtgcccttccaggatcaccagaatggtgtccataattatgaccttcatgacactgtcagcttcgtgggctcgagtactttttacctcgacgctgtccagccgtcaggacaatcggcctgtctgggggctctactgttcctgtataccggggacttctttctgcatatccgtttccacgaagattctacctccaaggaactcccccccagctggttctgcctgccttcagtgcatgtgtgcgctttagaagcccaggcatag

SEQ ID NO: 138115 - DNA, 2862 bp, Artificial Sequence
  Description of Artificial Sequence: Synthetic coding sequence
atggccctggtcttccagttcggccagcccgtcagagcacagccgctcccgggcctgtgtcacgggaaactgattagaaccaatgcatgcgacgtctgcaattccacagacctgccggaggtagaaattatctccctgttggaagagcaattgccccactataagctgcgcgcagacacaatatacggatacgatcacgacgactggctgcacacgccattaatttcccccgatgcgaacatcgatcttacgacagaacagattgaagagacattgaagtatttcctgctatgcgcagagagggttggacagatgaccaaaacctataacgatattgacgcggtgactcgcctcctggaggagaaagagagggatttggagcttgcagcccggattggacaatctctactaaagaaaaacaagacgttgacggagaggaacgagctgttagaagaacaggtggaacatatacgtgaagaggtttcacagcttagacacgagctgtcgatgaaggacgagctgctccagttctataccagcgcagctgaagagtctgaaccagagagcgtttgttcaaccccgctgaagcggaatgagagcagctcctcggtgcagaattactttcacctggacagcctgcagaagaagcttaaagacctcgaagaggaaaacgtggtgttgagatccgaggccagccaactgaaaacagaaacaattacgtatgaggagaaagaacagcagctagttaacgattgtgtaaaagagttgcgagacgccaacgtccagattgctagcattagcgaggaacttgcaaagaagacagaggacgcggcccgccagcaggaagaaattacacacctgttgtcccagatcgttgacctgcagaagaaagctaaagcctgtgccgttgaaaacgaagagctagttcagcatctgggtgccgccaaggacgcccagcgccagctgactgccgagttgcgggaactggaggataagtacgcagagtgtatggagatgctgcatgaagcccaggaggaactgaagaacctgcggaataagacaatgcccaacaccaccagcaggagatatcactctctgggtctattccccatggacagtctggctgccgagattgaggggacaatgagaaaggaactgcagttggaagaggccgaatcccccgatattacacatcagaaacgcgtcttcgagactgtgaggaacatcaatcaagtggtgaaacagagaagcctgaccccttcacctatgaatatcccaggctcaaatcaaagctccgcaatgaatagcctcctcagtagttgtgtgtcgactccccggagctctttttatggcagcgacatcggcaatgtggtcctcgataataaaacgaattcgatcatcctggaaactgaagctgctgacttagggaacgatgagagaagcaagaaacccggcacaccaggcacacctggaagccacgatctggaaaccgccctccggcggttatctttgcgacgggagaactatctctccgaacggcgcttcttcgaagaggaacaggagcggaaactgcaggagttggcagaaaagggagagctgcggagcgggtccctgacaccaacagagagcattatgtcactgggaacccactccaggtttagtgagtttacaggatttagcgggatgtccttttcttcccgctcgtacctgcctgagaagctccagatcgtgaagccattggagggttctgccactctccatcattggcagcagttggcgcagccacacttggggggaattcttgatccacgccctggcgtcgttaccaaaggatttcgaacgctggatgtggacctagacgaagtttactgtctcaatgatttcgaagaggatgatacgggggatcatatttccctccccagactggcaacaagcactcctgtgcaacaccccgagacttccgcccatcacccgggcaagtgcatgagtcagaccaacagcacctttaccttcaccacatgtcggattctccaccccagcgacgaactgacaagggtgactccgtccctcaactcagccccaactccagcctgtggcagcacttcccatctcaagagcacaccagttgcgactccttgtacacctagaaggctgtcactggcggagtcgttcaccaacacaagggagtccaccacgactatgtctacaagccttggattagtttggctgctcaaggaacgcggcatttctgccgccgtttacgatccccagagttgggaccgggcggggcgggggtcattattgcactcctacacccctaaaatggccgtgattccatcaaccccccctaactcgcccatgcagacccccactagcagcccgcccagttttgaattcaaatgcacgtctccaccttacgacaattttctggcaagcaagcctgctagttctatcttgcgggaagtcagggagaaaaacgttaggtcttccgaatctcagaccgacgtgtctgtgtccaacctcaacctcgtggataaggttcggcgctttggtgtggccaaagtggtcaatagcgggagggcccacgtcccaactctgacagaagagcagggtcctctcctttgtggccctcctggccccgctcccgctctcgtgccaagagggctcgtcccagaagggctaccactgaggtgccccacagtcacgagcgctataggcgggctgcagctcaacagcggcatcaggcgaaaccgatccttccccacgatggtcgggtcctctatgcaaatgaaagccccagtcaccctgacaagcggcattttgatgggtgctaagctgtctaaacagaccagcctccgctag

SEQ ID NO: 138116 - DNA, 2061 bp, Artificial Sequence
  Description of Artificial Sequence: Synthetic coding sequence
atgtcacttagggacaagggcggagaagaggagtgcttcgagtacgactgtcaggacgaggagcgaaagcccacccaccggcaacacgatacacaggatttacttgaagaagtactatgtgcagagcgcgtgggccagatgactaagacgtataacgatattgatgccgtgacccgactcctcgaggagaaagaacgcgaccttgagcttgccgccaggataggccagagtctgcttaagaaaaataagactctgacagaaaggaacgaactgttggaggagcaagtggaacacattcgcgaggaggttagccagctcaggcatgaactttcgatgaaagacgaactcctgcagttttacactagtgccgccgaggagagcgagccggagtccgtgtgctctacccctcttaaacgtaatgagtcaagctcatccgtccaaaactacttccatctcgactccttgcagaaaaaacttaaagatctcgaagaagagaatgtggttctgcggagtgaggctagccagctgaagactgaaactattacttatgaggagaaagagcagcagttggtgaacgattgcgtgaaggaactaagggacgctaacgtacagattgcctccatcagcgaggagctggctaagaaaacagaggacgccgctcgccagcaggaagaaatcacacatctgctcagtcagatcgtggatctgcagaaaaaagccaaggcctgtgctgtggaaaacgaggaactggtccagcaccttggggccgctaaagacgcacagaggcagttaactgcagagctgcgggagctggaagacaaatatgcagagtgtatggaaatgctacacgaggcccaagaggagcttaaaaatctgagaaacaagaccatgcctaatacgactagccgtagataccacagcctcggtctcttccccatggacagtttagcagccgagatcgaaggcaccatgcggaaggagcttcaactggaagaagcagaatccccagatattacccaccagaagcgcgtgttcgagacggtccgaaatattaatcaggtggtgaagcaacgaagcctgacaccgtccccaatgaacatacctggctctaatcaatctagtgctatgaactctttgttatcctcttgcgtaagtacacctcgaagctctttctacgggtccgatatcgggaatgtggtactcgacaataagactaactccattatcctcgaaacggaggccgcagatttgggcaatgacgagaggagtaagaagcccggaacacctgggacaccgggttcccatgacctcgagacagctttgcgccggctgagtttgcgtagagagaattacctgagcgaaagaaggttttttgaagaggagcaggagagaaaattacaggagcttgctgagaaaggtgaactccggtccggtagtctgaccccgactgagagcattatgagcctcgggacccactccagattcagcgagttcaccggcttttccgggatgagcttctcctcccggagctacttgcccgagaagttacagattgtcaagccgctggaggggtcagccacactccatcactggcagcagctcgctcagccacatttaggcggcattcttgatcccaggcccggagtagtgacaaagggcttcagaaccttagacgtggacctcgacgaagtgtattgtttgaacgatttcgaagaggacgataccggtgatcacatttccttgccacgcctggccacatcgacaccagttcagcaccctgaaacttcaggagagcggtctcaggcccgtgtgacagtgtccggctcaagaagttatcctagccggccccaggcaagccctgaggaaatgcaggaaccaccagctgctaccgaagaggaagaggaggaggaagaggaagaaggctctggtgaaggcaccactatcagcccggtcaatctggcgcccttccctgaggctgaattttgggctatcctcacatccgtgccaggcacgatccggtcagggtctctcagcgtggcatctgcgcgcctgtgtggctag

SEQ ID NO: 138117 - DNA, 2688 bp, Artificial Sequence
  Description of Artificial Sequence: Synthetic coding sequence
atgagtctacgcgataagggtggcgaagaggagtgctttgaatatgattgccaggatgaagaaaggaagcccacccaccgccagcacgacactcaggaccttctggaagaggtgttgtgcgctgagagggtagggcagatgactaaaacatacaatgatatcgacgctgtaaccagactgttggaggagaaggagagagacctggaactggcagccaggattggacagtccctgttgaagaagaacaagacattgacggagagaaacgagcttctcgaggagcaggtagaacatatccgggaggaggtctcgcagcttcgccatgagctgagcatgaaagacgaactactccagttctatacctccgcggccgaggagagcgagccggaatccgtgtgttccactccgctgaaacggaacgaatcctcctctagtgtgcagaattattttcatcttgacagcctccagaaaaagcttaaggatctcgaagaggagaacgtcgttctccgatcagaggctagccagctaaagactgaaactattacatacgaagagaaagagcagcagttggtcaacgattgtgtcaaagagcttagagacgctaatgtgcagatagccagtatatcggaggagctggccaagaagaccgaagatgccgctagacagcaagaagagattacacacctcctctcccaaatagtagatctccagaagaaagcgaaggcctgcgctgtggaaaatgaggagctggttcagcaccttggcgccgcaaaggatgctcagaggcaattaaccgcggaactaagggagcttgaagataagtacgccgaatgtatggagatgctccatgaagctcaagaggaactgaaaaatctccggaacaagacaatgccaaatacaacatcgcggcggtaccacagcctgggactgttccctatggattcgttggccgccgagatcgagggtactatgcgcaaagagctgcagctggaagaggcggagagcccagacatcacccaccagaaacgagtcttcgagaccgttagaaatattaaccaggtggtaaagcagagatcacttaccccttctcccatgaatattcccggatctaatcagtcatcagccatgaatagcctgttatccagttgtgtaagcaccccaagatcatcgttttacgggtcagacattggaaatgtcgtgctggataataagaccaactctataattctcgaaacggaagccgccgatcttggcaatgatgaacggagcaaaaagcctggaacccccggcactccaggatctcacgatctggagaccgcactccggcgtctgtcattgaggagggagaactacttgtcggagcgcagattttttgaagaggaacaagaaagaaagctgcaagagctcgcagagaagggcgagttacgctccggctcccttactccgacggagtccattatgagtctgggcacccactctcggtttagcgagttcacaggcttcagtggaatgtccttctcatcccgttcttatttgcccgaaaaacttcagatcgtaaaacccttagagggctccgcgacgttgcaccactggcagcagctggctcagccccacctgggcgggatcctggatcctcggcctggagtggttacaaagggattccggacattagacgtggaccttgacgaagtgtattgcttgaatgacttcgaagaggatgatactggggaccacatatctctccctcgactggcaacatcaacccctgttcagcacccagaaacctcagctcaccaccctgggaaatgcatgagccagactaatagtacattcacattcaccacgtgccggattctgcatccatctgatgagctcacaagagttaccccctcactgaacagcgcccccacaccggcctgcggcagcacctctcacctaaaatccacacccgtcgcaaccccatgcacaccacgcaggctgagtctggccgagtcttttacaaatacccgggaatcaaccaccaccatgtcaacatctttgggtctggtgtggcttttgaaagaacgcggcatctccgccgctgtttacgatccacagtcatgggaccgcgctggcagaggatcattactccattcttacaccccaaagatggccgtgatccctagtacaccccctaactcaccaatgcagactcctacttctagccctccatcatttgagtttaaatgtacaagcccaccgtatgataacttcctggcttcaaagcctgcaagttccattctccgcgaagtgcgcgagaaaaatgtgaggtcctctgaatcccaaactgacgtgtctgtaagtaacttgaacctggtggataaggtgcggcgttttggggtcgctaaggttgtcaactctggacgagctcacgttccaaccctcacagaggagcaaggcccactcttgtgtggacctcctggaccagcgcctgcactagtgcctaggggcctggttcccgagggcctgccactcagatgtccaactgtgacttcggccatagggggcctccaactaaatagcggaatcagaaggaatagatcctttcccacaatggtgggaagcagcatgcagatgaaagctcctgttactctcacgtcagggatactgatgggagccaagctgtcaaagcagactagcctgcgctag

SEQ ID NO: 138118 - DNA, 2361 bp, Artificial Sequence
  Description of Artificial Sequence: Synthetic coding sequence
atggccctggtgttccaatttgggcagcccgtgcgggcacagccactgcctggactgtgtcacggcaaactgatcaggacaaacgcttgtgatgtatgcaacagcacagatctgcccgaggtggaaatcatttccctcctggaggagcagctgcctcattataagctccgcgcagatacaatctacggatatgatcacgatgactggttacatacgcctctaatctcgccggacgccaacattgacctgacaactgaacagattgaggagaccctgaaatactttctcctatgtgctgaacgggtcgggcaaatgactaagacgtataacgacattgacgcagtgacacgcctgctagaggaaaaagagagagacttagaactggctgcacgaataggccagtctcttctcaaaaaaaacaaaactctcacagaacggaatgaactgcttgaggaacaggtcgagcacatccgggaggaagtgagccagctgagacacgagttaagcatgaaggatgagttactccaattctatacttcagccgccgaggaatcagaacccgagagcgtgtgcagtacacccctcaagagaaacgaaagtagcagtagcgttcaaaactactttcatctggatagtctgcagaaaaaacttaaagacctggaggaagagaacgtggtcctcagatcagaagcctcccagctgaagacagaaacaatcacctatgaagaaaaagaacagcaattggtgaatgactgcgtcaaagagctcagggacgccaacgtgcaaattgccagcatatccgaagagctggccaagaagacagaagatgccgccagacagcaggaagaaatcacacacctcctgagccagattgttgatttgcagaaaaaagccaaagcgtgtgcagttgaaaatgaagagctggtgcagcacctgggggccgccaaggatgcgcagcggcagctgactgctgaactgcgagaactcgaggacaagtacgctgaatgcatggagatgctgcatgaggcccaggaagaacttaagaatcttcggaataagaccatgccaaacactacgagccggcgataccacagtcttgggctctttccaatggactctttggccgcagaaattgagggaacgatgaggaaggaacttcagctagaagaggctgagtcacctgatatcacacatcaaaagagagtcttcgagaccgtgcgcaacattaaccaggtggtaaagcagcgttctctgactcctagtcctatgaatattcccggcagcaatcagagctccgccatgaacagtctgctttccagttgtgttagcacgccgcggtccagtttctatggctccgatataggtaacgtcgtgctggacaacaagaccaactccatcattttagagacagaagccgcagacctgggcaatgacgaaagatctaagaagccagggacccctggtactcctggatcccatgatcttgagacggctctgagaagattgtctctccgaagggaaaactatctgtcagagaggcgcttctttgaggaagaacaggaacggaagctccaggaactggccgaaaagggtgagctgcggtccggctcactgaccccaactgagagcatcatgagcttaggcacccattcccgcttctccgagttcaccgggttttccggaatgtcattttcttccaggtcatatctgcccgagaagctgcagatcgtcaagcccctcgaaggttctgctacccttcatcattggcagcagctggcccaaccccatctaggagggatattggatccacggcccggcgtggtcaccaaaggcttccggacgctcgacgtggatctggatgaggtgtattgccttaacgactttgaggaagacgatacagcccaccaccctggcaagtgcatgtcacaaactaattccacgttcaccttcaccacatgccgcatcctgcatccgtctgatgaacttacccgggttaccccttccctcaactccgctcctacccccgcctgtgggtccaccagccatctcaaatcgaccccagttgccaccccctgcacacccagaaggctttcattggcagaatctttcacgaacactagggagtccaccactacaatgtccacctccttagggttggtctggcttcttaaggaaagggggatctccgcggctgtctatgacccgcagagttgggacagggctggacggggatcgctgctgcactcccacgaagatgtgacttgtgcaaacttgggcgagggaggtgtgttaagctccttcctgctccgctcaaccgaaaccccgaaatgcgtactcatcccttggatcggaaaccaatag

SEQ ID NO: 138119 - DNA, 2745 bp, Artificial Sequence
  Description of Artificial Sequence: Synthetic coding sequence
atgtctcagtcccaaaacgccatattcacttcaccaacaggggaagaaaacctgatgaactccaaccaccgcgactcagaaagcattaccgacgtctgctctaacgaggacctgccagaggttgagttggtgtccttgctggaggaacagttgccccagtacaggttaaaggtagataccctttttctctatgagaaccaggattggactcagtcaccccatcagcgtcagcacgcaagcgatgccctatctcccgttctggctgaggaaacatttcgctatatgatcttgggaacagatagagtcgaacagatgaccaaaacatataacgatattgatatggttacacatcttctcgccgaacgggacagagaccttgaactggctgcgagaattggccaggcactgctaaagcggaaccacgttttgtccgaacagaatgagtctctagaggaacagttaggtcaggcgtttgatcaagtcaatcagctgcagcacgagttgtgcaaaaaggacgaactgctccggatcgtgtcaatcgcttcggaggagtctgaaactgactcttcgtgttctacccctctgcgcttcaacgaatccttcagcctctcccagggtttattgcaacttgaaatgctgcaagagaagttaaaagaactagaagaggagaatatggccctgaggtccaaagcttgccacataaagactgaaaccgttacttacgaggaaaaagaacagcagcttgtaagcgactgtgtgaaggagttgagagagaccaacgcgcagatgtcccgcatgacagaagagttgagtggcaaaagcgatgaattaatcaggtatcaggaagagctctcaagcctcctgagccaaatcgttgacctgcagcataaactgaaagagcatgtgatagaaaaggaagaattgaaactgcatctgcaggccagcaaggatgcgcagcgacaactgaccatggagctccacgagctacaggacagaaacatggagtgcctcggcatgctgcacgagtcccaggaagaaataaaggagctgcgtagtcgcagtggacctacagcacacttgtatttttcccaaagttacggagcgttcacgggcgagagcctggcagcagaaatcgagggcaccatgagaaagaaactttccttggatgaggagagctcgttgtttaagcagaaagctcaacagaagagagtctttgacactgtcagaattgcaaacgacactcggggccggagcatatccttccccgcccttcttcccatacctgggtccaataggtcatccgtgatcatgactgctaagcctttcgagtcggggctccagcagacagaagacaagagtctgttgaatcaaggcagcagtagcgaggaggtcgccggaagctcacagaagatgggccagccaggcccgtcaggagattccgaccttgcgactgctctccatcgtttgagccttcgcagacaaaattacctgtcagagaaacagttcttcgctgaggaatggcagcgcaagatacaggttcttgctgatcagaaagagggggtctccggatgtgtgacgccaaccgaaagtctcgcaagcctgtgtactacgcaatccgagataaccgatctttcttccgctagttgcctgcggggcttcatgcctgagaaactgcagatcgtgaagcctctggaggggtcacaaactctgtaccattggcagcaactggcgcagcccaatctgggtactattttagatccgagacctggcgtaatcactaaaggctttacacagcttcccggtgacgcaatctaccacatcagcgatctggaggaggacgaggaagaaggaataacatttcaagtccagcagcccctcgaagttgaggaaaagttgtctactagtaagcctgtgactggtatcttcctgcccccaatcacgagtgccggagggcctgtgaccgtggctactgccaatcccggtaagtgtctgtcttgcaccaatagtaccttcaccttcaccacgtgccgcatcctgcacccttctgacattacacaggtgaccccatcctctggctttccctcgttaagctgtggaagcagtggttccagctcttcaaataccgctgttaattctccggctctgagttatagattaagcatcggtgaaagcataactaatcgacgtgatagcacaactactttttcctctaccatgagcttggccaaactgcttcaggagcgaggtatctccgccaaagtttaccactctccaatctctgaaaaccctctacagcccttgccgaagagcctggctataccatctaccccaccaaattctccatcgcatagcccctgcccctctccgctgcctttcgagcctagggttcacttgtctgaaaactttttggcatctcgaccggccgaaaccttcctccaggagatgtacgggctgcggccctctcgaaacccacccgacgttgggcaactgaaaatgaacttggtagaccgacttaaacgtctcgggatagccagggttgtcaaaaaccctggggcccaggagaacggtaggtgtcaggaagctgaaataggtccgcagaaaccagattcagcagtgtacttgaactccgggtcttcacttctgggcggactgcgtcggaaccagtcactccctgttattatgggctcatttgcagctcctgtgtgcacttcatcacccaagatgggagtcctgaaagaggattag

SEQ ID NO: 138120 - DNA, 936 bp, Artificial Sequence
  Description of Artificial Sequence: Synthetic coding sequence
atgtctcaatcccagaacgcaatcttcaccagccctactggggaggagaacttaatgaactccaatcaccgggacagtgaatcgatcacagatgtttgctctaacgaagacctgcctgaggtggagctggtgagtctcctggaagaacaactgccgcagtaccgactaaaggttgacactctgtttttatacgaaaaccaagactggactcagagccctcaccaaaggcagcacgcctcagatgcgctgtccccagtgttggcggaggaaacctttaggtatatgattctcggtacagatcgggttgaacaaatgaccaagacttacaatgatatagatatggtcacacatctcctggcagaaagagatcgcgatctggagctggctgcgagaatcggccaggccctgttgaaacggaatcatgtgttaagtgaacagaacgagagcttggaagagcaactgggccaggcgtttgaccaagtgaaccagttgcagcatgagctctgtaaaaaggatgaactgctgcggatcgtctcaatagcttccgaggagagtgagacggattcatcatgcagtactcccctgcgattcaacgagtctttctctctgagccagggcttactgcagctggagatgctgcaagagaagctcaaagagctggaggaggaaaatatggctctacggagtaaagcctgtcacattaaaactgagacagtgacctacgaggagaaggaacagcagctcgtgtccgactgtgtcaaggaacttagagagacaaacgcacagatgagtcgtatgacagaagaactgtctggaaaaagcgacgaactgatcaggtaccaagaggagctttcctcccttctgtcccagatcgtagatctgcagcataaacttaaggaagtgggcctattcattcattctacagatatctgctag

SEQ ID NO: 138121 - DNA, 93 bp, Artificial Sequence
  Description of Artificial Sequence: Synthetic coding sequence
atgagtcagtctcaaaacgcaattttcacaagcccaactggagaagagaatctgatgaatagcaatcatcgagatagcgagtcaattacatag

SEQ ID NO: 138122 - DNA, 2340 bp, Artificial Sequence
  Description of Artificial Sequence: Synthetic coding sequence
atgatcttgggcacggatagagtggagcaaatgactaaaacctacaacgacattgacatggtcacgcatcttctggcggagcgtgatagagacctcgaattagcagcgaggattggccaggcccttctgaagaggaaccatgtgttgtctgaacagaacgagtcactggaagagcagctgggccaagctttcgatcaggtaaaccagctgcagcacgagctctgtaaaaaggacgagctgctgcggatcgttagcattgcatccgaggagtccgagacggatagttcttgctccacacccttacggtttaatgagagtttctccctatcccaggggttgctgcagcttgaaatgctccaggagaagctgaaagaactcgaagaggaaaacatggctttgaggagcaaggcttgtcacattaagactgagacagtcacatatgaggagaaggagcaacagctggtgagtgattgtgttaaagagctcagggagactaatgcccagatgagtcgaatgactgaagaactatccggtaaatctgacgagctgatccgctaccaggaggagctcagttctctcctgtcgcaaatcgtggatctgcagcacaagcttaaggagcacgtgattgagaaggaggagctgaaactgcacctgcaagcttcaaaagatgctcaacgacagctgaccatggaactccacgagctccaagatagaaatatggaatgtctgggcatgctgcacgagagtcaggaggagatcaaggaactgcggtccagatctggcccaacagcccacctttattttagtcagtcttacggcgcctttacgggggaatccctcgctgctgagatcgagggaacaatgaggaagaagctgtccttggatgaggaatcatctctgttcaaacagaaagcccagcagaaaagagtgtttgacacggtgcggatcgcaaatgatacccgcgggaggtcgatctccttcccggcgctgctacctattcctggctcaaatcgtagttccgtgattatgaccgccaagcctttcgaatcaggactgcaacagaccgaagataaaagtcttctgaatcagggaagctcctccgaagaggtagcaggctcaagccagaagatgggacagcccgggccctcaggggacagcgacctcgccaccgctctccacagactctctctcagaaggcagaattatttgtctgagaaacagttctttgcagaggaatggcagcgcaaaatacaggttctggcagatcaaaaggagggggttagcggttgcgtgaccccaacagagtccctggcgagcctttgtaccacacagagtgagataacggacctgtcctcggcaagctgtctgcgcgggttcatgccagagaaattgcagattgtgaaaccactggaagggtcccagaccttgtatcactggcagcagttggctcagcccaatttgggtacaatcttagaccctcggcctggagtcataactaaggggtttactcaattgccaggagacgccatctatcatatctctgatcttgaagaagatgaggaggaaggaatcaccttccaggtacagcaacctttagaagtggaggagaagttatccactagcaaacccgtgaccggcatttttctgcccccaatcaccagcgctggagggcccgtgactgttgcgacggccaatcctgggaagtgcctctcttgcacaaactcgacgttcacctttaccacttgtagaatccttcacccatctgacattacccaggtgaccccatcctctggatttccctcattatcttgtggctcatctggctccagctctagcaatacggcggtgaactcaccagccctgagctaccggcttagcatcggtgagtctataacaaaccgccgcgactccactacaactttctccagtactatgtctctggcgaaactattacaagaacgggggatcagcgcaaaggtttatcactcgcctatttctgagaaccctttgcagccgctgccaaaaagtctcgctatcccctctacaccgcctaatagtccctcccatagcccatgccccagcccactcccatttgaaccacgggtccatctctccgagaattttctagcaagcaggccagccgagacatttctccaggagatgtatggccttagaccgtcccgcaatccgccagacgtggggcagctgaaaatgaacttagtggaccgactgaaacggttgggaattgctagagtggtcaagaacccagtgcctaaaagaatggaggatgcgcgcaggcagaagctggttcttaaaaatcaaatcttgttgttcatctag

SEQ ID NO: 138123 - DNA, 486 bp, Artificial Sequence
  Description of Artificial Sequence: Synthetic coding sequence
atggagaaaccactcacggtgctccgcgtgtccctgtaccacccgactctggggccatctgcttttgccaacgtgcccccaaggctccagcacgatacatctcccttattgctcggacgaggccaggatgctcatctgcaacttcagctcccccgcctgagccggcgccatctctctctggagccctacctcgagaagggcagtgctctcttggctttttgcctgaaggcattgagccggaaaggatgtgtgtgggttaacggacttaccctgaggtatttagagcaggtacctctctctaccgtgaaccgagtgtctttctccggtatccagatgctggtccgagtcgaagaggggacatccctcgaggctttcgtctgctacttccatgtgagcccttcacctctgatatatagacccgaggccgaggaaaccgatgaatgggagggcatttctcaggggcagccaccacccggatcgggatag

SEQ ID NO: 138124 - DNA, 1749 bp, Artificial Sequence
  Description of Artificial Sequence: Synthetic coding sequence
atggcagaattcctggatgatcaagaaacccgattatgtgacaactgcaagaaggaaatcccggtgtttaattttaccatccacgagatccattgccagcgtaacattggtatgtgtcctacctgtaaagaacctttcccgaagtcagacatggaaacccacatggctgccgaacattgccaagtcacttgtaaatgtaataaaaagttggaaaaaagactgctcaagaagcacgaagagactgagtgtccactaagactggccgtgtgtcaacactgcgatctggagctcagcatcctgaaactcaaggaacacgaagattattgcggcgccagaactgaattgtgtggtaactgcggtcggaacgtccttgtgaaggaccttaagacgcatccagaggtttgcggaagggagggcgaggagaaacgcaacgaggtggccataccccctaacgcttatgacgaatcctggggccaggacgggatttggatcgcatcccagcttttgaggcagatcgaagctctggatcctcctatgagattgccaaggcggcccctgagggcattcgaaagcgacgttttccataacagaacgaccaatcagaggaatatcacagctcaggtgagcatccagaacaatctgtttgaggagcaagagcgccaagagcggaacaggggacagcagcccccaaaagagggcggcgaagagagcgccaaccttgatttcatgctggcccttagcttgcaaaatgaagggcaagcaagtagtgtggctgagcaagatttctggagagcagtctgcgaggccgaccagtctcatggcgggccacggtccctgagtgacattaaaggcgctgctgacgaaattatgctgccttgcgagttctgtgaggaactttacccagaggaactgcttatagatcatcagacctcctgcaacccaagccgtgcattgccttctctgaacaccggctccagttcccctagaggcgttgaagaacccgacgtcatcttccagaactttctgcaacaggccgcctctaaccaactcgattcgctgatgggcctgagcaactcccacccggtcgaggagagcatcattatcccttgtgaattttgcggtgtgcagctggaagaggaagtcctttttcaccaccaggatcagtgcgaccagagaccagcaactgccacaaaccacgtgaccgaaggaatccccagattagacagccagcctcaagaaacatcacccgagcttcctcgacgacgggtacggcaccagggcgacctaagtagtggctacctggacgatacgaagcaagaaaccgccaacggacccacctcttgcttaccaccgagtcggccaattaacaatatgaccgcaacctacaatcagctgtcccggtcaacatccggaccacggccaggatgtcagccatcaagcccttgcgttccgaagttgagtaactctgatagccaggatattcagggcagaaaccgggattcccagaatggggccatcgctcctggtcacgttagcgtgatacgtccaccccagaacctctacccagaaaatatcgtgccctccttctccccaggcccctctggcagatacggtgcctccggcaggtccgaaggtgggagaaacagcagggttactccagctgctgctaattaccggtctaggactgctaaggccaagccatccaaacagcagggcgctggcgatgccgaggaagaggaggaggaatag

SEQ ID NO: 138125 - DNA, 1749 bp, Artificial Sequence
  Description of Artificial Sequence: Synthetic coding sequence
atggccgaattcttggacgaccaggagacccgcttgtgtgacaattgtaagaaggagatccccgtctttaatttcacaattcacgagatccattgtcagcggaatatcggaatgtgtcccacatgcaaggaaccgtttcccaagtcagacatggaaacacacatggcggccgagcattgccaggtcacatgtaagtgtaacaagaaactggaaaaacgcctgctcaagaaacatgaggagaccgagtgcccccttcggcttgcggtttgccagcattgtgacctcgagttgagtatactgaaactgaaagagcacgaagactattgcggcgcccgaaccgagttgtgcgggaactgcgggaggaacgtcttagtgaaggatctgaagacccatccagaagtgtgtggaagggaaggcgaggaaaagaggaatgaggtcgccatccctccaaacgcatatgacgaatcatgggggcaagacggtatctggattgcatcccagcttttgaggcagatagaagcactggacccccccatgcgactgcctcggagaccactgcgcgcattcgagtccgatgtatttcataaccgcacaaccaaccaaaggaacatcactgcacaggtcagcatccagaacaatctgtttgaagagcaggagagacaagaacggaatcgcggtcaacagccccccaaggagggcggcgaagagtcagctaacctcgacttcatgctggccctcagcttacagaacgaaggccaagccagctccgtggcggagcaggacttttggcgtgccgtgtgtgaagcagatcagtcccatgggggacctaggtccctgtccgacataaagggtgcagcggacgaaatcatgctcccttgcgagttttgcgaggagctttatccagaagaactgctaattgaccaccagacctcatgcaatccgtcacgggccttgccaagtctaaatacaggatctagttctccacgaggagtagaagagccagacgttatcttccaaaacttcttacagcaggctgcttccaaccagctggatagcctgatgggactgtccaacagtcaccccgtggaggagtctattatcattccttgcgagttttgtggggttcagctagaggaggaagtgctgtttcaccatcaagaccagtgcgatcaacggcccgctactgccaccaaccatgtgacagaaggaattccaaggctcgatagccagccccaggagacgtcaccagagctgcctcgaagacgggtcagacaccagggcgacctgagctccggctacttggacgatactaagcaagagacagccaatggcccaacaagttgcctcccgccatcccgtcctatcaacaatatgacagccacatacaatcagctttcaagatccacatccggtccccgcccaggctgtcaaccgtcctccccttgtgtgcctaaattgtcgaactcggacagtcaggatattcagggacgtaatagggactcacagaacggcgcaatagctcctggacacgtcagtgtcatacggcccccgcagaatctttaccccgaaaacatagttccatccttctccccgggaccaagcgggaggtacggcgcatcaggccggagtgaagggggccgcaatagccgtgtaaccccggcagcagccaattacaggagcaggacagccaaagcgaaaccctcaaagcaacagggagctggcgacgccgaagaggaggaggaagagtag

SEQ ID NO: 138126 - DNA, 408 bp, Artificial Sequence
  Description of Artificial Sequence: Synthetic coding sequence
atggcggaatttttggacgaccaggagacacgtctttgtgataattgtaagaaagagatcccagtgttcaacttcaccatccatgagatacattgtcagagaaatattgggatgtgtcccacttgtaaagagccatttcccaagagtgatatggaaactcacatggcggccgagcattgccaggtaacctgtaagtgtaataaaaaattggaaaaaaggctcctaaagaaacatgaagaaaccgagtgtcctctcaggctggccgtgtgccagcactgcgatctggaactctcaattctgaagctcaaggagcacgaggattactgtggagctaggactgaactgtgcggcaattgcggcagaaacgtcctggtgaaggaccttaaaacacaccccgaggtctgctag

SEQ ID NO: 138127 - DNA, 495 bp, Artificial Sequence
  Description of Artificial Sequence: Synthetic coding sequence
atggcagagtttctagacgatcaggagacccgcctctgtgacaattgcaaaaaggaaatccccgttttcaatttcacaatccacgaaatccattgtcaaaggaacatcgggatgtgtcctacctgtaaggagcctttccccaagtcagatatggagacacacatggccgccgagcattgtcaggtcacgtgcaagtgcaataagaaactcgagaagaggctcctcaagaaacacgaagagacggagtgtcccctgcgactggccgtttgccagcactgtgatctggaactttctattctgaaactgaaggagcacgaagactattgtggtgccaggactgagctgtgtggcaattgcggacggaatgtcctggtcaaagatttgaaaacccatccggagctcaagaataagcgcggtcgcaaggggatcgaagcgaacagtccacccaaacgtgtggttaaacgagtccagacctggacgtcttgttggccctag

SEQ ID NO: 138128 - DNA, 852 bp, Artificial Sequence
  Description of Artificial Sequence: Synthetic coding sequence
atggccgaatttctagacgaccaggagacccgactgtgtgacaactgcaagaaagagatccccgtttttaattttaccatccacgagatccactgtcagagaaacatcggaatgtgccccacctgcaaagaaccgtttcctaagtctgatatggaaactcacatggccgctgagcattgtcaggtgacgtgcaaatgtaacaaaaagttagagaagcgcctgctaaaaaaacacgaggaaaccgaatgccctctccgcctcgccgtctgtcagcattgtgacctagaactgtcaatcttaaagctgaaggagcatgaggattattgcggggcccgcaccgaactgtgcggcaattgtggcaggaatgtcctggtgaaggacctgaagactcatccagaggtgtgtggcagagagggagaggagaagcgaaatgaagttgctatcccccctaacgcatacgatgagagttggggccaggatggcatctggatcgcaagccagctgttgcggcagatcgaagctctggatccacccatgaggctgcctagacgtcctttacgagcgtttgagtccgacgttttccacaataggaccaccaatcagcgaaacatcacagcccaggtgagcatacagaacaacctctttgaggagcaggagcggcaagagagaaaccggggtcagcaaccaccaaaagagggtggggaagagagcgcaaatctagatttcatgttagctctgagtcttcagaatgaaggacaggcctccagcgtggctgaacaagatttttggagggccgtatgtgaggcggaccagtcacacggaggcccccgatcactcagtgatattaagtag

SEQ ID NO: 138129 - DNA, 414 bp, Artificial Sequence
  Description of Artificial Sequence: Synthetic coding sequence
atgggggcccatctggtgagaaggtacctgggggatgccagcgtagaacccgaccctcttcagatgcccaccttcccgcctgattatggcttccccgagcgtaaagagagggaaatggtcgcaacacaacaggagatgatggatgctcaattacggcttcagctgcgggactactgcgcgcaccatctcataaggttgcttaagtgcaaacgtgactctttcccaaacttcctggcatgcaagcaggaacggcacgactgggattattgtgagcaccgcgactatgtgatgcgcatgaaagagttcgagagggagcgtcggctgctccagcgcaagaagcgacgcgaaaagaaagcggccgagctcgccaagggacaaggacctggagaggtagaccccaaggtagccctctag

SEQ ID NO: 138130 - DNA, 972 bp, Artificial Sequence
  Description of Artificial Sequence: Synthetic coding sequence
atgatcctgcaggagacaaaggcagcatgcgggataccagctattccacattgttcccgagtcgagatacttgatgccaagacacgtgaaaagctgtgcttcctggataaagtggagccacacgcgacaattgctgagataaagaatttgttcacaaaaacgcatcctcaatggtaccccgctcgccagtcgctcagactagacccgaaaggaaagtccctgaaagatgaggatgtgctgcagaagctcccggtcggcaccacagcaacactgtattttagagatttgggcgctcagatctcatgggtaactgtcttcttgacggagtatgcaggcccattgttcatttatctgctgttttacttcagggtccctttcatatatggccataaatatgactttactagcagcagacacactgtcgtgcatctagcgtgtatctgtcacagtttccattacatcaagcgcctgctggagaccctattcgtgcacaggttctcccacggcaccatgcctctgagaaatatctttaagaactgcacttactactgggggtttgccgcctggatggcctactatattaaccatccgttatacactcctcctacttacggcgcccagcaggtcaagctggcactggccatcttcgtcatttgccagctcggtaatttcagtattcacatggctctacgcgacctgagaccggctgggtccaagactaggaagatcccttatccaactaaaaacccgtttacgtggctgtttctgctcgtaagctgtccaaactacacgtacgaggtgggctcctggatcgggttcgcaattatgacccagtgtctgcccgtggcacttttctctctggtaggtttcacacaaatgactatatgggccaaaggaaagcacagaagttatctgaaggagttccgggactaccccccccttcggatgcccataataccttttctcctgtag

SEQ ID NO: 138131 - DNA, 1014 bp, Artificial Sequence
  Description of Artificial Sequence: Synthetic coding sequence
atgtccagctccccagtgaagcgccagcggatggaatccgcactagaccagcttaaacagttcacaactgtggtcgccgacacaggcgacttccacgccatcgatgagtacaagccacaggacgccacaaccaatccatccctgatactggccgcagcccaaatgcctgcatatcaggaattggttgaggaggccatcgcctacggccgcaagcttggcggtagtcaagaggaccagatcaagaacgctattgacaaactatttgttctctttggcgccgaaatcttgaaaaagattccagggcgcgtgtcgaccgaggtagacgcacgccttagttttgataaagatgccatggttgcaagggccagacgtctcatcgagctgtacaaggaggccgggatctctaaagatcgaattcttattaagctgtctagcacctgggaaggcattcaggctggaaaagaactggaggagcagcacggaatacactgtaacatgaccttgttgtttagtttcgcacaggcagtggcctgcgccgaggctggcgtaactctcatatcaccctttgtgggtaggattttggattggcatgttgccaatactgataagaaatcgtatgagcccctcgaggacccaggagttaagagcgttactaagatctataattactacaaaaagttctcctacaaaacaatcgtgatgggggcatcctttaggaatactggagaaatcaaggcactcgctggctgtgatttcctgacgatatcaccaaagctgcttggcgagctactacaagacaatgctaaactcgtccctgtgctgtctgccaaggccgcccaagcatctgatctcgagaaaattcatctggacgaaaaaagtttcagatggttgcacaacgaggatcagatggccgtggagaaactaagcgacgggataaggaagttcgccgccgatgccgtgaaacttgaacgcatgctgaccgagcgaatgtttaatgcagaaaatggtaagtag

SEQ ID NO: 138132 - DNA, 957 bp, Artificial Sequence
  Description of Artificial Sequence: Synthetic coding sequence
atgtccagttcccctgtcaagaggcagaggatggagtctgcactcgatcagcttaagcaatttaccacagtggtggcagacactggggacttccacgccattgacgaatataaacctcaggatgcgaccaccaaccccagtcttattctggccgccgcccagatgccagcctaccaggagctggtagaagaagccatcgcctatgggcgcaagcttgggggttctcaggaggatcagattaagaacgccatcgacaaactattcgtactgttcggcgctgaaatccttaaaaaaatcccagggcgggtgagtaccgaggttgacgcgagactctcctttgataaagacgcgatggtagcacgcgcccggcgcctcatagaactgtataaagaagccggcatttccaaggatagaattctgataaagctcagctctacctgggaaggaatccaggcaggcaaggagcttgaagagcagcatggaattcactgtaacatgactctcctgttctcattcgctcaagcagtggcctgtgccgaggctggggtcacattgattagcccctttgtcgggagaatccttgattggcatgtagctaacaccgataagaaatcgtacgaacctttagaggatccaggggtgaagtctgtaactaagatctataactattataaaaaatttagctacaagactatcgtgatgggcgctagtttccggaatacaggtgaaattaaggctctcgcaggctgtgactttctgacgatatcccctaaactcctgggggagctgcttcaggacaatgcgaagctggtgccggtgctgagcgcgaaacctaaacctgtcacctggaaaaaaagcacttggatgagaagcctgtccgtcggatgcactacacggactaggtggttgtggcggtcgtcattgaccggctccgcttccctgccgctaatgcagtag

SEQ ID NO: 138133 - DNA, 1302 bp, Artificial Sequence
  Description of Artificial Sequence: Synthetic coding sequence
atgcggcagtcccatcagctccctctggtgggactgttgcttttcagctttatccccagtcagctatgtgaaatctgcgaggtctcggaggagaactacatccggttgaagccattgctcaacaccatgatacaatccaactacaaccgcggaaccagtgctgttaatgtggtcctgagcctaaagctcgtcgggattcaaatccaaaccctgatgcagaaaatgatccagcagatcaagtataacgtcaaatctcgcctgtccgacgtgtcatccggcgaattggctctcattatacttgccctaggtgtgtgccgcaatgctgaggagaacctcatctacgattatcacttaattgataaactggagaataaatttcaggctgagatcgagaacatggaggcccacaacggcacaccactcaccaattactatcagctgtccctcgacgtattggctctttgcttgtttaatggaaactactccactgcagaagtggttaatcactttactccagagaacaagaattattactttggaagtcagttcagcgtggacacaggggctatggccgttctggcattgacctgtgtgaaaaagtccctgatcaacggccaaattaaggcagacgaaggcagcctgaagaacataagcatctacacaaagagcttggtcgaaaagatcctgagtgagaagaaggagaacggcctgattggcaatacattcagtactggtgaggccatgcaggccctgttcgtctcaagtgactattataatgagaatgactggaattgtcagcagacgctcaatacagtgttaactgaaatttctcagggcgcattctccaatcccaatgccgccgctcaagtactgcccgctctgatgggaaagacatttctggacataaataaggatagcagctgcgtgtctgccagcggcaatttcaacattagcgctgatgagcccatcacagttacgccaccagattctcagtcatatatcagcgtaaactacagcgtgaggataaatgagacttattttacaaacgtgacagtcctgaacgggtctgtgttcctgtccgtcatggaaaaggcccaaaagatgaatgacaccatcttcggttttacaatggaagagaggtcctggggaccctacatcacttgcattcaaggcttgtgtgccaacaataacgatcgaacctactgggaactgctgagtggtggggagcccctgtcacagggggccggatcatacgttgtgcggaatggcgagaatttggaggtgcgctggtctaagtactag

SEQ ID NO: 138134 - DNA, 1083 bp, Artificial Sequence
  Description of Artificial Sequence: Synthetic coding sequence
atggctgctgctgctgcagccggcgccggtcccgagatggtgagaggtcaggtcttcgacgtgggtcccagatatacgaatttgtcatatattggagagggagcttacgggatggtgtgttctgcctatgacaacgtgaacaaggtgcgagtggctatcaaaaagatttctcctttcgaacatcaaacatactgtcaaaggacgctacgggagatcaaaatcctgctgcgtttcaggcacgaaaacataattggtatcaatgatataatcagagcccccactatagagcaaatgaaggacgtgtacattgtgcaagacctgatggaaaccgacctgtacaaactgctcaaaactcagcacctgagcaatgatcacatctgttattttctctaccagatcctgagaggattgaaatatatacactctgcaaacgttctgcatagggaccttaagccgtcaaacctccttttgaatacgacttgcgatctcaaaatttgtgacttcggccttgcacgggttgctgatcctgaccatgatcacacaggatttctgaccgaatatgtggcaacacggtggtaccgcgctccggaaattatgttgaattctaaaggatataccaagtccatcgatatctggtctgtggggtgtatactggcagagatgttgtctaatcggcctattttccctggcaagcactatctggaccaactaaatcatatcctgggcatcctgggatccccctcacaggaggacctgaattgtataattaatctaaaagcacggaattatttactgtctctgcctcacaagaacaaagtgccatggaaccgactattcccaaacgcggatagcaaagcacttgacctattggataaaatgctcaccttcaatccacacaagaggattgaggtggagcaggccctggcccacccgtatctggaacaatactatgacccatccgacgagccaattgccgaggctccttttaaatttgatatggaactggatgacctgcccaaggagaaactcaaggagctgatttttgaagaaactgcccgctttcaacctggctatcgttcctag

SEQ ID NO: 138135 - DNA, 1203 bp, Artificial Sequence
  Description of Artificial Sequence: Synthetic coding sequence
atgagacatctgggagccttcctcttcctcctgggggtcctgggtgccctgaccgaaatgtgtgagattcccgagatggactcccatctcgtggagaagctgggacaacatcttctgccatggatggatagattgagcttagagcacttaaacccatcaatctatgtgggcctgcgcctgagctcactgcaggctggcacgaaggaagacctgtacctacatagcctgaagttgggataccagcaatgtctcctgggaagtgcattttccgaggatgacggagactgccagggaaagccctctatggggcagctcgctctatatctgcttgctctccgggccaactggcacgaccacaaagggcatccacacacgagctactatcagtatggcctggggatccttgcactgtgtttacatcagaaacgagttcacgattcagtcgtagacaagctactctatgccgttgaaccattccatcaagggcatcattcggtggacacagcagctatggcagggctggcatttacctgccttaaacgctcgaattttaatccgggacggaggcagagaatcaccatggcaattagaaccgtgagagaagaaatcctgaaggctcagacccccgagggccactttggaaacgtgtactccacccccctggcccttcagttcttaatgacgagccccatgcgtggagctgaactaggcacggcctgcctgaaagcgcgagtcgctctcttggctagccttcaggacggtgctttccagaatgccctgatgatcagccagctgttgcctgtcctcaatcataaaacctacatcgatttaatcttccccgactgcttggctccccgagtaatgttggaacctgccgccgaaacaatccctcaaacacaggaaatcatcagcgtgactttacaagtcctctccctgctacccccttaccgccagtcaatcagcgtgttggctgggagcacagtggaggacgtcttaaagaaagctcacgagctcggcggctttacatatgagacgcaagcatctttgtcgggtccatacctgacatctgtcatggggaaggccgcaggagaacgcgaattctggcaactcctcagagacccaaacaccccattgctccaggggatcgccgactaccgcccaaaggacggtgagaccatcgaactccggttggtttcatggtag

SEQ ID NO: 138136 - DNA, 843 bp, Artificial Sequence
  Description of Artificial Sequence: Synthetic coding sequence
atggaagacgaggtggtgagatttgcgaaaaagatggacaagatggtgcagaagaaaaatgcctctacacggattggcatgtccgtcaacgccatcaggaagcagtccaccgacgaagaggtcacctcactcgctaagagcctcatcaaatcctggaaaaagttgttggatggaccaagtacggaaaaggaccttgatgagaagaagaaggagcccgccatcactagtcagaacagccctgaggccagagaggaaagtactagttctggcaacgtatcaaataggaaagacgagaccaacgcacgggacacatacgtgagtagctttcctcgggccccgtcgactagcgattcagtgcgactgaaatgccgggaaatgttagccgccgccctacgtacaggtgacgattatatcgcaataggggcagatgaggaggagctggggtcccaaatagaggaagccatctaccaagagattcgaaatacagacatgaagtataaaaatcgagtgcggagccggataagtaacttgaaagacgctaagaatccgaatttgcgcaagaacgtattgtgcggcaatattccccccgatctctttgcacggatgactgccgaggaaatggcatccgacgagctcaaggagatgcggaaaaacctgactaaggaggctattcgagagcaccagatggctaaaactggcgggactcaaacggatctgtttacgtgcgggaagtgcaaaaagaagaactgcacatacacacaggtacaaacgagatctgcagacgaacccatgactacatttgtggtgtgtaatgagtgcgggaaccggtggaaattctgctag

SEQ ID NO: 138137 - DNA, 906 bp, Artificial Sequence
  Description of Artificial Sequence: Synthetic coding sequence
atggaggacgaggtagtccggttcgcaaaaaaaatggataagatggtccagaaaaagaacgccgccggagctcttgacctactgaaggagctgaaaaatattcccatgacattagagctcctgcagtccacccgcatcggaatgagcgtgaatgcgatacgaaaacagtctaccgatgaagaagtcacgagcctggctaaatcgcttatcaaatcatggaaaaaactcctggatggcccttccacagaaaaagacctggatgaaaagaaaaaggagccagccatcacttctcagaattcccccgaggcccgagaagaaagcactagtagcggcaatgtcagcaaccggaaagatgagactaatgctagagatacttatgtgtcttctttccccagggctcctagcacatctgactccgtcaggctcaagtgcagggagatgctggcagcagcgctgcgaactggcgacgattacattgcaatcggggccgatgaggaggaactagggagtcagatcgaagaggccatctaccaggaaatcaggaatactgacatgaagtataaaaatcgggttcggtctagaatttcaaatctgaaggatgccaagaatcctaatttaagaaaaaatgtactgtgtggaaatatcccgcctgacttattcgccaggatgaccgccgaagagatggccagcgacgagcttaaagagatgcggaagaatctgacaaaagaggcgattcgtgagcaccagatggcgaaaacaggggggacccaaaccgacttgtttacttgtgggaagtgcaagaaaaaaaactgtacgtacacacaggtccaaactcgaagtgccgacgagcctatgacaacatttgtagtctgtaatgagtgcgggaacaggtggaaattttgttag

SEQ ID NO: 138138 - DNA, 354 bp, Artificial Sequence
  Description of Artificial Sequence: Synthetic coding sequence
atggaagacgaagtggtgcgattcgccaagaaaatggacaagatggtgcaaaagaagaatgccgcaggagcactcgacctgctgaaagaactgaagaacatcccgatgaccctggagctcctacaggaaatggcaagcgacgagctcaaggaaatgcgcaagaaccttactaaggaggccatccgggagcaccagatggccaagaccggtgggacccagacagacttgttcacctgcggtaagtgcaagaagaaaaactgtacatatacacaggtccagacccggagtgcagacgagccaatgaccacattcgtcgtttgcaacgagtgtggcaaccgctggaagttctgctag

SEQ ID NO: 138139 - DNA, 480 bp, Artificial Sequence
  Description of Artificial Sequence: Synthetic coding sequence
atggataaacctagaaaagagaatgaagaggagcctcagtctgccccgaaaactgatgaggagcggcctcctgtggagcatagccctgaaaagcaaagccccgaagaacagtccagcgaagagcagtcttcagaggaggagttcttccccgaagaattactgccagagctgctgccagaaatgctcctgtccgaggaacgacccccccaagagggtctgtctcggaaggatctgtttgagggccgcccccccatggaacaacccccctgcggggtagggaaacacaagctcgaagaagggagtttcaaagaacggttagcgagaagcaggccccagtttcgcggtgacatacatggtcgcaacctgtctaacgaagagatgattcaggccgctgacgagctggaagagatgaagcgtgtgagaaataaactgatgatcatgcattggaaggccaagagatctcgtccatatcccatttag

SEQ ID NO: 138140 - DNA, 480 bp, Artificial Sequence
  Description of Artificial Sequence: Synthetic coding sequence
atggataaacccaggaaggaaaacgaggaggaaccacagtcagctccaaagactgatgaagagaggccccctgtggaacactccccagagaagcagagccccgaagaacagtcatcagaagagcagtcaagtgaagaagagttttttcctgaagaactgctgcccgaactgctgcccgagatgctgctgtccgaggaacggcctccacaggagggactgagcaggaaggatctgttcgaagggcgcccacccatggaacaacccccttgcggagtgggcaagcacaagcttgaagaaggttccttcaaggaaaggttggcccgttcccggccccagtttaggggtgacatccacggtcggaatctgagcaatgaggagatgatccaggccgctgatgagctcgaggagatgaaacgagtgcgaaataagctcatgatcatgcactggaaggccaaacgatctagaccttacccaatctag

SEQ ID NO: 138141 - DNA, 480 bp, Artificial Sequence
  Description of Artificial Sequence: Synthetic coding sequence
atggacaagccccgaaaggagaatgaggaagagcctcaatcggcaccaaaaaccgacgaggagagacctccagtggagcactcgcctgagaagcaatcccccgaggagcaatcctcggaggagcagtcaagcgaggaggaattcttccccgaagaacttttgccagagttacttccagaaatgctgctgtctgaggagcgacccccacaggagggactttcccggaaggatttgttcgagggaagacctccgatggaacagcccccgtgcggagtcgggaaacacaaacttgaggaaggctcatttaaggagcggctcgcccgtagcaggccccaatttcggggggatattcatgggcggaatctgtcaaacgaggaaatgatccaggcagccgacgagctggaagaaatgaaaagggtaagaaacaagctgatgattatgcactggaaagcaaaaaggagccgcccgtaccctatctag

SEQ ID NO: 138142 - DNA, 471 bp, Artificial Sequence
  Description of Artificial Sequence: Synthetic coding sequence
atggataaacctcgtaaagagaatgaggaagagccacagaggcctagacccatgcgaagaggccttcggtggtccaccctccccaaatcaagtcctccccggtcctcactgcggcggtcttccccgcgccgaaggagctctttcctgcgatcttcatgcctttcgagttgtctcagatgctccagccgaaggtcaccacaggagggcctcagcaggaaggacctgttcgagggccgacctccaatggaacagccgccgtgcggagtgggaaagcataaattggaggagggttccttcaaggagcgtctggcacggtcaaggcctcagtttcgaggcgacatccacggacgcaatttgagcaatgaggagatgatccaagctgcagacgaactagaagaaatgaagcgcgtcaggaacaaattgatgatcatgcattggaaagctaagagatcacgaccgtaccctatctag

SEQ ID NO: 138143 - DNA, 303 bp, Artificial Sequence
  Description of Artificial Sequence: Synthetic coding sequence
atgcagaagccatgtaaggagaatgagggtaaaccaaagtgctccgtgcccaaaagggaagaaaaaagaccatatggtgaattcgagcgccagcaaactgaaggtaatttccgccagcggctactgcagagtctcgaggagttcaaagaagacattgattaccgtcacttcaaggatgaagaaatgacgcgtgagggtgatgagatggaacgatgcctagaagagatccgcggattaagaaagaaattccgggccttgcattccaaccaccgacatagcagagatcgtccttatccaatctag

SEQ ID NO: 138144 - DNA, 303 bp, Artificial Sequence
  Description of Artificial Sequence: Synthetic coding sequence
atgcagaagccatgtaaggaaaatgagggaaagccaaagtgttccgtacccaagcgagaggagaagagaccttacggagaattcgaaaggcagcagactgagggcaatttcaggcagagattactccagtccctcgaagagttcaaggaagatatagactatcgtcatttcaaggatgaagagatgacacgagagggggacgaaatggagcgctgtcttgaggaaatccggggccttagaaagaaattcagagccctccattccaaccacaggcacagccgagacagaccttaccccatttag

SEQ ID NO: 138145 - DNA, 291 bp, Artificial Sequence
  Description of Artificial Sequence: Synthetic coding sequence
atgtatgtgaaattgatatcgagtgatgggcatgaatttatagtgaaacgggaacatgcccttactagcggaacaattaaggccatgttgagcggacctgggcagtttgccgaaaatgagacgaacgaggtaaattttcgggaaatcccgtcccacgtgctgtctaaggtgtgcatgtattttacctataaggtgaggtatacaaactcctctaccgagatcccggagttccctattgcccccgagatcgcgctggagctcctgatggccgcgaactttctggattgttag

SEQ ID NO: 138146 - DNA, 339 bp, Artificial Sequence
  Description of Artificial Sequence: Synthetic coding sequence
atggacggcgaggagaagacttacggcggctgcgagggacccgacgctatgtacgtgaaactcatttcttccgatggtcacgagtttattgtgaaacgagaacatgcattgacctccggcaccattaaggccatgctcagcgggcctgggcaattcgccgagaatgagacgaatgaagtgaattttagagagatccccagccatgtactgagcaaggtttgtatgtattttacatataaggtcagatatactaattcttctactgaaatcccagaattcccaatcgcgccggagatagcattagaactgctcatggccgcaaatttcctcgattgctag

SEQ ID NO: 138147 - DNA, 339 bp, Artificial Sequence
  Description of Artificial Sequence: Synthetic coding sequence
atggacggcgaggagaagacttacggggggtgcgaaggcccagatgctatgtatgttaagttgattagcagtgacggacatgaatttattgtgaagcgagagcatgctctcacttcaggaactattaaggcaatgttgagcggtcctggccagtttgccgaaaatgaaaccaatgaagtgaatttccgagagataccaagtcatgttttgtcaaaggtatgcatgtacttcacctataaggttcgctatacaaactcttccaccgaaatcccggagttccccattgccccagagatcgctctcgagctcttgatggctgccaactttttagactgttag

SEQ ID NO: 138148 - DNA, 339 bp, Artificial Sequence
  Description of Artificial Sequence: Synthetic coding sequence
atggacggggaggagaaaacgtacggcgggtgcgagggccctgatgcaatgtacgtgaaactgattagctccgatggccatgagttcatcgtaaagagggagcacgctctcacttctggtacaattaaggcaatgctgtccggcccaggtcagtttgcggagaatgagactaatgaggtcaactttcgtgagatcccttcccacgttctatcgaaagtctgtatgtattttacttacaaggtgcgatatacaaattcttctaccgagattcctgagttccctatagcccccgaaatcgcactggaattattgatggcggcaaattttcttgactgctag

SEQ ID NO: 138149 - DNA, 339 bp, Artificial Sequence
  Description of Artificial Sequence: Synthetic coding sequence
atggatggcgaagagaaaacatatggggggtgtgagggcccagatgccatgtatgtgaagttgatatcatccgatggccacgagtttattgtgaagcgtgaacacgccctgaccagcgggaccatcaaagcaatgttatcggggcctgggcagtttgctgaaaatgagacaaatgaggtgaatttcagggaaatcccatcacacgtgctgtctaaggtgtgcatgtacttcacctataaagtcaggtacaccaacagttctaccgaaatcccggaattccccattgctcccgagatagctctggagctgctcatggccgctaattttctggactgttag

SEQ ID NO: 138150 - DNA, 339 bp, Artificial Sequence
  Description of Artificial Sequence: Synthetic coding sequence
atggatggcgaagaaaagacttatggcggatgtgaaggtccagacgccatgtacgtgaagcttattagctctgatggccatgaattcattgttaagagggagcacgcattaacaagcgggaccattaaggcgatgctctccggccctggccagttcgcagaaaatgaaaccaacgaggtgaacttcagggagataccatcccacgtcctgagcaaggtgtgtatgtacttcacatataaagttcggtacactaatagctcgaccgaaatccccgagttccctattgcccctgagatagcactagagctgttgatggctgccaatttcctagactgctag

SEQ ID NO: 138151 - DNA, 339 bp, Artificial Sequence
  Description of Artificial Sequence: Synthetic coding sequence
atggacggcgaagaaaagacctacggtggctgcgagggccccgacgcaatgtatgtgaagttgatatctagcgatggtcacgagttcatagtgaagagggagcatgccctgacttcagggaccattaaagcaatgttgagtggacccggacaattcgcagagaacgagaccaacgaagtgaattttcgcgaaatccctagccatgtgctgtccaaagtatgcatgtactttacatacaaggtccgctatacaaacagcagcactgagatccctgagttcccgatcgcaccagaaattgctctcgaactgcttatggcagccaacttcctcgactgctag

SEQ ID NO: 138152 - DNA, 2397 bp, Artificial Sequence
  Description of Artificial Sequence: Synthetic coding sequence
atgcacggtggccgatcctgcggtcctcgaactaggagggaaccttcaagcggtgaggaagctgcccctgttaccgcaatggctgctgagtcggcccttcaagtcgtggagaagctgcaggctcgcttggccgccaatcccgacccaaagaagctcctgaaatatcttaaaaaactctctaccctccccataactgtcgacatccttgctgagacaggagttgggaaaaccgtgaactcgctgagaaagcacgagcacgtgggtagctttgcaagagacctggtggcccagtggaagaagcttgtaccagttgagagaaacgctgagcccgacgaacaagactttgaaaagagtaatagccgcaaaagaccgagagatgctttgcagaaggaggaggaaatggaaggcgactatcaggagacctggaaagcgacaggatcacgcagttactctcccgaccatcgacagaagaaacaccgtaagctgtctgaacttgagcgaccgcacaaggtgtctcatgggcacgagcgacgggacgaaagaaaacgctgccaccgcatgtctccaacttattcgtccgaccctgaatccagcgactatggtcacgtccagtctccgccatcttgcacaagtccacaccaaatgtacgtggaccattataggtctcttgaggaggatcaggaacccatcgtgtcccatcagaagcctggtaagggacacagtaatgcatttcaggatagactgggagctagccaggaacggcacctcggcgagccgcatggaaaaggcgtggtcagtcagaacaaagagcataaaagctctcacaaagacaaacgcccggtggatgcgaagagtgatgaaaaagcctcagtagtgtctagggagaaaagtcataaggcgcttagtaaagaggaaaacaggcgacctccgtctggagataacgctcgagagaaacccccctcaagcggagtcaagaaagagaaggatagggaaggctctagcctgaagaaaaagtgcctccccccaagcgaagccgcaagcgataaccacttaaaaaaaccaaagcatagagatccagaaaaggcaaaactagacaaatcaaagcagggcctggactcatttgacacagggaagggagccggtgacttgctgccgaaggtgaaggagaaaggatcgaataacctgaaaacaccggaaggcaaagtcaaaacaaacctggatagaaagagcttgggatcactgccgaaggtcgaggagacggacatggaagacgaattcgaacagcccactatgtccttcgaaagctatcttagctatgaccagcctcgtaagaaaaaaaagaaaattgttaagacaagcgcaactgctctgggggataaaggcctcaagaagaatgactctaagtccacgggcaagaacctcgactccgtccagaagcttcctaaggtgaataagactaaatctgagaagccggcgggagccgacctggcgaagctgcggaaagttccggatgttctgccagtgctgcctgacctgccacttccagccatacaggcaaactaccggccccttccatctctggagcttatttcaagtttccaacctaaacgcaaagcattttcttccccccaggaagaggaggaagctggatttaccggccggaggatgaattcgaagatgcaagtgtattcaggatctaagtgtgcctacttgcctaagatgatgaccctgcatcagcagtgcatcagggtcttgaaaaataatattgactccatattcgaggtagggggggtgccctatagtgtgctcgagcccgtgttagagcgatgcacccccgaccagctctataggatcgaagagtacaatcatgtgctgatcgaagagactgatcagctatggaaggtgcactgtcacagggattttaaggaggaaagacctgaggaatatgaatcctggagagaaatgtacctgcggctgcaggatgcacgggaacagcggctacgtgtgctgaccaagaacatccagttcgcacacgccaacaaaccaaaaggacggcaagctaagatggcgttcgtaaattctgtggctaagccacctcgtgacgtgaggagacggcaggagaagtttggcaccgggggagccgcggtacccgaaaaaataaaaataaaacccgcgccctatcccatgggatcttcacatgcgagtgcgagctccatcagcttcaacccttcgcctgaagagcccgcgtacgacggcccaagcacctccagtgcccacctggctcccgtagtgtcctctactgtttcctatgaccctaggaagcctacagtcaagaaaatagccccaatgatggcaaaaaccatcaaggcctttaagaacagattctctcggcgctag

SEQ ID NO: 138153 - DNA, 3297 bp, Artificial Sequence
  Description of Artificial Sequence: Synthetic coding sequence
atggccgagcgtggtggggacgggggagaatccgagcggttcaaccccggagaactccgaatggctcagcagcaggcactgaggttccgcgggccagcccccccacccaacgcagtgatgcgaggtccaccacccctgatgcgccctcctccgccattcgggatgatgcggggcccacctccccctccccggccgcccttcggaaggccgcccttcgatcctaacatgccacctatgcccccgccggggggtattccgccacctatgggcccgccacacctccagaggcctccttttatgcccccaccaatgtcctccatgccaccaccccccggcatgatgtttccccccggaatgcccccagttactgcgccaggcacccctgctcttccacccacagaggagatctgggtggaaaacaagaccccagatggtaaggtctattactataatgcgcgaacgcgggagtccgcttggactaaacccgatggggtgaaagtcatccaacagtccgaattgacccccatgctggccgcacaggctcaggtccaggcccaggcacaggctcaggcacaggcgcaggcccaggctcaggcacaagcccaggcacaggcccaggcccaggcccaggcccaggcccaggctcaggcgcaggctcaggcccaggcccaggctcaggcacaggcccaagctcaggcgcaagcgcaggcccaggcccaggcccaggtacaggcccaggtgcaggctcaggtccaagcccaggcagtcggagcttccacacctacaacttcgagcccggccccggccgtctccacgtctaccagctccagtacaccatcaagcactacgagcaccacaactactgcaacgtccgtcgcgcaaactgtgtccactccaactactcaggatcagacaccatcctctgctgtgagtgtggctaccccaaccgtgtcagtaagtacgccagcaccaacagctacccctgttcagactgtccctcagccacatccacagactctgccgccagccgtcccccacagcgtgcctcagcctacgactgccattcccgcgtttcctccggtcatggttcctccattccgggtgcctctacccggaatgccgataccacttccaggggttgccatgatgcagattgtgagttgcccctacgtgaagactgtggccaccaccaagacaggcgtactgccaggcatggccccacccatcgtcccaatgatccacccccaagtcgcaattgcagcatctcccgctacactggccggcgccaccgctgtgtcggagtggacagaatacaaaactgctgatggcaagacctactactacaacaaccgcacgttagaatcaacatgggaaaagccccaggaactgaaagaaaaagagaaacttgaggaaaagattaaggagcccatcaaggagccaagcgaagagccgcttccaatggaaactgaagaggaggatccgaaagaggagcccattaaggagattaaagaggaaccaaaggaggaggagatgactgaggaggagaaggcggctcagaaggcgaaacctgtagccacagcgcctatcccgggaacaccatggtgtgtagtgtggacaggagacgagcgcgtctttttctacaacccgaccactcgcctgtccatgtgggataggccagatgatctgatcggtcgcgctgatgttgacaaaatcattcaggaaccaccccacaagaaaggcatggaagagttgaagaagctgagacatccgactccaacgatgctgagtattcaaaagtggcaattttccatgtccgcgatcaaggaagaacaagagctgatggaggagatcaatgaggatgaacccgtgaaagccaagaaaagaaagcgcgacgataacaaggacattgattctgagaaggaggccgcgatggaggcagaaattaaagccgcgcgggaacgggcgatagtgcccctggaggcgcgtatgaagcagttcaaggacatgttattagagcggggggtgtccgccttctctacgtgggagaaagagctgcacaagatagtatttgacccaaggtacctgctactgaacccaaaagagaggaagcaggtttttgaccagtatgttaagacccgggcagaggaagagcgcagggagaagaaaaacaagataatgcaggctaaggaggatttcaagaaaatgatggaggaggccaagtttaatccgagagccaccttttccgaattcgcagccaagcatgcaaaagatagcaggtttaaggcgatcgaaaagatgaaagatcgggaggctctatttaatgagttcgtcgcagctgcaaggaagaaggagaaggaggattctaagactagaggtgaaaaaataaagagcgactttttcgagctgctatccaaccaccacttggatagtcagtctagatggtccaaggtcaaggacaaggtggaaagcgacccacggtacaaggccgtggactcctctagtatgcgtgaggacctgtttaagcagtatattgaaaaaattgccaagaacctcgacagcgagaaggaaaaagaacttgaacgccaggctaggattgaggcctccctccgggaacgcgagagggaagtgcagaaggcccgctccgagcagacaaaagagatcgacagagagagggaacagcacaaacgggaagaggctatccaaaactttaaagcactcttatctgacatggtaagaagctccgatgtatcttggtcagataccagacgcaccctgcgcaaagaccacagatgggagagtggaagtctcctcgagagagaggaaaaggaaaaactgtttaacgaacacatcgaagccctcactaagaagaagagagagcatttcaggcagttgctggatgaaacctctgcaatcaccctgacctccacttggaaggaggtcaaaaagattattaaagaggatcccaggtgcattaaattttccagttctgaccgtaaaaaacagagggaatttgaagagtacatccgcgataagtatattaccgccaaagctgacttcaggaccctcttaaaggaaactaagtttattacttatcgctcaaagaagttaattcaggaaagcgaccagcatctgaaggatgtagagaaaattctgcaaaatgataaaagatatctcgtccttgattgcgtccccgaagagcgccggaaactgatcgtcgcttacgtggatgacctagacaggcgggggcccccgccccctcccaccgcatccgaacctacaaggcgttctactaaatag

SEQ ID NO: 138154 - DNA, 3234 bp, Artificial Sequence
  Description of Artificial Sequence: Synthetic coding sequence
atggccgagaggggaggcgacggcggggagtctgaacgcttcaaccctggggagctgcgcatggcccagcagcaagccttgagattcagagggccagcccccccacctaatgctgtgatgcgtggtcccccaccattaatgcggccaccaccaccattcggcatgatgcgcgggcctccccccccgcccagacctcccttcgggcgtccacccttcgacccaaatatgccaccaatgccccctcccggcggcattcctccccccatgggcccaccacatttacagcgcccgccctttatgccccctcctatgagcagcatgcccccgcctcctggaatgatgttcccacccgggatgcccccagtcacagctccaggaacgccagcgttgccacccacagaggaaatttgggtcgagaacaaaacccctgacggaaaagtctattactataatgcccgcactcgtgagagtgcatggacaaaacccgatggggtaaaagttattcaacagtccgagttgactccgatgctcgctgcacaagcacaggtgcaggcgcaggcccaggctcaagcccaggcccaggctcaggcccaggctcaggctcaggcacaggcgcaggcccaggcccaagctcaggcacaagcgcaggcccaggcgcaagctcaagcgcaagcacaggcacaggcgcaggcccaggcccaggctcaggcccaggctcaggctcaggtccaggctcaagtccaggcccaggtgcaggcccaggcagttggcgcatccacacccaccacgtcaagccccgcccctgcagtgagtacctccacatcctccagcacacctagcagcaccacatctaccacaactacagcaacatccgtggctcagaccgtttcaacaccgactacgcaagaccagactccatcgtccgccgtttccgtggctactcctacggtaagtgtgagcaccccagccccgaccgcgacaccagtccagacagtgccgcagccccatccacagaccctcccccccgccgtcccacattctgtgccccaacctacaacagcgattcccgccttccctccagtgatggtccctccattccgcgtccccctgccgggaatgcctatacctctacctggcgttctcccagggatggccccacctattgtcccgatgatccacccacaggtagccattgcagcatctcccgcgactctggcaggagcaaccgccgtgtcggagtggacagaatacaaaactgctgacggtaagacatattactataacaatagaacccttgagtctacctgggagaaacctcaggagctgaaagagaaagagaaattggaggagaagattaaggagcctatcaaagagccctctgaggagcccctccctatggagacagaagaggaggatccaaaagaggagccaattaaagagatcaaggaggagcccaaggaagaggaaatgaccgaggaagagaaagccgcgcagaaagcaaaaccagtggccaccgcgccaatcccgggcactccctggtgcgtcgtatggacaggggatgagcgtgtgttcttttacaatccgacaaccaggctctccatgtgggataggcctgacgacctaatcggacgcgctgacgtcgataagattatccaggaacctccgcataagaaaggtatggaggaacttaagaaattgcgccatccaacgcccactatgctgtcgatacagaagtggcagtttagcatgtcagctattaaagaggaacaagagctgatggaggaaattaatgaggatgaacccgtgaaagccaaaaaacgaaagagagacgacaataaggatattgactccgagaaggaagccgctatggaagctgagataaaagccgcccgcgagcgggcaatagtgcccttggaggcgcggatgaagcagtttaaagatatgctgctcgagagaggggttagtgctttctctacttgggaaaaagagctccacaagattgtgttcgatccccgctatttgctacttaatcccaaagagcgcaagcaggtcttcgaccaatatgtaaaaacacgcgctgaagaagaaagacgggagaagaaaaataagatcatgcaggcaaaggaggatttcaagaagatgatggaagaggccaagttcaatccaagagctaccttttccgagttcgccgccaagcatgctaaggattctcgctttaaagccatagagaagatgaaagatagagaagccctgttcaatgaattcgtcgctgcggcaagaaagaaggaaaaggaagatagcaaaactcggggagagaagattaaatctgacttctttgagcttttgagtaatcaccaccttgattcacagtcccggtggtctaaagtcaaagataaggtggagtctgacccccggtataaggccgtcgattccagttcaatgagggaagatttgtttaagcaatacatagagaagatcgctaagaacctggacagcgagaaggaaaaagagttagaacgccaggccaggattgaggcaagtttgcgggaaagggagcgggaagtgcagaaagcaaggtcagagcagacaaaagagatcgatagggagcgcgaacagcacaagcgggaagaggctatacagaatttcaaagcgctgttatccgacatggtgaggagctccgacgtcagttggagcgatacgcgcagaactcttaggaaagatcaccgatgggaatctggctctctcctggaacgcgaagagaaagaaaagttattcaatgaacatatcgaggcactgacaaaaaaaaagcgcgagcatttccggcaactgttagatgagacatctgccataaccctgacatccacatggaaagaagtcaaaaagattatcaaggaagaccctaggtgcatcaaatttagttcatctgacaggaagaaacaacgggaattcgaagagtatatccgagacaaatacattactgccaaggcagactttcgcactttgcttaaggaaacaaaatttatcacctaccgctcgaagaaattaatccaggagtcagaccagcacctgaaggacgtggaaaagatcctgcagaatgataaacgttatctggttcttgattgcgttcccgaagaacgcaggaaactcatcgtagcatacgtggatgatctcgaccgacggggtccccctcctccccccactgcctctgagcccacaaggagatcaaccaagtag

SEQ ID NO: 138155 - DNA, 2049 bp, Artificial Sequence
  Description of Artificial Sequence: Synthetic coding sequence
atgaaccctcagcagcagagaatggcagccatcggtacagacaaagagctgtcggacctgctggatttctccgccatgttcagtcctcctgtcaatagtggaaagacaagaccaacaacgcttggatcctcccagttcagcggtagtggaattgacgagaggggaggcaccacgagctggggtacatcagggcagccatctcctagctacgatagcagtagaggctttacagacagcccacactatagcgaccatctgaacgattcgcgcctcggcgcccatgaaggtctcagtcccacaccatttatgaattccaacctgatgggcaaaacaagtgagcgcggatctttctctttatattcaagggacacaggccttcccggctgccagtctagcctgctaaggcaggacctggggctaggatctccagcacaactctcctcctccggtaaaccgggcacggcatattattcgttctcagcaacgagctctaggagacgccccttgcacgattccgctgcccttgaccctctgcaggccaagaaggtcagaaaggtcccacctgggctgccctccagcgtctatgctccctcccccaactcagatgactttaaccgcgaatccccaagttatcccagtccaaagccaccaacctcaatgttcgcctctacttttttcatgcaagatggcacgcacaactcgtctgacctgtggtccagttcaaatggcatgagtcaacccggcttcggcggcattctcggcacgtcaaccagtcacatgtcccagagctcctcctatgggaacctccactctcacgatcgcctgagctacccccctcattccgtgtctcccactgatatcaataccagccttccgccaatgagcagctttcatcgaggctctacgagctccagcccctatgtggccgcatctcacactcctcccatcaacggatccgatagtattttgggaaccagaggcaacgccgctggatcctctcagactggggatgccttaggcaaggctcttgcgagcatctactcccctgaccatacctcatcttcattcccatccaacccttcaacacccgtcggatcccccagtccactaaccggtactagtcagtggccgagaccaggggggcaagctcccagctctcccagctacgagaactccctccactccctacagtcccggatggaggatagattggacaggctcgacgacgcaatacacgtccttcgaaaccatgcagtaggcccttctacgagtctcccagcaggacattccgacattcattctcttctcggaccctcccataatgctccgattggttctctgaattcaaattacggaggcagcagcttagttgcaagctctcggtcagccagtatggtaggtacacatcgagaggatagtgtaagcctgaacggtaaccattctgttctgtctagtacagttacaactagttcaactgatctgaaccacaagacacaggagaactatcgaggaggcctgcagagccagtccggcacagtcgtcactaccgagattaaaaccgaaaataaggagaaggatgagaacctccacgagcccccatcttctgatgatatgaagtcagatgatgaatccagtcagaaggacattaaggtctcatccagaggccgaacctcctccacaaacgaggatgaggacctgaatccagagcaaaaaatcgaacgggagaaagaacgcagaatggccaacaacgctagagagagattgcgcgtgcgcgacataaatgaggccttcaaagagcttggacggatgtgccagctccaccttaaatcagagaagccccaaaccaagcttttgattctccaccaggccgttgcggtgatactgagtcttgagcaacaggtgcgagagcgtaatctgaaccctaaagctgcatgcctaaaaaggagggaggaagaaaaggtgtcagctgtcagcgccgagcctccaacaacattgccaggtacccacccaggtctgtcagagacaaccaatcccatgggccacatgtag

SEQ ID NO: 138156 - DNA, 2121 bp, Artificial Sequence
  Description of Artificial Sequence: Synthetic coding sequence
atgaatccacagcagcagcgaatggccgctattggaaccgacaaggagctgagtgacctgctagatttcagcgcaatgttcagtccccctgtgaacagtggaaagaccaggcctacaactttaggctcctcgcagttctccggttccgggattgacgaacgcggcgggacaacctcctggggaacttctggccagccctccccctcgtacgactcctcaaggggctttacagactcccctcattattctgatcatctcaacgacagccgtctgggcgctcatgaaggcctgtcccccacacccttcatgaacagcaatctgatgggcaaaaccagcgagcgcgggagctttagcctgtattcaagggatacaggattgcccggctgccagtctagtttgcttaggcaggatctgggattgggatcacccgctcagctcagttcatctgggaagcccggcaccgcatactacagctttagcgctaccagtagccggcgacgccccctccatgactccgcagccttagaccctttgcaagctaagaaagtgcgtaaagtgccgcctggattaccaagctccgtgtacgccccttccccaaactccgatgattttaacagagaatccccgagttaccccagtcccaagccacccacaagcatgttcgcctcaactttcttcatgcaggacgggacacataactctagtgacctttggtcaagcagtaatggcatgtctcagcccggctttggtgggatccttgggacatcaacttcccacatgtcccagagtagcagctatggaaatctgcattcccacgatcgcctgtcctaccccccacacagtgtaagccctactgacataaacacctctctgcctccgatgtcctcctttcacaggggatcaactagttccagtccctacgtggctgcctctcacactccccccatcaacgggagcgacagtattttgggtacgagaggcaacgctgctggctcgtctcagactggcgacgccctgggcaaagccctagcgagtatttatagccccgaccatacaagctccagttttccaagcaatccatccacccctgtcggctctccatctcctctgaccgggaccagccagtggcccagacccggaggacaagcccctagctccccttcatacgagaacagtctgcatagcctgaaaaatagggtggaacagcaacttcacgaacacctccaggacgccatgagctttctgaaggatgtgtgtgaacagagccgcatggaggacagactagatcggcttgacgatgcgatccacgttttacgcaaccatgcggtgggcccgtctacttctctgcccgcaggacatagtgatatccactctctcctaggcccctcccataatgcccctattggcagcctaaactccaattatggcgggagttccttagtagctagctccagaagtgcatccatggtgggaacacacagggaagatagcgtaagcctcaacggcaatcactccgtgctgtcctcgactgtcacgacttcctctactgatctgaaccacaagacccaggagaactaccgtggtggattgcagtctcagtctgggactgttgtgaccactgaaattaagacagagaacaaggagaaagatgaaaatctgcacgaacctccgagcagtgacgacatgaagtcagatgatgaaagttctcagaaggacatcaaggtgagctcacgaggacggacaagcagcaccaatgaagatgaagacctcaacccagagcagaagattgagcgcgagaaggagcggagaatggcaaacaatgcccgggaaagactgagagtgcgggatattaacgaggcctttaaggagcttgggagaatgtgtcagcttcatcttaagtcagagaagccccagacaaagctcctcatccttcaccaagctgttgctgtgattctctcccttgagcagcaggtgagggagaggaacctgaacccgaaggctgcatgtctaaaaagacgcgaagaagaaaaagtatccgccgtcagcgccgaaccgccaacaactttgcctggcacccaccccggacttagcgaaactacaaatcccatggggcatatgtag

SEQ ID NO: 138157 - DNA, 2109 bp, Artificial Sequence
  Description of Artificial Sequence: Synthetic coding sequence
atgaacccccagcagcagagaatggctgctattggcaccgacaaagaactgtcagatctgctcgattttagtgctatgttctcacctccagttaactccgggaaaacacggcctacaaccttaggaagctcacaattcagcgggagcggtactattcatgaaatgaaacagctgaattcaaaagcgagacagaaggggcaaaggatcaagggcttcacggactcacctcactattccgaccacttgaatgattctagactgggggcccacgaggggttgtcgcctactcctttcatgaattcaaatttaatggggaagacctcagagcgggggtccttcagcctgtacagtagggacacaggacttcccggttgccagtcatccttgctgagacaggatttaggcctaggaagccccgcgcaactctcaagctctggaaaacctggtacagcatattacagtttttctgccacaagtagtaggagaaggccgctgcacgactcagcggccctcgaccctttgcaggcaaagaaagtccgaaaggtaccccccggcctgccctcaagtgtgtatgctccatctcctaactccgacgattttaaccgggaaagcccaagttacccctctcccaagcccccgacttccatgttcgctagtacctttttcatgcaggatgggacacacaattcgagcgacctgtggtcaagttccaatggcatgagccaacccggtttcggcgggatactgggcacgagcaccagccacatgagtcaaagcagctcttacgggaaccttcacagtcacgacaggctgtcctatccaccgcattccgttagccccactgacatcaatacaagcctgccacctatgagctcctttcaccgcggatctacatctagctctccttatgttgcagcctcccatacccccccaattaacggatcggattccattctggggacaagaggaaacgccgctggctcctcccagaccggggacgccctgggcaaggccctggcctccatttatagtccagaccatacaagctcctcttttccctccaacccttcaacacccgtgggatccccctcacccctaacaggcactagtcagtggccccgaccagggggacaggccccctcatccccttcttacgagaactcactgcacagccttaagaacagggtggaacagcagctgcacgagcaccttcaggacgcaatgagttttctgaaagatgtatgtgagcagagccggatggaggaccggctcgacagattggacgatgcaatccacgtgcttagaaaccatgccgttggccctagcacctccctcccagcgggtcacagcgacatccactccctcctgggtcccagtcacaacgctccaatcggctctctgaattcaaactacgggggctcctcgctggtggcgagctcaaggagcgcaagcatggttgggactcatagagaagattctgtgtctctgaatggaaaccacagcgtcctgagttcgactgtgaccacaagctctaccgacctgaatcacaaaactcaagagaattacagaggcgggttgcaatcccaatcaggtacagttgtgacaacagagataaagactgagaataaagaaaaagacgagaatctgcatgagccacccagctctgacgatatgaagtcagatgatgagtcttcgcagaaagacattaaagtttctagccgcggtcgcacctcctccacaaatgaagatgaagatctgaatcctgaacagaagatcgagagggaaaaagaacgtcgcatggccaacaatgcccgggagcgtttacgagtacgagatataaatgaggcattcaaagaactgggcagaatgtgtcaacttcaccttaaatcggagaagccccagacaaaacttctgatactccaccaggcagtagccgtaatcctctcgctggaacagcaggtgcgcgagcgcaacctgaatccaaaagccgcgtgtctgaaacggagagaggaagaaaaagtcagcgcagtgagcgctgaacctcccaccaccctcccgggtactcatcccggcctgtccgagacaaccaacccaatgggccatatgtag

SEQ ID NO: 138158 - DNA, 1341 bp, Artificial Sequence
  Description of Artificial Sequence: Synthetic coding sequence
atgggcaagcgctacatgcaccacccacagattcagatgatatcaaccgtaaacttgctggtgatccacctgctcagccaccagcccgtgtgctccctcgctctgtccctgtgtaaatcgtaccccccgcattccgtgagtcccaccgatataaatacctcccttcccccaatgtcgtcctttcacaggggctctacctcatccagcccatacgtcgccgcttcacatactccgccaatcaacggaagtgacagcatccttgggacgagggggaacgcagctggcagttcacagaccggagatgcactgggcaaagccctggcttccatctattcgcccgaccatacgtcttcttctttcccttctaacccatcaacacccgtcggctctccatcgcccctgactggaaccagccagtggccccgacccgggggtcaggcccccagctctccgagctacgagaatagtttgcacagcctgcagtctaggatggaagatagactcgaccggttggacgacgccatccatgtccttcggaatcacgccgttggccctagcacgagcctgcctgccggccactccgatatccatagtctcctaggcccgtctcataacgccccaattggctcactgaactccaattatgggggcagcagccttgttgcctcctcacgctcagccagtatggtggggacacaccgggaggattctgtgagtttgaacggaaatcactctgttctctctagcaccgtgacgacaagctcaaccgacctgaatcacaaaactcaggaaaactatcgtggcggtctccagtcacagagtggcaccgtcgtcaccacagaaatcaaaaccgagaataaagagaaggatgagaacctacacgagcccccaagttccgatgacatgaagtcggacgatgaatcatcccagaaagacattaaagtgtcatcacgcggaaggacgagcagcacgaatgaagatgaggatctgaatcctgagcagaagatcgagagggaaaaggagcgaaggatggctaacaacgctcgagaacgcctccgggtgagagatatcaatgaggccttcaaagagctcggccgtatgtgccagttgcatcttaagagcgagaagccccaaaccaagctgttaattctccatcaagcggtggcagttatactcagcttagagcagcaggtcagagagaggaacttgaatcccaaggccgcctgcttgaaacggcgtgaggaagaaaaggtttctgctgtgagtgcggagccccctactacactccctgggacgcatcctggactctccgagaccacaaaccctatgggtcacatgtag

SEQ ID NO: 138159 - DNA, 2046 bp, Artificial Sequence
  Description of Artificial Sequence: Synthetic coding sequence
atggctgccttttctgttttacggccaagagtgccgggcagtagcggcacatgggctgcagacccagacgctagcactgccgtgtccccaagcctgagattcggcggccgggagcctgctcggccgaccagaggcggcgccaccaaatggccgaagatgaaccctcagcaacagagaatggccgccatagggactgataaagagctctccgacctgttggacttcagtgctatgtttagcccaccggtgaattctgggaagacccggccgactacactgggatcctcccaattctctggatccggcatcgatgagcggggcggtacaaccagttggggtacctcaggccagcccagtccatcgtacgactccagtagaggtttcacagactccccgcattattccgatcacctcaatgactcccgattgggcgctcacgagggattatcccctactccattcatgaacagtaacctgatgggtaaaacttctgagaggggtagcttctctctgtattcacgtgatacggggctgcccggctgccagagtagcctgctgcgtcaggacctcggtctgggcagtcccgctcagttgtccagctctggcaaacctggcaccgcctattactcattttccgcgaccagtagccggaggcgcccgcttcacgactctgcagccttggatcccttgcaagccaagaaggtaagaaaggtcccccccggtctgccatcttcagtgtatgctccctcacccaattcagacgacttcaaccgggaaagtcctagctatcctagccctaagcctcccactagtatgttcgcaagcaccttctttatgcaagatggaacacacaactcctccgacctatggtcgtcaagcaacggcatgagtcaacctggatttgggggcatcctgggtactagcactagtcacatgtcccagtcctcgagctacgggaacctccacagccacgacagattatcctatcctccgcactcagtaagtccgacagacattaacacttctctgcccccaatgagtagcttccaccgtgggtcaacatcctcgtccccatatgtggccgcctcccacacgccacctatcaatgggtcggacagcatcctgggcacccgagggaacgccgcagggtcttcacagacgggcgatgctctgggtaaagccttggcaagtatttatagcccagatcatacaagtagctcattcccttctaatcccagcacacctgttggctccccctcccccctgacaggaactagtcagtggccaaggccaggaggacaggctccgagttcacctagctatgaaaatagcctccactctcttcagtcccgaatggaggatcgccttgaccggctcgatgatgccattcatgtgctgagaaaccacgccgtgggaccttccacttcactgcctgcgggccattcggatatccactcactcctcggcccctctcacaatgcaccaatcggctctctgaattccaattatggtggctccagtttggtcgcaagttctcggtcagccagcatggtcggcacgcacagggaagatagtgtctctcttaacggaaatcattctgtcctgagttccacagtgactacctccagcacagacctgaatcataagacgcaggagaactatcgcggcgggctgcagtctcagtctggcacagtggtaacaaccgaaatcaaaactgagaataaggagaaggatgaaaatctgcatgagccaccatcatctgatgacatgaagtcagacgatgaaagctcccagaaagatatcaaagtctcctctcgtgggcgtacttcctctaccaatgaggatgaggacctcaaccccgagcagaagatcgagcgggagaaggaacgaaggatggccaataatgcccgagaaagactcagagtccgggatatcaatgaggccttcaaggaactgggtaggatgtgccaactgcacttgaagtccgaaaaaccccagactaagctgcttatacttcatcaggctgtaaccaccattggaccttag

SEQ ID NO: 138160 - DNA, 885 bp, Artificial Sequence
  Description of Artificial Sequence: Synthetic coding sequence
atgagcttcctaaaagatgtatgcgagcagtcccgaatggaagataggcttgacagattggatgacgctatccacgtgctaaggaatcacgcggtcggcccctctacttccctgccagccggccactcagatatacattcgttgctgggacctagccacaatgcccccatcggctccctgaatagtaattacggcgggagctcactcgtggcgtcctctcgaagcgctagcatggtcggcactcaccgcgaggactccgtcagtctgaacgggaaccactccgttcttagttctaccgtgacaacaagctcaactgacttgaatcataagacccaggagaactatcggggcggactgcagtctcagagcggcactgtggtgacgaccgagatcaaaactgaaaacaaggagaaagacgaaaatcttcatgaacccccttcatccgatgatatgaagtccgacgacgagagcagccagaaggacattaaggtctcatcaagaggaagaacgagtaccaacgaggacgaggacctaaaccccgagcagaagatcgagcgagaaaaagagcgccgcatggccaataatgctagggagcgactcagggtgagagacatcaatgaagccttcaaagagctcggaagaatgtgccagctgcacctaaagtccgagaagccgcagacaaagctgctgattctgcaccaggccgtagcggtgattctgtctctcgaacaacaagtgagagaacgaaacctgaatccaaaggccgcatgtctgaagcgtagagaggaggaaaaagtgagtgccgtgagtgccgagccgccaacgaccctgccaggaactcaccctggtctttccgagactaccaaccccatgggacacatgtag

SEQ ID NO: 138161 - DNA, 1611 bp, Artificial Sequence
  Description of Artificial Sequence: Synthetic coding sequence
atgtattgcgcttatcctgtgccgggtatggggtccaattcattaatgtactattataatggaaaaacagtgtacgccccttccccaaattctgatgacttcaaccgggagagtccctcatacccatcgcctaagccccctacctcgatgttcgcctccacttttttcatgcaagatggaacgcataacagttccgacttatggagctccagtaatggcatgtcacagcctggatttggcggtattctcggcacaagtacatcacacatgagccagtcttctagttacgggaacttacacagccatgatcgactgagttatcccccacatagcgtttcgccaactgatatcaatacctctctccctcccatgtcaagctttcataggggctccacttcctcatcaccctatgtggccgcttcccacactccaccaataaatggcagcgatagtattctgggcacccgaggcaacgccgcaggctctagccagaccggggacgccttgggaaaagctctggcaagcatttactcacccgaccacacctcatcgtcatttccctcaaatccctccacacccgtgggctcaccaagcccactgaccggcaccagtcagtggccacggcctggagggcaagcgccctcaagcccatcgtacgagaattccctgcacagcttgaagaatagggtagagcaacaactccacgagcatctgcaagacgctatgagcttcctgaaagatgtgtgtgaacagagtagaatggaggaccgattagaccggctggacgacgctatccatgtacttcggaaccatgccgtcggccccagcactagcctccccgcaggtcacagcgacattcactctctgctgggcccaagccataacgccccaattggcagcctcaactcaaattatggcggatccagccttgttgcctccagccgctccgcctctatggtgggaacccatcgcgaagactccgtgagccttaatggcaatcactcggtgctctcctctacagtgaccacttcaagcaccgatctaaaccacaagacccaggagaactacaggggcggactgcagagtcagagcggtaccgttgtaacaaccgagatcaaaaccgagaacaaggagaaggatgaaaacctgcacgagcccccaagctcagatgatatgaaatcagatgatgagtcctcacaaaaggacatcaaagtgtcaagccggggcaggactagttcgacaaatgaagatgaggacctgaaccctgaacagaaaatcgagagagaaaaagaaaggaggatggcaaacaatgcaagggagcggctgcgtgtgagggatattaatgaagccttcaaggagttaggtcgcatgtgccagctccatcttaaaagtgagaaaccccagaccaagctgctcatccttcaccaagctgtcgctgttattttaagcctagaacagcaggtgagagagagaaatctcaatcctaaagcggcatgccttaaaaggcgagaggaagagaaggttagcgctgtgtccgctgaaccaccaaccacactgcctgggacccaccccgggctaagcgaaactactaaccctatgggccatatgtag

SEQ ID NO: 138162 - DNA, 2049 bp, Artificial Sequence
  Description of Artificial Sequence: Synthetic coding sequence
atgaacccgcagcagcagcgcatggccgcaattggaacagacaaggaactctccgacttgctcgacttcagtgctatgtttagccctcccgtaaactcagggaaaactagaccaactacgctgggcagctcccagttctctggtagtgggattgatgaaaggggcggtactacatcttggggcacttccggacagcctagcccaagttatgattcctcaaggggcttcaccgattcaccccactactcagatcaccttaatgattctagactgggagcacacgagggtctgagccctaccccattcatgaattctaaccttatgggtaagactagtgagcgaggctctttctccctgtacagcagagacaccgggctgcctggctgccagtctagcctgctccgacaggacctgggcctgggatcgccggcccagctcagttcttccggaaagccaggtacagcttattatagcttttctgcaacatcctcacggcgcagacctctgcacgatagcgcagcattagacccactgcaggccaaaaaggtgcgcaaagtgccacccggcttaccgagcagcgtgtacgccccaagccccaatagcgacgattttaatcgagagagcccatcatacccaagtccaaaaccccccacatcaatgtttgcatctacttttttcatgcaagacggcacacataattcatcggacctgtggagctcctccaatggtatgtcccagccgggttttggcggcatcctgggaacgtccactagccatatgtcccagagctcttcctacggaaatctgcatagccatgaccggttatcctatcccccacactctgtgtcaccgaccgacatcaacacctccctcccccccatgagtagcttccaccgtgggtcaactagttcgagcccatatgttgctgcaagtcacactcctccaattaatgggagtgattcaattctgggtacacgagggaatgcagccgggagcagtcagaccggagacgcgcttggaaaggctctagcctcaatatacagtccagaccacacctcatcctcgttcccgtccaatccctccacacctgttggtagtcccagccctctgactggtacatcacagtggcccagaccgggcgggcaggctccttcttcccccagctatgaaaactcactccacagcctgcagagcagaatggaagaccgccttgatcgactagacgatgcaatccacgttctccgcaaccacgccgttggaccatctacctccctgccggccggccacagcgatatccattcccttctgggtccctcacataatgcccctatcggcagcctcaattctaactacggaggcagttccctggtagcctctagtagaagcgcctccatggtagggactcacagggaggatagtgttagccttaacgggaatcactctgttttgagttcaacagtgacaaccagcagcactgatctaaatcataaaacgcaagagaactatagggggggtctgcagtcacagtccggaacggtggtgaccacagaaatcaagactgagaataaagagaaagatgaaaatcttcatgagcctccttccagcgacgacatgaaaagtgatgatgaatcttctcagaaggacataaaagtaagcagccgcggcaggacctccagtacaaatgaggacgaggatctcaacccagaacagaagattgagagggaaaaagaacggcggatggccaataacgcccgcgagcgactccgggttcgcgacatcaacgaagcctttaaggagttggggcgcatgtgccagcttcacttaaaatccgagaaacctcaaacaaagttattgattctacaccaggctgttgcagtaatcctttctctggaacaacaagtgagggaaagaaatttgaaccccaaggccgcgtgtctgaaacgaagagaagaagagaaggtcagtgccgtgtctgctgaacctcccacaactctccccgggacacatccaggtctcagcgaaactacaaacccaatgggccatatgtag

SEQ ID NO: 138163 - DNA, 1020 bp, Artificial Sequence
  Description of Artificial Sequence: Synthetic coding sequence
atgagtagcaattcatccacatctcagtggcctcggcccggcggccaggccccctcttcaccgagctacgaaaatagccttcattccctgaaaaatcgggtggaacagcagctccacgagcatctgcaagacgcaatgagtttcctgaaagacgtctgcgagcagtcaagaatggaggacaggttggataggttagacgatgctattcacgtgctgaggaaccacgcagtgggcccatcgacttctctccctgcagggcacagtgacatacactctctgctcggcccttcacataatgcccctatcggatcattgaacagtaattacggagggagcagcctggttgcaagctccagaagcgccagcatggtcggtacacaccgggaggactccgtttctttgaatggaaaccacagtgtgctatcctctaccgtgaccactagctccaccgatctgaaccataaaacccaggaaaattatcggggcggacttcagtctcagtcaggaacggtggtaacaacagaaatcaagacagagaataaagaaaaggacgaaaacctgcacgagccaccctcttcagatgacatgaaatctgacgacgagtcaagtcagaaagacatcaaagtctccagccggggccggacaagcactaatgaggatgaggacctaaatcccgagcagaagattgaacgggaaaaagaacgtcgcatggccaacaacgcaagggagaggctgcgggttcgcgacattaatgaggcattcaaagaactgggtcggatgtgccagctgcatctcaagtcggagaagccccagaccaaactgttgatcctgcaccaggccgtggcagtgattttgtctctcgaacagcaagtcagggagcgcaacctaaaccctaaggctgcatgtttgaagcggcgcgaagaggaaaaagtctctgccgttagcgcagaaccacccaccaccctaccagggacccacccaggtctgagcgagacaaccaaccccatgggccacatgtag

SEQ ID NO: 138164 - DNA, 1341 bp, Artificial Sequence
  Description of Artificial Sequence: Synthetic coding sequence
atgggaaagcgctatatgcatcatccccagatccaaatgataagcacagtgaaccttttggttatacacttgctctcacaccagccggtctgttcacttgccctgtccctgtgcaagagctatcctcctcactctgtgtctccgacagacatcaacacctcactcccgccgatgtcaagtttccatcggggcagcacatcaagcagtccctatgtcgccgcctcccacaccccgcccattaacggatctgatagtatacttggcacaaggggcaacgctgcagggtcatcccagacgggggacgctctggggaaggctctggcatcaatttactcccccgatcacacatcatccagttttccctcaaatccatccactccagttgggagtccaagcccattgaccggtacgtcccagtggccccggccaggagggcaggcgccaagctcaccaagctatgaaaactccctccactccctgcagagcagaatggaagaccgcctcgaccgcctggatgatgcgattcacgtgctgcgaaatcatgccgttggacccagcacaagcctgcctgcaggccacagcgacatccactctttacttggccctagccataacgcgcccattggatctctgaactccaactatggcggcagctccctcgtcgcctcatcccggagtgcttcgatggtgggcacccatcgcgaggacagtgtttccctcaacgggaaccacagcgttctttccagcacggtaactacctcttctacagacttgaatcataaaactcaggaaaactataggggtggccttcagtcccagtctggtacagtcgtgactaccgagattaaaactgagaataaggaaaaggacgaaaatctgcatgaaccaccttcatctgatgatatgaagagtgacgacgaatcaagtcaaaaagacattaaggtctctagtcggggcaggacatcctctactaatgaagatgaagatctgaatcctgagcagaagatcgagagggagaaggaaaggagaatggcgaataatgcccgtgagcgcctcagggtgcgagacattaacgaggccttcaaggagctgggacgaatgtgccagttacaccttaagtccgaaaagccccagactaagcttctcatcctgcaccaggctgtcgctgtgatcctgtctctggaacagcaggtcagggagcgcaacttaaacccaaaggctgcgtgcttgaaacggcgcgaggaggagaaggtatccgccgtctctgcggaaccccccactaccctgcctggtactcaccctggtctgtccgaaaccacaaatccaatggggcatatgtag

SEQ ID NO: 138165 - DNA, 1539 bp, Artificial Sequence
  Description of Artificial Sequence: Synthetic coding sequence
atgtactgcgcataccctgtcccaggcatgggctctaacagcctaatgtattactacaatggaaagaccgtttacgcgccatcccccaactccgatgatttcaatcgggaaagcccatcctacccctctccaaaaccgcccacaagtatgtttgcgtcaacctttttcatgcaggacgggacccataactcttccgacctgtggagtagctcgaacggaatgagccagcccggattcggcggtatcctgggcacctcaaccagtcacatgtcccagtctagtagctacgggaacctccattctcatgatcgcctgagctatccaccacattccgtgagcccaacagatattaacacttctctgcctcccatgtccagcttccatcgtggaagtaccagtagctccccctatgtggcagcttctcacaccccaccaatcaacggtagcgatagcattctgggcacccggggcaatgctgccggatccagtcagaccggggacgccctcggaaaagccctggcgtcaatctactctcctgatcacacttcgtcaagttttccaagcaacccttccacccccgtgggtagccctagtccactgaccgggacctcccagtggccccgacccgggggacaggcgcccagcagcccctcatatgagaattcactgcactccctgcagtcccgtatggaggatcgccttgaccgactcgatgacgccatacacgtgttgcgaaaccatgccgtcgggccttccacctctctccccgctggccactctgatattcatagcttactcggaccctcccataatgccccaattggatcccttaattctaactacggcgggagttcgcttgtggccagtagccgctcagcaagcatggtcggcacacacagagaggatagtgtctcgctaaatggtaatcatagcgtcctgtcttctacggtcacaacttcttctacggatttgaaccataaaacccaagagaattaccggggtgggttgcagagtcaatcggggaccgtggtaaccaccgaaattaagaccgagaacaaagaaaaggacgagaacttgcatgaacccccaagttctgatgatatgaaatctgatgatgagtcttcacagaaggacatcaaagtgagctcgcgggggagaacgagcagcaccaatgaagacgaggatcttaatccagaacagaaaatcgagagggagaaagagcggagaatggcaaacaacgcgcgggagcgtctccgggtgcgagatattaatgaggctttcaaagagcttgggcgaatgtgccagctgcatctcaagtccgagaagccccagacgaaattgcttattctccaccaggccgtggcggtaattttgtctctggagcagcaggtccgcgaaagaaaccttaaccccaaggccgcctgcttaaagcgaagggaggaagagaaagtgagtgcggtctccgccgagccccctaccacattgcccgggacacatcctggcctctccgaaacaacaaaccctatggggcatatgtag

SEQ ID NO: 138166 - DNA, 600 bp, Artificial Sequence
  Description of Artificial Sequence: Synthetic coding sequence
atggcttttgctctgctccgaccggttggggcccatgtgctctatcccgacgtgaggctgttgtcggaggatgaagagaatcgctctgagtccgacgcaagcgaccaatcctttggctgttgcgaaggccccgaggccgctcgcagaggcccagggccagggggcggccgtagggccggtggtgggggaggtgctggccccgtagttgttgtgagacagagacaggcggccaacgcacgggagcgggataggacccagtcagttaacacggcgttcacagccctccggaccctcatcccgactgagccagttgaccggaagctctcaaagattgagacagtgagattggcttcctcgtatattgcccacctggccaacgtcctgttactgggcgattccgccgatgatgggcaaccatgcttcagggccgcaggcagtgccaaaggggcagtgcccgcggctgccgacggcggccgccagccgcgttctatctgcaccttctgcctgagcaatcaaagaaaagggggcggacgccgggatcttggaggcagttgccttaaggtccggggagtcgcaccactgagggggccccgcaggtag

SEQ ID NO: 138167 - DNA, 1038 bp, Artificial Sequence
  Description of Artificial Sequence: Synthetic coding sequence
atgctgccctgtttccaattactgaggatcgggggagggcgcggaggggacttgtataccttccaccctcccgcgggcgcaggatgcacttatcgactgggtcaccgggcagatttatgtgacgtcgccctgcggcctcagcaggagccaggcctcatctccggtattcatgctgaactgcacgctgagcctcgtggagatgactggcgtgtgtctctcgaagatcacagcagccagggcacactggtgaacaacgttcgattgccccggggccaccggctggagctcagcgatggagatctgctcacgttcggccccgaggggccacccgggacatcaccttcagaattctattttatgtttcaacaggttcgggtgaagccccaagactttgccgctatcactatcccaaggagtaggggcgaggctagagtgggggcagggtttcgacccatgttgccatcgcagggggcaccccaacggccgttgtccaccttctcccctgctcctaaggccactctcatcctgaatagcataggcagtctcagtaaactccggccccagcccttgacattcagcccctcttggggcgggcctaaaagcctgccagtgcccgctccccccggtgaaatgggcaccacccctagcgcgcccccccagagaaatcgccgcaagagtgtgcaccgagtcctagccgaactggatgatgagtctgagccccccgagaatccccctccggtcttgatggaacctcgcaaaaagctcagagtggacaaagctccattaaccccaaccggtaatcgcaggggcaggccacgcaagtacccggtgtccgctcctatggccccccctgccgttggcggaggcgaaccgtgtgcagccccatgttgttgtcttccgcaggaggagacagttgcttgggtgcaatgcgacggctgtgatgtctggtttcatgtcgcctgcgttggctgttccattcaggccgcccgtgaggctgattttcgctgccctgggtgtcgagccggcattcaaacctag

SEQ ID NO: 138168 - DNA, 1038 bp, Artificial Sequence
  Description of Artificial Sequence: Synthetic coding sequence
atgctgccctgctttcagttgctgcggatagggggcgggcgcgggggcgacttatatactttccatcccccagcaggagctgggtgcacatacaggctcggacaccgggccgacttgtgcgacgttgccctccgaccacagcaagagcccgggctgatcagtggtatacacgccgagctgcatgccgagccaagaggcgacgattggcgcgtctcattagaagaccactctagccagggcactctggtgaataatgtgcgattgccccgagggcatcgtcttgaactgtcggacggtgacctcttaacattcggtccggagggccctcctggaacttcgccgtcggaattctacttcatgtttcagcaggtgcgcgtgaaaccacaagacttcgcagcaataaccatccctcgctcccgtggcgaagctagggtcggagctggtttcaggcctatgctcccatcacagggggcaccacagagaccattaagcaccttcagcccagcaccaaaagccacactgattctgaactccatcggtagtctgtcgaagctcaggccccagcctcttacgttcagccccagctggggaggtcctaaatccctgccagttccagcacctcccggcgagatgggaaccacccccagcgccccccctcagagaaatcgcaggaaaagcgtgcaccgagtgctcgctgagttggacgacgaaagcgagccacctgagaaccctcctcctgtgctgatggagccgcggaaaaagttgagagtcgacaaagcgccccttacgcctacggggaatagaaggggccgcccccgcaagtaccccgtatctgccccaatggcgccacctgccgtcggagggggggagccttgcgccgctccatgttgttgcctgccccaggaagaaactgtggcctgggtacagtgcgacggctgcgacgtgtggtttcacgtggcatgcgtggggtgttctatccaagccgcacgcgaagccgatttcagatgccctgggtgtagagcaggaatccagacgtag

SEQ ID NO: 138169 - DNA, 1038 bp, Artificial Sequence
  Description of Artificial Sequence: Synthetic coding sequence
atgctgccatgcttccaactgctccgcatagggggagggagaggaggggatctgtacacgttccaccctcccgccggcgctgggtgcacgtacaggctgggtcatcgggccgatctctgtgacgtggccttgagaccacagcaagaacctggtttaatctccgggattcatgctgaattgcacgctgagcccagaggggacgattggagggtaagcctcgaggaccactccagccaaggaacactggtgaacaatgttcgattgccccgagggcacaggctggaattaagcgatggcgatctgttgaccttcggaccagaaggaccaccgggtaccagcccctccgaattctacttcatgtttcagcaagtcagagtgaaacctcaggactttgcagctatcacaattccccgctctagaggggaggcgcgggtgggagccgggttcagaccaatgcttccctctcagggcgcgccccagcgcccactgagcacctttagtccggcccctaaagcgaccctgattcttaactcaattgggagcctttcgaagctgaggccgcagccactcactttctccccatcttggggaggccccaagagcctacccgtcccagcgcctcctggggaagttggaaccaccccatctgcgccaccccagaggaacagacgtaagtcagtgcatcgcgtgttggccgagctggacgacgagtccgagccgccagaaaaccctcctccggtcctcatggaaccgcgcaaaaaactacgcgtagataaagcaccactgaccccaactggaaaccgccggggcagacccaggaaatatcccgtctctgcccctatggccccgcccgccgtggggggaggcgagccttgtgccgccccatgttgttgtcttcctcaggaggagaccgtggcctgggtccaatgcgacggatgtgatgtgtggttccacgtcgcttgcgttggttgcagtattcaggccgctagagaagctgatttccgatgccctggctgtagggcagggatccagacatag

SEQ ID NO: 138170 - DNA, 1038 bp, Artificial Sequence
  Description of Artificial Sequence: Synthetic coding sequence
atgcttccgtgctttcagcttctccggattggcggtggacgcgggggcgacttatacactttccatcctccggctggggccggctgcacctaccggttaggccatagagccgatctttgtgatgttgccctgcgcccccagcaggaacccgggcttatctctgggatccacgcggagttgcatgcagagcctcggggcgacgattggagagtgtcccttgaagatcattcctcccaaggaacactggttaacaacgttcgcctcccacggggacatcggctggagctgagtgatggggacctgctgacttttggcccggagggaccaccgggcactagcccctccgaattttacttcatgttccagcaggtcagagtcaaaccccaggacttcgctgcaattactataccaaggtctagaggcgaagctagggtcggagctggattccgcccgatgctcccttcacaaggcgcacctcagcggcccctctccacgttctccccggcccccaaggccactctcattttgaactccataggatctctttcaaaactccgtcctcagccactgacattttccccaagttggggtggtcctaagtcactgccagtgcctgcaccacctggagaagtgggcaccactccctcagcacccccccaaaggaacaggcgtaagtctgtacacagggtgctggcagagttggatgacgagtcagagcccccagaaaaccccccacctgtcctaatggagccgcgtaaaaagttgcgcgtggacaaggcccccctgacccctaccggcaatcgtcggggcagacctaggaaatacccagtgtcagcccccatggccccccctgcagtggggggcggcgaaccgtgcgctgctccttgttgttgtctcccgcaggaagagaccgtcgcctgggttcagtgcgatgggtgcgacgtctggtttcacgtggcctgcgttggttgtagtatccaggccgccagagaagctgatttccggtgtccagggtgccgggcaggcatccaaacctag

SEQ ID NO: 138171 - DNA, 1038 bp, Artificial Sequence
  Description of Artificial Sequence: Synthetic coding sequence
atgctaccttgttttcaacttctgcggatcggcggcggcagagggggtgacctctatacctttcacccaccggcaggagccggatgcacgtaccggcttgggcatcgcgctgacctttgtgatgtggccctaaggcctcagcaagagcctgggctgattagtggcatccacgcagagttgcacgccgagcctagaggggacgactggcgcgtctcattagaagatcactccagccaaggaactttagtcaataatgtaagattgcccagggggcatcgtctcgaactttcagatggcgacctgctaactttcggccctgaaggccctcctggtacgtcacccagcgagttctactttatgttccagcaagtgcgtgtcaaacctcaggacttcgccgccatcacaatcccaaggtctaggggcgaggcccgcgtgggagccggctttcggcccatgctcccatcacaaggggcgccacagcggcctctgtcaacgtttagccccgccccaaaagccactttgatcttaaattctatcggctcacttagtaagttgcgaccccagcctttgacattttctccttcctggggtggacctaaatcgcttcctgtgcctgctccacctggcgaggtgggaactaccccttctgctcccccccaacgcaaccgaagaaagagcgttcatcgagtcctggcagaactagacgacgagagcgaacccccagagaatccgccacccgtgcttatggaaccacggaagaagcttagagtcgataaagctcccctgacccctaccggtaatcgacgggggcgaccacgcaaatacccagtgtcagccccaatggctccaccagctgtgggcggtggagagccttgtgccgcaccatgttgctgtctgccccaggaggagactgtcgcatgggtgcaatgcgacggatgcgatgtttggttccatgtggcttgtgtcgggtgcagcatacaggccgcccgggaggccgactttcgctgcccaggctgtcgagccggaatccagacctag

SEQ ID NO: 138172 - DNA, 1038 bp, Artificial Sequence
  Description of Artificial Sequence: Synthetic coding sequence
atgctgccatgcttccagctgctccgtatcggaggaggacgcggcggtgacttatatacgttccatcctcccgccggagccggctgcacctaccggctaggccatagagcggacttgtgcgatgttgctctgagaccacagcaagaacccggactgatttcaggaatccatgccgagctgcatgctgagcctagaggagatgactggcgtgttagcctcgaagatcacagcagtcagggcacattggttaataatgtgcgcctcccccggggacatagactcgagttaagcgatggcgatctgctcaccttcggcccggagggccctccagggacgagtcccagcgaattctacttcatgtttcagcaggtgcgggtgaaaccacaggattttgctgccattacaattcctaggtctcgtggggaggcgagagtcggggctggatttaggcctatgcttccctcccagggggccccacagcgacctctgagcacattctcgccagcacctaaggctacacttatccttaactctataggaagcctcagcaagctgaggcctcagccccttaccttcagccctagctggggggggcccaaaagtctgccagtccctgctcctcctggagaagtggggacgacacccagcgcacccccccagaggaatcgcaggaagtctgtacaccgggttttagcagaactcgacgacgagagtgaacctcccgaaaatccaccccctgtacttatggaaccgcggaagaagctgagggtggataaggcaccgctgacccccacggggaatagacgcggcagacctaggaaatatcctgtgtctgcccccatggcccctccagccgtcggaggcggagaaccatgtgcagccccctgctgctgtcttccgcaggaagaaactgttgcatgggtgcagtgtgatggctgtgacgtttggttccatgtcgcctgtgtgggatgcagtatacaggcagctcgggaggctgacttcaggtgcccggggtgccgcgctggaatccagacttag

SEQ ID NO: 138173 - DNA, 1038 bp, Artificial Sequence
  Description of Artificial Sequence: Synthetic coding sequence
atgcttccctgcttccagctactgcgaatcggcggcggccgtggcggggatctctatacttttcacccgccagccggagcagggtgcacttaccgactggggcatagggcggatttatgcgacgttgccctccggccccagcaggagccaggtctcatctctggtattcacgcagaattgcatgcagagcctaggggcgacgactggcgggtgtcgctcgaagatcattcatcacagggtaccctggtgaataatgtacggttgccacgcggacaccggctggaactgagcgatggtgatctgttgacttttgggccggagggaccgccagggaccagcccatcagagttttactttatgtttcagcaagtgcgagtgaaaccccaggacttcgccgctattacaattcctcgctcccgaggagaggcaagagtgggggctggtttccgcccaatgctacccagtcagggagcgccgcagcgcccccttagtaccttctcccctgcacccaaggccacgctgattctgaatagcatcggttcgctgtcaaagctgcggccccagccactgaccttctctccgtcctgggggggacccaaaagccttccggtacctgcacctccgggcgaggtcggaactaccccttctgccccgccacagcggaatcgtagaaagtctgtccaccgcgttctggccgagctggacgatgaaagcgagccaccggaaaatccaccacctgtgctgatggagccaagaaaaaagctccgcgtggataaggcgccccttaccccaacgggcaataggagaggcaggcctaggaaatacccagttagcgcaccaatggccccgccagctgtagggggaggagaaccttgtgccgccccgtgctgctgtttaccgcaggaagagaccgttgcttgggtgcaatgcgacggatgcgacgtgtggttccacgtcgcctgcgtcggatgttcaatccaagcagcccgggaagctgattttagatgccctggttgccgggccggcatccagacttag

SEQ ID NO: 138174 - DNA, 1038 bp, Artificial Sequence
  Description of Artificial Sequence: Synthetic coding sequence
atgctcccatgcttccaactccttaggattgggggagggcgcgggggagatctgtatacgtttcatccacctgccggcgccgggtgcacgtatcgtctggggcatcgcgctgacctttgtgacgtggcgctgcggcctcagcaagagccgggccttattagcgggattcatgccgagcttcacgccgagccgaggggggacgactggcgggtgagtttagaggatcactctagtcagggcacactggtgaataatgttcgattacctcgcggacaccgcctggaactgtctgacggcgacttgctcacatttggaccagaggggagcccgggcactagtccttccgaattctattttatgtttcaacaagtaagggtgaagccgcaggattttgcagccatcactatccctaggtctagaggagaagcccgagtcggcgctggttttcgccctatgctgccctcccaaggcgctccacaaaggccgctgtcaactttctcacccgcccctaaggccacactgatcctgaacagcatcggctccctttccaaattgcgcccacagcctctgacgttttcaccgtcctggggtggtccaaagagcctgccggtgccagctcctcccggtgaggtggggacaactccatctgccccccctcagcgcaatcgtaggaagagtgtccaccgagtgctggcggagctggatgatgagagcgagcctcctgaaaacccacctcctgttctcatggagcctcgcaaaaaattgagagttgacaaggctccgctgacacccaccgggaataggcgaggtcgcccaaggaaataccccgtcagtgctccaatggcgcctccagcagtagggggcggtgaaccgtgtgcggccccttgctgctgtctgccgcaagaggaaaccgttgcttgggtacagtgcgatggctgtgacgtttggttccatgtggcttgtgtgggttgttccatccaggcagctagggaagccgacttccgctgtcccggatgtagagctggcatccaaacctag

SEQ ID NO: 138175 - DNA, 1038 bp, Artificial Sequence
  Description of Artificial Sequence: Synthetic coding sequence
atgctgccctgtttccaactcctgcgaataggtgggggcaggggcggggacctgtatacctttcatccacctgcgggggccgggtgtacctatcgcttgggtcacagggctgatctgtgcgacgtagctctgcgaccccaacaggaacctggccttatatccggtattcacgccgagctgcatgctgagccgagaggggatgactggagagtaagcctggaggatcattcctctcagggtacccttgtcaataacgtgagactgccaaggggacacaggctcgagctgtcagacggcgatctcctcaccttcggacccgaaggcccgccagggacatctccaagtgagttttattttatgtttcagcaggtgcgggtgaaaccacaagattttgcagccatcactattccacgcagtaggggcgaagcacgggtgggggcgggatttaggcctatgctgccctctcagggagcgccccagcgccctctgtcaaccttctcacctgcccctaaggcaacccttatcttaaactccattggcagcctgagcaagttgagaccccagcctctcacattcagtcctagttggggtggccctaaaagtctaccggtgcctgcaccccctggagaggtcggcacaacaccctccgctcctccccaaagaaaccgtcggaaatccgtccaccgggttctggcagaattggacgatgagtcggaaccccccgagaaccccccaccagtgctgatggagcctcgcaagaagctgcgcgtggacaaagcgccactcacccccacgggaaacagacgcgggcggcctagaaagtaccccgtatccgctccaatggcaccgcccgccgtcggcggaggagaaccatgcgccgcaccctgttgttgtttgccccaggaggaaactgttgcctgggtacagtgtgatgggtgtgatgtgtggttccatgttgcttgtgttggctgctccatccaggccgcccgtgaagccgacttcaggtgtcccggatgtcgcgcagggattcagacttag

SEQ ID NO: 138176 - DNA, 1038 bp, Artificial Sequence
  Description of Artificial Sequence: Synthetic coding sequence
atgctcccctgttttcagctgctgcggattggtggtggtcgagggggggacctctacacattccacccccccgccggcgccggctgcacatataggttgggtcatagagcagatctctgtgacgttgcactgagacctcagcaagaaccaggcttaatctccggcattcacgccgagcttcatgctgaaccgagaggggatgactggagagtctcactcgaggaccactcctcacagggaacactcgtcaacaacgtcagactgcctaggggccatcgtctggagttatcagacggcgaccttctgactttcggacccgaaggccccccaggaacaagcccaagcgagttctatttcatgtttcaacaggtgagggtcaaaccccaggattttgcagcgatcaccatcccccgctctcgtggggaggcccgggttggcgccggctttagaccaatgctgccctcccagggggccccccagcggccgttgtccacatttagccctgctcccaaagccacgctgatactcaattccatagggtccttgagtaaactgcgccctcaacccctcacttttagccccagttggggtggacccaagagcctgcccgtgcctgcccctcctggagaggtcggaacgacacctagtgcccctccgcaacggaatagaaggaagagcgtgcacagagtgctcgctgaactggatgacgaatccgagccacctgaaaacccacccccagtgctcatggagcccagaaaaaagcttagggtcgacaaggccccacttacacctacagggaataggcggggccgtcccaggaaatacccggtgtccgccccgatggcaccgcctgctgtgggcggcggtgagccctgtgcagccccttgctgctgccttccccaagaagaaactgtggcttgggttcagtgtgacggctgcgatgtgtggttccacgttgcctgtgtgggctgttctattcaggccgcccgcgaggctgatttccgctgccctggctgccgggctggcattcaaacatag

SEQ ID NO: 138177 - DNA, 1038 bp, Artificial Sequence
  Description of Artificial Sequence: Synthetic coding sequence
atgctgccatgttttcaactgttgcgcataggaggcgggcgcgggggagatctgtatacgtttcatccccccgctggcgctggctgtacgtataggctgggacatcgcgctgacttgtgtgatgtagcccttaggccccaacaggagccaggcctgatcagcggcatccacgccgaactgcacgcggaacccaggggcgacgactggcgagtgagtctggaagaccattcctcccagggcacattggtaaataatgtgagactcccaagaggacacagattagaactgagcgacggggacctgctgactttcggaccagagggtccccctggtacctctccttcagagttttatttcatgtttcagcaggttcgcgtgaaaccacaggacttcgccgccataaccatccctagaagccggggagaagcgagagtgggggctgggtttagacctatgctgccctcccaaggtgctcctcagcggcctttgtcaaccttcagtccagcgcctaaggctactcttatcctgaattccattgggtcactaagcaaattgcggccacagcccctgaccttctcacctagctggggcggacccaaatccttgcctgttccagcccccccaggagaggtagggaccactccatccgcaccaccccagcgcaatcggaggaaatcggtgcaccgtgtgctcgctgagctggacgatgagtcagagcctcccgaaaatcctcctcctgtattgatggagccgcggaaaaaactgcgcgtggacaaagcccctctgactcccaccggaaatagacgaggcaggccgcggaagtatcccgtatccgctcccatggcgcccccagccgtggggggaggggaaccctgcgccgcaccttgctgctgtttaccacaggaagagactgtggcatgggtgcagtgcgacggttgcgatgtgtggttccacgttgcatgcgtgggctgcagtattcaagcagccagggaagctgactttcgctgcccagggtgtagggctggcatccaaacgtag

SEQ ID NO: 138178 - DNA, 1038 bp, Artificial Sequence
  Description of Artificial Sequence: Synthetic coding sequence
atgctcccatgcttccagctgttgcgaattggaggtgggcgcggcggggatctttacacttttcaccctcccgcgggagccggatgcacctatcgactcggccacagagccgatctctgcgatgtggctctgcgacctcagcaagaacccgggctcatcagcggcattcatgcggagctgcatgccgagcccaggggtgatgactggagggtctctttggaggaccattcaagccagggcacactcgtcaataatgtgcgcttgcctaggggacaccggcttgagctaagtgacggtgacctgcttacatttggccccgagggtcccccaggtacctccccttcagagttttacttcatgtttcaacaagtgcgggtcaaaccacaagatttcgcagccatcacgattccgaggagtaggggggaggctcgcgtcggggctggtttcagaccaatgctaccatcccagggagcgccccagcggcctctgagcacatttagccccgctccaaaagcaacacttattctgaattccattgggagcctatccaaacttaggccacagcccctcacgttcagtccttcttgggggggccccaaaagcctgccggtgcccgcccccccaggagaagtgggaactacaccaagtgcccccccccagcgcaatagaagaaaatcagtacaccgtgtactcgcagagctcgacgatgaatccgagccaccagaaaaccctccacctgtcctgatggagccccgcaaaaaactcagagtggataaggcgccactgaccccgaccgggaatcgacgcggcagaccgcggaaatacccagtgtccgccccaatggcacccccagcggtagggggtggagagccctgtgctgccccctgttgctgcctgcctcaggaagaaacagttgcctgggttcagtgtgacgggtgcgacgtctggttccacgttgcgtgcgttggatgcagcattcaggctgccagggaggccgattttaggtgcccaggttgccgcgcgggcatccagacctag

SEQ ID NO: 138179 - DNA, 1038 bp, Artificial Sequence
  Description of Artificial Sequence: Synthetic coding sequence
atgctgccttgttttcaactccttaggatcggaggaggaagagggggagatctgtacacttttcaccctcccgcaggagcagggtgtacttatcggttgggccaccgggcggacctgtgtgatgtggctctgagaccacagcaagaacccggtttgattagcggcatacacgccgagttgcacgctgaaccaaggggagacgactggcgcgtaagtctggaggaccactcttcacaagggacactggtaaataatgtgcggctgccacgcgggcatcgactggagctgtccgacggggatcttctgacttttggtcccgagggccccccaggcacctccccaagcgagttttatttcatgttccagcaagttcgggtcaagcctcaggacttcgccgccataactatccctaggtctcgcggcgaggcgagggtcggtgcagggttccgccctatgctgccgagccaaggggcgcctcagagacccttgtctacgttctcccccgcacccaaagctactctgatcttgaacagtataggatctctgtccaagctgaggccccagcctctgactttttctcctagttggggaggccccaagtccctgcccgtgcctgcgcctccaggcgaagtcggaaccaccccaagcgccccaccacagcgcaataggcgcaagtctgtgcaccgagtgctggcggagctcgacgacgaaagtgagccacccgagaatccccctcccgttcttatggaacctagaaaaaagctacgcgtggacaaagctcctctgaccccaacagggaaccgacgtggacgtcctaggaagtaccctgtgtctgcacctatggctccccctgcagtggggggaggggagccgtgtgcggccccttgttgttgtctgccccaggaagaaacagtcgcctgggtgcaatgcgatggctgtgacgtgtggtttcacgtggcttgtgttggttgtagtatccaggcagccagggaggcagacttccggtgtcccggatgtagagcaggtatccagacctag

SEQ ID NO: 138180 - DNA, 1038 bp, Artificial Sequence
  Description of Artificial Sequence: Synthetic coding sequence
atgctgccttgcttccaactcctgaggataggcggaggccgtggaggggatctatatacgtttcacccccccgccggggcaggatgtacctatagattggggcaccgcgccgacctgtgcgacgtcgccctgcgaccgcaacaggaacccggtctcatttccgggattcacgctgagctgcatgctgagccgcgcggcgatgattggcgagttagccttgaggatcattcaagccaggggacattagtgaacaatgtccgtttgcctcgtggccaccggctggaactgtcagacggagacttgctcacattcggcccagaaggatctcccggcacctcaccctctgaattctactttatgttccaacaggtgcgcgtgaagccacaggattttgcggccatcaccatacctagatctcgtggggaggctcgcgtcggggccggctttcgtccaatgttgccaagtcaaggagcaccccaaagacctctgtctaccttcagccctgcccccaaagccacactgatcctgaatagtatcggctctttgtctaagctgcgcccccagcctttaaccttctcgcctagctggggtggacccaaaagtctgcccgtgccagcaccgcctggtgaagttggtactacaccctcagctcctcctcagcgcaatagaagaaagagtgtgcaccgagtgcttgccgagctagatgatgagtctgagccgcccgaaaaccccccaccagtattgatggaacctaggaaaaagttgagagtagataaagcacctctgacccccactggcaaccgacgagggcgaccgcgcaaatatcccgtttctgccccaatggctccgcctgctgttggaggcggcgagccatgtgccgccccatgctgctgcctgcctcaggaagagacagtggcctgggttcagtgcgacggatgcgacgtgtggtttcatgtggcctgtgttggatgctcaatccaggcagcaagagaagctgatttccgttgtcccggctgtcgtgccgggatccagacctag

SEQ ID NO: 138181 - DNA, 654 bp, Artificial Sequence
  Description of Artificial Sequence: Synthetic coding sequence
acacttgtcaataacgtcagactgcctaggggccataggcttgagctttctgatggagacctgctgacttttggcccagaagggccccccggcactagcccaagcgagttctacttcatgtttcaacaggtgagagttaagccccaagattttgcggccataacaatccctcggagcaggggcgaggcacgagtcggcgctggattccggcccatgctaccctcacagggagcgccgcagcggccgttgagcaccttttcaccagcacccaaggccacacttattttgaactcaataggaagcctaagcaagctgcgacctcagcctctcactttctcaccgagctggggcggacccaagagtctgccagtgccagctcctccaggcgaaatgggtacgaccccatccgccccccctcaaaggaaccgccggaagagcgtgcacagggtgttagctgagttggacgatgagagtgagccaccggagaaccctccacctgtgttaatggaacccaggaagaagcttcgagtcgataaagcccctctgacaccaaccggtaactggcacattcaaggcatgcaatccatagtgaagggacaaaaggaaagaccctggcctcgtgaacacctcagcgggtatgaggaggcttcttag

SEQ ID NO: 138182 - DNA, 645 bp, Artificial Sequence
  Description of Artificial Sequence: Synthetic coding sequence
atgtcacagcgcaaggctaggggaccaccagctatgcccggcgtagggcactcacagacacaagctaaggcacgactgctcccaggggcggaccggaagcgcagtagattgtcccgtacccgccaggacccttgggaagaaaggagctggagcaatcagaggtggagtagggcgacaccagggcctcgcggcacccgcgcgggaggcctggctctgggacggtcagaagcatctcctgagaatgccgcgcgtgaacgctcacgggtgcgaaccctacggcaggcctttcttgccctccaggccgcccttccagcagtcccaccagacactaagttatctaaactggacgttctggtgctcgccgcttcttacatcgcacatctgaccaggacacttggtcatgaactgccaggccctgcttggcccccctttctgagagggttaaggtacttacaccctctgaagaaatggccaatgcggtctcgtctgtacgccggggggctggggtacagtgacctcgattctacaacagcttcgacgcccagtcaaaggacacgggatgcagaagtgggatcccaggtgcccggggaggctgacgcactcctttccactacaccgctcagcccagcgctgggggacaagtag

SEQ ID NO: 138183 - DNA, 2031 bp, Artificial Sequence
  Description of Artificial Sequence: Synthetic coding sequence
atgtcccggagagctctgagaagactgcgcggcgaacagcgcggtcaagagcctttggggccaggggccctgcactttgatctgcgggacgacgacgacgcggaggaggagggccccaaacgggagctgggagttaggcgccctggaggcgcagggaaagagggggtcagggtaaataatcgattcgagcttatcaacatcgatgacttggaagacgaccctgtggtaaatggagagaggagcggctgtgctctcaccgatgctgtagcccccgggaataaaggtagaggacaacgaggtaacacagaatcaaagaccgatggagacgacactgagacagtgccttccgaacagtcccatgcatcaggaaaactccgaaaaaaaaagaagaagcagaaaaacaaaaaatcttctaccggagaggccagcgagaacggtcttgaggacatcgaccggatccttgaaagaatagaggattcaactggccttaataggccaggccccgcaccactgtcgtcacggaaacacgtgctgtacgtggagcatcgtcatctcaacccggacactgaacttaaacggtatttcggggcgcgagccatactcggggaacaacgccccagacagcggcagcgggtgtacccaaagtgcacatggcttacgacaccaaagagcacttggcctagatactcaaaacccgggctatcgatgagactattggaaagcaagaagggactaagcttcttcgctttcgaacattctgaagaataccagcaagcccaacacaaattcctggttgccgttgagtcaatggagccaaataacatcgtggttctgctgcagaccagcccctaccacgttgactcactgcttcagttgagcgacgcgtgccgcttccaggaggaccaggagatggcgagggatctcgtagaacgggctctatactcaatggagtgcgccttccaccctcttttctctctcaccagcggcgcctgtagattagactaccgacgcccagagaacaggtccttttatctggctttatataagcagatgtccttcctcgaaaagcgagggtgccctcgcactgctctcgaatattgcaagctcatattgagtcttgaacccgacgaggatccactgtgcatgctccttctgatcgaccacttggctctgagggcccggaattatgagtaccttatacgactctttcaggaatgggaggcgcataggaatctgtctcagctgcctaactttgcatttagcgtgcctttggcctactttctcctctcccagcaaaccgacctacccgagtgcgaacaatcctcggccaggcagaaagcatcactgctgatccagcaggctctcacaatgttccccggcgtcctgttgcccctgttagagtcatgttccgtgcgcccagacgcctcggtctcttcgcataggttttttgggcccaacgctgagatctcacagccccccgcactgtctcagctcgtcaacctatacctaggaagaagccattttctctggaaagagcctgccactatgagctggttagaggagaacgtgcatgaagtcttgcaagctgttgatgccggagaccccgccgtcgaggcctgtgaaaacaggcggaaagtgctgtatcaaagagccccgcgaaacattcacagacacgtgatcttgtctgagatcaaggaagccgtcgcggcactccccccagatgtgacaactcagagcgtgatggggttcgacccactccccccctctgatacaatatattcatacgttcgacccgagagactcagcccaatctctcacggtaatacaatagcgctgttctttagatctctcctcccgaactacacaatggaaggggaaagacccgaggagggcgtggcaggcggactgaaccgcaatcagggcctgaatcgattgatgttggccgttcgcgacatgatggcaaactttcacctaaatgacctggaggccccccacgaagacgatgctgagggggaaggcgagtgggattag

SEQ ID NO: 138184 - DNA, 1422 bp, Artificial Sequence
  Description of Artificial Sequence: Synthetic coding sequence
atgagactactggaatccaaaaaagggttgtcctttttcgctttcgaacacagcgaagagtatcagcaggctcagcataagtttcttgtcgccgtggagagcatggagccgaacaacattgttgtgctccttcagactagtccttatcacgtggacagtctactccagttgtcagacgcatgccgtttccaggaagaccaggaaatggccagggaccttgtggagcgggccctgtattctatggagtgcgccttccacccgctattcagtcttacctctggagcctgtcgtctcgactaccgcagaccagaaaacagaagcttttatctggccctgtataaacaaatgtcctttcttgagaagagggggtgtccacgcaccgctttggagtactgtaaattaattttgtcccttgagccagatgaggatcctctctgcatgctgctgctcattgaccatcttgccctccgtgccaggaattacgagtatcttatcagactgtttcaagaatgggaagcacatcggaacctgtcgcagcttccaaatttcgcgttttcggtccccctggcctactttctgctgtctcagcagacagatttacccgagtgcgaacaatcatcagcccggcagaaggcgtctttgctaatccagcaggcccttaccatgtttcctggtgttctgttacccctcctggagtcatgtagtgttcgccccgacgctagtgtgagttcccatcgctttttcggacctaacgccgagattagccagccccccgccctatcacaactcgtgaatctctatctggggcgctcccatttcttgtggaaggagcccgccactatgtcgtggcttgaagagaacgtccacgaggtactacaggcggtcgatgcaggggatcctgctgtggaagcctgtgagaatcgacggaaggtgctgtatcagcgggcgccccggaatatacaccgacacgtgatactgtcagagattaaggaggctgtggccgccttaccacccgatgtgaccacgcagagcgttatgggctttgacccgcttccgccttccgataccatttactcatacgtccggcctgaaaggaaaggggaggaagaaaggaactccgtcatttggggtagccagttatgtgtctgccggccaaggagttttccgtccccccccaatgtacaggcacttgcttgccgaccgctgtggcaggcgaagtcctaccagccttggaaacaccactgtagcttgctccctgtcacggtggctaaactttatcacggtggtggggaggccaggggcaggagcgggtgggggtctgagccacagcccggccccgagcaagctgacgccggttgtgcaaggcacgatggccaactcccaccgcagcggcccggcggcgctgctcgcggtcgtcgatag

SEQ ID NO: 138185 - DNA, 651 bp, Artificial Sequence
  Description of Artificial Sequence: Synthetic coding sequence
atgagtaggagggcattgcgccgacttaggggcgaacaaagaggccaggagcccctggggcctggggctttgcattttgatctccgcgacgatgatgatgccgaagaagagggaccaaagcgcgagcttggagtgaggcgaccaggaggcgctgggaaagagggggtcagggtcaacaatagattcgaactcatcaatattgatgacctggaagacgatcccgtggtgaacggggagcgatcaggttgtgctctgaccgatgctgtggcccccggtaataagggaagaggccaacgggggaataccgaatccaaaacagacggggacgatacggagacagtcccttccgagcaaagccacgctagcgggaaactccggaagaaaaaaaagaaacagaaaaataagaagagcagcaccggcgaggccagtgaaaacggcctagaagacattgaccggatcctggaacgtatagaggatagcacggggcttaataggcccggaccagcccctctgtccagccgcaaacacgttctttatgttgaacaccggcatctgaatcccgataccgaactgaagagatactttggcgcccgggccatattgggcgaacagcgcgacagggtgctgctaggttgtcctgtctggttttag

SEQ ID NO: 138186 - DNA, 624 bp, Artificial Sequence
  Description of Artificial Sequence: Synthetic coding sequence
cttactgtgaacgcatctatgagccggtttccccctcacatggttccccctcatcacacgctgcatactactggcattccgcaccccgccatagtcactcccactgttaagcaggaatcaagccagtccgacgttggttctctgcattcatccaaacaccaagattctaaaaaggaggaggagaaaaaaaaacctcatataaagaaacctctgaacgcatttatgttgtatatgaaagagatgagggccaaggtcgtggcagaatgtacactgaaagagtcagcagccattaaccagatcttggggaggcggtggcatgctctttcaagagaggaacaggccaaatattatgaactcgcccgcaaagaaagacagctacatatgcagctgtacccaggatggagtgcgagagataattacggaaaaaagaagaagaggaagagggataaacaacctggcgagacaaacgatctatctgcaccaaagaaatgccgagcaagattcgggctggaccagcaaaataattggtgcggcccttgtagaagaaaaaagaaatgtgttcggtatattcagggcgaaggcagctgcctgtcacctccctccagcgacggctccctgttgtag

SEQ ID NO: 138187 - DNA, 669 bp, Artificial Sequence
  Description of Artificial Sequence: Synthetic coding sequence
accaatcagaacagcagcagcgacagcgaagccgagcgtcggcctccaccacggagtgagtcgtttcgcgataaatctcgtgaaagtctcgaggaggccgctaaacggcaggatggaggcctgttcaagggccccccttatcctgggtatccatttatcatgattcctgatctcacctctccctatctgcctaacggatcgctgtcccccaccgcacgcaccctgcacttccagtccggaagcacccactattctgcctacaaaactatagaacaccagatcgccgtgcagtatctccagatgaaatggccgctgttggatgtacaagctggttctctgcaatcccgacaggcactgaaggatgctagatccccaagcccagcccatatagtatcccccttgccatgctgtacccagggacacgattgccagcatttctatcctccgtctgatttcactgtcagcacccaagtgttcagggatatgaaaaggtcccacagcttacaaaaggtaggagaaccatggtgtatagaatcaaataaggtgcccgtcgtgcagcatccccatcatgtgcaccccttaacgccactcattacttactcaaatgagcatttcacccctgggaaccccccaccccacctcccggccgacgtggacccaaagacatag

SEQ ID NO: 138188 - DNA, 867 bp, Artificial Sequence
  Description of Artificial Sequence: Synthetic coding sequence
atgccacaactaaacggaggcggaggcgacgacctgggggccaacgatgagctgatatctttcaaggatgagggcgagcaagaggaaaagtcatctgaaaacagctctgctgaaagggatctggctgacgtgaaaagtagtttagtcaatgagtcagaaaccaaccagaattcttcatctgattctgaggccgaacgaagacctccacccaggagtgagtctttccgcgacaagtccagggagagccttgaagaagccgctaaacggcaggatggagggcttttcaaagggccaccttatcctggctaccctttcattatgatcccagatcttaccagtccttatctacctaacgggagtttgtccccaactgctcgcaccctgcattttcaatctgggagtacccactattccgcatacaagacaatcgaacaccagattgccgtgcaatatctgcaaatgaaatggcctttgctggatgtgcaggccggttccctgcagagccgacaagctctgaaggacgctcgcagtcccagtccggctcacattgtctctaataaggttccagtggtacagcacccccaccacgtgcaccctctgaccccgttaatcacgtactccaatgagcactttacccctggaaatccgccacctcacttgccggccgatgttgatcctaaaaccgggattcctcggcccccacacccgccagatattagcccatattatcctctgtcgccaggtactgtgggacagatcccccatcccctcggctggcaggggcaacccgtatacccaatcacgactggaggctttagacatccatatcccacagcgctgactgtgaatgcgagcatgagccgctag

SEQ ID NO: 138189 - DNA, 1380 bp, Artificial Sequence
  Description of Artificial Sequence: Synthetic coding sequence
atgcctcagttgaatggaggtggaggggatgatctgggagctaatgatgagctcatctctttcaaggatgagggtgagcaggaggagaagtcctcagaaaacagctccgcggagcgcgatttggcggatgtcaaaagctcactggtaaatgagagcgagacgaaccagaactcttcctcggactccgaggccgagaggaggccccccccccgctcggagagcttccgggataaatctcgggaaagtctcgaagaggccgctaagaggcaagacggcgggttgtttaaaggcccaccttacccaggctacccttttatcatgatccccgatttaacaagcccttatctgccaaacggttccctgagccctacagccaggacctatctgcagatgaaatggcccctcctggacgtgcaggcaggcagtctccaatctagacaggctctgaaagacgctagatctccgagtcccgcccacatcgtttcaaacaaggtgcccgtcgtgcagcatccccaccatgtccaccctctgacaccactgatcacctattccaatgagcacttcacccccgggaacccacccccccacctacctgccgatgtggacccaaaaacgggtatacctcgccctcctcacccccccgacatcagtccctattaccctcttagtcctggcacggttggtcagatccctcatcctctgggctggcttgtgccacagcaggggcagcccgtctaccccatcacaaccggcggctttcggcatccctatcctactgctctcacagtaaacgccagcatgagtcgattcccaccccacatggttccaccacatcacaccttacacacaactggtattccccatccagctatcgttactcccacagttaaacaggaaagtagccagtccgatgtcgggtccttgcacagctccaaacatcaggattctaagaaagaggaggaaaaaaagaagcctcacatcaaaaaaccattaaatgcctttatgctgtacatgaaggagatgcgggctaaggtggtagccgaatgcaccctcaaggagtctgcagctatcaaccagatcctggggcgccgctggcatgctctgtcccgggaggaacaggctaagtactacgagcttgcgagaaaagaacgccagctacatatgcagctgtaccccggatggagcgcccgcgataattacggaaagaaaaagaagagaaaacgagacaaacagcctggtgagacaaacgagcattctgagtgtttcttgaacccctgtctatcactacctcccataactgatctgtccgcacccaaaaagtgccgagccagatttgggctggaccaacagaacaactggtgtggtccttgctccttatag

SEQ ID NO: 138190 - DNA, 1470 bp, Artificial Sequence
  Description of Artificial Sequence: Synthetic coding sequence
atgcctcagctaaacggaggggggggggatgaccttggcgctaacgatgagcttatctcattcaaggatgaaggcgagcaggaagagaaatcctccgagaactcgagtgccgaacgggatctggctgacgtaaagagcagtctggtaaatgagagcgaaactaatcagaactccagtagtgacagcgaagcggagagacgccccccacctcgatcagagtctttcagggacaagagcagggaatctttggaggaagctgcgaagcgtcaggacggtggcctgtttaaaggtcctccttatccagggtatcctttcataatgatacctgacctgacctccccctatctacctaatgggtccctttcccccacagcacggacttaccttcagatgaagtggcccctgcttgacgtccaggccggatctctacagagcaggcaggctctgaaggacgcgcgctcacccagtcctgcccatatcgtcagccctctcccatgttgcacacagggccacgattgccagcatttctaccctccttccgacttcacggtgtcaacacaggtcttcagagatatgaagcggagtcacagcctgcagaaggtgggcgaaccttggtgcattgaaagtaacaaagtgccagtggttcaacacccacatcatgtgcatccacttacccctctgattacatactcaaatgagcactttacacccggaaaccccccgccacaccttcctgctgacgtagacccaaaaacaggaatccctcgccctccccaccctcccgacatctcaccatactaccccttatcccccggcaccgtgggccaaataccacaccctctgggttggcttgttccgcagcaaggccagcccgtgtatccaatcactaccggagggttcaggcacccttaccccaccgcactgactgtaaacgcctctatgtctcgatttccccctcacatggttccccctcaccacaccctgcatacgacgggaattccccacccggctatcgtcacacccacagttaagcaggagtcatcccagtcagacgtgggatcgctccacagctccaaacatcaggactcgaagaaggaagaggagaaaaaaaagccacacattaagaagccgctgaacgcctttatgctgtacatgaaagaaatgcgcgctaaggtggtggctgagtgcacattaaaagagtctgctgcgattaatcaaattctcgggaggcgctggcacgccctttctcgggaggagcaggccaagtactacgagcttgctagaaaggagcgtcagctccacatgcagctttaccccggatggtcggccagagacaactatggtaaaaaaaagaagcggaagagggataaacagccaggtgagaccaatggagagaagaagtccgcttttgcgacctacaaagtcaaagcagctgcctcggctcatcccttacagatggaagcatactag

SEQ ID NO: 138191 - DNA, 1860 bp, Artificial Sequence
  Description of Artificial Sequence: Synthetic coding sequence
atgccacaattgaacggcgggggcggcgacgatctgggggccaatgacgagctgataagttttaaggacgaaggcgagcaagaggagaaatccagcgagaactcatcagccgaacgcgatcttgccgatgtgaagtcctcacttgtgaatgagtcagagactaatcaaaacagcagctccgacagtgaagcagaacggcgccctccaccgagatccgagagctttcgggataagagccgggaatccttagaggaggcagctaaacggcaggatggcggtctcttcaagggacctccttaccctggctaccccttcatcatgatcccagacctgacatctccatacttgcccaatggcagcctgagccctacggctcgtacattgcactttcagagcggatctacccactacagcgcctacaagacaatcgaacatcagatagcggtccaatacttgcagatgaagtggccgctgctcgacgtccaggcaggtagtttgcagtctaggcaggccttgaaggatgcccgcagcccttccccagcccacattgttagcaacaaagtgccagtcgtccagcacccgcatcacgtccaccctcttactcctctcattacatatagtaacgagcacttcacaccgggcaacccgcctccacatcttccagccgatgtggatcccaaaacagggattcccagacccccccatccacctgatatatctccctactatccattgtctcctgggactgtgggccagatcccccaccctcttggttggttggtcccccagcagggtcagccagtttatcctatcacgacgggcggctttagacacccctatcctactgcactcacagtgaatgcctcaatgagccgtttccctccccacatggtgcctccacatcacaccctgcacacaaccgggatcccccaccccgccatcgtgacccctacggtaaagcaggaatctagccagtccgacgtcggctcccttcatagcagcaagcaccaagattcgaaaaaggaggaagagaaaaagaagccccatatcaagaagccattgaacgctttcatgctgtacatgaaagagatgagggccaaggtcgttgcagaatgtaccctcaaagagtctgcagccataaaccaaatccttgggcgccggtggcacgccctaagcagagaggaacaggctaagtattacgagctggcgaggaaggagagacaattgcacatgcaattatatcctgggtggtctgctagggacaactacggtaagaagaagaaacggaaaagagacaagcagcctggtgagaccaacgagcactcagagtgtttcttgaacccttgcctctcattgccacctataacggatctgagcgctcctaagaagtgtcgagccaggttcggcctggaccaacagaataactggtgtggcccctgtagaaggaagaagaaatgcgtgcgttacatccagggggagggctcttgtctgtctcccccctctagcgatggtagtctgttagattcccctccacctagtcccaaccttctggggtctcccccgcgcgacgccaagtcccagaccgaacagacccaacccttaagcctttcacttaaaccagaccctctggctcatctatcaatgatgccaccccccccagccctgctgctagccgaggcgacccacaaagcctcagccctttgcccaaacggggccctagatcttccccccgcagccctgcagcctgccgcacccagttcatcaattgctcagccctctactagcagtctgcactcccatagttcactagccgggacccagccccagcctctctcccttgttacaaaaagtctggagtag

SEQ ID NO: 138192 - DNA, 363 bp, Artificial Sequence
  Description of Artificial Sequence: Synthetic coding sequence
atgctatacatgaaagaaatgcgcgccaaggttgtcgccgaatgtactctgaaggagagcgcagctataaatcagatcctcggcaggcggtggcacgccctttctagagaggagcaagccaagtactatgagctggctaggaaagagcgccagcttcatatgcagctttatcctgggtggtctgccagggacaactatggcaaaaagaaaaaacggaagcgggataaacaaccaggggaaaccaatgatctgtcagcaccaaagaagtgtagagcccgttttggactggaccagcagaacaattggtgcggcccgtgtcgatgtaaatactcgaaggaagtgtctggcactgtgcgagcctag

SEQ ID NO: 138193 - DNA, 531 bp, Artificial Sequence
  Description of Artificial Sequence: Synthetic coding sequence
atgagtcgcttcccgcctcatatggtgcctccccatcacactctgcatactactggcattcctcatcctgctatcgtcaccccaacggtgaaacaagagtcttcacagagcgatgtggggtctctccattcatctaagcaccaggactccaaaaaggaagaagaaaagaagaagccacatatcaagaagccattaaatgcattcatgctctatatgaaggaaatgcgagcaaaggtggtggctgaatgtacactgaaggagtccgcagccatcaaccagatcctggggcgccgttggcacgcgctgtctcgggaggaacaggctaaatactatgagttagcccgcaaggagcgacagctgcacatgcaattataccctggctggtcagctcgggacaactacgggaaaaaaaagaagcggaaaagggataaacaacccggggaaactaacggggaaaaaaagtccgcttttgctacgtacaaggtaaaagctgccgccagcgcccatcctctacaaatggaagcgtactag

SEQ ID NO: 138194 - DNA, 954 bp, Artificial Sequence
  Description of Artificial Sequence: Synthetic coding sequence
atgccccagctgaatggaggaggcggggatgacctgggcgccaacgatgagctgatctcattcaaagatgaaggcgagcaggaggaaaagtcatctgagaatagcagcgccgagagagatctggccgacgttaaaagctccttagtgaacgagtccgaaactaaccaaaattctagctcagacagcgaagctgaacggcggcctccccctcgttccgagagcttccgcgacaaatcacgtgagagtcttgaagaagccgcaaaaagacaggatgggggcttgttcaaagggcccccttacccaggatacccatttattatgattcccgacctcacgtccccttatctgcccaacggctctctgagcccaacagcaaggacctacctgcagatgaaatggcctctgctggacgtccaggccggctcactgcagagccggcaggctttaaaggatgcgcgttcaccatcacctgcgcacattgtgcaatccccactcccgtgctgcacccaaggccacgactgccaacatttctatccccctagcgactttacagtgtccacccaggtgttcagagatatgaaacgatctcactcactgcaaaaagtgggcgagccctggtgcatagaatccaataaagtgcccgtggtgcagcacccacatcatgtacatcctctgacacccctgatcacctactccaatgaacacttcactcctgggaacccaccgccacatttgcctgccgatgttgacccaaaaaccggaattccccgcccaccacaccccccagacatctccccctactaccctctcagccctggcaccgtcggacaaatacctcaccccctgggttggctggtaccccagcagggccagccagtttaccctatcactacgggggggttccgccatccttaccccacggccttaacagtgaacgctagcatgagccggtag

SEQ ID NO: 138195 - DNA, 1791 bp, Artificial Sequence
  Description of Artificial Sequence: Synthetic coding sequence
atgcctcaactgaatgggggaggcggtgacgacctcggagccaatgatgagctcatttcctttaaagacgagggagagcaggaagaaaaatccagcgaaaactcatcagccgagagagacttagctgatgttaaatcttccttggtgaatgagagcgagacaaaccagaattcgagtagcgactcggaagcagagagaagacctccccctagatccgagtcctttagagacaaaagtcgggaatctctagaggaggctgctaaaaggcaggatggaggcctttttaagggccccccttatcctggctatccctttatcatgattcccgacctgacgtccccttatctgccaaacggatctctttcacccactgcccggacctaccttcagatgaagtggccactcttggatgtgcaggccgggagcttgcagtcaaggcaggcccttaaagacgcaagaagtcctagcccagcccacatcgtcagcaataaggttcccgtggtgcagcatccgcatcacgttcacccgttaacaccactcatcacttatagcaatgagcacttcacgcccggtaatccccctccgcatctaccagcggacgtcgatcctaaaactggcatcccccggcccccccaccctcccgatatctccccttattatccgctctctccaggcacggtgggacaaatccctcatcccctgggatggttagtgccacaacaagggcagcccgtgtacccaattaccacgggggggttccggcacccctatccgacagcactgacagtgaacgcctctatgtctagattcccacctcacatggttcctccccatcacaccctgcacaccactggcatacctcacccagctattgtgaccccgacagtgaagcaggagagttcccagtcagacgtgggttcactacatagtagtaaacaccaggattcgaagaaggaggaggagaaaaaaaaaccacacattaaaaagccgctaaacgctttcatgttgtacatgaaagagatgagggccaaagtggtcgcggagtgcacccttaaagagagcgccgctatcaaccagattcttggcaggagatggcacgctctaagtagggaggaacaggccaaatactatgagctggctcgtaaagagagacagctgcatatgcagctctacccaggctggagcgcacgtgacaactacggaaagaagaaaaagagaaagcgcgataaacagcctggtgagacaaacgaacattctgagtgctttcttaatccctgcctgtccctgccacctattacagatctcagtgctcccaagaagtgccgggcccgatttggcctcgatcagcagaacaactggtgtggaccttgtcggcggaagaagaaatgcgttcggtatattcagggagaggggtcatgtctgagccccccgtcttcagacggctctctgcttgatagtccccccccgtcccctaatctgttaggcagtcccccaagagacgcaaaatcccagactgaacagacgcagcccttgtcattaagcctgaagccggacccactggctcacctatccatgatgccaccccctcccgcactgctccttgctgaggcgactcacaaggcatcagctctatgtccaaacggcgctctagacctccctcccgcggccctgcaacccgccgctccttcatcttctatcgcccaaccatccacatctagtctccactcccattcgtctctggccggaacgcagccccagcccctaagtctggttacaaaatcgctggaatag

SEQ ID NO: 138196 - DNA, 1485 bp, Artificial Sequence
  Description of Artificial Sequence: Synthetic coding sequence
atgcctcagctgaatggtggggggggcgatgatctgggagccaacgatgaactcatcagcttcaaggatgaaggagagcaagaagagaaatccagtgagaattcatcagcggagcgagacctggccgacgtgaagtcatcccttgtgaacgagtctgaaactaatcaaaacagtagttccgattccgaagcggagcgccgaccaccacccaggtccgaatcatttcgtgataagtctcgagagagtctggaggaggcagccaaacggcaggacggggggctgttcaaggggccgccatacccagggtatccatttattatgatacctgatctgaccagtccatatctccccaatggtagcctgtctcctacggcacgcaccttgcatttccagtctggctctacacattattccgcatataagacaatagagcaccagattgccgtgcagtacctgcagatgaagtggccccttctagacgtccaagccggctctcttcagtcaaggcaggcacttaaggacgcccggagtccgagcccggctcatattgtctcaaataaggtgccagtggtccagcacccgcaccacgtccatcccctaacaccacttattacttattcaaacgagcattttacccctggaaacccgccaccccacttgcccgctgacgtcgaccctaaaacagggatccctcgtcccccacacccacccgatatctctccctactacccgttgagtcccgggaccgtggggcagatacctcatcctctcggttggctggtccctcaacaaggacagcctgtgtatcccataacaaccggggggtttaggcacccttaccctaccgccttgacagtgaatgcatcaatgagccgattccccccccatatggttcctccccaccacactctccatacaacagggatccctcatcctgctattgtgacccctaccgtgaaacaggaaagctctcaatctgacgtcggatcactgcattccagtaagcaccaggatagcaaaaaggaagaagaaaagaaaaaacctcatatcaagaaaccgctcaacgccttcatgttgtatatgaaggagatgcgtgctaaagtcgtggctgagtgcactctgaaggaatcggcagcaattaaccaaattttgggccggaggtggcacgccttgtcacgcgaggaacaagccaaatactatgagctcgcccggaaagagaggcagctacacatgcaactgtatccgggatggagcgcgcgtgataactacggaaaaaagaagaagaggaagagagacaaacagcccggcgagactaacgaacactcagagtgcttcctgaatccctgtcttagcttgccccctataacagatttaagcgcaccaaaaaagtgcagggcccggtttggactggatcagcaaaataactggtgcggaccctgccgctgtaagtactcaaaagaagtgagtgggacagtgcgagcctag

SEQ ID NO: 138197 - DNA, 1809 bp, Artificial Sequence
  Description of Artificial Sequence: Synthetic coding sequence
atgccccagctgaatgggggtggcggagatgatctcggtgccaacgacgaactaatctcctttaaagacgagggcgagcaggaggaaaaatcgtccgagaattcatccgcagagcgggatcttgctgacgtgaagtccagcctagtcaacgagtccgagactaatcaaaactcatcctccgactctgaggcagagcggagacccccgcctagatccgagtcctttagagataaatcccgcgaatcactggaggaggctgccaaaagacaggacggcggactgttcaaaggtcccccatacccgggctatcccttcattatgatccccgacttaacctcgccttacctaccgaacggatcactgagcccaacagctcgcacactccactttcagtctgggtcaacacactatagcgcttacaagactatcgaacaccagattgctgttcaatatttgcagatgaagtggccccttctggacgtccaagccgggagcctgcagtctcgccaggccctgaaagacgctaggtctccttctcctgcccacattgtgagcaataaggtgcctgtggttcagcatccacaccacgtccaccctttaacccctctcatcacgtatagtaacgagcatttcactcctggaaatccgcctcctcatcttcctgcagacgtagaccccaagactggcatcccccggccaccccaccctcctgacatttcaccgtactatcccctgtccccaggcaccgtgggtcaaattccgcaccccctcggttggctcgttcctcagcagggccagccggtttatccaatcacgacaggaggttttcggcatccttaccccactgccctgacggttaacgcctctatgagtaggttcccaccgcatatggttccaccgcaccacacactgcacactaccgggattcctcatccggcaatagttactcctactgtgaagcaggagagttctcagagcgatgttggcagccttcattcaagtaaacaccaagactcaaagaaagaggaggagaaaaaaaaacctcacatcaaaaagccactcaacgccttcatgctctacatgaaggaaatgcgcgccaaggtcgtcgcagagtgcacgctgaaggaatcagccgccatcaaccaaatccttggcagacgctggcacgccctgagccgtgaggaacaggccaagtactatgagctggccagaaaggaaaggcaactgcatatgcaactctatccaggttggagtgcccgtgacaattacggtaagaagaagaagaggaagagggataaacagcccggagagacgaatgatctcagtgccccaaagaagtgtcgcgcacgcttcggcctggatcagcagaataattggtgcggaccctgtaggaggaaaaaaaaatgtgtgagatacatccagggggaaggatcctgtctcagtcctcccagctctgacggctccctgcttgatagccctccaccatcacctaacttgctcggtagccctccccgggacgcaaagtcgcaaaccgagcagacacaaccactgtccctgagcctgaaaccggatcccctggcccacctatcaatgatgccacctccccctgccctattgctggctgaagctactcataaagcatctgctttatgtccgaacggcgcgctggacctacccccagctgccttgcagcccgccgccccctcgtcttctatcgctcagccatccaccagtagcctgcatagccactcatcactggcgggaacacagcctcagcccctgagtctggtcacaaaatctctggaatag

SEQ ID NO: 138198 - DNA, 1449 bp, Artificial Sequence
  Description of Artificial Sequence: Synthetic coding sequence
atgccacagctaaatggtggggggggagatgacctgggagccaacgatgaacttattagcttcaaggacgagggcgaacaagaggagaagtcttctgaaaattcatcggcagagcgcgaccttgccgacgtgaagtcaagcctcgtgaacgagtctgagacaaaccaaaactccagctctgattcagaagcagagagaaggcccccccccaggtctgagtccttccgcgacaaatccagggaatcgcttgaagaagccgccaaacggcaggatggagggctcttcaagggcccaccatatcccggttatccgtttatcatgatacctgacctgacatcaccctacttacccaatggtagcctctcaccaaccgcgcgcactctgcactttcagagtgggtcgacacactacagtgcttacaagacaatagaacaccagatcgccgtgcagtacctccagatgaaatggccactcctcgatgtccaagcaggctccctgcagagcagacaagccttaaaagatgctcggtctccgtctcctgcccatattgtgagcaacaaggttcctgtggtgcagcatcctcaccacgtgcaccccctgaccccacttatcacatactcaaatgagcattttactcctggaaacccacctccgcacctgcctgctgacgttgatcctaaaactggcattccaaggccaccgcatccccccgacatcagcccctactatcccctttctccgggaaccgtcggccagataccccatcccctgggttggctggtgccccagcagggccagccagtttaccccatcactacagggggctttagacacccttatccgacagcactaaccgtgaatgcctctatgtcccgttttcctccccatatggtgcctccgcaccacacgcttcacactacgggaattccacaccccgcaattgttacgcctactgtgaagcaggagtcatctcaatcagatgtaggaagtctgcattcctccaaacaccaggactccaagaaagaggaggaaaaaaagaagcctcacatcaaaaaacccctcaatgccttcatgctatatatgaaagaaatgcgtgcaaaggtcgtggctgagtgcacattgaaagagtcagccgcgatcaatcagatcctgggtcgaaggtggcatgcgctgtctcgcgaggaacaggcgaagtactacgagttggctcgaaaggagcgccagctgcatatgcagctatatcccggttggtctgccagggacaattacgggaagaaaaagaagaggaaaagggataaacaacccggagaaaccaacgaacactccgagtgctttctaaatccttgcctgtcattgcctcctataacaggcgaaaaaaagtcagccttcgctacctacaaggtgaaggccgctgcctctgctcatcccctgcagatggaggcatattag

SEQ ID NO: 138199 - DNA, 1008 bp, Artificial Sequence
  Description of Artificial Sequence: Synthetic coding sequence
atgtccagttttcttagttcacgctttcctccccacatggtgcccccacatcacacccttcacaccactggcatccctcatcccgctatcgtgacccccacggtgaagcaggaatcttcgcaatccgacgtcggctctctccactccagcaagcaccaggattctaaaaaggaagaagagaagaagaaaccgcacatcaagaagcccctgaacgctttcatgctctatatgaaggaaatgagggccaaggtagttgcagagtgcaccctgaaagagtccgctgcaatcaaccagattcttgggcgtaggtggcacgctctttctagggaggagcaggcaaagtattacgagttagcaagaaaagagcggcagctgcatatgcagctttaccctggatggtcagcaagggacaactacggcaaaaaaaaaaagcgcaagagggataaacaaccaggtgaaaccaatgagcacagcgaatgctttctgaatccttgcttatctctaccgcctatcaccgatcttagcgcccctaagaagtgcagagcccgctttggtctggatcagcagaataattggtgtggtccgtgcaggcgcaaaaagaagtgcgtgaggtacattcagggcgaggggagctgtctgtcaccgccctccagtgatggaagcttgctggatagtcctcctccgagtcctaacttgctcggctccccaccccgtgacgctaaatctcaaactgagcagacacagccactgtctctaagcctgaaacccgatcccctcgcacacctcagcatgatgccccccccacctgctctcctgctggcagaggctacccacaaagcctccgccttgtgtccaaacggcgcgcttgaccttccacccgcagctctacagccagccgctccttctagttccatcgcccaaccttcaaccagtagtttacattctcattcctctcttgctgggactcagccccaaccccttagcctggtgactaagagtcttgagtag

SEQ ID NO: 138200 - DNA, 1809 bp, Artificial Sequence
  Description of Artificial Sequence: Synthetic coding sequence
atgccccaactgaacggtggtggaggcgatgacctgggggccaacgatgagctgatcagctttaaggatgaaggcgagcaggaggagaagagcagtgaaaacagctctgcggagcgcgacctggcagatgttaagtctagtctggtgaacgagtcagagactaatcagaacagttccagtgactccgaagccgagcgaaggccaccgcctaggagcgaatcctttcgtgataaatcaagagagtccctggaggaagcagctaaacgccaggacggcggcctctttaagggaccaccttacccagggtatcctttcataatgatcccagacttaaccagtccctacctgccaaacgggtctttgtcccctacagcacgcaccttacatttccagagtgggtcaacacactactctgcctacaagactatcgaacaccagattgcagtgcagtatctccagatgaaatggccactcctcgatgtgcaggcgggcagcttgcagtcacgacaggctttaaaagacgctagatcaccttcgcctgctcatatagtctctaataaggtgcctgtggtgcagcaccctcaccacgtccatcctttgactcccctcataacatacagcaatgaacacttcacaccagggaaccctccccctcatcttcctgccgacgtagatcctaagaccggcattccgagaccccctcaccctcccgacatctcaccatactacccacttagccccggtaccgtcggacagattccacatcctttgggctggttagtgcctcagcagggacagcccgtgtatcctatcaccaccggtggtttccgccatccgtaccccaccgcactgacagtcaacgcctctatgtcaaggttcccacctcatatggtgcctccccatcataccctgcataccaccgggattcctcaccccgctattgttacccccaccgtcaaacaggaatcctcccagtcagacgtgggaagcctgcactcaagcaaacatcaggactccaaaaaagaagaagagaaaaaaaaaccccatataaagaagccgctcaatgctttcatgctgtatatgaaggagatgagggctaaggtggtggccgagtgtaccttaaaggaatctgcggcgatcaatcaaatcctcgggcgccggtggcatgccctttcaagagaggaacaagcgaaatactatgagcttgcccgcaaagaacgtcaactgcacatgcaattataccctggatggtcagctcgggataactacggcaaaaaaaaaaaacggaagagagacaaacagccaggtgagaccaacgacgccaataccccaaaaaaatgtcgcgctttattcgggttggatcggcagacactgtggtgcaagccgtgccgcaggaagaaaaaatgcgtgcgttatatacaaggggagggatcatgcctgtctcctccaagcagtgacgggagcctgctggatagccccccaccatctcccaatctgctgggcagtccacctagagacgctaagagtcaaacagaacaaactcagcccctcagtcttagtctcaaaccggaccctcttgcccacctctctatgatgcccccccctcccgcgctccttcttgcagaagccacgcacaaagcctccgccctgtgccccaatggcgcgctggatcttcctccggcagctctccaacctgctgcccctagcagctccatcgcccagcctagcacaagctccctgcattcgcattcaagtctcgccggcacccagccccagcctctgtctctcgtgacaaagtcactagagtag

SEQ ID NO: 138201 - DNA, 1860 bp, Artificial Sequence
  Description of Artificial Sequence: Synthetic coding sequence
atgcctcaattgaacggcggagggggagatgacttgggcgcaaatgacgaactaatttcttttaaggatgagggagagcaagaagaaaagtcctccgagaacagtagcgccgagcgtgatttggctgatgtgaagtcctcacttgtgaatgagagcgaaactaatcagaacagttcttcagacagtgaagccgagcggcggcctcctccacggagtgaatcctttcgcgacaagtctagagaatcactggaagaagctgctaagcggcaagatggtgggcttttcaaaggacctccttatcccggatatccttttataatgatcccagacctaacctccccatacctcccaaacgggagcctgagccctactgctagaacactgcatttccagtcaggcagcactcactattctgcgtacaagacaatcgagcaccaaatcgcagtgcaatacttgcaaatgaagtggccactgctagacgtccaggccgggtcactgcaaagtagacaggcactgaaggatgcacgctcacccagtcccgcacatatcgtgagtaataaggtgcccgtggttcaacatccacatcatgtgcaccccctgaccccacttattacctactctaatgagcacttcacaccaggcaacccgcctccccacttgcctgctgatgtggatccaaaaaccggcatcccacgcccgccccacccacctgatattagcccttactatcctcttagtcccggaactgtaggccagattccacacccactgggatggctcgtcccacagcaagggcagccagtctaccccatcactaccggtgggttccgacatccctatcctaccgctctcaccgtgaatgcctctatgtctagatttcctccccatatggttccccctcatcacaccctgcatacgaccgggatcccgcacccagccatcgttacgcccacggtgaagcaagaaagctcccagtccgacgtcggctcgctgcacagctccaagcaccaggattccaagaaggaagaggaaaagaaaaagcctcatattaagaagccgctgaacgcttttatgctgtatatgaaagagatgcgggccaaggtggtggcggaatgcaccctgaaggaaagtgctgcaattaatcagatactcggacgcagatggcatgccttatcgagggaggaacaggccaagtattacgaattagcccgcaaagagagacagttgcacatgcagctgtatcctggctggagcgctagggataactacggcaagaagaaaaagcggaagagggacaagcagcccggcgaaaccaacgagcattcagagtgttttctgaacccgtgtctgtcacttccgccaatcaccgacgctaatacccctaaaaagtgtagggccttgttcgggctagatagacagactctttggtgcaaaccctgtaggcgtaagaaaaagtgtgtccggtacatccaaggggagggctcctgcctgagccccccctccagtgacgggtcacttctggactcaccccctccgagcccaaacctgctgggctctcctcccagagacgcaaaaagtcagaccgagcaaactcaacccctttccctctctctgaagcccgaccccttggcccatctgtccatgatgccgccccctcccgcactattgttagccgaggctacccacaaggcatccgccttgtgccctaacggcgccctcgacctgcccccagcggccttgcaacctgctgcaccttccagctccattgcccaaccgtctacttcgtctctccactctcatagtagcctcgcagggacccagcctcaacctctatcccttgtcacaaaatcactggaatag

SEQ ID NO: 138202 - DNA, 645 bp, Artificial Sequence
  Description of Artificial Sequence: Synthetic coding sequence
atggcttttctcaggagcatgtggggagttttgagcgcactgggccgcagcggcgcagagttgtgtactggatgcggaagcaggctgaggtcaccgtttagtttcgtgtatctgccccgctggttttcttctgtgctggcgagctgtcccaagaagcccgtgtcgtcatacttgaggttctccaaggaacagctcccaatcttcaaggcccagaatccagatgcgaaaactactgagctcatcagacgcatcgcccaacgatggagagagctgcccgactctaaaaagaagatctaccaggacgcctatcgggctgagtggcaagtctacaaagaagaaatatcccgttttaaagaacaactgacaccgtcacagataatgtctctggagaaagagatcatggacaaacacttgaagcgtaaggcaatgactaaaaaaaaggaaaaacttaagactgttaaagagaattggaagaatttatctgattcagagaaagagctgtacatccaacacgccaaggaagacgaaactagatatcacaacgaaatgaagtcttgggaggagcaaatgatagaggttggtcggaaggacctgctgagacgcacgattaagaagcaacggaagtatggcgccgaggagtgttag

SEQ ID NO: 138203 - DNA, 660 bp, Artificial Sequence
  Description of Artificial Sequence: Synthetic coding sequence
taagagctctgcacaggatgcggcagcagactgcgtagccccttctctttcgtgtacctgccaaggtggttttcttccgtgctcgcaagctgcccaaagaagccagtcagtagctacttaaggttcagtaaagagcaactgcctatattcaaagcgcagaaccctgacgccaagaccaccgaactgatacgacggattgcacagaggtggcgggagttgcctgactcgaaaaagaagatttaccaggatgcataccgggccgaatggcaggtttataaggaagaaatcagtcggtttaaggaacagctcacccccagccagattatgtccctcgagaaggagattatggacaagcatctcaagaggaaggcgatgacaaagaaaaaggaactaactttactgggtaaacctaagcggcctaggagtgcgtacaatgtgtatgtggctgaacgatttcaggaggccaaaggggactcaccccaggagaaactgaagacagtcaaggaaaattggaagaatctgtcagactcagaaaaggaagtcagcatcaccgtggtgtcactgaaatgcttgctcaggatctcagtgagggaatgcataagggcaagactagatagttgcgaggataacctcgtattgctaataattcaagttttttag

SEQ ID NO: 138204 - DNA, 741 bp, Artificial Sequence
  Description of Artificial Sequence: Synthetic coding sequence
atggccttcttgcggagcatgtggggagtgctgtccgctctcggccgaagtggggctgaactgtgcacaggatgcggctcacgcctccggagtcctttttcctttgtatatttgccaagatggttctcttctgtgctggcttcctgcccaaagaagccagtaagtagctacctcagattttctaaggaacaattacctatcttcaaggcacagaacccagatgctaaaaccaccgagcttatcagacgcatcgcacagcgttggcgcgaactccctgactctaagaaaaagatataccaggacgcctacagggctgaatggcaagtgtacaaggaggaaatctcacgcttcaaagaacagctcacaccaagccagatcatgtcactcgagaaggaaatcatggataaacacctcaagcggaaagccatgaccaaaaagaaagagctgactcttctaggaaagccaaaacgcccccgtagcgcgtataacgtctatgtggctgagagattccaggaggccaaaggggactccccccaggagaaattgaagactgttaaggagaactggaagaatctgtctgactcagaaaaggagctgtacatacaacacgctaaggaagacgaaactcgctaccacaacgaaatgaagtcctgggaggaacagatgatcgaagtgggaagaaaagatctgttacgtcgcactattaaaaagcaacgtaagtacggtgctgaggaatgttag

SEQ ID NO: 138205 - DNA, 1302 bp, Artificial Sequence
  Description of Artificial Sequence: Synthetic coding sequence
atgtctattttggcaaagatgggcgattggcaggacagacacgacgggaccagcaacggcaccgctagactcccccagctcggaaccgtcggccaatccccatacacttctgcaccgccactgtcgcacaccccgaacgccgacttccagccaccatacttccccccaccataccagccgatataccctcaatcacaggacccttacagccatgtaaacgacccatattctctaaatccactccacgcccagccccaaccacagcaccccgggtggccagggcaaaggcaatcccaggaatctggactcctgcatacacaccggggtctgcctcatcaattatccggcctggatcctcgccgtgattaccgccgacacgaagacctgttacacgggcctcacgcgctatctagcggcctcggagatctctccatacacagcctgccacacgcgattgaggaagtgccccatgttgaggatcctggaattaatatccccgaccagacagttataaaaaaggggccggtgagtcttagtaagagcaactccaacgctgtctcagccataccaattaataaggacaacctttttggtggcgtagttaaccctaacgaagtgttctgctcggttccgggacggctgtccctgctttcttctacctcgaagtataaagtcactgtcgccgaggtacagcgccgactttctccccctgaatgtctcaatgcatctctgctaggaggcgtgctgagacgcgccaagagcaaaaacgggggtagatccctgagagaaaagctggacaaaatcggattgaacttgcccgcagggcggagaaaggcagccaatgttacactgctaacctccttagtcgaaggagaagcggtccacctggcccgtgactttggctatgtgtgcgaaacggaattcccagccaaggctgtggcggagttcttgaataggcagcactcggaccccaatgaacaggtgacgcggaaaaatatgctgctcgctactaagcagatctgcaaggaattcactgacctgttggcccaggacaggtctcctctgggcaactctagaccgaatcccatcctcgaaccagggatccagtcatgtttaacccacttcaacctgatctcacacggttttggatcacctgccgtgtgcgctgcagttacagcgctgcagaattatctgaccgaggctttgaaggccatggataagatgtacctgtctaacaacccaaatagtcacaccgataataacgcgaagtcctctgataaggaggagaaacatcggaaatag

SEQ ID NO: 138206 - DNA, 1314 bp, Artificial Sequence
  Description of Artificial Sequence: Synthetic coding sequence
atgctttggaaactcaccgataacattaaatatgaggactgcgaagacaggcacgacgggacaagcaatggaacagctaggctgccgcagctaggcacagtgggccagtctccatacacaagcgcaccgccactctcacacaccccaaacgccgacttccaacctccatacttccctcctccataccaaccgatatacccccagagccaggatccctattcacatgtgaatgatccctactcactgaaccccctgcatgcccagccacagccacagcacccaggatggccggggcagagacaatctcaggaaagcggcctactccacactcacaggggtttaccccaccaactgagtggtctggatccaagaagggattaccgtagacatgaggatttgttgcacggcccacacgcgctttcttctggactgggtgacttgtcaattcattctctgccacatgccatcgaagaagttcctcacgtagaggatcccggaataaacattccagaccagacagttatcaagaaagggccagttagcctctctaaatcaaactcaaatgctgtgtcagccattcctatcaataaggataatctgtttggcggggtcgtgaatccgaatgaagttttttgcagcgtcccgggtagattgtctctgctgagtagtacgtccaagtacaaggttactgtcgcggaggtgcagagaagactgtcaccgccagagtgcctcaatgccagtctgttggggggagtgctcagacgggcaaagagtaaaaacgggggccgcagtctcagagagaaactagataagatcggcctgaaccttccggccggacgtcgtaaggccgcaaatgtaactctcctgacatcgctggtggaaggcgaggcagttcacctggctagagactttggttatgtgtgtgaaactgaattccccgcgaaggctgtcgcggagttcctgaaccgacagcattccgatccaaacgagcaggtcacccgcaaaaacatgctcctggctaccaagcagatatgcaaagagttcacagacttgcttgcacaagaccggagtccacttggaaatagcagacccaatccaatcctggaaccaggcatacagagctgcctgacccactttaacttgatctctcacgggttcgggtccccagccgtatgcgcagcggtgacggccctacaaaactacctgactgaagctttgaaggctatggacaagatgtacctgtccaacaatcccaactcccacaccgacaacaacgcaaagtcttcagacaaggaggaaaagcatagaaaatag

SEQ ID NO: 138207 - DNA, 1296 bp, Artificial Sequence
  Description of Artificial Sequence: Synthetic coding sequence
atgttagtccattcgttttctgctatggatcgacacgatggtacctccaacggtactgcccggcttccccaactcggcacggtggggcagtcaccttacacatccgctccccctctttcacatacaccaaacgcagactttcagcccccctactttccgcctccttatcagcctatctatccacagagtcaggatccgtactcacatgtcaatgacccatactctctcaatcctctccacgctcagccccagcctcagcatcccggctggcccggtcagcgacagtcccaggaatcaggactcctgcacactcaccgcgggttgccccatcagctgagcggcctggatcctcggcgggactatagaaggcacgaggatctgctacacggtccgcatgcgctctccagcgggctgggtgatttgtccattcacagccttccacacgcaatcgaggaagttccccatgtcgaggaccccgggatcaacatacctgaccagactgtgattaagaaagggcccgtgagcttgagcaagtcgaactcaaatgccgtttcagcgatccccataaacaaggataacctgttcgggggtgttgtgaaccctaatgaggtcttctgttccgtgccgggcagactcagcctgctctcgagtacgtccaagtacaaagtgaccgtcgctgaggtacagcgtaggctaagcccacccgagtgtctgaacgcatcgctacttgggggagtgttgcgccgggccaaaagtaaaaatggcggccgcagcctgagagaaaaacttgataagataggacttaacctaccagctggaagacgcaaggctgcaaatgtgacattacttacgtccttggtggagggagaggctgtgcatttggctagggatttcggctatgtttgtgaaaccgagttcccagcaaaggccgtcgcggagtttctaaatcggcaacactcagacccaaatgagcaggtaactcgcaagaacatgctgctcgcaactaaacagatatgcaaagagtttaccgatctgcttgcgcaagatcgttcgcctctgggaaactcccgaccaaacccaatcctggaaccaggcatacagagttgcctaacccactttaacctcatctcccatggattcggctcccccgcagtatgtgctgcggtgacggccttgcagaattacctgacagaggcccttaaggccatggataagatgtatctctccaacaacccgaacagccacactgataataacgctaaatcttccgataaagaggaaaaacatcgtaagtag

SEQ ID NO: 138208 - DNA, 1320 bp, Artificial Sequence
  Description of Artificial Sequence: Synthetic coding sequence
atgaagatgttatggaagttgaccgacaacatcaagtacgaggattgtgaggaccggcacgatggcacttcgaatgggactgccaggttgccccagctcggtacagtgggccagtctccttatacttcagcaccacctctgagccatactcccaacgctgactttcagcccccttattttcctccaccttaccagcctatataccctcagtctcaggatccctactcccatgtgaatgacccctattccctcaacccgcttcacgctcaacctcagccacagcaccccggctggcctgggcagcgccagtcacaggagtcaggactgctgcacactcatcgcgggctcccccatcagctgtccggcctggatccccgacgcgattaccgaagacacgaagacttactgcacggtccccacgcgctttcttcaggtcttggagatttaagcatacacagccttccccatgcaattgaagaggtgcctcacgtggaagatccagggataaacattccggaccagaccgtgatcaagaaaggccccgtgtctctctccaagtctaatagtaatgccgtcagcgccatccccatcaataaggacaacctgttcggaggcgtcgtgaatcctaatgaagtgttctgcagcgtgcctggcaggctgtctttgctctcttccacttctaagtataaggtaactgtagcagaagtgcagaggcgcttgagtccaccagagtgcctgaacgcatcactcttggggggagtgcttcggagagctaagtcgaaaaatggcggcagatccttacgtgagaagttagacaaaatcggactcaatctgcctgctgggcgccgcaaagctgcgaatgtgacactccttacaagcctggtggaaggcgaggctgtgcacttagcccgggatttcggttacgtgtgcgagaccgaatttcccgccaaagcagtagctgaatttctcaaccgtcaacacagtgacccaaatgagcaggtcacccgtaagaacatgttgcttgccactaagcagatctgcaaggagtttaccgacttgttggctcaggaccggtcacctctggggaactcccgccccaatccgatcttggagccaggaattcagagttgcctgacacatttcaacctgattagtcacggttttggtagcccagcagtatgcgcggcagtgacagctcttcagaattacttgactgaggcactaaaggccatggataagatgtacctttcaaacaatccaaactcccatacggataataacgccaagtccagcgataaagaggaaaaacaccgaaagtag

SEQ ID NO: 138209 - DNA, 987 bp, Artificial Sequence
  Description of Artificial Sequence: Synthetic coding sequence
atgctttggaagctaaccgataatattaagtacgaggattgtgaagatagacatgatggaacttctaacggtacagctcgactcccacagcttggaacagtagggcaaagcccttataccagtgcgccacccttgtctcacacccctaacgctgattttcagcccccttacttccccccaccataccaacctatctacccccagtcgcaggacccttactctcacgtgaacgatccgtactccctaaatcccctgcatgcacagccccaaccacagcacccgggctggccaggccagagacagtcacaggaaagtggactgcttcacactcacagggggctgcctcaccaattatcaggcttggacccacggcgagattaccgtcggcacgaggatctgctccacggcccacatgcattgtcttcaggactaggggacctgagcatccactcattgccccacgctatcgaggaagtcccacatgtggaggatcctggcatcaacatacccgatcaaactgttatcaaaaaaggtccggtgtctttgtctaagtctaacagcaatgctgtttcagccattcctatcaataaagacaacctgttcgggggcgtggtgaacccgaacgaggtcttctgctccgttcctggaaggctgagcctcctgagctcaacgagcaagtacaaagtcaccgtggccgaggttcaacgtagactgtctccccccgagtgcctaaacgcctccttgttaggcggggtgctccgcagggccaaaagcaagaatggtgggaggtccctgcgggagaaactggacaagatcggccttaatctgccggccggccggcgcaaagccgccaacgtaacactgttaacttcgctggtggaagaccgatacgctaagtcttcacccacatgctggttgcgtactgacctgccctggggaactcatgggcctaccccctcttggtcacctgcctcccgggccgcctag

SEQ ID NO: 138210 - DNA, 1314 bp, Artificial Sequence
  Description of Artificial Sequence: Synthetic coding sequence
atgctttggaaacttaccgacaatattaagtacgaggattgtgaggatagacacgacggtacctccaacggtaccgcccgcctgccccagctcggtactgttggacagagtccgtatacctctgcgccaccactgagccatacaccgaatgcagactttcagcccccctacttcccccccccgtaccagccaatctatccacagtcacaggacccttactctcatgttaatgacccttactcactgaatcctctacacgcgcagccacagccccagcacccagggtggccgggacagagacagagtcaagagagcggacttttacatacccacaggggactccctcaccagttaagcggattggaccctcggagagattaccggcgccatgaggacctcctgcatgggccccacgccctgagcagtgggcttggagacctgtcgattcacagcctgccacacgctatcgaggaagttcctcacgtagaggatccgggaattaatatcccagatcagacggtcattaagaagggacccgtgagtctgagtaagtccaattcaaacgcggtctcagcaattcctatcaacaaagataacttatttgggggggtagtgaatcctaacgaggtgttctgtagcgtgcccggaagactgtctctcctaagcagtacatccaagtataaggtcacagttgccgaggtgcagagaagactttcaccccccgaatgtctgaacgccagtctgctgggaggggtgttgaggcgggccaaatcgaagaatggcggacgatctcttagggaaaagctagataagattggcctgaacctgcccgccggcaggcgcaaggccgcaaatgtgaccttactgactagcttagttgaaggagaggcagtgcaccttgcacgtgactttgggtacgtctgtgaaactgaattccctgcaaaggcggtcgccgagtttctgaatagacagcatagcgatccgaacgaacaagttacccgaaagaacatgctgctagctactaagcagatatgtaaggagtttacagatctgctagcgcaggaccggtcccccctggggaatagtcggccaaatccgatccttgaacctggcatccagagctgcctcacccactttaacttgatctcccatggcttcggcagccctgccgtgtgtgccgctgttaccgccctccaaaattatctgactgaggccctcaaggctatggacaagatgtacctgtccaacaacccaaactctcacaccgataacaacgccaagtccagtgacaaagaagagaagcatagaaaatag

SEQ ID NO: 138211 - DNA, 1410 bp, Artificial Sequence
  Description of Artificial Sequence: Synthetic coding sequence
atgcacagtccacctagagatcaagccgccatcatgttgtggaaattggttgaaaacgtcaagtacgaagacatctacgagatgctggtgcacacttatagttcgatggatcgccacgatggtgtgcctagccactcctcacgtctctcacagctcggcagcgtgtcccaggggccttatagcagtgcgcccccactgagtcacactcctagcagcgatttccagcccccttactttccaccaccttaccagcccctgccataccatcagtcccaagatccctactcacacgtgaatgatccctatagtcttaaccccctgcaccaaccccagcaacacccgtggggccaacgacaaagacaggaagtaggcagtgaggcaggcagcctgcttccccagccgcgcgcagccctgccgcaactgtcgggccttgacccacgccgggactaccacagcgtgcggagacctgacgtcctgctccacagcgctcaccatgggctagacgccggcatgggggacagcctgtcattgcatggcttggggcaccctggtatggaggacgtacaaagcgtggaagatgcaaacaacagcggcatgaacctgcttgaccagagcgttataaagaaagtgccagtccctcccaaaagtgttacatcgctaatgatgaacaaagatggcttcctgggagggatgagtgttaatacaggggaggtgttttgctctgtcccggggcgtttatcccttttaagctcgacaagcaaatacaaggtcaccgtcggcgaggtccagaggagactttcacctccagagtgcctgaacgccagccttctaggcggggtcctgcgtcgcgctaagtccaaaaatgggggacgctcactgcgggagcgacttgaaaagatcggcctgaatctcccagcagggaggagaaaggctgcaaacgtcaccctgctgaccagcctcgtggagggggaagctgtccatctggcacgagattttggctatatatgtgagaccgagtttcctgctaaagccgtgtctgagtacctcaacaggcaacacaccgatccttcggatctgcatagcagaaagaatatgcttcttgccaccaagcagctctgtaaggagttcacagaccttctagctcaagaccgtaccccgatcggcaattccaggccttctcccattcttgaaccgggtatccagagctgtcttacacacttctctctgattacccacggcttcggagcgcccgccatctgtgcagccttgacggctctgcaaaattatctgacagaagccttgaagggaatggacaaaatgtttcttaataatacaactactaaccgacatacgtccggcgagggcccaggttccaaaacgggcgacaaggaggagaagcatcgaaaatag

SEQ ID NO: 138212 - DNA, 597 bp, Artificial Sequence
  Description of Artificial Sequence: Synthetic coding sequence
atgttgtggaagctcgtggagaatgtgaaatatgaggacatctatgaaatgcttgtccatacctactccagcatggaccggcacgatggagtgcctagtcacagcagtcggctctcccagctggggtccgtgagccagggtccatactcttccgcacctcccctcagccacaccccatcgagtgattttcagcctccgtattttccccccccataccaaccccttccgtaccatcagtcccaagatccctattctcatgtgaatgatccctatagtctcaacccacttcaccagccacagcaacacccctgggggcagcgacagcggcaggaggtcggctctgaggctgggagcctgctaccccaaccaagagccgcattgccccagctgtcgggcctggatcctcgccgcgattatcattcagtacgtcgcccggacgtcctcctgcatagtgctcatcacggcctggacgctggcatgggggacagtctgtcgctgcacggtctggggcaccccggcatggaggacgttcagagcgtggaggatgcaaataactccggaatgaatctcctggaccagagcgtcataaagaaatag

SEQ ID NO: 138213 - DNA, 1383 bp, Artificial Sequence
  Description of Artificial Sequence: Synthetic coding sequence
atgcatagcccaccccgtgaccaggcagcaatcatgctctggaaacttgtggagaacgtgaagtacgaggacatttatgaggatcggcacgatggcgtcccttcacacagctccagactaagccagctcggatccgtgagccaaggcccctatagtagtgctcctccactgagccacacacctagctccgactttcagcctccttattttccgccgccctaccagccactgccataccatcagagccaggatccatattcacatgtcaatgacccctactccctgaacccactacatcagccccagcaacacccctgggggcaaaggcagcggcaggaggttggctcggaagcaggatccctgctgccccaacctcgggctgccctgccgcaactttccgggcttgatcctcggagagattaccactccgtgaggcgccccgatgtgctgctgcattctgcccaccatgggctcgatgccggaatgggagattcccttagcttgcatggcctaggacacccaggcatggaggatgtgcagtccgttgaggacgccaataactcaggtatgaacctgctggatcagagcgtgatcaaaaaagtgcctgtcccgcctaagtcagttaccagcctgatgatgaacaaggatgggtttctgggaggcatgtcagttaacaccggtgaggtcttctgctccgtgcctggacggctgagcctgctgtcttcgacgtcaaagtacaaggtaacagtgggtgaggtccagcgtcggctgagtccacctgagtgtcttaatgcttctctcctgggcggagtcttgcgccgggctaagagcaagaatggggggcggtctctcagagaaaggctcgaaaaaatcggtctgaatctccccgcaggcagacgcaaagctgcaaatgtcaccttactgaccagtttagtggaaggcgaggcagtacacctggcaagggattttggttatatctgtgaaacagaatttcctgcgaaggccgtcagcgaataccttaacaggcagcacacagatccttccgatctgcattccagaaagaatatgctccttgcaactaaacaactgtgtaaggagttcacagatctgctggcccaggataggacgccgatcggcaatagtcggccctcccctatcctggagccgggcatacaaagttgtcttacacatttttctctgattacccacggctttggcgctcctgccatttgcgccgcgctgaccgccttgcagaactacctgacagaagccctgaaagggatggataaaatgttcctgaacaacactacgaccaacagacacactagcggggaaggtccaggtagtaagactggagacaaagaggagaagcacagaaagtag

SEQ ID NO: 138214 - DNA, 1359 bp, Artificial Sequence
  Description of Artificial Sequence: Synthetic coding sequence
atgagcactacgttcccagggcttgtccacgacgccgaaattcggcacgatggctccaattcctaccgtctgatgcagttaggttgtctggagtcagttgcaaattcaacagtggcctattcttcctccagccccctcacgtactccaccacaggaacggagttcgccagcccatatttcagcaccaatcaccagtacacccccctccatcatcaaagtttccactatgagttccaacacagtcaccccgctgtaacgccagacgcctacagcctgaactcccttcaccatagtcagcaatattatcaacagatacaccatggagagcccacagacttcattaatcttcacaacgctcgtgcccttaagagctcatgcctggacgagcagaggcgtgagctgggctgtctcgacgcctatagaagacacgacctctcattgatgtcccatggaagccagtacggcatgcaccctgatcagcgcctgctacctgggccctccctgggtttggctgcagccggggctgatgacctccagggctcggtcgaagcgcaatgtggactggtccttaatggccagggaggagtcatcagacgtggagggacctgtgttgttaatccgaccgacttgttctgctcggttcccggcaggctgagcctactgtccagcacctccaaatacaaagtcacaattgctgaagtgaaaaggaggctctccccgccagaatgtctcaacgccagccttctgggaggcatcctccgtagagctaagagcaaaaatggcggccgctgcctgagggaaaagctggacaggctaggtctgaatttgcccgccggccggaggaaggcagccaatgtgacactgctgactagcttggtcgaaggtgaggctttacatctagcaagagactttgggtacacttgcgagacggaattccccgccaaagcggtaggcgaacacctggcgcgtcagcacatggaacagaaggaacagaccgcccggaagaagatgattttggcaacaaagcagatttgcaaagagtttcaggatctgctttcgcaggatcgctctccactaggcagttccagaccaaccccaatcctggatttagatatccagagacacttaacgcatttttccctgattacccatggctttggaacgcctgctatttgcgccgctttgtccacatttcagacggtactgtccgagatgctcaactatctggagaagcacacaacccacaaaaacgggggcgcagcagactccggccagggtcacgccaatagcgagaaagcccccctgagaaaaacatcagaggcggcagtgaaggaaggaaagacagaaaaaacagactag

SEQ ID NO: 138215 - DNA, 1329 bp, Artificial Sequence
  Description of Artificial Sequence: Synthetic coding sequence
atgcttgtccatacttattccgcaatggaacgtcctgacggactgggggcagccgcgggcggcgcccgcttaagttctctgccacaggcagcatatgggccagccccacccttgtgccacactcccgctgccaccgctgccgctgagttccagcccccatactttccacctccatatccacagccaccactcccatatggccaggcaccggacgctgcagccgccttcccacaccttgctggcgacccttatggaggtttggctcctttagctcagccccagccgccgcaagctgcttgggctgctcctcgggctgctgctcgggctcatgaggagccacccggcctcctggcccccccagctcgcgctctcggcctggatccccgcagggattacgccaccgccgtacctcgtctgctgcacggactcgccgacggcgcacatggactggccgacgcaccactaggattacctgggcttgctgccgctcctggcctcgaggacctgcaggccatggatgaacctggaatgtccttgctcgatcaatctgtgatcaaaaaggttcctatcccttccaaggcatcgtctctgtcagcgttgtcccttgcaaaggactccttggttggcggcatcaccaaccccggcgaggtgttctgttccgtgcctgggcggctctcactccttagctcaacctccaagtataaagtcacagtcggtgaagtccagcggcgcctctccccccctgagtgcctcaatgcatccctacttgggggagtgctcaggcgagccaagtccaagaatgggggcagatgtctgcgcgaaagacttgagaaaatcgggctgaatctcccggcaggacgccgcaaagccgctaacgtgacactgctgacatccttggtggaaggggaagcggtgcatttagcacgcgactttggctatgtgtgtgaaactgagttccctgctaaagcggccgcggagtatctctgtaggcagcacgccgacccaggcgaactccacagcagaaaaagcatgctgctcgctgcgaaacagatttgcaaagagtttgcagacctgatggcccaggataggagcccccttggaaatagtcgcccagcccttatcttggaaccaggcgtgcagtcctgtctgacacatttctctttgatcactcacggcttcggcggacccgctatctgcgcggcattgaccgctttccaaaattacctcctcgaaagtctcaaagggcttgacaagatgttcctttcttcggtaggctctggccacggagagactaaggcctccgaaaaagatgctaaacaccgcaagtag

SEQ ID NO: 138216 - DNA, 1353 bp, Artificial Sequence
  Description of Artificial Sequence: Synthetic coding sequence
atgttatggaagattactgacaacgttaagtatgaagaagactgcgaggaccgtcacgatggatctagtaatggtaatccacgagtacctcatctttcatccgcaggtcagcatctgtattctcccgcgccacctctctctcatactggcgtcgctgaatatcaaccccctccttattttccccccccgtatcagcaactggcatattcacagtccgccgacccctactcccatcttggcgaggcttacgcagcggcaataaatcccctacaccaacctgcccccacaggcagtcagcagcaagcctggcccggtaggcagagccaggaaggggctgggctgccaagccatcacggccggcccgctgggcttctcccacacctgagtgggttggaggcaggagcggttagtgcaagaagagacgcctatagaagatctgacctgttactgccacatgcccacgctctagatgccgccgggctcgcggaaaacctcgggctgcacgatatgccccaccaaatggacgaggtgcagaatgttgacgaccagcacctcctgttgcacgatcagactgttatcagaaagggcccaattagcatgactaaaaacccattgaatctcccttgccaaaaggaattagtgggagctgttatgaaccccactgaggtgttctgcagcgtgcccgggagactgtcccttttgagttctacctcaaaatataaggtaacggtggccgaggtgcagcggaggctttcgccaccagaatgcctgaacgcctccctgctaggtggtgtcctgcgtcgcgccaaatccaagaatggtggaagaagtctgagggaaaaactggacaaaatcggtctgaacttacccgccggccgtcgaaaagcggcccatgtgacattgcttacttccctcgtggaaggagaggctgtgcacctcgctcgggactttgcatacgtttgcgaagcggaattccctagcaaacccgttgctgaatatctgaccaggcctcatctgggtggtcgtaatgagatggcagcaagaaagaatatgttgttagctgcccaacagctgtgcaaggaatttacagaactcctgtctcaggaccggacacctcacggaactagccggctggcaccagtcttggagactaatatccagaattgcctatcccactttagcctaataacccacgggtttgggagccaggcaatctgtgctgccgttagtgccctccagaactacatcaaagaggctcttattgttattgacaaatcttatatgaatcccggtgaccagagcccggccgacagcaacaagactcttgagaagatggaaaaacatcgcaagtag

SEQ ID NO: 138217 - DNA, 357 bp, Artificial Sequence
  Description of Artificial Sequence: Synthetic coding sequence
atgttcttacaagatcgccacgatgggtcttcaaacgggaaccctcgcgtaccccacctttcaagtgcagggcagcatctatactctccagctcctcctctgtcacatacaggggtggccgaataccaacctcccccttattttcctcctccgtaccagcagcttgcctacagtcagtcagctgatccttatagccacctgggtgaagcctacgcggccgctatcaacccactccatcagccagccccaaccggtagccaacaacaggcctggccaggtcggcaaagccaggaaggagccggcttgcctagtcaccacgggaggcctgctgggcttctgccgcatctgtcaggatag

SEQ ID NO: 138218 - DNA, 846 bp, Artificial Sequence
  Description of Artificial Sequence: Synthetic coding sequence
atgccccatcagatggatgaagtccaaaatgtcgacgaccagcatctgctgttgcatgaccagacggtgatccgcaaagggcctatcagcatgaccaagaatcctctgaacctgccctgtcagaaagaactggtgggcgccgttatgaatcctaccgaagtattctgctccgttcctgggcgactctctttactgtcgtccaccagtaaatacaaagttactgttgcagaagtgcaacggcgcttgtctccccctgaatgcctgaatgcatcgctgctgggaggcgttcttcgcagagccaagagtaaaaatgggggcagatcacttagggagaaactcgataagattgggctgaaccttccagctgggagacgaaaggctgcacacgtgactttgttgaccagcctagtggagggcgaggctgtccatctggcacgagattttgcttatgtgtgcgaggccgaattcccgtcaaagcccgtggccgagtacttaactcgcccccacctcggcgggcggaatgagatggctgcacggaaaaatatgcttctcgcagcccagcagctgtgtaaggagtttacggaacttctatcccaagacagaacgccgcatgggacgtctaggttagcccctgttctggaaactaacatccagaactgcttgagtcatttttcgctgataactcatggttttggctcacaggctatttgcgccgccgtgtcggctttacagaattatatcaaagaggccctgattgtgattgataaatcgtatatgaatcccggcgatcagtcacctgccgatagtaataagaccttagagaagatggagaagcacaggaagtag

SEQ ID NO: 138219 - DNA, 1041 bp, Artificial Sequence
  Description of Artificial Sequence: Synthetic coding sequence
atggccgcgtctgggaaactaagcacatgccggctgcctcccttacccacaatcagagaaataatcaagctgctccggttgcaggcggccaaacagctgagccagaattttctcctggatcttagactgacagataagatcgtacgcaaagccggcaatctgacaaatgcctacgtatacgaagtggggcccggacccggcggtattacaaggtctatccttaacgccgatgtagccgagttgcttgtggttgaaaaagatacacggttcatccctggcctccaaatgctgagcgacgccgctccaggtaaactccgaatcgtgcacggtgacgttctcacattcaaagtggaaaaagcgttctccgagagccttaaacgaccctgggaagacgacccgcccaacgtgcatatcattggaaacttgccattttccgtgtccaccccactgattatcaagtggcttgagaatatttcttgcagagacggcccttttgtttatggacggactcagatgacgttaacttttcaaaaagaggtggcagagcggttggcagcaaacactgggagtaagcaaagaagtaggctgtcggtaatggctcagtacctttgtaacgtcagacacatattcaccataccaggacaagcgttcgttcccaagcccgaggtggatgtaggcgtcgtacactttacacccttaatccagccaaagatagagcagccttttaaactggtagagaaagtagtgcagaatgtgttccagtttcgtcgaaagtactgccatcgaggcttgcgtatgctttttccggaggctcagagactggagtcgactgggaggcttctggagctagccgatatagacccgacactgaggccacggcagctgagtatttcccacttcaagagtctgtgcgacgtctaccgaaaaatgtgtgatgaagatccccagctgtttgcatataacttccgcgaggagctaaagcgtcggaaatctaagaacgaggaaaaggaagaggatgacgcagagaattacaggctctag

SEQ ID NO: 138220 - DNA, 1728 bp, Artificial Sequence
  Description of Artificial Sequence: Synthetic coding sequence
atgagccatgccgcagagcctgctcgggatggggtggaggccagcgcagagggtccacgggcagtgttcgtacttcttgaggagcgtcgccctgctgattcagctcagctcctttctctgaattccctgttgcccgaatctggaatagttgccgatatcgaactggaaaatgtcctagatcctgactccttctacgaactcaagagtcagcctctgccactccgcagcagtctgccgatcagtctgcaggccactcctgctactccggcaaccctgtcagctagcagctccgccggtgggtctcgcacccccgccatgagtagctcatcttccagcagggttttgctgagacagcagctgatgagggcccaggctcaggaacaggagcgacgcgaacggcgtgaacaggccgcagccgcacctttcccatcccccgcccctgcttctcccgccatctctgtggtcggagtaagcgcgggcggccatacactgtctcgcccccctccagctcaagtgccaagggaggtcctgaaggtgcaaactcatcttgagaaccctacaaggtaccacctccagcaggcccgtaggcagcaggtaaaacagtatctgtcaaccaccttggggcccaaactcgcaagtcaggcgttgaccccacccccgggaccagccagcgcccagccactccctgcacccgaggccgcccacactaccggccccacgggatcagcacctaattctccgatggctctgttgaccatcgggtcgtcaagcgagaaagagattgatgatgttatcgacgagattatttcccttgagagcagttacaacgacgagatgctgtcctacctccccgggggaacgactggtctgcaactcccctccactcttcccgtgtctggcaacctgctggacgtttattcttcacaaggcgttgccacgccagctatcactgtgagcaatagttgtccggctgaactccccaatataaagcgtgaaatttctgagacggaagccaaggcactgctgaaagagagacagaagaaagacaatcataatcttattgagcgacggcgccgcttcaatatcaacgataggataaaggaactgggcacactgataccgaagagcagcgatccagaaatgagatggaataaggggaccattttgaaggcctccgtggactatatccggaagctgcagaaggagcaacagaggagcaaagacctggagagccgacagcgcagccttgagcaagcgaatagatcgctgcagctccggatccaggaattggagctgcaggcacagatccacggtttgcccgtgccgcccactccaggcctcctgagcctggctacaacatcagcttcagactctctcaagccagaacagctggacattgaggaggagggccgaccaggcgctgctacatttcacgtggggggcggacctgcacagaacgccccacatcagcaaccaccagcccccccttcggatgccctgttggatcttcactttccatccgatcacctgggggacctgggagacccttttcatcttggtctcgaggacatccttatggaagaggaggagggggtagtggggggtctgtctggcggtgcattgagcccactgcgggccgcatcagatccccttctgtcgtccgtgtctccggcggtatcaaaggccagctcacggagatccagcttttccatggaagaggagtcctag

SEQ ID NO: 138221 - DNA, 1509 bp, Artificial Sequence
  Description of Artificial Sequence: Synthetic coding sequence
atggcttgggccctgaagctgccgctggctgacgaagttatcgaaagtgggctggtacaggacttcgacgcatctctcagtggcattggacaagagctcggagccggtgcctactccatgtctgatgtgctggcactacctatctttaagcaggaggagagttcacttccccccgataatgaaaataagattctgccgttccagtatgtgctgtgtgccgcaaccagcccggctgtgaaattacacgatgagaccctcacctatttgaatcaaggacaatcatatgaaattcgcatgctagacaaccgaaagctgggcgaactgcctgagattaacggtaagttggttaaatctatctttcgggtcgtcttccatgaccggcgcttgcaatataccgaacatcagcagctggagggttggaggtggaaccgtccgggcgatcgaatcctggacatcgacattcctatgtcagtgggcataattgatccccgtgcaaacccaactcaactgaacacggtcgaattcttgtgggatcctgccaaacgcaccagcgtcttcatacaggtgcattgtatatccaccgagttcaccatgcgcaagcacggcggggagaaaggggtccccttccgcgtccaaatcgacacttttaaagagaacgaaaatggggaatacacagagcatttgcatagcgcaagctgtcaaatcaaagtcttcaaaccgaagggtgctgaccgaaagcagaagactgacagagagaaaatggagaaaagaacgcctcatgagaaagagaagtatcagccctcctatgagaccaccatattgaccgaatgtagcccgtggcctgaaataacatacgtcaacaattcccctagcccaggcttcaattctagccattcaagctttagtctgggagagggaaacggatcccctaaccaccaaccagagcctcctcccccagtgaccgacaatctgctgccaacaactacaccacaggaggctcagcagtggctacatcgcaatagattttctacttttacacggctgtttaccaacttcagcggggctgatctgctgaaattgacccgggatgatgtcatccagatttgtgggcctgccgatgggatccggctgtttaacgcgttaaaaggccgtatggtgcggccccggttaaccatctatgtctgccaagagagtctgcagctccgggagcagcagcaacagcaacagcaacagcagcagaagcacgaagatggagacagcaacgggactttctttgtctatcacgccatatacctggaagaactgacggccgtggaattgactgagaaaatcgcacaactattcagcatatccccttgtcaaattagtcagatttataagcaggggcctactggaatccacgttctgatctctgatgagatgattcaaaatttccaagaagaagcatgtttcattttggacactatgaaggctgaaactaacgattcctatcatataatactcaagtag

SEQ ID NO: 138222 - DNA, 1356 bp, Artificial Sequence
  Description of Artificial Sequence: Synthetic coding sequence
atggcatgggccctaaagctccctctcgccgacgaagttattgaaagcgggctcgtacaggacttcgatgcctcgctcagcggaatcggacaggagttgggcgccggcgcctactctatgagtgacgttcttgcgctgcctatttttaaacaagaggaatcctccttgcctcctgacaacgagaataaaatccttccatttcagtacgtgctgtgcgcagccacctcccccgccgttaagctccacgatgaaaccctcacatacctgaatcaggggcagagttatgagattcgtatgctcgataaccggaagctgggcgaacttccggaaattaacgggaagctggttaagtccatattccgcgtcgtttttcacgatcgccggttgcaatacaccgagcaccagcagctggaagggtggagatggaaccggcccggcgatcggatcttagatatagacattccaatgtcagtgggcataatcgacccccgtgcgaacccgacacagctcaacaccgtggaatttctatgggatccagcgaagcgtacaagcgtattcatacagcccaagggagcggacagaaagcagaagacagatcgagagaaaatggagaagaggactccgcacgagaaggagaaataccaacccagctacgaaaccaccatcctgaccgagtgcagtccatggcccgaaatcacctacgttaacaattccccatcccccggctttaacagctcccacagcagcttctcattgggagagggcaatggatcccccaaccatcaacccgagccccctcctcctgtgacagacaaccttctgccgaccactacgccgcaggaagctcaacagtggttacaccgaaaccgcttcagtacgttcactcgcctattcactaatttttccggcgcagacctcctgaagctgacgcgcgatgacgtcatccagatttgcggacctgctgatgggatccgcctgtttaacgccctcaaggggcgaatggtacggccaaggctcaccatctatgtctgtcaagagtccctgcagttacgcgagcaacagcaacagcagcagcagcaacaacagaagcatgaagatggggacagcaatgggaccttctttgtctatcatgctatatacctggaggaactgactgccgtggagctgaccgagaaaattgctcaactcttctcaatctctccttgccagatctctcagatttataagcagggccccaccggcatccacgttctgatctctgacgagatgatacagaattttcaggaagaggcttgctttattctggacacgatgaaggcagagactaacgatagctaccacatcattttgaagtag

SEQ ID NO: 138223 - DNA, 1353 bp, Artificial Sequence
  Description of Artificial Sequence: Synthetic coding sequence
atggcatgggctctcaagcttcctctggccgatgaagtgatcgaaagcggtttggttcaggattttgatgcttccctatccggaatcggccaagagctgggcgccggcgcttactcaatgtcagacgtgcttgccctccctatcttcaagcaggaggagagttcactgccaccagataatgaaaataagatccttccctttcaatatgtcctttgtgctgcgacaagccccgccgtcaagcttcacgacgaaactttaacctacctcaatcagggccagtcttatgaaatccgaatgttggataatcgcaaactcggcgagctgcccgagatcaacggtaaattagtgaagagcatttttcgggttgtattccatgaccgacgcctccagtacacagagcatcagcaattggagggatggcgatggaataggcccggagaccggatcctggatatcgatatcccgatgagcgtgggtatcattgaccccagggctaaccccacccagcttaacacagttgagttcctgtgggaccccgcaaagcgcacctctgtgtttatccagcctaagggagccgatagaaagcagaaaaccgatcgagaaaagatggagaagaggacacctcatgagaaggagaagtaccaaccctcttacgagactaccatcctgaccgagtgttcaccatggccagagattacgtatgtgaacaactcaccttcccccggctttaatagttctcactcttcgttctctttaggcgaaggtaacggcagcccaaaccatcagccggagcctcctccccccgtgaccgataacttgctgcctacaactaccccccaagaagcccagcaatggctgcatcggaaccgatttagcacatttaccagattgtttaccaacttctccggcgccgacctgctgaagctgacacgggacgacgtgatacagatttgcggtcctgccgatggcatcaggttgtttaacgctttgaaaggccgaatggtgcgcccgcggttgactatttacgtgtgccaggagagcctgcagttgagagagcagcaacagcagcagcagcagcagcagcaaaaacacgaggacggagattcaaacggcaccttttttgtctaccacgccatttatctggaagaactcacagccgtggagctcactgagaaaatcgcccagctgtttagcatttcaccctgtcaaatctcccagatttataagcagggaccaactgggatccacgtgttaatttctgacgaaatgattcagaattttcaggaagaagcctgctttatcctggacacaatgaaggaaaccaacgacagttaccacatcatacttaaatag

SEQ ID NO: 138224 - DNA, 1440 bp, Artificial Sequence
  Description of Artificial Sequence: Synthetic coding sequence
atgctgttctggcatactcagccggagcattacaaccagcataatagcgggagttacctccgtgatgtgcttgcactacccatctttaagcaggaggagcctcagctttctccagagaatgaggcacgtttgccacccttacaatatgtgctgtgtgccgccacctcacctgccgtgaagttacacgaggagacactgacctatcttaaccagggccagagctacgaaatcaggctattagaaaatcggaagctcggcgacttccaggacctgaatactaagtacgtgaagagcatcataagagtagtcttccacgataggcgcctgcagtatactgaacatcagcaattggaaggatggcgttggtcgaggcccggggataggattttggacattgatattcctctctctgtgggaattctggacccacgggccagccctacccaacttaatgccgtcgagttcctttgggatcccgctaagagggccagcgccttcattcaagtacattgcatttccacagagttcactccgagaaaacacggaggagaaaagggcgtaccctttcgagtacagatcgacaccttcaagcagaatgaaaatggcgagtacactgaacatctacactctgcttcctgccagattaaagtgttcaaaccaaagggcgctgacaggaaacagaagacagatagggaaaagatggagaaacgaacagcccaagaaaaagaaaagtaccagccgtcctatgaaacaaccatcctgactgaatgctccccctggccggatgtcgcctaccaggtgaatagcgcaccttccccttcctacaatggttcccccaacagctttgggctgggagagggtaacgcatcacccacacaccccgtagaggctctgccagtggggtccgaccacctgttaccctcggctagcatccaggatgcccagcagtggttacaccgcaatcgcttttcacagttttgccgcctgtttgcatctttctctggagccgatctgttgaagatgtcccgcgatgacttggttcagatatgtggcccggcagatggaattcgccttttcaatgcaatcaagggtcggaacgtgagacccaaaatgacgatctatgtttgccaggagctggagcagaatcgggtaccccttcaacagaagcgcgatggctcaggggacagcaacctgtctgtctaccacgcaatcttcctcgaggaactgactacgttggaactaatagagaaaattgcaaacctctattctataagtccccagcatatacaccgcgtataccggcagggacccaccggaatacatgtggtcgtctctaatgaaatggtgcagaatttccaagacgagagctgctttgtcctgtccacaatcaaagctgagtcaaacgacggctatcatattatcctcaagtgcggactgtag

SEQ ID NO: 138225 - DNA, 99 bp, Artificial Sequence
  Description of Artificial Sequence: Synthetic coding sequence
atggtgcaaaatttccaggacgagtcttgcttcgtgctgtcaacaattaaggccgaaagtaatgatgggtaccacattatactcaaatgcggcctctag

SEQ ID NO: 138226 - DNA, 1218 bp, Artificial Sequence
  Description of Artificial Sequence: Synthetic coding sequence
atggcaaaatacgtgtcgctcaccgaggcaaatgaggaacttaaagtcctcatggatgagaatcagactagccggcccgtggctgtgcatacttctacagttaatccccttggtaagcagcttttgcccaagaccttcgggcagtcatctgtaaacatcgaccaacaggttgtaataggaatgccccaaaggccggccgctagtaatattccggtggtggggtctccaaatccacctagcactcactttgccagccagaaccaacattcttatagcagcccaccttgggctggccagcacaacaggaagggggagaagaatggcatgggtctatgtaggctgagcatgaaagtctgggagaccgtgcaaagaaaaggcactacctcatgccaggaagtggtgggggagctggtggcaaagtttcgggcagcatctaaccatgcctcccctaacgaatctgcttatgacgtcaagaacatcaaaaggcggacgtacgacgcactcaacgtgttgatggccatgaacattatctcacgcgaaaaaaaaaaaatcaagtggatcggcctaacaacaaatagtgcccaaaattgtcaaaatctgagggtcgagcggcagaaaagattagaacgcattaaacaaaagcagagcgaactgcagcaattaatcctgcagcagatcgcctttaagaatctggttttgagaaatcagtacgtcgaggagcaggtgagtcaaagaccgttgcccaactccgtcattcacgttccatttattatcatttcgtcaagtaagaagaccgttattaattgttcaatcagcgacgacaagagtgaatacctgttcaaattcaactcaagtttcgagatacacgacgacactgaagtcctaatgtggatgggtatgacatttggtcttgaatccggctcttgctcagcggaagacctgaaaatggcccgcaatctcgtgcccaaagcgctggaaccatatgtgacggagatggcccagggaaccttcggcggtgtcttcacgactgccggcagcaggtccaatggcacttggctgtcagccagcgatctgacaaacatcgccattgggatgctcgcgacatcatcgggcggcagccaatactccggttcaagagtggagacacctgctgtggaggaagaagaagaagaggacaacaacgacgacgacctcagtgagaacgacgaagatgactag

SEQ ID NO: 138227 - DNA, 2649 bp, Artificial Sequence
  Description of Artificial Sequence: Synthetic coding sequence
atggaaggcgagagctctagatttgagatccataccccagtcagcgataagaagaaaaaaaagtgtagcatacataaagagcgcccccagaagcactcccatgaaatctttagggatagttcgctggttaacgaacagtcccagatcaccagacgcaaaaagaggaagaaggattttcagcacctcatatcaagcccccttaaaaagagcagaatttgcgatgaaactgctaatgcaactagcacccttaaaaagcgtaaaaagcggcggtattccgccttggaggttgacgaggaggcgggagtaacagtcgtactcgtggacaaagagaacataaataatacaccaaaacactttagaaaggacgttgacgttgtgtgcgtggatatgagcatagaacaaaagctgccacggaagcctaaaacagataagttccaagtgctggctaaaagccatgcccacaaaagtgaagccctccacagcaaggtgcgagagaaaaaaaataagaagcatcagcggaaggctgcctcttgggagtcccaaagggccagagacacattgccgcagtctgagtcccatcaggaagagagttggctttccgtgggacccgggggtgaaattacagaactgcccgccagcgctcataagaacaaatcgaagaagaaaaagaaaaagtcttccaacagagagtatgagacactggccatgcctgagggttcccaagcggggcgggaggccggtacagatatgcaggagagccaacctaccgtaggactcgacgacgagactcctcagctgctgggccctacccacaagaagaaatccaaaaagaaaaagaagaagaaaagcaatcaccaagaattcgaagcgctcgccatgcccgagggttcacaggtcggcagtgaagtaggcgccgacatgcaagaaagcagaccagctgtgggcttgcatggcgagactgcaggaatccctgcccctgcttataaaaataagtctaaaaagaaaaaaaaaaagtctaatcaccaagagttcgaggccgttgccatgcctgagtccctcgaatccgcctaccctgaagggtctcaagtcggaagtgaggtcgggacagtcgaggggtccacagctctgaagggcttcaaagaatctaactctactaagaagaagtccaagaaacggaagcttaccagcgtcaaaagagctcgggtctccggggatgacttttcagtgcccagtaagaattcagaatcgacactttttgattcagtggaaggcgacggcgctatgatggaggagggagtgaaatcccgccccagacagaaaaagacccaggcatgcctggcatccaagcacgtacaagaggctccccgtctggaacctgcaaacgaggaacataacgtagaaaccgctgaggattctgaaattcgatatttatcagcggattctggcgacgctgatgatagtgatgcagacctcggctcagccgtgaagcaactgcaggagttcatccctaatatcaaagatcgagccacgagtacaataaagcgtatgtaccgcgacgatcttgaaaggttcaaagaattcaaggcgcaaggggtggctattaagtttggtaagttcagcgttaaggagaataagcagctcgaaaaaaacgtggaggattttcttgcactgacaggaatcgaatcagctgacaagttgctgtatactgaccgctaccccgaggaaaaatctgttatcactaacctgaaacgaagatatagctttcggttgcacattggacggaatattgccaggccatggaagctgatctactaccgcgcaaaaaaaatgtttgacgttaataactacaaggggagatattccgaaggcgacactgagaagcttaagatgtaccactccctgttagggaacgattggaaaaccatcggtgagatggtggcccgaagcagcctgagcgttgccctcaagttctcccagatcagctcccaacggaacagaggagcatggagcaagagtgagacaaggaagcttataaaagccgttgaagaggtgattttgaaaaaaatgagtccccaagagcttaaagaggtggactcaaagttacaggaaaatcctgagtcctgtctgtccattgtacgtgagaagctctataaaggcatctcctgggtcgaagtagaagccaaggtgcagactcgcaactggatgcagtgtaagtcgaaatggactgaaattttaaccaaaagaatgacgaacggtcggcggatctactacggcatgaatgccctgcgggcaaaagtgtctctgatcgagcgcttgtacgaaatcaatgtggaggacacaaacgaaatcgactgggaagacttagcttcagccatcggggacgttcccccatcttatgttcagacaaagtttagcagactcaaagccgtttacgtgcccttctggcagaaaaagacatttcccgagatcatcgactatctgtatgaaaccacactgccccttctgaaagaaaagttggaaaagatgatggagaagaaaggcaccaagattcagaccccagccgccccaaaacaggtcttccctttcagggatattttctactatgaggacgactccgaaggaggacatcgaaaacggaaacggagatag

SEQ ID NO: 138228 - DNA, 2718 bp, Artificial Sequence
  Description of Artificial Sequence: Synthetic coding sequence
atggaaggtgaaagctctcggtttgagatccacaccccagttagcgataagaaaaaaaagaaatgtagcatccacaaagaacgcccacagaagcactcccacgagatattcagagacagctctctggtgaatgagcaatcacagatcacccgcaggaaaaagcgcaaaaaagattttcagcacctgatctcatctcccctgaagaaatcccgcatatgtgacgagacagctaacgccacctccacgctgaagaaacgaaaaaagcgccggtactctgccctcgaagtcgatgaggaggctggggtcaccgtggtgctggtagacaaggagaatatcaacaacacacccaagcatttccgtaaagacgtggacgtggtgtgcgtggatatgtcgatcgaacagaaactgcctcgcaagcctaagaccgacaagtttcaggtccttgctaaatctcatgctcacaagagtgaggcactgcactcaaaggtccgggagaagaagaacaagaagcatcagcgcaaggctgcgtcttgggagagtcagagggcaagagacaccctccctcaatctgaatcccatcaggaggaatcctggctcagtgttggcccgggtggggagatcacggagttacccgctagtgctcataaaaataagagtaagaagaagaagaagaagtcctccaaccgggagtacgagaccctggcaatgcccgagggatctcaggcaggaagggaagcgggaacagatatgcaggaatctcagcctactgtgggcctggacgatgaaacaccgcagttgttggggcctactcataagaagaagagcaagaaaaagaagaagaagaaaagcaaccaccaggagtttgaagccctcgcaatgccggaggggagtcaggtcggctctgaagtcggcgccgatatgcaggaatcgcggccagccgtgggtctgcacggtgagactgcaggaattccagcaccagcttacaaaaataaatccaaaaagaagaaaaaaaaatcaaatcatcaggaattcgaagctgtggccatgccagagtcgctggagtctgcctacccagagggctcccaggtcggctccgaagttggaaccgtggagggctctaccgcccttaaaggtttcaaggaatctaattctacgaagaagaaatcgaaaaagcggaaactgacgtccgtgaaaagggctcgcgtgagcggcgatgatttttccgtcccgagcaaaaactcagaatcgacgctttttgatagtgtggaaggcgatggtgccatgatggaggaaggtgtcaaatctagaccgaggcaaaaaaaaacacaggcctgcctggcatctaagcacgtccaggaagcgccgcgtctggaacccgcaaatgaggagcacaatgtggaaacggctgaggatagcgaaatccggtacttgtcagccgacagcggagacgcagatgacagcgacgcggatcttggcagtgctgtcaagcagctgcaggagttcattccgaacataaaggacagagccacctcgactattaaacgcatgtatagggatgacctcgagcgctttaaggagtttaaggctcagggtgtggccattaagttcggcaaatttagcgtgaaggaaaataagcagctggaaaagaatgtggaggattttttggccttaactggcatagagtccgctgacaaacttctctacaccgataggtacccagaggagaagagtgtcatcactaaccttaagagacgttattctttccgcttacatatcggcagaaatatcgcgcgtccatggaagttgatctattacagagcaaagaagatgtttgatgtgaataactacaaagggaggtactctgaaggcgacactgaaaaactcaagatgtaccattccctgctggggaacgattggaagacaatcggggaaatggtagcccgctcttcattgagtgtagcccttaaattctcccagatctcttctcagagaaacagaggagcctggtctaaaagtgaaacccgtaaactcatcaaggctgtcgaagaggtaatattgaagaagatgagcccgcaggagctgaaggaagtggacagcaagcttcaagagaacccagagtcttgcctgagtattgtccgggagaaattgtataagggcatatcctgggttgaagtggaggcgaaagtgcagacacggaactggatgcagtgcaaaagcaagtggacagaaatcctgaccaagagaatgaccaatgggcgccgcatctattatggcatgaacgccttgcgcgctaaggtgagcctcatcgaacgtctgtatgagatcaatgtggaagatacgaacgaaatcgactgggaagacttagcgtccgctattggtgacgtcccccctagctatgtgcagacaaaattcagccgcctgaaggcagtgtatgttcctttttggcagaagaaaacctttcccgaaattatagattacctgtatgaaacaactttgcctttactgaaggagaaactcgagaaaatgatggagaagaagggaacaaaaatacagacacccgcagcccctaaacaagtcttccctttcagggatatcttctattacgaggacgatagcgaaggagaggatattgaaaaggaatctgagggacaggccccctgtatggctcatgcctgtaacagcagcactctgggcggacagggccgctggattatatag

SEQ ID NO: 138229 - DNA, 3489 bp, Artificial Sequence
  Description of Artificial Sequence: Synthetic coding sequence
atggaggaggtgcgatgccccgaacatggaaccttctgttttttgaagacaggggttagagacggcccaaataaaggtaaatccttctacgtttgcagagccgatacctgtagctttgtgagggccacggatatcccagtttcccattgcctcctccatgaggactttgttgttgaactccagggtttactgctccctcaagataagaaagagtaccgtttgttctttaggtgcataaggagtaaggctgaaggaaaaaggtggtgcgggtctataccctggcaggacccagacagtaaggaacattctgtctccaacaaatctcagcacgcttccgaaacattccaccatagctccaattggctgcggaaccctttcaaggtcttagataaaaatcaggaaccagctctgtggaaacagctgatcaagggggaaggagaggagaaaaaggctgacaagaagcagagagagaaaggagaccagctgtttgatcagaagaaggagcaaaagcccgaaatgatggagaaagacctgtcatcaggattggtgcccaagaagaaacaaagtgtagttcaggagaagaaacaagaggagggagcggaaattcagtgtgaggccgagactggggggacgcacaaaagggatttctccgaaattaaaagtcagcaatgtcaggggaatgaactcaccagaccctccgccagctcccaggaaaagtcaagcgggaagagccaagacgtccagagagagtccgagcccttgagggagaaagtgacacagcttttgccacagaatgtgcactctcataactccatttccaagcctcagaagggggggccgttgaacaaagagtacacgaattgggaagccaaggagacaaaagccaaagacggacccagtatacaggccacgcagaaatcattgccccagggtcattttcaggagcgccccgagacacacagcgtgccagcaccagggggacctgcagcacaagcagcccctgcagctccagggttaagcctgggtgagggtcgcgaggcagccacttcctctgatgacgaggaggaagacgatgttgtgttcgtcagctcaaaaccaggctccccactgctgtttgactctaccctggacctggaaactaaggagaaccttcaattcccggatagaagcgtgcaacggaaggtgagcccagcttccggagtgagcaagaaagttgagccgtctgaccctgtggccaggagggtttatctgacaacccagctgaaacaaaaaaagtccacgctcgcttctgtcaatatccaggctcttcccgacaaaggccagaagttaattaagcagattcaggaattagaagaggtcttgtcagggctgacactgagtcccgagcaggggacaaatgaaaagtccaatagtcaagtcccccaacagagccattttaccaaaacaacaacagggccgcctcacttggtaccccctcagccactgcctcgaagaggaacccaacctgttgggagcctggagctgaagtccgcatgtcaggtgactgcagggggcagctcgcagtgctacagaggacacacaaaccaggaccacgtccacgccgtgtggaaaatcacatcagaggccattggtcagctgcatagatcattagagtcctgccccggggaaacagtggtagcggaagatcccgcaggcttgaaagtgccccttctgctccaccagaaacaggcccttgcatggttgctatggagggagagccagaagccacagggggggatattagctgacgatatggggttaggcaagacactgaccatgattgccctcattttgacccagaagaatcaggaaaaaaaggaagaaaaagagaaaagtaccgcgctcacctggcttagcaaggacgatagctgtgatttcaccagtcatgggacccttattatctgtccggcctctcttatccaccactggaagaacgaagtagagaagcgtgtcaatagcaacaaactcagggtctacctttaccatgggccaaatagggattctagggccagagtcctgtctacttacgacatcgtcataacaacatactccttggttgccaaggaaataccgaccaataagcaggaggcagaaatccctggggcaaatctaaacgtcgaggggacaagcacacccctgcttagaatcgcctgggccagaattattcttgatgaagcccataacgtgaaaaacccgagggtccagacctctattgctgtgtgtaagttacaggcatgtgcccgctgggctgtcacagggactccaatccagaacaacctgctggatatgtacagtctgctcaagttccttcggtgtagtcccttcgatgagttcaatctatggcggtcacaggtagacaacggttcaaaaaagggtggagagcgcctatccattctgacgaaaagtttgctgctgcgccggaccaaggatcagctcgactccactggacgcccgctcgtgatcctgcctcagagaaaattccaattacatcaccttaagctgagcgaggatgaggaaactgtttacaacgtattttttgctaggtcacgttctgcccttcagtcctacctgaaacgccatgagagtcggggaaaccagtcgggcagatcacccaataaccccttttcccgtgtggcactggaattcggttccgaggagcctcgccactcagaggcagctgattcacctcgctcctcgaccgtgcacatcctcagtcagttgctccgattgaggcagtgctgctgccacctgagtctcctaaagtctgcactcgaccctatggagcttaaaggcgaggggctggtcctgagtctggaagaacagctgagtgcattgactctatctgaactgcgggattctgagccgtcttctactgtgtctcttaacggtactttttttaagatggaactattcgagggcatgagagagtccactaaaatctcctctctcctcgctgaactggaggccatccagagaaactcagcgtctcagaagtcggtgatcgtgtcccagtggaccaatatgcttaaagtcgtggcactgcacctcaaaaagcacggactcacttacgccaccattgatggatccgtcaaccctaagcagaggatggatctggtggaggcctttaaccactcccggggaccacaggtgatgcttatctccttactcgctgggggggtaggcctcaatctcactgggggaaatcatctatttctgctggatatgcactggaatccttccctcgaggaccaagcttgcgataggatttaccgcgtgggtcaacagaaagacgtggtaattcaccggtttgtgtgtgaagggacagtggaagagaagattctccaattacaggagaagaaaaaggatctggccaagcaggtcctgtccggaagcggcgagagtgtaacgaaactcaccttggctgatctgcgtgttttgttcgggatctag

SEQ ID NO: 138230 - DNA, 432 bp, Artificial Sequence
  Description of Artificial Sequence: Synthetic coding sequence
aatatgttgaaggttgtcgctctgcatctgaagaagcacggcctgacgtacgcaactatagatggatcggtcaacccaaaacaaaggatggacctggttgaagcctttaaccactccaggggccctcaggttatgttgatttcattgctggcggggggagttggccttaacctcactgggggaaaccatctgtttctgttggacatgcactggaatccttcgctggaagaccaggcttgtgacaggatctatcgggtggggcagcagaaagacgttgtcattcatcgtttcgtctgcgaggggaccgtcgaggaaaagatcttgcagctgcaggaaaagaagaaagatctcgctaaacaggttctttctgggagtggagagtctgtcacaaaacttacgctcgccgaccttagagttctgttcgggatctag

SEQ ID NO: 138231 - DNA, 1263 bp, Artificial Sequence
  Description of Artificial Sequence: Synthetic coding sequence
atggccgagttagggaagaagtattgtgtgtactgcttggccgaggtctccccactgcggttccgctgtacagaatgccaggatatcgaactctgcccagagtgcttttccgcgggggcagagatcggacaccatcggcgctaccacggctaccagctggttgacggcggaaggttcactctatggggccctgaggcagagggaggatggaccagccgagaggaacagcttctcctcgatgccattgagcagttcgggtttggcaactgggaagatatggctgcacacgtcggtgcaagtcgcacccctcaagaagttatggaacactacgtttctatgtatatccacggcaacctaggaaaagcttgcattcccgacacaatccccaaccgcgtaactgaccatacatgccccagcgggggccccctgtcgccgtctttgacaaccccacttccaccgctcgatatctcagtcgcagagcagcagcagctggggtatatgcccttgcgggacgattatgagattgagtatgaccaggatgccgagacgctgatctccgggctgagcgtgaattacgacgacgacgacgtggaaattgagctgaaacgtgctcacgtggacatgtatgtgcgtaagttgaaggagcggcaacgccggaagaacatcgccagagactataatctggtccctgcctttctcggaaaagataagaaagagaaagagaaagcactgaaacgcaaaatcacaaaagaagagaaggagcttcgccttaagttgagacctttatatcaatttatgagctgtaaagaattcgacgatctgtttgaaaatatgcataaggagaagatgctgcgcgccaagatacgggaacttcagaggtataggcggaacggcatcacaaagatggaggaatctgctgaatacgaggcagcaaggcacaagcgcgagaaaaggaaagagaacaaaaatctggctggatccaaacgaggaaaggaggacggcaaagactccgagtttgccgcaattgagaatcttcccggattcgagttgttatctgatagagagaaggtgctttgctcctccctcaacctgtcgcccgccagatacgtcactgtaaaaacgattataatcaaagaccacctgcagaagcggcagggtattccgtccaaaagcaggctgccctcttacctcgacaaagtgctgaaaaaaagaattttgaatttcttaacagagagcggctggatctcacgggatgctagctag

SEQ ID NO: 138232 - DNA, 366 bp, Artificial Sequence
  Description of Artificial Sequence: Synthetic coding sequence
atggccgcccacgtaggcgcaagtcggaccccacaggaagtcatggagcactatgtgtctatgtacatccatgggaatctggggaaggcctgcatacctgatactatcccaaacagggtcaccgatcatacctgtccctccggaggccccctttcacctagtcttacgacaccgctaccacccctcgacatttcggtggctgagcaacaacaactcgggtatatgcccctgcgggatgattacgaaattgagtacgaccaggacgccgagactttaattagcggcctgtcggtgaattatgatgacgacgatgtggaaatcgagctgaaacgagcacatgtagacatgtacgttcgcaagttgtag

SEQ ID NO: 138233 - DNA, 390 bp, Artificial Sequence
  Description of Artificial Sequence: Synthetic coding sequence
atggccgctcacgtgggtgctagccgcacaccccaggaggtgatggaacattacgtgtcaatgtacatacacgggaatctaggtaaggcatgcatcccagacacaatccccaatcgtgtcacggatcacacctgtccatcgggcggccctctttccccatcacttaccacaccccttccccccctggacatcagtgtagccgagcaacagcagttaggctacatgccactccgggatgactacgaaatcgagtacgaccaagatgctgaaacactaatcagcggcctcagcgtgaattacgatgacgatgatgtggaaattgaactcaaaagagcccacgttgacatgtacgttcgcaaactgaaggagcgtcagaggcgtaaaaattag

SEQ ID NO: 138234 - DNA, 1038 bp, Artificial Sequence
  Description of Artificial Sequence: Synthetic coding sequence
atggccgagttaggtaagaaatattgtgtatactgcctggcggaagaagacatggccgcgcacgttggagcttctcggacaccacaggaagttatggaacactatgtgagtatgtacatccatggtaacctgggaaaagcatgcatccccgatacaattcctaatagagtgaccgaccatacatgcccttccggaggaccactgtcaccatcccttaccacgcctctacctccgttggacatctctgtggctgagcagcagcagctgggctacatgcccctgcgtgatgactacgagattgaatacgaccaggatgctgaaacactgatctccggtctcagcgtgaactacgacgatgacgatgttgagatcgaactcaaacgcgcacacgttgacatgtatgttcggaaactgaaagagcggcagcggcgcaaaaacatcgcgcgggattataatctggtccccgcatttttaggcaaagacaaaaaggaaaaagaaaaagccttgaagcgtaagatcaccaaagaggaaaaggagttgcgattgaagctgaggccattgtaccagtttatgagttgcaaagagttcgatgacctcttcgagaacatgcataaggagaagatgcttcgagccaaaatcagagagctacagcgataccggagaaacggcattacgaagatggaggagtcagcagaatatgaggcggccagacacaagagggagaagaggaaggagaataaaaatctggctgggagcaagcgcggaaaggaagatggcaaggattcggaatttgctgccatcgagaacctgccaggatttgaactcctatctgaccgtgagaaagtgctctgctcttcactcaacctgtcacctgcccgatatgtgactgtaaaaacaatcataattaaagatcacctgcagaaaaggcagggtatccctagtaagtcccgtctaccttcgtatctggataaggtgctcaagaagcggatccttaacttcctgaccgaaagcgggtggatatcaagggacgcatcctag

SEQ ID NO: 138235 - DNA, 987 bp, Artificial Sequence
  Description of Artificial Sequence: Synthetic coding sequence
atggctgctcatgtgggcgcctcccggacccctcaggaggtgatggagcattatgtatcgatgtacatccacggcaaccttgggaaagcatgcattcccgacactatccccaacagagtaaccgaccatacatgcccctccggtgggcctctctctccctccctgacaacacccctacccccacttgatatcagtgtggctgagcagcagcagctcggctatatgcccctgcgtgatgactacgagatcgaatacgaccaagatgctgagacacttatttctggattaagcgtaaactatgacgatgacgacgtcgagattgagcttaaaagagcacacgtcgacatgtacgtgcggaagctcaaggagcgccagaggagaaagaacatagccagggactataaccttgttcccgcatttctcggtaaggacaaaaaagaaaaagaaaaggcgctgaaaagaaaaattaccaaggaagagaaggagttaagactgaagcttcggcctctataccagttcatgtcctgcaaggaatttgatgatcttttcgagaacatgcataaagagaaaatgctgcgggccaagattagagagctgcagcgttacagacgtaatggcattaccaagatggaggagagcgctgaatatgaggcggcaaggcacaaacgggaaaaacgtaaagaaaataagaatctcgctggttccaaaaggggaaaggaggatggcaaggacagcgagttcgccgccatcgaaaacctcccagggttcgagctactttctgaccgtgaaaaggtactgtgtagcagtcttaatctgtctcctgcacgatacgtgactgttaagacaatcatcataaaggaccacttacagaagcgacagggcattccctctaaatcaagactcccaagttacctggataaggtgttaaaaaaaaggatcttaaacttcctgacagagtctggatggataagtagagacgcctcatag

SEQ ID NO: 138236 - DNA, 1299 bp, Artificial Sequence
  Description of Artificial Sequence: Synthetic coding sequence
atgtctgagctgaaggattgtccgctacaattccacgacttcaagagcgtggaccatctgaaggtatgtccacgttacaccgcagttcttgcccggagcgaggacgatggcataggcatcgaagagttggatactttacagctagaacttgagaccctgttaagttctgccagccggcgactcagagtccttgaggcagagacccagatcctgactgactggcaagataaaaaaggtgatcggcgctttctgaagttggggcgggatcatgagctgggggccccgccaaaacatggcaagcctaaaaagcagaaactcgaaggcaaggcaggtcacggaccaggaccgggccctgggagaccaaagtctaagaatctccaacctaaaatccaagaatatgaatttaccgacgacccaatcgacgtcccccgaattcctaagaatgacgcaccaaatcgattctgggcttctgtggaaccttattgcgctgacatcacatcggaagaagtgagaactcttgaggagctgttgaagccgcccgaggacgaggcagaacactacaagattccccctctggggaaacactatagccagaggtgggctcaagaggacctgctcgaggagcagaaggatggggcaagggctgcagctgtcgctgataagaagaaggggttgatgggacccctcaccgagttagatactaaggacgtggatgcactcctgaagaaatcagaggctcagcatgagcagccagaagacggatgtccgttcggtgccctcacccaacgattactccaggcccttgtggaagagaatatcattagcccaatggaagactccccaatcccagacatgtcaggaaaggaatccggagcggacggcgcatcaacttcccccaggaatcaaaacaagccattctccgtccctcataccaaatctctggaaagcaggatcaaggaggagctgattgcccagggcctgctagagagtgaagatcgccctgccgaagactcagaggatgaagttttagccgagttacggaaaagacaagcagaacttaaggccctctcagctcacaaccggactaaaaagcatgatttgcttagactggctaaggaagaagtgagccgccaggagctgcggcagcgcgtgcgtatggccgataatgaagtgatggacgccttccgcaagatcatggcagcccgacagaagaaacggacgcctacaaagaaggaaaaggaccaagcctggaagacgctaaaggagcgcgaaagcattttaaagctccttgacggctag

SEQ ID NO: 138237 - DNA, 1110 bp, Artificial Sequence
  Description of Artificial Sequence: Synthetic coding sequence
atgtcagagctcaaggattgcccattgcagtttcacgattttaaaagcgtggaccatctcaaagtatgccccaggtacacagctgtgctggcaagatccgaggatgacggtattggaatcgaagagctagacactcttcagctggaactggaaacccttctttcgagtgcctcgaggcggctgcgcgttttggaagccgaaacccaaatcctgactgactggcaggacaagaaaggcgataggcgcttcctgaagttaggccgggatcatgaactaggggcccctccaaaacatggaaaacccaaaaaacagaaactggaagggaaggctggtcatgggcccggaccaggccctggtcgtccaaagtcaaaaaacctgcagcccaagatccaggaatacgagtttactgatgatcccatcgacgtgccacgcatccctaaaaacgacgcccccaaccggttttgggcctcagtggaaccctattgtgccgatatcacatcagaagaagtccgtacgctggaggagttgcttaaacctccagaggacgaggctgagcattacaagatcccaccattaggaaaacactattctcagcgctgggcgcaggaggacctgttagaggaacaaaaggatggcgccagggcagccgcagtggccgacaaaaagaaggggctgatgggacccctgaccgagctggacactaaagacgtggacgcacttttgaaaaagagcgaagcgcaacacgaacagcccgaggatgggtgccccttcggggcccttacccaacggcttttgcaagcactagtggaggaaaacatcatttctcctatggaagactccccgatacctgatatgtccggtaaggagtcaggcgccgatggggcctccactagcccaagaaaccaaaataaaccatttagcgtgccccacacaaaaagcttagaaagccgcatcaaagaggaacttatagcacaggggcttctagagtctgaggatcggccagccgaggattcagaagacgaagtgctagctgaactgcggaaaagacaagccgaactaaaagcactgtcagctcataatcgcacgaaaaaacacgacctgcttcgatag

SEQ ID NO: 138238 - DNA, 288 bp, Artificial Sequence
  Description of Artificial Sequence: Synthetic coding sequence
atgagcgaactgaaagactgtccacttcagtttcatgatttcaaatcggtggaccacctcaaggtatgccctcggtatacggccgtattagcacggagcgaagacgacggcattggtattgaagagctggacaccctacagctggaactggagacactgttgtccagtgcttccaggcgtcttcgcgtgctggaggccgagacacagatcctcacagattggcaggataagaagggcgatcgcagattcctaaaactgggaagagaccacgaactcggcgctccttag

SEQ ID NO: 138239 - DNA, 1299 bp, Artificial Sequence
  Description of Artificial Sequence: Synthetic coding sequence
atgtccgagctgaaagattgtcccctacagtttcacgactttaaatccgtcgatcatctgaaagtgtgtcctcgctacaccgctgtgctcgcccgttcggaggatgacggtatcggcattgaagagctggataccctacaacttgaactggagaccttactaagtagcgccagtagacgcttgagagtgctggaggcagaaacacagattctgaccgactggcaggacaagaagggcgaccgacggtttctaaaattgggccgcgatcatgagctgggggcccctcccaagcacgggaagcccaagaaacagaagctcgaaggcaaggctggacatggccctggccccggcccaggacgccccaaatcaaaaaatctgcaacctaagatacaggaatatgaatttacagatgaccccatcgatgtcccacggatccccaaaaacgacgctcctaaccgattctgggcttcagtggaaccatattgcgccgacatcacctctgaggaggtgcgcaccttagaggagctgctgaagccacccgaagatgaagccgaacattacaaaataccacccctgggcaaacactactcccagaggtgggcacaagaggacttattggaagaacagaaggatggcgcaagggccgccgccgtggccgataagaagaaaggcctgatgggcccactcaccgagcttgataccaaggacgtggacgctcttctgaagaagagcgaggctcagcatgaacagccagaggatggttgtccattcggcgccctaactcagcgcttgctgcaagccctggtggaggagaacatcatatcacctatggaagatagccctattcctgacatgtcgggcaaagagagcggcgcagacggagcctccacttctcctcgcaaccagaataagccctttagcgtgccccatacgaagagcctagagagccgaattaaggaggagctcatcgcacagggactcctggagagcgaagaccgaccagcggaggacagcgaggacgaagttttggctgagctcagaaagagacaggcagagttgaaagccctgtccgcccacaaccgtactaaaaagcatgatctcctgaggctcgcgaaagaggaggtgagccgtcaggagctgaggcagcgagttaggatggccgataacgaggtgatggatgcttttcgcaagattatggccgctcgtcagaaaaaaaggactcctactaagaaagagaaggaccaggcatggaagaccttgaaggaacgtgaatcaattctcaagcttcttgatggctag

SEQ ID NO: 138240 - DNA, 1038 bp, Artificial Sequence
  Description of Artificial Sequence: Synthetic coding sequence
atgcagctggaaattcaggtcgcactaaactttattatttcctacctctataacaagcttcctaggcggcgggtgaacatatttggcgaagagctggaaagactgctgaagaagaaatatgagggccactggtatcccgaaaaaccttataaagggagtgggtttaggtgtatccacataggcgaaaaggtcgacccagtgattgaacaagcctccaaagaaagcggcctcgatattgacgatgttcggggtaatctcccacaggacctctctgtctggattgatccctttgaagtctcttatcagatcggggagaagggcccagtcaaggtactgtacgtggacgataataatgaaaacgggtgcgagttggataaggagattaagaactcctttaatccggaggcgcaggtgtttatgccaattagcgatccggcaagctctgtgtcctcatccccaagccccccttttggccattccgcagcggtgtctcctacgttcatgcctcgatccacccagccgctgacgtttactacagccacctttgcggcgaccaaatttggatccaccaagatgaagaatagtgggagatcaaacaaggtggcccggacctccccgatcaatttgggtctgaatgttaacgacttactgaaacagaaagcgatctcaagctccatgcactctctctatggtctgggattgggcagtcagcagcagccccaacaacagcagcagcccgcacaaccacctccccctccaccccctcctcagcaacagcagcagcaaaagacctccgccctgtctcccaacgctaaggaatttatattccctaatatgcagggccagggtagctccaccaacggaatgttccctggcgactcccctctcaatctgtcccctctgcagtattcgaatgcattcgacgtattcgcagcctacggcgggctaaacgagaagtcattcgtcgacggcttgaatttttcacttaacaatatgcagtactcgaaccagcagttccaacctgtgatggccaattag

SEQ ID NO: 138241 - DNA, 1038 bp, Artificial Sequence
  Description of Artificial Sequence: Synthetic coding sequence
atgcagttagaaattcaggttgccctgaattttataatatcctatctctataataagttgcccaggaggagagtgaacatattcggggaggaactggagaggctgctaaaaaagaagtacgagggtcattggtatcccgagaagccttataagggttccggctttcggtgtatccacattggtgaaaaggttgacccagttatagaacaggctagcaaggaatcgggcttggatatcgacgacgtgaggggcaatcttcctcaggacctcagcgtttggattgatccgttcgaagtgagttaccagattggcgaaaaggggcccgtgaaagttctatacgtggacgataacaatgagaatgggtgcgaactagataaagagatcaagaactctttcaatccagaagctcaggtgttcatgcctatttctgatcccgcatcttcggtgagttcctccccgtcaccccctttcggccactccgctgctgtcagcccaacattcatgcccagaagcacacagcccctgacgttcacaaccgccacctttgcagccaccaagttcggcagtactaaaatgaaaaatagtgggaggtctaataaagtggcgagaacctccccaatcaacctgggactcaatgtaaatgacttacttaagcagaaggctataagttcgtccatgcatagcctgtacggcctcggcttaggcagtcagcaacaaccacaacaacagcagcagcccgcacagcctcctccaccaccgcccccaccccaacaacagcagcagcaaaaaacatcagccctcagcccaaacgccaaggagttcattttccccaacatgcaaggccaagggagctctacaaatggaatgttccccggagacagtcccttaaacctgtctccactgcaatatagcaatgctttcgacgtgtttgctgcttatggtggactgaatgagaaaagcttcgtggacggactgaacttctccctgaataacatgcagtattcgaaccaacagttccagcccgtaatggctaattag

SEQ ID NO: 138242 - DNA, 1035 bp, Artificial Sequence
  Description of Artificial Sequence: Synthetic coding sequence
atgcagctggagatcaaggttgctctgaactttatcatctcttatctgtataacaagctgcctcgcaggcgggccgacttattcggtgaggagctggaaagacttctgaaaaaaaaatacgaaggtcactggtaccccgaaaaacctctgaagggctctggctttcggtgtgtgcacatcggagaaatggtggatcccgtcgtcgagttggccgccaagagatccggcctggcagtggaagacgtgcgagccaatgtcccggaagagctctcggtgtggatcgaccctttcgaggttagctatcagatcggagagaaaggcgccgtgaaagtgctgtatctggatgatagtgaggggtgtggggcccccgagctcgataaggaaattaagtcgtcctttaacccggacgcacaagtgttcgtgcccattgggtcacaggactctagtctttcgaactctccctcaccttctttcggccagagccccagccccacctttatccccaggtcagcacagccaatcacctttactactgcttcatttgcggcaacaaaatttggatcaacaaaaatgaagaaaggcggtggcgccgcatccgggggcggagtggcctcctcaggcgccggcggacagcaaccccctcagcagccgaggatggcacggagtcccaccaacagcttattgaagcacaagtccctcagcctctcaatgcacagtctcaacttcatcaccgcaaatcccgcaccacagtcccagctaagccccaatgctaaagagtttgtgtataatgggggtggcagcccttctctgttcttcgatgctgctgacgggcagggctccgggaccccgggcccttttggcgggagcggagcggggacctgcaactcatcatccttcgacatggcacaggtctttgggggaggagcgaactctcttttcttggagaagactcccttcgtggaaggtctctcttataacctgaacacaatgcagtatccctcccaacagtttcagcctgtggtcttggccaattag

SEQ ID NO: 138243 - DNA, 306 bp, Artificial Sequence
  Description of Artificial Sequence: Synthetic coding sequence
atgcagctggagataaaagtggctttgaactttatcataagctacctgtataataaactgccgagacggcgcgccgatttgttcggggaagaattggagaggctgctgaaaaaaaaatatgagggacattggtaccctgagaagcctttgaagggctcaggttttcgatgcgtgcacattggcgaaatggtggaccccgtcgtggagctggccgccaaacgcagcggcttggcggtagaagatgtacgggctaatgtccccgaagagctgagcgtttggattgacccctttgaggtctcatactag

SEQ ID NO: 138244 - DNA, 1569 bp, Artificial Sequence
  Description of Artificial Sequence: Synthetic coding sequence
atgagtatcacatcagatgaagttaacttcttagtgtaccgatacctgcaagagagtggattttcccactccgcctttacctttggaatcgagagccatatctcccaatccaatatcaacggaaccctggtgccgccctctgcactcatctccattctacagaaaggtcttcagtacgtggaagccgagataagcatcaataaagacgggactgtgtttgattcacgccctattgagagcctgtctcttattgtggcggtgattccggatgtggtacagatgagacagcaagctttcggagagaagctcacccagcagcaggcttccgccgcggcaactgaggcttctgcaatggccaaagctgccaccatgactcccgccgccatatcacagcagaaccctcccaagaaccgggaggccaccgtaaacggtgaagagaatggcgcccacgagatcaacaaccatagcaagccaatggagatcgatggcgacgtggaaattccccccaataaggccacagtactcaggggccacgagtccgaggtcttcatttgtgcatggaatccagtgtcggatctgctcgcatcaggctcaggggactccactgcgagaatttggaacctgaacgaaaactcaaatggaggttctactcagttggtgctgcggcattgcataagagagggagggcatgatgtcccatccaacaaagacgtcacctcactggattggaacagcgacggaactctactggccatgggttcttatgatggatttgcccgcatttggactgaaaacggcaatttggcgtcaaccttaggtcaacacaaggggccgatatttgccttgaagtggaataaaaaaggcaattatgttttgagcgctggcgtggacaagactaccatcatctgggatgcccatacgggcgaggccaagcagcagtttccctttcattcagctcctgcactggacgttgattggcagaataatatgacatttgcctcctgctcaactgatatgtgcatacacgtatgtcgtttggggtgtgatcaccctgttaaaaccttccaagggcatacaaatgaggtgaacgctatcaaatgggacccatcagggatgcttttggcctcctgctccgacgatatgacattgaaaatatggagtatgaaacaagatgcctgcgttcacgatcttcaggcacattccaaagaaatatacactatcaaatggagtcctacgggtccagccactagcaatccgaattcctccatcatgttggcctctgcctccttcgatagcactgtcagactctgggatgtggaacagggagtctgcacgcacacgctaatgaagcatcaggaaccagtctacagcgtggccttcagtcccgatggcaaatacctggcctctgggagcttcgacaagtatgttcatatttggaatacccagtctggttctttggtccactcgtaccagggaaccgggggcattttcgaggtgtgctggaatgctcggggggataaggtaggggcatccgccagtgacgggagcgtctgtgtgctggacttgtag

SEQ ID NO: 138245 - DNA, 1569 bp, Artificial Sequence
  Description of Artificial Sequence: Synthetic coding sequence
atgagcatcaccagtgatgaggtcaattttctggtctacaggtatctccaagagtccggtttttcccacagtgccttcacctttgggatcgaaagccatatctcacagagcaacataaatggaaccttggtgccaccgagcgctctgataagtatcctccagaagggcctgcagtacgtcgaagcggaaatctccatcaacaaggacgggactgtcttcgatagccggccaatcgagtctctcagcctgatcgtcgcagtcatcccggatgtcgtacagatgcggcagcaagccttcggtgaaaagctgacccagcagcaggcaagcgctgcagctacggaagcctcagccatggccaaggctgcgaccatgacgccagctgcaatctctcagcaaaacccacctaagaatagggaggccactgtgaatggagaggagaatggtgcccatgagattaataatcattctaagcccatggagattgacggggacgtcgaaatcccccctaacaaggcgactgttctgagggggcatgagtcggaggtcttcatctgcgcttggaatccagtctcagatttactggcatcgggctctggggactccactgctagaatctggaatctgaacgagaactctaatggaggcagcacacagctggtgctgcggcattgcatccgtgaaggggggcacgatgttccctcaaataaagacgtaaccagtttggattggaattcagacggcacactgctggctatgggctcttatgacggctttgcacggatatggaccgagaatggcaatctagcaagcacgctggggcagcataagggccctatctttgcgctcaagtggaacaagaaaggaaattacgtgctgtccgctggggtggacaaaacaacgattatttgggacgcacatacaggtgaggcaaagcagcagtttccgttccactcggctccagctttggatgtggattggcagaacaacatgactttcgctagctgctccactgacatgtgcatccacgtctgcagacttggatgcgaccatcctgtgaaaacgttccagggtcacactaatgaagtgaacgctataaagtgggacccatcgggcatgctactggcctcttgcagcgacgacatgacactcaagatttggtccatgaagcaggatgcttgcgttcatgacctccaagcccattcgaaggagatctacacgatcaagtggagcccaaccggtcccgcaacatctaatcctaattccagtattatgctcgcctccgccagcttcgacagtaccgttcggctttgggacgtggagcaaggcgtgtgtacccacacccttatgaaacaccaggaacccgtttattccgtggcattcagccccgatggaaagtaccttgccagcggcagcttcgacaagtatgtgcatatctggaatacacagagcggctctctagtgcattcctaccagggcactggtggaattttcgaagtgtgctggaacgctcgcggagataaggtgggcgcctcagcatccgatgggtcagtctgcgtcctcgatctctag

SEQ ID NO: 138246 - DNA, 1569 bp, Artificial Sequence
  Description of Artificial Sequence: Synthetic coding sequence
atgagcattacaagcgatgaggtaaacttccttgtttatcgctatttacaggagtccgggttctctcatagcgcgttcacttttggaatcgaatcacatatcagccagtcaaatatcaacggcactctggtccccccatccgctttgatcagcatcctgcagaagggtctgcaatacgtcgaagccgaaattagcataaataaggacggcacagtcttcgacagccgtcctatcgaaagcctcagcctcatagtagccgtgatcccggatgtcgtgcagatgcggcaacaggcctttggtgagaagttgacccagcaacaggccagtgccgccgctacggaggccagcgccatggccaaggccgccaccatgacacctgccgctatctctcaacagaaccccccaaaaaaccgcgaagccacagtcaatggagaagaaaatggagcacatgagataaacaaccacagcaaaccaatggagattgacggggatgtcgagatccctcctaataaggcgaccgtcttgcgcggccacgagtcagaagtgttcatctgtgcatggaacccggtgagtgatctgctggcttccggatccggggactctactgcacggatttggaaccttaacgaaaattcgaacggtggctctacccagctcgtgttacggcactgtattagagaagggggacacgacgttccgagcaacaaggacgtgacgtctctagactggaactcagatggaactttactggccatggggtcttacgacggctttgcaagaatttggacagagaatgggaacctagcttccactctgggacagcacaagggcccgattttcgcactgaaatggaataagaaagggaactacgtcctttcagctggggttgacaaaacgacaatcatatgggacgctcacactggtgaggcaaagcagcagtttccgttccattccgcgcccgctctcgacgtcgattggcaaaataatatgacgtttgcttcatgcagtaccgacatgtgtattcatgtgtgtagactcggctgcgaccacccagtaaagacgtttcagggccataccaatgaggtcaatgctattaagtgggatcctagcgggatgctcttggccagttgctccgacgatatgactctaaagatatggtctatgaagcaggacgcctgcgtacacgatctccaggctcatagcaaggagatctataccatcaaatggagccccactggaccggcaactagcaatccaaactccagcatcatgcttgcaagtgctagcttcgattccaccgtcaggctctgggacgtggagcagggtgtctgcactcacaccctgatgaagcaccaggagccagtgtattccgtcgccttcagccccgatggaaagtacttagcttcgggaagctttgataaatatgtccacatctggaacacacagtctggctccttagtgcatagctaccaaggcactgggggcattttcgaggtctgctggaacgctcggggggacaaggtgggcgcttctgcttccgacggctctgtttgtgtgttggacctgtag

SEQ ID NO: 138247 - DNA, 1095 bp, Artificial Sequence
  Description of Artificial Sequence: Synthetic coding sequence
atggagatagatggcgacgttgagattcccccaaataaagctacggtcctcagaggtcatgaaagcgaagtctttatttgcgcttggaatcccgtgtcagacttgttggcctccggatctggtgattctactgccaggatctggaatttgaatgagaactctaacggtggatccacacagctggtcctgaggcactgcatccgggagggggggcatgacgtgccatctaataaagacgtaactagcctcgattggaattccgacggcacactcctcgcgatgggcagctacgacgggttcgcccggatttggacagaaaacgggaatctggccagcacactgggccaacataaaggcccaatctttgcattaaaatggaataagaagggcaattatgtgttgtctgcaggtgtggacaaaacaacaattatatgggacgctcacactggggaggctaaacagcaattcccattccattcagccccagccctcgatgttgactggcagaacaatatgacctttgctagctgttctaccgacatgtgtattcacgtgtgcaggttagggtgtgatcatcctgtgaaaactttccaagggcataccaacgaggtgaatgcaattaagtgggatccttccggcatgcttttagcttcctgctccgacgatatgaccctgaagatctggagtatgaagcaggacgcctgtgtgcatgatctgcaagcacattctaaagagatttacaccattaaatggagccccacaggacccgctacctccaatccgaatagcagcattatgttggccagtgccagcttcgacagtacagttcgtctgtgggatgttgaacaaggagtatgtactcacacccttatgaagcaccaagagcccgtttattcagtggccttctccccagacggaaaatacctggcctcaggcagctttgataagtatgtgcacatatggaatactcagagcggttccctcgtgcacagctatcaggggactggcgggatctttgaggtgtgttggaacgccagaggggacaaggttggtgccagcgcttctgatgggagcgtttgtgtgctggatttgtag

SEQ ID NO: 138248 - DNA, 1752 bp, Artificial Sequence
  Description of Artificial Sequence: Synthetic coding sequence
atgcccctgcgaaaaatgaaaattccatttcttctcctgtttttcctgtgggaagccgagtcccacgcggcaagtaggcccaacattatactggtaatggccgatgatctcggtatcggtgatcctgggtgttacgggaataaaaccatccggactcccaacatcgacagactggcttccggcggcgtcaagttgactcagcatctggcagcttcacctctgtgcacgcctagtcgagccgcgtttatgaccggacggtaccccgtccggtcaggcatggcctcctggagtaggaccggcgtcttcctttttaccgccagctccggcggccttcctaccgatgagataaccttcgcgaaactgctcaaggaccaaggctacagtacagcacttattgggaagtggcaccttgggatgagttgtcactcaaagactgacttttgccatcatccgttacatcacggttttaactatttctacggaatctctctgactaatttaagggattgtaagcccggggaaggctccgtgtttaccactggctttaaaagactcgtcttcctacccttacagattgtgggcgtcaccctactaaccctggccgcactcaattgcttgggtttgttgcacgtgcctctgggagtgttcttctctctcttgttcctcgccgcactgattcttacgctgttcctcggctttcttcattacttccgtccactaaattgttttatgatgaggaactacgagatcatacagcaacccatgtcatatgacaacctcacccaaaggctgaccgttgaagctgctcaatttatccagagaaacacagaaacccctttcctgctggtcctgtcatatttgcacgttcacacagccctgttttcttccaaggatttcgccggcaagtcccaacacggcgtttatggcgatgccgtcgaagaaatggattggtccgtaggccagatactgaatctgctcgacgaactgcgcctggccaatgacactcttatctattttacgtcagaccagggcgcacatgttgaggaggtgagctcaaagggtgaaatccacggaggaagtaacggcatttataagggcgggaaagccaacaattgggaagggggcatacgggtccctggcattctgaggtggcccagggtgatacaggctggccagaagattgacgaacccacctccaatatggatatcttccctaccgtagcaaagttagccggagcccctctgcctgaggatcgaattatcgatggtcgggacttgatgccactcctcgagggaaaatctcaacgttccgaccatgaattcctgtttcattactgcaacgcatatttgaatgccgtgagatggcatccccagaattccacgagcatctggaaagctttcttcttcacccccaactttaaccccgtgggaagcaacggttgttttgccacccacgtgtgcttctgctttggaagctacgtaacccatcatgacccgccattgcttttcgacattagtaaggacccgcgggaacggaacccacttacgccggcgtcagagcctcgtttctacgagattttaaaagtgatgcaggaagccgctgacaggcatacccagacactgcccgaggtacccgatcaattctcgtggaacaattttctgtggaagccctggctccaactctgctgtcctagcaccgggttatcctgccagtgcgatcgcgagaagcaggacaaacggctgtctcgatag

SEQ ID NO: 138249 - DNA, 1581 bp, Artificial Sequence
  Description of Artificial Sequence: Synthetic coding sequence
atgtcaatcacatcggatgaagtcaactttttagtgtaccggtacttgcaggagagcgggttttcccactccgcctttacatttggcatagagtcccacatcagtcaatcaaatattaatggcacgttggttccgcctgccgctctgatcagcatcctgcagaaaggtctgcaatatgttgaggccgaaatttcaataaacgaagatggaacagtgttcgacggccggcctatcgagtccctctcattaatcgatgccgtgatgccagacgtggtgcagacaagacagcaggcatttagggaaaagcttgcccaacagcaggcatccgctgcagctgcggccgcagctgctaccgctgcagcaacagcagccactaccacttccgcaggcgtgtctcaccagaatccatccaagaatcgtgaagcaaccgtaaacggagaagagaatcgggcacactcagttaacaatcatgcgaagcctatggagatcgatggagaggtggagattccgagctccaaagcaacggtgcttcgggggcacgagtcggaagtattcatttgtgcttggaacccagtgagcgacctgcttgcttcagggtccggtgattcaaccgcacgaatctggaatctaaacgagaacagcaatgggggaagtacccagctggttctgaggcattgtattagagaaggtggccacgacgtcccttcgaataaggatgtaactagcttagattggaataccaacggaacgctgctggccacaggctcatacgatggttttgccaggatctggactgaagatgggaacctggccagcacccttggccagcataaaggccccatcttcgcgctcaagtggaacagaaagggaaattatatcctcagcgcaggtgtggacaagacaacgattatatgggacgcacataccggggaggcgaagcagcagttcccatttcactcggcccctgccctcgatgtagattggcagaataacaccacattcgctagttgtagcacagacatgtgcattcacgtctgccgcctgggctgtgatcggcctgttaaaaccttccaaggccacaccaacgaagtaaacgccatcaaatgggatccttcaggtatgctgctggctagttgctccgacgacatgaccctgaaaatatggagtatgaaacaagaggtgtgcatacatgacctgcaagcccacaacaaggaaatctacaccatcaaatggtctccaaccgggcctgcaactagtaaccctaatagtaacataatgttggcctctgcttcattcgactccaccgttaggctctgggatattgagcggggcgtttgcacccacactttaaccaaacaccaagaaccggtctactccgtggctttctcccctgatggcaagtatttggcgagcggcagttttgataagtgtgtgcacatctggaacacacagtccggaaatctggtgcactcttaccggggcaccggagggatttttgaggtctgctggaacgcacggggagacaaagtgggagcctccgcctctgacggatctgtttgcgtgcttgacttaagaaaatag

SEQ ID NO: 138250 - DNA, 1734 bp, Artificial Sequence
  Description of Artificial Sequence: Synthetic coding sequence
atgactgagctggcaggagcaagctctagctgttgtcatagaccagcagggcgcggggctatgcagtccgtgcttcatcatttccagcgcctgcggggccgcgagggcggctcacacttcataaataccagcagtcccaggggggaggctaagatgtccataacttcagatgaagtgaactttctggtctataggtatctccaggaatctggcttttcacattctgcttttacatttggaatcgaaagccacatatcccagagtaacattaatggcactctcgtgcctcctgctgcgctgattagcattctgcagaaagggctgcaatacgtggaggctgagatcagcatcaacgaagacggtacagtatttgacgggagaccaatagagtcgctgagtctaattgatgctgtgatgcccgacgtcgtccagacacggcaacaggcctttcgggagaaactggctcagcagcaggcctcagcggcagcggccgccgccgctgccaccgccgccgctactgcagctactaccacctccgctggtgtctctcaccagaacccctctaaaaatagggaggctactgtcaacggagaagagaacagggctcacagtgtcaacaatcatgctaagcccatggaaatcgatggagaggtggagattcctagcagcaaggcgactgttctccggggccatgagtccgaggttttcatctgcgcctggaatcctgtatcggacctgctggcttcagggagcggagactctacagcaagaatctggaacctgaacgagaattcaaacgggggctctacacagctggttctgagacattgcatcagagaaggcggtcatgacgtcccttcaaataaggatgtgacgagtttagattggaatacaaatggcaccctgcttgccaccgggagttacgacggctttgcccgcatctggactgaggacggaaacctggcctccacactcggtcagcacaagggtcctatttttgccctgaagtggaaccgcaaaggcaattatatcttgtcggccggagttgacaaaacaacgattatctgggacgcccatacgggggaggctaagcagcagtttccatttcactctgctcctgctttagacgtagattggcagaataacacaacatttgcttcttgcagcaccgatatgtgtatccatgtctgtcggctgggatgcgatcggccggtcaagacctttcagggccacacaaatgaggtgaatgccattaaatgggacccttcggggatgctactggcctcctgctcagacgacatgacccttaaaatttggtccatgaagcaggaggtgtgcattcacgacctgcaggcccacaataaggaaatctacacaatcaaatggagtcccaccggcccagccaccagtaaccctaactctaacatcatgctggctagcgcatcctttgactcaaccgtgcgattgtgggatattgagagaggcgtttgcacacatactctgacaaagcaccaggagccagtgtatagcgtcgccttctcacctgacgggaagtatttggccagcggatcattcgacaagtgcgtgcacatatggaatacacagtccggcaatctcgtgcactcttaccggggtacaggcggcatctttgaagtatgctggaacgcaaggggcgataaggtcggcgcaagcgcttctgacggcagcgtatgcgtactggacctgcgcaaatag

SEQ ID NO: 138251 - DNA, 228 bp, Artificial Sequence
  Description of Artificial Sequence: Synthetic coding sequence
atgtccatcaccagcgatgaagtgaactttctagtctataggtacctgcaagagagcggtttttctcactcagcctttaccttcgggatcgaaagccatatcagtcaaagcaatatcaatggcactctcgtgccccctgctgcattaatctctattctgcagaaaggtctccagtatgtggaggctgagattagcatcaacgaagatggtactgtctttgacgggtag

SEQ ID NO: 138252 - DNA, 138 bp, Artificial Sequence
  Description of Artificial Sequence: Synthetic coding sequence
atgtccattacttccgatgaagtgaatttcctcgtttataggtatctgcaggagagcggcttctcacattcagcctttacatttggcatcgaatcacatatttcccagtctaatattaatggcacactcgtcccctag

SEQ ID NO: 138253 - DNA, 1581 bp, Artificial Sequence
  Description of Artificial Sequence: Synthetic coding sequence
atgtccattaccagcgacgaagttaatttcctagtgtaccggtatcttcaggagagtgggtttagccattctgcattcactttcgggatcgaatcccatatctcacagagtaatatcaacggaacgttggtaccgcctgctgctctgataagtatactccagaagggccttcaatatgtcgaggcagaaatttcaatcaacgaggatggcacagtattcgatggccgccctattgagtctctctccctgatcgatgccgtcatgcctgatgttgtacagacgcgacagcaggcctttcgagaaaagctcgcccaacagcaggcatctgccgcagccgcagcagctgccgccacagcagcagcgactgcagcaacgacaactagcgccggcgtcagccatcagaacccaagcaagaatagggaagcaactgtgaacggtgaggagaatcgggcccattcagtgaacaatcatgctaagcccatggagatagacggcgaggttgaaatcccaagcagtaaggccactgttctgcggggccatgaaagcgaggtctttatctgtgcctggaatccagtgtccgacttactggccagcggatccggcgacagcacagctcgcatttggaatctgaacgaaaattcgaatggcgggtccactcaactggtgcttagacattgtatccgagagggtggccacgacgtgccaagcaataaggatgtgactagcttggattggaacaccaacggcaccttgctcgccacgggcagctatgatggcttcgcacggatatggacggaagacggcaacctcgcatcgactctgggtcaacacaaaggcccaatcttcgcactcaagtggaaccgtaaaggtaactacattctctctgcgggcgtggataagactaccattatttgggatgcacacaccggggaggccaaacaacagttccccttccacagcgcccctgcactcgatgtcgactggcagaacaacacaacttttgcttcttgctcaacagatatgtgcattcatgtgtgccgcctgggctgcgatcgccccgtgaagacgttccagggacacaccaacgaggttaatgccatcaaatgggacccctctggtatgctgttggcctcctgttcagacgacatgacactgaaaatttggtcgatgaaacaggaagtttgtatacacgatcttcaggcccataacaaggaaatctacaccatcaagtggagtcctacaggaccagccacctccaacccgaactccaacattatgttagccagtgctagctttgattcaaccgtccggttatgggatatcgagcgaggcgtgtgcactcacacactgaccaaacaccaggagcccgtgtatagcgtggcattcagccctgatgggaaatacctggccagcggcagttttgacaagtgtgtgcacatctggaatacccagagcggaaacctcgtacactcttatagaggcactggaggaattttcgaagtctgttggaacgctcgtggagacaaagttggcgccagcgcgtccgacggctccgtctgtgtgttggatcttagaaaatag

SEQ ID NO: 138254 - DNA, 180 bp, Artificial Sequence
  Description of Artificial Sequence: Synthetic coding sequence
atgaccgagctggccggagccagttcgagttgctgccaccggcccgccggccgaggggctatgcagagcgtgctgcaccatttccagcggctacggggacgagaggggggctcccacttcatcaacacaagctcgccaaggggggaagccaaaatgtccattacctctgacgaggtgtag

SEQ ID NO: 138255 - DNA, 243 bp, Artificial Sequence
  Description of Artificial Sequence: Synthetic coding sequence
atgactgaattggccggggcttcctcctcatgctgccatcggcccgccggcagaggtgccatgcagtctgtcctgcaccattttcagcgcttaaggggtcgggaaggcgggtcgcattttatcaatacaagctcaccgcgcggtgaggccaagatgtctatcacttcggatgaagttaatttcctggtgtaccgctatctgcaggaatccggcttttctcactcagcattcacatttggttag

SEQ ID NO: 138256 - DNA, 1581 bp, Artificial Sequence
  Description of Artificial Sequence: Synthetic coding sequence
atgtctatcacttctgacgaggtgaactttctcgtctaccgctacttacaggagtccggctttagtcacagtgcctttacctttggcatagagtcccatatttctcagagcaatataaatggcacgcttgtccccccagcagctttaataagtattttgcagaaggggctgcagtacgtagaagctgaaatctccatcaatgaagacgggactgtgtttgatggaaggccaattgaaagcttatcactcattgatgccgtgatgcctgatgtcgtgcagaccagacagcaggcgttcagggagaagctggctcagcagcaagcatccgcggctgccgctgcggctgccgctaccgcagctgctacagcggctactaccactagtgctggcgtgtcccatcagaacccaagtaaaaatagggaggccacagttaatggcgaggaaaaccgcgcccactctgtcaacaaccatgccaagccaatggagatcgacggggaggtggagattccatcttccaaggccaccgtactcagaggacatgagagtgaagtgtttatttgcgcatggaaccccgtttccgacctgctggcttccggtagtggggactccacagcccgtatttggaacttgaacgagaattccaatggtggcagcacacaacttgtgctgcgccattgtatccgcgagggaggtcacgatgtcccatcgaataaggatgtgaccagcctcgattggaatacaaatggcactctacttgcgacaggaagttacgatgggttcgcaaggatctggactgaggatgggaacctggctagcacgctgggacaacacaaggggcctatttttgcccttaaatggaaccggaaagggaattacattctttctgcaggtgtagacaagacaactatcatttgggatgctcacaccggagaggcaaagcagcagttcccattccatagtgctcctgcgttggatgtggattggcagaacaacaccacctttgcatcttgttccacggatatgtgtatccatgtgtgtcgtcttggttgcgacagacctgtgaaaactttccaggggcatacaaatgaggtgaacgcgatcaagtgggatcctagcgggatgctcctggcgtcctgctcagacgacatgacattgaagatatggtcaatgaagcaggaggtgtgcattcacgacctgcaggcccataacaaagaaatctatacaataaagtggtcccccaccggtccggcaacgtctaaccccaattcaaatataatgttagcctccgcttcgttcgacagtactgttagattatgggacatagaaaggggggtgtgcacgcacacactgaccaaacatcaggaaccagtgtacagcgtcgccttttcccccgacggcaaatatctggcatccggatcttttgataagtgcgtacatatctggaacacccaatcaggaaacctcgtgcactcctatcgcggtacagggggtatattcgaggtctgctggaacgctcggggagacaaggttggtgcttcagcttccgatgggtctgtctgcgtgcttgatctcaggaagtag

SEQ ID NO: 138257 - DNA, 1344 bp, Artificial Sequence
  Description of Artificial Sequence: Synthetic coding sequence
atggaattgtctcaaatgtctgagctgatgggactgtctgtgttattgggattgctggcactcatggccacggcggcagtggccagggggtggctgcgagcaggcgaggaacgtagcggccgaccggcctgtcaaaaggcaaatgggtttccacccgacaagagctcagggtcaaagaagcaaaaacagtatcagagaattaggaaggagaaaccccaacaacacaactttacccataggctgttagccgcggctttaaaatctcactcaggcaatataagttgcatggatttcagcagcaatgggaagtacttggctacttgtgcagacgaccggaccattcgtatctggtctactaaggattttctgcagagggagcataggtctatgagagccaacgtcgaacttgaccacgcgactctcgttaggtttagtcctgattgtagggctttcatcgtctggttagcaaatggggataccctgcgcgtgttcaagatgacaaagcgggaggacgggggatacacgttcactgctacaccagaggatttcccaaagaagcacaaggcaccggtcatcgatatcggcattgctaacactggcaaattcataatgacagccagttctgacacgacagttttaatatggtcactgaaagggcaggtgctgtctacaattaacactaatcagatgaataatacccacgccgctgtgtcgccctgcggaaggtttgtggcatcgtgtggctttaccccagatgttaaagtctgggaggtgtgctttggcaagaagggagagttccaggaagtagtgcgcgcctttgagctgaaggggcactccgctgcagtacactctttcgctttctctaacgactcgcggcgaatggcttccgtctccaaagatggcacctggaagctttgggatactgatgtagaatacaagaaaaagcaggatccctatctactgaaaactggtaggtttgaggaagctgcaggagcggccccgtgcagactcgcactctctccaaatgctcaggtgcttgcgctggcaagcggcagttctatccacctatacaatacacgaaggggggaaaaagaggaatgctttgaacgggttcacggagagtgcatcgccaacctgtcttttgatattaccggcagatttctcgccagctgcggcgatcgagcagtcagacttttccacaacactcccgggcaccgagcaatggtcgaggaaatgcaaggccacttaaagcgggccagtaatgaatctactagacagcggttacagcaacagttgacgcaggctcaggaaaccctgaagagcctgggcgcccttaagaagtag

SEQ ID NO: 138258 - DNA, 1341 bp, Artificial Sequence
  Description of Artificial Sequence: Synthetic coding sequence
atggaactaagtcaaatgtccgagcttatggggctttccgtgctgttgggcctgctggcactcatggcgaccgccgccgttgcccgcggctggcttcgggccggggaggagcgatcagggaggccagcatgccagaaagccaacgggttccctccagataaaagcagtggatcaaaaaaacagaagcaataccagagaattcgaaaagaaaaaccacagcagcataatttcacccataggctcctggccgccgcactgaagtcgcactcaggaaacatttcctgtatggacttttcaagcaacggaaaatatttagccacttgtgccgatgacaggaccatacgcatttggtccactaaggatttcctgcaaagagagcatagaagtatgagagcaaacgtggagctggaccatgcaacactggtgaggttttcgcccgactgtcgggcctttattgtttggctggcaaacggagatactttacgcgtgttcaagatgaccaaaagggaagatggcggttacacttttacagctaccccagaagacttcccaaaaaaacacaaggcgcctgttatagacatcggcattgctaacacggggaagttcatcatgacagcctcttccgacaccactgtgttaatctggtcgcttaagggacaggtgctcagtaccatcaacacaaaccagatgaacaacacacacgcagcagtgtcaccttgtggacggttcgtggccagttgtggatttactcctgacgtcaaggtctgggaggtgtgtttcggcaaaaagggggaattccaggaagtcgttcgagctttcgagcttaaaggccattcagctgccgtccactcctttgctttctcaaatgactctaggagaatggcatcagtgagcaaggatggaacctggaaactttgggacaccgatgtcgagtataagaaaaagcaggatccatacctgcttaaaacaggtagattcgaggaagcagctggcgcagcgccttgtcggctggctttaagtccaaatgcccaggtgcttgcacttgcctccgggtcttcaattcacttgtataacacccgacgcggagagaaagaggagtgcttcgagagggtgcacggcgaatgtattgctaacctttcgttcgatataacgggccgattcctggctagttgtggagaccgagcagtgagactgttccacaacacccctgggcaccgtgccatggtcgaagaaatgcaggggcaccttaagcgggcatccaatgaatcgactcgtcagcgcctgcagcagcagttgactcaggcgcaggtgaccctgggcggtccaggggctgaagattag

SEQ ID NO: 138259 - DNA, 2427 bp, Artificial Sequence
  Description of Artificial Sequence: Synthetic coding sequence
atggctgagaccgccgctggcgtaggaaggtttaaaaccaactatgccgtcgagagaaaaatcgagcccttttataaagggggaaaggcccagttggatcaaactggccagcacttgttttgtgtgtgcggcacacgagttaacatcctggaggtggcttctggcgccgtgctcaggagcctggagcaggaagaccaggaggatattacggcgttcgatctctctccagataacgaggttctcgttactgctagccgggctcttttattggctcagtgggcctggcaagaagggtcagtcacgcggctttggaaagctattcacacagcccccgtggccacaatggcctttgacccaactagtaccctccttgcaacaggcgggtgcgatggcgccgtgcgggtctgggacatagtcaggcactacggaactcatcatttccgcggctcccctggcgtggtgcacctggtggcattccacccggatcctacgaggcttcttctgttcagttccgccacagatgcggccataagggtctggagtctccaggacaggtcttgtctggccgttctcaccgcccattattccgcagtgacatctctcgccttctctgccgacgggcacaccatgctgagttctggcagagataaaatttgtatcatctgggacctgcagtcttgccaggcaacgagaaccgtgcccgttttcgaatcggttgaggctgccgtcctgctgcccgaggaaccagtttctcaactgggcgttaagagtcctggcctctattttttaaccgctggagatcaggggaccctgagagtgtgggaagctgcatctgggcagtgcgtgtacacacaagctcagccaccagggcctgggcaggaactgacgcactgtacgctggcccacactgccggtgttgtgctgaccgctacagcggaccacaatctccttttatatgaagctcgttctctgaggctccagaaacagtttgcaggctacagcgaggaagtgctggacgtgagatttttggggcccgaagactcccatgtggtggttgccagcaactccccctgccttaaggtctttgaattgcagaccagcgcctgccaaatcttgcatggccacacggacatcgtccttgccctagatgtttttcgtaaagggtggctgttcgccagctgcgcaaaggaccaaagcgtgaggatctggaggatgaacaaagctgggcaggtgatgtgtgtggcacaaggatccggacatactcattctgtcggtacggtgtgctgttcacgtttgaaggaatcgttcctcgttaccgggtcacaggactgcaccgtgaagctgtggcctctccctaaggctctcctgagcaagaataccgctcccgacaacggaccaatcttgctccaagctcaaactacacaacgctgccacgataaagacatcaactccgtggcaattgctccaaatgacaagctgctcgcaaccggcagccaggacaggacagctaagctttgggcattgcctcagtgccaactcttaggagtgttctccggccaccgacgcggcctgtggtgtgtccagttcagtcctatggaccaggttcttgcaactgcaagcgcagatgggacaattaagctgtgggctcttcaggacttttcctgtctcaaaactttcgaaggtcatgacgcttccgtgctaaaggtagctttcgtcagccgcggcacccagctgctttcatccggctctgacggtcttgtgaaattgtggaccattaaaaacaatgagtgtgtgaggactctggatgctcatgaagataaggtgtggggacttcactgttcaagactcgatgaccacgctctgaccggtgcttccgatagtagagttattctgtggaaggatgttaccgaggcagaacaagctgaggagcaggctcggcaggaggaacaggtcgttcgtcagcaggaactcgacaacctcctgcacgagaagcgttacctgcgggcactgggcctggcaatctccctggatcgtccgcatacagtgctgaccgtcatccaggcgatccgcagagatcccgaggcctgtgaaaaactggaggcaacgatgttaaggctccgcagagaccagaaagaggccttgctgaggttttgtgtaacttggaatactaacagccgacactgtcacgaggctcaggccgtcctgggtgttctgctcaggcgcgaggcgcctgaggagctgctagcctacgaaggcgtacgggcagcactggaagctctcttgccctacacagagaggcacttccagcgtctgagcagaactctgcaagccgcggcattcctcgatttcctgtggcacaatatgaagctacctgtcccggctgccgcaccaacaccttgggagactcacaaaggcgctctcccctag

SEQ ID NO: 138260 - DNA, 2427 bp, Artificial Sequence
  Description of Artificial Sequence: Synthetic coding sequence
atggccgagacggccgccggagtggggcggtttaagactaattatgcggtggaaagaaaaattgaacctttttacaaaggggggaaggcgcagcttgatcagacgggccagcatctcttttgcgtgtgcgggacaagggtcaatattctcgaagtggcatccggtgcggtactccgaagcttagaacaggaggatcaagaagacattactgcatttgatcttagcccagacaacgaagtgctcgtaaccgcatctcgagccttgctcctcgcgcaatgggcctggcaagaggggagtgtaaccagactatggaaggccatccacacagctcctgttgcgaccatggcattcgaccccaccagtacgctgttagcgactggcggctgcgatggtgcagtgagggtttgggatattgtccgacactacgggactcaccatttccgcgggagcccaggcgtggtgcacctggtggctttccatcccgatcctacgaggcttttgctgttttcttctgcaaccgacgccgccatcagagtgtggtctttgcaggacagaagttgtctagctgtgctcaccgctcattactccgccgtcacaagtctcgctttttcagctgatggccacaccatgctttcctccggtcgtgataaaatctgtatcatctgggatctccagtcctgtcaggccactcggacagtgcccgtattcgagtccgtggaggctgccgtgcttctgcccgaggaacccgtgtcccaactcggggtgaagtcccccgggctctacttcctgactgccggtgatcagggcacgctcagagtatgggaggccgccagcggacagtgcgtatacacacaggcccagccacccggccctggacaagagttgacacactgtaccctggcccataccgctggcgtggtgctaacagcaaccgccgaccacaaccttttactttacgaggcacgatcactcagactgcagaagcagtttgcgggatacagtgaggaagtgctggacgtgcgcttcctgggaccggaggatagccacgtggtggtggccagcaacagtccctgcttgaaggtttttgagctccagaccagcgcttgtcagatattacatggtcacaccgatattgtgttggcgcttgatgtgttcaggaagggatggctcttcgcgagctgcgctaaagaccagagcgtgcgcatttggcgtatgaataaagcagggcaggttatgtgcgtcgcacaaggatcagggcatacccactcagtcggcactgtatgctgttctcgcctgaaggagtccttcctggtcaccgggtcccaagattgtacagtgaaactttggcccctccccaaagctctgctgtcgaagaatacggcccccgacaatggacccattctgttgcaagcccagactacacaacggtgtcatgacaaagacataaactcggttgccatcgctcctaatgataagttgctcgcgaccgggagtcaagacaggaccgccaagctctgggcactgccacagtgtcaactgctaggggtcttctccggacacagaagaggtctgtggtgcgtgcagttctccccgatggaccaggtgctcgctactgctagtgcagacgggaccattaaactctgggctctacaggattttagctgtctaaagactttcgaggggcatgacgcatccgtactcaaagtggccttcgtttctcgcggcacccagctgctgtcctccggatccgacgggttggtcaagttatggaccattaaaaataatgaatgtgtcaggacactggacgcacacgaagataaagtctggggcctgcactgcagtcggttggatgaccacgctctcaccggtgcttcagattctagggttattttgtggaaagacgtgaccgaggcagagcaggccgaagaacaggcaaggcaggaggaacaagttgtaagacagcaagagctcgataatctgctccatgagaagcggtatctgcgcgccttggggctggctatcagcttggatcgtccacataccgtgctgacagtcatccaggctattaggagggatcctgaggcttgcgaaaaactggaagcaacaatgctgcgcttgcgtagagatcagaaggaggctctcctgagattctgtgtgacttggaataccaactccaggcactgccacgaggcccaggctgttctgggggtgctcctgcggcgagaggcccctgaagagttgctcgcctatgaaggcgtgcgcgcagcattggaagcactactgccatatactgagcgccacttccagaggctgtcccggaccttgcaggccgccgcatttctggacttcctttggcataatatgaagttaccggtaccggctgccgcgcctacaccttgggagactcataaaggagctttgccttag

SEQ ID NO: 138261 - DNA, 729 bp, Artificial Sequence
  Description of Artificial Sequence: Synthetic coding sequence
atgtttccccagagccgtcaccctaccccacaccaggctgccgggcaacccttcaagttcacgatccctgagtctctcgatcgcatcaaggaagagtttcagtttctccaggcccagtatcattcattgaagctggaatgtgagaagttagctagtgaaaaaactgagatgcagcggcattacgtgatgtactacgagatgtcatacggcctgaacatagaaatgcataagcagacagaaatcgctaagcggctgaataccatctgcgcccaagtcattccatttctgtcccaggagcatcagcagcaggttgcgcaggcagtggagagggcgaagcaggtgacaatggccgagctgaacgctatcataggagtgcgcggcttgccaggccttccaccaacccaacagcagctgcaggcccagcacctgtcccacggtcatggtccacccgtgcccctgacaccccacccctcaggactgcagccacccgggatcccccccctggggggatctgccggattgctcgcactaagcagcgcattaagtggccagagccatttggccatcaaggatgacaagaaacatcatgacgcagaacatcatcgcggggaaagacctggtaagagcaactcgctgctggtcccagactccttgcgtggcacggataaacgccgtaatggacccgaattcagcaacgatataaagaaacgcaaagtggacgataaatag

SEQ ID NO: 138262 - DNA, 435 bp, Artificial Sequence
  Description of Artificial Sequence: Synthetic coding sequence
atgcagagacactacgtcatgtactatgaaatgagttacgggttgaacatcgagatgcataagcagactgagatcgccaaaaggcttaatacaatctgcgcacaggttatcccattcctcagtcaggaacaccaacaacaggtagcccaggccgtggaacgtgccaagcaagtcaccatggcggaattgaatgctatcatcgggcagcagcaactgcaagctcagcatctgtcccatgggcatgggccaccggtgcctttaacaccgcacccttctggtctgcagccccctggaattcctcctctggggggatccgcgggactgctggctctcagttcagctctgagtggccagtcacacctggccattaaggatgataagaaacaccatgatgctgagcaccaccggggggagcgccccggaaaacctgattag

SEQ ID NO: 138263 - DNA, 384 bp, Artificial Sequence
  Description of Artificial Sequence: Synthetic coding sequence
atgcccacaccagggacgagtgctacccccggattgaggcctgggctcggaaaacccccggctatcgatccactggttaaccaggctgcagccggtttaagaacaccgttagcggtccctggcccatacccggcccccttcggcatggtgccacacgccggtatgaatggagagttaaccagccccggagctgcttacgcctcgctgcacaacatgtctcctcagatgagtgcagctgctgcagccgccgcggtcgtggcttacgggcgttccccgatggtcggcttcgaccctccgccccacatgagggttcccaccataccaccgaacttggcaggcattccaggggggaagcctagcctagtgcctgctcccgcccattag

SEQ ID NO: 138264 - DNA, 384 bp, Artificial Sequence
  Description of Artificial Sequence: Synthetic coding sequence
atgccaacaccgggaacctccgcaacccccggattgagaccggggctcggcaagccacctgctatcgatccattggttaatcaggcagctgcaggtctccgcacgcctctggctgtgccaggcccttatcctgccccgttcggcatggtcccgcacgctgggatgaatggggagctgactagtcccggggctgcctacgcatccctccacaacatgagcccacaaatgagcgctgctgctgcggctgccgccgtggtagcttatggaaggagtcctatggtggggtttgacccacctccccatatgagagtcccaacgattcctcctaatctcgccggaatacctggcggcaagccctcacttgtacccgctcccgctcattag

SEQ ID NO: 138265 - DNA, 2313 bp, Artificial Sequence
  Description of Artificial Sequence: Synthetic coding sequence
atgttcccccagtctagacaccctacgccacatcaggccgctggacagcctttcaagtttacgataccggaaagtctcgatcgtataaaggaggaatttcagttcctgcaggctcagtaccatagtttaaagctggaatgtgaaaagctggcctcggaaaagaccgagatgcagagacactacgtcatgtattatgaaatgagctatggcttgaatattgaaatgcacaaacaaaccgaaattgccaaaaggctgaataccatctgtgcgcaggttataccctttcttagtcaagaacatcagcagcaggtggcacaggccgttgagagggcaaaacaggtgacgatggctgaattgaatgccatcattggacagcaacagctgcaagcacagcacctgagccacggccatggacctcccgtcccactcacaccgcacccatccggattgcagcctccaggtatcccgcctctcggcggctctgccgggttactggcactgagcagcgctttgagcggtcagagccatcttgcgatcaaggacgacaagaagcaccatgatgccgagcaccaccgggatagagaaccgggcacttctaactctctcctagttcctgattccttaaggggtacagataagaggaggaatggtcctgaattcagtaatgacattaaaaaaaggaaggtggacgacaaagactcaagccattatgactctgacggagataaatctgatgacaacctggtcgtcgatgttagcaacgaagaccctagtagtccaagggcctcaccagctcattctcctagagagaacggcatcgacaagaaccgacttctcaaaaaggatgccagctctagcccagcaagcacagcttcatctgcctcttccaccagcttaaagtctaaagagatgagcttgcatgagaaggccagtaccccggttttgaaaagctctaccccgacgcccaggtccgacatgccaactcccggtacatctgctacccccggtcttcgcccagggttggggaagccccctgctatcgacccattggtgaatcaggccgcggccgggcttagaacaccacttgcagtgccgggcccttaccccgcgcctttcgggatggtcccacacgccggtatgaatggcgaactaacctctcccggagccgcctacgcttctctgcacaatatgagccctcagatgtccgccgccgccgcagccgccgccgtggtggcatacgggcggtctcccatggttggatttgaccctccaccccatatgagagtgcctacgatacctcccaatctggccggcattcccggcgggaagcccgcatattcattccacgtgacggccgatggccaaatgcaacccgtcccattcccccctgatgccctcattggacccggtatcccacgccatgctcggcagatcaataccttgaatcatggggaagtcgtctgcgcggtgacaattagtaatcctacccgccacgtatacaccggaggcaagggctgtgtgaaggtgtgggatattagccaccccggcaacaagtcgccggtcagtcagctcgattgcctgaaccgagacaattacatacgatcctgtaaactgctgccggacggttgtacactgattgtggggggggaggcatccacgctgagcatttgggacctggcagcccctaccccccgaattaaggccgaactcacgtccagtgctcccgcttgttacgctctggccattagtcctgatagcaaggtgtgctttagctgttgctctgacgggaatattgccgtctgggatctccataaccagacattggtacggcagtttcagggccacacggacggggcttcctgcatagatatctctaacgatggcacaaagctctggaccggtggcctggataacactgtgcgtagctgggacctgcgggaaggtcggcagctccagcaacacgactttaccagccagattttttcactcgggtattgcccaactggggagtggctcgctgtgggaatggaatcatccaatgtcgaagtgctccacgtaaacaagcctgacaagtatcaactgcacctgcacgaaagttgcgtattatccctgaaattcgcctactgtggcaagtggttcgtgtcgacaggaaaagataatctgctcaacgcctggcggactccctatggcgctagcatttttcagagcaaggagtcctcctcagtgctcagttgtgatatcagcgttgacgacaaatacattgtgaccgggtctggagacaaaaaggcaacagtatatgaagtgatttattag

SEQ ID NO: 138266 - DNA, 729 bp, Artificial Sequence
  Description of Artificial Sequence: Synthetic coding sequence
atgttccctcagtcccgccatccaactccccatcaggctgctggccagcctttcaagttcactataccagagagccttgatcgcatcaaggaagaattccagttcctgcaggcccagtaccactcgctcaaactcgagtgtgagaagctggcttcggagaagaccgagatgcaaagacattacgtgatgtattacgagatgagttatgggcttaatattgaaatgcacaagcaaaccgagatagccaagcgcctcaatacaatctgtgcacaggtcatacccttcctgagtcaagagcatcagcagcaggtggcacaggccgtcgagagagcgaaacaggtaaccatggcggagctgaacgcaatcattggggtgcgaggtctgccagggttgccacccacacagcagcagctgcaggcccagcacttgagtcacgggcacggtcccccggtccccctaacaccgcacccctctggattacagccgcccggcatcccgccccttggaggaagtgcaggcctgctcgcactgagttccgctttgagcggacagagccatctcgccattaaggatgacaaaaagcatcatgatgccgagcaccatagggatagggaacctggaacttcaaatagcctcttagtacctgactcgctacgcgggaccgacaagagaagaaatgggccagagttttccaatgacataaagaagcgaaaggtggatgacaaatag

SEQ ID NO: 138267 - DNA, 2121 bp, Artificial Sequence
  Description of Artificial Sequence: Synthetic coding sequence
atggtccaatcgcgactgactgcaacatccgcctcacaggattctcctgcctccgggctccagactcccctgcagtcgggacagcctttcaagttctcaattcttgagatatgtgatagaattaaggaggagttccaattcctgcaggcacagtatcacagtttgaaactggaatgcgaaaaactggcgtctgaaaaaacggaaatgcaacgacactatgtgatgtattacgagatgtcctacgggctcaacatcgagatgcataaacaagcagaaattgtcaagcgtctaagtggaatctgcgctcaaataataccctttttgacccaggagcaccagcagcaggtactccaggccgtagaaagagctaagcaggtaaccgtcggagaactaaacagtttgatcggccagcagcagctgcaaccccttagccaccatgctccaccagtcccgctcaccccgaggccggccggccttgtcggtggctccgcaacggggctcctggccctctctggcgcacttgctgctcaagctcaactggccgccgccgtgaaagaagatcgagcaggggtggaggctgaaggatcccgtgtggagcgtgctccatctcgcagcgcctccccatctccacccgaaagtctggtagaagaggaacggcccagcggacccgggggaggaggcaaacagagggcagacgaaaaggaacctagcggtccatacgaatcagatgaggataaaagcgattacaatcttgtggtggatgaagaccagcctagcgagccgccatctcccgccacaacaccctgcgggaaggtccctatttgcatccctgccaggagggacctggtcgactcccctgcaagcctcgctagctcgcttggcagccccctaccacgcgcaaaggaacttatattgaacgaccttcctgcctcgacccccgctagcaagtcatgtgactcttccccgcctcaggacgctagtacacctggtccctctagtgcttcacacttatgccaactggctgctaaacctgcgccttctactgattcagtggccctgcgctccccattgacactgtcaagcccgtttaccactagcttctcactgggtagccacagcacattgaatggcgaccttagcgtgccctcatcgtacgtgtccttacacctgtctccccaagtgtccagtagcgtggtttatggccgctctccggtcatggcgttcgagtctcacccgcatctgcgcgggagcagtgtctcctcgagtctgccttcaataccgggaggcaaacctgcttacagcttccacgtaagcgctgatggccagatgcagcccgtgccttttcccagcgacgctttggtgggggccggaatcccccgccacgctaggcagctccataccttggcgcacggcgaagttgtgtgtgctgtgaccatatcaggaagcacacagcacgtgtacactggtggaaaaggctgcgtgaaagtctgggacgttggtcagcccggagccaagacacctgtggcacaactcgattgcctcaatagagacaactatattaggagttgtaagcttctgcccgatggccgttcactcattgtgggaggcgaagcctctacactctccatatgggatctggcagcgcccacacctcgcattaaggcggagctgacctctagcgccccagcatgttatgccctggctgtcagcccagatgctaaagtttgcttttcctgttgtagtgacggaaatattgtcgtgtgggatctgcagaatcagaccatggttcgccagttccaggggcataccgacggggcttcgtgcatcgacatcagtgattacgggacacggctgtggaccggagggctggataatacggttcggtgctgggacttgcgggaggggagacaactgcagcagcatgacttttcatctcaaatattctccctcggccactgcccaaaccaagattggctggccgtcggcatggaatcctccaatgttgaaatcctgcatgttaggaagccggagaagtaccagcttcatttacacgagagttgtgtgctaagtttgaagttcgccagctgtgtgcagggcgtcgtgctgtctccagagctgtag

SEQ ID NO: 138268 - DNA, 2232 bp, Artificial Sequence
  Description of Artificial Sequence: Synthetic coding sequence
atgtacccacaaggccggcacccaaccccactacagtcaggacaaccttttaaattcagcatcctggagatctgcgacaggatcaaggaggagttccagttcctccaggcccaatatcattccctaaaactggagtgtgaaaagctcgcatccgagaaaacagagatgcaaaggcactatgttatgtattacgaaatgagttacggcctgaacattgagatgcacaaacaagcagagatcgtgaagcgcctctctggaatctgcgctcaaatcattccatttctcactcaggagcatcaacagcaggtactgcaggcagtggagcgagcgaaacaggtgaccgtgggcgaactgaattcactgatcggccaacagctccaaccgcttagccatcatgccccccccgtgccactgacccccagaccagccggactggtcggcggttctgctacaggcctgctagctctgtcaggggccctggcagcacaagcacagctggctgctgcagtcaaggaggatcgcgctggcgtcgaggccgaagggtccagggtagagagagcaccatccagaagcgccagcccttctcctcctgagtctctggtggaggaagagaggccctccgggccgggaggcggcggcaaacagagggcagacgaaaaagagccttccggcccctatgaatccgacgaggataagtcagattataatcttgtggtcgacgaggatcagccctccgagcctccttcccccgccacaacgccctgcggcaaggtcccaatttgcatccccgccagaagggatctggtagacagccctgccagccttgcttcctctctcggaagtccactccctcgggcgaaagaactcattttaaacgatctccctgccagcactcctgcgagcaagtcctgtgactcctcacccccccaggacgcctccacccctggaccaagtagtgctagccacctgtgccagctggctgcaaagcccgcgccctcaaccgatagcgtggccttaaggtcacctctgacgttaagttcccctttcacaactagcttcagcctgggatctcactccacactaaatggtgatctgagcgtgccatcatcctacgttagtctgcacctctctccgcaggtctcttcgagcgttgtatatggcagatcaccagtgatggccttcgagtcccaccctcacctcagaggctcttcagtttcctcatccctacccagtatcccgggaggcaaaccggcttatagcttccatgtgtccgctgatggccagatgcagccggtaccattcccttccgatgccctcgtgggggctggcatcccacgacacgccaggcagctgcatacactcgctcatggtgaggtcgtgtgcgcggttacaatctctggctcaacacaacacgtgtatacaggaggaaaaggttgcgtgaaagtttgggatgttggccagccaggagccaaaacccctgtggctcaattggactgcctcaatcgggataactatattcggagctgtaagttactgcctgacggacgctcactgatagtcggcggcgaagcatctacactttctatttgggacctagctgctccaactcctaggattaaagccgagctcaccagttccgcacccgcctgttacgcattagccgtatcgccagacgcgaaagtctgtttcagctgttgcagtgatggaaacatagtagtatgggatttacagaatcagaccatggtgagacaattccagggacacaccgacggggctagttgcatagatatttccgattacggaacccgtctttggaccggtggactggataacaccgtgcgctgttgggacctgagggaagggaggcaactccaacaacatgatttctccagccagatcttcagtctgggacattgtccgaaccaagactggctggctgttggaatggaatcctccaatgtcgaaatcctgcacgtgagaaagcctgagaagtatcagctgcatcttcatgagtcctgcgtcctgtctctgaaatttgctagctgcggtcgatggttcgtttccaccggcaaagacaaccttctcaacgcttggagaactccttacggagcatccatctttcagagcaaggaatcctctagcgtgctgtcatgcgatatttctcgcaacaataagtacatcgtcaccggctccggagataagaaagccactgtgtatgaggtagtgtactag

SEQ ID NO: 138269 - DNA, 879 bp, Artificial Sequence
  Description of Artificial Sequence: Synthetic coding sequence
cttgcccacggcgaggtggtttgcgccgtaaccattagtggctccacccagcacgtgtataccggagggaagggctgcgtgaaggtgtgggatgtagatggtgcagtgttcgcagggcagcggggaggggcacaccagcctatacgtaatagggacaactatatccgctcttgtaagctgttacccgatgggcgttcactgatagtggggggtgaagccagcactctgtcaatctgggacctggccgcccccactcctcgaataaaggccgagcttacatctagcgcccccgcgtgttacgctcttgctgtaagtcctgacgctaaagtttgcttctcatgctgcagcgacggcaatatagtggtctgggatctgcagaatcagaccatggtaagacaattccaaggacacacagacggtgcctcgtgtatcgacattagcgattacggaaccaggctgtggaccggcgggctagataacacagttcgatgctgggatctgagggagggccgtcaactgcagcaacatgatttcagctcccagatattcagcctgggtcattgtcctaaccaggattggctggccgtcggtatggaatcgagcaatgttgagattctccatgtcagaaagcccgaaaaatatcagctgcatctgcatgaatcttgcgtgctgtcattgaagtttgcttcatgcggtcggtggttcgtcagtactggcaaggataatctactgaacgcctggcggacgccttacggtgccagtatcttccagtctaaggagtcttcatctgtcctgtcctgcgacatttcccgcaacaataagtacatcgtgaccggctctggagataaaaaagcaaccgtctacgaagtggtgtattag

SEQ ID NO: 138270 - DNA, 2121 bp, Artificial Sequence
  Description of Artificial Sequence: Synthetic coding sequence
atggttcaatctagacttactgcaaccagcgcttcccaagacagtcctgcctcaggcctgcagacacctttgcagtctgggcagccctttaagtttagcattctggagatctgcgaccgcattaaggaggagtttcagtttctgcaggcccagtatcattccttaaaactggaatgtgagaaattggcttctgagaaaaccgagatgcagaggcactacgtcatgtactacgaaatgtcgtacggtctgaatattgaaatgcataaacaggccgaaattgttaaacgactcagtggaatttgcgctcagatcatccccttcttgacccaggagcaccagcagcaggtcctgcaggccgttgagcgcgctaagcaggtcaccgtgggcgaacttaattcattgataggtcagcagcagcttcagccactgagccaccacgctcctccagtgcccctgacaccgaggccggctgggctggtcggaggctctgcgaccgggcttctcgctctgtccggggcgctggcagcccaggcccagctggcagcggccgtgaaagaggacagggctggcgtggaggccgaaggctctcgggtggaacgggcaccgagcagatcggcgtccccgtcgcctcctgaaagcttagtagaagaggaacgccctagcggccctggaggaggtggcaaacaaagggcggacgagaaggaaccatctggaccttacgagtcagacgaagacaagagtgactacaaccttgtcgtagatgaggatcaacctagcgagccgccatcgcctgccacaactccatgtgggaaagttcctatctgcataccggcaaggagagacctggtggattcccccgcctctcttgctagcagcctcgggagtccactcccacgagcaaaagaattgatcctgaatgacttaccagcaagcactcctgcaagcaaatcgtgcgactcctcacccccacaggatgcttctacccctgggcccagcagcgcttctcacctgtgccagctcgccgccaagcccgccccaagtacagatagcgtggcactgaggtcccccttaacactttcttccccattcacaacatccttctctctgggaagccacagcacactcaatggcgatctttccgtgccctcctcttatgttagcctgcacctcagcccccaggtcagtagcagcgtcgtgtacggtcgctcacccgtcatggcttttgagtcacatccccaccttcgagggtcttctgtgtcttcgagcctcccgtccatccctggaggcaaacccgcctacagctttcacgttagcgccgacggtcagatgcagccagtgcccttcccaagtgatgcactagtcggagccggtatcccgcggcatgcccgccagttgcacaccctggcgcatggtgaagtcgtatgcgcagtgacaatcagcgggagtactcagcacgtatacactggcggcaagggttgcgtcaaagtctgggacgtggggcagccaggagccaagactcctgtagcccagttagactgtcttaaccgagacaattacatcagatcctgtaagctgctgccagatggaagatcactgatagtgggcggagaagcttctacactctccatatgggacctagcggcacctactccgcggataaaggccgaactcacctcgtcagccccggcgtgttatgccctggccgttagccccgatgctaaggtttgtttctcgtgttgcagtgacggcaatatcgttgtctgggatctgcagaatcagaccatggtgagacagtttcaagggcataccgacggggcgtcttgcatcgatattagcgattacggtactcgattgtggactggcggactggataacaccgtccgatgctgggacctgcgggagggtcggcaactgcagcagcacgacttctcatcccaaattttttcactgggtcattgccctaatcaggactggctcgccgtggggatggaatctagcaatgttgaaatcctgcatgtgcgcaaacctgagaaataccagttacacttgcatgagtcttgcgttctgtctctgaagttcgcctcttgcgtccaaggcgtggtactgtcacccgaactgtag

SEQ ID NO: 138271 - DNA, 1083 bp, Artificial Sequence
  Description of Artificial Sequence: Synthetic coding sequence
atgtatccacagggtcgccatccgaccccattgcaaagcggccagccctttaagtttagcatccttgagatatgcgatagaataaaagaggaatttcagtttctgcaagcacaatatcacagcctcaagttagagtgcgaaaaacttgcttctgagaagaccgaaatgcagcgccactacgtcatgtactatgaaatgtcctacggcctcaacatagagatgcacaaacaagcagagatcgtaaagcgactgtcgggtatttgcgcccagataatccccttcttgacccaggaatctgccagcccatcccccccggaaagcctagtggaggaagaacggccctccggcccaggcggaggtggcaagcaaagggctgacgaaaaagaacctagcggtccttacgaaagcgatgaggataagagtgactataatctggtggtagacgaagaccagccaagtgaacccccgtccccagcgactacaccctgtggcaaggtcccaatttgcataccagctaggcgtgatctggtggactcacccgcttctctagcttctagtctgggctctcccctgcctagggcaaaggaattaattctcaacgatctgcctgcaagtacgcccgcttccaaatcttgtgacagtagcccacctcaagacgcttccacccccgggccaagctctgcatctcacctgtgccaattagcagctaaaccggcccctagtacagatagtgttgccctccggtcaccactgaccctcagcagcccgttcactaccagtttctccctaggtagccattcgactctgaatggcgatctgagcgtaccctcttcctatgtgagtctgcacctctcgccacaagtcagttcttcagtcgtttacggacgatcgcccgtgatggcattcgagagccatcctcatctccgggggagctcggtgtcgtccagcctgccttcaatacccggaggtaagcctgcttattccttccatgtaagtgccgatggccagatgcagccagtcccatttccttcggacgcgctggttggtgccgggattcctccctggccctcatccaccgcttag

SEQ ID NO: 138272 - DNA, 1866 bp, Artificial Sequence
  Description of Artificial Sequence: Synthetic coding sequence
atgcagagacattatgtaatgtattatgagatgtcctacggactgaatatcgagatgcataaacaggcagaaattgtgaagcggctcagcggcatctgcgctcaaattatcccgttccttacgcaagagcatcagcagcaagtgcttcaggccgttgaaagagccaagcaggtcacagtgggcgagctcaactctctgatagggtctgcatccccctcaccgcccgagagcctggtcgaggaggagaggccatccggaccaggcggcggtggaaaacaacgggctgatgagaaggagccatcgggaccgtacgaaagcgacgaagacaagagcgactataatctggttgttgacgaggaccagccaagcgagccgcctagccccgctacaactccatgcgggaaagttcctatttgtattcccgcaaggcgcgacctggtcgacagccccgcttccttagcctccagtctggggagtccactgccccgggccaaggaattgatcctaaacgacctccccgcatctactcccgcctctaagtcttgtgattcttctcctccacaggacgccagcaccccaggtccttcgtcagcaagccacctttgccagctcgctgccaagcccgccccaagcactgatagcgtagcactccggagcccgctgaccctgtcttcccccttcacaacaagtttctccctgggtagccactctacacttaacggcgatttgagcgtgcccagctcttacgttagcttgcatctttcaccccaagtttccagcagcgttgtctatggtcggtcccccgtaatggcatttgagtcacatccacacctacggggctcctcagtcagctctagcctgccatccatcccgggtggcaagccggcttattccttccatgtttctgcggacgggcagatgcagcctgttccattccccagcgatgcacttgtcggagccgggattccacgccacgccaggcagctccacaccctggcacatggcgaagtggtatgcgcagtcaccattagtgggtccacccaacatgtgtatacgggcggtaaaggctgcgttaaagtgtgggatgtcgggcagcccggggctaagacaccagtggcccaactcgactgcctgaatagggataattatatccgcagttgcaaactgctaccggatgggaggagtctgatagttggaggagaggcttctacccttagcatttgggatcttgcagccccgacaccaaggattaaagcagaactcactagctctgcacccgcctgttacgccttagcagtgtctccggacgctaaagtgtgctttagttgctgctccgacggcaatattgtagtgtgggatcttcagaatcagacaatggttaggcaattccaggggcacacagatggggcatcgtgtatcgacattagcgattatggcacaaggctgtggactggcggcctggataatactgtcagatgttgggatctacgtgaaggaagacaacttcaacagcacgatttttcctcgcagatattctctctaggacactgccccaatcaggactggctcgcagtagggatggagagctcgaatgtagaaatcctgcatgtgcgcaagcccgagaagtatcagttgcacttgcacgagtcgtgcgtcctctcgctgaaatttgcgagttgcgggcggtggttcgtttctaccggcaaagataatctcttgaacgcctggcggaccccgtatggggcgtccattttccagtctaaggaaagcagctcagtactctcatgcgacatatcacgtaataacaaatacatcgtcacaggcagcggcgataagaaagcaactgtttatgaggtcgtatactag

SEQ ID NO: 138273 - DNA, 1233 bp, Artificial Sequence
  Description of Artificial Sequence: Synthetic coding sequence
atgaccttcccccctgcactgttaccccccaatccagtaactcctccgagaccaagaaccttgccacccccaggcccggcacgacccgtgacctctgcaagtctgctaccaagccagcacctaccccgtaccgctagcgtctcttcttcagtggtctacggaagatcgccggtgatggcctttgagagtcacccgcatttgcgcggctctagcgtcagctccagcctgccttccattcccggagggaagcccgcatacagcttccatgtgtctgccgacggccagatgcagccagttccattccctagtgatgccttggttggagccgggatccctagacacgcaaggcagctgcatactctggcgcatggagaggtcgtttgtgcagtcactatctccggcagcacccaacatgtgtatacgggaggtaaaggttgcgtgaaggtttgggacgtcgggcagcccggcgccaaaacacccgtagcacagctggattgcctgaacagggataactatatcagaagctgcaaacttttgcctgatggacggagtttaatcgtcgggggggaggctagtacactgtctatatgggatctagcagctccaacgccccgcatcaaggccgaattgacatccagcgcacccgcatgctatgcattggccgtgagcccagacgcaaaggtatgtttctcatgctgttcagacggtaatatagtcgtctgggatctgcaaaatcagacaatggtgcggcagtttcagggccacactgacggggcctcatgcatcgacatctcagattacgggacgcggctttggaccggaggccttgacaacaccgtacgatgttgggacctgagagaggggcggcagctgcagcagcacgacttctcttctcagattttctcgctggggcactgtcctaatcaggattggctggctgtcggcatggaatcatccaatgtcgagatcctgcatgtgaggaaacccgaaaagtatcagctacatttacacgaatcttgcgttctgagcctgaagttcgcttcatgtggacgatggttcgtgagcacaggcaaagacaatcttctgaatgcctggaggacaccatatggcgcctccatcttccagagtaaagagtcctccagtgtgctgtcatgcgacattagccgcaacaacaagtacattgttaccggatcaggggataaaaaggccaccgtgtacgaggttgtgtactag

SEQ ID NO: 138274 - DNA, 2061 bp, Artificial Sequence
  Description of Artificial Sequence: Synthetic coding sequence
caaacccctctgcaatccggtcagccctttaaattctctatcttggaaatctgtgatcggataaaggaggagttccagtttctacaggcccagtaccacagccttaaactggaatgcgaaaagctggccagcgaaaaaaccgagatgcagcgtcattatgtgatgtactacgagatgagctatggcctgaacatcgagatgcacaaacaagccgaaatcgtcaaaagactctctggaatctgcgctcaaattatcccatttctcacccaggagcatcaacagcaggttttgcaggcggtggaacgcgccaagcaggtaactgtcggagagctaaattcgctgataggccagcaacagttgcagcccctctcccatcatgctcccccagtgcctctgacaccccggccggctggactagtggggggttcagccaccggtttactcgccctgtctggggcccttgctgcacaggctcagctcgccgccgctgtgaaagaggatagggcaggcgtggaggctgaaggtagtcgagtcgagcgagctccgtcccgctcagcttcgccatccccccctgaaagtttggtggaggaggaacggccgtctggccccggaggcggcgggaaacagcgcgctgacgagaaggaaccgagtggcccctacgagtctgatgaagataagagcgactacaacctggttgtggatgaggatcagcctagtgagccaccctcaccagccaccaccccctgtggaaaagtccccatttgcatcccagcgcgccgcgacttggtggactctccagctagtctcgcgtcctcccttggttctcctcttccgcgggcaaaagaattaatcctgaatgatctgccagcgtccactcctgcaagtaagtcatgtgattctagccctcctcaggatgcaagtacccccggtccctcctccgcctctcacctttgtcagctcgcagctaaacccgcaccgtctacagatagcgtagctctcagatccccactgaccctctcctctcctttcacaacaagctttagcctggggtcacactctacactcaatggcgacctgagcgttccgtcgtcttatgtttctctgcacctaagtccacaagtgtcaagctcagtcgtgtatggccgttctcctgtgatggcctttgaaagtcacccacacttgcgaggcagcagcgtttccagcagtcttcccagcattcctggtggaaaaccagcctactcgtttcatgtctccgcagatggtcaaatgcaaccagtaccattccctagcgacgctctcgtgggggccggaattcctcggcacgcaagacaactgcacactttggcccatggagaggtagtgtgcgcggtaaccatttccggtagtactcagcatgtctacactggggggaaggggtgcgttaaggtttgggacgtggggcagccaggggccaaaaccccagtcgctcagttggactgtcttaaccgagataattatattcgaagctgcaaactgctgccagatggcaggagtctcattgttggcggcgaggcatccaccctcagtatttgggatttagccgcccctactcctcgcataaaagcagagttgacaagctctgctccagcatgctatgcactagcagtctcaccagatgcgaaagtgtgcttcagttgctgctctgacggcaacatagtcgtttgggatctacagaatcaaaccatggttagacaattccaggggcacactgacggggcgtcttgtatagatatctcagattacggcaccaggctatggacaggggggttagataatacagtgcgttgttgggacttacgtgaggggcgccagctgcagcagcacgacttctcctcccaaattttctcgcttgggcattgtcccaaccaggactggctagcagtggggatggaaagtagtaatgtggagatcttacacgtccggaaacccgaaaagtaccagttgcacctgcatgagtcctgcgtgctgagcttgaaattcgcgagttgcgtgcagggagtggtgctctcccctgagctctag

SEQ ID NO: 138275 - DNA, 1866 bp, Artificial Sequence
  Description of Artificial Sequence: Synthetic coding sequence
atgcagcgccactacgtgatgtattatgaaatgtcttatggactgaacatcgagatgcacaaacaggccgagatagtgaagcgcctgtcagggatttgcgcccagatcatcccgttccttacccaagagcatcaacagcaggtccttcaggccgtggaacgggccaaacaggtgactgtgggtgaactaaattccctgatcggatctgcgtctccgtctccaccagagagcttggtcgaagaggaaagaccctcagggccaggcgggggtgggaaacagcgagccgacgagaaagagccctccgggccatatgaaagtgacgaagacaaaagtgattacaacctggtcgtggatgaggatcaaccaagtgagcctccaagccccgctacgaccccatgtggcaaggtgcccatatgcattccagccaggagggatctcgtggactcccccgccagcctagctagctcattgggcagtcccctccctcgggccaaggagcttattctgaatgatctgcccgcttcaacacccgcatccaagagttgcgatagctcacccccacaagatgcttctaccccaggccccagttcagccagtcacctttgccaactggcagcaaaaccagccccatctactgactccgtggctctcagatcaccactgactctgagttctcctttcacaacatcttttagcttgggttcacacagtactttgaatggtgatttgtccgtcccatcaagctatgtgagtctgcatttgtctccacaggtgagtagcagtgttgtgtacgggaggtctcccgtgatggcatttgaatcccaccctcacctgaggggttcctctgtgagctcttcgctcccgtctatccccggtggcaagccagcatacagctttcatgtgagcgccgatggacagatgcaacctgtcccattcccttctgatgccctggtgggcgcaggaatacctagacatgcacgccagcttcatacactggctcatggagaagtcgtgtgcgccgtgaccatctctggaagtactcagcatgtctataccgggggcaagggatgcgtcaaggtctgggacgttggacagccaggagctaaaactccagtggcccagttggattgtttaaaccgggataactacatccgatcctgtaaactactccccgacggtcggagtttaattgtgggcggggaagcgtctacactcagtatttgggatctcgcggctcccactccgcggatcaaagctgagctgacatcttccgctcctgcttgctatgcactggctgtatctcctgatgccaaagtctgcttttcttgctgttccgacggcaatatcgtggtgtgggatctgcagaatcaaacgatggtgagacagttccaaggacacactgacggggcttcatgtatcgacatatctgattatggcactcggttatggaccggagggctggacaacacagtccgctgttgggacttgcgtgaaggacggcaattacagcagcatgatttttcctcacagattttctctttgggacactgccctaatcaggattggttagctgtcggaatggagagttccaacgtggaaattttacacgtacgtaaacctgaaaagtatcagttgcatctgcatgagagttgtgtgcttagtcttaagttcgccagctgtggacggtggttcgtgtctacagggaaagacaacctgttaaacgcttggaggactccttacggtgcttctatcttccagtccaaggagagcagctctgtgctgtcatgtgacattagtagaaacaacaaatatatcgtgaccgggtccggggataagaaggccaccgtgtatgaggtggtttattag

SEQ ID NO: 138276 - DNA, 2283 bp, Artificial Sequence
  Description of Artificial Sequence: Synthetic coding sequence
atgtacccacagggcaggcatccagcaccccaccagcccggtcagcccgggtttaaatttaccgtggcagaaagttgcgatcgaattaaagacgagtttcagttcctgcaggcccagtatcattctcttaaagtcgagtacgataagctggccaacgaaaagaccgagatgcagcggcattacgtgatgtactacgaaatgagttatggcctcaatatcgagatgcacaagcagaccgaaatcgccaagcgattaaacaccatccttgctcaaattatgccttttttgtctcaggagcaccaacagcaggtggcgcaggcagttgagcgcgcaaaacaggttaccatgaccgaactcaatgctatcattggacagcagcagttgcaggcacagcatctgagccacgctactcacggacctcccgtccagctgccaccacaccccagcggactgcaacccccaggtatcccacctgtgaccggctcatcctccggcttgcttgccctcggggccttgggaagtcaggctcaccttaccgtgaaagacgagaagaatcatcatgaactggatcatcgtgaaagggaatcctcagctaataactccgtcagtcctagtgaatccctgcgtgccagcgagaaacacaggggcagtgctgattattctatggaagctaaaaaaaggaaagctgaggaaaaagactctctctccaggtacgattccgacggcgacaaatccgatgatctggtagtcgatgtcagtaatgaggaccccgcgacaccccgcgtatcaccagcccactcccctcccgagaatggcctcgacaaagcccgaagtttaaaaaaggacgccccgacaagccctgcctcagtggctagctcgagttccacgccgtctagcaaaactaaagatctcggtcacaatgacaaaagcagtactccaggcctgaaatctaacacaccaacgcctcgcaacgacgctcccactcccggtacatccaccactcccggattacgatccatgccagcctctgccttgcgaacaccaatctccatcacttcttcatacgctgctcctttcgcaatgatgtctcatcatgagatgaatgggtcactgacttcccctggggcctatgctggcctccacaacattccaccgcaaatgtcagcagccgctgcagccgcggcagccgcttatgggagaagccccatggtctcatttggggccgtggggttcgaccctcacccacctatgagggccacaggactgccctcatcccttgcatccattcctgggggcaagcccgcctactctttccacgtgtcagctgacgggcaaatgcagccagtccccttccctcatgacgctttagctggtcccgggatacctagacatgctcgccaaattaataccctcagccacggggaggtggtatgtgctgtgactatctccaatccaacacggcatgtttacaccgggggaaagggatgcgttaagatctgggatatatctcagcctggtagcaaaagtcctatctctcaactggattgtttaaatcgagacaactacatcaggagctgcaagctcctgccagacggaaggactctaatcgttggcggcgaggcttcaactctgactatttgggacctggccagcccaacaccaaggataaaagccgagttaacatcctccgctcccgcctgctatgccctggctatatcacccgacgcaaaagtctgtttctcgtgctgttctgatgggaacatcgcagtgtgggatctgcataatcagaccttggtcaggcagtttcagggccacacagatggggctagctgcatagacattagccacgacggcactaaactttggacaggcgggctggataacacggtgagatcctgggacctgcgggaaggccgccagcttcaacaacacgactttacgagtcaaatcttctctctggggtattgccctacgggtgaatggctcgctgtcgggatggagtcctcaaatgtggaagtgctgcaccacaccaaaccagacaaataccaactccacctccacgagtcctgtgtcctgagcctgaagttcgcatattgtgggaaatggtttgtttccacagggaaggataatttgcttaatgcctggcgcactccttatggggcttcaatttttcaaagcaaagagagctcatccgtacttagttgcgatatttctgctgacgataagtatattgttaccggcagcggtgacaagaaggctacagtgtacgaggtgatctactag

SEQ ID NO: 138277 - DNA, 2289 bp, Artificial Sequence
  Description of Artificial Sequence: Synthetic coding sequence
atggcaccgcaccaaccaggacagcctggtttcaaatttactgttgccgagtcctgtgatagaataaaagatgaattccagttccttcaggcacaatatcactccctgaaagttgaatacgacaagcttgccaatgagaagacagaaatgcagaggcactacgttatgtattacgaaatgagttacggattgaatatcgaaatgcataagcagacagagatagcaaaaagacttaacaccattctcgcccaaatcatgcctttcctgtcccaggagcatcagcagcaagtggcccaagcagtagaaagagctaagcaggttacaatgactgagttgaacgccatcatcgggcagcagcagttgcaagcccagcacttaagccacgccacgcacggccctccggttcagttgccgccccacccatctggcctccaaccgcctggaatccctccagtcaccggaagcagctcaggacttctggcgctgggagccctgggctcacaggcccacttgaccgttaaggacgagaaaaaccaccatgaactggatcaccgcgagagagagagctcagctaataattccgtgagcccatccgagtcacttagagcctctgagaagcatagaggaagcgccgattacagtatggaggcaaagaagagaaaggcagaggaaaaggatagcttgagccgctatgatagtgatggcgataaatctgatgacttggtggtcgacgtttccaacgaggacccagctacacctagagtctcccccgcccattccccccccgagaacggactcgataaggctcgaagcctcaagaaagacgcgcccaccagcccagcaagtgtagcctcctcaagtagtactccgtccagcaagacaaaagatcttgggcacaacgacaagagcagtacccctggcctgaagtcaaacacacctaccccacggaacgacgcccctactccagggactagcacaacacccgggctaagatccatgcccggaaaaccaccaggaatggaccccatagcaagtgccctgcggaccccgatcagcataacatcctcttacgccgcaccattcgcaatgatgtctcatcacgagatgaacgggagcttgacaagccccggagcttacgctggactgcacaatattcctcctcaaatgtctgctgctgccgcggccgcagccgccgcctacggacgatcacctatggttagctttggtgccgtgggctttgatcctcacccacctatgcgagccaccggactgccctcttcattagcgtcgattccgggaggcaagcccgcctattcattccacgtgtccgctgatggtcaaatgcagccagtcccttttcctcatgatgccctggctggcccgggcatcccgcgacacgcaaggcaaattaacacactgtcccatggagaggtcgtgtgcgccgttacgatctccaatcctacgcgccatgtgtataccgggggcaaaggctgcgtaaaaatttgggacattagtcagccgggctctaaatctccaatttctcaacttgactgcctaaacagagataactacatccggtcctgcaaactgctgcccgacggcaggacgctcatagttggcggggaagccagtacattaaccatctgggacttagcaagccctaccccaagaattaaagcagagctgacaagcagcgcccctgcctgttacgctttggccatctcccccgacgctaaagtttgcttttcctgctgctctgatggaaatattgcagtgtgggatctgcacaaccagaccctcgtgcggcagttccagggccacacagacggcgcctcttgtattgacatatcccacgatggaactaaattgtggactggcggcttggataatactgtgcggtcctgggacttacgcgagggacggcaactgcagcagcacgattttacttcacagatcttctctcttggctattgtcctactggagagtggctcgcagttggcatggagtcatccaatgtggaggttttgcatcacacaaaacccgacaaataccagttgcacctccacgagagctgcgttctctctctgaagttcgcatattgcgggaagtggttcgtgtccaccgggaaagacaacctcctcaatgcctggcggaccccctacggggctagcatattccagtctaaggagagctccagcgtgttgtcttgcgatattagtgctgatgataaatatatcgtgacgggttctggagataaaaaggctactgtttacgaagtgatttactag

SEQ ID NO: 138278 - DNA, 2295 bp, Artificial Sequence
  Description of Artificial Sequence: Synthetic coding sequence
atgtatccccaagggcgtcaccctgccccccatcaacctggacagcctggtttcaagtttaccgtcgctgaatcatgcgacaggatcaaggatgaattccaatttttgcaggcacagtaccattccctcaaagtagagtacgacaaactagccaacgaaaagaccgagatgcagagacattacgtcatgtactacgagatgtcctatggcttgaacatagagatgcacaagcagactgagattgccaaaaggctcaacacgatccttgcacagatcatgccctttctgagtcaggaacaccagcagcaggtagctcaagcggtggagcgggcaaaacaggtcactatgacagagctcaacgctatcattggtcagcagcagcttcaagcacaacacctaagtcatgccacacacgggccccccgttcaacttcccccacacccctccgggctgcagcctccgggcattcctccagttactggcagttcctcgggcctgctggccctcggagcgctggggtctcaggcccacttgaccgtgaaggatgaaaagaaccaccatgagctcgatcacagggagcgcagtagcgcaagtaacaacagcgtgagcccaagtgagtccctcagagctagcgaaaagcatcggggcagtgccgactactccatggaggccaagaaacgcaaggctgaagagaaggactccctgagccgctacgattctgacggggacaagagcgacgacctagtcgtggacgtgtcgaacgaagacccggctacccctagggtctcccccgctcatagcccacccgaaaatggactcgataaggccagatctttgaaaaaagatgcgccaacaagtccggcttccgtggccagttcgtcctccacacctagcagtaaaaccaaggacttggggcacaatgataagagttccacgcccggattaaagagcaacaccccgacaccgagaaacgatgcaccgacccctgggacttctactacccctggtctccggagcatgcctggcaaacctccaggcatggaccctatagcctcagcgcttcgcactcccataagcattacctcttcttacgctgctcctttcgctatgatgagccatcacgagatgaatgggagcctgacaagtcctggcgcctatgccggcctccacaacatcccgccacagatgagcgccgccgctgctgcagcggccgcagcttacgggaggtcccctatggttggctttgacccacacccgccgatgcgcgctactggtctcccatcttcgctggcatctatccctggtggcaagccggcttacagcttccacgtgagcgccgatgggcagatgcagcctgtgcctttcccacacgacgcgttggccggtcctggtattcctcgtcatgcccggcaaataaacactttatcacatggagaggttgtgtgcgccgttaccatttccaacccaactaggcatgtttacacagggggtaaagggtgtgtcaaaatctgggacatctcccagccaggatcgaagagtcccatatcgcagttggactgcctgaaccgcgataactatatccgcagctgtaaactacttcctgatggcaggacattgatcgtcggaggtgaagctagcacactcacgatctgggatctggctagccccacaccccggatcaaggccgaattgacaagctccgctccggcctgttatgccttggccatctccccagatgctaaggtgtgtttcagctgttgttccgatgggaatattgcagtttgggacctgcacaaccagactctggtaaggcaatttcaaggccacacagacggcgcatcctgcatcgacatctcccatgacggtactaagttgtggaccggggggctcgataacacggtgagatcctgggacctcagggagggcagacagctgcagcagcacgactttactagccagatcttctccctggggtactgcccgacaggtgaatggcttgccgttggaatggaatcatcaaatgtggaggttctgcatcacaccaaacccgacaaataccaactgcacctgcatgagagctgcgtgctatccctaaaattcgcttattgcgggaaatggtttgtgtcgacaggcaaggacaacttgttaaacgcttggcggaccccatacggtgcttcaatcttccagtcaaaagaaagttcgtctgtgttgagttgcgatatttcagccgacgacaaatatatcgtgacgggatcaggggacaagaaagccactgtttatgaggtaatttactag

SEQ ID NO: 138279 - DNA, 2310 bp, Artificial Sequence
  Description of Artificial Sequence: Synthetic coding sequence
atgtatccccaggggcgccaccccgccccacaccaacctggtcagcccggcttcaagttcaccgtggccgagtcctgcgaccgaataaaggacgagttccagttccttcaggcccagtaccattcactgaaggtcgaatacgataagctcgcaaacgaaaaaaccgaaatgcagcgccactacgttatgtactacgagatgagttacggcttgaatattgaaatgcacaagcaaactgaaattgcaaagaggcttaacactatcctcgctcagataatgccatttttgtctcaggagcaccaacagcaagttgctcaggccgtagaacgcgctaagcaggttacaatgactgaacttaatgctattattgggcagcaacagctgcaagcgcagcatctgagccatgccactcacggtcctcccgtacaactgccaccccatccctccggtttgcagcccccggggatcccccctgtgaccggatcttccagtggcttacttgcactaggtgctttgggcagtcaagctcatttaaccgtaaaagacgaaaagaatcaccatgaactggatcatagagagagggaatcaagcgctaataacagtgtaagcccctcagagtcgcttagggcaagcgagaagcatcggggctccgcggactatagcatggaggccaagaaaaggaaggccgaagaaaaagatagcctctcaaggtatgactcagacggcgacaagtccgatgatctggtggtggatgtcagcaatgaggatcctgccaccccgcgcgtgagtcctgcccattccccccctgagaacggcctggacaaggcccggtctctgaagaaagacgcccccacaagcccggctagcgtggctagctcttccagtacgcccagcagcaagactaaggacttggggcataacgataagtcaagcacccccggccttaaatctaacacacctaccccaagaaacgatgcccctacccctggcacctctaccaccccaggcctgcgctctatgcccgggaaaccacctggaatggacccgatcgcttctgcactgcggacccctataagcatcacaagttcttacgcggcacctttcgccatgatgtcacaccacgaaatgaatggctccttaaccagccctggggcatacgccggtctccataacatccctcctcaaatgtccgcagcggccgcggctgcagcagcagcgtacgggcggtcacccatggtgagcttcggagctgttggcttcgaccctcacccacctatgcgggcaaccggactccctagttccttagccagtataccggggggaaaacctgcatactccttccatgtgagcgccgacggtcagatgcagccagtgccttttccccacgatgctctggcagggccagggattccacggcacgcacggcagattaataccttgtcccatggagaagtagtctgcgccgtaacaatctccaaccccaccagacacgtgtatacaggaggaaaaggttgcgtaaaaatctgggatatatctcaacctggatctaaaagccctatctcgcagttggattgcctgaaccgcgataactacattaggtcctgcaagcttttgcccgacggcaggactctcatcgtcggtggagaggcttcgaccctaaccatttgggatctggcgagtcctacgcctaggatcaaggccgagctgacttcctctgcccctgcctgctatgcactcgccattagtcctgacgccaaggtttgctttagttgctgtagtgacggaaacatcgcggtttgggatctacataatcagacgcttgtgaggcagtttcaaggccataccgacggcgcaagctgcattgacatctcgcacgatggtaccaagctttggacaggagggctcgacaacacagtgcggtcgtgggatcttagggaaggtagacagttacagcaacacgatttcaccagccaaatctttagcttgggctattgtcccacaggggaatggctggccgtgggcatggagtcttctaatgtcgaggtcttacatcatacgaaaccggacaagtaccaattgcatcttcacgagtcctgtgttctctcccttaagtttgcatattgcggcaaatggtttgtcagcactggcaaggataacctactgaatgcttggaggacgccttacggtgcaagtatctttcagagcaaagaaagttcatctgtactcagttgcgacatatccgctgacgacaaatatattgtcacaggctctggggataagaaggcgaccgtatacgaagtcatctactag

SEQ ID NO: 138280 - DNA, 2295 bp, Artificial Sequence
  Description of Artificial Sequence: Synthetic coding sequence
atgtaccctcaggggaggcacccagccccccaccagccagggcagcccgggttcaaatttaccgttgccgaaagctgtgacagaattaaggacgaattccagtttctgcaagctcagtaccactcacttaaggtcgagtacgacaagctcgccaatgagaaaaccgagatgcaaaggcactatgttatgtactatgaaatgagctatggcctgaacattgaaatgcataaacagactgagatagcaaagcggctaaacacaatccttgcgcagataatgcccttcctatcacaggagcaccaacaacaagtcgcccaggccgtagaaagggccaaacaggtaacaatgaccgaactgaacgccataatcggacagcagcagttgcaagcccaacacctctcccatgcgactcatggcccccccgtccaactccctccccatccgtctggactgcagccacctggaattccccctgtgacgggatccagtagcggtctgctcgctctgggagccctggggagtcaagcacacctgacagtgaaggatgaaaagaaccaccatgaactggatcacagggaacgggagagcagcgccaataactctgtgtcaccctccgaatccttacgtgctagcgaaaagcacagggggtccgctgattactccatggaagcaaagaagcggaaagctgaagagaaggattctttaagcagatatgatagcgatggcgacaaatcagatgacctggtggttgatgtgtcaaatgaggatccggccacccccagagtgtcccccgcccacagtccaccagagaatggcttggataaagccaggagtctgaagaaggatgcccctaccagtcccgcttctgtcgcaagcagttcctccaccccaagtagcaagacaaaagacctgggccataatgacaaatcatcaaccccgggccttaaaagtaatacacctacccctagaaacgacgcccctactccagggacctctaccacaccaggcctgcgaagcatgccaggtaaaccacctggcatggaccctatagcttccgcactgaggaccccaattagcattactagcagttacgcggccccatttgcaatgatgtcccaccacgagatgaacggcagtctcacctcgccaggggcctacgccggcctgcataacattcccccgcagatgtccgctgccgcagctgccgccgcggccgcctacggccgctcccctatggtgggttttgaccctcacccaccgatgcgcgccaccggtctgcctagtagcctggcttctattcctgggggaaagcctgcctactcgttccacgtcagcgcagacgggcaaatgcagccggtgcccttcccacacgatgccctcgccggaccagggattcctcggcacgcccgacagattaatacattgtctcacggcgaggtcgtttgtgccgtgactatcagcaatccaacccggcatgtctataccggagggaaggggtgcgtgaagatttgggacatctcacaacctgggtcaaaatccccaatcagtcagttagactgcttgaatcgtgataattacatacgttcatgtaaactcctccctgatgggcgaacactaattgttgggggcgaggcctccacccttaccatctgggaccttgcctctcccacacctcgcatcaaagcagaacttacttcaagtgccccagcctgctatgccctggccatctcgccagatgccaaggtctgttttagctgttgctctgatgggaacatcgctgtatgggatctgcataaccagactttggtgcgacagtttcagggacacactgacggggcaagttgcattgacatctcacacgatggcacaaaactgtggactggagggctagacaatactgtgagatcatgggacctccgggaaggaaggcagctccagcagcacgactttactagtcagattttctcactcggttattgccccaccggagaatggctggccgtgggaatggaatcctctaatgtggaagtcttgcatcatactaagcccgacaagtaccagctccacctccatgaatcgtgcgtgctgtctctgaaattcgcctattgtgggaagtggttcgtctctactgggaaggacaacctcctgaacgcatggcggaccccatatggtgccagtattttccagtctaaagaaagcagtagcgttctttcatgcgatatttcagctgatgataaatacatcgtaacgggttccggagataaaaaggccacggtatacgaggtaatatattag

SEQ ID NO: 138281 - DNA, 2319 bp, Artificial Sequence
  Description of Artificial Sequence: Synthetic coding sequence
atgtatccccagggaagacacccagctccacaccaacccggccagcccggttttaaattcacagtcgctgagagctgtgatcgaatcaaagacgagtttcaatttttacaggctcagtaccattctctaaaagtggagtacgacaagctggccaatgagaagacggaaatgcagcgacactacgtgatgtattacgagatgtcctatggcctgaatatcgagatgcataaacagacagaaatcgccaaacgcctcaacacaattctggcacagatcatgccctttctctctcaggaacaccagcagcaggtcgcccaggctgttgagagggcaaaacaggtcaccatgacggagctgaacgcgatcatcgggcaacagcaattgcaggcacagcatctttcccacgcaacacacggtccaccagttcagctgccccctcaccccagtggactgcagcctccgggtataccaccagttacagggagctccagtggcctgctggcgttaggtgctttagggagccaggctcacctgacagtaaaggacgaaaagaatcaccacgaactggatcatcgcgaaagggaaagtagcgcaaataatagtgtgagtccctccgagtctctcagagcctccgagaaacatcgaggatcggctgactactcaatggaagctaaaaaaagaaaagccgaagagaaggacagcctatcccgttacgactccgatggagacaaatctgatgatctggtggttgatgtcagcaacgaggatcctgccactcccagagtctctccagctcattctcctccagagaacggtttggacaaagccagatctttaaagaaggacgctccaactagccccgcctctgtggcaagtagctcaagcacaccctctagcaaaactaaagacttaggccacaatgataagagctctactccaggcttaaaatcaaacacaccaaccccaaggaatgacgctcccacccctggcaccagtactactcctggcctcaggtccatgcccggtaaacctccagggatggatccaattggaattatggcatctgccttaaggactcccatctctataacgtcatcttacgccgccccctttgcgatgatgtcccaccacgagatgaatggcagcttgacttcaccgggagcttacgcaggcctacataacattcccccccaaatgagcgctgctgccgccgcggctgcggcggcctacgggcggtcccccatggtctcatttggcgctgtaggctttgatccgcatccaccaatgcgtgctaccgggctgccgagcagtctcgccagtatcccaggtgggaagcccgcttacagctttcacgtgagcgccgacggccagatgcagcctgtaccgtttcctcacgatgccctggccggtccagggatccccagacacgcgcggcagatcaatactctcagtcacggagaggtagtgtgcgccgttaccatctcaaatccaaccagacatgtgtacactggcggcaagggttgtgtgaagatctgggacatctctcagcccgggtccaagagtccaattagccagctcgactgcctaaaccgcgacaactacatcaggagctgtaagctgttacccgacggacgcaccctcattgtggggggggaagcatctaccctaacaatctgggacctcgcctcacctactcctcgtatcaaagccgagctgacctcaagcgctccagcgtgctatgctctagcaattagtcccgacgcaaaagtgtgcttcagctgctgcagcgacggaaacatcgcagtgtgggatctgcataatcagaccctggtgcgacaattccagggccatacggatggggcctcatgtatcgatatttctcacgatgggaccaaactttggacaggcggtctggataacactgtgcgatcttgggacctccgtgagggaagacagttgcagcagcatgacttcacgtcacagatcttcagcctgggatactgcccaactggggagtggctagcagtgggaatggaatctagtaacgtggaagtgctccaccatacaaaaccggacaaatatcagctccacttacacgagagctgcgttctgtccttgaagtttgcctattgcggcaaatggtttgtaagtactggaaaggacaatctgctgaacgcctggagaacaccctacggagcttctatttttcagtcaaaagagtcctccagtgtcctgtcttgcgatataagtgcggacgacaaatacatcgttaccggatccggtgataagaaggctacggtatatgaagtaatttattag

SEQ ID NO: 138282 - DNA, 2319 bp, Artificial Sequence
  Description of Artificial Sequence: Synthetic coding sequence
atgccccctcccccgccactgtcctgcctgcgcggtcttcaggctccccatcagcccggccagcccggctttaaatttaccgtggccgagagctgtgatcgaattaaggatgaattccaatttttgcaggcccaatatcattccctgaaagtggagtatgacaaacttgccaatgagaagaccgagatgcagagacactacgtcatgtattacgagatgagctacgggttaaacatagaaatgcacaagcagacagagatcgcgaagaggctgaacaccatcctcgcccaaatcatgccatttcttagccaggaacaccagcagcaggtcgcacaggccgtggagcgggcaaaacaggtgacaatgacggaactgaacgccataatcggccagcaactccaggcacagcacctgtcccatgcaacacacggtcctcctgtgcagcttcctcctcaccccagtggcctgcagccccctggtattccaccggttacaggcagttcctccggactcctggcattaggtgccctcggctcacaggcccacttaactgtgaaggatgagaagaaccatcacgagctagatcacagagaacgagaaagctcagcgaacaactccgtgagtccatctgagtctttgcgggctagcgagaaacatcggggctccgcggattactctatggaggcgaagaagcgaaaggcggaggagaaggactcattaagccggtatgacagtgacggcgacaagtcagatgacctcgtcgttgacgtaagtaacgaggacccagcaactccgcgcgtaagcccagcccattcccctccagagaatgggctggacaaggctcgcagcctgaaaaaggacgcccccacctcgcccgcaagcgtggccagttcttccagcactccctctagtaaaaccaaggacctgggccacaacgacaaaagcagcacacccggcctgaagagcaacaccccaacacctcgcaatgatgccccaacgccggggacatctactacacccggattgaggagcatgcccgggaagcccccagggatggacccaatcgggatcatggctagcgctttgagaacgccaatctccataacttcaagctatgcagcaccttttgccatgatgagtcatcatgaaatgaatggctccctcactagcccaggagcttacgctggcctgcacaatatcccaccccagatgtccgcagcagccgctgcagccgccgccgcctatggtcgtagcccgatggttggatttgatccccacccccccatgagagccacggggctaccttcaagcctggcttctatccctggcggcaagcctgcatactcctttcatgtatctgccgacggacagatgcagcccgttccctttcctcatgatgcgctcgccgggcccggcattccgcgacacgccaggcagattaatacccttagccatggagaagtagtctgcgcagtgacaattagtaatcccactaggcacgtctacacaggaggcaagggttgcgtgaagatttgggacatatcgcagccaggcagcaagtctccaatctcccagttagattgcctcaatagagataactatatccgttcatgtaagttactgcctgatgggaggaccttgatcgtgggcggggaggcttcaaccctgactatttgggatctggcatccccaaccccaagaattaaggccgaattgacatcatccgcccccgcctgttatgcgctcgcaatcagccctgatgcaaaggtgtgctttagttgctgctccgatggaaacatcgcagtctgggatctccataatcagaccctggtccgtcaatttcagggacacaccgacggcgccagctgtatcgatatctcacacgatgggacaaagctttggaccggcggtctggacaacacggtgcgctcatgggatctgcgggagggcagacagctccagcagcacgactttacaagccagatattcagtttaggttattgtcctacaggggaatggctggcggtgggaatggaatcaagcaacgtggaggtgctgcaccacactaagcctgacaagtatcagctccaccttcacgagtcttgcgtgttaagcctgaagttcgcctattgcggaaagtggtttgtctcgactggaaaagataacctgctgaacgcctggagaacaccctacggtgcttcgatctttcagagcaaggaaagttcatcggttctttcttgcgatatttctgcagatgacaagtatattgtaaccggatctggggacaaaaaagccacagtgtatgaagtgatatactag

SEQ ID NO: 138283 - DNA, 2325 bp, Artificial Sequence
  Description of Artificial Sequence: Synthetic coding sequence
atgccgcctccaccacctctgtcttgtctgcggggccttcaggcgccacatcagcctggtcagccaggatttaagttcaccgtggccgagagctgtgatagaataaaggatgaatttcaattcctccaggcacagtaccacagcctgaaagttgagtatgataaactggcaaacgagaaaactgaaatgcagaggcattacgtgatgtattatgaaatgtcttacggtttaaacatcgagatgcacaaacagaccgaaatcgccaaacggttgaacacgattctggctcagatcatgcccttcttgtctcaggagcaccagcaacaggtcgcacaggcagtggagcgcgcgaagcaggtaacaatgaccgagcttaatgcaattataggacagcagctccaggcacaacacctgagccatgcaacccacgggcctcctgtgcagttacctccccacccctcagggctgcagccacccggaatacccccagtgactggatcctcctccggcctgctcgccctgggggccttggggtcccaggctcatctcacagtgaaggacgaaaagaaccatcacgagctggatcaccgggagagggaaagctctgccaacaattctgtgtctcctagtgagagccttcgggccagtgaaaagcaccggggcagcgcagactacagcatggaggccaagaagcggaaagctgaagagaaagacagtttatcccgatatgatagcgatggagataagtccgacgacctggttgttgacgtgtctaacgaggatccagcaacaccacgggtgagtccagctcactcaccacccgaaaacggacttgataaggcccgtagcctgaaaaaagacgctcccacaagcccggcctctgttgcctcaagctctagcacgccttcatctaagaccaaggatttgggacataacgataagtcctcaacccctggcttaaaatcaaatactcccacgccaaggaatgatgcccccacccctggcacctctaccacaccggggctgcgaagcatgcctggcaagccacccgggatggacccaatcgccagcgctctgcggactccgatctccatcacctctagttatgcagccccctttgcaatgatgtcgcatcacgagatgaacggcagcctgaccagccctggggcctacgctggcctgcacaacatacctccccagatgtccgcggctgcagccgctgctgcagctgcctatgggagatctcccatggttagtttcggggctgttgggtttgaccctcatcccccaatgagggcaacgggtttaccctcaagccttgcttctattcctggcgggaagcctgcgtacagcttccatgtttctgctgatggccagatgcagcccgttcctttcccccacgacgccctggccggccctggaattccacggcacgcaaggcaaatcaatacgctaagccacggtgaggtggtttgtgccgtaaccataagcaacccaactcggcacgtttatacgggcgggaagggctgtgtcaagatctgggacatctctcagcctggctctaagtcacctatttcacagctcgactgccttaaccgagataattatatacgctcctgtaagctgctgcctgacggaaggaccctcatcgtgggaggcgaggcctcgaccctgacaatttgggatctggcatctcctactccacgtatcaaggccgaactgacctcgagtgccccggcttgttatgccttggccatctcccctgatgccaaggtgtgctttagttgttgttcagatgggaacatcgcggtgtgggatctgcacaaccagaccctagtccgccagtttcaaggacacaccgacggcgcaagttgtatcgatattagccatgatggaaccaagctttggactgggggattggacaatacagtcagatcctgggatctgcgtgaagggcgccaattgcagcagcatgactttaccagccagatcttttccctgggatactgcccgactggcgagtggctcgctgtcggcatggagagttcaaacgtggaggtgttacaccacactaagccagacaagtaccagctacatctgcacgagtcatgtgtgttatcactgaaattcgcgtactgcggcaagtggttcgtgagcacgggaaaggataacttactgaacgcttggaggaccccatatggagcttcaatttttcaaagcaaagagagctcaagcgtactgtcatgcgacatctctgctgacgacaaatatatagtgactggcagtggtgataagaaggcaactgtctacgaagtgatttattag

SEQ ID NO: 138284 - DNA, 1719 bp, Artificial Sequence
  Description of Artificial Sequence: Synthetic coding sequence
atgacctctagggatcaacctcgacctaagggacccccaaagtcaacttcgccttgccccggcatctcaaatagtgagagctccccgacactgaactatcagggcatcctgaaccgcttaaaacagttccctagattttccccccattttgccgccgaactggagtctatctattactccctgcacaagattcaacaagatgtggctgaacaccataagcagattgggaatgtactgcagattgttgaatcctgctcacagcttcagggctttcagtccgaggaggtgtctcccgccgaaccagccagccctggcactccacagcaagtgaaggataaaaccctgcaagagagctcctttgaggacatcatggcaaccaggtccagcgactggctgaggcgccccttaggggaggacaaccagcccgaaacacaactgttttgggacaaagagccctggttctggcacgacactctgaccgaacagctgtggcgaatctttgccggagtgcacgacgaaaaggcaaaaccccgtgatagacagcaagcgccgggccttggtcaggagagcaaggccccggggtcctgtgacccaggcactgacccttgtccggaagacgcttcaacaccacgaccaccggaagccagctcttccccacccgagggaagccaggatagaaacaccagctggggcgtcgttcaggaaccacccgggcgggctagcagattcctgcagagtatcagttgggacccagaggatttcgaggatgcctggaagcgcccagacgcactccctgggcagtccaagcgtctggcagtgccctgcaagctggagaaaatgcgaatcttagcacatggtgaactcgtactggcaacagccatcagtagctttaccaggcacgtgtttacatgcggaaggcgggggataaaagtgtggagcctcaccggccaggtggccgaggataggttcccagagagccatctgcctattcagacacctggtgctttcttgcgcacatgcttgctctcatcaaacagccggtcgctgctgactggaggctacaatctcgcgtccgtgtctgtctgggacctagctgctccgtcgctccacgtcaaagagcaacttccatgcgccggccttaactgtcaggcactggacgcgaacctggatgccaatcttgcctttgcttccttcaccagtggagtcgtccgcatttgggacctgcgcgaccagtccgtggtgcgggatctgaaaggctacccagacggcgtgaagagtattgtagttaaggggtataatatctggacaggaggtcctgacgcatgcttaaggtgctgggaccaacgcactatcatgaaacctctcgagtaccagttcaagagtcagatcatgtcgttgtcccactcaccacaggaagactgggtgcttttaggtatggcaaacgggcagcagtggctgcagtcaaccagcggctcccagagacacatggtgggacagaaggacagtgtgatcttgtctgtgaagttctctccgttcggccaatggtgggcctcagtcggaatggacgatttccttggtgtatactctatgcctgcagggacaaaagtatttgaggtgcctgaaatgtcccctgtgacatgctgtgacgtctcgtccaataaccgtctagtggtgactggttcgggtgagcacgcttctgtatatcaaatcacctattag

SEQ ID NO: 138285 - DNA, 1251 bp, Artificial Sequence
  Description of Artificial Sequence: Synthetic coding sequence
atggcaacaaggtctagcgattggctgcgtagaccacttggcgaggacaaccagccagagacacagcttttttgggacaaagagccttggttttggcacgacacgttgacagagcagctttggcgcatatttgccggagtgcacgacgaaaaagcaaaaccgagagatagacagcaagccccaggcctgggtcaggagtcaaaagcacctggcagttgtgatccaggcaccgacccctgtccggaggatgcatctactccgaggccccctgaggccagttcttccccacccgaggggagccaagacagaaacacatcgtggggagtcgtccaggagcctcctggacgcgcaagccggtttttacagtcgatctcttgggaccctgaagactttgaggacgcatggaagcgccccgacgccctcccggggcagagtaagagattggcggtgccttgcaaacttgagaagatgaggatcttggcccatggcgaattggtgctggcgacagccatcagcagctttacacggcacgtgttcacgtgcggtaggaggggtatcaaggtatggtctctaaccgggcaggtagctgaggatcgcttccctgaatcccacttacctatacagacacctggagctttcctgcgaacctgcctcctgagtagcaacagccggtccctcctgactgggggctataaccttgcgtccgtttctgtgtgggacttagccgcgccctccctgcatgtgaaggagcagctgccctgtgcaggcctgaactgtcaggcccttgacgcaaatttggatgcaaatttggcgtttgccagctttacatcaggagtggtgaggatttgggacttaagagaccaatccgtggtgagagacttgaaaggatacccggatggtgttaagagcatcgtggtgaagggctacaatatatggacggggggtcccgacgcctgtctgagatgctgggaccagcggactataatgaaacccctggagtatcagttcaagtcacagattatgtcactcagccattcaccgcaggaagattgggtgctgctgggcatggccaacggacagcagtggctgcagtccacttccggctcgcagaggcacatggtgggacagaggcagcgccatccggaacgccaagtactcccactgtggcctgtggtgggtaaaaggtggaacgggaggctgccatggcggttgcagcatgctggcggtgataagagcgtaagaggggcctag

SEQ ID NO: 138286 - DNA, 1719 bp, Artificial Sequence
  Description of Artificial Sequence: Synthetic coding sequence
atgaccagtcgcgatcagccaagacccaaagggccccctaaatccacgtccccttgccccggcattagtaattccgagagcagccccaccctcaattatcagggtatcctgaaccgactgaagcagtttccccggttcagcccccacttcgccgctgaactggaaagtatctactattcactgcataaaatacagcaggacgtagccgaacaccacaaacagatcgggaacgtgcttcagattgtggagtcatgctcccaattacagggattccagagcgaagaagtgagtcccgcagagcctgcctcccccggcactccacagcaggttaaggacaaaacccttcaggagagctcattcgaggatatcatggcaactcggagctctgactggctccggaggccactgggggaagacaatcaaccggaaacccagcttttctgggacaaagaaccctggttctggcacgacaccctcacggagcagctgtggcgaatctttgctggcgttcacgatgagaaagcaaaacccagagatcgtcatttcagtattttccagggacaagaatccaaagcacctggcagctgcgaccccggcacagatccctgccctgaagatgctagtactcccagaccaccagaggccagctctagcccgccggaaggcagccaagaccggaacactagctggggcgtcgtacaggagcctcctgggagggcctcacggtttctgcagtcaattagttgggatcccgaggactttgaggatgcttggaagcgcccagatgcactgcccggtcagagcaagagactcgcagtgccttgtaagctggaaaagatgcgcatcttagctcatggcgagcttgtgctggccaccgcaatatcatcattcaccaggcacgtctttacctgtgggcggagaggaattaaagtttggtctttgaccggccaggtcgcagaggacagatttcccgagtcccaccttcctatacagaccccaggcgccttccttaggacttgcttgctgtcttcaaattctaggtcccttctgacaggaggctataatcttgcctccgtgagcgtctgggacctggctgctcctagtttgcacgtgaaagagcagttaccttgcgcaggactgaactgccaggccctcgatgccaaccttgatgcgaacttagcgttcgcgtcttttacttctggcgtcgttcgcatctgggatctacgggatcagtccgtggtacgcgacctgaagggctaccctgatggggtcaagtccatcgtggtgaagggatacaacatttggactgggggcccagacgcttgcctgcggtgttgggaccaacgcaccattatgaaacccctggagtaccaattcaaaagtcagatcatgtctttaagccacagccctcaggaggattgggtcttgctgggaatggcgaatgggcagcagtggctgcaaagtacctccggtagccagcgacacatggtaggacaaaaagatagcgtcatcctgagcgtgaaattttccccgtttggccagtggtgggcatcagtgggcatggacgacttcctaggcgtctatagtatgcctgccggcacaaaagttttcgaggtccctgagatgagccctgtgacatgttgtgacgtgtccagtaataaccgtctggtggtcaccggatctggtgaacatgctagcgtttaccaaatcacctactag

SEQ ID NO: 138287 - DNA, 1350 bp, Artificial Sequence
  Description of Artificial Sequence: Synthetic coding sequence
atggccacgaggagtagcgactggctgcggcgcccactgggtgaggacaaccaaccagaaacacaattgttctgggataaggaaccttggttctggcacgatacactgactgagcagctgtggcggatcttcgcaggagtgcatgacgagaaggctaaacctcgcgatcggcaacaagcccctggtctggggcaagaatccaaagcacctggttcatgcgatcccggcacggatccatgtcccgaggacgcctcaacaccaaggccacctgaggcgtctagtagcccgcccgagggctcacaggataggaatacctcatggggtgtggtgcaggaaccaccaggtagagcctctcgttttctgcaaagtatttcatgggatcctgaggactttgaagatgcctggaagcgtcccgatgccctgcctggccagagtaaacgacttgccgtcccttgcaagttagaaaaaatgcgcatcctcgcacatggagaactggtgttggcaacagctatcagtagcttcacccggcatgtgttcacctgtggcaggaggggcatcaaggtttggtccctaaccgggcaggtcgccgaagacagatttccagaaagccatctcccgatccaaacccccggagccttcctccggacatgcttactttcatctaactctcggtctctcttgactggaggctacaatcttgcgagcgtgtctgtatgggatttggcggcccccagcctgcacgtcaaagaacagcttccttgtgcggggctgaattgtcaggccctagacgccaaccttgacgccaatctggcgttcgcatcctttacaagcggggttgttcgaatttgggacttacgggatcagagcgtcgtgcgcgatcttaagggctacccggatggggttaagagcatcgtcgtgaagggctataatatctggacagggggaccggacgcatgcctgagatgttgggaccaaaggaccatcatgaagccactggaataccaattcaaaagtcagattatgagcctgagtcattccccccaggaggactgggttctcctgggtatggctaacgggcaacagtggttacagagtacctccggtagccagcgccatatggtcgggcagaaagattcagttatcctcagcgttaagttcagccctttcggacaatggtgggctagcgtcgggatggatgatttcctcggtgtttactccatgccagcagggaccaaggtgtttgaagtgccagaaatgtctccggtcacatgttgcgatgtatctagcaataataggttggttgtgacagggagcggggagcacgccagtgtttaccagatcacatactag

SEQ ID NO: 138288 - DNA, 1716 bp, Artificial Sequence
  Description of Artificial Sequence: Synthetic coding sequence
atgaaccagctgcgaggtaagaagtcctgtcacacaggactcgggagatcagctggatggaacattcccattggtctcctttactgcgatcttccagagcctagaaagcccctggaaaaggccgtggccaacttcttctcaggtagttgcgctccatgcgctgacggaacagacttcccccaactttgtcagctgtgtcccggttgcgggtgttccaccttgaatcaatatttcggatactcaggggccttcaaatgcttaaaggatggagctggagatgttgcatttgtgaagcacagcactatttttgagaatctggccaacaaggcggatcgtgatcagtatgagcttctctgtctcgataatacccggaagcctgtggacgagtacaaagactgccatctcgcacaggtcccgagccacacagttgttgctcgctctatgggcggaaaggaggacctgatttgggagttgttaaaccaggcccaggagcactttggcaaggacaaatccaaggaattccagttgtttagctctcctcatggaaaggaccttctgttcaaggacagcgcacacggatttctgaaggtcccccctcggatggatgccaagatgtacctggggtatgagtatgttaccgccatccgaaatcttcgggagggcacttgtcctgaggcgcccacagacgagtgcaagccggttaaatggtgtgcgctgagtcaccacgagcggctgaagtgcgatgaatggagcgtcaactctgtggggaaaatagaatgtgtgtctgcagagaccaccgaggactgtatcgccaaaatcatgaacggcgaggctgacgcaatgagtctggacggggggttcgtgtacattgctggaaaatgtggcttagtaccagtactcgccgaaaactacaacaagtccgataattgtgaggacactcctgaggccggatacttcgccatagccgttgtaaagaaaagtgcttcagacctcacttgggacaatttgaagggcaaaaaatcctgtcacaccgctgtcggcaggactgccggatggaatatacccatgggattactgtataacaagatcaaccattgtagatttgatgaattctttagtgagggctgcgccccagggagcaaaaaggatagctcactttgtaagctgtgtatggggagcgggttgaacctctgtgagcctaacaataaagaaggctactatggatacaccggcgcctttagatgcctggtggaaaagggagatgtagcattcgtgaagcatcaaactgtaccccagaacacaggaggaaagaacccagacccctgggcaaaaaacctgaatgaaaaggactacgagttgctgtgcctggatggaaccaggaagcctgtggaggagtatgccaactgccacctcgctagggctcccaatcacgctgtggtcactcgcaaagataaggaagcttgtgtgcacaagatcttgcgccagcaacaacacctgttcggctccaatgtaaccgattgttccgggaatttctgcttgttccgtagcgaaacgaaagatttactttttagggacgacacagtctgcctcgccaagctgcatgaccggaacacatatgagaaatatttgggcgaggaatacgtgaaggcagtaggcaatttaagaaaatgtagcacttcgtccttacttgaagcttgcacatttcggcgaccctag

SEQ ID NO: 138289 - DNA, 2097 bp, Artificial Sequence
  Description of Artificial Sequence: Synthetic coding sequence
atgcgtctggccgtcggcgcacttcttgtgtgtgctgtcctgggactgtgcctggctgtccccgataagaccgtaaggtggtgtgccgtgtccgagcatgaggcaacaaaatgccagtcgtttcgagaccacatgaaaagcgtgatccccagtgatggaccttcggtagcttgtgtcaagaaagcgtcatatctggactgcataagagccattgcggcgaatgaggccgatgcagtgaccttggacgccggattggtatatgacgcttatctagcgcccaacaatttgaagccagtggtggcagaattctacggctcgaaggaggaccctcaaactttttactacgctgtggctgtggtcaaaaaagactcaggtttccaaatgaatcagttgcgaggcaagaaatcatgtcacacaggcttagggaggtccgctgggtggaacatcccaatcggcctgttatactgtgacctgccagagccccggaaaccgctggagaaagctgtagcgaacttcttcagtgggagctgcgcgccctgcgcagacgggactgactttccacagctctgtcaactctgcccaggatgtgggtgctcgacactcaatcaatactttggctattctggggctttcaagtgtcttaaagatggagccggggatgtagcatttgtgaaacattcaaccatttttgagaatcttgccaacaaagccgacagagatcagtacgagctgctgtgtttggacaacacgcgcaaaccggtggacgaatacaaggactgccatctggcccaggtccctagtcataccgtagtagcacggagtatgggcgggaaagaagacttgatctgggagcttctgaatcaggcgcaggaacattttggtaaagataaaagcaaggagtttcagcttttttcgtcccctcatggaaaagatctactctttaaggacagtgcgcacggttttctgaaggtccccccaaggatggacgctaagatgtatttgggctatgaatatgtgaccgctataaggaacttgagagaggggacctgccccgaggctcccaccgatgaatgcaagccggtgaagtggtgcgcactaagtcaccacgagaggttgaaatgcgatgagtggtcagtgaatagcgtggggaagatagagtgcgtatcggctgagaccaccgaagactgcatagccaagatcatgaacggtgaggctgatgccatgtcactcgatgggggctttgtctatatagctggaaagtgcgggcttgtgcctgtgctggccgaaaactacaacaagtccgataactgcgaagataccccggaagcaggttattttgccatcgctgtggtgaagaaatctgccagcgatttaacatgggacaatttgaaaggtaagaaaagttgccacactgccgtggggcggaccgccggctggaatatcccaatgggactcttgtataacaaaataaatcactgtcgattcgacgaatttttctcagagggatgcgctcccgggtctaagaaagactctagtctctgcaaattatgtatggggtcaggcctgaatctgtgcgaacctaacaataaagaaggatactacggttataccggggcattcaggtgtctggtggagaagggggacgttgccttcgtcaagcaccaaactgtaccccagaacacaggtgggaagaaccccgacccatgggcaaaaaatctcaacgaaaaagactacgagctgttatgtctagatggtactcggaaacctgtagaagagtatgccaactgtcatcttgccagagcccccaaccacgcggtagtcacccgcaaggataaggaagcgtgtgtgcacaaaatcctccgtcagcagcaacacctattcgggtcaaacgtaactgactgtagtggcaacttctgcctctttcgttcggaaactaaagaccttctgtttcgtgacgacaccgtctgcttggctaaactgcacgatcggaacacatatgagaagtatcttggggaggaatatgtgaaagctgtaggaaatcttcgtaaatgctcaacttcttcacttttggaagcctgcactttccgtaggccatag

SEQ ID NO: 138290 - DNA, 2283 bp, Artificial Sequence
  Description of Artificial Sequence: Synthetic coding sequence
atgatggatcaggcccgatcggcgttctctaatctgtttggcggggaacctctctcttatactcgcttctcattagcgcgccaggtagatggtgacaactcccatgttgagatgaagctcgcagtggatgaggaggaaaacgcagataacaatactaaagccaacgtgacgaagccgaagaggtgcagtggttcgatttgctacggaaccatagcagtcatcgtgttcttcctgattggatttatgataggctacctgggatactgtaaaggcgtggagcctaaaacagagtgcgaaaggctggcgggcaccgagagccctgtcagagaggaacctggcgaagacttcccagctgcacggcgtctctactgggatgatctgaagagaaaactcagcgagaaattggacagtactgacttcacagggaccatcaagctgttgaacgaaaactcatacgtaccgagagaagctggctcacaaaaagatgagaacctagcactgtacgtggagaatcagttcagagagttcaaattaagcaaggtgtggcgggaccagcacttcgtcaagatacaagtgaaggatagcgctcagaatagtgtgatcattgtggataaaaacggcagactggtatatctggtcgagaaccctggtggctacgttgcttactccaaggctgctactgtgacgggcaaacttgttcatgccaattttggcacaaagaaggatttcgaagatctgtacacacccgtgaatggatctatcgtcatcgtcagagccggaaagataaccttcgccgaaaaggtggctaatgctgaaagtctgaacgccattggggtgctgatctacatggaccagacgaaattcccaattgtgaatgctgagctgtcattctttggccatgcacatttgggaacaggagacccatacacacctgggttcccatcttttaaccacacccaattccctccttcccggagctccggattacccaatatcccggtgcagactatatcgcgcgccgccgcagagaagctcttcgggaatatggagggagattgcccttctgactggaagacagactctacctgccggatggtcacgagtgagtcaaagaatgtgaagctcaccgtttctaacgtcctgaaagagatcaagatactgaacatttttggagtgataaaaggctttgttgagcctgatcattacgtagtggtgggcgctcagagagacgcctggggccctggcgcagcaaagagtggagtgggaacagccttgcttttgaaactcgcacaaatgtttagcgacatggtgcttaaggacggattccaaccatcccggtccatcatcttcgcttcttggtccgccggcgacttcggaagcgtgggagcgaccgagtggttggaggggtatctcagctcactccatttgaaagcgttcacatatataaacctggataaagcggtgctgggaacctctaacttcaaagtttctgcttcgccgcttctctacacactcattgagaaaactatgcagaacgtcaaacatcctgtgaccggacagtttttgtaccaggactccaactgggccagcaaagtggagaagcttaccctggataacgccgcctttccgtttctggcttatagcggcatacctgcagtgtccttttgcttttgcgaagataccgactatccttacctaggcactactatggatacttacaaggagctgattgaaagaattcctgagctcaacaaggtcgcaagagccgccgctgaggtggccggccaatttgtcattaagctcacgcacgatgtagagctgaatcttgattacgagcgttacaattcccagcttctgtcgtttgtgagagaccttaaccagtaccgcgccgatataaaggagatgggcctaagcttacaatggctctatagtgctcgaggagatttcttcagggcgacatctaggcttaccactgactttggtaatgcagaaaagaccgatagattcgtgatgaaaaagctaaacgatcgagtcatgagagttgaatatcacttcctgagtccatacgtgtctcctaaggagtccccttttagacatgtcttctggggctcaggatcgcatacactgccagcacttctagaaaatttgaagttaagaaagcagaacaatggcgccttcaacgaaaccctgttcagaaatcagttggcactggccacatggaccatacagggggcagcaaatgccctgtcaggcgatgtgtgggatatcgacaacgaattctag

SEQ ID NO: 138291 - DNA, 2283 bp, Artificial Sequence
  Description of Artificial Sequence: Synthetic coding sequence
atgatggaccaggctaggtccgctttctcaaaccttttcggtggggagcctctgtcttatacccggtttagccttgcgcgccaagtggatggcgacaactctcacgttgaaatgaaactggccgtagacgaggaggaaaacgccgacaacaatacaaaagcaaatgtcaccaaacctaagaggtgctcagggtctatctgctacggcacaatcgccgtgattgtgttctttctgattgggttcatgataggttacctaggctattgcaaaggggtagaacctaagaccgagtgcgagcgcctcgcgggcacagagagtccggttcgggaggaacccggcgaggactttccggccgcgaggagactctattgggacgacctgaagaggaaactgagtgagaaattggactccacggatttcacaggcaccatcaaactgttgaatgagaactcttatgtaccccgagaggcaggttcacagaaagacgaaaaccttgcactctacgtggaaaaccagttccgcgaatttaaactgtctaaggtgtggagggaccagcacttcgtcaagattcaggttaaagactccgcccagaacagtgtgataattgtggacaagaatggtaggctcgtgtacctggttgaaaaccccgggggatatgtggcctactccaaagcagcgacagtaacgggtaaactggtgcacgccaactttgggaccaagaaagactttgaggatctttatacccctgttaatggttccatcgttattgtaagagccggtaagataacctttgccgaaaaggtagccaacgcagagtcgttgaacgctataggcgtgctaatctacatggaccaaacaaagttccccattgtcaacgcagagctttctttttttggccatgcccacctggggacgggggatccctatacccccggtttcccctcatttaatcatacacagttccccccctctaggagctctgggttgcccaatatcccggttcagaccatctcccgagccgcggcagagaaattattcggaaatatggaaggtgactgtccctctgactggaagacggacagcacatgtagaatggtgacttcagaatctaagaatgtgaaactgacagtgtctaacgtgctcaaggagatcaagattctgaacatattcggagtaatcaaggggttcgtcgagcccgaccactatgtggtggttggggctcagagagacgcttggggacctggtgccgctaaatcaggcgtaggcaccgctctgctcctcaaacttgcgcagatgtttagcgacatggtgctgaaagatggatttcagccctcacgctccatcatctttgcatcctggtcggcaggcgattttggctctgtcggggccacagagtggctcgaaggatacctttcctccttgcatctgaaagcgttcacgtatatcaaccttgataaagccgtgcttggaacatctaacttcaaagtgtctgcatccccactgttatacacactcatcgaaaagacaatgcaaaacgtcaaacacccagtgactggtcagttcctgtaccaagacagcaactgggcctcaaaggtagaaaaattaacactggacaatgctgcatttccttttttggcttactctggcatcccggccgtgtcattctgcttctgcgaggataccgattatccttatctggggactaccatggatacttacaaggaactgatagaaaggatccctgagctcaataaggtggcccgggctgctgctgaggtggcaggccagtttgtaatcaaacttacacacgacgtcgagttaaatttagactatgagaggtacaattcccaattacttagttttgtcagagatctcaaccagtatagggcagacattaaagagatgggactcagcctgcagtggctttactcagctcgcggggatttctttagggctactagtcgtttgacaaccgattttggaaatgccgaaaaaaccgacagatttgtgatgaagaagttgaacgaccgagtgatgagggttgagtaccattttctgtccccatacgtctctcctaaggagagccccttccggcacgtgttctgggggtctggatcccacaccctgcctgcactgctggaaaacttgaagcttcggaaacaaaataatggcgccttcaacgagactttgtttcgtaatcaactcgctctggccacctggacgatacagggagctgccaatgccctcagtggagacgtctgggacatagataacgaattttag

SEQ ID NO: 138292 - DNA, 1437 bp, Artificial Sequence
  Description of Artificial Sequence: Synthetic coding sequence
atggaccagaccaagttccccatagttaacgctgaattatcttttttcggccacgcccatctggggaccggggacccgtacactcctgggtttccaagctttaatcatacccaattcccaccttctagatcgagcgggctgcccaacattcccgtccaaacaatttcacgcgctgccgcagaaaaactgtttggcaacatggagggcgattgccctagtgattggaaaaccgatagcacatgtagaatggtgacatctgagtctaagaatgtcaagctaaccgtctccaatgtcctaaaagaaataaagatcctgaacatcttcggagtgatcaagggatttgttgaaccagaccactacgtggtcgtgggcgcgcaacgcgatgcctggggacccggcgcagctaaaagtggcgtggggactgctctgctgttaaagctggcacagatgttttcggacatggtgctaaaggatggtttccagcccagtagatctataatttttgccagctggagtgctggcgacttcgggtcagtaggagcaacagagtggctggagggatacttgtcctcgctacacctgaaggctttcacttatataaatctggataaggctgtgcttgggaccagtaatttcaaggtaagcgcgtctcccctgctatacaccttgattgagaagactatgcagaacgtaaagcaccccgtgactgggcagttcctgtatcaggactcgaactgggcaagtaaagttgaaaaactaaccttagataacgccgccttccctttcctcgcttactctgggattccagccgtgagtttctgcttctgtgaagacactgattatccctatctcggtacaacaatggatacatacaaggaactgatcgaacggatacctgaactgaacaaagtcgctcgtgcagccgcagaagttgctggccagttcgtcatcaagctgacccacgatgttgaactcaacctcgattacgagagatacaattcccagctgctgtcattcgtacgggatctgaaccagtacagggctgatatcaaagagatgggattgtctcttcagtggctttactccgctcggggcgacttttttcgagctacaagcagacttaccaccgacttcggaaatgcagagaagacagatcgctttgtgatgaagaaactgaacgatagggttatgcgcgttgagtaccattttctgtcaccatatgtctcacctaaggagagccccttcagacatgttttctgggggtccggttctcatacgcttcctgccctgttagagaacttaaagctgaggaagcagaataacggggcttttaacgagaccctgttcaggaaccagcttgccctggcaacatggacaatacaaggtgctgcaaatgccctgagcggtgacgtctgggatatcgataacgaattttag

SEQ ID NO: 138293 - DNA, 42 bp, Artificial Sequence
  Description of Artificial Sequence: Synthetic coding sequence
atggaccaggctcgctctgcctttagcaacctggacctgtag

SEQ ID NO: 138294 - DNA, 11493 bp, Artificial Sequence
  Description of Artificial Sequence: Synthetic coding sequence
atggcctttgtggctactcagggggcaactgtggtagaccaaactacattgatgaagaagtacttacagttcgtggcagccctgaccgacgtgaatacccctgacgaaacaaagctcaaaatgatgcaagaggtgtctgaaaactttgagaacgtcacctcttcaccacaatattctacatttctcgagcatatcattcccaggttcctgacgtttctccaagacggggaggtgcagttcttgcaagagaagccggcacagcagctgcgtaaactagttctggaaatcatccaccggatacccacaaacgaacacctccgtccacacaccaaaaacgttctgtccgtcatgttccggttcctagaaacggaaaacgaggagaacgttctcatttgtttacgcattatcatagaactgcacaagcaattcagacctccgatcacacaggagatccatcacttcttagactttgtaaagcagatttacaaagaactgcctaaggtcgtcaatagatatttcgagaacccacaggtcattccggagaacacggtgccacctcctgaaatggtcggaatgataaccaccatcgccgtcaaagtaaatcccgagcgcgaagactctgaaacccgtacccactctataatcccacgtggatctttgtctctcaaagtgctcgctgagctgcccatcatcgttgtactcatgtaccagctgtacaagcttaacatccataacgttgtcgctgagttcgtgcctcttatcatgaacaccatcgccatccaggtctctgcccaagctcgccaacacaagctctataacaaagaactttatgcagacttcatcgccgctcagattaagactctgtcctttttggcttatatcatccggatctatcaggagctggtcactaagtacagccaacagatggtcaagggaatgcttcagctgcttagtaattgccctgcggagacagcccacctgcgaaaggaactcctgatagcggctaagcatatcctgaccacggagcttaggaatcagtttataccttgtatggacaaattgttcgacgaatccatactcatcgggtctgggtacactgctcgagagacactgaggcctctggcttatagcacactcgctgatcttgtccaccatgtccgccagcaccttcccctatcagatctgagtcttgcagtgcaacttttcgctaaaaatatcgacgatgaaagcctacctagttctatacagacaatgtcatgcaagctccttttgaacctagttgactgtatacggtccaaatccgagcaggaaagcggaaatggacgagatgttctcatgcgtatgctcgaagtgttcgtcctgaaattccataccattgcccggtaccaactctccgccatcttcaagaagtgcaaaccccaaagcgagctgggagctgttgaagccgctttgccaggagtccctaccgccccagccgcaccaggcccagccccctctccggcccctgtaccagccccacccccacctccacctccgccaccacccgccaccccagttacccctgctcccgtgcccccttttgagaaacagggcgagaaagacaaagaggataagcagaccttccaagtcaccgactgcaggagtcttgtgaaaacacttgtctgtggggtgaaaactatcacttggggaatcactagctgcaaggcccctggagaagctcaattcattccgaacaagcagttacagccaaaagagacccagatatatattaagttagtgaaatacgcaatgcaggcattggatatctatcaggttcagattgcaggtaacgggcaaacctacattcgggttgcaaactgccagacagtgagaatgaaagaggaaaaggaagtgttggaacactttgcaggggtgttcaccatgatgaaccccctgacctttaaagagattttccagactacagtgccatatatggtcgagaggatatccaaaaactatgcactacagatagtagccaatagctttcttgccaaccctaccacctcagcactcttcgcgaccattctcgttgagtatctcctggaccgcctgcccgagatgggctcgaatgtggaactgtccaatctttacttgaagctctttaaactggttttcggctccgtgtcattgttcgcagctgaaaatgagcagatgctcaaacctcatcttcacaaaattgttaactccagtatggagctcgcccaaaccgcaaaggagccttataattatttcttgctcctgcgggcattgttcagatcaatcggcggaggttcacatgacttgctgtatcaggaattcctacctctgctgccaaacctgctgcagggcttgaatatgctgcagagtggcttgcataagcagcatatgaaagacttgtttgtggaactgtgcctcacagtgcctgtgagactgtcctccctgttgccctacctgcctatgttgatggatcccttggtaagcgccctcaatggttcccagacactagtttcccagggcctgaggactctagagctctgcgtggacaatctgcagcctgacttcttatacgaccacatccagccagtccgcgccgaacttatgcaggccttgtggcgtacacttcggaaccctgcggacagcatctcacatgtggcttatagggtgttgggaaagtttggcggaagtaatcgaaaaatgttaaaggagtcccagaagctgcattacgtggtaaccgaggtgcagggtccttccatcaccgtggaattctccgattgtaaggcctcgctacaattacctatggagaaggcaatcgagaccgctttggactgcttaaagtctgccaatactgaaccttattaccggcggcaagcttgggaggtgatcaagtgtttccttgttgctatgatgagcctagaggataacaagcacgctctataccagctcctcgctcaccccaacttcaccgaaaagactataccaaacgtgatcatctctcaccgctacaaggcacaagatacacccgctcgtaagacctttgaacaggcactgaccggcgctttcatgtcggccgtgattaaggatctccgaccctcagcattgccattcgtggcctcacttatccggcactatacaatggttgccgtggcgcagcagtgcggcccgttccttctgccatgctaccaggtcgggtcccagccaagtactgccatgttccactccgaggagaatggaagcaaggggatggacccgctcgtgctcattgatgcaatcgcaatttgcatggcctacgaggaaaaggaactgtgtaaaatcggggaagtcgccctagccgtgatttttgatgtcgctagcattattctcggttcaaaggagcgcgcttgccagctccctttattttcctacatcgttgagagactatgcgcttgttgctacgaacaggcctggtacgctaagttagggggagtggtcagcattaaatttctcatggagcggctacctctcacatgggtgctgcaaaaccagcagacttttcttaaggccctgctcttcgttatgatggacttgacaggcgaggtgtccaatggcgctgtagccatggctaaaactaccctggagcagctgttgatgcggtgcgctacgccacttaaagacgaagaaagggcggaagagattgttgcagctcaagagaaatccttccaccatgtcacccacgacctcgtcagggaggttacgagccccaattctaccgtacggaagcaggcaatgcattcactacaggtcctcgcccaggtcaccggcaagtctgtgacagttatcatggagccccataaagaggtgctacaagacatggtgccccctaaaaaacacctgcttcggcaccaacccgccaacgcacagattggactaatggaggggaacaccttttgcaccaccctccagccacggttgtttaccatggatctcaatgtagtggaacacaaggtgttttacaccgagctcctgaatctttgtgaagctgaggacagcgcactgacaaaactcccgtgttacaagtctcttccatccctcgtgcctctacgaatagcagccctgaatgccctggcagcctgtaattatctcccccagtcccgcgaaaagatcattgccgcactgtttaaagccctgaactccaccaatagtgaattgcaagaagcaggggaagcctgcatgcgcaagtttctcgagggcgcaacgatagaagtcgatcaaattcacacgcacatgagacccctgttgatgatgctaggagactaccggagcctcacgctgaatgtggtcaatcggctgaccagcgtcactcgcctctttcccaacagcttcaatgataagttttgcgaccagatgatgcagcacctgcgtaaatggatggaagtagtggtaataacccataaaggcgggcagaggtctgacggcaatgaaatgaagatctgcagcgccatcatcaatctgttccatctgattcccgccgctccgcagaccctggttaagccgcttttagaggtggttatgaagacagaacgtgcaatgttgatcgaagctggatccccgtttcgcgaaccactcattaagtttctcacgcgccatcccagtcagacagtggaactgtttatgatggaggccacgctgaacgatccccaatggagtcggatgtttatgtcatttttgaaacacaaggacgctagaccactcagagacgtcctggcagctaatcccaatcggttcatcaccttacttctgccaggtggagctcagactgcggtgcggccaggatctccatcaacctcgaccatgagactggacctccagttccaagcaatcaaaatcatcagtataatcgtcaaaaacgatgactcctggctggccagccaacacagcctggttagccagctgaggagggtgtgggtgtctgagaattttcaggaacgccatcggaaggaaaatatggcagctacaaattggaaagagccaaagctgttagcctactgccttctgaattattgcaagcggaactatggtgatattgaacttttatttcagctcctccgagcattcaccggtagatttctctgcaatatgacgttcctgaaggagtatatggaagaggaaatcccaaagaattactctatagcccagaaaagggcactcttctttcggttcgtcgactttaacgatcccaatttcggggacgagctgaaggcaaaggttctgcaacacattcttaaccctgctttcctgtacagctttgaaaaaggggaaggcgagcagctcctcggaccacctaaccccgagggcgataatccggagtccattactagtgttttcataacaaaggtacttgaccccgaaaagcaggctgacatgctggacagcttgagaatttacctgctccaatatgccaccctcctggtcgaacacgccccacaccatatccacgataataataagaatcgcaattctaagctgaggcgacttatgacttttgcgtggccttgtctcctgtccaaggcctgtgtggatcctgcatgtaaatattccggacacctattactggcacacatcattgccaaatttgcaattcacaagaagatagtcctccaggtgttccattccctgctgaaagcccacgccatggaggctagagccatcgttcggcaggccatggctattctgacgcctgcggttccggcacgtatggaggacggacatcagatgctcacgcactggacacgcaagatcatagttgaggagggccatactgtgccgcagctggtccacatccttcatctaattgtgcaacactttaaggtgtattaccctgtacgacatcacttagtacagcacatggtgagtgcgatgcagaggctaggttttaccccaagcgttactatcgagcaacgccggttagcagtggatctcagtgaggtcgtgattaagtgggagctgcagcgcataaaggatcaacagcctgatagcgacatggatcctaactcatccggagagggcgttaattcagtctcctccagcataaaacggggtttgtccgtggattctgctcaggaagtgaaacggtttagaacggcaacaggtgccatttcagctgttttcggtcgctctcagtcccttcccggggccgacagtctacttgccaagcccattgacaaacagcatacagatactgttgtcaatttcttaatcagagtggcttgtcaagtgaacgacaacacaaatacagcaggatcaccaggggaagtgctcagccggcgatgcgtgaacctcctcaaaacagcactgcggcccgacatgtggcctaaaagcgaactaaagctgcagtggtttgacaagctactaatgaccgtggaacagcccaaccaggtcaattatgggaacatctgcaccggtctggaggttctaagttttcttcttaccgtgctgcagagcccagcaatcctgtcttcattcaaaccacttcagcgtgggatcgccgcctgtatgacttgtggtaacacaaaagtgctgagagctgtacacagtctgttatcgcgattaatgtccatcttccctactgagccctctacttcctcagtggcttccaagtacgaggagctggaatgtctgtatgcagccgtcggaaaagtcatatatgaaggtcttacaaattacgagaaagcaaccaacgctaacccttcgcagctatttggaactcttatgatacttaaatcggcctgtagcaataacccgagctacattgatcggctgatctcagtctttatgcgctccttgcagaagatggtaagagagcacttgaaccctcaggctgccagcggatcaacagaagctacatcaggaacttctgagctggtcatgctcagcttggaacttgtgaaaacaaggctggctgtcatgtccatggagatgagaaagaattttatccaagcaatccttacatctctgatagagaaaagtcctgacgctaaaattctgagagcggtagtcaaaatcgtggaagagtgggttaagaacaattctccaatggccgccaatcagacgcctaccctgcgcgagaagagcatcctgctggtgaagatgatgacttacattgaaaaacggttcccggaggacctggagttaaatgcccagttccttgatctggtaaattatgtctacagggacgagaccctctctggaagcgaactgacggccaagctcgagccggcctttcttagcggtttgagatgtgcccagccactcattagggccaagttttttgaggtttttgataattcaatgaagaggagagtatacgaacgacttctatacgtaacttgcagccaaaattgggaggcgatgggcaaccatttctggattaaacagtgtattgaactcctacttgccgtatgcgagaagagtacccccattggtacctcatgtcagggcgctatgctgccctccattacaaacgttattaacttggcagactcccacgacagggctgcatttgccatggtgacccatgtgaaacaggagcctcgtgaacgagagaactccgaatccaaagaggaagatgtggaaatcgatattgagctcgcgccaggtgatcagacgtccacacctaaaacaaaagagctctcagagaaagacatcggcaatcagctccacatgctgactaataggcacgacaagttcttagacacattgcgagaggtgaaaaccggggcactgctcagcgccttcgtccagctgtgccacatttcaaccacactcgccgaaaagacttgggtccagttgtttccaagactttggaagatcctgtcagacaggcaacagcatgccctcgcgggtgagatcagcccgttcctgtgttccgggtcgcatcaagttcaaagagactgtcaaccaagtgcattaaattgtttcgttgaggcaatgagccaatgcgttccacccatcccaatacgcccttgcgtattgaaatatctgggaaaaacccacaatttgtggtttcgctctaccttaatgttggaacatcaggccttcgagaagggattgagcctgcaaataaagcccaaacagactactgaattctatgagcaggaatccatcaccccgccccagcaggagattctggacagcctggcagagctatacagtctgctgcaggaggaggatatgtgggccggactatggcagaagcgctgcaagtactctgaaactgccactgctattgcatacgagcagcatggcttcttcgagcaggcacaggagtcctacgagaaagcaatggacaaagccaaaaaggaacatgagcgctccaatgcctctcctgctatattccctgagtatcagctctgggaagatcactggatacggtgttcaaaagaactcaaccagtgggaagctctcaccgagtatggtcagagcaagggtcacatcaatccctacctggttctcgaatgcgcctggcgcgtgtcgaactggaccgcaatgaaagaggcactcgtgcaggtggaagtgagttgcccaaaggagatggcgtggaaagtcaatatgtaccgcggctacctggccatttgccatccagaagagcagcaattatcttttattgaaaggttggttgagatggcatcctctctcgccatccgagagtggagaaggctccctcatgtcgtgtcacacgtgcatacccctctgctgcaggccgctcaacaaataatagagctgcaggaagcggctcagattaacgcaggcctccagccaacgaatctggggagaaacaactctctacatgatatgaagacggtggtaaaaacgtggcggaataggctccctatcgtgagtgatgatttgtcgcattggagtagcatcttcatgtggcggcagcatcactaccaggcaatcgtgaccgcatacgaaaattccagccaacacgatccctccagcaataatgcgatgcttggcgtccatgctagtgcaagcgctattatccaatatggcaaaattgcgagaaagcaggggcttgtgaacgtggcccttgatatcctgtcgcgcatccatacaatccccactgtaccaatcgtggattgtttccagaagatcaggcagcaggtgaagtgttaccttcaactggctggcgttatgggcaagaacgaatgcatgcaagggctagaggtgattgagagcacgaaccttaaatactttaccaaagagatgactgccgaattttatgcgctgaaggggatgtttctggcccaaattaacaagtctgaggaggccaataaggctttttctgccgccgtgcagatgcatgatgtattggtgaaggcatgggccatgtggggtgactaccttgagaacattttcgttaaggagaggcaactgcatctgggagtcagtgctattacgtgctacttacacgcatgccgccatcagaatgaatccaaaagccgcaagtatctggccaaagtgctgtggctcttgtcatttgatgatgacaagaataccctcgccgatgcagttgataagtattgcattggagttcctccaattcaatggctggcgtggattcctcaactgctgacatgcctggtggggtcggagggaaaactattactgaatctgatatctcaggtaggcagagtctacccccaggctgtttatttcccaatacggaccctgtaccttaccttaaaaattgagcagcgcgagcgatataagagcgaccccggccccatccgcgccactgctcccatgtggcgctgcagccgaatcatgcacatgcaacgcgagctgcacccgactctcctgagtagccttgaaggaatagtggaccagatggtgtggttcagagaaaactggcacgaagaggtgttgcgccagctccagcagggcctagctaaatgctactccgtggcgttcgagaaatccggagccgtgtctgacgccaagatcactcctcatacgctaaactttgtcaagaaacttgtgtccacgttcggcgtgggcctcgagaatgtaagtaacgttagtactatgtttagtagcgctgctagcgagtctctggcacgtagggcccaggcgaccgcacaggatccagtgtttcagaagctgaaagggcaatttacgacggatttcgatttctctgtgccaggatcaatgaagctgcataacctgatcagtaagctgaagaagtggatcaagattttagaggccaaaaccaaacaactccctaagtttttcctcattgaagaaaaatgccgattcctatctaacttttcagctcaaaccgcagaggtcgaaattcctggggagtttctcatgccgaaacccactcactattatattaagatcgcacgattcatgccacgagtagaaatcgtgcagaagcataacaccgccgcccggagattatatattaggggacacaacggcaagatctatccttatttggtcatgaatgacgcgtgtttgaccgaaagtcgtcgagaggaacgcgtgctgcagctgttgcgcttactgaacccatgcctggagaaaagaaaagagacaaccaagagacacctgttctttaccgtgcccagagtagtcgcagtctcccctcagatgagactcgtcgaggataatccctcctccctctcacttgtcgaaatctataagcagagatgtgctaaaaaaggaatagaacacgacaatccaataagtaggtactacgacagactggcaacagttcaggcaaggggcacacaagcttctcaccaggtgctgagggatattctgaaagaagtgcagtcaaacatggtcccgcgaagtatgctcaaggagtgggctcttcatacatttcccaatgctacagattactggacgttccggaaaatgttcaccatccagctcgccctgattggctttgccgagtttgtcttgcatctgaatcggttgaaccccgagatgttgcaaatagcccaagacaccggcaagctcaatgttgcctattttcggttcgatatcaatgacgccaccggagatcttgacgcaaataggccagtcccgttccgacttacccccaacatttccgagttcctgacgacgattggggtgtccggcccactgacagctagtatgatcgctgtggcccggtgcttcgctcagccaaattttaaggtggatggtattctaaagactgtgttgagggatgagatcatcgcctggcacaagaagactcaggaggacacttcctcgccgctgagtgccgcgggccaacctgagaacatggacagccagcagctcgtgagccttgtccagaaggccgtcaccgccataatgacaaggctccacaatctcgcacagttcgaagggggcgagagcaaggtgaatactttagtcgccgcagctaacagtctggacaatttatgccgaatggaccccgcatggcacccctggctgtag

SEQ ID NO: 138295 - DNA, 11580 bp, Artificial Sequence
  Description of Artificial Sequence: Synthetic coding sequence
atggcattcgtggcaacccagggcgcaacagtagtcgaccaaacaacgctcatgaagaaatatttacagttcgtcgcagctctgactgatgtgaacacgcctgatgagacaaagcttaaaatgatgcaagaggtcagcgaaaattttgaaaatgtgacgagttctccacagtacagcacattcctggaacatatcattccacggttccttacctttctgcaggacggcgaagtgcagttcctgcaggaaaagcccgcccagcagctaagaaaactggtgctggagataatccataggatccccacaaacgaacacctgagaccccacaccaagaatgtgttaagtgtcatgtttcgtttcttggaaactgaaaatgaagaaaacgttttgatctgcctgcggattattatcgagctgcataagcagttccgacctcctataacccaggaaatccatcacttcttggatttcgtaaagcagatatacaaagagctgcccaaagtcgtgaaccggtactttgagaacccccaagtgatccccgagaatactgtccctccccctgagatggtgggcatgattactacaattgccgtaaaagtcaacccagagagagaggacagtgagacacgcacacactccattatacctaggggaagcctctccttgaaggtactagccgaactgcctattattgtggtactgatgtaccaactgtacaagttaaacatacataatgtggtagccgagttcgtcccactaatcatgaatactattgcaatacaggtctctgcacaggctcgacaacataagctgtataataaggagctgtatgcagatttcatcgctgcccagatcaagaccctctcgtttcttgcatatatcatccgcatctaccaggagttggtcacaaagtactctcaacagatggttaaaggaatgctacagctgctgagcaattgccccgcggaaaccgcccaccttagaaaagagctgttgatagccgctaagcatatattaaccactgagttgcgaaaccagttcattccctgtatggacaaattgttcgacgaaagcatcctgattggatctggatataccgccagggagacccttcgtccactcgcctacagtacactggctgatttggtgcaccacgtgcggcagcatttgcccttgtccgacctgagcctggctgtgcagctttttgctaagaatatcgatgacgagagtctcccatccagcattcagactatgtcttgtaagttacttctgaatctggtagactgtatccgaagcaaatcagagcaggagagcgggaatgggagggacgtactcatgaggatgctggaagttttcgtactgaagttccacactatagctcgctaccaactctcagctattttcaaaaagtgtaagccccaaagcgagttaggcgccgttgaggcagctctccccggagtgcccactgcacctgctgcacctgggccggcaccttcgcctgcgcctgtgcctgcacccccacctccccccccccctcctccacctgcaacccccgttactcctgcccctgttccgccattcgaaaaacagggcgaaaaagataaggaggataaacaaacttttcaggtcactgattgcagatcattggtgaagaccctcgtctgcggtgtgaaaacaattacctgggggatcacatcttgcaaagctcctggcgaggcccagttcattcctaataaacaacttcagcccaaagagactcagatctacatcaagttagtgaagtacgcaatgcaagccctggacatttaccaagtacagattgccggaaatggccagacctacatccgcgtggctaattgtcaaaccgtccgtatgaaggaggagaaggaggtcttggagcactttgccggcgtcttcacgatgatgaatccactcacttttaaggagatattccagacaacggtgccatatatggtcgagcggatctccaaaaattatgctttacagatcgtcgctaattcattcctcgcaaatcccaccactagcgctctttttgctacaatactagtcgaatatctgctcgaccgcttgcccgagatgggcagcaacgtggaactgtctaacctttatttgaaactcttcaaactagtgttcggatccgtcagcctttttgccgccgagaacgaacagatgttgaaaccgcacctgcacaagatagtcaactctagcatggaattggcgcagacagctaaggaaccatacaactattttctgctgctgagggccctgtttagaagcataggcggcggtagtcatgacctgctttaccaggagtttctgccactgctgccaaacctgttacagggtttgaacatgctacaaagcggcttacataaacaacacatgaaagatctctttgtggagctatgtctgaccgttcccgtccggctctcctccttgctgccctatctgcctatgcttatggaccccttggtgtcagccctcaacggctcacaaacacttgtgtcccagggtttacggactctggagctctgtgttgacaatttgcagcccgacttcttatatgaccacattcagcctgtccgagccgagctgatgcaggccctgtggcgcaccctaagaaacccagcagattccattagccacgttgcctacagagtgctggggaaatttggcgggagcaacaggaaaatgctaaaagagtcccagaagttgcattacgtagtgaccgaggttcaagggcccagtatcacagtggagttcagtgattgtaaagcgtccctccagctgcctatggagaaggccatcgagaccgctttagactgcctaaaaagcgcaaataccgaaccctattaccgccgccaagcctgggaagtgatcaaatgttttttagtcgctatgatgagcctggaggataacaagcacgctctataccagctgctcgctcaccctaatttcaccgagaagacaatccctaatgtgatcatctcacaccggtataaggcccaggatacacctgctcgtaaaacttttgagcaggcacttacaggagccttcatgagtgctgtaattaaggacctgaggcctagtgccctcccattcgtcgcgtctttgatccgacactacaccatggttgccgttgctcagcaatgtggccctttcctcctgccatgttaccaagtaggatctcagccatccactgccatgttccatagcgaggaaaatgggagtaaagggatggaccctctcgttctcatagatgccatcgcaatctgcatggcctatgaagagaaagaattgtgcaagataggtgaggtggccctggccgtgattttcgatgtggcaagcatcatcctcggctccaaagaacgagcatgccagcttcctttgttttcatatattgtcgaacgcttatgcgcatgctgctacgagcaggcctggtatgcaaagttgggcggagtggtttccattaagttcttgatggaaagattgcctcttacgtgggtcctacagaatcagcagactttcctgaaagccctgctgttcgtgatgatggatctgaccggggaagtgtcaaatggggccgtagcaatggcaaagaccacactggaacagctcctgatgaggtgtgctacgccgctaaaggatgaggaaagagcagaggagattgtcgctgctcaggagaaaagcttccatcatgtaacacacgacctggtgcgcgaagtgacaagcccgaacagcactgtccgaaagcaagccatgcactccctacaagtgctggcccaggtgacaggaaagtctgtaaccgtgatcatggaaccacataaggaagtactgcaggacatggttccccccaagaaacatctccttcgccaccaacccgccaacgcgcaaatcggtctgatggagggaaacactttttgcacaaccctgcaacccagactctttactatggacctcaatgttgtggagcacaaggtgttctatactgaactgctgaacctctgcgaagccgaggactcggcactgacaaaactgccgtgttataagtccctaccctcactagtgccactgcggatagccgccctaaatgcgctagcagcctgcaactatctgccccagagcagagaaaagatcatcgccgctctcttcaaagccctgaattccactaattccgaattgcaggaggcaggagaagcctgtatgagaaagttcctggagggcgccacaattgaagtggaccagatccatacgcatatgcggcccctgcttatgatgctgggcgattacaggtccctaacactgaacgtggtgaacaggctaacaagcgtgacacgcctcttccccaactcttttaatgataagttttgtgaccagatgatgcagcaccttcgtaagtggatggaagttgtggtcatcacacacaaaggcggtcagcggtcggacgggaacgagagtatcagcgaatgcggccggtgtccattgtcccccttctgccagttcgaggaaatgaagatctgctcagcaattattaatttatttcacctcatacccgctgcccctcaaactttggtaaaacctctgctggaggttgtgatgaagaccgagcgggctatgttgatcgaagccggctccccatttagagaacctcttatcaaattcctgactaggcatcccagccagacagtggaactgttcatgatggaggcaaccctaaacgatccgcagtggtctcggatgttcatgagctttctgaaacacaaggatgctagaccgctgcgggacgtattagctgcaaacccaaatcgattcatcacactgctgctgccaggaggagcacagaccgcagtccggcccggcagcccatcaactagcaccatgcgattagacttgcaattccaggccattaaaataatctccataatagttaaaaacgatgattcatggctcgcgagccaacattctcttgtatcccagctgcgccgagtgtgggtcagcgagaatttccaggagcgccatcggaaagaaaatatggccgctacaaactggaaagaaccaaagctgcttgcatactgcctcctgaattactgtaaaaggaattatggggacatcgagctactgtttcagctgttaagagcttttaccggccggttcctgtgtaatatgaccttcctcaaggaatacatggaagaagaaattcccaagaattacagtatcgctcagaaaagggccctgtttttcagatttgtggactttaacgatcccaactttggtgatgagctgaaggctaaagtacttcagcacatattgaaccctgcattcctctactcattcgaaaagggcgagggagaacagctcctgggaccacctaatcctgagggcgataacccagagtcaatcacaagcgtattcatcacaaaagtgttggatccggagaagcaggcagatatgctcgatagccttaggatttatctgttgcagtatgccaccctcttggtggagcacgccccccatcatatccatgataacaacaaaaacagaaactctaagcttcgccggctgatgacctttgcctggccatgtctgctgagtaaagcatgtgtcgatccggcttgtaagtacagtggccatctcctcttggcacacatcatcgccaagtttgctatccacaaaaagatcgtgctgcaggtattccacagcctccttaaggcccacgcaatggaggccagagctattgtcagacaagccatggcaattctgactcctgcagtgccagctagaatggaggacggccaccagatgctgacgcactggaccagaaaaataatcgtggaggaaggacacactgtgcctcagttggtccacattctgcatttgatagtacagcactttaaagtatattacccggtccgacaccatctcgttcagcacatggtttcagctatgcagagattgggcttcaccccctccgtgacgatcgagcagcggcgccttgctgtggatctgtccgaggttgtaattaaatgggaattgcagagaatcaaggatcaacaacctgactccgacatggacccaaattcttctggagagggcgttaattccgtatcctcgagcattaagaggggattgtcggtggactctgcccaggaggtgaagagatttagaactgccacgggtgccatctccgcagtatttggaaggtctcagtccctgcctggagctgatagtctgctggccaagccaatcgacaagcagcacaccgacactgttgtcaatttcttgattagagtcgcctgccaggtgaacgataacacaaacactgctgggtctccgggggaagtactgtcgagaaggtgcgttaacctacttaaaaccgcgctgagaccagacatgtggcctaagtccgaattgaagctccagtggtttgacaagctgctcatgacagtagaacagcccaatcaggtcaattatggaaacatctgcactggcctggaggtcctttccttcttgctgaccgttctgcagtcaccagctattttgtcctctttcaagccgctgcaaagggggatagccgcgtgtatgacatgtggaaatacgaaggttcttagggcagttcactcacttctgagcagactgatgagtattttccctacggaacccagcacttcctcagtggcgagtaagtacgaggaactggagtgtctgtatgcggctgtgggaaaagttatttacgagggcctcaccaactatgagaaggcaacaaatgccaacccgagccagctgttcggaaccctgatgatccttaagtccgcttgctcaaataacccctcttacattgatcgcctgattagcgtgtttatgcggtccctgcaaaaaatggtgcgggagcacctgaatcctcaggcagcctccgggagcaccgaggcaacctccggtacttccgagctcgtcatgttgtcgttagaactcgtcaagacgagattagctgtgatgagtatggaaatgcgcaagaatttcattcaggccattctgacttctctgatagagaagtcgccagacgctaagattctcagagcagtcgtgaaaatcgtagaggagtgggtaaagaacaacagcccaatggcagcaaaccagacccccacattacgcgagaaatccatcctattggtaaagatgatgacgtacatcgaaaagagattccctgaggatctggaattgaatgcacagtttctcgacctggtgaactacgtttaccgcgatgaaaccctgtccggtagtgagctgacagcaaagctcgagcccgcatttttgtccggtttaagatgtgcacaacctctgattcgcgccaagttcttcgaggtcttcgacaactcaatgaagcggagagtttacgagcgcctcctgtatgtgacgtgctctcagaactgggaagctatgggcaaccatttctggataaaacagtgtatagagctgctgctggctgtatgcgagaagtcgacaccaatcggcacatcatgccagggcgcaatgctacctagtatcactaacgtgataaacctagctgatagccacgatcgtgccgcatttgccatggttacgcacgtgaaacaggaaccacgcgaacgggaaaactccgagtccaaagaagaagacgtcgagatagacatcgaactcgcccctggggatcagacgtcaacaccaaagaccaaagaacttagcgagaaagatattggcaaccagctacacatgttgacaaataggcacgataagtttctcgacactctgagggaggtcaagacgggagctctcctgagcgcttttgtgcagctctgtcacatcagcaccacactcgctgaaaagacgtgggtgcaactgttcccaaggttatggaagatcctatccgataggcagcagcacgcactagcaggtgaaatcagccccttcctctgttcagggagccatcaagtgcaacgagactgccagccttccgcattgaattgtttcgtggaagctatgagtcagtgcgtgccgccgatcccaataaggccatgcgtgctcaagtacctcggaaaaactcacaatctgtggttccggagtacacttatgttagagcaccaagcttttgagaaaggcctgtccctccagattaaacccaagcagaccacagaattctacgagcaggagagcatcacccctcctcagcaagagattttggactccctcgccgaattgtactctcttttgcaggaggaggatatgtgggccgggctctggcagaaacgttgcaagtattcggaaactgcaaccgccatcgcatatgaacagcacggattttttgagcaagcccaagagtcatatgagaaagcgatggataaagctaagaaagaacacgagcggtcgaatgcctccccggccattttccccgaataccaattgtgggaggaccattggatccgctgttccaaggaactgaaccagtgggaggctttgaccgaatatggacaaagcaaagggcacataaacccctacctggtactggagtgcgcctggcgggtctctaactggacagcaatgaaggaggcactcgttcaggtcgaggtgtcctgcccaaaggagatggcatggaaagtaaacatgtaccgcggctacctcgctatttgtcaccctgaagagcagcaactttccttcatcgagaggctggtggagatggcctcgtctcttgctatacgtgaatggcgaaggcttccacacgtggtcagccatgtgcacacgcctctcctgcaggccgctcaacagatcatcgaactgcaagaggccgcccagataaatgctggcctccagcctactaatcttgggaggaacaacagtcttcacgatatgaagactgtggtcaagacctggcggaatcgtctgccaatagtgtctgacgacctgtcacactggtcttcgatctttatgtggaggcagcatcattatcagggcaagcccacatggtctgggatgcattcctctagtatagtgactgcctatgagaacagctcccagcatgatccttcttctaataatgcaatgctgggcgtccacgcctcggcttcggccatcattcagtacggaaaaatcgcccgcaagcagggcctggttaatgtggccttggacatattaagtcggattcatactatacccaccgtgccgattgtcgactgcttccagaagattaggcaacaggttaaatgctatctgcagttagcaggagttatgggcaaaaacgagtgcatgcaaggactcgaagtcatcgagagtaccaatctcaagtacttcaccaaggaaatgacagcagaattttatgctttgaagggaatgttcttggctcagatcaacaaaagcgaagaagcgaacaaggcattcagtgccgccgtgcaaatgcacgatgtgctcgtaaaggcgtgggcaatgtggggtgactatcttgaaaatattttcgttaaggaacgtcagctacacctcggcgtttccgcaataacgtgctaccttcatgcttgccggcatcagaacgagtcgaaatcccggaagtatctggccaaagtgctgtggctactctcctttgacgatgataagaatacactagctgacgctgtggataaatactgcatcggggtgcctcctattcaatggctcgcgtggataccgcaacttttaacatgtctcgtcggttcagaaggtaaactgctgctgaacctcatttctcaggtcggtagggtgtacccacaggccgtttatttccccataaggacgctatatcttaccctgaaaatcgagcagcgggagagatacaaatcagatcccggtcccattcgcgctactgcccctatgtggaggtgctcacgcatcatgcacatgcagagggaactgcaccccaccttgctctcgtctctcgagggtatcgttgaccagatggtgtggttccgcgaaaactggcacgaggaagtcctgaggcagctgcagcagggtctcgctaaatgctattctgtagcattcgagaagtcgggggccgtttctgatgcaaagatcacacctcacacattaaactttgtgaagaaattggtgtcaacattcggcgtgggactggagaatgtgagcaatgtgagtacgatgtttagtagtgcagcaagtgagtccctcgcacgtagggcccaggcaacagcccaagatcccgtgtttcaaaaactcaaaggacagttcacgacagatttcgacttcagcgttcctggtagtatgaagctacataacctgatcagtaaacttaagaagtggatcaagattctagaggccaagacaaagcagctgcccaagtttttcttgatagaggagaagtgtaggttcctgagtaatttctccgcacaaacggcggaggtggaaattcccggagagttcctaatgcccaagcccacacactactacataaaaattgccaggtttatgccccgcgtggaaattgtgcagaaacacaacactgcagcccgtaggctttatatccgagggcacaacggcaagatctacccatacctggtgatgaatgatgcttgtctaacagagtctcgacgtgaggagcgggtgctgcaattgcttagactcttaaatccctgcctcgagaagcgcaaagagaccacaaaacgccatctattttttaccgttccgagggtggtagctgtgtccccgcaaatgcggttggttgaggataatccctcctcattatctctggtcgaaatatacaagcagcgctgcgcaaaaaagggcattgagcatgataatcctatctcacgttactatgacaggctggctacagtacaggcccgtgggacccaggcttcacatcaggtactgcgagacatcctaaaggaggtacagtccaacatggttccacgttctatgctaaaggagtgggccctgcatacgttcccgaacgccactgactattggacttttcgcaagatgtttactatccaactggctttgattggcttcgcggagtttgtcctccatttgaaccgcttgaaccccgagatgctgcagattgcccaggatacaggcaagctaaacgtggcatacttcaggttcgatattaatgatgccacaggcgacctcgacgctaacagacccgttcctttccggcttactcctaatatcagcgagtttctgactacaattggtgtctccggccccctgacagcctcaatgatagccgtggcccgctgttttgcccagccaaattttaaggtagatggcatactcaagacagtgctccgggatgaaatcatcgcctggcataagaagacccaggaagacacctcctccccgctttctgccgctgggcagcctgaaaatatggactcccagcagctcgtctccctggtgcagaaagccgtgactgctattatgacccggctgcacaacctggcacagtttgaaggtggcgaatcgaaagtgaacactctggtcgccgcagcaaattccttagacaatctctgcaggatggatcctgcctggcatccctggttatag

SEQ ID NO: 138296 - DNA, 216 bp, Artificial Sequence
  Description of Artificial Sequence: Synthetic coding sequence
atggcattcgtcgctacccaaggtgcaaccgttgttgatcagaccacactgatgaagaaatacctccagttcgtcgccgcactgacagacgtgaataccccagatgaaacgaaacttaagatgatgcaggaagtctcggagaattttgagaacgtgacgtcgtctccacagtatagtaccttcctggagcatattatcccccgcttcctcacctag

SEQ ID NO: 138297 - DNA, 117 bp, Artificial Sequence
  Description of Artificial Sequence: Synthetic coding sequence
atgagcgatagtggcgagcagaattatggcgagagagttaatgtcgaggagggaaagtgcggctcccgccatctgacctccttcattaacgaatacctcaaacttaggaacaaatag

SEQ ID NO: 138298 - DNA, 567 bp, Artificial Sequence
  Description of Artificial Sequence: Synthetic coding sequence
atgtccacccgacggcgacacgtgggcaatcgagccaacccggatccaaactgctgcctgggggttttcgggctctccctgtataccaccgaaagagacctccgtgaggtgttttcaaaatacggacctatcgctgatgtcagtattgtgtatgaccagcagtcacgacgctctagaggtttcgccttcgtctactttgagaatgttgacgacgccaaagaagccaaggaaagggccaatgggatggagctcgacggcaggagaatcagggtggatttctcaatcaccaagcgtccgcacacaccaacgcccggaatttacatgggaagacccacttacggctcttctagaagaagagattactacgatcgaggttacgatcggggatacgatgatcgagattattactctcggtcctaccgggggggagggggaggaggaggaggctggagagcggcccaagatagggaccagatttacagacgaagaagcccaagcccttattactctcggggggggtaccgttccagaagccggtcaagaagttactcaccccgcaggtattag

SEQ ID NO: 138299 - DNA, 867 bp, Artificial Sequence
  Description of Artificial Sequence: Synthetic coding sequence
atgtcggactctggagagcagaattacggggaacgggaaagtaggtccgctagccgcagtgggtctgcccacggttccgggaagtccgccaggcacacccctgcgagaagtaggtcgaaggaagattcccgccggagcagatcaaagagtcggagtcgcagcgagtcccggtcaaggagccgcagatcttctcgacgacattatactcgatcaaggagccggtcaagaagccacaggaggtcccgctcacggtcttactcacgtgattaccgaagacgccacagccattcccactctccgatgtcaacaaggcgccgccatgtggggaatagggcgaaccccgacccaaattgctgccttggagtctttggcctgagcctgtacactactgagcgcgatctgagagaggtttttagcaaatacgggcccatcgctgatgtgtcaatagtgtacgaccagcaatcacgaaggagccggggttttgctttcgtttacttcgagaacgtggacgatgctaaggaggccaaagaaagagctaacggcatggaactggacggacgccgtataagagttgacttcagcatcactaaaaggccccatactcctactccagggatatacatggggcggccgacatacgggagttcaaggagacgcgattattacgaccgcggctacgatcggggctatgacgatcgtgattactattcacggtcgtataggggaggcggaggagggggcggcggttggcgtgcagctcaggaccgagatcaaatctatcggcggcgctccccaagcccttactacagtaggggtggctataggtctagaagcaggtcaagatcatatagtcctaggaggtactag

SEQ ID NO: 138300 - DNA, 483 bp, Artificial Sequence
  Description of Artificial Sequence: Synthetic coding sequence
atggttccatctgccggacagttagccctctttgctttagggatcgtcttggccgcatgtcaagccctcgaaaactccacatccccgctgagcgccgatcctccggtagctgcagcagtggtctcgcacttcaacgattgtcccgactcacatactcagttttgcttccacggcacttgtagatttcttgtccaggaggacaaaccggcttgtgtatgccacagcgggtatgtgggtgccagatgtgagcatgcagatttgctagccgtagttgctgcgtctcaaaagaaacaggctataacagccctggtcgttgtgtcaatcgtggccctcgcggtcctaattataacttgcgttctgatacactgctgccaagtgcggaaacactgcgaatggtgcagggctctgatctgcaggcacgaaaaaccttcagccctgttaaaggggcgtacagcttgctgtcattccgaaactgttgtttag

SEQ ID NO: 138301 - DNA, 480 bp, Artificial Sequence
  Description of Artificial Sequence: Synthetic coding sequence
atggtgccctccgccggacaactggcattgtttgccttgggaattgtgctggccgcatgccaggctctcgaaaacagcaccagccccctctcggacccccctgttgccgccgccgtcgtctcccatttcaacgactgccctgacagtcatacccagttctgtttccacgggacttgcaggtttctggtgcaggaggacaagcctgcatgtgtctgccatagcggctatgtgggagcacgctgcgaacacgccgacttactagcagtggttgccgcttcccagaagaagcaggccatcactgcactcgtggttgtgagcatcgtggctcttgccgtgctgatcattacttgcgtcctcatccactgctgccaagtaagaaagcactgcgaatggtgccgggctctaatctgcaggcatgagaaaccttcagcactgcttaagggacggacagcttgttgtcacagtgagactgttgtgtag

SEQ ID NO: 138302 - DNA, 2583 bp, Artificial Sequence
  Description of Artificial Sequence: Synthetic coding sequence
atgatgtcaattaaagcctttacactggtcagcgcagtggagagggaactgcttatgggggataaagaacgcgtcaatatcgaatgcgtagagtgctgcggacgcgacctctatgtggggaccaacgattgtttcgtctaccactttctgttggaagagcggccagtgcccgccggacctgctacctttactgcgacaaagcagttgcaacggcacctgggatttaagaagccagttaacgaactccgggcagcctcagctctgaacaggctactggtactgtgtgacaactccattagccttgtcaatatgctgaatctggagcccgttccatccggcgctagaatcaaaggcgcagccacgttcgctctcaacgaaaatccagtttccggcgaccctttctgcgtcgaagtttgcatcattagcgtgaaacgcagaactatacagatgttcctggtgtacgaggaccgggtgcaaatcgtaaaggaagtgagtactgccgagcagcctctggctgtagccgtagacggccactttctctgtctggcactaacaacacagtatattatacacaactacagtaccggcgtctcccaggacctgtttccatattgtagtgaggagagaccccctattgtgaaacgtatcggacggcaggaattcctgctggcggggcccggaggcttagggatgttcgctactgtcgctgggatttctcaaagagccccagtgcactggagcgagaacgtaatcggtgctgctgtttctttcccctacgtgatcgccctggatgatgaatttattacagttcactccatgttggatcaacagcagaagcagaccctgccttttaaggaggggcatattctgcaggatttcgagggccgtgtaattgtcgccacctctaaaggcgtgtatatactggtgcccttgccactggagaaacagatccaggaccttctcgccagccgcagggtggaggaggcactggtgttggccaagggggcccgaagaaacatcccaaaggagaagttccaagtcatgtatcgtagaatcctccagcaggcaggcttcatccagtttgcccagctgcagttcttggaggccaaggaactgtttcggagcggccagctagacgtcagagaactcatatctctctacccatttctgctgcctacttccagctccttcaccaggtcgcacccccccctgcatgagtacgccgaccttaatcagctgacacagggggatcaggaaaagatggccaagtgcaagcgctttttaatgtcatatctgaacgaagtccggtcaacggaggtcgccaacggctataaggaggacattgatacagccctccttaagttatatgcggaggctgatcacgacagcttattggacctcctggtgacggaaaatttttgtctcctaaccgattccgcagcatggctggaaaaacataagaaatacttcgcattgggtctactttaccattataataaccaggatgccgcagcagtgcagctctgggtgaatatcgttaacggggacgtgcaggacagtacaaggtccgatctttacgagtatatcgttgactttctgacgtattgtcttgacgaggagcttgtctgggcctacgcagactgggtcttacagaagtccgaggaggtgggcgtccaggtgttcactaagcgaccgcttgacgagcagcaaaagaactctttcaatccagatgacatcatcaactgcctgaaaaagtaccctaaagctctcgtaaagtaccttgaacacctggtgattgataaacgacttcagaaggaagaatatcacactcatctggctgtgctatatctggaggaggtcctgttgcagcgagccagcgccagtggcaaaggcgcggaggccactgagactcaggccaagctcagacggcttcttcaaaaaagcgacttgtatcgtgtgcattttctcctggagaggctacagggtgcaggtctccccatggaatctgctatattgcatgggaagttgggcgagcatgagaaggccctgcatatactggtccatgagctgcaggattttgcggccgccgaagactactgcctttggtgcagtgaaggtcgggacccccctcatcgccagcagcttttccacacgctcctcgctatttacctgcacgccggacctactgctcacgagctcgctgttgccgccgtggacttgctgaacagacacgctactgagttcgacgccgcacaggtcctgcagatgctccctgacacatggagtgttcaactgctctgcccctttctcatgggggcaatgcgtgactccatccacgccaggcgcacaatgcaagtggcattgggactggccaggtctgagaacctcatttatacctatgataaaatgaagctcaaggggagctccattcagctgtcggataagaagctgtgccaaatctgccagaaccccttctgtgagccagtgttcgtgcgatatcctaacggaggtttagtgcacacccactgtgctgcctctagacacacaaatcccagttcatcctcccctggtacccgaacatag

SEQ ID NO: 138303 - DNA, 2583 bp, Artificial Sequence
  Description of Artificial Sequence: Synthetic coding sequence
atgatgtctattaaggccttcactttagtgtccgccgtagaacgagaactgctaatgggcgataaggagcgggtgaacattgagtgtgttgagtgttgtgggcgagacctgtacgtaggcactaacgactgctttgtgtatcactttctgctcgaggagcgaccagtccccgctggtcctgccaccttcaccgcgactaagcagctgcagagacacctgggattcaaaaaacctgtgaacgagctgagagccgcaagcgcattgaacagactgctggtgttgtgcgataatagtatttccctagttaatatgctgaatctggagcctgtacccagtggagcacgcatcaaaggggctgcaacttttgctttaaacgaaaatccagtaagcggagatcccttctgtgttgaagtgtgcatcatcagtgtcaaaagaaggactatccagatgtttctcgtgtacgaggaccgggtacagatagtgaaagaagtcagcaccgccgaacagcctctggcagttgcggtcgatgggcacttcctttgtctggctttgaccacccagtacatcatccacaactactccaccggtgtatctcaagatctgttcccttactgctccgaggagcgccctcccatcgtgaagaggatcggtagacaggaattcctcctggccggcccaggaggactggggatgttcgccaccgttgccggcatcagccagcgtgcccctgtacattggagcgagaacgtgattggggctgccgttagttttccatacgtgatagcactggacgatgagttcatcacagtccactcaatgctggaccaacaacaaaaacagactcttccttttaaggaggggcatattctacaagacttcgaggggagagtaatagtggctacctcaaagggggtctatatcctcgtaccgttgcccttggagaagcaaattcaggatcttttggcaagtagaagagtggaagaggcactggtcctggctaagggcgcccgtaggaatattcccaaggaaaaatttcaagtgatgtatcgaagaatcttgcaacaggcaggcttcatacagttcgctcagcttcagttcctcgaggctaaagaactgtttcgaagcggacagttggatgtgagagaactcatttcgctgtatccatttctattaccaacatccagttctttcactcggagccatccccccctgcatgagtacgctgatttgaaccagcttacacagggcgaccaggaaaagatggcgaagtgcaagcgatttcttatgtcttacctaaacgaagtgcgtagcacggaagtcgctaatggttacaaagaagacatcgacactgccctgctaaaactctacgcggaggcagaccatgactccctcctggacctcttagtgaccgaaaatttctgtttgctaacggactctgccgcatggctcgagaaacataagaagtatttcgcactcggactgctctatcattataacaaccaagatgctgctgctgtccaattgtgggtgaatatcgtgaacggagacgtgcaagattctacacgctccgacctgtatgagtacatcgtcgattttctcacttattgtttagatgaggaactcgtctgggcctatgctgactgggtgttacaaaaaagcgaagaggtgggggtgcaggtctttaccaagcgcccgttagatgaacagcagaagaactcctttaacccagacgatatcattaattgcttaaaaaaatatcccaaagctctggtcaagtatctcgaacacttagttatcgataagcggttgcagaaggaggaataccacacacatctcgccgtgctttaccttgaggaggtacttctacagagggccagcgccagcggcaaaggtgctgaggctaccgaaactcaagccaagctgaggcgcctcttacaaaagagcgacctttacagggtgcactttctgctcgagcggctgcagggcgccggacttcccatggagagtgcaatcctacacggcaagctgggagaacacgagaaggccctacacatcctggtccacgagcttcaggactttgccgcagcagaggactattgcctgtggtgctctgaaggtcgggacccaccccatcgccaacagttgtttcacactctgctggctatttacctgcacgcaggacctacagcccatgagctggccgtggcagcggtcgaccttttgaacaggcatgctactgagtttgacgctgctcaggtgcttcaaatgttgcctgacacttggagcgtgcagctgctgtgcccattccttatgggtgccatgagagatagcattcacgcacgtcgcaccatgcaggttgctctcggtttggcccgttccgaaaatctgatttacacatatgataaaatgaaactgaagggcagttcaatacagctctcagataaaaagctgtgtcagatttgtcagaatcctttttgtgagcccgtctttgtcagataccctaacggcggcttggtgcatacgcattgcgccgcttcccgacatacaaatccgagtagctccagcccagggacaagaacatag

SEQ ID NO: 138304 - DNA, 948 bp, Artificial Sequence
  Description of Artificial Sequence: Synthetic coding sequence
atgttgattggctcctgcaggaaggtaaaaagaagcgtgcaagtgtttaccaagaggcccctcgacgaacagcagaaaaatagttttaacccagatgacatcatcaactgcctgaaaaaatatcctaaggccctggtgaagtacttagagcacctagtgatcgacaaacggttacagaaagaggagtaccatactcacctggccgtgctgtacctcgaggaggttctcctccagagagctagcgcttccgggaagggcgccgaggcaacggagactcaggccaaactgcggagacttctgcaaaagagcgatctgtacagagtgcacttcctcttggagcgcttacagggagcgggattaccgatggaatccgccattctgcacgggaagttaggcgaacacgagaaggccctgcacattttggtgcacgagctgcaagatttcgccgctgcagaagattactgcctgtggtgtagcgaggggcgggatccgcctcaccgacaacagctcttccacacgctgctcgctatttacctacatgccgggccaactgcccacgagctagctgttgcagcagtggatctgttgaatagacacgctactgaattcgacgcggcccaagttctgcagatgttaccggatacttggagtgtacaattattatgcccctttctgatgggggccatgcgcgacagtatccacgcccgtagaacgatgcaggtcgctctgggtctggccaggtctgagaatcttatctacacatatgataaaatgaaattaaaagggtcatcaatccagctaagcgacaaaaaactgtgccagatatgccagaatcccttttgtgaacccgtattcgtgaggtaccctaatggcggtctggttcacacacactgtgcagcctcaagacatacaaacccaagcagtagttcccccggtacgagaacctag

SEQ ID NO: 138305 - DNA, 1704 bp, Artificial Sequence
  Description of Artificial Sequence: Synthetic coding sequence
atgggcagaggactcctccgagggctctggcccctgcatattgtgctctggacacgtatagctagcaccatcccgcctcacgtacagaaatctgttaataatgatatgattgtcactgataataatggcgcggtaaaattcccgcagctttgtaaattctgcgatgtcaggttctcaacttgtgataaccagaaaagctgtatgtctaattgtagcataacttctatctgcgaaaaaccacaggaggtgtgtgtggccgtgtggcgaaaaaatgatgagaacattactctcgagacggtctgtcacgatccaaagctgccataccacgattttatcttggaagatgctgccagtccgaagtgcattatgaaggagaagaagaaacctggggaaacatttttcatgtgctcctgcagctcagatgagtgtaacgataatatcatcttcagtgaagaatacaatacctccaatcccgacctgctgctcgtgatctttcaggttactggcatatctctactgcctccactaggcgtagccattagcgtaatcatcatcttttactgctatagagttaaccgtcaacaaaagctgagctctacttgggagaccggcaaaacgcgcaagcttatggaattttcagagcattgtgctataattcttgaggatgacagaagtgatatctcatccacgtgtgccaacaatatcaaccacaatacagagttgcttcccattgagcttgacacattggtaggcaaggggcggttcgcggaggtctacaaggccaaactgaagcagaatacctcagagcagtttgagaccgtggccgtcaaaatcttcccctacgaagagtacgcatcttggaaaacagaaaaggacattttctctgacatcaaccttaagcacgaaaatatactgcaattcctgacagctgaggagagaaagacagagttgggtaagcagtactggctgatcacagccttccatgccaaaggcaacctgcaggaatacctgacccgacatgtgatttcatgggaggacctcaggaaactgggcagctccctcgcaagaggcatagcccatttgcacagtgaccatactccttgtggcaggccaaagatgcctatcgtccaccgcgatctgaagtcctccaacatcttggtcaaaaatgacctgacatgctgtctgtgtgacttcggcctctccctgcgcctggacccaactctcagcgtggacgacctggcaaattccggccaagtcgggacagcacgctacatggcaccggaagtgttggaatctaggatgaacctcgagaacgtcgaaagctttaagcaaaccgatgtgtattccatggcactggtgctctgggagatgacaagccgatgcaatgccgtcggggaggttaaagactatgaacctccgtttggtagtaaggtgcgtgagcacccctgtgtcgagagtatgaaggataacgtcttacgagatagaggtagacctgagatccccagcttctggttaaatcatcaaggtattcagatggtgtgcgagaccctgactgaatgctgggatcatgatcccgaagccagattgacagcgcaatgcgtcgcagagcgattctccgaattggagcacctggatcgcctgagcggacgaagctgttctgaagagaagattccagaagacgggagccttaatactaccaagtag

SEQ ID NO: 138306 - DNA, 1779 bp, Artificial Sequence
  Description of Artificial Sequence: Synthetic coding sequence
atgggtcgaggattgttgaggggactgtggccactccacattgtgctgtggacacgcattgcttccacaattccaccacacgttcagaagtccgacgtggaaatggaagctcagaaggatgagataatctgtccttcctgtaaccgaactgctcatcccctccgtcacatcaataacgacatgatcgttaccgacaacaatggtgcagtcaaattcccacagctatgcaagttctgtgacgtgcgtttctccacatgtgacaatcagaagtcctgcatgtccaactgttccatcactagcatctgtgagaaaccccaagaggtgtgcgtggccgtgtggcggaagaatgatgagaatatcaccctggagaccgtatgtcatgaccccaaactgccataccacgacttcatcttggaagatgctgcttctccaaaatgtattatgaaggagaagaaaaagcctggagagacctttttcatgtgctcttgtagctccgatgaatgcaatgacaacattatcttctctgaggagtataacaccagcaatccagacctattgctcgtaatattccaggttactggtatcagtctgctgcctcctctaggagtggctatctcagtcattataattttttactgctacagagttaatcgccagcagaaactttccagcacctgggaaaccgggaaaactagaaagctaatggagttttctgagcactgcgcgatcatcctcgaggacgaccggagcgatatctcttcaacctgtgctaacaatattaaccataatactgaactgctacccatcgagctcgacacattggtgggcaaaggcaggttcgctgaggtgtacaaagccaagctaaagcagaacacttcagaacagttcgagactgtcgccgtcaagattttcccatacgaggagtacgcttcctggaagactgagaaagacatattttcagacattaacctgaaacacgaaaatatcttacagttcttgacggctgaggagagaaagaccgagctgggcaaacaatactggttgattaccgcatttcacgccaagggtaatctccaagaatatctaactagacacgttatcagctgggaagatctgcggaagctgggatcgtcgttagcccgcggcatagcacacctccattccgatcacacaccctgcggccggcctaaaatgcctatcgtgcatagggatcttaagtcatccaatattctcgtgaagaacgatctgacctgttgcctatgtgattttggactcagtctgcgccttgacccaacactgtccgtggacgacttagccaactccggtcaggtcggcacagccaggtacatggctcccgaagtactcgagagtagaatgaatctggaaaatgtggaatctttcaaacagaccgacgtgtattctatggcactggtgttatgggagatgacctcccggtgtaacgctgtgggggaagttaaggattacgaaccaccattcggatctaaagtgcgggagcatccttgcgttgagtcaatgaaggacaacgtactgcgggaccgtgggagaccagaaataccttctttctggctaaaccaccagggcatccagatggtgtgcgagacactcaccgaatgttgggaccacgatccagaagcccggctgacggcccagtgcgtggcagaacgattctctgaactggagcacttagaccggctcagtgggagaagctgttccgaggaaaagatccctgaagatggttccctgaacacaacaaaatag

SEQ ID NO: 138307 - DNA, 339 bp, Artificial Sequence
  Description of Artificial Sequence: Synthetic coding sequence
atgtgctcatgctctagtgacgaatgcaacgataatatcattttcagtgagggacgatgtaaaattcgacacattggaagtaataatcgattgcagcggtccacatgtcagaataccggttgggaaagcgctcacgttatgaagacccctggctttagagaatacaatacaagcaatcccgacctgctactagtcatattccaagtcaccggaataagtctcctgcctcctcttggcgtggctatttcagtcataatcatcttctactgttacagagtcaatagacagcagaaattatcatcgacatgggagacaggcaagacgagaaaattaatgtag

SEQ ID NO: 138308 - DNA, 1194 bp, Artificial Sequence
  Description of Artificial Sequence: Synthetic coding sequence
atgtgcagctgttcctctgacgagtgtaatgataacatcattttttctgaagagtataacacatccaacccggacctgctgcttgtcatctttcaggttacgggcatcagcttgctgcctcccctgggagttgctataagtgtgatcattatattttactgctatcgggtgaatagacaacagaaactatcttctacgtgggagaccggcaagacgagaaagctgatggaattctccgagcactgtgctatcatactcgaggatgaccgatccgatattagttcaacatgtgcaaataatattaatcataatacagaattactgcctatcgagttggatacactagtgggcaaaggaagattcgcagaggtgtacaaagctaagttgaagcatgaaaatatcctgcagttcctcacagctgaggagaggaagaccgaactcggaaaacagtattggcttattaccgccttccacgctaaaggtaacctgcaagagtacttgactcggcatgttatctcgtgggaggatctccgcaaactgggctcttctctggcacgcggcatagcccatctgcacagcgatcataccccgtgcggtcgccctaagatgccgattgttcaccgggacttaaagagctccaacatcctggtgaagaatgacttaacctgttgcttatgcgacttcggcctctcactgaggctggaccccacgttgagcgtggatgacctcgccaacagtggacaggtggggactgcgagatatatggctcccgaagttttggaatcgaggatgaatctggaaaatgtagagtctttcaaacagacagatgtgtattcaatggccctggtactgtgggagatgacctcacggtgtaatgccgtgggggaggtgaaggattatgaaccaccctttggctccaaggttcgggagcacccatgcgtggaatcaatgaaggataatgtattaagggatagaggtcgtccagagatcccgtcattctggttaaatcatcaggggatccagatggtgtgtgagacactgacggagtgctgggaccatgatccggaagctagactcacggcccaatgcgtggctgagagattctctgaattagagcacctagaccgcctatccggccgctcttgctccgaggagaagatccccgaggatgggtcactgaacacaaccaaatag

SEQ ID NO: 138309 - DNA, 2244 bp, Artificial Sequence
  Description of Artificial Sequence: Synthetic coding sequence
atggcagatgaagcagctcttgccctgcagccgggcggttctccgtctgcggctggagctgacagggaggctgcttccagtccagccggagaacctctacgaaaacggccgagacgagatggacccggtcttgagcggtcaccgggcgagccaggtggcgctgccccggaacgcgaagtccctgcagccgcccgtgggtgtcctggagcagccgcagccgctctctggagagaagcagaggcagaagccgccgcggcaggcggtgagcaggaggcgcaggcaaccgcggcagcgggcgaaggggacaacggcccaggacttcaggggccttcccgagagccacctctagccgacaacttgtatgacgaggatgatgacgacgaaggagaagaggaagaggaggccgctgcagccgccattggttatagggataatctcctcttcggcgacgaaattataacaaatggattccactcctgtgaaagcgacgaggaagatcgagccagtcacgcatcatcctcagactggacaccccgaccccgtatcggaccttatactttcgtgcaacaacacctcatgataggaaccgatcctcgaacaattctgaaagatctgctgccagagactatcccccctcccgaactcgatgatatgaccctttggcagattgtgattaacattctttccgagccaccaaaacgaaaaaaacgcaaagacatcaacacaatcgaggacgctgttaagctgctgcaggagtgcaagaagatcatcgtgctcacaggcgcaggggtctccgtgtcatgtgggatacccgactttaggagccgcgacggaatctacgctagactggccgtcgactttcctgatctccctgaccctcaggccatgtttgatattgagtactttagaaaggatcccaggccattctttaagttcgcaaaagaaatttatcctggacagttccagcctagcctgtgccacaaattcattgccctgtcagataaggagggcaagttgctgaggaattatacccagaatatcgataccctggaacaggtggcaggcatccagcgaatcatccagtgtcacggcagtttcgccacagcaagttgtctaatttgcaaatataaggtcgactgtgaggctgtgagaggggacattttcaaccaggttgttcccaggtgccccagatgccccgccgatgagccactagcaatcatgaagccagaaatagttttcttcggcgaaaaccttcccgagcagtttcatagagccatgaaatatgataaggatgaggtagaccttcttattgtcatcggcagttctttgaaagtgaggcccgttgccctgattccctcatccatcccacacgaagtgccccagattctaattaatcgggaaccattaccccatctgcacttcgatgtggaattattgggggattgtgacgttattatcaatgagttgtgccatcgactgggaggagagtacgctaaactgtgttgcaatccggtcaagctttccgagataacagagaagcctcctaggactcagaaagagcttgcctatctcagcgagctgccaccgactcctctgcacgtctcagaagattcaagctctcctgaacgcactagcccacctgattcctccgtgatcgtgacgttactggaccaggctgcaaaaagcaatgatgatcttgacgtgagtgagagcaaagggtgtatggaagagaagcctcaggaggtgcagaccagccgcaatgtcgagagcattgcagaacagatggaaaatcccgatttgaagaacgtggggtcatctacgggggagaaaaacgaacgcacttcagtcgctggcacagtgcggaaatgctggcctaatagagtggcaaaagagcagatcagccgcaggcttgacggcaatcagtatctgtttctgcctcccaacaggtatatcttccacggggccgaggtgtacagtgatagcgaagatgacgttctgtcgtccagttcctgtggctcaaacagtgactccggaacttgccaatcgccatctttggaagagccaatggaggatgagtctgagattgaggaattttataatggtcttgaggacgagccagacgtgcccgagcgggctggcggcgccggatttggaacagatggtgatgatcaggaggctatcaacgaggctatctcagtgaaacaagaagtgaccgacatgaactacccaagcaacaagagctag

SEQ ID NO: 138310 - DNA, 2553 bp, Artificial Sequence
  Description of Artificial Sequence: Synthetic coding sequence
atgacgtcccattacgtgatagccatattcgccctgatgtcgtcctgtctcgcaactgcaggtcctgaacccggggctttgtgcgaactgagccctgtttccgcctcccatcccgtgcaagcacttatggaaagcttcactgttctctccggctgcgccagtcgtggaaccacaggcctcccacaggaggttcacgtgctgaatttacgcacagctggacagggtccaggtcaactgcaacgtgaggtgaccctgcacctgaaccctatctctagtgtacacatccaccacaaatcagtggtgttcctgcttaactcaccccatccactcgtgtggcatctcaaaaccgagcgcttagctacaggagtgagtcggctcttcttagtcagcgagggctctgttgtgcagttttcctccgcgaattttagcctcacagccgagaccgaggagcgtaactttccacatggcaacgaacacttgctgaactgggccagaaaagagtacggggctgtgacttcattcactgaattgaaaattgccaggaacatttatattaaagttggggaggatcaggtcttcccacctaagtgtaacatcggtaagaatttccttagcctgaattacttggctgagtatctccagcctaaggcagccgaaggctgtgtaatgtcctcccagccacagaacgaggaagtccatattatcgagttgattacccccaattccaatccctatagtgcttttcaggtggacatcaccattgacataagaccaagccaagaggatctggaggtggtaaaaaacctgattttgatcctgaaatgcaagaaatctgttaattgggttattaagtctttcgatgtgaaaggcagtttgaaaatcatcgcacctaacagtattgggttcggtaaggagtctgaacgcagtatgaccatgaccaaaagcatcagagatgacatccccagcacacagggaaacctggtgaaatgggccctagataacgggtactcaccgatcactagctatactatggcacccgtcgctaacagatttcatctgcgattggagaacaacgaagagatgggggatgaggaggtacacaccattccgcccgagctcagaattctgcttgatcctggggcccttccagcacttcaaaatccacccattaggggcggtgagggacagaatggaggcctgcccttcccctttcccgatatttcgcgacgagtgtggaatgaggaaggggaagacggactgccaaggccgaaagatcctgtcattcctagcatacagctgtttcccgggctccgagaaccggaagaagtgcaagggagtgtggatatagccctctccgtaaagtgcgacaacgaaaaaatgatcgtagctgtggagaaggactcttttcaggcctcaggatacagtggcatggatgtgactctgctggaccccacgtgcaaagcaaagatgaacgggacccatttcgtgttggagtctccactgaacggatgcgggacgagaccccgctggagcgccctagacggggtcgtctactacaatagcatcgtgatacaggtgccggccctcggtgattcaagtggttggccagacggctatgaagaccttgaaagcggcgacaatggattccccggagatatggatgaaggtgacgcctccctctttaccagacccgaaatcgtcgtgttcaattgctccctccaacaggtgagaaatccatctagcttccaggaacaaccacatggtaatatcacatttaacatggagctctacaacacagacctgtttctcgtgcccagccagggtgtgttcagtgtgcctgaaaacgggcacgtttatgtggaggtgagtgtaacaaaggccgagcaggagctgggcttcgccatacagacttgctttatctctccatactcaaatccagatcggatgtctcactataccatcattgaaaatatttgtccaaaagacgaatctgtcaagttttatagccctaagagagtccatttccccatacctcaagctgacatggacaaaaagagattttcgttcgtatttaagcccgtcttcaatacttccctgctgttcctgcagtgcgagctgactctgtgcacaaaaatggaaaagcacccgcagaaactgccaaaatgcgtgcctcccgacgaagcatgcacatcactcgatgccagcattatctgggctatgatgcagaacaaaaagacatttacaaaacctctggcagtgattcatcacgaggccgagtccaaagagaaaggcccatcaatgaaagaaccgaaccccatcagcccgccaatcttccacgggctggacaccttgacggtaatgggaattgcatttgccgcgttcgttatcggagcgttgctaacaggcgccttgtggtatatttactctcacaccggcgagactgccggaagacagcaggtgcctacttcgcctcccgcctctgaaaactcctccgcagctcattccattgggtcaacccagtccactccttgttcaagcagttctacagcctag

SEQ ID NO: 138311 - DNA, 108 bp, Artificial Sequence
  Description of Artificial Sequence: Synthetic coding sequence
atgacttcacactacgtcattgcaatctttgccttgatgagtagctgcctggctactgctggaccagaacctggggccctttgcgaactgagcccagttagtgcttag

SEQ ID NO: 138312 - DNA, 2553 bp, Artificial Sequence
  Description of Artificial Sequence: Synthetic coding sequence
atgactagtcactacgtgatcgccatcttcgcacttatgagttcttgcttagcaacagctggacctgagcccggagctctttgcgaactcagccctgtgtccgcgtcacatcctgtacaggctctcatggaatcatttacagtgctgagtggatgtgcttctcggggaaccaccggcctgcctcaggaagtacacgttctgaatctgcgcactgcaggccagggccctggacagctgcagcgggaggtaacactgcaccttaaccccataagctccgtgcatatacaccataaatccgtcgtgttcctactgaattccccccacccactcgtttggcacctcaaaactgaaaggttggcaacgggagtgtcacgcctctttttagtctccgaggggtccgtcgtacaatttagcagtgccaatttttccctgacggccgaaaccgaggaaagaaatttcccccacggcaacgaacatttactgaactgggcgcgaaaagaatacggtgccgttacatcttttacagaactgaagatcgcacggaatatctacataaaggttggagaggaccaggtcttcccgcctaaatgcaacattggaaagaatttcctttctctcaactatttggctgagtacctgcagccgaaggccgcggaagggtgcgtgatgagctctcagccacagaatgaggaggtccacattattgaactgattacccctaacagtaatccatactccgcattccaagtcgatatcactattgacattcgcccgtctcaagaagatctggaggttgtcaagaatctaattcttattttgaagtgtaaaaagagcgtgaattgggtaataaagtccttcgacgtaaaaggtagtctgaaaatcattgcccccaatagtattggattcgggaaagagtcagagcggtctatgaccatgaccaagagcatccgggatgacatccctagtacacaggggaacctggttaagtgggccttagacaacggatattcgccgattactagctacactatggcaccagtggccaatcgatttcaccttcggttggaaaataacgaggagatgggagatgaggaagtgcacacaatcccccccgagctgagaatcctgctagaccctggcgctctccccgcacttcagaacccccccatcagggggggggagggccagaatggaggcctccccttccctttcccagatattagcagaagggtctggaacgaagagggcgaggatggcctgcctcgaccaaaagatcctgtgataccatccatacagctatttcccgggctaagagagcccgaggaagtgcagggctccgtggatatcgccctgagcgtaaaatgtgacaacgaaaaaatgatcgtggctgtggagaaagattctttccaggcatccgggtattctggtatggatgttactctcctcgaccctacgtgcaaagccaagatgaatggcacacacttcgtgttggagtctccactcaacggctgtggcacccggccccggtggtctgccctcgatggagtagtgtattacaactctattgtgattcaggtccctgccctgggcgacagcagcggatggcccgatgggtacgaagatctggagtcaggggacaacggctttcctggagatatggacgagggggatgcctctctgttcactcgccccgaaatcgtcgtctttaattgctctctccagcaagtcagaaaccccagctctttccaggaacagcctcacggtaatatcacgttcaatatggaactgtataacacggatctctttctggtgccctcgcaaggtgttttttcagtgccagagaacgggcacgtctatgtcgaggtgagcgtgaccaaggcagaacaggagctggggtttgccatacaaacatgtttcatctctccatactccaatcccgaccgaatgtcacactatacgataattgagaatatatgtcccaaggatgaaagcgtgaaattctactccccaaaacgggtccactttccaatacctcaagccgacatggacaaaaagcgatttagttttgtgttcaaacctgtgtttaacactagcctgcttttcctgcaatgtgagctgacgctctgcacgaagatggagaagcacccccaaaaactcccgaagtgcgtgcctccggatgaagcatgtacatcactggacgcctccatcatctgggctatgatgcagaataagaagactttcacaaagcctctagctgtaatccatcatgaagctgaaagtaaagagaagggacccagtatgaaggagcccaaccccatctcaccccctatctttcacggtctggacaccctgaccgtgatgggcatcgccttcgccgctttcgtgattggggccctactcacaggcgccctgtggtatatctatagccatacaggtgagactgccggacggcagcaggttcccaccagcccccccgcatctgaaaacagctcagctgcccattcaatcgggagcacccaaagcaccccgtgcagctctagcagtacagcctag

SEQ ID NO: 138313 - DNA, 2556 bp, Artificial Sequence
  Description of Artificial Sequence: Synthetic coding sequence
atgacctctcattatgtgattgcaatttttgcgttgatgtctagttgtctggctacggccggtccagagccaggcgcattatgtgagttatccccagtaagcgctagtcatcccgtgcaagccctgatggaatcatttacagtactgagcggctgcgcgtcccgggggaccacaggactaccccaggaagttcacgtgctgaatctgagaaccgctggccagggccccggacagctgcaaagggaggtgactctacaccttaatcccatttccagtgttcacatccaccataaatcggtggtatttctgctgaactcgccccacccccttgtgtggcacctgaagaccgagcgcctggctaccggcgtgtcccggctctttctggtgagcgagggatccgtggttcagttctcttccgccaatttcagtctcacagcagaaaccgaagagcgcaattttccacacggcaatgagcacctactgaattgggcccggaaggagtatggggccgtaacttcttttacagagctgaagatcgctcggaacatctacatcaaggtcggcgaagatcaggtgttccctcccaagtgtaacatcgggaaaaatttcttgagcctcaactaccttgccgagtaccttcagcccaaggcagccgaaggatgcgtcatgtcaagccaaccccagaacgaggaggttcacataattgagctgatcacccccaatagcaatccttacagcgcctttcaggtggacataaccattgatatccggccttcccaggaagacttggaagtcgtgaaaaacctcatactgatccttaagtgtaagaaaagtgtcaactgggtgattaaaagcttcgatgtcaaaggctccctcaaaatcatcgcccctaacagcattgggtttgggaaggagtccgaaagaagcatgactatgaccaaatctatcagggatgatattcccagcacccaggggaaccttgtgaagtgggccctcgacaacggatatagtcccattacctcatacactatggctccagtggccaaccgcttccacctccgactggagaataatgcagaggagatgggcgatgaagaagtccacaccatacccccggagctccgcatattgctcgatcccggtgctcttccagctcttcagaatccccctataagggggggggagggccagaatggcggcctcccctttccctttcccgatattagccgcagagtctggaatgaagagggcgaagatggactgccccgacctaaggatccggtgattccctctattcagctcttccctggattaagggaaccagaagaagtgcaggggagtgtggatatcgctcttagtgtaaagtgtgataatgaaaaaatgattgtggcagtggagaaagactcctttcaggcatccggttactctggtatggatgtgaccttgcttgacccaacctgcaaagcaaaaatgaatggtacacacttcgtcctcgagagccctctaaacggctgcggtacccggccgcgctggtcagctctggacggagtggtgtattacaactcgattgtcattcaggtcccggcgctaggggattcctcgggatggccggacggttacgaggacctggagagcggagataatggattccccggtgatatggatgaaggggatgcatctctgtttacccgtcctgagatcgtggtatttaattgttcgctgcagcaggtgagaaaccccagctcctttcaggagcagccccacggcaacatcacttttaacatggaactgtataacacggacctgtttctggttccctcccaaggcgtcttttctgtgccggaaaatggccacgtttatgttgaggtgtccgttaccaaggcggaacaggaattagggttcgctattcagacgtgtttcatttcaccttactccaaccccgacaggatgtcccattatactatcatagaaaatatctgcccaaaagacgagagcgtgaagttctatagtcccaagcgggttcatttcccaataccccaggcagatatggacaaaaagcgattttcattcgtttttaagccagtttttaacacctctctgctttttcttcaatgcgagttgactctgtgcactaagatggagaaacacccccagaaacttcctaagtgtgtacctccagacgaagcatgcacttccttggacgccagcatcatctgggccatgatgcagaataaaaaaacttttaccaaaccattggccgtgattcatcacgaagccgaatctaaagagaagggcccatcaatgaaggagccaaatcctatcagtcctcctatcttccatggcttggacactctcacggtgatgggcattgctttcgcagctttcgttatcggcgccctgctcacaggcgccttgtggtatatttattctcacacgggagagactgctggcagacagcaggtgcccacttcgcccccggcctctgaaaacagctctgcggctcatagtatcggaagtacgcagtccacgccatgttcctcctcttccacagcatag

SEQ ID NO: 138314 - DNA, 2052 bp, Artificial Sequence
  Description of Artificial Sequence: Synthetic coding sequence
atggccctgttcgtgagattgctcgctctagccctagcgctcgccctggggccagccgcaacactggcagggcctgcaaaatcgccatatcagttggttctgcagcacagccgtctgcggggcagacaacatgggcccaatgtatgtgcagttcaaaaagtgatcggcacaaaccgtaaatacttcacaaactgcaagcagtggtatcaaagaaagatatgcggcaagtccactgtcatcagctacgagtgctgtcctggatatgaaaaagtacccggcgagaagggttgccccgcagctctaccactgagcaatctgtacgagactttgggagtggttggctctactacaacccagttgtacaccgatcgaactgagaagctgcgccccgagatggaaggtcctggctcttttacaatcttcgcccctagcaatgaggcgtgggcttcccttcccgctgaagtgctcgattctctcgtgagtaacgtgaatattgagctgctgaatgccctgaggtaccatatggtaggtcggcgcgtgctgaccgacgagctgaagcacggcatgaccctcaccagcatgtaccagaatagcaacatccagatccaccactaccccaatggcatagtcacagtgaattgtgcccggctcctgaaagcggaccatcacgccaccaatggcgtcgtgcatctgatcgataaagtcataagcactataaccaacaatattcagcagatcatcgaaatcgaagatacttttgaaacactgcgcgccgctgtagcggcttccgggctcaatactatgctcgagggaaatggccaatataccttactggctcctactaacgaggccttcgaaaaaatacctagtgagactctgaacagaattctcggagaccctgaggcactaagggatcttctcaataatcacattttaaagtcagccatgtgcgccgaggctattgtcgctggactttctgttgagaccttggagggcactacactcgaggttggctgttccggcgatatgctgacaattaatgggaaggcaatcatatcaaacaaagacatccttgccaccaatggcgtaatccactacatcgatgagctgttgatcccagactcggccaaaacgctgttcgaactggcggcagagagcgatgttagcaccgccattgacttatttcggcaggcaggcctggggaatcatctgagcggatcagaacgattgactcttctggctccgctgaacagcgtgttcaaggacgggacaccacctatcgatgcccatactcgcaacctgctcagaaaccacattattaaagaccagctggctagtaagtacctataccacggacagaccctggaaacactgggcggcaaaaagctgagagtcttcgtgtaccgcaatagcctgtgtattgagaactcatgcattgccgctcacgataagcggggccggtacggcaccctgtttactatggaccgtgtgctgaccccacctatgggtaccgtgatggacgtactcaaaggagataaccgttttagcatgcttgtggccgccatccaatccgccggtcttactgagacattgaacagagaaggagtgtacactgtgtttgccccaactaacgaggccttccgcgcattacctcctcgtgaacgtagtaggctgctgggcgacgccaaggaattggccaatatcttaaagtaccacatcggcgatgaaatactggtgtccggagggattggtgctctagttaggttgaaatcattgcagggagacaaattggaagtgtcactcaagaataacgtggtgtcagttaataaagaacccgtcgcggagccagacatcatggctaccaacggagtggtgcacgtaattactaacgtgcttcagccaccagcaaaccgaccacaggagcggggcgacgaattagctgatagcgctctggagatttttaagcaggcgtccgcattctcaagaccagaacagccccaggtgctgtgcagccccgtgtaccagaagcttcttgagcgtatgaagcattag

SEQ ID NO: 138315 - DNA, 1251 bp, Artificial Sequence
  Description of Artificial Sequence: Synthetic coding sequence
atgctcgagggcaatggccaatacactcttttggcgccaacaaacgaggctttcgagaaaattccctcagagaccttgaataggatcctgggcgaccccgaggccctccgcgacctgttgaataaccacatcttgaaatccgcgatgtgtgccgaagcaatcgtcgctgggcttagtgttgagactcttgaaggaactacgcttgaagtcggctgcagcggcgatatgcttactataaatggaaaagcaatcatatcaaataaagatattttggcaacgaatggcgttatccattacatcgatgagctcctgattcctgattcggccaaaacccttttcgagttggccgcggaaagcgacgtttccaccgccatagacctttttcgtcaggctgggctgggtaaccacctgtccggctcggagcggcttacactattagcccccctcaactccgtgttcaaagatggcacacctccaattgacgcacatacacgaaacctgttgagaaatcatatcatcaaggaccaactggcctctaaatacttataccatggccagactctcgagacgttaggggggaaaaaacttagggtctttgtttatcggaacagcctttgcatcgaaaatagttgcattgccgcccatgacaagagagggagatacggtacgctgttcacaatggatcgggttttgaccccgcctatggggaccgtgatggacgtattgaagggagataaccggttctcaatgcttgttgccgccattcagagcgccggccttaccgagactctgaatagggagggcgtctatacggtctttgcacctaccaacgaggcctttagagcactcccccccagggagaggagtcgcctgctgggggatgcaaaggagttggcgaacattttaaaatatcacattggcgacgagatcttggtttcgggggggatcggggctctcgtccgcctgaagagtctgcagggagacaaattggaggtttctctcaaaaataatgttgtgtccgttaataaggaacctgtggctgaacccgatatcatggctaccaatggcgtcgtccatgtcataactaacgtgctgcagccacccgcgaaccggccacaggagcgcggagacgagctcgccgacagcgccctggaaatcttcaaacaggcctcggctttctcacgcgcatcgcagcgctccgtaagattggcacccgtgtatcaaaagctgttggagcgcatgaaacactag

SEQ ID NO: 138316 - DNA, 2052 bp, Artificial Sequence
  Description of Artificial Sequence: Synthetic coding sequence
atggcactgttcgttagactcctggccctcgctctcgcactcgcactcgggcccgccgcaacactggccgggcctgctaagtccccatatcagctggtgttgcagcactcgaggctgcgggggcggcaacatgggcctaacgtgtgtgcagttcagaaggttataggaaccaacagaaagtactttactaactgtaaacagtggtaccaaagaaagatttgcgggaaaagcaccgtgatttcgtacgaatgttgtcccggatacgagaaggtgccgggcgaaaaggggtgtcccgccgccctgcccctgagcaatttgtatgaaacattaggagtggtaggatctacaacaacgcaactctacaccgaccgaactgagaaacttaggccagagatggaagggcccgggtcctttacaattttcgcccccagcaatgaagcatgggcgagtctgcctgccgaggttcttgatagcctcgtttccaacgtcaatatcgagctacttaatgccctgcgctatcacatggtgggccgccgcgtgcttaccgacgaactcaagcatggcatgactctgactagtatgtaccaaaacagcaatatccagatccaccactaccccaacggaatcgtgactgtcaattgcgccaggctcctgaaggctgaccaccatgcaaccaatggagtggttcacttaattgacaaggtgattagtacaattactaacaacattcagcagataatcgaaatagaagacacgtttgagaccctgagggctgcagtggctgctagcgggctgaatactatgttggaaggaaacggccaatacacactgttagcccccacaaacgaggcattcgaaaagattccctccgaaaccttgaacaggatccttggagaccctgaggctctgcgggacctcctgaataatcacatcctgaagagtgccatgtgcgcagaagccatcgttgcaggactgtctgtggagacactggaagggactactcttgaggttggctgttcgggggacatgctcactattaacggtaaagcaattatttccaataaagatatactggcaaccaacggcgtgattcattacatcgacgagctgcttattcccgactccgccaaaacactgttcgagctcgcagccgaatctgacgtgagtacagcgattgacttgtttaggcaggctggattgggaaaccacctgagtggaagcgagaggttgaccctcctggcccctcttaactcagtatttaaggatgggacgccgccgatagacgctcacacgaggaacttgctgcgcaatcacatcatcaaagatcagctcgcctctaagtacctctatcatgggcagaccctggagaccctcggcggaaaaaagttgcgcgtctttgtttaccggaatagtctttgtatagaaaatagctgtatagctgcccacgacaaacggggacggtatggtacactttttacgatggaccgggttttgaccccccctatgggtacggtgatggatgttctgaagggtgataaccgctttagcatgctcgtggctgcaatccagtcggcgggactgactgagactctcaatagggaaggagtgtataccgtgttcgcacctaccaatgaagcattccgcgccttgccgccacgggaacgctcaagattattgggggatgccaaagagctcgctaacattctgaagtatcacatcggtgacgaaatcttagtgtcagggggtataggagcgttggttagactgaaatctctgcagggcgataagctggaagtgagtctcaaaaacaatgtggtgtcagtgaataaggagccagttgcggagcccgacataatggcaacaaatggggtggttcatgtcatcacaaacgttctgcagcctcctgcaaatcggcctcaggaaaggggtgatgaactggcggactctgctctggaaatctttaaacaggcgtccgcattctcaagggcttcccagcggtctgtcagactcgccccagtgtaccaaaagctccttgaacggatgaaacattag

SEQ ID NO: 138317 - DNA, 1188 bp, Artificial Sequence
  Description of Artificial Sequence: Synthetic coding sequence
atggccttctccccatggcagatactttcccccgtacagtgggctaagtggacctggagtgcagtccgggggggggccgctggtgaggacgaggcaggcggcccagaaggagaccccgaggaggaggactcgcaagccgaaactaaatcactgtctttcaggagcggttgcaaggtgaagaagcatgaaacacaaagcctcgctctggacgcctgctcccgtgatgagggggcggttatttcgcaaatatccgacataagcaacagagacggccatgccactgatgaagaaaaactcgcctcaacgtcttgtggacagaaatcagctggcgctgaggttaaaggcgagccagaggaggacctggaatacttcgagtgcagcaatgtgccagtctcaacaatcaaccatgccttctcctcatctgaggcgggcatcgagaaagaaacctgtcagaagatggaggaggatggcagcaccgtgctgggcctgctcgagagtagcgccgaaaaagcccccgtgagtgtgagctgcggcggagagtcgcccctagacggcatatgtctatccgaatccgacaagaccgccgtcctgacgctgatccgggaagagatcatcaccaaggagatcgaggccaatgaatggaaaaagaagtacgaggagactcgacaagaggtgctagaaatgcggaagatagtagccgagtacgaaaagaccattgctcagatgatcgaagatgagcaaagaacgtccatgaccagccagaaatcctttcagcagctgacaatggagaaggaacaggctcttgccgaccttaattccgtggagcggagtctgtccgacctgttccggaggtatgagaatctgaagggagtactcgaggggtttaagaagaacgaagaagcgttgaaaaaatgtgcccaggactatttggccagagtgaagcaggaagaacagaggtatcaagcgcttaaaattcacgccgaggaaaaattggataaggctaacgaagagattgcacaggttaggaccaaggccaaggccgaaagcgcggctctccacgcaggcctccgcaaggagcagatgaaggtggaatcactggaaagggcactacagcaaaagaaccaagagatcgaggagctcaccaaaatctgtgacgagctcatcgccaaactgggtaaaactgactag

SEQ ID NO: 138318 - DNA, 2418 bp, Artificial Sequence
  Description of Artificial Sequence: Synthetic coding sequence
atggccttctccccctggcagatcctatctcccgtgcaatgggccaaatggacttggagcgcggttaggggcggcgcagccggcgaagacgaagcaggaggcccagagggagatccggaggaggaggatagccaggccgaaaccaaatccctctccttttcaagtgatagtgagggaaacttcgagacccctgaggccgagactcctattcgtagcccatttaaggagtcatgtgaccctagcctggggctggctggccctggagccaaatcccaagagtctcaggaggcagacgaacagctagtggccgaagttgtggagaagtgcagctctaaaacttgctcgaaaccttcagagaacgaagtgccccagcaggcgatagacagccattctgtaaagaactttcgagaggaaccagagcatgatttctccaagatcagcatcgtgagaccgttctccattgagaccaaggactcaacagatatatccgcagtgctcggcacaaaggccgcacatggatgtgttacagccgtgtccgggaaagcattgccttcctccccaccagacgccctgcaagacgaagcaatgactgaaggtagtatgggcgtgacacttgaggcgtctgctgaggcggatctgaaggcaggaaattcctgtcccgaactggttccatccagacgaagcaagcttcgcaagcccaagcccgttcccctcagaaaaaaggcaattggaggagaattttctgacacaaatgctgcggtggaaggaacaccactgcctaaggccagctaccacttctctccagaagagctggacgagaacaccagtccattactgggcgacgcaaggtttcagaaaagtccccctgacctcaaggagacacctgggacactaagctccgacacaaatgactccggcgtagagttgggggaagaatcgcgcagcagcccactcaaacttgagttcgattttaccgaggataccggtaatattgaggcccgaaaggccctgccaagaaagctcggtaggaagctagggtcaacattaactcctaagatccagaaggacgggatttctaagtctgccggactggagcagcctactgaccctgtcgctcgcgatgggccactcagtcagacaagttctaagcccgatcctagccagtgggagagtccttcatttaatccatttggttctcattctgttcttcagaactccccccccctgtccagtgaaggatcatatcatttcgatcccgataattttgacgagtccatggacccgtttaagcctactaccaccctcacctcgtccgatttttgctctccaactggaaaccacgtgaatgaaatcctggagagcccaaagaaagccaagagcagactgattacatcgggatgcaaggtgaaaaaacatgagacacaaagcctcgccttggatgcatgttcaagagatgagggcgcggtaatcagccaaatcagcgacatcagcaatcgcgatgggcacgcaactgatgaggaaaaactcgcttctacttcctgcggccagaaatccgccggagccgaggtcaagggagagcctgaggaggacttggagtatttcgaatgctctaatgtgccagtaagcactattaatcacgcattctcaagttctgaagctggtattgagaaggagacctgccagaagatggaagaagatgggagcactgttctcggtttgctcgagagctcagccgagaaggcccccgtctccgtttcatgtgggggtgagagtcctctggatggaatctgtctgagtgaatccgacaaaaccgcagtgctgacgctaatcagagaagaaattatcaccaaagaaattgaggccaatgaatggaagaagaaatacgaagagacgcggcaagaagtgctggagatgcggaagatcgtggccgagtatgagaaaaccatcgcccaaatgatcgaggatgagcagagaacatcgatgacttcacaaaagagctttcagcagctcactatggagaaggagcaggcccttgctgacctcaactcagtggagaggtcattgtcggacctgttccgaagatacgagaatctgaagggtgtgctggagggctttaagaaaaacgaggaggcactgaagaaatgtgcccaggattacctcgcccgggtgaagcaggaggagcagagataccaggccttaaagattcacgcagaggagaaactcgataaagctaatgaggaaatcgcccaagtccgcactaaggccaaagccgagtctgccgctcttcatgcgggtctacgaaaagagcagatgaaggtggaatctctcgagcgagctctgcaacaaaagaaccaggaaattgaggaactaaccaagatttgtgacgaactgattgctaaactaggaaagactgactag

SEQ ID NO: 138319 - DNA, 1140 bp, Artificial Sequence
  Description of Artificial Sequence: Synthetic coding sequence
atgggcggttcacacagccagacccctcgggggagggaacctgctggcgagcggcacccacgcccaactgaaacggctaccactgagcaggttaaattcttgtgctttttgctctctggctgtaaagtcaagaaacacgagacccagtccttggccctcgacgcatgtagccgtgatgagggcgcggtgatcagccagatcagtgacatctctaatagggacggtcacgctaccgacgaagagaagttggcttcaactagttgcggacagaagtcggcaggggcagaggttaagggagagcccgaagaggaccttgagtacttcgaatgctccaatgttcctgtctccaccattaatcacgccttctctagtagtgaagccggcattgaaaaggagacctgccaaaaaatggaggaggacggcagcactgtgctgggcctgttagagtcttctgccgaaaaagcccctgtgtcagtctcatgcggcggcgagtccccgttagatggcatctgtctgtcggaatccgataagactgccgtgttgacacttattcgggaggagatcatcaccaaggagatcgaggcaaatgaatggaaaaagaaatacgaagagactcgtcaggaagtcctcgagatgcggaagatcgtagcagaatatgaaaagacgatcgcccagatgattgaggatgagcagagaaccagtatgacgtctcaaaagtccttccagcagctcaccatggaaaaagaacaggctctcgcggatctaaactcagtagagcgaagtttatccgacttgttccggcggtacgaaaacctaaaaggggtattggagggatttaagaagaacgaggaagccctaaaaaagtgcgctcaggattacctggctagagtcaaacaggaggaacaacgataccaggcgctcaaaatacatgccgaagagaagttggacaaggccaacgaagaaatcgctcaagttcggaccaaggcaaaggccgaatcagcagctcttcacgcgggtctgcggaaggagcagatgaaggtcgaatcactggaaagggccctgcagcagaagaatcaagagatcgaggagttgacaaaaatctgcgatgagctgatcgccaagctgggaaagacagattag

SEQ ID NO: 138320 - DNA, 1104 bp, Artificial Sequence
  Description of Artificial Sequence: Synthetic coding sequence
atggggggcagccacagtcaaactccaagaggccgtgagcctgccggcgaacgacatccaagacctaccgaaaccgctagtggatgcaaggtaaaaaaacacgaaacgcaaagccttgcgttggacgcatgtagccgcgatgagggggcagtaatctctcagatctctgacatctcgaaccgcgatggacatgcaacggacgaggagaagctcgcctcgacatcttgcggccaaaaaagtgctggcgccgaagtcaaaggcgagccagaagaggatctggaatactttgaatgtagtaatgtgcctgtgagcacaatcaaccacgcattcagtagctcagaagcagggatagagaaagagacatgtcagaaaatggaggaggacggcagtacagtgctgggtctgttggagtcatcggcagagaaggccccagtgtcagtttcttgcggcggggaaagtcctctggatggaatatgtctgagcgaatcggataagacagcagtgttgacccttataagagaggaaattatcaccaaggagatcgaggccaacgagtggaaaaaaaagtacgaggagactcgccaggaagtgctggaaatgaggaagatcgtggcagaatatgagaaaaccattgcccagatgatcgaggatgaacagcgcacttctatgacctcccaaaaatcctttcagcagctgacaatggaaaaagaacaagctctggctgatctcaattcagtcgaaagatctttgtctgacctgttcaggcggtacgagaacttaaagggggtgttggaaggctttaagaagaacgaggaggcactgaaaaagtgcgcccaggattacctcgcaagagtcaaacaggaggagcagaggtatcaggccctgaagatccatgcagaagaaaaattagacaaggcgaatgaggaaattgcgcaagtgagaactaaagctaaggcggagagcgctgccctgcacgcaggacttcggaaggaacaaatgaaagttgaaagcttagaaagggcccttcaacaaaaaaatcaggaaattgaagaactcactaagatatgtgatgaattgatagctaaacttggaaaaaccgattag

SEQ ID NO: 138321 - DNA, 2454 bp, Artificial Sequence
  Description of Artificial Sequence: Synthetic coding sequence
atggccttctctccctggcagatactgtcccccgtgcagtgggctaaatggacttggtctgcggttaggggaggcgccgcaggggaagacgaggccggcggtccagagggcgaccctgaggaagaggatagccaggccgagaccaaatccctctcttttagtagtgacagcgaggggaactttgagacaccggaagccgagactccaattcggtcccccttcaaagaaagctgcgacccctcactcggtcttgcgggaccaggcgccaagagccaagaaagccaggaggcagatgaacagctggtggctgaggttgtggaaaaatgcagttctaaaacatgctccaagccctctgagaatgaggtgccccaacaagctattgactcccactccgtgaaaaacttccgtgaggaaccggagcacgatttcagcaaaatctctattgttcgccccttctccattgaaacaaaggatagcactgatatttcggccgttctcggtaccaaggcagcccacggctgtgttacggccgtgagtggcaaggctctccctagctccccgcctgatgccctgcaggacgaagccatgactgagggatctatgggtgtcaccctggaggcctccgccgaagcagacctcaaggctggcaacagctgcccagaattggtgccgtcccggcgctctaaactgcgaaaacccaagcctgtgccgctgcgtaagaaggccataggtggggagttcagtgatacaaacgccgcagtcgagggcacaccgctacccaaggcatcctatcacttctcaccagaggagctagacgaaaacacatcccccctgctgggagacgctagattccaaaaaagcccgcccgatctgaaagagaccccaggaaccctgagctccgataccaacgattctggtgtggaactcggcgaggaatcccgctcaagccccctgaagctggagttcgattttactgaagacacaggaaacatagaggcacggaaggccctgcccagaaaattgggtagaaaactcggtagcacacttactcctaagattcagaaagacggaattagtaagagcgcaggcttggaacaaccgacagaccccgtggctcgcgacggccctctgtctcaaacgagctccaagcctgatccctcccagtgggaaagcccgagctttaacccctttggatcccactcagtactccagaacagccctcccttaagttccgaaggctcctaccacttcgatccagacaactttgatgagtcaatggatccattcaagcccacaacaactcttacttcaagtgatttttgttcgccaacaggcaatcacgtaaacgagattctagagtcaccaaagaaggcaaagtcacggctaattactaccaccgagcaggtcaaattcctgtgcttcctgcttagcggctgcaaggttaaaaaacacgaaacccagagccttgcacttgacgcctgctcacgcgacgagggagccgtcatttctcagatatcagacatttctaaccgtgacggccatgctacagatgaagaaaaactcgcctctactagctgtggacagaagagcgccggagctgaagtgaaaggagagcccgaggaggatctcgagtattttgagtgcagtaacgtgccagttagtaccattaaccatgccttctcctcaagtgaagcaggcattgagaaagagacctgtcagaagatggaggaagacggctctacagtacttggcctgctggaatctagcgccgagaaagcccccgtctcagtgagctgcggcggagagagccccttagatgggatatgtctctcggaaagtgacaagactgccgttctgacactgattagggaagagataattacaaaggaaattgaagcgaacgagtggaagaaaaagtatgaggagacgagacaggaggtgctggaaatgcgaaaaatagtggctgaatatgagaagaccattgcccagatgatcgaggacgaacagagaacgagcatgaccagccagaaatcattccagcagctcacaatggaaaaggaacaggccttagcagatctgaacagcgtggagcggtccttatcagacctattccgccgttatgaaaatctgaagggggtcttggaaggattcaaaaagaacgaagaggccttgaagaagtgcgcgcaggactacctggccagggtgaaacaggaggagcagaggtaccaggcactgaaaatccacgccgaagagaagctcgataaagccaatgaggaaatcgcacaggtgagaaccaaggcaaaggccgagagcgcggcccttcacgccgggctgcgcaaggaacagatgaaagtcgagagcttagagcgggctctgcagcagaaaaaccaagagatcgaggagctgactaagatttgtgatgaattgatcgctaagctgggtaaaacagactag

SEQ ID NO: 138322 - DNA, 2379 bp, Artificial Sequence
  Description of Artificial Sequence: Synthetic coding sequence
atgcaaaggcagacaatcaagggagcaggtgcaggaggagccgcacttatggcgttctccccctggcaaattttatctccggtccaatgggcaaagtggacgtggtccgccgtgcgcgggggtgctgctggcgaggatgaagctggggggcctgaaggtgatccggaggaggaagattcgcaggccgaaacaaaaagcctgagttttagtagcgactcggagggcaatttcgaaacccccgaggccgagaccccaatccgcagcccctttaaggagtcatgtgaccctagcctgggactcgcgggccctggtgccaaatcgcaggaaagccaggaggctgatgagcagctggtggctgaggtggtagagaagtgctcatccaagacatgttcaaaacctagcgagaacgaggttcctcagcaagcaatcgacagccattccgtgaagaacttcagggaagaacccgagcacgatttctcaaagattagcatcgtgcgcccttttagtattgagacgaaagactccactgacatctccgcagtattggggaccaaggcagcccatggctgcgtgacagcagtcagtggcaaggccttgccatcttctcctccagatgccctccaagacgaggctatgacagaaggctccatgggcgtgactctcgaagcatccgccgaagccgaccttaaggctggcaactcatgccccgagctggtgccctcaaggagaagtaagctgaggaagcctaagccagtgcccctcagaaagaaagctattggcggcgagttctccgacacgaatgcagccgttgagggcacaccactgccgaaggcttcttatcactttagtcccgaggaactggacgagaatacctctcctctgctgggcgacgcgcgcttccaaaagagtcctcctgacctgaaggagaccccaggcaccttatcgagtgataccaacgatagcggggtggagctcggggaagagagccgttcaagccctctgaaactggagttcgatttcactgaagacactggaaatatagaggctcgtaaagctctcccacgaaagcttgggagaaagctaggctctacactgacccctaaaattcagaaagatggtatttctaagtccgcaggccttgaacagcccactgacccagtggctcgcgatggacccctgtcgcagacctctagcaagcccgatccttcgcaatgggaaagcccttcgtttaatccttttggatctcactccgtcctacaaaactcccccccattaagcagtgaaggtagctaccacttcgacccggataattttgacgagtcaatggatcccttcaaacccaccactacgctgacgagctccgatttctgttcccccaccgggaatcatgtgaacgaaattcttgagagcccgaaaaaggccaagagccgtctgatcacctctggctgcaaagtcaaaaagcatgaaacacaatccctagctctcgacgcctgctcaagggatgagggagccgtgataagccagatttctgatatcagcaacagggatgggcatgcgaccgacgaagaaaagcttgccagtaccagttgtgggcagaagtctgccggcgctgaagtgaagggcatagaaaaggagacctgtcagaagatggaggaggatggcagcacagtgctcggtctgctagaatcatccgccgaaaaggcaccggtgtccgtttcttgcggcggagagagtccattggatggcatatgtctgagcgagtctgataaaaccgctgtgctgacactcatccgggaggaaataattacaaaggaaatcgaggctaacgaatggaaaaagaaatatgaggagactcgccaagaggtattggagatgcgcaagatcgtggctgaatacgagaaaacgatagctcagatgatcgaggatgaacaaagaacatctatgacctctcagaaatcctttcagcagctgaccatggagaaggaacaggcattggcggatctgaatagcgtcgagcgatctctatccgaccttttcagaaggtatgagaatctgaaaggggtgcttgaaggattcaaaaagaatgaagaggcgctcaaaaaatgcgcccaggattacctggctcgggtgaaacaagaggagcagcgttaccaggcacttaagattcacgccgaggagaagctcgacaaagcaaatgaagaaatagcacaggtgaggactaaagctaaggccgaatcagccgccctgcatgccggtctgcgcaaggaacagatgaaagttgaaagcctggaaagggctctccagcaaaagaatcaagaaattgaggagctgaccaagatatgcgacgaactgattgcaaagctcggcaaaactgactag

SEQ ID NO: 138323 - DNA, 1431 bp, Artificial Sequence
  Description of Artificial Sequence: Synthetic coding sequence
atgaccgaaggctccatgggggtgaccctggaagcttcagctgaggccgacttgaaagcgggcaactcatgcccagaactggtgcccagcaggcgtagcaagttgaggaagcctaaacctgtccctctacggaagaaagccattggaggggagttctctgatactaacgctgcggtagaaggcacacctttaccaaaggcctcatatcatttttcccctgaggaacttgacgagaatacatcccccctgctgggtgatgctaggttccagaagagtccgcctgatctgaaagaaacccctggcacactgagctcggatacaaatgactctggtgtggaattgggagaagagtcgagaagctctcccctcaaattggaattcgactttacggaggatacgggaaatatcgaggcgcgaaaagcgctgccccggaagctaggccggaagctcggaagtactctgacacccaaaatacagaaagatggtatcagcaagtccgctggcctggaacaacccaccgacccagtggcccgggatggtccactatcacagacgtcgagcaagcctgacccaagccagtgggaatccccttccttcaatccttttggctcacattctgtgctccagaattcacctcccctctcctctgaggggtcatatcacttcgatccagataacttcgacgaaagcatggacccttttaaaccaaccactacgttaaccagtagtgatttctgttcccctaccggcaatcatgtcaacgagatcctcgagagcccaaagaaagcaaaaagccggctgataacttccggctgcaaggtgaagaaacatgagacacaaagtctggccttggatgcgtgttcccgcgatgagggtgccgtaatctcacagattagcgacatttccaaccgcgatggacacgcaaccgacgaagaaaagctcgcatccactagctgtggccagaagagcgccggcgcggaagtgaagggagaacccgaagaggacttggaatactttgagtgttcaaatgtgcccgtctcgaccattaatcacgctttttcaagcagcgaggctggcattgagaaagaaacctgccaaaagatggaggaagatggttccacagtcctgggtctcttagaatcaagcgcggaaaaggcgccagtcagcgtgagctgtggcggcgaatcccctcttgacgggatttgccttagcgagtccgataagacagctgttctaacactaatacgcgaggagatcatcacgaaggaaatcgaggccaatgaatggaagaagaagtattttaacaaggaggtgttcagaggtgacatttgccccaaaaggttcggcctacagattcccgtgatcttcaagaaacagcttaccacaaagagcctcagcctccatcgggtaacagtgaaaaagctcatgtag

SEQ ID NO: 138324 - DNA, 2196 bp, Artificial Sequence
  Description of Artificial Sequence: Synthetic coding sequence
atgaacaatatactaaagcttaaatctagtgacagtgaaggcaacttcgaaaccccagaagctgagaccccaatcagatccccatttaaagaaagttgtgatccatccctgggcctggccgggcccggtgctaagtcgcaggaaagtcaggaggctgatgagcagcttgtagccgaagtggtggagaaatgctcaagcaagacctgcagcaagccaagtgagaatgaagtaccacagcaggctatcgattctcatagcgtaaagaactttcgtgaagaaccagagcacgatttctccaagatcagcatcgtgcggcctttcagcatagagaccaaggattcgactgacatttccgccgtgcttggaaccaaagcagcacatggttgtgtgaccgctgtgagcggcaaagcactcccttctagtccccctgacgccctccaagacgaagccatgaccgaggggtccatgggcgtcaccttagaggcctccgctgaagccgacctgaaagcaggcaatagctgtcctgaactggtcccaagccgtcgctccaagctcagaaaacctaaacctgtgcccctccggaagaaagcgatcggcggagagttcagcgataccaacgccgctgtcgagggcactccccttcccaaggcgagctatcactttagccctgaggagctcgatgagaatacgtcccctctgttaggagatgcccggtttcaaaagtctcctcccgacttgaaggagacacctggcacactgtcctccgatacaaatgattcgggtgtggagttgggggaagagagtcgctccagtcccctcaaacttgagttcgacttcaccgaggacactggtaacatcgaagctcggaaggcgctccctcggaaactgggccgtaaactgggaagtactctgactcctaaaatccagaaggacgggataagcaaatctgcaggcctggagcagcccacggaccctgtggccagggatggtccgctcagccagacttcctctaaaccagatccaagccagtgggagtctccttctttcaaccctttcgggtcccactccgttctgcagaactcgccccctcttagctctgagggaagctaccatttcgaccctgacaatttcgatgagtcaatggatcctttcaaaccaacgactactcttacttcatctgacttctgctcccccacaggaaaccacgttaacgaaatactagaatcccctaagaaagccaagtcccgcctgatcacttcaggctgtaaggtcaagaagcatgagacccaatccttggcattagacgcgtgtagccgcgacgagggggcggtgataagccagatttccgacatttctaaccgggatgggcacgctactgacgaagaaaaactggccagtacatcgtgcggtcagaagtctgccggggcagaggtcaagggtattgaaaaggagacatgccagaaaatggaggaagacggttccactgtcttggggctcctggagtcctctgcagaaaaggctcccgttagcgtgtcctgcggcggagagtcccctctcgacggcatttgcctttccgagtcagacaagaccgccgtgctgacattaattcgagaggaaattatcactaaagaaatagaggctaacgagtggaagaaaaagtacgaggaaactcgccaggaggtcctcgagatgcgaaaaattgtggcagagtatgaaaagacaatcgctcagatgattgaggacgagcagcggacctcaatgacctcccagaagtcattccagcaactgaccatggagaaggaacaagcactggcagatctgaatagcgtggagcggtcacttagcgacctctttcgacgctacgaaaatctcaaaggagttctcgaagggttcaagaaaaatgaggaggcgctgaagaagtgcgcccaggattaccttgctagagtcaagcaagaggaacagcgataccaggctcttaagattcacgctgaagaaaagctggacaaagccaacgaggagatcgcccaggttcgaacgaaagcaaaggcagagagcgcagctttgcatgccgggcttaggaaagaacagatgaaggtcgaatcacttgagcgtgcactccagcaaaaaaatcaagaaatcgaggagctgactaagatctgtgatgaactgatagccaagctcggcaaaacggattag

SEQ ID NO: 138325 - DNA, 1833 bp, Artificial Sequence
  Description of Artificial Sequence: Synthetic coding sequence
atgactgagggcagcatgggcgtgaccctagaagccagcgcagaagcagacctcaaagctggcaactcatgtcccgagttggttccgtctaggcgaagcaaactgcgcaagccaaagccagtacctttaagaaagaaggccattggcggagaattttcggatacaaatgcggcagtggagggtacgccactgccaaaggccagctatcactttagtcctgaagaacttgacgaaaacacatctccacttcttggcgacgccagatttcagaagagcccgcctgacctgaaggagacaccaggtacacttagttcggataccaatgactccggggtagaactcggggaggagtctcgaagttctccgcttaaactcgaattcgatttcacagaagacactgggaatatcgaagcccgcaaggcccttcctcgaaaattgggccgaaagttggggtccacacttacacccaaaattcagaaggatggaatatcaaaaagcgcaggactggaacagccgactgatcccgtagccagggatggtcctctttctcagacttctagcaagccagatccttctcagtgggagtctcccagttttaacccatttggcagccacagcgtcctccagaacagtccccccctaagttccgaaggatcatatcactttgatccagacaattttgatgagagcatggatccatttaaacctaccaccactctcaccagctcagatttctgctcccccacagggaatcacgtcaatgaaatcctcgagagccccaagaaggctaaatcccgcctcattacctcagggtgcaaagtgaaaaagcatgaaacccagagtctagcgctggacgcctgctctcgggacgagggggccgttatcagccaaattagcgacataagcaatagagatgggcacgccaccgacgaagagaaactggccagcacctcatgtggccagaagagtgccggggcggaagttaaaggcgaacctgaggaggacctggagtacttcgaatgttccaacgtgcccgtgtccaccattaatcacgcctttagcagtagcgaggccgggatagagaaggaaacttgtcagaagatggaggaagatggttctaccgtgttaggattgctcgaaagtagtgccgagaaagctcctgtgtctgtgtcttgcgggggagagtcacctctggacggaatctgcctttccgagagcgacaagacggccgttcttacactgatccgggaagagattattacgaaagaaattgaggctaacgaatggaagaagaagtacgaagaaaccaggcaggaggtgttggaaatgaggaaaattgtcgctgaatacgaaaaaacaatcgcccagatgattgaagacgaacagcgcaccagcatgacttctcagaagtcttttcagcagctgaccatggagaaggagcaagcgctggctgacctgaactccgtggaacgctccctgagcgacctcttcagaagatacgagaatcttaagggggttctagagggattcaagaagaatgaggaagcactgaagaaatgcgcgcaagattacctggcccgagtgaagcaggaggaacagcgctaccaggcgctgaaaatccacgccgaggagaagctggataaggcgaacgaagagatcgcccaagtgagaacaaaggccaaagcagagtccgccgccctccatgccggattgcggaaagaacagatgaaagtggagagtctggaacgcgccctacaacagaaaaatcaggaaatcgaggagttgactaaaatctgtgacgagctgatcgccaagcttggcaagacagattag

SEQ ID NO: 138326 - DNA, 1746 bp, Artificial Sequence
  Description of Artificial Sequence: Synthetic coding sequence
atgacagaaggatctatgggtgtcaccttagaggcaagtgctgaagctgacctcaaggcagggaacagctgcccggaattggtcccatctcggagatccaagctacgcaaaccaaagcccgtccccctgcgcaagaaagctataggcggagagttctcagacacaaacgcagccgttgaggggaccccgcttcctaaggcctcctaccattttagtcccgaggagcttgacgagaacacttcccccttacttggagatgccagatttcagaagagtccaccagatctgaaggagacccccggaaccctatcatctgacaccaatgacagcggagtggaattgggggaggagtctaggtcctccccgctgaaactggaattcgacttcacagaggacacagggaatattgaagctcgcaaagcactacctcgcaagctggggagaaaactgggatctaccctgacacccaaaatccagaaggatggtatcagcaagtccgccggattggagcaaccgacagatcccgtggcacgcgacggccctctgagccagacatcatccaaaccggatccatctcaatgggagagcccgtcatttaatccatttggttcgcattcggtgttgcaaaattcaccacccctcagcagcgagggctcttatcactttgaccctgataattttgacgagagcatggaccccttcaaaccgaccactactctgacaagttcagacttctgtagccctactggcaaccacgttaacgagatcttggagtctcccaagaaagctaagagccggcttataacttctggatgcaaggtgaaaaagcatgagacacagtcccttgccctcgacgcttgcagccgggatgaaggggccgtgatctcccaaatttccgatatttcaaatagggatgggcacgcgactgacgaggagaagcttgcttctacctcctgtggtcagaaaagcgcaggagcagaggtaaagggaatagaaaaagaaacgtgccaaaagatggaagaggacggatctacggttctgggattgctagagagtagtgctgagaaggcaccagtcagcgtcagctgcggaggggagtcacctcttgatggtatctgcttgagtgagagcgacaagacagcggttctaacattgatcagagaagaaattattacaaaagagattgaagctaacgagtggaagaagaagtacgaagaaaccagacaggaggtgttggaaatgcgcaaaatcgtcgccgaatatgaaaagactatagctcagatgatagaagacgagcagaggacaagtatgaccagtcaaaaatccttccagcagcttaccatggagaaagagcaagctctggcagatctgaactctgtagagcgaagtctgagcgatctgttcagaaggtacgaaaacttgaaaggcgtactcgaagggttcaagaagaacgaggaggccttgaagaagtgtgctcaggactacctcgccagagtaaagcaagaagagcaaagataccaagcccttaagattcacgccgaagagaaactggataaagctaatgaggaaatcgcccaggtgagaacaaaggctaaggctgagtcagccgccctgcacgccggcctgaggaaggaacagatgaaggtggagtcacttgagagggctctgcaacagaaaaaccaagaaatcgaggaactcacgaagatatgcgacgagcttattgctaagctggggaagaccgactag

SEQ ID NO: 138327 - DNA, 93 bp, Artificial Sequence
  Description of Artificial Sequence: Synthetic coding sequence
atgactgagggttccatgggagttactcttgaggcctcagccgaggccgacctgaaggccggcaattcatgtccagagttggttccgtcttag

SEQ ID NO: 138328 - DNA, 417 bp, Artificial Sequence
  Description of Artificial Sequence: Synthetic coding sequence
atgactgaaggcagtatgggggtcaccctggaagcgagcgctgaagcagacctgaaggcaggaaacagctgtcctgagctggtcccatctagacgaagcaaactacggaagccgaaacccgtgccgcttcggaaaaaagccatcgggggcgagtttagcgatacgaacgccgccgtcgagggcacgccccttcctaaagcttcctaccattttagccccgaagaacttgacgagaacacctctcctctcctaggcgatgctcgattccagaaatctccacctgatctgaaagagacacctggtactttgtcatcagacacaaatgattctggagtcgagctgggtgaagaatcgaggtcatctcctctaaaactggaattcgactttactgaggacaccgggaacatcgaagcatag

SEQ ID NO: 138329 - DNA, 186 bp, Artificial Sequence
  Description of Artificial Sequence: Synthetic coding sequence
atgacagaggggtctatgggcgtgacattggaggcgtctgctgaagccgatctgaaggctggcaatagctgccctgaactcgtcccatcccggcgcagcaagttacgtaaacctaagccggttccgctaaggaagaaagccatcgggggcgagttttccgatactaacgcagcagtagagggctag

SEQ ID NO: 138330 - DNA, 390 bp, Artificial Sequence
  Description of Artificial Sequence: Synthetic coding sequence
atggctttctccccttggcagatcctctctcccgtccagtgggccaaatggacctggagtgctgtgcgagggggagccgcaggggaggacgaagccggcggtcctgagggggatcctgaggaggaggacagtcaggccgagactaaaagtctgagcttttcttctgatagtgaggggaacttcgagacccctgaagccgaaacacccatccgaagtccattcaaggagtcctgtgatccctctttagggcttgctggtcctggggcaaaatcccaggagagccaggaggctgacgagcagctggtcgcggaagtggtcgaaaagtgttcaagtaagacatgctcgaagccatcggagaatgaggtaccccagcaggccattgattcctag

SEQ ID NO: 138331 - DNA, 3081 bp, Artificial Sequence
  Description of Artificial Sequence: Synthetic coding sequence
atgggaggctcccagtctctccagcccgccccagcgagcgacctgaacctggaggccagcgaagccatgagtagcgactctgaagaagcttttgagacccccgagtccactacccccgtaaaagctccacccgctcccccaccacctccaccagaggtaatcccagaacccgaggtgagcacccaacctcctcccgaggagcctgggtgcggatctgagactgtgcctgtgcccgacgggcctagaagcgattctgttgagggttctcctttcaggcccccttcccatagtttctctgctgtgttcgacgaggataagccaattgcctcctctgggacatacaacctggactttgacaacatcgagctcgtggacactttccagaccctggagcctagagccagcgacgcaaagaaccaggagggtaaggtcaacacccgaagaaagagcacagacagcgtgcccatttccaagtccacactcagtagatcacttagtctccaagcctctgactttgatggagccagctcttcaggtaatccggaggccgttgccttggctccagacgcctattctaccggatcaagctcagcatccagcactctcaagaggaccaagaaaccccgcccaccaagcttaaaaaagaagcagacgactaagaagcctacggaaacccccccagtcaaagaaacccagcaggagccagatgaggaatccctggttccaagcggggaaaacctggcctcagaaaccaaaaccgagtccgcaaaaaccgaaggaccatctcccgctttgctggaagaaacaccattggagcccgctgtgggaccaaaagccgcctgcccgctcgattccgagagcgcagagggagtagtccctcccgcctcagggggcggaagggtccaaaactctccacctgtagggcgtaagaccctccccttgacaaccgcccccgaggcaggcgaagtgacccctagtgacagcgggggccaagaagattcaccagccaagggtctgtccgtacgtttggagttcgactacagcgaggacaaaagttcctgggataatcagcaggagaatccacccccaactaaaaaaatcgggaaaaagcccgtggccaagatgcctctcagaagacctaagatgaaaaagaccccagaaaaattagacaacacaccagcctctcctccacgcagcccagccgagcctaatgacatcccgatagctaagggaacatatacctttgacatcgataaatgggatgacccaaacttcaaccccttctcgtctactagtaaaatgcaggaatcaccaaagcttcctcagcagtcctataactttgacccagatacgtgtgacgaatctgttgatccttttaagacgtctagtaagaccccgtcttcaccaagtaagtcacccgcatccttcgagatccctgcctccgccatggaggcgaacggtgttgatggggacggcctgaataaaccggctaagaagaagaagacccccctcaagaccgacacttttagagtcaagaaatcacccaaaagatctccactgtcagaccctccaagccaagatcctacccctgccgctactcctgaaacccctcccgttatctctgccgtggtccacgcgaccgacgaggaaaaactggccgtgactaatcaaaaatggacctgtatgactgttgatctggaggcggataagcaagactaccctcagccaagcgatctgtctacgtttgtgaacgagaccaaattcagcagcccgaccgaggagctggactatcggaattcatatgagattgagtatatggagaaaattggcagcagtctgccacaggatgacgacgcaccaaagaaacaggccttgtaccttatgtttgacacctcccaagagtctccagtgaagagcagccctgtacggatgtcagaatctcccaccccttgcagcggaagctcttttgaggaaactgaggctctggtgaataccgccgccaagaatcaacaccccgtccctcggggcctggcgcctaaccaagagagtcacctccaggtgccagagaagtcatcgcaaaaggagctggaggccatgggtctagggacaccatccgaggccattgagattaccgctcccgaaggctccttcgcaagtgctgacgcacttctcagcaggctggcccacccggtgtcactttgcggcgcattagattatctggaaccggacctagcagagaagaaccctccgttattcgcccagaaactgcaggaagagctggagttcgcaattatgcgtatcgaggctttaaagctggcccggcagatcgccctcgccagccgttctcatcaagacgccaagcgggaagcggcacacccaaccgatgtttcaattagcaagaccgcactttatagccgcattggaactgcggaagtggaaaagcccgccggcctcttattccagcagcccgatctggattccgccctgcagattgccagggccgaaataatcaccaaggaacgcgaggtcagtgaatggaaggataagtacgaagagtcccgtcgtgaagtaatggagatgcggaaaatcgtcgccgagtatgaaaagaccatcgcacagatgatcgaagatgagcaacgtgaaaaaagcgtctcacatcagactgtgcagcagctcgtgcttgagaaggagcaagctctggcggacctcaacagcgtggagaaaagcctggcagacctgttccgccgctacgaaaagatgaaagaggttttggagggatttagaaaaaatgaagaggtgctcaagcgttgtgctcaggagtatctctcaagagtcaagaaggaagagcagcggtaccaagcgcttaaggtacacgcggaggaaaaattggatcgagctaatgccgagatagcccaggtccgtgggaaggctcagcaagagcaagccgcgcatcaagccagtctccgtaaggaacagctgagggttgatgccctcgaaagaactctggagcagaaaaataaggaaattgaagagctgactaaaatttgtgacgaattaattgcaaaaatggggaagtcctag

SEQ ID NO: 138332 - DNA, 8847 bp, Artificial Sequence
  Description of Artificial Sequence: Synthetic coding sequence
atgggcaacgagaactccacctccgataaccagaggaccctcagtgctcaaaccccccggtcagcacagcccccagggaattcccagaacattaaacgaaagcagcaggatacccccggttcccccgatcatcgagacgcttcatctatcggttcggtggggctgggtgggttttgcactgcctcagagagcagcgcctcacttgatccatgcctggtaagcccagaggtgactgaaccaaggaaggatccacaaggagctagaggacccgagggcagcctcctgcccagccctcctcccagccaggagagagagcacccgtccagttcgatgccgttcgccgaatgtccgccggagggatgtctggccagccctgctgcggcccccgaagacggtccacagacccaaagtccgagaagggagccggcacctaatgcccccggcgatatcgctgctgcgttccctgcagagagagactcctctacaccgtaccaggaaattgcagctgtccctagtgccgggcgcgaacggcagcccaaagaggaaggccagaagtcgagctttagcttttcttccgggattgatcagtcacccggtatgagccccgtgccactgagggagcccatgaaggcccctctgtgcggcgagggcgaccagccgggggggttcgaatcccaagagaaagaggctgccggcggctttccgccagctgagagccgccaaggtgtagccagtgtccaagtgacccctgaggcccctgctgcggcccaacagggaacagaatctagcgccgttctcgagaagtctccattgaaacccatggcccctattcctcaagatcccgcaccaagggcttccgaccgtgaaagaggacaaggagaggctcctccacagtatttaacggacgacctggaatttctccgggcctgccacttgcctagaagtaattccggggccgctccagaggccgaggtcaacgcggcatcacaggagtcatgccaacaaccggttggagcttacttaccacacgccgaacttccatggggcctgccctcccccgcactggtcccagaagctggcggttctggcaaagaggcacttgatacgatcgacgtccaaggtcacccacagactggcatgcggggtaccaagccaaatcaagtcgtgtgcgtggccgctgggggtcagcctgaaggcggactgccagtaagtcccgaaccttccttactgacccctaccgaggaggctcacccagcatcttccttggctagcttccccgctgctcaaatacccattgccgtagaggaacctgggtcatccagtcgagaaagtgtgtcaaaagctggcatgcccgtctcagccgatgccgctaaggaggtggtggatgccggccttgtaggactggagcgtcaggtctccgatttaggaagtaagggagagcatcccgaaggtgacccaggtgaggtgcctgcaccttctccacaggagcgcggcgagcacctaaatacagaacaaagccacgaagtgcagccaggggtgcctccccccccactgccaaaagagcagtcacacgaggtgcagccaggcgctcctcccccccctctgcctaaggcaccttctgagagtgcccgtgggcctcctggacctaccgacggtgctaaggtgcatgaagattccactagtccagcggtggctaaagaggggtcccggtctcccggcgattcacccggcggaaaagaggaggcgcccgagccacctgacgggggagatccgggcaacctacaaggagaagattcccaagcatttagtagtaaacgtgatcccgaagtgggcaaggatgagctgtccaagccgtcatctgacgcagagtccagagaccacccgagctcccactcagcccagcccccaaggaagggaggcgccgggcatactgatggtcctcattcccagaccgcggaagccgacgccagcggactgccccacaagttaggtgaagaagaccctgtgctgccacctgtcccagacggcgctggagaaccaactgtgccagagggtgccatttgggaagggtccggccttcagcccaagtgtcctgataccctgcagagccgcgaggggttagggcggatggaaagctttttgacgttggaatcagaaaagtcagattttccgcccacaccggtggcggaggtggcacctaaagcccaagagggagagtcaaccttggagatcaggaaaatgggctcatgcgacggcgagggcttgcttacaagccctgaccagcccagaggcccagcgtgtgatgccagcagacaggaatttcatgctggggtcccacacccacctcaaggtgagaacctggctgctgatctcggactgaccgctctcattctcgaccaggatcaacagggaataccatcttgcccaggcgaaggctggattaggggggcggcaagcgagtggcctctcttatcatccgagaaacacctgcagccatcccaggcccaaccggaaacatctatctttgacgttctcaaagaacaagcccagcccccggagaatgggaaagagacaagcccaagccaccccggctttaaggatcagggagcagactctagccagatccacgtgcccgtcgaacctcaagaggacaacaatctacctacccatggtggacaggaacaagcactgggctccgagctgcagtcccaactccccaaggggaccctgtctgacaccccgactagtagtcccacagatatggtctgggaaagttccctgactgaagagtcagagctatccgccccaacccggcagaaactaccggccctgggcgagaagaggcccgagggggcatgtggcgacggtcagtccagtcgagtttctccacccgccgccgatgttctgaaggacttttctctcgccggtaacttctctaggaaggagacctgttgtactgggcagggcccaaacaagtcccagcaggctttagctgacgcactcgaggagggttcgcagcatgaggaagcttgccagcgtcaccccggggcatctgaagcagctgatggctgttcaccactgtggggcctcagcaaacgcgagatggcatccggtaacaccggagaggcccctccttgccagccggactccgtcgcgcttttagacgcagtgccatgcctgccggccttggcaccagcatcccccggcgtgacacccacgcaggatgccccggagactgaagcatgcgacgagacacaggaagggaggcagcagcccgtccctgcaccccagcaaaaaatggaatgttgggccacaagcgatgccgagagtccaaagctactggccagcttcccctccgcaggggagcaaggtggggaagccggagccgcagaaaccggaggcagcgcgggagctggtgatcctggtaagcaacaggcgcctgagaagcccggagaggctacattaagctgtggactgcttcagactgaacactgtcttacatccggggaagaggcatcaacctcagccctccgcgaatcatgccaggcagaacaccccatggcctcctgccaggacgctctcctgcctgccagggaactgggaggcataccgcgctcaacaatggacttttctacccatcaggctgtccccgatccgaaggagctcctgttgtctgggcccccagaagtagctgctccagatacaccatacttgcatgttgacagcgcggcacagcgcggagcggaagatagtggcgtgaaggcagtgagcagtgctgatcctcgtgcacccggagagtctccttgtcccgtaggcgagccaccactggcgctcgagaacgctgcttctctgaaactgtttgccggatcacttgcacctctactgcagcctggagccgcaggcggcgagatacctgccgtgcaggcatccagcggcagccccaaggcaagaaccacggagggtccagttgactccatgccttgcctggaccggatgccgctgcttgcaaagggcaaacaggcaaccggagaagaaaaggctgctacagccccgggcgccggcgccaaggcatctggcgaagggatggcaggggatgcagccggtgagaccgagggaagcatggaacgaatgggcgaaccttctcaggaccctaagcagggcaccagtggaggagtcgacacaagttccgaacagattgccacactgacaggattccccgattttcgcgaacacatcgccaaaattttcgaaaagccagtgttgggagccctggcaacaccaggggaaaaggcaggggcgggaaggagcgcggtcggaaaggacctcacaaggccactgggtcccgagaaactgctggatggtccccccggcgttgacgtcacattgctgcccgcccccccagcccgccttcaagtcgagaaaaaacagcagttggcaggagaagctgagatatcacatcttgccctgcaagatcctgcgagcgacaaattgctggggcccgctggcctgacatgggaacggaatctgcctggagctggcgtgggaaaggagatggccggggtgcctcccactttacgagaagatgagagacccgaggggccgggggctgcctggccgggactggagggccaggcttatagccagttagagcgctctagacaggaacttgcgagcgggctgccaagtcctgctgccacacaagagttgcctgtggaaagggcggctgcgttccaggttgcgcctcatagtcacggcgaagaagccgttgcccaggatagaattccaagcggaaaacagcatcaggaaacaagtgcatgtgactccccacatggtgaagatggtcccggcgattttgctcacacaggcgttccggggcacgtgcctaggagtacgtgtgccccatcccctcagcgcgaggtcttgacagttcccgaagccaactcagagccctggaccctggacaccctgggcggagagcggaggcccggtgtaaccgcaggcattctggaaatgcggaacgccctcggaaatcaatctaccccagcgccacccaccggcgaagtagctgatactccacttgaaccaggaaaggtcgccggagcggctggcgaagctgagggtgatattaccctcagtactgcagagacacaggcttgcgcgtcaggtgacttaccagaggctggtactactcgcactttttctgtggttgctggggacctcgttctcccggggtcttgccaggatccagcgtgttcagataaggcgccagggatggaagggacagctgcccttcatggggattctccggcccggccccaacaggccaaagagcagcctgggccagagcggccgatccctgccggtgacgggaaagtttgtgtgagctccccgcccgagcctgatgagactcatgacccaaagcttcagcacttggccccagaagagctccataccgaccgggagtctcccagacctggcccatccatgcttccttccgtgcctaaaaaggacgcgcctcgcgtgatggataaggtgacatctgacgaaacccggggagccgaaggcaccgagagtagtcccgttgccgatgacattattcaacccgcagctcctgccgatctggaaagccctacacttgccgcttcttcttaccacggagacgttgttggacaggtgagcacagatctgatcgcacagagtataagtcctgccgcagcacacgccgggctgccccccagcgccgccgagcacattgtttcaccttctgcccccgccggtgatcgagttgaggccagcactccttcatgcccggaccccgctaaagatttatcaaggtcatcagactccgaagaggcgtttgaaaccccagaatcgacgacacccgtgaaagctccacccgcgccgccccctcctccaccagaggtgatccccgagcctgaagtctccacacagccacctccggaagagcccggctgtggtagtgagacagttcccgtacccgacgggccaaggtcagacagtgtggaaggcagtcccttcagacccccttcccacagtttttccgccgtttttgatgaggacaaacccatagcctcctctggtacctacaaccttgatttcgacaacatcgagcttgtggatacttttcagacactggaaccgcgtgcaagtgatgccaagaaccaggaagggaaagtaaatacacggcgcaagagtaccgatagcgtgcccatctctaaaagcacactgtcacgttcactcagtttacaggcaagtgacttcgatggggctagctccagtggaaatcctgaggccgttgcactggccccagacgcttacagcacgggatccagttccgctagctctaccttaaagcgcacaaagaaaccccgccccccgagtttgaaaaaaaaacagacgacaaagaagcccaccgaaaccccccccgtgaaagaaacccagcaggagcccgatgaagagtccctggtcccttccggagagaatttggccagtgagaccaagactgagtctgccaagaccgaagggccatcccccgccctgctggaagagacacccttggagcccgcggttggacctaaagccgcctgtcccctggacagcgaatccgcagagggtgtcgtgccacccgcaagcgggggcggtagagtacaaaacagccctccagtgggtcgtaagaccctccctttaaccacagctccagaggctggggaagtcactccctccgatagtggggggcaggaagacagcccagccaagggactgagcgtgcgtcttgagttcgattatagcgaggataagtcatcatgggataaccagcaggagaaccctcccccaacaaagaagattggcaagaagccggttgccaagatgccacttagaaggcctaaaatgaagaagacacctgaaaaactggacaatactcctgcatcacccccccggagtcccgctgagcccaacgacatccccattgccaagggcacttatacattcgacatcgataagtgggatgatccaaatttcaatccctttagctcaacttcaaaaatgcaggaatccccaaagttacctcagcagagttacaacttcgaccccgacacatgtgacgaatcagtggatccgttcaaaacatcctctaagacacctagcagtccctccaaatcaccggccagctttgagatcccagcctcggcaatggaagccaatggggtggatggggatgggctcaataaacccgctaagaaaaagaagaccccgctgaagacagatacttttagggtgaaaaagtcaccaaaacggagccccttgtccgaccctccttcgcaggatcccacaccagccgctacccctgaaacacctcctgtgatctcagcagtggtccatgctactgatgaagaaaagctggctgtgaccaatcagaagtggacttgcatgactgtggacctcgaagccgacaaacaggactacccacagcccagcgatctctccacgttcgtgaacgagaccaagtttagttcaccaaccgaggagctcgactaccgcaacagctatgaaatcgagtatatggagaaaatcgggagtagcctgccacaggacgatgatgcgcccaagaaacaagccctttatttgatgttcgacacaagccaggagtccccagtaaagtcatcaccggtgcggatgtctgaaagtccaacaccttgttcgggaagctcattcgaggagactgaagcactggtgaacactgccgcgaagaaccagcacccagtgccccggggccttgcgcctaatcaggaatcccatctgcaggttccagaaaagtctagtcagaaagagctggaggccatgggtctaggtacaccatctgaggccatagaaatcactgcacctgagggttcctttgcctcagccgacgctctattgtcacggttagcacaccccgtcagcctctgtggtgctctggattatttggaacctgacctggccgaaaagaatccacctttatttgctcagaaactgcaagaagagctcgaatttgccatcatgagaattgaggcactgaaattggctagacagatcgctcttgcatctcgatcccaccaggacgcgaagcgggaggctgcacacccaacggacgtttctattagcaaaacagccctgtactctagaatcggcacagctgaagtggaaaaaccagccggcttgctcttccagcaaccagacttggatagtgccctccagattgcacgcgcagagataattacaaaggagagagaggtttccgaatggaaagataagtacgaagagtcccgacgagaggtgatggagatgaggaaaatcgtcgccgaatacgagaaaaccattgctcagatgatcgaagacgaacaaagggagaagagcgtgtcccatcagactgtccagcagcttgtgcttgagaaagagcaggccctggccgacctgaattctgtggagaaatcacttgctgatctctttcggagatatgaaaagatgaaagaagtgctggaagggtttaggaaaaatgaagaggtgctgaaacggtgtgctcaagaatatctgagccgtgtaaagaaggaagagcaacgttaccaggccctgaaggttcatgctgaagaaaagctggatcgcgccaatgcagaaattgcgcaggttcgcgggaaggcccaacaggagcaagccgcccaccaggccagccttcgtaaggagcagctccgagttgatgccttggagagaacactggagcagaaaaataaagagatagaagagctgactaagatttgcgacgagttgatcgctaagatgggcaaatcctag

SEQ ID NO: 138333 - DNA, 8586 bp, Artificial Sequence
  Description of Artificial Sequence: Synthetic coding sequence
caacgcaccttgtccgctcagacgccacggagtgcccagccacccggcaattcacagaatatcaagagaaaacagcaagacacccctggatccccggatcatcgtgacgcatcaagtatcgggtcggttggactgggtggcttctgtacagcaagtgagagctccgcctctctggatccgtgtctggttagcccagaggtgaccgagcccagaaaagaccctcagggcgctcgggggcccgaaggcagcctgctaccgtctccaccacctagccaggagagagaacaccctagtagtagcatgccgtttgctgaatgcccacctgagggatgtctcgcttcaccagccgctgcccctgaagatggccctcaaactcaatcacctaggcgcgaacctgctcctaatgctcctggtgatatcgccgctgcgtttccagccgaaagggatagctccacaccttatcaggaaatcgccgcggtgccttcagcagggcgtgagaggcagcctaaggaagaggggcaaaaaagctcattttccttctcatcaggaattgaccagtccccaggcatgtcacctgtcccattgagagagcctatgaaggctccactgtgtggcgagggcgatcaaccaggtggctttgaatctcaggagaaagaggctgcgggaggtttcccaccggcggaatctagacagggcgtggcaagcgtgcaggtgactcccgaagctccagccgctgcccagcagggcaccgaatcctccgctgtcctggagaagagtccccttaagcctatggcccccattccccaagatcccgcgccccgagcaagtgatcgagaacggggccaaggcgaggctccacctcagtacctgacagacgacttggaattcctgagggcctgccaccttcccaggagcaattccggggctgccccagaggccgaggtaaacgccgcctcccaggaatcttgtcaacagcctgtcggtgcctacctgccacacgccgagttgccgtgggggctgccctcacccgccctggtccctgaagccggaggaagcggcaaggaagctctggataccatagatgtgcaggggcacccacagaccgggatgaggggtacaaagccaaaccaggtggtgtgcgtggcagctggcggccagcctgagggggggctgccagtgtcaccggagccgtccttactaactccgacagaggaagcccatcctgcttcctccctcgcatcctttcctgctgcgcaaattcctattgccgtagaagaaccaggatctagttcacgcgagtccgtgagtaaggccggtatgcccgtttctgctgatgcagccaaggaggtcgtggacgctgggctggtggggttagaacgacaggtgtctgatctcggctccaagggtgagcatcccgaaggagatccaggcgaagtgcctgccccctccccacaggaacgaggcgaacatttaaacacagagcagtctcacgaggtgcaaccaggggttcccccgccgcctctgcccaaggagcagtcacatgaggtgcagcctggcgctccacctccccccttgcccaaggcacccagcgaatctgctcggggacctcctggacctacagatggggccaaagtgcatgaggatagcacttctccagcagtggcgaaagagggttcgcggtcacctggggactcgcctggaggaaaagaagaggcccccgagccacccgatggcggcgatcctgggaacttacagggagaagactcacaggcctttagttcaaagcgcgatccggaggtcggaaaggacgaattatcaaagccaagctccgacgccgaatcacgggaccatccctcttctcacagtgcacaaccacctcgcaagggaggggcaggccatacggacggcccacactctcagaccgcggaggcagatgcgagcggactcccacataaactgggcgaagaggaccccgtgctgccacccgtgccagacggtgctggcgagccaactgtcccggagggggcaatatgggagggctcagggcttcaaccaaaatgtccagatacccttcagagcagagagggcctgggccggatggagagttttctaactttagagtcggagaagagcgactttcctcccacaccagtagccgaagtagcaccaaaagcgcaggagggcgagtccacgctggagatccggaagatgggcagctgcgatggagaagggctgctcacgtccccggatcagccgagaggccccgcctgtgacgcctcccggcaggagttccatgccggggtcccccatccccctcagggcgaaaatctggcagcggacttgggcctcactgccctgatcctggatcaggaccaacaagggatccccagttgcccgggcgagggatggatcagaggagctgcatccgagtggcccctgctgtcatcagaaaaacacttgcagccctcccaggcccagccagaaaccagcatcttcgatgtgctgaaggaacaggcccagccgcctgagaatggcaaggaaacttccccaagccaccccggatttaaggaccaaggggcggacagcagtcaaatccacgttccagtcgaaccacaagaggataacaatctgccgacccacggtgggcaggaacaggcactgggctcagagctccagtcgcagctacccaaagggactttgtctgacacccccacttcttcacccaccgacatggtctgggagtcgtctctgaccgaagaatcagagctgtctgcccccactaggcagaagttgcctgcgctgggcgagaagcgacccgagggggcatgcggcgacggacaaagctcgcgtgttagccccccagcagccgatgtcctcaaggacttctcccttgccggcaacttttcccgcaaagaaacctgctgtaccggccagggccctaataagtcccagcaggctctcgcggacgcactggaggaagggagtcaacacgaggaggcatgccagcgacatcctggggcaagcgaggccgctgatggatgctcccccctgtggggtctctctaaaagggaaatggcgtctgggaatactggcgaggccccgccttgtcaaccggatagcgtcgcactactggacgccgtaccctgcctgcccgccttggccccagcctcacccggcgttacccccacacaagacgccccggaaacagaggcctgcgatgaaacccaagaggggcgccagcagccagtccccgccccacagcagaagatggagtgttgggctacctccgacgccgaatctcctaaactcctcgcttccttccccagtgctggagaacagggcggggaggccggggccgcagaaacgggtgggagcgccggtgcgggtgatcctggtaagcagcaggcccccgagaagcctggcgaagccacccttagttgcgggctgctgcagactgaacactgcctgacctcaggagaggaggccagtaccagcgccctgagggagagctgccaagcagagcatcccatggctagttgccaggacgccctgctcccagccagggagctcggcgggattcccagatctaccatggacttctccacccaccaggctgttcctgacccaaaggagctgctgctatctgggccccccgaagtggcagcccctgataccccttaccttcatgtcgactctgctgctcagcgaggcgctgaagatagtggcgttaaagcagtgagcagcgcggaccctagggcacccggcgagtcaccctgcccggtgggagagccgccacttgccctcgagaacgccgcaagccttaaactcttcgctggatccctcgcccccctcttacaacctggagccgcaggaggcgaaattcctgccgtacaggcgagttccggttcccctaaggccaggaccacggagggaccagtagatagcatgccctgcctcgatagaatgcctctgttggccaagggcaagcaagccacgggtgaagaaaaagctgccacagccccaggcgcaggggctaaagcctcaggggaaggcatggcaggagacgctgccggcgagacagaaggctctatggagagaatgggagagccctctcaggatcctaaacagggcaccagcggaggggtagacacatcgagcgagcagattgctaccctgacaggtttcccagatttcagggaacacatcgccaagatcttcgaaaaaccagttctaggagccctggctacaccaggtgagaaggcgggcgccggaaggagcgccgtgggaaaagatttaacaaggccgctgggtcccgaaaagctgttagatggcccccccggcgttgatgtgactttattacccgctccaccagcgaggcttcaagtggagaaaaaacaacaactggccggagaagccgagatctctcaccttgctctgcaggacccagcctccgataagctgttgggccccgccggactgacatgggagcgcaatctccctggcgcaggggttggtaaagagatggcaggtgtgcctccaaccttgcgcgaggacgagcggccagagggtccgggcgctgcttggccaggtctcgagggtcaggcctactcccagctagagcgaagtcgtcaggaactggcaagcgggctgccctcccctgctgcgactcaagaacttcccgtggagcgcgcggcagccttccaggtcgccccccacagccatggagaggaagcggtggcccaagacaggattccaagtggtaaacagcatcaagaaacatccgcttgcgacagccctcacggggaggatgggccaggcgacttcgctcatacaggcgtcccaggccatgtacctagaagtacctgtgcgccctcaccacagagggaggttttgaccgtgcccgaggctaattccgaaccctggaccctcgacacgttgggtggcgaaaggagacccggcgttactgccggcattctggagatgcggaatgctctgggcaatcagtctacacccgcaccacctacaggcgaggttgccgatacaccgttagagccgggtaaggttgccggcgccgccggagaggcggaaggagacatcactctttctaccgcagagacacaggcttgcgccagtggagacttgccggaagctgggaccacccgcaccttctctgttgtggcaggggatctagtactgcccgggagctgccaggaccccgcttgtagtgataaagcccccggaatggaaggtactgctgctctccacggagatagcccggcacggccgcaacaggcaaaggagcagcccggacctgaacgaccaatccccgctggagacggcaaagtttgtgtaagcagccccccagagccagacgagacccacgaccctaaactccagcacctcgccccagaggagctgcatactgacagggagagtccacgccccggcccctcaatgctgccatccgttcccaagaaggacgctccgcgagtcatggacaaagtgacaagcgatgagactcgaggcgccgaaggcacagagagctcccctgtcgccgacgatatcattcaaccggcagcaccagcagacctggaatcccctacactcgcagcgagttcgtatcacggtgatgtcgtcggacaggtttcaacagatctcatcgcccagagcatctccccagcagctgcacacgcgggcttacctccttctgcagcagagcacattgtttcaccaagtgcccccgccggcgaccgcgtggaggccagcaccccttcctgtcctgatccagctaaagacctttcaagaagctctgattccgaggaagcgttcgagacccccgagagtacgacccctgtcaaagcacctcctgcacctcccccgccgccccccgaggtaatccccgaaccggaggtgtctacgcagcctccgcccgaagagcctggctgtgggtccgaaactgtaccagtgccagacggcccaaggtccgactctgttgagggctcaccattcagacccccgtcccactcattttccgccgtctttgacgaggataagccaattgcctcttctgggacatataatctggattttgacaacatcgaattggtagatacattccagactcttgagccacgagcctctgacgcaaagaatcaagaagggaaggtcaatacaaggcgaaagtccactgactctgtgcccatctctaagtcgacgctctcacgatccttgagtctacaggcctctgatttcgacggcgcctcttctagcggcaatccagaagcggtcgcgctggcacccgatgcttatagcacaggcagctcaagcgctagttcaactctgaagcgcactaagaagcccaggcccccatctttgaagaagaaacagacaacaaagaaaccaaccgagacccctcctgtgaaggagacgcagcaggaacctgacgaggagtctcttgtgccttccggggaaaacctggcctcggagactaaaaccgaatccgccaaaaccgaaggcccctccccagcccttctagaggaaaccccactcgagcctgccgtgggccctaaggccgcttgccctttagattcggagagtgctgaaggggtggtgccccccgcctcaggcggagggagggtgcagaactctccccctgttgggagaaaaactcttcccctgaccacggcccccgaagctggagaggtgactccttccgattcgggaggtcaggaggatagcccagctaaggggctgagtgtaaggttggaattcgactattcagaggacaaatccagctgggacaaccagcaggaaaatccgccaccgaccaaaaagatcggtaagaaacccgtagcaaagatgccactccgacgtcctaagatgaagaagaccccggagaaacttgacaatacccccgcatctcctcctagatcccctgccgagccaaatgatatcccgatagccaaggggacatacacgttcgatatcgataaatgggatgatccgaacttcaatcccttcagctcaaccagcaaaatgcaggaatctcctaaattaccacagcagtcgtacaatttcgacccggatacctgtgacgagtctgttgatccttttaagactagctccaaaactccaagctcgcctagcaagagcccggcaagctttgagatccccgcgtccgcaatggaagctaacggagtagacggggatggcctgaataagccagcaaagaagaagaagacacccctgaaaaccgacacattccgggtgaaaaagtctcccaagaggtccccgctgtctgatccaccaagtcaggacccaactccagccgccacaccggaaacccctcccgtaatttccgctgtcgtacacgctactgatgaggagaagttggccgtcacaaaccaaaagtggacatgtatgaccgttgacctggaggcagataaacaggattacccccagcccagcgacctgtccacgtttgtaaatgagactaaattctcaagtccaactgaggaactggactatcgtaattcctacgagatcgagtatatggagaaaatcggctcctctcttcctcaggacgacgacgcacctaagaaacaggcactctacctcatgttcgacacatcacaggaaagccccgtgaagtccagccctgtcagaatgtccgagtctccaacaccctgctccggctcctcattcgaggagactgaggcgctagttaatacggccgccaagaaccagcatcccgttccccgaggcttggctccgaaccaggaatcccacttacaagtacctgaaaagagctctcaaaaggaattggaggcaatggggctcggtaccccaagcgaagccatcgaaatacgggaggcggcacatcccaccgatgtgagcatttctaaaacagccctatatagccgcataggcacagccgaagttgagaaacctgccgggctcctgtttcaacagccagatttagattcagccctgcagatcgctcgtgctgaaatcataaccaaggaacgggaagtcagcgagtggaaagataaatacgaggagtcccgtagagaggtaatggagatgcgcaaaatcgttgcagagtacgaaaaaacaattgcacagatgattgaagatgagcagcgggagaaaagcgtctctcatcagactgtccagcaactggtccttgaaaaggagcaggcactggcagacttgaacagcgtggaaaagtccctggccgatctcttccgacggtatgaaaaaatgaaggaggtcttggagggctttcggaagaacgaggaggtgcttaaaagatgtgcccaggagtatctgagtcgggtgaagaaagaagaacagagatatcaggctttaaaagttcacgcggaggagaagcttgatagagctaatgccgagatagcccaggtaaggggaaaagcccaacaggagcaggccgcacaccaggcctccttgcggaaggagcaactcagggtggacgcactggaaaggacccttgaacagaaaaataaggagatcgaggagcttactaagatctgcgatgaattgatcgcaaagatgggcaaaagttag

SEQ ID NO: 138334 - DNA, 3285 bp, Artificial Sequence
  Description of Artificial Sequence: Synthetic coding sequence
atggggaacgagaattccaccagcgacaatcagcgcacactcagtgctcaaacacctcgcagtgcacagcctccgggcaatagccagaatataaagaggaaacaacaagataccccaggctcgcctgatcaccgggatgcctccagtagtcccgtggcagatgatattatccagcctgcagctccggcggatttggagtcaccgactctcgccgcttcttcttatcacggagacgttgtaggccaggtgagcacagacctgatcgcgcaacggtcgtcagattcggaggaggcttttgagacccctgaaagcaccacgcctgttaaggccccccctgctcctccgcccccaccacccgaagtcattccagagcccgaggtttcaacacagccaccaccagaagaaccgggctgtggcagtgaaaccgtcccagtgccggatggacctcggagtgacagcgtcgagggctccccttttagacccccttcacactccttttctgccgtgttcgacgaagataagcctatcgcttcaagcggcacctacaatctggatttcgataacattgagctggtcgatactttccagaccctggaacctcgagcctctgatgccaaaaaccaagaagggaaggtgaatacccggagaaaaagtactgactccgtgcctatttcaaagagcacactaagtaggtccctctctttgcaagcttcggactttgatggcgcaagttcgtctggcaacccagaagcggtggcgttagcccctgatgcgtacagcaccggctcttccagcgcttctagcaccttaaagcgcactaaaaagccccgcccgcccagcctgaagaagaagcagaccactaagaagccaaccgagacaccaccagtcaaagaaacccagcaagaacccgatgaagaaagcttagtcccttctggtgaaaatctcgctagcgaaactaaaacagaatcagctaagacagaggggccctcacccgcattacttgaggaaactcccttagagccagcagtagggccaaaagccgcatgcccccttgatagcgagagcgctgagggagtagttccacccgcatcaggcgggggccgagtgcagaactctcctcccgtgggcagaaagactctgccactgacaactgctcccgaggcaggtgaagttacgccaagcgatagcgggggacaggaggactctcccgccaaagggctgtcagttagacttgagtttgattattctgaagataagtcttcatgggacaaccagcaggagaaccccccgccaacaaaaaagatcggcaagaaacccgtagctaaaatgcctctcaggagacccaagatgaaaaagacgcctgaaaaactggacaacacacccgcctctccacctcgctctcccgccgagcctaacgacattcctatcgccaaaggcacttatacctttgatatcgataagtgggacgatcctaatttcaatccattttcaagtacatccaagatgcaagagtccccaaaactgccacagcagagctataactttgaccccgatacctgcgatgagtcagttgaccctttcaaaacaagcagcaaaacaccgtcgtcaccatctaaatcccccgccagcttcgaaatccctgccagcgctatggaagcaaacggtgtggacggtgatgggttgaacaagccggccaaaaaaaagaagaccccgctgaagacagacacattcagggttaagaaatcaccgaaaaggtcccctctaagcgaccccccgtcacaagatcccacccccgctgcaaccccggaaactccaccagtaataagtgcagtcgtgcatgccacagacgaggagaagctggctgtgaccaaccagaagtggacatgcatgacggtggacctggaagcagacaagcaggattacccacagccctccgatttgtccacttttgtgaatgagactaagttctcctctccaacagaagagctggattaccggaatagctatgaaatcgagtacatggaaaagatcggtagctccctgccacaagacgatgacgcccccaagaaacaggcactgtacctgatgttcgataccagtcaggagtcacccgtcaaaagttcccccgtacggatgtccgagagtcctacgccctgcagtggtagttccttcgaagaaactgaggccctggtgaacaccgctgccaagaatcagcatcccgtcccccgggggctcgctccaaaccaggaatcccacttgcaggtgcctgaaaaatcatctcagaaggaactagaagcaatgggtcttggcaccccctccgaggccatcgaaataaccgctccggaaggatccttcgcttcggctgacgcacttctgagcaggttggcgcatcccgttagtttatgtggagccctggattatctcgaacccgacctggccgaaaagaacccccccctgttcgcgcaaaaactccaagaggaactcgaatttgcaattatgcggatcgaggctctgaagcttgcccgccagattgccctggccagtcggagtcaccaagatgcgaagagagaggctgctcatcctaccgacgtcagtatctccaagaccgccctttatagtcggatcggaacagccgaagtggagaagccggccggcctgctgttccaacagcctgatttggactctgcccttcaaattgcccgggccgagatcattactaaggaaagggaagtatccgagtggaaggataagtacgaagagtcccgacgggaagttatggagatgcgtaagattgtggctgaatatgaaaaaacaatagctcagatgatcgaggatgaacaaagagagaagtccgtaagccaccagacagtgcaacaactggtacttgaaaaggagcaggccctggccgatctcaattcagttgagaagtccctggctgatctgttcagacggtatgagaagatgaaagaggtgcttgaagggttccggaagaacgaggaagtactaaagaggtgtgcgcaggagtacctgagtcgggtgaagaaggaggagcagcgctaccaagctttgaaagtgcacgcagaagagaagctggacagggccaatgccgagatcgcacaggtgcgcggcaaagcccaacaggagcaggcagcccaccaggctagcttgagaaaggagcagctgcgggtggacgctctggagcgaaccttggagcaaaagaacaaggagatcgaggagctgactaaaatctgtgacgaactgatcgctaaaatgggcaagagctag

SEQ ID NO: 138335 - DNA, 2991 bp, Artificial Sequence
  Description of Artificial Sequence: Synthetic coding sequence
atgggcggcagtcagtcactgcagccagccccagccagcgatctaaaccttgaagcctccgaagctatgtccagtgatagcgaagaggcattcgagacgcctgaaagtacaacccccgttaaagctcccccagcaccgcctccacctccccccgaggtcatccctgaacctgaagtatccactcagccccctcctgaggaaccagggtgtgggagtgagaccgtacctgttccggacgggccacgaagcgactcagtggaaggcagcccctttcgcccaccgtcccacagtttctcagctgtctttgatgaagacaagcccattgcgtctagtggcacgtataatcttgattttgacaatattgaactggtggacacattccagacattggagccccgtgcgagcgatgctaaaaatcaggagggcaaggtaaatacacggaggaaaagtactgactcagtgccaatctccaagagcacactgtccaggagcctatctctccaagccagtgacttcgacggcgctagctctagcggaaacccagaggcagttgcgcttgcccccgacgcatatagtaccggctcaagttcagcctctagtaccctcaagcggacgaagaaaccgcgccccccttcgcttaagaaaaagcaaaccactaaaaaaccaaccgaaacccccccagtcaaggaaacacagcaggagcctgacgaggagtcattagtcccctccggggagaacctggcgtcagaaaccaaaacagagtctgccaagacggaggggccaagccccgccttgctggaggaaactcccttggagccagccgtggggccaaaggccgcatgtcccctggattctgaaagtgctgagggagtggtcccccctgcttcaggcggcggccgtgtgcagaacagcccgcctgtgggacggaagactctgcccttgacaactgccccggaggccggcgaggtaactccttctgacagtggcgggcaggaagacagcccagcgaagggacttagcgttcgcttagagtttgattattctgaggacaagtcatcgtgggacaatcagcaggagaaccccccacccaccaagaaaattggaaagaagcctgtagctaagatgccccttcgccgccccaagatgaaaaagacacctgagaagttggataacacaccagcgagcccacctagatctcccgcagaacctaacgacattcccatagcaaagggcacatacaccttcgatatagacaagtgggatgaccccaattttaacccattctcttccaccagcaagatgcaagaatctccaaagctgcctcagcagtcttataacttcgatccagatacctgcgatgaatccgtggatccttttaagaccagcagcaaaactccatctagcccctccaaaagcccagcctcttttgagattcctgcttctgcaatggaggcaaatggcgtggatggggacgggcttaataagcctgccaagaagaagaaaactcccctgaaaacagacactttccgcgttaaaaagtccccgaaaaggtctccactctcagacccaccctcacaggaccccacacctgctgctacccccgaaacccctcccgtgatcagtgccgtggtgcacgccaccgacgaggaaaaattggccgtgactaaccaaaaatggacttgtatgaccgtggacctcgaagccgataagcaggattatcctcagccgagcgatctaagcacatttgtaaacgagaccaagttcagcagtcctacagaggagttggattacagaaacagctacgagatcgaatacatggaaaagataggtagcagcctcccccaggatgatgacgcaccaaaaaagcaggccctgtacctgatgtttgacactagccaagaatctcccgtgaagtcctccccagtgcggatgtctgaaagtcccactccgtgctccggttcctcgtttgaagaaacagaggctctagtcaataccgcggccaaaaatcagcacccggtacctcgcggactcgcacctaaccaagagtcccacctacaagtaccggagaagagttcgcagaaagaactcgaagcaatgggacttggtacaccttccgaagccatcgaaataacagcacccgaaggctcatttgccagcgcagatgccctcttgagccggctggcccatcccgtgagtctgtgcggcgctttagactacttggagcccgacctcgcggaaaaaaacccgcctctgttcgcacagaaactacagcgggaagccgcccaccctactgatgtgtccatcagcaagaccgccctctacagccgcatcggtaccgcggaagttgagaagcccgctggtttgttgtttcagcaacctgatctcgactcagccctgcaaatcgctagggcagagataattactaaagaacgcgaagttagtgagtggaaagataaatacgaagaaagccgtcgcgaggtaatggagatgcgaaaaatagttgctgagtatgagaagacaatcgctcagatgatagaggacgagcagcgtgaaaaatccgtaagccatcaaacagtgcaacaattggtactggaaaaggagcaggctctggcagatctgaactctgtggagaagagtctggctgatctcttccggaggtacgagaaaatgaaagaagtgcttgaggggtttcgaaagaacgaggaagtgctcaagagatgtgcccaggaatacctttcgcgcgtgaaaaaagaggaacagcggtaccaagccttgaaggtgcacgctgaagagaagctcgacagagccaatgcagagattgctcaggtgagaggcaaggctcagcaggaacaggctgcccaccaggcaagtctccggaaagaacagctcagagttgacgccctcgaaaggactttggagcagaaaaataaggaaatcgaggagctaactaaaatctgcgacgaacttatcgctaagatgggaaaatcgtag

SEQ ID NO: 138336 - DNA, 1716 bp, Artificial Sequence
  Description of Artificial Sequence: Synthetic coding sequence
atgcccttgcgtaggccaaaaatgaaaaaaactccagagaaactagacaacacccctgcctctccccctcggtctccggcagaaccgaatgacatacctatcgccaaaggcacctatactttcgacatagacaagtgggatgaccctaacttcaacccattttcttccacatccaagatgcaggagagcccaaagttgcctcagcagtcttataactttgatccagacacttgcgatgaatctgttgatccattcaagacctcttctaaaactccctctagcccatcaaaaagtccagcaagttttgaaattcccgcttcggcgatggaggctaacggcgtggatggcgatggcctcaacaagcctgcaaaaaaaaaaaaaactccgctcaagaccgtcaagaaaagtcccaaaagatcccctctctccgaccctccaagccaagaccccactcccgccgcaacacccgaaacccccccagtgatatcagctgtcgtgcatgcgacggatgaggaaaagcttgcagtcactaatcagaagtggacttgcatgactgtagacctggaagccgataagcaggattacccacagcccagtgacttatcaaccttcgtgaatgagactaaattctcttctcccaccgaagagctcgattatcggaatagctatgaaatcgaatacatggagaagattggaagctcgttgccccaagatgatgacgcaccaaaaaagcaagccctgtaccttatgtttgacacctcacaggagtcccctgtcaaaagttcccccgtacgaatgtcagaaagcccgactccctgcagtgggagctctttcgaggagaccgaggcacttgttaacaccgccgccaaaaatcagcatccagtcccccggggtctggcccccaatcaggaatcccatctgcaggtgccagagaaatccagtcagaaggaactggaagcaatgggcctgggtaccccaagcgaggctattgaaattcgggaggccgcccatccaacagatgtctctattagcaaaactgccctttatagcaggattggcacagccgaggtggagaagccggccggcttgctgttccagcagccagacctggacagcgcactgcagattgcgcgggccgaaatcataactaaagagagggaagtatccgagtggaaggataaatatgaagagtccagacgcgaagtaatggagatgcgcaagattgtcgcagagtacgagaagaccatcgctcagatgattgaggacgaacagcgggagaaatcagtgagccatcagactgtccagcagctcgtgctggaaaaggaacaagcactggctgacctaaatagcgtggagaaatccctcgccgatttatttcgtcgctatgaaaagatgaaagaggtgttagaaggctttcgaaaaaacgaggaagtattgaaaagatgcgcacaagagtacctgtcaagggtgaagaaggaagagcaacgctaccaggctctgaaggtgcacgccgaagagaagttagatagggccaatgctgagatagcccaggtccgggggaaagcacagcaggaacaggctgcccaccaagcctctcttagaaaggagcaactaagggtcgatgcactggagcgcaccctggaacagaagaacaaggaaattgaggagttgaccaaaatttgcgacgaattaatcgccaagatggggaaaagctag

SEQ ID NO: 138337 - DNA, 8847 bp, Artificial Sequence
  Description of Artificial Sequence: Synthetic coding sequence
atgggtaatgagaactcaacatccgacaatcaacgtactctgagtgctcaaactcctcgcagtgcccagcccccaggtaacagtcagaacattaaaaggaagcagcaggacacgccaggctcccccgatcatcgggacgcttcatctattgggtctgtgggcttgggaggcttctgtacagcttctgaaagcagcgcctcccttgacccatgcttggtcagccctgaggttactgagccacgcaaggatccccaaggcgcccgtggaccagagggcagccttctcccgagcccccctcctagccaggaacgcgaacacccaagtagctctatgcctttcgcggaatgcccgcccgaaggttgtctcgcatcccccgcggccgcaccggaggacggccctcagacacagtccccccgacgtgagccagcccctaacgcccctggagacattgccgcagcattccccgccgaacgcgactcctccacgccttatcaagagatcgctgctgtacccagtgcggggcgcgaacggcagcctaaggaggagggtcagaaaagctcgtttagtttttcatcaggcatcgatcagtctccaggtatgagtcccgtgccccttcgggagccaatgaaagctcccctgtgcggagaaggcgatcagccaggaggtttcgagtcacaggaaaaggaggccgcgggcgggttcccccccgcagagagcagacagggagtggccagcgtgcaggtgacacccgaagccccagccgcagcgcaacagggcactgaatcgagcgctgtgctggagaaaagcccactgaaacctatggctcccattccacaggatcccgcgccccgcgctagcgaccgagaacgtggccagggggaagcccccccacagtatctcaccgacgacctggagttcctgcgcgcttgtcatctgccgagatccaactctggagctgcaccagaggccgaggtgaacgccgcatcgcaagaaagctgtcagcagccggtgggagcgtacctcccacacgcagagttaccatggggacttcctagccctgccctggtgcctgaggccggggggtctggcaaagaggccctggacacgattgacgtacaggggcaccctcaaaccgggatgcgcggaaccaaacctaaccaggtagtgtgtgtggccgccggaggccaaccggaggggggcttgcctgttagccccgaacccagtctgctgacccccactgaggaagcccaccctgcaagttctctggcatcctttcccgctgcgcaaataccaatcgctgtcgaggaacctgggagtagtagtagagagtccgtttctaaagcaggaatgccggtctccgccgacgccgctaaagaagttgttgacgccggtctggtagggctagaacgacaggtgagcgacttagggtccaaaggggagcacccagagggtgaccccggcgaagtgcccgcaccgtcccctcaggagaggggagaacacttaaacactgaacaatcccacgaagtgcagcctggagtgccaccccctccgcttcccaaggaacaatcccacgaggtgcagcctggcgcacctccaccacctcttcccaaggcaccgtcagaaagtgcacgggggccgcctggaccaaccgacggggccaaggtgcacgaggactccacctcacccgccgtcgctaaggagggtagccgctcaccaggagattcgcctggcggaaaggaagaagccccagaaccgcctgatgggggagatccaggcaacctgcaaggtgaagattcccaagcatttagttctaaacgcgacccagaagtagggaaagatgaactgagtaagccttcttccgacgcagaaagtagggaccatccaagcagccatagtgcacagccaccacgaaaaggtggggcagggcataccgacggtccccacagccagacggcggaagcggatgcctctggcttacctcacaagctcggagaggaggaccctgtattgccaccggtgcctgacggcgcaggtgaaccaacagtccccgaaggggccatctgggaggggtccggtctgcagcccaagtgtccggacactttacagagcagagaaggactcggccgaatggagagtttcctgacactcgaatccgagaaatccgattttcccccaacacccgtagctgaagtggcccccaaagcccaggagggagaatcaactctcgagatccgtaagatgggaagctgtgacggtgaagggctgctcacatcgccagaccaaccccgggggccagcctgtgacgcaagcagacaagagtttcacgctggtgtgcctcatccaccccagggggagaacctggcggccgaccttgggttaacggcgttaatccttgaccaggatcagcagggaattccaagctgccctggcgaagggtggattcggggggctgcaagcgaatggccgctgctctcatctgaaaagcacctgcagccttctcaggcacagcccgaaacctctatcttcgatgttctgaaggaacaggcccagccacctgaaaacgggaaagagactagccccagccatccaggctttaaagaccagggagctgattcatcccagatccacgtccctgtcgaacctcaagaagacaataacctgccaacacacgggggccaggaacaggccctgggcagtgaattgcagtcgcaactgcctaaaggtaccctgtccgacactcccacgtcaagtcctactgacatggtgtgggagtcaagtctgaccgaagaatccgagctgagcgcacctacacgccagaaactccccgccttaggagagaaacggcccgagggtgcgtgtggcgacggtcagagctctcgggtcagtcctcccgccgccgatgtgctgaaagacttcagcctcgccggcaatttcagtcgcaaggagacgtgttgcactgggcaaggccctaacaagagccagcaagccctggcggacgcgctcgaagagggcagtcagcatgaggaagcgtgtcagcgacatcccggagcatcggaggccgcggatggctgctcccctctgtggggtctgtcaaagcgcgaaatggcctccggcaacacaggcgaagctccaccctgccaacccgattctgtcgctctactcgacgcagttccctgtttgccagccctagcacccgcttcccccggagttacccccacccaggacgcgcctgaaacggaagcttgtgacgagacccaagaaggccgacagcagcctgttcctgcccctcaacaaaaaatggagtgttgggctaccagcgacgcagagtcccccaagctgctcgcctctttcccatcagccggagaacaaggaggggaagcaggagccgcagagacgggcgggtccgctggagcaggggatccaggaaaacagcaagctcctgaaaagcctggcgaggcaacgctgtcctgcggcctgctgcagacagaacactgcctgacatctggcgaggaagcctcaacatctgccctcagagaaagctgccaggccgaacacccgatggcttcctgtcaggatgccctgctgccagctcgggaacttggaggtattccacggtccacaatggactttagcacacaccaggcggttccggatcccaaagagcttctgctgagcggacctcccgaagtagctgccccagacacaccgtatcttcatgtggatagcgccgcccagcgtggagctgaggattccggagtcaaggccgtatcaagcgccgacccgcgggccccaggcgagagtccgtgccccgtgggagaacctccgctggcattagagaatgccgcgagccttaaactttttgctggcagcctagcaccccttctacaaccaggagccgctggaggagaaattcctgcagtccaggctagtagcgggagcccgaaggcaaggaccaccgaggggcccgttgactcgatgccgtgcctggataggatgcctctgcttgcaaagggtaagcaggctacaggcgaagaaaaggctgctactgcacctggtgctggagctaaggcatccggagagggcatggcaggagatgccgcaggcgagactgaaggaagcatggaacggatgggcgagcctagtcaggatccgaagcaggggacatcgggcggcgttgacacctcctcagaacaaattgctaccctgaccggttttccagactttcgggaacacatagccaagatctttgagaagcccgtgctcggcgcgctggccacccccggcgagaaggctggcgcgggtcggtcagcagtgggaaaggatttaacgaggccgctcggtcccgagaagctgctggacggccctccgggggtggatgtgacacttctgcccgcacccccagcccggctgcaggtggaaaaaaaacagcaattagccggcgaagccgagattagtcacttggcactgcaggacccagcctctgataaactcttaggacctgcagggctgacttgggagcgcaatctgcctggcgctggtgtcggcaaggaaatggccggtgtgcccccaaccctgcgggaggatgagcgtccagagggtcctggggctgcgtggcccggactagaagggcaagcctactctcagctggaacggtcaagacaagagctggcgtctggccttccctcccccgccgcgacccaagagctgcccgtcgagcgtgccgctgcgttccaggtggccccgcacagccacggcgaggaagctgttgcgcaagaccggattccaagtggcaagcaacatcaggaaacatcagcttgcgactctcctcatggtgaggacggccctggcgactttgcgcatacaggcgttccaggacacgtgccaagaagcacgtgtgccccctctcctcagcgagaagtgctcactgtgcctgaggcaaattctgaaccctggacactcgacaccctaggcggtgaacgtagacccggagtgaccgcaggcattctcgaaatgaggaatgccctgggtaaccaaagtacaccagccccccctaccggagaagtggctgatacacccctcgaacctggcaaggttgccggggcagcaggagaggccgagggggatattaccctctctaccgctgaaacgcaggcgtgcgcaagcggcgacttgcctgaggctgggaccacccgaacattctcggtagtggcaggggatcttgttctgcctggttcctgtcaggatccagcctgttcggacaaagctccgggcatggaagggacagccgcactgcacggtgactccccggctaggcctcaacaggcaaaggaacaacctgggcctgaacggccaatccccgcgggcgatggcaaggtgtgtgtcagcagccctccagaaccggacgagacacacgatcccaaactccagcacttggccccagaggagctccacacagatagggagtcgccacgacctggtcccagcatgcttcctagcgtgcccaagaaagacgcacccagagttatggataaggttacctcagacgagacccggggggctgaggggactgaaagcagtcctgttgccgacgacattatacagccggccgccccagccgatctcgagtcccccacactcgccgcttcaagttaccacggcgacgtcgtcgggcaggttagtaccgatctcatcgcccaatcgattagtcctgcggcagcccacgctggacttcctccgtctgccgctgagcacatcgtcagcccctccgcccccgcaggcgacagagttgaagcttctacccccagttgcccggacccagcaaaggacttatcccggagttctgacagtgaagaggcctttgagaccccagaatccactacacccgtaaaggcacctcccgccccacctccacctccgcccgaggttattccggagccagaggtatccactcaacctccgcctgaagaacccggctgcggctcagagacagtgcccgtgccagatggacctcgaagcgatagtgtggagggaagtccgttcagaccaccatctcatagtttcagcgctgttttcgacgaggataaaccaattgcatcatccggaacctataacctggacttcgataacatagagcttgtagacactttccaaacactggaaccacgcgcctctgatgcaaagaatcaggagggaaaggtgaatacgcggcgcaagtcgactgattccgtgcccatctctaaaagcacactctcacgcagcctgagcctgcaggcaagcgattttgatggagcctcttccagcggcaacccagaggcagtggccctggcccctgatgcatattcgactgggagcagttcggccagcagtacactgaaaagaacgaagaagcccaggccccccagtctgaagaagaagcagaccacaaaaaagcccacagagacaccaccagtcaaagagacacagcaggaacctgatgaggagagtctggtgccaagtggggagaatctcgcttcagaaacgaaaactgagtcggccaagaccgaaggcccatcaccagcgttattagaagagactccactggagccagccgtcggacctaaagccgcatgcccgcttgattccgaatccgccgaaggagtagttcctcctgcatctggaggggggagggtccagaactcgccacccgtcgggcgcaaaacgctgcccttaactacagccccagaggctggagaggtaacaccttccgattcgggagggcaagaggacagtcctgccaaaggactgtccgtacggctcgaattcgactattctgaggataaatcttcatgggacaatcagcaagaaaacccacctccaacaaagaagatcggaaaaaaacctgtagccaaaatgccactgcggcggcctaagatgaagaaaacgcctgagaagttggataacactccagcatccccaccccgctctcccgccgagcctaacgatattcccatcgccaaagggacgtataccttcgatattgacaaatgggatgaccctaactttaatccattcagctccacaagcaagatgcaggagagcccaaaactaccacaacagtcctacaacttcgacccagacacttgtgatgagagcgtcgacccatttaagacaagttctaaaaccccatccagccctagtaagagccccgcttcatttgaaatccctgcctctgcaatggaagcaaatggggtggatggcgacgggctgaataagccagccaagaagaaaaaaacgccactgaagactgacacgttccgggtcaaaaaatctcccaagcggagccccctttctgatccccccagccaggacccaacaccggccgctaccccggagacacctccagtgatttctgctgtggtgcacgccacggacgaggaaaagctcgccgtgaccaatcagaagtggacttgtatgacggtggatctggaggccgacaaacaggattatccgcagccatctgacctgtccacattcgtgaacgagacaaagtttagcagtcctaccgaagagctggattacagaaacagctacgaaatcgagtacatggaaaagatcggcagctcccttccacaggatgacgacgctccgaaaaagcaggcactgtaccttatgtttgacactagtcaagaatccccggtgaaatcttccccggttagaatgagtgagtcgcctactccctgctcaggaagtagcttcgaggaaacagaggcgttagtgaacactgcggccaagaatcagcaccccgttcctagaggcctcgcacctaaccaggaaagtcatctgcaggttcccgagaagagctctcaaaaagagctggaagcgatgggcttaggcacaccctcggaagccatagagatcaccgcacctgagggcagcttcgcctcagctgacgcattactgtcaagattagcccaccctgtgtccctctgtggagccctggattacctcgaacccgacctcgccgagaagaaccctcctcttttcgctcagaagctccaagaagaactggaatttgccattatgcggatcgaggcactgaagttggcccgacagattgcgctcgcaagtcgatcacatcaggatgccaaaagggaggccgcccatcctactgatgtaagcattagcaagacagcactttattcaaggattggcactgcagaagttgagaaaccagccggcctactctttcagcaacccgatctcgactccgccctccaaatcgcaagagcggaaatcatcacaaaagagcgcgaagtgtccgagtggaaagacaaatatgaggagtcccgacgcgaagtcatggagatgcggaaaatcgtagccgagtatgagaagactatcgcccagatgatcgaggatgagcagagggaaaaatctgtgagtcatcagaccgtccagcaactcgtgctcgagaaggaacaggccctcgccgatctcaactccgtggagaaaagccttgccgatctctttcgcagatatgaaaaaatgaaggaagtgttggaaggcttccgtaagaacgaggaagtactaaagcgttgcgcccaagagtatctctctcgcgtcaagaaggaagagcagaggtatcaagccttaaaggttcacgccgaagagaagctggatcgcgccaacgcagaaattgctcaggtgagaggaaaggcacaacaagaacaggcagcacatcaggctagcctgaggaaagagcagctgcgcgttgacgctttggagcgcactctggaacagaaaaataaggagattgaagaactcacaaaaatctgtgatgagctgattgccaagatgggcaaatcatag

SEQ ID NO: 138338 - DNA, 8628 bp, Artificial Sequence
  Description of Artificial Sequence: Synthetic coding sequence
atggggaacgagaattcaaccagtgacaatcagcgcaccctgagtgcgcaaactccaaggtctgcccagccccccggcaattcacagaacattaaacgcaaacagcaagacactccgggaagccccgaccaccgggatgcctcttccattggctcagtggggctgggtggcttctgtacagcctctgagagctctgcttcattggacccttgcctggtgtctcctgaggtcaccgaacctcgcaaggaccctcagggcgcaagaggcccagagggtagtttactgcccagcccccccccgtcccaagaaagagagcatcctagcagctcaatgccattcgcagaatgtcctcccgagggttgtctcgccagtcccgccgccgctcccgaggatgggccacagacccagtcaccccgtcgcgagcccgcaccaaatgcaccaggggacatcgccgcagctttccctgcggaaagggactcaagcacgccatatcaggagattgccgctgtaccgagtgccggacgcgaaaggcagccaaaagaggagggccagaaatctagcttttctttctcatctggcatagatcagtcccctgggatgtcacctgtccctctaagggagccaatgaaggcacctctatgtggagagggggaccagcctggcggctttgagagtcaggagaaggaagccgccggcggcttcccaccagccgagagccggcaaggcgtagccagcgtgcaggtgacacctgaagcacccgctgctgctcagcagggaactgaatcatctgccgtgctagagaagtcacctctcaagcccatggcacccatcccacaagaccctgcccctagggcttcagacagggaacgcggacagggcgaagctcctcctcagtatctgacagacgaccttgagttccttcgagcatgtcatctacccaggtccaatagcggtgccgcccccgaggctgaagttaacgccgcatcgcaagaatcttgtcaacagccggtgggggcttacctcccccatgccgagttgccctggggcctgccctcccccgccctggtgcctgaggcaggagggagcggcaaggaggcactggacactatcgatgtgcagggacacccacagactggaatgcgtggcactaagcctaaccaggtcgtttgtgtggccgctggcggccagcctgagggcgggcttccagtttcaccagagcccagtctgttaacccccactgaggaggcgcaccctgcctcttctttggccagttttcctgcagctcagatacccatcgccgtggaggaacccgggtcgtcgagccgcgaatctgtaagcaaggccgggatgcctgtgtcggccgacgccgccaaggaggtcgtagatgccggcttagtaggcctagagaggcaagtgagtgacctgggctccaagggcgaacatccagagggggacccgggtgaagtccctgccccatcaccacaagaacggggtgaacacctgaacacagagcagtctcacgaggtccaacccggcgttccccctcctccactgcctaaagagcagtcacacgaggtgcagccgggcgcccccccacccccactgccaaaggctccgagcgagtcagctcggggccctccaggtcctacggacggagccaaagttcatgaggattccacaagccctgcagtagcaaaagagggttcaaggtcaccgggcgattctccaggcggtaaggaagaggcccccgaaccccctgatggtggggaccctgggaatctccagggcgaagacagccaggcattctcgagtaagcgggacccagaagtgggaaaggatgagctgtcaaagccatcttcagacgctgaatcaagggaccaccctagcagtcacagcgcccagccaccaaggaaggggggcgctggccatactgacgggccacacagtcagacagccgaagccgatgcctcgggtctgccgcacaagctgggcgaggaagatccagtgttaccacccgtccccgatggcgccggtgagccaaccgtgcctgagggagccatctgggaagggagcggactacaacctaaatgcccagacacactgcaaagccgcgagggactagggagaatggagtctttccttacattggaaagcgagaagagcgacttccctcccacaccagtggccgaagtggccccaaaggcccaggaaggcgaatcaacactggagatacgaaagatggggtcgtgtgatggggaggggctactcacatcccctgatcagccacggggacctgcctgcgacgcgtccagacaagaattccacgccggggtacctcaccctcctcagggagaaaacttggctgccgacctaggactgacagctctaattctggatcaggaccagcagggtatcccaagttgtcccggtgagggctggatcaggggcgcagccagcgagtggccacttctcagctctgaaaagcatctccagccatcccaggcccaacccgaaacttccatatttgacgtcttgaaggaacaagcccagcctcctgagaacgggaaggaaacatcacctagccatcccggcttcaaggaccaaggcgccgacagctctcagatccatgtccctgtggaaccacaagaggataacaacctgcctacccacggcggccaagaacaggcacttgggtccgaactccaaagccagctgcccaagggaaccttatcagacacacctaccagctccccaacagatatggtctgggagtcctccttgactgaagagagtgagctgagtgcccccaccaggcagaagctccccgccctgggcgaaaaacggccagagggtgcttgcggagatggccagtccagtcgggtgtcccctcctgccgcagatgttcttaaagactttagcctggccgggaactttagcaggaaggaaacgtgttgtaccggccaggggcccaacaagagtcaacaagcactcgccgatgccctcgaagaggggtcgcagcacgaggaagcctgtcagaggcaccctggagctagcgaggctgccgacggttgctctccactgtgggggctttcaaaaagagagatggccagcggaaataccggggaggcacctccctgtcagcctgactcagtggcactgcttgacgccgttccctgcctcccggcactggcccctgctagtccaggcgtcactcctactcaggacgccccagagacagaagcgtgtgatgagacccaggagggacggcagcaacccgtgcccgcgccccaacaaaagatggagtgttgggccacatcagatgcagagtcgcctaaacttttagcctcttttccttcagctggggagcagggcggagaagcgggagcagcagagaccggaggaagcgctggcgccggagaccccggaaagcagcaagcacctgaaaagcctggcgaggccactctgagctgcggattactccagaccgagcactgtttgacctctggcgaggaagcctctacttctgctctcagggagagctgtcaagcggagcatcccatggcttcttgccaggacgctctgctgccggctcgcgagctgggaggcatcccccggagtaccatggattttagcacccatcaggccgtgcctgacccaaaggaattactcctttctggacctcccgaagtggctgctcccgacaccccatatttgcacgttgactccgccgcccaacggggtgctgaagatagcggggtgaaggcagtgtccagtgctgacccccgcgccccgggcgagagtccatgtccagtcggcgaaccgccccttgccctcgagaacgctgcctccttaaaactgttcgcaggttcccttgcaccattactgcagccgggggctgctgggggcgagattcctgcagtgcaagcctctagtgggagcccgaaagcacggaccacggaggggccagtggattccatgccttgcctggaccggatgcctttactggctaagggcaaacaggctaccggagaagaaaaagccgccacggctcccggagctggcgccaaagcgtcaggagaagggatggccggcgacgccgctggggagaccgagggctcaatggagcgaatgggagaacccagtcaggacccaaagcaaggaaccagtggcggggtggatacctcttctgagcagatcgcaacactcacgggctttcccgatttcagagaacacattgctaaaattttcgaaaagcccgttttgggggccctggcaacccctggagaaaaagctggtgccggcaggagcgccgtcggcaaggacctcactaggccgctgggcccagagaagctgttagacggtccaccaggcgtggatgttacattgctccctgccccacccgcacgcctgcaagtggaaaaaaaacaacagttagctggggaggccgagatctcacacctggccctccaagatccagctagtgataaactactgggacctgccggcctgacatgggagagaaatttgcccggcgcaggagtgggaaaggagatggccggcgtgccacctactctgcgagaagacgagcggccggagggaccaggcgctgcctggccgggtctggaggggcaggcctacagtcagctagaaagatcacgtcaggaattggccagtggcctgccatctcctgccgccactcaggagttgccagttgaaagggctgccgcgtttcaggtggcacctcattcccacggggaggaagctgttgcccaggatcggataccctctgggaaacagcatcaggaaacgtctgcctgcgatagtccgcatggagaggatgggcctggggattttgctcatactggggtgccgggccacgtgccacggtctacttgcgccccaagccctcagcgtgaagtgctcactgtgcctgaggcaaatagtgagccctggactcttgatacactgggaggggagcggagacctggcgtcactgccggaatcctggaaatgaggaacgctttgggcaatcagtctactcccgcccctccaaccggggaggtcgcggataccccattggaaccagggaaagtggcaggtgcggccggagaagctgaaggcgatattactctgtcaacggctgagacgcaggcttgcgcctcaggtgacctcccagaggcagggacaacacgcactttctcagtggtggcaggcgatctggttctgcctgggtcatgccaggatcctgcatgtagtgataaggctccaggcatggagggcaccgccgccctgcatggagattcacccgctagaccgcagcaggcaaaggaacagccaggacctgaaagacccatccctgctggtgatggtaaagtctgtgtgtcctccccgccagagccagacgagactcacgatcccaagctacaacacctcgccccggaagaactgcatacggacagagaatctccccgtccagggccttccatgctgccctccgtgccaaaaaaggacgcgccccgtgtaatggacaaggtgactagcgatgaaacacgaggcgctgaggggacagaaaggagtgctaaggatatcggcctttggaaagctatgatgccttctctcgacaccgacaccttggacgtcctggagcgcagagtggtgctgattcagcacgagtttctgcataagaaggaagctaacggccactccaggttcatgtattccagcccagtcgctgacgatattatccaacccgccgccccggctgatctagagagtcctaccctggccgcgagttcatatcacggcgatgtggtgggccaggtctccacagacctgatcgcacagcgaagctcagattcagaggaggcgtttgagacccccgagtctaccacccccgtgaaagcccctcctgcccctcctccacctcctcctgaggtcatacccgagcctgaggtgagtactcagcctccaccggaagaaccaggctgcggaagtgaaacagtccctgttcctgacggacctcgctccgattctgtcgaaggctctccctttagaccgccctcacactccttttctgcagttttcgacgaagacaagccgatcgcatccagtggtacatataacctggacttcgacaacatagaactagtagatacatttcagacactcgagccccgggcctctgacgcgaagaatcaggagggaaaggttaacacccgtcgtaaatcgacggacagcgtacccatcagcaagtctacactcagtagaagcctgtcgctgcaggccagtgattttgatggtgccagtagcagcggcaaccctgaagcagtcgcactagccccggacgcttattccacgggaagctcttccgcttcaagcacacttaagcgtaccaagaaaccccgacccccgagcctgaaaaaaaagcaaaccaccaaaaagccgactgaaacacccccagtgaaagagacgcaacaggagccggacgaggagtcactggttccttcaggtgaaaatctcgcctctgaaacaaagactgagagcgcaaaaactgaagggccaagcccagccctccttgaggagacacctttagaacccgccgtgggacctaaggccgcctgtccactcgatagcgagtccgctgagggagtagtgccccccgcaagtggcggagggcgggtgcagaactctccaccagttggccggaaaacattaccactgaccacagcccctgaagcaggcgaagtgaccccgtcagacagtggaggccaggaggacagtcctgccaagggactgagcgtgcgccttgagtttgactacagcgaagacaaaagctcatgggataatcagcaggaaaacccccccccaaccaagaagatcgggaagaagcctgtggccaaaatgcctttgcggaggcctaagatgaaaaaaactcccgagaagcttgacaatactcctgcatcccccccacggtcccctgctgaaccgaatgacatacccatcgccaaagggacatacacgtttgacatagataagtgggacgaccccaacttcaaccctttttcatccacttctaagatgcaggagtccccaaagctgcctcagcaatcatacaactttgatcccgacacgtgtgatgaatcagtggacccttttaagacatcaagtaagacccctagctccccttctaagtcccctgcttcctttgaaattcctgcctccgccatggaggccaacggggtcgacggcgacggcctgaacaaaccagctaagaaaaagaagacacccctcaaaaccgatactttcagggtgaagaaatccccgaaacgatcaccgttgtctgatcctccatctcaggaccccacccccgctgcaaccccggagacccctccagttatttccgctgttgtgcacgctaccgacgaagaaaaactcgccgtgaccaatcagaagtggacctgtatgacggttgacctcgaagccgacaagcaggattatccgcagccatcagacctgagcactttcgtgaatgaaaccaagttctctagtcctacggaggagctagattatagaaactcctacgagattgaatacatggagaagataggatctagtttgcctcaggatgatgatgcaccaaagaagcaggcgttgtatcttatgttcgacacctctcaggagtcacccgtgaagtcaagccctgttcgaatgtctgagagccccacgccctgctccggaagctctttcgaggagacggaagcactggtcaataccgccgccaagaaccagcatcccgtcccccggggactggcccctaaccaagagtcacatctccaggttcctgagaaaagttcacaaaaggagctggaagccatgggcttggggactccatccgaggctattgagattcgcgaggcagcgcatccaaccgacgtgagcatatcaaagaccgccctctacagtcgaatcggcactgcagaagttgaaaagcctgcggggctgctttttcaacagccagaccttgactccgcactacagatcgctagggcagagattatcaccaaggagcgcgaggtgtccgagtggaaggataaatatgaggaatcacgaagagaggtgatggagatgagaaaaatcgtggctgagtatgaaaagaccatcgcccagatgatcgaggatgaacagagagagaagtccgtgtcccaccagaccgtacagcagctcgtgctggaaaaagagcaggccctggccgaccttaactccgttgagaaatcgctggctgacttgttccgcagatatgaaaagatgaaggaagtcctggaaggtttcaggaaaaatgaggaagtcctgaaaaggtgcgctcaagagtacctgagccgtgtcaaaaaggaggagcagcgttatcaggccctgaaagtgcacgccgaggagaagctcgatcgagctaacgcggagatagcgcaagtacgcggaaaggcacagcaagaacaggctgctcaccaggcctccctgcgaaaagagcagctccgcgtagacgccttggaaaggaccctcgagcagaagaataaggaaattgaagagcttacaaagatctgcgacgagctgattgctaaaatgggcaagtcttag

SEQ ID NO: 138339 - DNA, 3285 bp, Artificial Sequence
  Description of Artificial Sequence: Synthetic coding sequence
atgggtaacgaaaactctacttccgataatcagaggaccctgagcgcgcagactcccagaagcgctcagccccctggcaattcacagaacattaagaggaagcagcaagataccccaggatcccccgatcacagggatgcgagctccagcccagttgccgatgatatcatccaacccgcagcccctgcggacttggagtctccaacactcgcagcttcttcctaccacggcgacgtcgtggggcaagtcagtaccgacctgatcgcccagcggtcttcagactctgaagaagccttcgaaactcccgaatctactaccccagtaaaggcccctccagcaccacccccacctccccctgaggtaatcccggaacctgaggtttctacccaacccccaccagaggaaccgggctgcggttctgagaccgtgccagttccggacgggcctagatctgacagtgtggagggctccccgtttcggcccccaagccattccttctctgctgtgtttgatgaggataagcccatagctagttccgggacctacaatctggatttcgacaatatcgagctggtcgacacgtttcagactctggaaccgagagcgagcgatgccaaaaaccaggagggtaaagtcaacactcgccggaagtccacagattctgtgccaataagcaaaagcactctgtcccgctcgctgtccctgcaggccagcgacttcgatggagcttctagttccggaaatcccgaagccgtggcccttgcgccagatgcatatagtacaggttcctcttcagcctcatctacactgaagcgaactaaaaagccaagacctccgagtcttaagaagaaacagactaccaaaaaacctaccgagacccctcctgtaaaggaaacccagcaggagcctgacgaggagtcattagtgccatccggagagaacctggctagtgagactaaaacagagtcagcaaagacggaagggcccagccccgctctgcttgaagaaaccccactggaaccggccgtgggtcccaaagcagcctgtccactcgactcggaatccgcagaaggagtcgtgcctccagctagcggcggcggccgcgtccagaatagtcctcccgtcggaagaaagacactgccccttaccacggctccagaggccggggaggtgacaccatcagattccggggggcaggaagattcgcctgccaagggcctgtctgtgagactggagttcgattatagcgaggataagtcttcgtgggacaaccagcaggagaaccccccccctaccaaaaagatcgggaagaagccagtggctaaaatgcctctcaggagacctaaaatgaaaaagaccccagaaaagttagacaatacaccggcgagcccaccacgctctcccgcggaaccaaatgatattcccattgctaagggaacgtacaccttcgatattgataaatgggacgatccgaattttaacccattcagttctactagcaaaatgcaggaatcacctaaactgccccaacagtcttacaacttcgatcctgacacttgcgatgagtccgtggatcccttcaaaacttcttccaagacacctagctctccttcaaaatcccccgcgagcttcgaaattcccgcatcagccatggaggccaacggcgtggacggggatggcctgaataagcccgcaaaaaaaaagaaaacccctttaaaaaccgacacttttcgagtgaagaagagtcccaagcgctcccctttatctgatcccccttctcaggaccctacacccgcagccacccccgagactccgcccgtgatttctgctgtggtgcacgctacggatgaggagaaactcgcagtgaccaaccaaaaatggacttgcatgactgtggacctggaggcggacaaacaggactatccgcagccgtcagatctcagcacttttgttaatgagacaaagtttagctctccgacagaagaactggactatcgaaatagttatgagattgagtatatggaaaaaatcggctcgtctctgccccaggatgatgacgcccctaagaaacaggccttatatctcatgtttgacactagtcaggagagtccggttaaatcatcacccgttaggatgtcagaatcaccaacaccctgcagcggaagcagctttgaagagacagaggcactggtgaacactgctgctaaaaatcaacatcccgtgccaaggggacttgcccccaatcaggaaagtcacttgcaggtgccagaaaaaagctctcagaaggaattggaagcaatgggtctcggaactccatcagaggctattgagatcacggctcctgagggctcgttcgcgagcgcagatgctctgctcagcagacttgcgcacccagtgtccctatgtggtgctctggattacctcgagcctgatctcgctgaaaagaaccctccattgttcgctcaaaagctacaggaggagcttgagttcgccatcatgaggattgaagccctgaagctcgcccggcagatcgcgctcgctagtcggtcccaccaggacgcaaaacgggaagcagcccatccaacagacgtgtctatttctaagacggcactctacagcagaattggcacagccgaagtggaaaaacccgctggactacttttccagcagccggacctagattctgcactgcagattgctagggctgagataatcacaaaagagagggaagtcagcgagtggaaggataaatacgaagagtctagacgtgaggtgatggagatgagaaaaattgtggctgagtacgaaaagacaattgcccaaatgatcgaagacgaacaacgggagaaaagcgtatctcatcaaaccgtgcagcagctcgtgctcgagaaagaacaggcgttagctgatcttaactccgtcgagaagtcgttggccgatttgtttagaaggtacgaaaaaatgaaggaagtcctggaggggtttcgcaagaatgaggaggtgctgaagcgatgcgctcaggagtatctgtctcgggtgaagaaggaggagcagcggtaccaggccctcaaggtccacgccgaggaaaagctggaccgtgccaacgctgaaatcgcccaagttagggggaaggcacaacaagaacaggccgcgcaccaggcctcccttcggaaagagcagctccgcgtggatgctctcgagcggaccctggagcaaaaaaacaaagaaattgaggagctcactaagatttgtgacgagctcattgcaaagatggggaagagttag

SEQ ID NO: 138340 - DNA, 2517 bp, Artificial Sequence
  Description of Artificial Sequence: Synthetic coding sequence
atgtcacttcaagtgctcaatgataaaaacgtgtctaacgaaaagaacaccgagaattgcgactttttgttctcaccgcccgaagtgacggggcggtcctcagtcctgcgagttagccagaaagagaatgtcccgcccaaaaacttagcaaaagcaatgaaggtaaccttccagactcctctccgggatccacaaacacaccgcatcctgagcccatcaatggctagcaagctagaggcgccgtttacccaggatgacacccttggcctggagaacagccacccagtttggacacagaaagagaaccagcaactaatcaaagaagtggatgctaaaacaactcacggcatcctgcagaaaccagtagaggctgacacggatctgctgggtgatgcatcccctgcctttggctccggatcaagttccgagtcaggcccgggcgcacttgccgatctcgattgttccagttcatcacaaagcccaggttcatcggaaaatcagatggtctccccgggcaaggtctccggatcccccgaacaggctgtggaagagaacctgagcagctacagtcttgataggcgagtcactcctgcatctgaaaccctggaagatccatgtcgcaccgagtctcaacataaagctgaaactcctcacggagcggaagaggaatgtaaggccgagacaccccacggtgccgaggaagaatgccgacacggtggcgtttgcgcaccagcagcagtggcaacaagtccccctggcgcaataccaaaagaagcttgcggaggcgctccattgcagggtcttcccggtgaagctctgggctgcccagcaggggtggggactcccgtgcctgccgatggaacacagaccctcacctgtgcccacacgtccgcgccggagagtacagcccccacgaaccacctggtcgccggcagggccatgactttgtctcctcaagaagaggtcgccgccggacagatggcgtcctcctcccggtctgggccagtgaagctcgagttcgatgtgtccgacggtgctacaagcaaacgcgccccaccaccccgcaggttgggcgagcggagtgggctaaaacctcctttgcgtaaggcagccgttcgacagcagaaggctccccaagaagttgaagaagacgatggcagaagcggcgccggggaggacccccccatgcccgcatcacggggatcatatcacctggactgggataagatggatgaccctaactttataccttttggcggagatactaaatccggatgctccgaggcacagcctccagaaagtcccgaaactagattgggccaacctgcggcagagcaattgcacgcaggaccagctacggaagaaccaggaccgtgcctgtctcagcagttgcactctgccagcgcagaggacaccccagtcgtgcagctggcagccgaaacgcccacagctgagtccaaagaacgtgctcttaatagtgcatccacatcacttcccacttcatgccccggaagcgagccagtgcccacccatcagcagggccagccagctcttgagctcaaggaggaatcattcagagaccccgctgaagtgctgggtaccggtgccgaagttgactacctggagcagttcggaacgtccagctttaaggagtcggcactgcggaagcaatccctgtatctgaagtttgaccccctgctcagggacagccctggccgacctgtgcccgtggcaactgagacatcgtcaatgcatggtgcaaacgaaacaccttctgggcggcctcgggaggctaagctggtggagtttgatttcttaggtgccctcgacatcccggtgccggggccgcctcctggcgtccctgcgccaggaggcccaccattatcaactggcccaatcgtggacctgttacaatactcacagaaggatctcgatgccgtcgttaaggccactcaggaagaaaatcgggaactccgctctcgctgcgaagaactgcacggaaagaacctagaactgggaaagatcatggatcggtttgaggaggtggtctatcaggccatggaggaggtccagaagcaaaaagagctgtctaaagcagagattcagaaggtgctgaaagaaaaggaccaactaacgaccgatcttaactccatggagaaatcttttagtgacctgtttaagaggttcgagaaacaaaaagaggtaattgagggatatcgtaagaatgaggaaagcctgaaaaagtgcgttgaagattatctggcacgcattacccaggaaggtcaacggtatcaagccctcaaagcccacgctgaggaaaaattgcagttggctaacgaggagattgcccaggtgcggtctaaagcacaggccgaggcactcgcattacaggcttctctacggaaagaacagatgaggatccaatctctggagaagacagtggagcaaaagacaaaagaaaatgaagaactgacacgaatatgtgacgacctcatcagcaagatggaaaaaatttag

SEQ ID NO: 138341 - DNA, 438 bp, Artificial Sequence
  Description of Artificial Sequence: Synthetic coding sequence
atgagtttgcaggtgttgaatgataagaatgtttccaatgagaaaaacacggaaaattgcgactttctgttctccccccccgaggtcactgggaggagtagcgtactcagggtgtctcagaaagaaaatgtgcccccaaagaatctggccaaagctatgaaggtcacctttcagacacctctgcgggatccacagacacacagaatactttccccaagcatggcatcaaagctcgaggccccttttacccaggatgacacactgggtttggagaactcccacccggtgtggactcagaaggagaaagctgcagcttttagcttatccggtggacatgcctgtggggccgtaggtagcagagatcccaattctagggaacagggcgaaagcctggagctctgccagcaccttgcaagccataagttgagtagacaatag

SEQ ID NO: 138342 - DNA, 666 bp, Artificial Sequence
  Description of Artificial Sequence: Synthetic coding sequence
atgtcacttcaggtgctgaatgataagaatgtgtctaatgagaagaatacagagaactgtgattttttgttttcaccccccgaggtcaccggtaggagctcagtcttaagagttagtcagaaagagaacgtcccccccaaaaacctggcaaaggccatgaaagtgacattccaaactccactccgcgatccgcagactcatcgaatcctctctcctagtatggcttcgaagcttgaggctccattcactcaggatgacacactcgggttagaaaattcccaccctgtctggacccagaaggagaaccaacaacttattaaagaagttgacgccaagaccactcacggcattctgcagaagcccgtagaggcggacactgatctgcttggagatgctagtccagctttcggttccggctcctcttccgagagtggtcccggagcccttgccgacctggactgtagtagctcatctcagagccccggctcatccgagaatcagatggtctcccccggtaaagttagcgggtcacccgagcaggccgtggaagagaacctgtcctcatactctttggataggagggttacacccgcatcagagaccctcgaggacccatgcaggacggagtcacaacataaggcagaaacccctcacggggctgaatag

SEQ ID NO: 138343 - DNA, 696 bp, Artificial Sequence
  Description of Artificial Sequence: Synthetic coding sequence
atgagcttacaggtgttgaatgataaaaatgtgtcaaacgaaaagaatacagaaaactgtgacttcctattctcaccgcccgaggttacaggcaggtcctcggtattgagggtgtctcagaaggagaacgtgccccccaagaacctggccaaagcaatgaaggttaccttccagactcccctcagggatccgcaaacacaccgcattctctcacccagcatggccagtaaattggaagctcccttcacacaagacgataccctcgggctcgagaattcccatccagtatggactcagaaagagaatcagcagcttataaaggaggtcgatgccaaaacgacccacggcattctccaaaaacctgtcgaagccgacaccgatctgttgggcgacgcatctcctgccttcgggagtggctctagttctgaatcgggccctggagccctcgccgatctggactgttcatcctcaagtcagagtcccggttcatcagagaatcaaatggtctcaccaggtaaagtcagcggctccccagaacaggcagtggaggaaaatctcagttcctattcccttgaccgccgcgtgactccagcctccgagaccctcgaggacccttgtcgtacagagtctcagcataaagcagagacaccccatggggccgaggaggaatgtaaggccgaaacgcctcacggctag

SEQ ID NO: 138344 - DNA, 606 bp, Artificial Sequence
  Description of Artificial Sequence: Synthetic coding sequence
atggcaaacaagggtcccagctacggcatgtcgagagaagtccagagcaaaatcgagaaaaaatacgacgaagagctggaagagcgtctggtggagtggatcattgtgcagtgtggaccggacgttggcaggccggataggggtcggttggggttccaggtctggctgaagaacggcgtgatcctgagcaaactagtgaatagtctgtatcctgatggctccaagcctgtcaaggtgcctgagaaccctcctagcatggtgtttaaacaaatggagcaggtcgcacagtttctgaaagccgccgaggattatggagtcattaagacagatatgttccagacagtggacctgtttgaaggaaaggatatggccgcggtgcagcgcaccctgatggcgctggggtctcttgctgtgactaaaaatgacggtcattaccggggagatcccaactggttcatgaagaaagcccaagagcacaaaagggaatttacagaatcacagctgcaggagggtaagcatgtaattgggctgcagatgggatcgaacagaggagcttctcaggctggcatgacaggatacgggagacctcggcagattatttcgtag

SEQ ID NO: 138345 - DNA, 108 bp, Artificial Sequence
  Description of Artificial Sequence: Synthetic coding sequence
atggccaataagggcccgtcttatggaatgagccgcgaggtccagccctccagactagcatgtctgacacatacccgtgtggtcccatcggccctagctaaattgtag

SEQ ID NO: 138346 - DNA, 606 bp, Artificial Sequence
  Description of Artificial Sequence: Synthetic coding sequence
atggccaacaaaggcccttcttacggcatgagtagagaggtacaaagtaagattgaaaagaagtatgacgaggaattggaagaacggcttgttgagtggataatcgttcagtgtggtccggacgtcggccgaccagacagaggcagactcggttttcaagtgtggctaaagaatggcgttatcctcagcaaactggtgaattcgttatatcctgacggcagcaaacctgtcaaggtgcccgagaatccccccagtatggtctttaaacagatggagcaggtggctcagtttctgaaggccgctgaggactacggggtcattaaaactgatatgtttcagaccgtggatctatttgaaggtaaagatatggccgccgtgcagagaactctcatggccttggggtccctagcagtgaccaaaaacgatggtcactacaggggcgatccaaattggtttatgaagaaggctcaagaacacaaaagagaattcactgaatctcagctgcaggaggggaagcacgtcattggactccagatgggctccaaccgtggtgcttctcaggccggcatgaccggctacggtcgaccacggcagatcattagttag

SEQ ID NO: 138347 - DNA, 606 bp, Artificial Sequence
  Description of Artificial Sequence: Synthetic coding sequence
atggctaacaaggggccatcctacgggatgtcgcgcgaggtccagtcgaaaatcgagaagaaatacgacgaggaactggaagaaaggttagtggaatggattattgtccagtgcggtcctgacgttggccgacctgatcgtggccgccttggctttcaggtgtggctgaagaacggtgtaattcttagcaagctagtgaatagcctgtacccagatggatcaaaacccgtgaaggtgcccgagaaccctccttctatggtgttcaagcagatggaacaggtggcacagttcctaaaggcagccgaggactacggcgtgattaaaactgatatgttccagactgtcgatctgtttgaagggaaggatatggccgctgttcagcggaccttaatggcccttggttctctggccgtcacaaagaacgacgggcactataggggtgatcctaactggtttatgaagaaagcgcaggagcacaaacgggagtttactgaatctcagctccaggagggaaagcacgttatcggcctgcaaatgggcagcaacagaggcgcaagccaggctgggatgactggctatggacgccctcggcagattatctcctag

SEQ ID NO: 138348 - DNA, 276 bp, Artificial Sequence
  Description of Artificial Sequence: Synthetic coding sequence
atggcaaacaagggcccatcttacggcatgtcacgcgaggtgcagtctaaaatcgaaaagaagtatgacgaggagctggaggaacgccttgtggagtggataatcgtccagtgcgggccagacgtgggccggccagaccgcggacggctcgggtttcaagtttggcttaagaatggcgttatcctgagtaaactggtgaatagcctatacccagatgggtctaaaccagtgaaagtgccagagaacccgccatctatggtttttaagcaaatgtag

SEQ ID NO: 138349 - DNA, 606 bp, Artificial Sequence
  Description of Artificial Sequence: Synthetic coding sequence
atggctaacaaagggccctcatacggtatgagcagggaagtgcagtctaagatagaaaaaaagtatgatgaggaactcgaggagcgcctcgtggagtggattatagtgcagtgtggtcctgacgttggcagaccggaccggggaaggctcggtttccaggtttggctgaagaatggagtcattctgtcaaagctcgtgaactcgctgtatcccgatggaagtaaaccagtaaaggtgccggaaaacccaccctctatggtgtttaagcagatggagcaggttgcccagttcctcaaggcagcagaggactacggggtgatcaaaaccgacatgtttcagactgtggacctgttcgaaggaaaggatatggcagcagtacaacgcacgctaatggctctgggctcactggcggttaccaaaaatgacggccactatcggggggaccctaactggttcatgaagaaggcacaggagcataagagggaatttaccgagagtcagttgcaggaggggaagcatgtgatcgggctgcagatggggtccaatcgcggcgcttctcaagcaggcatgacaggctatggcagaccacgccagattattagctag

SEQ ID NO: 138350 - DNA, 606 bp, Artificial Sequence
  Description of Artificial Sequence: Synthetic coding sequence
atggccaataaggggcccagttacggcatgtcccgggaggtccagtctaaaatcgagaagaagtacgacgaggaactcgaggaaagactagtcgaatggatcattgtccaatgtggacctgacgtgggtaggccagatcggggccggctggggtttcaagtatggttaaagaatggagtcattttatccaaattggtgaacagtttgtaccccgacggctctaagcccgtgaaggtccccgagaacccaccatctatggtgttcaaacagatggaacaggtggcacagttcctgaaggcagccgaggactatggcgttatcaagaccgacatgtttcagaccgtagacttgtttgagggcaaggatatggctgccgtccagcggactcttatggctcttgggtctctcgctgtgaccaaaaacgatggtcactaccgcggggaccccaattggttcatgaagaaggcgcaggagcataaaagagagttcaccgaatctcagctgcaggaaggaaagcacgttatcggtctgcagatgggaagtaaccgaggcgcctcccaggccggaatgaccggctacggcaggcctagacagataatttcctag

SEQ ID NO: 138351 - DNA, 600 bp, Artificial Sequence
  Description of Artificial Sequence: Synthetic coding sequence
atggccaatagaggcccagcatatggtctgtcccgggaggttcagcagaaaattgagaaacagtacgacgccgacttggagcagatcctaatccaatggattactacgcagtgccggaaggacgtagggaggccccaacccgggagagagaattttcagaactggttaaaagatgggactgtgctttgcgagctgattaacgcattataccctgaaggtcaggccccagtgaagaagattcaggcttccactatggctttcaaacagatggagcagatttctcagttcctgcaggcagccgagcgttatggcattaacactaccgacattttccaaaccgtggacctatgggaaggaaagaacatggcctgcgtccagcggacattgatgaatttgggtgggcttgcagtagcccgtgacgacgggttgtttagtggagaccccaactggttccctaaaaaaagcaaggagaatccaaggaatttctcagataatcaactgcaggagggtaaaaacgttataggtctgcagatggggactaaccgcggcgcaagccaggccggcatgaccggatacgggatgccaagacaaatactctag

SEQ ID NO: 138352 - DNA, 663 bp, Artificial Sequence
  Description of Artificial Sequence: Synthetic coding sequence
atgagcgccttcagcttagccttggcccttgtctcatctcctcagcctcccccgccaatagggatggctaatcgcgggcctgcctatggcctttctagagaggttcaacagaagattgagaagcagtatgacgcagaccttgaacagatcttaattcagtggattactacgcaatgtaggaaggatgtcggccgaccccagcccggtcgggagaattttcagaattggctgaaagacgggacagtgctctgcgagctgatcaacgccctgtatcctgagggacaggcaccagtgaaaaaaatccaggccagcaccatggcttttaaacagatggaacagatttcacagttcctgcaggccgctgaacgatacggcattaacaccaccgatatctttcagaccgtagacctctgggagggtaaaaatatggcctgcgtgcagcggactctaatgaacctcgggggactggctgttgccagagacgatggactttttagcggagaccctaactggtttcccaagaagtcaaaggagaaccctagaaattttagtgacaaccagctgcaggagggcaaaaatgtcatcggattgcaaatgggaacgaataggggcgcctcccaagctggtatgactgggtatggaatgccaaggcaaatcttgtag

SEQ ID NO: 138353 - DNA, 600 bp, Artificial Sequence
  Description of Artificial Sequence: Synthetic coding sequence
atggcaaatcgagggcccgcatatggactcagccgggaggttcaacagaaaattgaaaaacagtatgatgcggatcttgaacagatactcatccaatggatcacgacccagtgccgcaaagatgtgggccgccctcagcctggccgtgagaacttccagaattggttgaaggatggaacggtcctctgtgaacttattaacgcgctctaccccgaaggacaagcccccgtaaagaaaatccaggctagtactatggcattcaaacagatggaacagataagccaatttttgcaggcagccgaacgatatggcattaatacgacagatatctttcagaccgtcgatctgtgggaaggcaagaacatggcctgtgtacaaagaactctcatgaatttaggagggctcgccgtggcaagagatgacggcctgttcagcggcgatcccaattggtttccaaagaagagcaaagagaaccctaggaacttcagcgataaccagttacaggaaggaaaaaatgttattggactgcagatgggtacaaacaggggggccagccaggctggtatgacaggatacggcatgcccaggcagatactgtag

SEQ ID NO: 138354 - DNA, 564 bp, Artificial Sequence
  Description of Artificial Sequence: Synthetic coding sequence
atggccaacagagggccggcatatgggctgagcagagaagtgcagcagaaaatcgaaaaacagtacgacgcggacctggagcagatactgattcagtggatcactacccaatgcagaaaggatgttgggaggcctcagcccggcagggagaatttccaaaattggctgaaagacgggacagttctgtgcgaactgattaacgctctctaccctgagggccaagcccctgtcaaaaaaatccaggcatcaaccatggccttcaaacagatggaacagatttcacagttcttacaggctgcagaacggtacgggataaacaccacagacatcttccagaccgtcgatttatgggaaggcaaaaacatggcttgtgtgcagcggacattaatgaatcttggcggacttgccgtggcgcgagatgacgggctattcagtggagacccgaattggtttcccaagaagtcaaaagaaaacccacggaacttcagcgacaatcagctgcaagaaggtaaaaatgttatcgggcttcagatgggcactaatcggggagccagtcaagcatag

SEQ ID NO: 138355 - DNA, 3861 bp, Artificial Sequence
  Description of Artificial Sequence: Synthetic coding sequence
atgtctcacctggttgatccaacctccggagacctacccgtgcgggacatcgacgccataccccttgtcctccccgcctctaaaggaaagaatatgaagactcagcctcccctgtcgcgaatgaacagggaggaactagaggattctttttttcggcttcgcgaagaccacatgttggtgaaggagctttcgtggaaacagcaggacgagatcaaaagacttagaacaacacttctgaggttaacagccgccggaagagatctgcgcgttgcggaagaggccgccccgctatccgaaacagcacgccggggacagaaggctgggtggagacagcgcctctccatgcaccaaaggccccagatgcaccgactacagggtcacttccattgtgtgggaccagctagccctcgtcgagcacagcctcgtgtacaggtgggacacagacagctgcacacagccggtgcccccgtacctgaaaagcccaagcgggggccaagagaccgcttgtcatacacagcacccccctcatttaaagagcacgccacaaacgagaatagaggtgaggtggcctccaagccctccgagctggtatctggcagcaacagcattatctccttttctagcgtaatctcaatggccaaaccgattggactttgtatgccaaactccgcccatatcatggcctctaataccatgcaggtggaggaacctccaaagagccctgaaaagatgtggcccaaagacgagaactttgagcagcggagctcccttgaatgcgcccaaaaagcagccgagctgagagcaagtataaaagagaaagtggagttgatcaggctgaagaaactgctccatgaacgtaacgcatcccttgtgatgaccaaggcccaactcactgaagtgcaggaggcctgtacatttctgctgactcaaaaccagggaatcctcagcgcagcccacgaggcacttctaaaacaagttaacgagctgcgagccgagctgaaggaagaatcaaaaaaggcggtgagccttaaatctcagctcgaagatgtgtctattctccaaatgacgctcaaggaattccaggaacgtgtcgaagaccttgaaaaggaaagaaagctgctgaacgacaattatgataaactcctggaaagcatgttggatagctccgacagctctagtcagcctcactggtccaatgagctgatcgccgagcagcttcagcagcaggttagccagttgcaagaccagctggacgccgagctggaggataaaaggaaggttctactggaactgagcagggaaaaggcccaaaatgaggacctcaagttggaggtgacaaatatcctgcagaagcacaagcaggaggtcgaactgctgcagaatgcggcaacaatttctcagccaccagatcgtcagtccgaacctgcgacccaccccgccgtgctccaggaaaatacccagattgaaccatccgagccaaaaaatcaggaggaaaagaagctttctcaggtgctgaatgagctgcaggtgagccacgctgaaaccaccttagagttggagaagacccgggacatgttgattctgcagcgcaaaattaatgtctgctatcaagaagagctggaagctatgatgactaaggcagataatgataaccgggaccacaaggagaaactggagcgactcacgagactgttggatctgaaaaataacaggatcaaacagctggaaggcatcttgcggtcccacgatctcccaactagcgagcagcttaaggatgtcgcttacggtacacggcccctctctctgtgtttagaaaccttaccagctcacggcgacgaagataaggtggatattagccttttacaccagggagagaatctgtttgaactgcacattcaccaagcctttctaaccagtgctgccctggcccaggccggagacacccagcccactacgttctgcacctactcgttttacgactttgagacacactgtactcccctgtctgtggggcctcaaccattgtatgattttacttcccaatatgtgatggaaaccgatagtctgtttctgcattaccttcaggaggctagcgcccgcctggatattcaccaggcaatggccagtgagcactccacactcgcagctgggtggatctgcttcgatcgtgtacttgagacagtagaaaaggtacacgggctcgcaacacttatcggcgccggcggtgaggaatttggagtcctagaatattggatgaggctaaggtttcctattaagcccagcctgcaggcttgcaacaaaaggaaaaaggcccaggtttatcttagtacagatgtgcttggcggcaggaaagcgcaggaggaggagtttcgaagcgagagctgggagccacagaatgaactttggatcgagatcaccaaatgctgtggcctgaggtccaggtggctcggtactcagccctctccttacgctgtttacagatttttcacatttagcgatcatgacacagccattatccccgccagcaataacccgtacttccgcgatcaggcacgttttccagtgctcgtgacctctgatctagaccactacctgcgccgggaagcactgagtatacacgtgtttgacgatgaggacctagaacctgggagctacttgggcagggcccgggtgcctctgctgccacttgccaaaaatgagagtataaagggcgatttcaacctgacagatccggccgagaagccgaatggcagcatccaggtccagctcgattggaaattcccctatattcctcccgagagttttctgaaaccggaagctcaaactaaaggaaaggatacaaaagattcaagcaagatctccagtgaggaggagaaggcaagtttcccttcccaagaccagatggcatcccctgaggtcccaatcgaggcaggtcagtatcggtcaaagcgtaaacctcctcatggaggggaaagaaaggagaaggaacaccaggtcgtctcttattcacggcgcaagcatggcaaacgcattggtgtgcaggggaagaataggatggagtatttgtccttgaacattttaaatggtaacactccggagcaagtcaactacactgaatggaaattttccgagacgaacagtttcataggagatggcttcaagaatcaacatgaagaagaagagatgactttgtctcactccgcactgaagcaaaaagagccactgcaccccgtgaatgacaaggagtcatccgaacagggctctgaagtcagtgaagcacaaaccacggatagtgatgacgtgatcgtaccaccgatgtcccaaaaatatcccaaagcggacagcgaaaagatgtgtatcgaaattgtgtccttagccttctatcctgaggcagaggtgatgtcggatgagaatattaaacaggtctatgtggagtacaagttctatgatctgcctctgtctgagacagagaccccagtctcgctgaggaagcctagggctggggaagaaattcacttccatttttcgaaagttatcgacctcgaccctcaagagcagcagggcaggcgaaggttcctatttgacatgttgaatggtcaagaccctgaccagggccacttaaaattcacagttgtgagtgatccattggatgaggaaaaaaaggaatgtgaagaggtgggttatgcctatctgcaactgtggcagattcttgagtcggggagagacatcttggaacaggagctagacattgtgagccctgaggatctcgccaccccaatcgggagattgaaagtgtcccttcaggctgcagcggtgctccacgctatatataaagaaatgaccgaagatcttttctcctag

SEQ ID NO: 138356 - DNA, 1128 bp, Artificial Sequence
  Description of Artificial Sequence: Synthetic coding sequence
atgaaacgtccagatcttcctagcggatttgacggttggcaggtcgttgatgctaccccccaagaaacctcatctggcattttttgttgcggcccctgttcagtcgagtctatcaaaaacggattggtgtatatgaagtacgacaccccatttatctttgctgaggtgaattcagataaagtttactggcagagacaggacgacggaagctttaagatcgtctacgtggaagaaaaagcaatcggaacccttattgtgaccaaggcaatctcctctaacatgcgcgaagacataacttacctctacaagcacccagaagggagtgacgcagaacggaaggcagtcgagactgccgcggcccatgggtccaagccgaatgtttatgcaaacagaggtagcgccgaggacgttgcaatgcaggttgaagctcaggacgcggtgatgggccaagatctgatggtgagtgtaatgctcatcaaccactcatctagccggcgtacagtgaagctgcacctgtacctatctgtcactttctatacgggtgttagcggcacgatctttaaagaaaccaagaaagaggtcgagctcgcacctggcgcttccgaccgcgtgaccatgccagtggcgtataaagaatatcgccctcacttggtggatcagggggctatgcttctcaatgtgtccggacatgtcaaggagagtggtcaagttctggctaagcagcatacctttcggctgagaacacccgacctctcccttacgcttctgggcgctgcagtggttggacaggagtgtgaggtccaaattgtgtttaaaaaccctcttcctgtcacacttaccaatgtagtattccgcttggaaggctctggattacaacgcccaaagatattgaatgtgggtgatattggtggaaacgagactgtgacccttagacagtcctttgtgcctgtgcgccctgggccccgccaactaatcgccagccttgatagtccccagctctctcaggtgcatggagtcattcaggtggatgtcgcacctgcccccggagatgggggattctttagcgacgccggaggagattctcacttgggggaaaccattcccatggccagcagaggaggtgcttag

SEQ ID NO: 138357 - DNA, 408 bp, Artificial Sequence
  Description of Artificial Sequence: Synthetic coding sequence
atgatggatggaccccggtctgatgttggccgctgggggggcaacccactccaaccaccaaccactccttcccctgagcctgagcccgaacccgatggccgctcgagacgcgggggcggacgtagtttttgggcgcgctgctgtggatgttgctcttgtcgcaacgccgcggatgatgattggggacccgagcccagtgattctcggggacggggcagcagttccggaactaggcggcccggctcaagggggtccgactccaggcggcccgtgtcacgcggaagcggagtgaacgccgcaggagacgggaccatccgggagggcatgctggtagtgaatggcgtggatctgttgtcatctagatccgaccaaaatcgaagagagcaccacactgacgagtacgagtag

SEQ ID NO: 138358 - DNA, 129 bp, Artificial Sequence
  Description of Artificial Sequence: Synthetic coding sequence
atgatggacggccctcggagcgacgtcggccgatggggaggcaaccctctgcagccccctacaaccccgtcccctgagccagaacctgaaccagacggaagatctcgccggggcggtggtagatcctag

SEQ ID NO: 138359 - DNA, 198 bp, Artificial Sequence
  Description of Artificial Sequence: Synthetic coding sequence
atgatggacgggcctaggtcggatgtgggaaggtgggggggaaatccattgcagccccccactactccttcacccgaacccgagcctgagccagatggccgatctagacgaggcggcggccgatcattttgggcacgatgttgtggctgttgttcctgccgcaatgccgctgacgatgactggggaccagaaccctag

SEQ ID NO: 138360 - DNA, 153 bp, Artificial Sequence
  Description of Artificial Sequence: Synthetic coding sequence
atgatggacggtcctcggtccgacgtgggcaggtggggcggcaacccactgcagccccccacaacgccctcaccggagcccgaaccagaacctgacggtcgctcccgccgtggcggtggccgaagtttctgggcacgttgctgtggctgttag

SEQ ID NO: 138361 - DNA, 30 bp, Artificial Sequence
  Description of Artificial Sequence: Synthetic coding sequence
atgatggatggacctagatccgacgtctag

SEQ ID NO: 138362 - DNA, 2064 bp, Artificial Sequence
  Description of Artificial Sequence: Synthetic coding sequence
atggctgaggagttagtgctcgaaaggtgcgacttggagctggagactaatggacgcgaccaccataccgccgacttatgtcgtgagaagctcgttgtacggcggggccaacccttttggcttacactgcactttgagggacgcaattacgaggctagcgtcgactctctgactttcagcgtcgttaccggccctgcccccagtcaggaagccggcactaaggcccgcttccctctgagagacgccgtggaggagggcgactggacagccacggtggttgatcaacaggactgtacactgtcactccagctcactactcccgcgaatgccccaattgggttatacaggttatcactagaggcctccacaggctaccagggttcctccttcgttctgggacactttattctcctgttcaatgcctggtgccctgcagacgctgtgtatctcgactcagaggaggaacgccaggagtatgtgctgactcaacaaggatttatctaccaaggatcggcaaagttcataaagaatatcccttggaacttcggacagtttgaagacggtattttggatatctgcctgatcctgctggacgtgaatccaaagtttttaaaaaatgctggacgcgactgctctcgtcgctcatccccagtctacgtcggccgcgtagtgtcgggtatggtgaattgcaacgacgaccaaggggtgttgctcggccgatgggataataactatggcgacggagtttccccaatgagctggatcgggagcgtcgatattctccgtagatggaagaaccatggctgtcagcgagtgaagtatgggcagtgttgggtatttgcagcggtggcctgcaccgtgttgcgctgtctcggcattcctacaagggtggtgacgaattacaattctgcccacgaccagaactcgaacctgctgatcgaatattttagaaatgagttcggcgagatccaaggggacaagtccgaaatgatctggaactttcactgctgggtggaatcttggatgaccagaccggacttgcagcccgggtatgaagggtggcaggctctggatcccacgccccaagagaagtccgagggtacatactgttgcggccctgtgcccgtccgggctattaaagaaggcgacctgagcactaaatatgacgctccctttgttttcgctgaagtgaacgcagatgtcgtggattggatccagcaagatgatggttcagttcataagtctataaaccggtccctcatcgtgggcttgaagatttctaccaaatccgtggggagggacgagcgcgaggatatcacacacacctacaagtatccggaaggtagcagtgaagagcgagaggcctttacacgtgcgaaccatcttaacaagctcgccgagaaggaggagaccggtatggccatgagaattagggtgggccagtcaatgaacatgggcagcgactttgatgttttcgcccatatcaccaataacacggccgaagagtacgtttgtcgattactgctgtgtgctagaacagtctcatataacggaattctggggccagaatgcgggaccaagtacctcctgaatctaaatttggagcccttctcagaaaagtctgtccctctgtgcatcctgtacgagaaataccgcgattgtttgacggaaagcaatctgatcaaggtgagggccctactggtcgagccagtcattaattcctatctgttggccgagagggatctctacctggaaaatccggaaatcaaaataaggattttaggggagccgaagcaaaagcgtaaacttgtggccgaagtgagcctacaaaacccactcccagtggccctagagggatgcacctttaccgttgagggtgccggcttaacagaggaacagaagacggtggaaatcccggaccctgttgaggccggcgaggaggtaaaagttcggatggatttattgcctctgcatatggggctgcacaagttggtcgtcaacttcgagtccgataagctaaaggctgtgaagggcttcaggaacgtcatcatcggccccgcctag

SEQ ID NO: 138363 - DNA, 846 bp, Artificial Sequence
  Description of Artificial Sequence: Synthetic coding sequence
atggcggaagagctggtattggaaagatgcgatctcgagctcgagacaaacggtcgcgatcaccacacagcggacttatgccgcgaaaagctagtagtgcgtcgcgggcaacctttctggcttactctacattttgagggacgtaattacgaagcatctgtggattccctcaccttctcagtggtaactgggccagcccctagtcaggaggccgggaccaaagcacggtttccgctgagggatgccgttgaagagggggactggacggctaccgttgtggaccagcaagattgcactctgtccctccagttgactacacctgcaaacgcccccatcggtctttatcgcctcagcctggaggccagcactggttatcagggctccagctttgtacttggccactttattctgttatttaatgcctggtgtcccgcagacgcggtgtatcttgacagtgaagaggagaggcaggaatacgttctaacacagcagggattcatataccaaggatcggccaagttcatcaagaatatcccgtggaacttcgggcaatttgaggacggaattcttgacatttgtctcattctcctcgacgtgaacccgaagtttctgaagaatgcaggcagggactgcagtcgacgcagcagcccggtctatgtgggccgggtcgtgagtggtatggttaactgtaacgatgaccagggagttctgctgggacgatgggacaataactacggagacggcgtgtcaccaatgtcctggattgggtctgtagatatattgaggcgctggaaaaatcacggctgtcaacgagtaaaatacggacaatgctgggtgttcgcatag

SEQ ID NO: 138364 - DNA, 483 bp, Artificial Sequence
  Description of Artificial Sequence: Synthetic coding sequence
atggcggaggaactggtgctcgaacgttgtgatctggaattggagactaatggtcgggatcaccacaccgccgacttatgcagggagaaacttgtcgtgcgccggggtcagccattctggctcacgctgcactttgagggaaggaattatgaggcctctgtggacagtctgacattttccgttgtgacgggccctgccccctcacaggaagcggggacaaaagccagatttcctctgagagatgccgttgaagagggagactggaccgccaccgtggtggatcagcaagattgtactctttcactgcaactgacgaccccggccaatgccccaatcgggctctatcgactgtctcttgaagcctcaaccgggtatcagggaagctcattcgtgctgggtcatttcatcctacttttcaatgcgtggtgccccgctgacgccgtgtacctcgattcagaagaagaaaggcaggagtacgtgtag

SEQ ID NO: 138365 - DNA, 1821 bp, Artificial Sequence
  Description of Artificial Sequence: Synthetic coding sequence
atggcagaggagttagtgctcgaaagatgcgacctggagctggagacaaatggtagagaccaccacactgccgacctctgtcgggaaaagcttgttgttcgaagaggacagccattttggttgacactccacttcgaagggcgaaattatgaagctagcgtggattccttgacctttagcgtcgtaacagccgacgccgtgtacctagactctgaggaggaacgtcaggagtacgtgctaactcagcagggtttcatctatcaagggagtgctaagttcattaagaacataccctggaatttcggccaattcgaggacgggattctagacatttgcctgattctactcgacgtcaatccaaagttcctgaagaatgccggtcgagactgcagcagacgcagctctcctgtctacgttggaagggttgtgtccggaatggtaaactgtaacgatgatcagggcgtcctgctcgggagatgggacaacaattatggggacggcgtgagtccgatgtcttggatcggctcggtcgacattctgcggcggtggaagaaccacggctgtcagcgagttaagtatgggcagtgctgggtattcgctgcagttgcctgtactgtcttgcggtgcttggggattcccacccgcgtggttactaattacaactccgcacatgaccaaaatagcaatctgcttattgagtactttagaaatgagttcggggagatccagggtgacaagtctgagatgatttggaacttccactgctgggtggagagctggatgactcggcctgatctgcagcctggctatgaaggctggcaggcactcgatcccacaccccaagaaaaaagcgaagggacatactgttgcggacctgttccagtgcgagcaatcaaggagggggatcttagcacaaaatacgatgctcctttcgtcttcgctgaagtgaacgccgatgtggtggattggatccagcaggacgatggaagtgtgcataaaagcattaaccgcagcttaatcgtcgggttgaagatcagtactaagagtgtcggcagagacgaaagagaagacattacacatacctacaaatatccggagggcagctcggaggagagagaagctttcaccagggccaaccatctcaataagctggcagagaaagaagagacgggcatggccatgcggatccgcgtgggccaatctatgaacatgggctctgacttcgacgtgttcgcccatattactaacaatacagcagaggagtatgtatgcagactcctgctgtgtgcacgcacagtttcatacaatggcattctagggcccgagtgtggcaccaaatatctgctgaacctgaacctggagccattcagtgaaaagtccgtcccattgtgcattctctatgagaagtatagggactgtctaaccgaatcgaaccttatcaaggtgcgcgctctgcttgttgagcccgtaataaactcttacctcttagccgagagagatctttatctagagaatcccgagattaagatccgaattttaggagaacctaaacagaagcggaaactggtagccgaggtgagtctgcagaaccctctgccagtggcattggaaggatgcacctttacagtagaaggcgcaggcctgaccgaggagcagaaaaccgtagaaatcccggatccagtggaggccggtgaggaagttaaagttcgcatggacttgctgccactacatatgggcctccacaaactagtggtcaatttcgagtccgacaagctcaaggctgtgaaaggttttagaaatgtgatcattggacccgcctag

SEQ ID NO: 138366 - DNA, 1884 bp, Artificial Sequence
  Description of Artificial Sequence: Synthetic coding sequence
atggcagaaggccccgcaccttcccaggaagctggcacaaaggcccgattcccattacgagatgctgttgaggagggggactggacagcaacggtagtcgatcagcaagattgtactctgagcctgcaattgactacccccgccaacgcccctatcggactttacaggcttagcctggaagcaagcacggggtaccagggaagttccttcgtgctcggacatttcattcttttattcaatgcttggtgtcccgccgacgcggtgtatcttgactccgaagaagagcgtcaggaatatgtcttaactcagcagggtttcatctaccagggtagtgccaagttcattaagaacatcccttggaattttggccagtttgaggatggaattctggatatctgcctgatactgctggatgtaaacccaaagttcctgaagaacgccgggcgggactgcagcaggcggtcgagccccgtgtatgtaggaagggtcgtatcaggtatggttaactgcaatgatgaccagggcgttctgctgggcaggtgggacaacaattacggcgacggcgtttccccgatgtcctggatagggagcgtggatatcttgcgtagatggaagaaccacgggtgccagagagtcaagtacgggcaatgctgggtgttcgccgccgtggcttgcacagtactccgatgcctgggaatccccacaagagtggtgacaaattataatagcgctcacgatcagaactctaatctcttaatagagtactttaggaacgagttcggagagatccagggcgacaagtctgaaatgatatggaactttcattgctgggtggagagctggatgactagacccgacttacaaccaggttatgaagggtggcaggcgctcgatccaactccccaggagaagtcggagggaacatattgctgtggacccgttcccgtgagagccatcaaggaaggcgacttgtccactaaatatgatgcaccctttgtgttcgccgaagtaaacgccgacgtagtcgattggatccaacaggacgatgggtctgtacataaaagcataaataggtcattaatcgtcggcctaaagatttctaccaagagcgtcggccgtgatgagagagaagatattacccatacgtataagtacccggagggttctagtgaggagcgcgaggcattcactcgcgccaatcatcttaataagttggctgagaaggaggagaccgggatggcaatgcgaatccgggtcggccagtccatgaacatgggcagtgacttcgacgtgtttgcccacattacaaacaatacagcagaagagtatgtgtgtagactgttactatgtgcccgcactgtgtcatacaatggcatcttggggcctgaatgcggaactaagtatctcctgaatctaaacctggagccgttctctgagaagtctgtgccactatgcatcctttacgagaagtaccgcgattgcctgaccgagagcaaccttatcaaagtccgggctcttctagtcgagccggtaatcaatagctatctgctcgccgagcgcgatctgtacctcgagaaccctgaaatcaagatcaggatcctgggcgaacctaagcagaaacggaaattggtcgctgaggtgagtctccagaacccactgccagtggctctggaagggtgcacgttcaccgtggaaggggccgggctgaccgaagagcagaaaaccgtggagatcccggatcccgtggaagctggagaagaagtgaaggtccggatggaccttctgccactacatatgggacttcacaagctggtggtcaactttgagagcgacaagctcaaggccgtgaaaggattccgcaacgtcatcattggacccgcttag

SEQ ID NO: 138367 - DNA, 2082 bp, Artificial Sequence
  Description of Artificial Sequence: Synthetic coding sequence
atggctgctctgggagtgcagtccattaactggcaaaccgcatttaataggcaggcccaccataccgataagttctcttcgcaggagctgatcctgagacgcgggcaaaattttcaggtgctgatgatcatgaacaagggcctgggttccaatgagcggctagagtttattgtcagcaccggcccgtacccctccgagagtgcaatgacgaaagctgtctttccgctgagcaatggctcttctggcgggtggagcgccgttctgcaagcctcaaacgggaataccctgaccatctctatatcatctcccgcgagtgcccccattggcaggtacacaatggcacttcagatcttctcgcaggggggaatcagctccgtaaaactgggtaccttcatactgctttttaacccctggctcaatgtggacagcgtgttcatggggaaccacgctgaacgcgaggagtatgtccaggaggacgctggaatcatcttcgtgggatctacaaatcggattgggatgattgggtggaacttcggacaattcgaggaggacattcttagcatctgtctgtcaatcttggaccgttcacttaacttccgtagagacgctgctaccgacgttgcatcgcgtaacgaccctaagtacgttgggcgggttttgtctgcaatgattaattcaaatgatgacaacggggtcctcgctggcaattggagcgggacgtacaccgggggacgcgatccacggtcctggaatggtagcgtggaaatactgaagaattggaaaaaatcagggttttcaccggtaagatatggccagtgctgggttttcgcaggaaccctaaacacagccctgcgctccctcggaatcccctcccgggtgatcactaactttaactctgctcacgacacagatagaaacttgtcagtggatgtctattatgacccgatgggtaaccccctggataaaggcagcgatagcgtgtggaacttccacgtttggaacgaggggtggtttgtgcggtccgatctgggaccgagttacggcggatggcaggtgctagacgcaaccccacaggaacgcagccaaggcgtgttccagtgcggccccgcctctgtcatcggtgttagggagggagacgtgcagttgaattttgacatgcctttcattttcgctgaggttaacgccgatcgcattacttggctctacgacaacactacaggcaaacagtggaaaaactctgtgaacagccatactataggacgctatatctccacaaaagctgtgggctccaatgcacgcatggacgtaaccgacaaatacaaatacccagaagggagcgaccaagagagacaggtattccagaaggcgctaggaaagcttaagccaaataccccatttgccgctacaagtagcatgggactcgaaacggaagaacaagagccaagcattattgggaagctgaaagtggccggcatgctggctgttgggaaggaagtcaacctggtactactgctgaagaacctctctagggacacaaagaccgtgactgtaaatatgaccgcgtggaccatcatctataacgggacactggtgcatgaggtgtggaaggattccgcgaccatgtctttggacccggaggaggaagccgaacacccaataaaaatcagctatgcccagtatgaaaaatacctcaagtcggataatatgatcaggattacagctgtgtgcaaagtccctgacgagtctgaggtggttgttgaaagagatattatactggacaatcccaccctgactcttgaggtgctgaacgaggctcgcgttagaaagccagtcaacgtacagatgttgttcagcaaccctctggacgagcctgtacgggactgtgtgctaatggtggaaggatcaggccttctcttgggcaatttaaagatcgatgttcccactctgggccccaaggagggctcgagagttcgtttcgatatcctcccctccagaagcggaacgaagcagctgcttgctgacttctcgtgtaataagtttcctgccataaaagccatgctgtccattgatgtcgctgaatag

SEQ ID NO: 138368 - DNA, 1602 bp, Artificial Sequence
  Description of Artificial Sequence: Synthetic coding sequence
atggctgctctcggcgtgcagagtattaactggcaaactgctttcaacaggcaagcacatcatactgacaagtttagttcacaggagttgattctgcgaagggggcagaattttcaagtgctgatgattatgaataaaggcctcggctctaacgagcgcctagaatttattgtctctaccggcccctacccttcagagagcgccatgacaaaggctgtgtttccactgtcgaacggcagctccggtggatggagtgccgttctgcaggcgagcaatggcaacacactgactatctctatcagcagccctgcctcggcaccgatcggacgttacaccatggctctgcagatcttttctcagggcggtatctcaagtgtaaagttgggcacatttatactgctttttaacccctggttgaatgtggatagtgttttcatgggcaaccacgctgagcgagaggagtacgtgcaggaagacgctggtatcatctttgtgggctcaaccaatcgaattggaatgattgggtggaactttggccagtttgaagaggacatcttgtcaatctgcctgtccattcttgacagatccctgaattttcggcgggatgctgccactgatgtcgccagtcggaatgatcccaagtatgtcggtcgtgtgctgtcagccatgatcaattctaatgacgataatggagtgctggctggaaattggagtggcacatatactggcggccgcgaccccagaagctggaacgggagcgtggaaatcctcaaaaattggaaaaagtccggctttagtcctgtgaggtatggtcagtgttgggtgttcgctggaactctgaacacagccctgcgatccctaggaatcccatcaagagtaataactaactttaattctgcacacgacactgaccgaaacctcagtgtggacgtgtactacgaccccatgggtaatcccttggacaaaggctccgatagcgtatggaatttccatgtgtggaatgaggggtggtttgtccgttccgatctgggaccctcctacggtgggtggcaggtccttgacgccacgcctcaggaacgcagccaaggggtgtttcaatgtggccctgcaagtgtgattggggtgagggaaggagacgtacagcttaatttcgatatgccatttatctttgccgaagttaacgcagacaggataacctggctttacgataatactaccggcaagcaatggaaaaactcggtgaactcacatactattgggcgctacatttcaacgaaagcagtggggagcaacgctagaatggacgtgacagacaagtacaagtatcccgaggggtcagaccaggaaagacaggtgtttcagaaggccctaggcaagttaaaacccaacactccctttgccgccactagctccatgggtctggaaacagaggagcaagagccatctatcatcgggaagttaaaagtggcaggcatgctggcggtcggaaaagaggtgaatctcgtcctcctgcttatcccgcacgcactccagtgctgtcggatggattggcctctcacgcaaggtctgagcaagcgtgatacaggggagaagttagtgtag

SEQ ID NO: 138369 - DNA, 2055 bp, Artificial Sequence
  Description of Artificial Sequence: Synthetic coding sequence
atgatggatgcatcaaaggaattacaggtattgcatattgactttctcaatcaggataatgctgtcagtcaccatacgtgggaatttcagacctcgagcccagtgttccgaagaggtcaggttttccacctgagattggtgctaaaccagccgctgcagagttatcatcaactaaaactggaattttcaactggcccaaacccgagcattgcgaagcacaccttggtagtactcgaccctaggacgccatctgatcattataactggcaggcaaccctccagaatgaatctggaaaagaggtgaccgttgccgtgaccagtagccctaatgccattcttggcaagtaccagctgaatgttaaaacaggaaaccacatcctgaagtctgaggagaacatactctacctgctctttaatccttggtgcaaggaggatatggtattcatgcccgacgaagatgaaaggaaagaatatatcctgaacgacaccgggtgccactacgtgggcgcggctagatcaatcaaatgtaagccctggaattttggacagttcgaaaagaacgtcctggactgctgtatttccttgcttaccgagtccagtttaaaaccaaccgatagaagagaccctgttttggtatgcagggccatgtgtgctatgatgtcgtttgagaaagggcagggcgttctcatcggcaactggacgggtgactatgaaggagggactgcaccctataaatggacagggagcgcaccaattcttcagcaatactataataccaagcaggccgtctgctttggccaatgttgggtctttgcaggcatactaaccacagtcctccgagccctggggatacccgcacggtctgtgacgggctttgattctgcccacgatacggaacgaaacctgaccgtggacacctatgtgaacgagaacggcgagaaaatcacgtctatgactcacgactctgtttggaatttccatgtgtggaccgatgcttggatgaagaggcctgaccttccaaagggttatgacgggtggcaagccgtggatgctaccccccaggagaggtcgcagggcgtgttctgctgtggccctagcccgctgaccgccatccgtaagggagacatatttattgtgtacgatacgcgttttgtattctcagaggtcaatggcgatcggctgatctggctagtgaagatggttaacggacaggaggagctccatgtaataagcatggagaccacatcaatcgggaaaaatatcagcaccaaggcagttgggcaggatcggcgccgtgacataacatatgagtacaaataccctgagggtagcagcgaggaacggcaggtcatggaccatgctttcctgctgctttcctctgaaagggaacacagaaggcccgtcaaggaaaattttctgcacatgagcgtgcagagtgacgatgtactgctgggcaacagcgttaactttaccgtaattctcaagcgcaaaaccgcggcgcttcagaacgtgaatatactgggaagcttcgagctgcaactgtacaccggtaaaaagatggccaaactgtgcgacttaaacaagaccagccagattcagggtcaggtctcagaagtgacgctgaccttggattctaagacatatatcaacagccttgcaatcctcgacgacgagcctgtcatcagagggtttattattgcagagattgtcgagtcaaaagaaattatggcctccgaggtttttaccagtttccaatatcccgagttttcaattgaactgcctaataccggacggatcgggcaattgctggtgtgcaattgtatattcaaaaataccctcgcgattcctttgactgatgttaaattctcactcgaatcattaggtattagtagccttcagaccagtgatcacggcacggtgcagcccggggagaccatacagtcacaaatcaaatgtacgcccatcaaaactggtcccaagaagtttatcgtgaagcttagtagcaagcaagttaaggagatcaatgcccagaagatagtactgattaccaaatag

SEQ ID NO: 138370 - DNA, 1626 bp, Artificial Sequence
  Description of Artificial Sequence: Synthetic coding sequence
atgttctcctggatggggagacaagcgggcgggcgcgagagagctggaggcgccgacgcagtccagacggtgaccggaggactaaggtctctgtacttgcggaaggtcttgcccctggaagaagcgtaccgcttccatgagtttcactcccccgctcttgaggacgcagatttcgaaaacaagccaatgattttgttggtgggccagtattctacgggaaagacaaccttcatccgatacctcttagaacaagacttcccaggtatgcggatcggacctgagccaactaccgatagctttatcgctgtgatgtatggggagaccgagggctccacacccggcaatgctctggtcgtggatccaaagaagccatttagaaagctgtctaggttcgggaacgccttcctaaacagatttatgtgtagccagcttccgaaccaggtactcaagtccatctcggtgatcgacagtccaggaattctaagtggcgaaaagcaacgcatctccagaggctacgatttctgccaggtcctgcagtggtttgcggaacgagtggaccgcattatcttgcttttcgacgcccataaacttgatatctccgacgagttctcggaggcaatcaaggcattccggggacaggatgataaaattagagtggtgcttaacaaggcggatcaggtggacacccagcagttgatgagggtgtacggagctctgatgtggtcgttaggaaaggtcatcaacactcccgaagtgctgcgagtgtacatcgggtccttctgggctcaacccctgcaaaataccgataaccgcaggttgttcgaggccgaagcccaggacctgtttcgggatattcagtcgctgcctcagaaggccgctgtacgcaaattaaacgacctgattaagcgggcacggcttgcgaaagtacacgcctacatcatctcttacctgaagaaggaaatgcctagcgtttttggaaaagagaacaagaagcgcgaactcataagtcgccttcccgaaatttatatccagctgcaacgtgaatatcaaatttcagctggagattttccagaggtgaaggccatgcaggaacagcttgaaaattacgactttactaagttccactccctcaagccaaaattgatagaggccgtggacaacatgttgtcgaataaaatttctcccttaatgaatctgatctcccaggaagaaacctcaactccaacgcagctggtgcagggaggagccttcgacgggactactgagggtcctttcaaccaggggtatggcgaaggagctaaggaaggggcagatgaagaagaatgggtagtggccaaagataagcccgtttacgatgaacttttctacacgctgtcacctattaatggcaaaataagcggcgtgaacgctaagaaggagatggtgaccagcaagcttcccaatagcgttctgggcaagatttggaagttggctgattgtgattgtgatgggatgttagacgaggaagagttcgccctcgctaagcacctcatcaaaatcaagcttgatggatatgaactcccttcctccctgcccccccatctcgtgcccccctctcacaggaagtccctcccaaaggctgattag

SEQ ID NO: 138371 - DNA, 1917 bp, Artificial Sequence
  Description of Artificial Sequence: Synthetic coding sequence
atggcccagggcctagaagtggccttaacagacctgcagtctagcagaaataacgtgaggcaccacactgaagagataaccgttgaccacctcctggtgcgcaggggccaggccttcaacctcacgttgtatttccgaaacaggtcctttcagcccggactcgataatatcatattcgtcgttgaaacggaggacgctgtctacctcgattcagaaccccagcgtcaggaatacgtcatgaacgattatggcttcatttaccaaggttcaaaaaactggatccggccgtgtccttggaactacggccagtttgaggacaagatcatcgatatctgcctgaagttgttggataagagtttgcacttccagacagacccagccaccgactgtgcactgcgtggatccccagtgtatgtgtcgcgcgtggtgtgtgccatgataaattcaaatgacgacaatggggtccttaatggaaactggtccgagaattatacagacggggcgaatcccgcggaatggactggatccgtggctatcttgaagcagtggaacgcgacagggtgtcagccagtacgctacggacagtgctgggtgttcgccgcggtgatgtgtacagtgatgcggtgtttgggtatcccaacacgcgtgattactaacttcgacagtggccacgacaccgacggcaatctgataatcgatgaatattacgataatacagggcgtatcttgggaaataagaaaaaagataccatctggaactttcacgtttggaacgagtgctggatggcgcggaaagacctccctcctgcctacggcgggtggcaggttttggacgccaccccacaggaaatgtccaatggggtgtattgctgtggtcccgcaagtgtgagggctatcaaggagggggaggtagacctgaactacgacactccttttgtcttctcaatggtgaatgccgattgcatgtcctggctcgtccagggaggcaaagaacagaagctgcaccaagacacttcttctgtcggcaattttatttccaccaagtcgatccagtccgacgagcgcgatgacatcactgagaattacaagtacgaagagggtagcctccaggagaggcaggttttcctgaaagctctgcagaagttaaaagctcgctcttttcacgggagccagcgcggcgccgaattacaaccaagccggcctacgtctctctcgcaggacagcccaaggagcttacacactcctagtttacgacccagcgatgtcgtgcaggtgtctctgaaattcaagctactggatccccctaacatgggccaggatatttgtttcgtactccttgctctcaacatgtctagccagttcaaggacctaaaggtgaacctaagcgcacagtcacttctgcatgatgggtcccctctgagccctttttggcaggacactgcctttataactctgtcccctaaggaggccaaaacatacccatgcaagatcagttattctcagtactcccagtacctgagtactgataagctgatacgcatttcagcattgggcgaggagaagagcagccccgaaaaaatactggtaaataagatcattacccttagttaccctagtattaccatcaacgtcctcggagccgccgtggtgaatcaacccctttccattcaggttatttttagtaaccccctcagtgaacaggtcgaagattgtgtgctgaccgtggaagggagcgggttattcaaaaagcagcagaaggttttcctaggagttctaaagccacaacaccaggcaagcattatcctcgagacagtgccctttaaaagcggccagcgccagatccaggcaaacatgcgaagcaacaaatttaaggatattaagggataccgaaacgtgtatgtggattttgccttgtag

SEQ ID NO: 138372 - DNA, 2160 bp, Artificial Sequence
  Description of Artificial Sequence: Synthetic coding sequence
gcccagggtctggaagtggctctgaccgaccttcagtcgagcaggaataatgtcaggcatcacaccgaagagatcactgtggatcatctgctggttaggcgcgggcaagctttcaaccttacactgtatttccgcaacaggtcattccagccaggtctggataacattatcttcgtagtggagaccggtccccttccagacttggccctgggcactcgagctgtgttttcactggcacgccaccactccccttctccttggattgcctggctggagactaacggagccaccagtactgaggtctccctgtgtgcccctcccacggccgctgtgggtcgctacctgctcaaaattcacatcgattcttttcagggaagtgtcacggcctatcagctgggggaatttattttgctgtttaacccatggtgtcctgaggatgccgtctatctggattcggagcctcagcgccaggaatatgtcatgaacgattatggctttatctaccaaggtagtaagaattggatacggccttgtccttggaactacggacaattcgaggataagattatagatatttgtttgaagcttctggacaagtcgctacatttccagacggacccggccactgattgtgctctgcggggatcgcccgtgtacgtcagcagagtagtgtgtgctatgatcaacagcaacgatgacaatggcgtcctgaacggcaattggagcgagaattacactgatggcgccaaccctgcagagtggaccggatcagtagctattttaaaacagtggaatgctactggatgccaaccagtgcgatatggtcagtgttgggttttcgcagcagtcatgtgtaccgtaatgagatgtctgggcattcccacccgcgtcatcaccaatttcgatagcggccatgataccgacggaaacttgatcattgacgaatactatgacaacactgggcgtattttaggtaataaaaaaaaagacactatatggaattttcacgtctggaacgagtgctggatggcgcggaaggacctgcctccggcatatggcggttggcaggttctggatgccacccctcaggagatgtcaaacggcgtgtattgctgcggtcccgccagcgtgagggctatcaaggaaggtgaggtggacttgaactacgataccccctttgtgttttccatggtcaatgccgattgtatgtcatggctggtacaaggagggaaggagcagaaactacaccaggatacaagttccgttggcaattttatttcaacaaagtccatacaatctgatgagagagacgacatcaccgagaattataagtatgaagaaggctcattacaagaacgccaggtttttctcaaagccctgcagaagctcaaagcgcgatcattccatggctcccagcggggggccgaactacagccaagtagacccacatccctgagtcaggattcgccccgttctttgcacaccccaagcctcagaccctccgatgttgtccaggtcagcctgaaattcaagctcctcgatccacccaacatgggacaggacatttgttttgtgctccttgccctcaatatgtcctcccaattcaaggacctcaaagtgaatctgtcagcacaatccctgttacatgacgggtcccccctctctccattctggcaagacacagcttttattacgctgtcccctaaagaagccaagacttatccctgtaagatcagttactcacagtactcccagtacctgtccactgacaagctgattaggatcagtgctttgggggaggaaaagtcctctcctgagaaaattcttgtaaataaaatcataaccctcagctatccctctatcacaataaatgtgctgggagccgctgttgtgaaccaaccactgtctatacaggtcattttttccaaccccttatctgagcaggtggaggactgcgtgctcacagtggagggttcagggctgtttaagaagcagcaaaaggtgttcttgggagtactcaagcctcagcatcaagcttccattatcctcgaaactgtgcctttcaagagtggccagaggcagatccaggccaacatgagatctaacaaatttaaagatataaaagggtatcgcaatgtttatgtggattttgccttgtag

SEQ ID NO: 138373 - DNA, 2121 bp, Artificial Sequence
  Description of Artificial Sequence: Synthetic coding sequence
atggcggggatccgcgtgactaaagtcgactggcagcggtcccgtaacggcgcggcccaccatacgcaggaatacccatgcccggagttggtcgtgcgccgcggtcaatctttttccctgaccttggagctgagcagggccctcgattgcgaggaaatccttatattcacgatggaaaccggcccacgggcctcggaagccttgcacacaaaggctgtgttccaaaccagcgagttggaacgcggggaaggttggacagcagctagggaagcacagatggagaagactctcactgtctcccttgcgagtcccccctctgccgtaatcggaaggtacctgctctcaatcaggctcagcagtcaccgcaagcattccaatcgccgcctgggagagttcgttctgttgtttaatccatggtgcgctgaagatgatgtgttcctcgcttccgaggaggagaggcaggagtatgtactgagtgatagtggtattattttccgcggagtcgagaaacacatcagggctcagggttggaattacggacagttcgaggaagatattctgaatatttgtttatccattttggatcggagcccggggcaccaaaacaatcccgcgaccgatgtgtcatgcagacataacccaatctatgtgactcgcgtgataagcgccatggtaaatagcaacaatgataggggagtagtgcagggtcaatggcagggcaagtatggcgggggaacctcgcctctgcattggcggggtagcgtggccattctgcagaagtggttaaagggtagatataaacccgtaaagtatggtcagtgctgggtgtttgcaggggtgctttgtaccgtgttgagatgcctgggcatcgccacccgcgtagtatccaactttaacagtgctcatgacaccgaccagaacctaagcgtagacaagtacgtcgattcattcggtaggaccctggaagacctgacagaagattccatgtggaatttccacgtctggaacgaatcatggttcgcccgccaggatctgggccctagctataacggatggcaagttctggatgccactcctcaggaggagtccgaaggggtcttcaggtgtggacctgccagcgttacagcaatacgggaaggagatgtgcacctcgctcacgacggtcccttcgtcttcgctgaggtcaacgctgactatatcacctggctgtggcacgaagatgagagccgggagcgcgtatattctaacactaagaagattgggcgctgtatcagcaccaaagccgttggctccgactccagagttgatatcaccgacctttataaataccctgagggctcaaggaaagaaaggcaggtctacagcaaggctgtcaatagactgtttggggtggaggcctccggccgacgaatctggattagaagggccggggggcgctgcctctggagagatgacctgcttgagcccgccacaaagcctagcatcgccggcaaattcaaagttttagaacccccaatgctggggcacgatttgagattggcgttgtgtctggccaacctgacctctcgagcacagcgggtgcgcgttaatctgtctggggcgaccatactttacactaggaaacccgtagcagagatcttacatgaaagccacgctgtgcgacttgggccacaggaagagaagagaattccaatcactatatcgtattctaagtacaaagaagatctgactgaggataagaagattctactggcggcgatgtgcctcgttactaaaggagagaagttgttggtcgagaaggacatcactctcgaggacttcataactatcaaggtgttgggcccagctatggtgggagtggccgtgaccgtggaagtcacagttgtaaaccccttgattgaaagagtcaaagattgcgctctgatggtcgagggttccggtctcctacaagaacaactgtcaatcgatgttcccacactcgagcctcaggagcgggccagtgttcagtttgatataacgccctccaagtcgggaccccgtcaactccaggtagacctggtcagtcctcactttcctgatataaagggattcgtgatcgtgcacgtcgccactgctaaatag

SEQ ID NO: 138374 - DNA, 1878 bp, Artificial Sequence
  Description of Artificial Sequence: Synthetic coding sequence
atggctggcattagggtgacaaaggtggactggcagcgcagccggaatggcgcggcccaccacacgcaggagtatccatgcccagaacttgtggtgcgcaggggacaaagcttctcccttaccctggagttatcgagggcactggattgtgaggagattctgatcttcacaatggagactggaccacgggctagtgaggctctccacactaaggccgttttccaaacctctgagctagagagaggggaggggtggaccgcggctagggaagctcagatggagaagacactgactgtaagcctggcgtctcctcccagtgcggtgatcggacgctacctgctgtcaatcagactcagttcacatcggaagcactctaacagacgactgggagagttcgtgcttctctttaacccatggtgcgcggaagatgacgtcttcctggcaagcgaggaagagcggcaggagtatgtgttgtcagattccggcatcatattccgcggcgtcgaaaagcacattagggcacaggggtggaattatggacagtttgaggaagacatcctgaacatctgtcttagtatcttagaccggagccccggccaccagaataatcccgccactgacgtgtcttgtcgccacaatccaatctacgtcacacgggtgatttccgccatggtgaactctaataatgacaggggcgttgtgcaaggccagtggcagggaaaatacggaggcgggacgagccccctgcattggcgaggcagcgtcgcgattctgcagaaatggctaaaaggcagatacaagcccgtcaagtacggccagtgctgggtgttcgccggtgtcttgtgcaccgtcttaagatgtctcgggattgctaccagagtggtgtcgaatttcaactctgcccatgatacagaccaaaacctctcagtggataaatatgttgactctttcggcagaacactcgaggacttgaccgaggactccatgtggaactttcatgtctggaacgagtcttggtttgcccgccaggatcttgggccgtcctacaacggctggcaggtcctggacgctacacctcaggaggagagcgagggggtgttccggtgcggccccgcgtccgtgaccgccatcagagaaggggatgtccatctcgcccacgatggtcctttcgttttcgctgaggttaatgccgattacattacatggctttggcacgaagatgagtctcgggaacgggtgtatagcaacactaagaaaatagggcgttgtatcagcactaaagcggtgggctcagactcacgtgttgatatcactgatctctacaaataccccgaagggagccggaaggagagacaagtgtactccaaggccgttaataggctgttcggtgtagaagccagtggtcgcagaatttggattaggagggctggaggcaggtgtttgtggagagacgatttactcgaacctgcaactaaacccagcatcgctggaaagttcaaggtgctggaaccccccatgctgggtcacgacctgaggctggcactgtgcctggcgaaccttacttctcgagctcagagggtccgcgtcaatctgtcaggtgcgacaatcctttacacaaggaagcccgtggctgaaattctgcatgagagtcacgccgtccgcctggggcctcaggaggagaagcgaattccaatcaccatatcctattctaagtacaaagaagaccttactgaggataaaaaaattctgttggccgcaatgtgcctggtcacaaagggcgagaagctcctcgtagaaaaagatatcacgctggaagatttcattacaattaagagggcttatcccggggccagtggcgagggactcagtccagtgtag

SEQ ID NO: 138375 - DNA, 2133 bp, Artificial Sequence
  Description of Artificial Sequence: Synthetic coding sequence
atggatcaggtggcgaccctcagattggaatcagtggatctccagagttcgaggaataacaaggagcaccacacacaggaaatgggagtcaagcggctgaccgtgaggcgtggccagccgttttacctgaggctctccttttctagacctttccagagtcaaaacgatcatattacgtttgtggccgagaccggtccaaagccctcggaacttctcggaactagagccaccttctttttgactagagtccaacctggcaatgtttggagcgctagcgacttcactatcgacagtaactctctccaggtcagcctattcaccccagcaaatgcggtcattgggcattatacccttaagattgaaattagtcagggccaggggcactcagtcacttatcctttagggacatttattcttctgtttaatccatggtcgcccgaggatgatgtgtatctgcccagtgagattctgctacaggaatatataatgcgtgattatggtttcgtgtacaaaggccatgaaagattcatcacctcatggccctggaattacggtcaattcgaagaggacattatcgatatctgctttgagatcctgaacaagtccctttatcatctgaaaaatccagccaaagattgctctcaaaggaacgatgtagtatacgtttgcagggtggtaagcgccatgataaactcaaacgatgacaatggggtgttgcaggggaattggggggaggactatagcaaaggagtctccccgcttgaatggaaaggcagcgtcgctattctccagcagtggtctgccagaggcggacaacccgtgaaatatggccagtgctgggtttttgccagcgttatgtgcacagttatgcgctgtctaggggtacctacccgagtggtgagtaactttcgttcggcgcacaatgtggaccgcaacctgacaattgacacttactatgatcgaaacgctgagatgctctctacacaaaagagggataagatctggaactttcacgtgtggaacgagtgctggatgatccgaaaggacctgccacctggctacaatggctggcaggtgttagaccctactccccagcagacctcttctggtttattctgctgcggcccagcaagtgtgaaagcgatcagagagggagacgtgcacctggcatacgacaccccgttcgtgtatgcggaggttaacgcggacgaagtgatctggctcttgggggacggccaggcccaggagatactcgcccacaatacgtccagcatcggcaaggaaatcagtaccaaaatggtcggatctgaccagaggcagtctattacgagtagctataaatatccagaaggcagtccagaagaaagggcagtctttatgaaagcgtctcggaagatgctcggaccacagagggcctctctgcccttcctcgacctgctggagagcggcgggctgagagatcagcccgcacaactgcaactgcacctggccaggatcccggagtgggggcaggatctgcagctcctgctacggatacagagagtgccggactcaacacatcctcggggccctattgggcttgtggtgcggttctgcgcacaggcccttctgcacggtggaggcacacagaaacctttttggcgccacactgttcggatgaacctcgatttcgggaaggaaacacagtggccactgctgttgccatactccaactatcgaaataagcttaccgacgaaaagctgatacgtgtaagcgggattgctgaggtggaggagactgggcggtccatgctggtattgaaggacatatgtctcgaacctccccaccttagcatcgaggttagtgaacgcgcagaagtgggcaaagccttgcgagtccatgtgactctgaccaacacattgatggtcgccctgagttcttgcacgatggtgcttgaagggagtggccttattaacggacagattgccaaagatctgggtactctggtggccgggcatacccttcaaatccagctggacctctaccccaccaaggccggtcccaggcagctgcaggtgctgatatcaagtaatgaagtgaaggaaataaaagggtataaggacatcttcgtcactgtggccggagccccctag

SEQ ID NO: 138376 - DNA, 846 bp, Artificial Sequence
  Description of Artificial Sequence: Synthetic coding sequence
atgaggttcgtcgtcgctttagtcttattgaatgtggcggcagccggcgctgtgccgttgctggcaacggaaagtgtcaaacaagaagaggccggagtgcgcccatcagccggtaatgtgtccactcacccctccctgtcccagcgccccggaggctccacaaagagtcatccagagccccagactccgaaggactctcctagtaagtcttctagcgaggctcagaccacaaaagacgttcctaataagagcggtgcagacgggcagacaccaaaggacggctcatcgaaaagcggcgcagaagatcaaacccctaaagacgtccccaacaagtctggagccgaaaagcagacccccaaagacggctccaataaatctggcgccgaggaacagggccctatcgatggaccgtcaaaaagcggtgcagaggaacagacaagcaaggacagccctaataaggaggaagttaaaagcagcgagcccaccgaagatgttgagcccaaggaggccgaggacgacgataccgggcccgaggaggggtcccctcccaaggaggaaaaagaaaaaatgagcgggtccgcgagttctgagaacagagagggaacattaagcgactctaccggatccgagaaagatgatctatatcccaatggtagcggaaatgggtctgcggagtccagccatttcttcgcgtatctggtgaccgccgccatcctggttgctgtcctctatattgcccaccacaataagagaaaaatcattgctttcgtacttgaagggaagagatccaaggtcacaagacgtccaaaagcgtcggattatcagcgcctggaccagaaatcttag

SEQ ID NO: 138377 - DNA, 1314 bp, Artificial Sequence
  Description of Artificial Sequence: Synthetic coding sequence
atgagatttgtggtggccttggtcctcctaaacgttgcagcggccggtgcagttcccctcttggccacagagagcgtaaaacaggaggaggctggagtccggccttctgctggcaatgtgtcaacacaccccagcttgtcccagaggccaggcgggagcactaaatcccacccagaaccccaaacccctaaagattcgccctcgaaatcatccgcagaagcccagacacctgaagatacaccgaacaaatccggcgccgaagccaaaacacaaaaggattcatcaaataagtctggcgccgaagctaagactcagaaaggatctaccagtaagtctggctctgaggcccagaccaccaaggacagtactagtaaatcccaccctgagctacagactcccaaggacagcaccggtaagagtggggccgaagcccaaacaccagaggactcccctaaccggtcaggggctgaggccaagacgcaaaaggacagtccctcaaagtcaggtagtgaagcccagaccactaaggatgttccgaacaagagcggtgccgacgggcaaacacctaaggacggctcaagcaagtcaggtgctgaagaccagacccctaaggacgtgcctaataagagcggagccgagaagcagactcccaaggatggctctaacaagtccggcgccgaggagcagggccccattgacggtccaagcaagtccggcgccgaagagcagactagcaaggactctcccaataaggtagtgccagaacaaccctcacgaaaagatcattcgaagcccatcagcaacccatcagataataaggaactgcccaaagctgacacaaaccagctggctgataaggggaagctgtccccgcatgctttcaagaccgaaagcggcgaggaaaccgatcttatttcccccccacaggaggaggtgaaatctagtgagccaactgaagacgtcgagccaaaagaagcagaagatgacgatacaggacctgaagaaggttcgcctccgaaggaggagaaagagaagatgagcgggtcggcttcctctgagaatagagaaggaaccttgagcgattccacaggcagtgaaaaggacgacctttaccctaatggcagcggcaatggctccgctgaatcctctcacttttttgcctatctggtcaccgcagccattcttgtggccgtgctctacatcgcacaccacaacaagcggaagatcatagcttttgtactggaaggcaaacgaagcaaagtgaccagacggccaaaagccagcgactaccagcgattggatcagaaaagctag

SEQ ID NO: 138378 - DNA, 1140 bp, Artificial Sequence
  Description of Artificial Sequence: Synthetic coding sequence
atgagattcgtggttgcgttagtcctgctcaatgtggctgcagcaggtgccgttcccctgctggctaccgagtccgtgaagcaggaggaagctggtgttaggccttccgcgggtaatgttagcactcacccaagtctcagccaacgcccaggggggagtacaaagagccacccagagccccaaacccccaaagatagcccctccaaatcaagcgccgaagcccagaccccagaagatacgcctaataaatccggggccgaagctaaaactcagaaggactcatcaaataagtcgggggcagaggccaaaacgcagaagggttcaaccagcaaatcaggaagcgaagcccagacaacgaaggattcaacaagcaaatcccacccagagctccagacacctaaagattccaccggcaaaagcggggccgaagcacagactccggaggatagcccaaatagaagtggggctgaggcgaagacccaaaaggactcccctagtaagtccggctctgaggctcaaacaactaaggacgtgcccaataagtctggcgctgacggacagacacccaaagatggcagtagtaaatctggcgcagaagaccagacccccaaagacgtgcccaacaagtcaggcgctgagaaacagaccccaaaggatggttccaataagagcggtgctgaagagcagggacccatcgatgggccctcaaaatccggcgcagaagaacagactagcaaggactcaccaaataaggaagaggtcaagtcctccgagcccaccgaggacgttgagcctaaagaagccgaggatgatgataccgggcccgaggaaggcagcccacctaaggaggagaaagaaaagatgtcaggcagcgcttcatctgagaatagggagggtactttaagcgattctaccggtagtgagaaagacgacctgtatccaaacggtagcggcaacggatctgccgaatcttcacacttttttgcctacctggtcaccgccgcaatccttgtcgccgtgttatacatcgcccatcacaacaagcgcaaaatcattgcttttgtgctggaggggaagagaagcaaagttacgcgacgccctaaggcctcagattatcagagattagatcagaagtcctag

SEQ ID NO: 138379 - DNA, 1362 bp, Artificial Sequence
  Description of Artificial Sequence: Synthetic coding sequence
atgcgtttcgtggtggcattggtcttgctgaacgtggccgctgcaggcgcagtgcccttattggctacggaatctgtaaaacaggaggaggccggggtgagaccttctgccggtaacgtaagtacacacccatccttgtcacaacgccccggggggtcaacaaagtcgcaccctgaaccccagacaccgaaggacagcccatctaagtcatcagctgaggcacagacaccagaagacactcctaataaaagcggggcagaggccaagactcagaaagactcttctaataaatccggagctgaggctaagacccaaaaggggtctacttcaaagtcaggctccgaagcccagacaaccaaggattctacgtccaagtctcaccctgaactccagacgcctaaagacagcaccggtaagtccggtgctgaagcccagacgccagaggattcgccaaaccgcagcggtgccgaagccaagacacaaaaagattcacccagcaagagtgggagcgaggcccaaaccacaaaagacgtgcccaacaagtctggagcggacggacagacgccgaaggacggctctagcaagagcggcgccgaggaccagactcccaaggatgtccccaacaagtctggtgcagagaagcagacccccaaagacggttcaaataagtcgggggcggaggagcagggacctatcgacggaccaagtaaaagcggtgccgaggaacagacgtccaaggacagtcccaataaggtggtgcccgagcagcctagtagaaaggaccactcaaaaccgattagcaatcccagcgataacaaggaactgcctaaagccgatacgaaccagctggctgataaaggaaagctgagtcctcacgcttttaaaacagaaagtggcgaagagacagacctgatctcaccaccacaggaagaggttaagagcagcgaacccacagaagacgtggagccgaaggaagctgaggacgacgacacaggaccagaggagggaagcccaccaaaagaggaaaaggagaagatgtcagggtccgcgtcatcagaaaatcgtgaaggaaccctgtcggattccactggctctgagaaggacgacctgtatcctaatgggtcggggaacggatccgccgaaagttcacattttttcgcctatctcgtgaccgccgcaatcctcgtcgccgttctctacattgcccatcacaacaagagaaaaatcatcgcattcgtgctcgaggggaagcggagcaaagtgacccgacgtccaaaggccagcgactaccaaagactagatcagaagattttttttcctctgagccccaatagaatggtctattcatcaggaaagagatag

SEQ ID NO: 138380 - DNA, 693 bp, Artificial Sequence
  Description of Artificial Sequence: Synthetic coding sequence
atgtatgtgcgggtgagcttcgataccaaaccagacctccttctccacctaatgacaaaggagtggcagctggagttgcccaagttgctgatatctgtacacggggggctgcagaattttgagttacaacctaaactgaaacaggtatttggaaagggcctaataaaggccgcaatgactactggagcctggatctttaccggtggagttaacacaggcgtgatccggcatgtcggggacgccttaaaggaccatgctagtaaatcccgtgggaagatttgcactattggcatcgctccatgggggatcgtagagaatcaggaggatcttatcggccgggacgtagttcgcccctatcagaccatgagcaaccctatgagtaaactcaccgtgctgaacagtatgcatagccatttcatcctcgccgataacgggactaccggcaagtatggcgctgaagttaaactccgtcgccagcttgaaaagcacatttctttgcaaaaaatcaatacaagaataggccagggtgtgcctgtagtagctctgatcgtggagggcggcccaaatgtaatcagtattgtcctagaataccttagagacactccaccggttccagtggtcgtgtgtgacggatcggggagggcctcagacatccttgccttcggccacaagtactccgaagagggaggttag

SEQ ID NO: 138381 - DNA, 2520 bp, Artificial Sequence
  Description of Artificial Sequence: Synthetic coding sequence
atgaagaaatggagctcaacggacctgggcgccgctgccgacccgttgcagaaagacacatgtcctgatcctctggatggagatcctaactctagacctccccccgccaaaccacagttgagtacggccaagtcccggactaggttgtttggtaaaggcgatagcgaggaggcttttccagtggactgtccgcacgaggagggcgaacttgactcttgccccaccattacagtcagcccagtcattaccatccagagacccggggatggtcccaccggagctaggttattgagccaggatagcgtggccgcttccactgagaaaaccctccgtttgtacgaccgacggagcatcttcgaggctgtcgcacaaaataactgtcaagacctggagtctctgctgctgtttctccagaagtcgaaaaagcacctgacagacaacgaatttaaagaccctgaaacaggcaagacatgtcttttaaaggccatgctgaacctccatgacgggcaaaacaccaccatccctctgcttctggagattgctaggcagactgattcactgaaggagctggtcaacgcttcctataccgatagctattacaagggccaaaccgccctgcacattgccatcgaacggcggaacatggctctggtgaccctcctcgtggaaaacggggcagatgtgcaggctgcagcacatggcgatttctttaagaagacaaagggccgtccgggattttatttcggcgagctcccccttagcctcgctgcatgtaccaaccagctcggcatcgtgaagttcctgcttcagaactcctggcagaccgcagacattagtgcacgggactccgtcggaaacactgtcctgcacgctctcgttgaagtcgcggataacactgctgacaatacgaagttcgtgacatccatgtacaatgagattctcatgctcggggccaaacttcaccccaccctaaagctggaggagctcaccaataaaaaaggtatgacaccccttgctctggctgcaggaactggaaagatcggggtgttggcatatatcctccaacgggagatccaggagccagaatgtcgtcacctgtcacggaaattcaccgagtgggcctacggacctgtgcactccagcctttatgacctttcttgtattgacacatgtgaaaagaactctgtgctggaggtcatcgcatacagttcttccgagaccccaaaccgtcacgatatgctgttagtagagccattaaacagactcctgcaggacaagtgggataggtttgtgaaaagaattttttattttaatttcctggtctactgcctgtatatgatcatattcacgatggcggcatactacaggcccgttgatggtctgcccccattcaagatggaaaaaactggtgactattttagagtcacgggcgagatactatctgtgctcggtggcgtttatttctttttccggggtatacagtatttcctgcagagacgccctagcatgaagaccctgttcgtggactcctactcagagatgctctttttcctgcagtcattatttatgctggctactgtggtcctctacttctcacatttgaaggaatacgtggctagcatggtattctccttggccctgggatggacgaacatgttatattatacccgcggctttcaacagatgggtatttacgccgtcatgatcgagaagatgatcttgagggatctttgtcgattcatgttcgtgtacattgtgtttctattcggtttctcgaccgctgtagttacgctcatagaggacggaaagaatgactcccttcctagcgaatcaacctctcaccgctggcgggggcctgcctgccggcccccagactctagttataattcactgtactctacatgcttggaactgttcaagttcaccattggaatgggtgaccttgagttcacggagaactatgacttcaaagcagtgttcattatcttgctgttggcatacgttatcctcacctacatactgcttttgaacatgcttatcgctttaatgggagagacagtcaataagattgcccaagaaagcaaaaacatatggaagttgcagcgtgcgattacaatactcgataccgaaaaatcctttctgaagtgtatgcgtaaagcctttcggtcgggcaaacttctgcaagtggggtatacgcccgacggcaaggatgactacagatggtgtttcagggttgacgaggtgaactggaccacctggaatacaaacgttggtattattaatgaggaccccggcaactgcgagggggttaagcgcactctgagctttagcttgcggagcagtagagttagtggtagacactggaagaattttgcacttgtgcccttgttgagggaggccagtgcgagagatagacagtcagcgcaaccggaggaagtctacctaagacaattcagcggcagcctcaagcctgaggacgctgaggttttcaaatcccctgcggcctctggcgagaagtag

SEQ ID NO: 138382 - DNA, 2373 bp, Artificial Sequence
  Description of Artificial Sequence: Synthetic coding sequence
atgaaggcacaccctaaagaaatggtgccactaatgggtaaacgcgtggctgcaccatccggtaacccggcgattctgcctgaaaagagacccgcagagatcacccccactaagaaaagcgcccatttcttcctggaaattgagggttttgagcccaatcccactgtcgctaaaacatctccaccggtcttcagtaaaccgatggacagcaatattcggcaatgtatctcgggcaattgtgacgacatggattctccccaaagtcctcaagatgatgtgacagagactccatctaaccccaatagtccctctgcccagctggcaaaggaagagcagcgaaggaaaaaaagacgtctgaaaaaacgtatctttgcagcagtctccgaaggttgtgttgaggaactagtagagcttctggtagaactccaggaactgtgtcgccgtagacatgatgaagacgtccccgatttcttaatgcacaaactgaccgctagtgataccggtaaaacctgtctgatgaaagctttgctgaatatcaaccctaataccaaagaaatcgtacggatcctcctagcgttcgccgaggagaacgatattctaggccggttcattaacgcagagtacacagaggaagcctacgaggggcaaacagctctgaatatcgcgatcgaacggaggcagggggatattgcagcccttcttatcgctgctggagcagacgtaaatgcccacgccaagggcgcttttttcaaccccaaataccaacacgaaggattctacttcggggaaacacctctcgcgctcgctgcctgtacgaatcaacctgaaatagtccagctcctgatggaacatgaacagactgacatcacttcccgagattctagggggaacaatatattgcacgctctcgttactgtcgctgaagacttcaagacacagaacgactttgtaaaaaggatgtatgatatgattctgttaagaagtggaaactgggagctggaaaccactcgcaacaacgatggacttactcccttacagctggccgctaaaatgggcaaggccgagatactcaaatacattctgtcacgtgaaataaaggagaagagactgagaagcctcagcaggaagttcaccgactgggcctacggaccagtgtccagtagtctgtatgatttaacgaatgtggataccactaccgataacagcgtacttgagatcaccgtctataataccaatatcgacaatagacacgaaatgctgactttagaaccactgcatactcttctgcacatgaaatggaagaaatttgccaagcatatgttctttctgtccttctgcttttactttttttacaatatcaccttgacactggtgtcgtattatagaccccgggaggaagaagctattccccacccactggccctgactcataaaatggggtggctgcagttgctgggtcggatgtttgttcttatctgggcgatgtgtatatctgtgaaagaagggatcgctatctttctcttacggccttccgatctccaatcaatcctgtccgacgcttggtttcactttgtgtttttcatccaggcagttttggtaatcctgagcgtgtttctgtacctctttgcctacaaagagtaccttgcttgcctggtgcttgcaatggcactcggctgggctaacatgctgtattacaccagagggttccagagcatgggtatgtacagcgtgatgatccagaaggtgattctccatgatgttctcaagttcttgtttgtatatatagtgttccttcttggctttggggttgcgctggcatcgctgatcgaaaagtgtcccaaagataacaaagactgttcctcttacgggtcattctctgacgccgtactggaactctttaagctgacaatcgggcttggggaccttaacatccaacagaattcaaagtatcccatcctctttctgtttcttttgattacctacgtaattttaacgttcgtgctccttcttaacatgctcattgctcttatgggagagacagtggaaaacgtgagtaaggaatccgagagaatatggcgtcttcagagggcccgtaccattctggagttcgagaaaatgttgcccgaatggttaagaagccgcttcaggatgggagagctgtgtaaggttgccgaagatgatttccgcttgtgtctgaggatcaacgaagtcaagtggacagagtggaaaacacacgtctcattcctgaatgaggaccctggccctgttaggaggaccgacttcaataagatccaggacagttcaaggaacaacagtaagacaaccctcaacgcctttgaggaagtggaggaatttcctgaaacatccgtatag

SEQ ID NO: 138383 - DNA, 3360 bp, Artificial Sequence
  Description of Artificial Sequence: Synthetic coding sequence
atgaagcgctcactacgaaagatgtggaggcctggtgagaagaaagagccacagggagtggtatacgaggacgtgccagatgacactgaggatttcaaggagtcgctcaaggtggtgtttgagggtagcgcctacgggttacagaattttaacaagcagaaaaagctgaaacggtgcgacgatatggataccttcttcctgcactatgcagcagccgagggtcaaattgagctgatggagaagatcactagagattcttctttagaagtcctgcacgaaatggacgactacgggaataccccactgcactgcgcagtggagaagaaccagattgagtcagtaaagtttctgctgtcgagaggcgccaaccctaatttgaggaattttaatatgatggcgcctctgcacatagctgtgcagggcatgaataacgaagttatgaaggtcctgctggaacaccggaccattgatgtgaatcttgagggggaaaacggaaataccgccgtcattatcgcctgtacgaccaataattccgaggccctgcagatcctcctgaagaagggcgctaaaccctgcaagtctaacaaatgggggtgcttccccatccaccaagctgctttctcagggtctaaagaatgcatggagatcatcctgcgattcggcgaagaacatggctacagccgtcagctacacattaacttcatgaataatggtaaggcaactccgctgcacctcgcagttcaaaacggtgaccttgagatgattaaaatgtgtctggacaatggtgctcagattgatcccgtggagaaaggtcgttgtacagcgatccacttcgctgctactcagggagcgaccgagatcgtgaagctgatgattagtagttactccggctctgtcgacatcgtcaacacaacagatggttgccacgagaccatgctgcatagagccagtctatttgaccaccacgagctggcagattatcttattagtgttggcgctgatatcaataagatagattcagaaggaaggtcacctttgattctcgccactgcatccgccagctggaatatcgtaaacctcctgctgagcaaaggagcacaggtcgacataaaggacaatttcgggaggaattttctacacctgacagtgcagcagccctatggactgaagaacctgcggccagagttcatgcaaatgcagcagatcaaggagttggtcatggatgaagacaatgacgggtgcacaccgctgcactacgcatgcaggcagggaggtcctggcagcgttaacaacctcctgggttttaatgtgtctatccacagtaagagtaaagacaaaaaaagccccctacatttcgccgcctcctacggaagaatcaacacgtgtcagcggctcctgcaggacatcagtgacacccgcttgctgaacgagggggacttgcacggaatgacccccctacacctggccgcaaagaatggacacgacaaagttgtccagttgctgctcaagaaaggggccttgtttctgtcggaccacaatggctggactgccctgcaccacgccagtatggggggatatacccagaccatgaaagtcatccttgatacgaatttaaagtgtaccgaccgactagatgaggacggtaatacagcccttcatttcgccgcccgggagggccacgccaaggctgtggccctgctgcttagtcacaatgccgacattgtgctgaataaacagcaggccagttttctgcaccttgcgctccataacaaacggaaagaagtggtattgacaataatcaggagcaagagatgggatgaatgcctcaagattttcagtcataatagccccggcaacaagtgccccataaccgaaatgatcgaataccttccggagtgtatgaaagttctcctcgatttttgcatgttacattctaccgaggacaaaagctgcagggactactacatagaatataatttcaagtacttgcagtgcccgctggagtttactaagaaaacccctacccaggacgtgatctacgaacctctgaccgctctgaacgcgatggttcagaataacaggatagagcttttgaaccacccggtctgtaaagaatacctgttaatgaaatggttagcgtatggatttcgcgcgcacatgatgaacttgggtagctactgtctcggactcatccctatgaccatactagtggttaatattaaacccggtatggcctttaactccactggcataatcaatgagacaagcgatcacagcgagatcctggacaccacaaactcttatctcatcaagacatgcatgattctcgtttttctgtcatctattttcggatattgcaaagaggccgggcagatctttcagcagaagcggaattacttcatggatatcagcaatgtactcgaatggataatatacacaacagggatcatcttcgtccttccattattcgtggagattcccgcccacttacaatggcagtgcggcgccatcgcagtgtatttctattggatgaacttcctgctttatctgcagaggttcgaaaactgcggaatctttatcgtaatgctcgaagtcatcctaaaaacgctgctgcgcagcacagtagttttcatttttttgctactggcctttgggctaagcttttatattctgttgaatttgcaggatcccttctccagccctctgctgtcaattatacagactttttccatgatgctgggggacattaactacagggaatcgttcttggaaccatacctcaggaacgaacttgcccatcctgtgctgagtttcgcccaactggtgagcttcacaatcttcgtacctatagtcctgatgaacttgttaattggactggcagtaggagacatcgctgaggtgcagaagcatgcgagcttgaagagaatcgcaatgcaagtggaactccatacaagcttggagaaaaaactgcctctgtggttcctgcgaaaggtggaccaaaagtccaccatagtctacccaaacaaacccagatctggaggcatgcttttccacattttttgttttctgttctgcacaggagagattcgccaggagattcccaacgccgacaagagtcttgagatggaaatcttaaagcagaagtatcgtctgaaagatcttacgttcctattggaaaagcagcatgaacttattaagctcatcattcagaaaatggagattatttcggagactgaggacgacgactcccactgttcatttcaggatcgctttaagaaggaacagatggaacagcggaacagcagatggaacactgtcttgagagctgtgaaggccaagacacatcacttggaaccttag

SEQ ID NO: 138384 - DNA, 2280 bp, Artificial Sequence
  Description of Artificial Sequence: Synthetic coding sequence
atgatggccgccctctatcccagcacagatctcagcggagcgagttcttcctctctgccttcaagcccgtctagttcatcccctaacgaagttatggccctgaaggatgtgagagaggtcaaggaggagaataccctcaatgaaaaacttttcctgctggcatgtgataaaggagactactacatggtgaagaaaattctcgaggaaaactcctctggagacctgaacatcaattgtgttgatgtgctgggccgcaacgctgtcaccatcaccatcgaaaacgaaaacctcgatatcttacaactgcttttggactacggatgccagaaactaatggagagaatacagaacccggaatattcaaccacaatggatgtcgcgccagtgattctagccgcccatagaaacaactatgaaattttgaccatgctgctgaaacaggacgtttcccttcccaagccacatgcggtgggctgtgaatgcacactatgtagcgctaaaaacaaaaaagattcactgcgccacagtcgctttaggctcgacatctatcggtgtctcgcctctcccgctttgattatgttgaccgaggaagatcccattctaagagcattcgagctttccgccgatctcaaggaactctccctggtggaggtcgagttccgcaacgattatgaagagttggcccgacaatgtaagatgtttgccaaggatcttctggctcaggcgcgaaatagccgggaactggaggttattctaaatcatacttcatctgacgagcctctggataaaagagggctcttggaggaacgtatgaacctttcccgacttaagctcgccattaagtacaaccagaaggagtttgtctcacagtctaactgtcaacagttcttgaatactgtgtggttcggccaaatgagcggctatcgcagaaagcccacgtgcaagaaaatcatgaccgttttgacggtgggcatcttttggccagtgctgagcttatgttatctgattgctcccaaaagtcagttcgggagaatcatccacaccccatttatgaagttcattatccacggtgcaagctattttactttcttgctacttctcaatctgtacagcctcgtgtacaatgaggacaagaaaaacacaatggggcctgcattagaacgtattgattatctgttaatcctgtggattattggcatgatttggagtgacattaaacgtctgtggtacgagggactagaagacttcctagaggagtcccggaaccaattatcctttgtcatgaactcactgtatctggcaactttcgccttgaaggtggttgcccacaacaagtttcatgacttcgccgaccggaaggactgggacgcttttcatcccacactggttgccgagggcctgtttgctttcgccaatgtgttatcctatttgaggctgtttttcatgtacacgacgtcctccatcctgggaccgctgcaaattagtatggggcagatgttacaagacttcggcaaattccttgggatgtttctgctggtgctttttagcttcactattgggctcacccagctgtacgacaagggctacacgagcaaagagcagaaggattgcgtcggcatcttttgtgaacaacagtctaacgacacattccattctttcatagggacctgcttcgcccttttttggtatatttttagcctcgctcatgtggccatttttgtcacacggttcagctatggagaggagctgcagagttttgtgggagccgtcatcgtcggaacttacaatgtagttgtggtgattgtgctcacaaagttgcttgttgctatgcttcacaagagcttccaattgatcgcaaatcacgaggataaagagtggaaatttgcaagagcaaagctttggctgtcttacttcgatgacaaatgcacactgccacccccgttcaacatcattcctagtccgaaaactatctgctacatgatttcaagcctctctaagtggatttgctcccatacctcaaagggcaaggtgaagcgccagaattccctgaaagaatggcggaacctgaagcagaagcgggacgaaaattaccagaaagtcatgtgttgcctggttcatcggtatctaacctcaatgagacagaagatgcaatccactgaccaggcaacggtggagaacttaaatgagctccgccaggatctgtcaaagttccggaatgagatccgggatctcttggggtttagaacatcgaagtatgctatgttctatccacggaactag

SEQ ID NO: 138385 - DNA, 435 bp, Artificial Sequence
  Description of Artificial Sequence: Synthetic coding sequence
atgatctggagtgatattaaacgtctgtggtatgaggggctggaggactttctggaagagtcgaggaatcagctgagtttcgtgatgaattctctttacttagccacttttgccctgaaagttgtggcgcataataagatctcaatgggtcagatgctgcaagacttcggcaaattcctcggaatgttccttctggtgctctttagctttacgattggcctcacacagctgtatgataaggggtacacttccaaggagcaaaaggattgcgtgggaattttctgtgagcagcagagcaacgacacattccactcctttatcggaacctgtttcgctttattctggtatatctttagcctagctcacgtagccatcttcgtgaccaggttttcctacggcgaggaactgcaatcatttgtgggggctgtaatttag

SEQ ID NO: 138386 - DNA, 2382 bp, Artificial Sequence
  Description of Artificial Sequence: Synthetic coding sequence
atgatggctgcgctgtatccctctaccgacttatcaggcgcttcttcgagctctttgccctcatcccccagcagtagttccccaaacgaagttatggctcttaaagatgtgagggaggtgaaagaagagaatacactcaacgagaaactctttctcctggcttgcgacaaaggcgattattatatggtaaagaaaatcctcgaagagaactcctccggtgacctgaatataaactgtgttgacgtgcttgggcgcaacgccgtcacaatcacgatcgaaaacgagaacctcgatattctgcagttactgttggattacggttgccagtctgctgacgcactgctcgtcgccattgactcagaggtggttggagctgttgatatcctgctgaatcaccggcccaagcgcagctccaggcccacaatcgtaaagctgatggagcggatacaaaaccctgagtacagtacgactatggacgtcgctcccgtgatcctggcggcacatcgcaacaattacgagattctcacaatgctgttgaagcaggacgtctctctgcctaagcctcatgcggtgggatgcgaatgtaccctctgttcggcaaagaacaaaaaagattctctgcgacattctaggttcaggctcgacatttaccgctgcctcgccagtcccgcactcattatgctgacagaggaggaccccattctgcgcgctttcgaattgagcgccgatctgaaagagctcagcctcgtcgaagtggagttccggaacgactacgaggaactcgctaggcagtgcaagatgttcgcaaaagatttattggcacaggcccggaatagtagggaactcgaggtgattctgaaccacacctcttccgatgagccgttggacaagagaggtctgctcgaggaaaggatgaatctgagcagattgaagcttgccatcaaatacaaccagaaagagttcgtgtcacaaagcaattgccagcaattcctgaatacggtgtggttcgggcagatgagtggttatcggaggaaacccacttgtaagaaaataatgaccgtgcttaccgttgggattttctggcccgtcttatcgctgtgttacctgatagctccgaagagccagtttggacgaatcatccacacaccctttatgaagtttataattcacggagccagttattttacctttctcttgcttctcaacctgtacagcctggtctacaacgaggacaaaaagaacacaatgggcccagcgctggaacggattgattatctgctcattctgtggataattggcatgatttggtctgatattaaacggctgtggtacgaaggcctggaagactttctggaggaaagtaggaaccagctgtctttcgtgatgaatagcctgtatctggctaccttcgccctaaaagtcgtggctcacaacaagtttcatgacttcgccgatagaaaagattgggatgctttccacccaacccttgtcgccgaaggcctgtttgcttttgcaaatgtactgagttatcttcggctgttcttcatgtacaccacctcaagtattctgggccccttacagataagtatgggacagatgctccaggatttcggcaagttccttgggatgttcttgctcgtgctgttttcgttcactattggactgacccagctttatgataagggctacaccagcaaagaacaaaaggattgtgttggtatattctgcgagcagcagtcgaacgacacttttcacagcttcatcggcacctgtttcgccttgttttggtacatcttctccctggcccatgttgccatatttgtgacccggttcagttacggagaggagctgcagagttttgtgggagcagttattgtaggtacttacaacgtcgtggtggtaatagtacttactaaattgctggtggccatgctccacaaaagctttcagctcatagcaaaccacgaagacaaagagtggaaatttgcgcgagccaagctgtggctgtcatactttgacgataaatgcacgttgcccccccccttcaatatcatcccatcaccaaagactatatgttacatgatctccagcctgtccaaatggatatgttcccacacaagcaaagggaaagtgaagcgacagaactcactgaaagagtggagaaacctgaaacaaaagcgtgatgagaactaccagaaagtcatgtgttgcctcgtacaccgctacttaacaagtatgcggcagaagatgcagtcgacagaccaggccactgtggagaacttgaacgagttgaggcaggacctgagcaaattccggaacgagattcgagacctcttgggctttcggactagcaagtacgccatgttttatccgcgaaattag

SEQ ID NO: 138387 - DNA, 2415 bp, Artificial Sequence
  Description of Artificial Sequence: Synthetic coding sequence
atggcccagttttactataagaggaacgtcaatgccccctacagagacaggatccctcttagaattgtccgcgctgagtcagaactctcccccagcgagaaagcatatctgaatgccgtggagaaaggagattacgcctccgttaaaaagagcctcgaagaggctgaaatctactttaaaattaacattaactgtattgatcctctcgggcgcactgcactgttaatcgctatcgagaacgaaaatctcgaactgattgagcttctgctcagttttaacgtgtacgttggggacgccctgcttcatgccatacgaaaggaggtggtgggggctgtcgaactgctattgaatcataagaaaccttccggcgaaaagcagttcgtggcccagccaaactgccagcaactgctggccagccggtggtatgacgagtttccaggctggcgtaggaggcattgggcggtgaaaatggtaacatgcttcattattggactgctgttcccagtgtttagcgtgtgctatctcatagcccctaaatctccccttggattattcatccgtaagccatttattaaattcatctgtcatacagcctcttatctgacctttctcttccttcttctgcttgcctcacagcatatagacagaagcgatctgaaccgccagggccctcccccaactattgtggaatggatgatattaccctgggtgctgggcttcatatggggggagatcaaacagatgtgggacgggggattacaggactacattcacgattggtggaacctcatggactttgtgatgaatagcctgtacttggccacaattagcctgaagattgtggctttcgtgaagtattcagcacttaatccacgggagtcgtgggatatgtggcatcctactctggtggccgaagcgttgttcgctattgctaacattttcagcagtcttagactaatctctctatttactgcaaattcacacctgggtcctctccaaatcagtctgggacgaatgctgctggacattctaaagttcctctttatttactgccttgtgctgctcgcatttgctaatggattgaaccagttatatttttactatgaggaaaccaagggactgacctgtaagggaattaggtgtgagaagcaaaataatgcatttagtaccctgtttgagaccctccagtcactgttttggagcatcttcggcttgatcaatctttatgtcaccaacgtgaaagcccagcacgagtttactgagttcgtcggagcaacgatgttcggcacttacaacgtgatctcactggtggtgctcttgaatatgcttatcgctatgatgaataactcttaccagttaatcgccgatcacgcagacattgagtggaaattcgcacgtacaaagctgtggatgtcttactttgaggagggcggaaccctgcctactcctttcaatgtgattcccagccctaagagtttatggtatttgataaaatggatatggacacacctttgcaagaaaaagatgcgtcgaaaaccagagtcttttggaacaatcgggagacgggccgccgataacttgcgcagacaccatcagtatcaggaagtgatgcggaacttggtgaaaagatatgtggcagcgatgatccgtgacgctaagactgaggaggggctcaccgaagagaatttcaaagaactgaaacaagatatctcctcctttaggttcgaggtgctgggcctgctcaggggaagcaaactgagcaccatccagtccgcgaatgcttcaaaagagagctctaactcagccgacagcgatgaaaaatctgacagcgagggaaactctaaagataagaaaaagaacttttcgctgttcgacttgactaccctcatccaccccagaagcgctgccattgcaagtgaaagacacaacatttctaatgggtccgcacttgtggtccaagaaccccctcgagaaaagcagcggaaggttaacttcgtgacagatatcaagaactttggtcttttccatagaagaagcaaacagaacgctgctgaacagaatgcaaatcaaattttttccgtgagtgaagaggtggcccgtcagcaagctgccggtccattggaacggaatatccagcttgagtctagagggctcgctagccgtggtgatctgtccataccaggattgtccgagcagtgtgtcttagttgaccatcgagaacggaacaccgataccctgggcctgcaggtaggaaagagggtgtgcccgtttaaaagcgagaaagtggtagtggaagataccgtcccaattatcccaaaagaaaagcacgccaaagaggaagactcctcaattgattacgacctcaatctgcccgacacagtgactcacgaagactacgttaccacacggctctag

SEQ ID NO: 138388 - DNA, 2511 bp, Artificial Sequence
  Description of Artificial Sequence: Synthetic coding sequence
atggcccagttctattacaaacgtaatgtcaacgccccatacagggacagaattccactgcgaatagtcagggctgagagcgagctatcgccatccgagaaagcttacttgaatgccgtggaaaagggggattatgcgagcgtcaagaagtctttggaggaggcagaaatctattttaaaataaacatcaactgcattgaccctctggggcgcaccgccctgctgatagccatcgagaacgagaaccttgagcttattgaactcctgcttagttttaatgtctatgtgggcgacgcattgttacacgccataaggaaggaagtggttggggccgtagagctgcttctgaaccacaaaaagccttctggtgagaagcaggtgcccccaatactgctagataaacaattcagcgagttcaccccggacataactcctatcattttagccgcccacaccaataactatgagatcataaaactccttgtgcaaaagggggtgtctgttcctagacctcatgaggtccgatgtaactgtgttgaatgcgtgagcagttctgatgtggattccctccgccattctcggagccgactcaacatctacaaagccctggcctctccttcgctaattgcgctgtcctcagaggacccttttttaactgcctttcagctcagctgggaactgcaggaactgtccaaggttgaaaatgagtttaagtctgagtacgaggagctgtcaaggcagtgcaaacagttcgccaaggatctgttggatcagactcggtctagccgcgagctggagatcattctgaattatcgcgatgacaacagcctgatagaggaacagtcaggaaatgacctcgctcgcttaaaactcgctatcaagtaccgtcagaaagagttcgtcgctcagcctaattgccagcagctgctcgcttccagatggtacgatgagttcccaggctggagaagaaggcactgggccgttaagatggtgacctgcttcatcataggccttctgttcccggtattcagtgtctgttaccttattgcccccaagtccccattgggacttttcatccggaagccgtttattaagttcatttgtcacacagcctcatatttgacttttctgttcctgctgcttctcgcctcacagcatatcgatcggagtgacctcaaccgtcagggcccgccacccaccatcgtggaatggatgatacttccctgggtgctgggatttatttggggcgagattaaacagatgtgggacggaggcctgcaggactatatccacgattggtggaatttgatggatttcgtgatgaactccttatatctggccactatttctttaaagatagttgcctttgtcaaatattcagcacttaacccccgtgaatcttgggacatgtggcatccaactctggtggcagaggcgctctttgcaatagcgaacatcttcagcagtcttaggttgattagcctgttcacagccaacagccatcttggtcctctgcaaatatcgttaggacggatgttattggatatccttaagttcctcttcatttactgtcttgtactgttagcctttgccaatggcctgaatcagttatacttttactacgaggagaccaagggcctgacctgcaagggtatccgttgcgaaaaacagaacaacgcgttttcgacacttttcgagacactccaatcgttgttctggtccattttcggcctgatcaacctgtacgttactaacgtgaaagcgcaacacgaattcacagagtttgtgggggctacaatgttcgggacatacaacgtcatttccttagtggtgctccttaatatgctgatagccatgatgaacaacagctaccagctgatcgccgaccacgcagatatagagtggaagttcgcccggacaaaattgtggatgtcctatttcgaagagggtggtacattgccaactccttttaacgtgataccaagcccaaagagcttgtggtatttgatcaagtggatatggacccatctctgcaaaaaaaagatgcgacgtaagcccgagtcttttggcaccatcggccgccgcgcagccgataacctccgcagacatcaccagtatcaagaagtgatgcgcaaccttgtcaagcgctatgtcgccgctatgatccgggatgctaaaacagaggaagtggccaggcagcaggctgccggccctcttgagaggaatatacaactcgagtccagggggctggcttccagaggcgatctgtccattcctggactctccgaacagtgtgtattggtggaccatcgggaacgcaacactgacacgctcggtctgcaggtgggaaagcgtgtttgtccattcaagtcagaaaaagtggtggtggaggatactgtgccaattatccccaaggaaaagcatgctaaagaggaggattcttccatcgattatgatctgaatctcccagacacggtgactcacgaggattacgttacgacaagactatag

SEQ ID NO: 138389 - DNA, 2682 bp, Artificial Sequence
  Description of Artificial Sequence: Synthetic coding sequence
atggctcaattttattataagaggaatgtcaacgcaccctacagagacagaatccctctacggatagtccgggccgaatccgaactgtctccatccgagaaagcctacttgaacgccgtcgagaagggagactatgcgagcgtgaagaaatcattagaggaggctgagatctactttaagatcaacataaactgcatcgatccgctaggccgtaccgctctgctcatagcaatcgagaacgagaacttggaactcatagagttgctgctctcatttaacgtgtacgtgggggacgcgctgcttcatgcaattaggaaggaggtggtgggcgcggtggagctgctgttaaatcataagaaacctagtggcgaaaaacaggttcctccaatcttgctggataagcaattttcggaatttacccctgacattacacccatcatcctagccgctcacacaaacaactatgaaattatcaaactcctggtccagaaaggagtgtccgttccgcgtccccacgaggtcagatgcaattgtgtggaatgtgtatccagcagcgatgtcgacagcctgagacacagcagatcaagactcaatatttataaggctttggctagcccaagcctcatcgccttgagctctgaggacccattcctgaccgcattccagctgagctgggaactgcaggaactttccaaggtggaaaacgagttcaagtccgaatatgaggaactgtctcggcagtgcaagcagttcgctaaggacctcctcgaccaaactagaagctctcgcgaactggaaatcattctaaattaccgagatgacaactctctgatcgaagagcagtcgggaaacgacctggctaggctcaagttggcaattaagtatcgccagaaagagttcgtggctcagccgaactgtcagcagcttctggcatcaaggtggtacgatgagtttcctggctggaggcggcggcattgggctgtgaaaatggtgacctgttttatcattggccttctatttcctgtgttttcagtttgttacctgatcgcccctaaatcgccactgggactgtttatccgaaagccctttatcaaatttatttgtcatacagccagttacctcacctttctttttttgctgctgctggcttctcagcatattgatcggtctgatctgaacaggcagggacctccccccaccatagtggaatggatgatcctaccctgggtgctcggcttcatctggggtgagatcaagcaaatgtgggacggggggcttcaggattacattcacgactggtggaatctgatggacttcgtgatgaacagcttataccttgctacaatttctctcaaaatagttgcattcgtgaagtactcagccctgaaccccagggagtcctgggatatgtggcaccctaccctcgtggccgaggccctgttcgccatcgcgaacattttctcttctcttcggctcatttccctcttcaccgcaaacagccaccttgggcctctgcagattagtctcggaaggatgctactggatatattgaagtttctgttcatctactgcttggttctgttggccttcgccaacggtttgaatcagctttatttctattatgaagaaactaaagggctgacctgcaaagggattcgctgcgagaagcagaacaacgctttctctactctttttgagacactccagagcttattttggtccatcttcggactcataaacctctacgtgactaatgttaaggcacagcacgaattcactgaatttgttggtgccaccatgttcggcacgtacaacgtgatctccctcgttgtgctgctcaatatgttgatcgctatgatgaataactcgtaccagctcatcgccgaccatgcagatatcgagtggaaattcgcccgaactaagctgtggatgtcatacttcgaggaaggtggaaccttacccacacccttcaatgtgatcccgtccccaaagagcctatggtatctaattaagtggatctggactcacctgtgtaaaaagaagatgaggcggaagccggagtctttcggaactatcggaagacgggcggctgacaacttgcggcggcatcatcagtaccaggaagttatgaggaacctggtgaagagatacgtcgcggccatgatccgtgacgccaagaccgaagaaggactgactgaggagaactttaaagagctgaagcaggatatttcatccttccggttcgaggtgctcggactgctgaggggtagcaaattgagtaccattcagtccgccaatgcaagtaaagagtcttccaactcagctgatagcgatgagaagtccgattcagaggaggaggtggctaggcaacaagccgccggcccactcgagcgcaacattcagttggagtcccgaggacttgcctcccgcggggacctcagcattcctggcctcagcgaacaatgcgttctggtggaccatagagagcggaatacagacactttgggcctccaagttggcaagcgcgtctgtcccttcaaatccgagaaggttgtggtggaggacacggtacctatcatccctaaggaaaagcatgcaaaggaagaggatagcagtattgactatgacttaaatctgcctgatacagtgacacatgaagattacgtgaccacaaggctgtag

SEQ ID NO: 138390 - DNA, 2487 bp, Artificial Sequence
  Description of Artificial Sequence: Synthetic coding sequence
atggctcagttttactacaaaagaaatgtcaacgctccttatcgggacagaatccctctacggatagtccgagctgaatccgagttgtctcctagcgaaaaagcctacttgaacgcagttgaaaagggcgactacgctagtgtgaagaaatccctggaagaagccgaaatttacttcaagattaacatcaactgtatcgatcccctcggacggactgcactgctgatcgccattgagaacgagaatcttgaactgatcgagttattgctgtccttcaacgtctatgttggcgatgcgcttcttcatgcgatcaggaaggaggttgttggggccgttgaactgcttctgaatcataaaaaaccctctggagagaagcaagttccccccatacttcttgacaagcaattttcagagtttacaccagacatcaccccaataatacttgctgctcatactaataattatgagatcatcaaattgctggtgcaaaaaggggtcagcgtgcccaggccccatgaggtaaggtgtaactgtgtcgaatgcgtgagctcctcagacgtcgattctctgagacatagtcgcagtcgcctcaacatctacaaggctctcgcctctccctccttaatcgccctgtcaagtgaagatccttttcttacagctttccaactttcctgggagctccaggagctctccaaggtcgagaacgagtttaagagtgaatacgaagagctgtcaaggcagtgcaaacaattcgcaaaggatttgctggatcagacaagaagttcacgggagctcgagattattttgaactatagagacgacaattccctgattgaggagcagtctgggaacgacttggcacggctcaagctcgccataaaatatcgccaaaaagaatttgttgcccagccaaactgtcagcagttgctcgctagccgctggtatgatgagttccccggctggcgtcgtcggcattgggcagtcaagatggtgacttgtttcattattggactactgttcccagtgttctcagtgtgttacctaatcgcccctaagtccccactcggactgttcattaggaaaccgttcattaagtttatttgccacactgcctcttatctgactttcctttttttattgctgctggcaagccaacacatcgacaggagtgacctgaacaggcaaggacccccaccaaccatagttgagtggatgatcctaccttgggttctgggatttatctggggagaaatcaaacagatgtgggacggcggactacaggattatatccatgactggtggaaccttatggatttcgttatgaattcactgtacctggcgaccatctccttgaaaatagtggcatttgtgaagtactccgccctgaaccctagggaaagctgggatatgtggcaccccaccctcgtggccgaagctctcttcgccattgccaatatttttagttctcttaggctcatttcactcttcacagccaacagtcacctgggacccctgcagatatcgttggggcgcatgctcctcgatattttgaagttcctcttcatatattgtctggtattgcttgctttcgccaatggtctcaaccaactgtatttttactacgaggaaactaagggtttgacctgcaaggggattcgctgcgaaaagcaaaataacgctttctcaaccctctttgagacactgcagagcctgttttggtcgatttttggtctgatcaatctatacgttaccaatgtgaaagcgcagcacgaattcacagaattcgttggcgcaacaatgttcggaacttacaacgttatcagtcttgtggtacttctcaatatgctcatcgctatgatgaataactcttatcagctcattgccagacgggccgccgacaatctgaggagacatcaccagtatcaggaggtaatgaggaacttagtcaaacggtacgtggctgcaatgatcagagacgctaagaccgaggaaggattaactgaggagaattttaaagaactgaagcaagacattagttctttccgctttgaagtactgggattgcttagaggttctaaactgtccaccatccagagcgccaacgcttctaaagagtcatcaaattctgctgatagcgacgagaagtcagatagcgaagaggaagttgcccgccagcaggctgcagggccgttggagcgaaatatccagctggagtctcgaggcctggcatcgcggggcgatctgtctatccccggcctcagcgagcaatgcgtactggtcgaccatagggagagaaacaccgacactcttggactgcaggtcgggaagcgcgtctgtccattcaagtcggagaaggttgtcgttgaggacaccgtgcctatcatccccaaagagaagcacgctaaagaggaagactcctctattgattacgaccttaacctgcccgacacagttacccacgaggattacgtcactacccgactatag

SEQ ID NO: 138391 - DNA, 2415 bp, Artificial Sequence
  Description of Artificial Sequence: Synthetic coding sequence
atggcccaattctattacaagcgcaatgtgaacgccccctatagggaccgaattccactgcgcatagtgcgagctgagagcgaactatccccaagcgaaaaagcctacctgaacgccgtggagaaaggtgactacgcttccgtgaagaagagtttggaagaggctgaaatttatttcaaaatcaacattaactgtatcgatcccctggggagaactgcgctgttaatagccatcgagaatgaaaatctcgagttaatcgaactccttctcagctttaacgtctatgtaggtgacgctctcctgcatgctattagaaaggaagtggtgggcgcagtggaactgctgttaaatcacaagaagccttccggtgagaaacagttcgttgcccagccaaattgtcaacagctccttgccagtagatggtacgacgaattcccgggctggcgacggaggcattgggcagtgaaaatggtgacatgcttcatcattggccttctcttccctgtgttctccgtttgctatctgatagccccaaaatctcccctcggcttatttatcaggaaaccattcattaagtttatctgccatacagcatcatatctcacattcttattcctgcttcttctggcctcacaacacatagatagaagcgacctaaatagacagggccctcccccgacgattgtagaatggatgatactgccttgggtccttgggttcatatggggcgagattaagcaaatgtgggacggcgggctgcaggactacattcatgactggtggaacctgatggacttcgtgatgaattctttatacctggccactatctcgttgaaaatcgtcgcattcgttaagtactccgcccttaatccgagggaatcgtgggacatgtggcatccgactctggttgctgaagccctctttgcaattgcgaacatttttagttctctgcgcctgatatctttgttcaccgccaattcccatctgggacctcttcaaatctcactcggccgcatgctcctggacatcttgaagtttctctttatatactgcttagtactccttgccttcgccaatggactgaatcaactatacttctactatgaagaaacgaaggggctgacttgtaagggtattaggtgtgagaaacagaacaacgcgttctcgacattatttgagacgctccaatctcttttctggtcaatttttggactgatcaacctttacgtcactaacgtcaaggcccagcatgaattcactgagtttgtcggagcgactatgtttggcacttataacgttataagtttggtggtgttactgaacatgctgattgccatgatgaacaactcctaccagctgatcgccgatcacgcagacattgagtggaagttcgcaagaactaagctgtggatgtcatacttcgaagagggcggaacgctcccaactccgtttaacgttataccatcaccaaagtcactgtggtaccttatcaagtggatttggacccacttatgcaagaaaaagatgaggcggaagcccgagtcttttggtacaatcgggaggagggctgctgacaaccttcggcgacatcaccagtatcaggaggttatgcgaaatctggtcaagagatacgtcgcagccatgatccgcgatgccaaaacagaggaaggtctgacggaggagaatttcaaggagttgaagcaggatataagctcatttcgcttcgaggtgctgggactgctccgaggatctaagctctccaccatacaatccgcgaacgcgagcaaggagagcagtaacagtgcggacagcgacgaaaagtcagacagtgaaggtaactccaaagacaagaagaaaaacttctccctgtttgatctcacgaccctcatccatccccggtctgcagcgattgcaagcgagaggcataatattagcaatggttcagctttggtggtgcaagagccaccaagagaaaagcagcgcaaggtcaactttgtaaccgacattaaaaatttcgggctgttccaccgccgcagcaagcaaaatgcagccgagcaaaacgctaaccaaatctttagtgtctctgaagaagttgccaggcagcaggcagccggtccattggagagaaacatccagttggaatcacgaggcctggctagccggggggacctaagcatccctggactcagtgagcagtgcgtcctagtggaccatagggagcggaatacagatacacttggcttgcaggtcggaaagagggtctgtcccttcaagtccgagaaggtggttgtggaagatactgttccaatcatccctaaagagaagcatgccaaggaagaggatagctccatcgattacgaccttaacttaccggacacggtgactcatgaagactacgtgactacacgactgtag

SEQ ID NO: 138392 - DNA, 2949 bp, Artificial Sequence
  Description of Artificial Sequence: Synthetic coding sequence
atggctcaattctactacaaaaggaacgtcaacgccccttacagggacagaatccccctcaggattgttagggccgagtccgagctgagcccctcagagaaagcttacctgaacgcagtggaaaagggcgattatgcttccgtaaaaaagtccctcgaagaagccgagatatatttcaagataaacatcaattgcatcgatccccttggtcggacagcacttttgattgccattgagaatgagaatctggagcttatagaattgttactttccttcaacgtctacgtaggagacgccttattacatgctatacggaaagaggtggtgggagctgttgagctattactcaaccataagaagcccagcggcgagaagcaagtaccgccaatcttgttggacaaacagttctcagaattcacaccagatatcaccccaattattctcgccgcccatacaaataattacgagatcattaagttactggtgcagaagggcgtgagcgtccctcggccgcacgaggtccgctgtaactgcgtagaatgcgtgtctagttctgatgttgattcattgcggcactcacgctcccggctgaatatctacaaagccttagcaagcccatctctgatcgctctgtccagtgaagacccattcctgacagccttccagctctcctgggagctgcaggaactgagtaaggttgaaaacgaattcaaaagcgagtatgaagagctttcacgtcaatgcaagcagttcgccaaggatctcttggatcagacacggtccagccgggaactagaaattattttaaattaccgtgacgacaattcacttatcgaggaacagtcgggcaatgatttggccaggcttaaactagccatcaaatatcggcagaaggaattcgtcgcccagccaaattgtcagcaactgctggccagccggtggtacgatgagttcccaggctggcggcgtaggcattgggccgtgaaaatggtgacatgctttattattgggctgctgttccctgtcttcagcgtctgctacttgatcgctcctaaaagtccgctgggactgttcatcagaaaacccttcattaaatttatatgtcatacagctagctaccttacctttctgtttctcctattgctcgctagtcaacatatagaccgatctgacttaaacagacagggaccaccgcccaccatagtggagtggatgatcctgccatgggtccttgggttcatttggggggagataaaacaaatgtgggatggcggactgcaggactacatccacgactggtggaacctgatggactttgttatgaacagcctctatctggccaccatttcactcaaaatcgttgcctttgttaaatattctgctttgaaccctcgtgagagttgggatatgtggcaccccacactcgtggcggaggcactgttcgcaatagcaaacattttttccagtctgcggctcatttctctcttcactgctaatagtcatctcggacctttgcagatctctctgggtcgtatgcttcttgacatactgaaattcctttttatatactgcctcgttctgctggcatttgctaacgggttgaaccagctctacttttactacgaagagaccaaggggttaacatgcaagggaatccggtgcgagaagcaaaacaacgccttctctaccttattcgagacgttgcagtcactcttttggtcaatcttcggccttatcaatctttacgtcaccaacgtaaaagcccagcatgagtttacagaattcgtgggggccaccatgttcggcacgtacaacgtgatcagcttggtggttttgctgaatatgctgattgctatgatgaacaattcatatcagctcatcgcagatcatgccgatatcgagtggaaatttgcacggaccaagctctggatgtcctactttgaggagggagggactcttcccactccttttaatgtcatcccatcaccaaagtccttgtggtaccttatcaaatggatctggacccacctttgcaagaagaaaatgaggagaaagcccgaatctttcgggactatcggggtgagaacccagcaccggagggccgcagacaacctccgccggcatcatcagtatcaggaagtgatgcgtaaccttgtgaagagatatgtggctgccatgatcagagacgcaaaaacggaggagggcctgactgaagaaaactttaaggagctgaaacaggatatttctagctttcgatttgaagtcctgggtcttctgcggggctcgaaactgagcacgattcaatccgccaacgcttctaaggagagttcaaacagcgccgattcggacgagaaaagtgatagcgaggggaattcaaaagacaaaaagaagaactttagtctcttcgatctgactacactcatccatcccaggtcagcagcaatagcctccgagagacacaacatttccaatggatctgcattggttgtgcaggagccaccacgagagaaacagagaaaagtgaactttgtgaccgatattaagaattttggattattccatcggagaagtaagcagaacgctgcagaacagaatgccaaccaaattttctctgtctcagaggaggtggcccggcaacaggcagccggcccgctggagagaaacatccaactggaatctaggggtctggccagtcgcggggacctttccatccctggcctctctgagcagtgcgtgcttgttgatcatagagagcggaataccgacacactgggcctccaggtgggaaaaagagtctgcccattcaagtcagaaaaagtggtggtggaggacaccgtccctatcatacccaaagaaaagcatgccaaggaagaggattcctctatagattatgacctcaaccttccggacaccgtcacacacgaagattatgttaccacgaggctgtag

SEQ ID NO: 138393 - DNA, 2934 bp, Artificial Sequence
  Description of Artificial Sequence: Synthetic coding sequence
atggcccagttttactacaaacgaaacgtgaatgcaccgtaccgcgacagaatcccactgcggatagtgcgagccgagagtgagctctctcccagcgagaaggcatacctcaacgcggtggaaaaaggggattacgcctcagtaaagaagtcattagaggaggcagaaatttatttcaagattaacattaattgtatcgatccacttgggagaactgctctcctgatcgccattgagaacgagaacctggaactgattgaattactgctcagcttcaacgtgtatgtcggcgacgcactgctgcacgccattaggaaagaggttgttggagcggtggaactgcttctaaaccacaaaaaaccctcaggcgaaaagcaagtgccacctatcttgctggacaaacagttttctgagtttacccccgacatcactcccatcatccttgctgctcacacgaacaactacgaaataattaagttgctggtacagaaaggagtcagcgtgcctaggccccacgaggtgcgatgcaattgtgtggaatgcgtgagtagctcggatgtcgattcactccgccattcacgatccagactcaatatctacaaagccctagcatcaccatccctgatagcccttagctctgaagatcccttcctgaccgccttccaactctcatgggaactgcaggagctgagcaaagtcgagaacgagtttaagagcgaatacgaagaactctcaagacagtgtaaacagtttgccaaggaccttcttgaccagaccagatccagcagggagcttgagattatattgaattaccgggatgacaacagcctgattgaggaacagtctggtaatgatctggcccgtcttaaactagccatcaagtataggcagaaagagttcgttgcacagccgaattgccagcagctcctcgctagtcggtggtacgacgaatttccgggatggcggcgtcgccactgggctgttaagatggtaacctgcttcatcatagggctgctgttccctgtgtttagtgtatgttacctgattgctcctaagtccccccttggtctttttatcaggaagccttttattaaattcatttgtcacaccgcctcttatctaacgtttctctttttgcttctccttgcctcccagcacatagataggtctgaccttaacagacaggggccccctcccaccatcgtcgagtggatgattctgccctgggtgcttggatttatttggggggagatcaagcaaatgtgggacggagggttgcaagattatatccatgattggtggaacctcatggacttcgtgatgaactctctctacctcgctacaatatctcttaagatagtggcttttgttaagtattccgctctgaacccgcgagaatcttgggacatgtggcaccctacgcttgtggctgaagcccttttcgccatcgcaaacatcttctcctccctgcggctgatttctcttttcacagccaactcccacctgggacccctgcagatatctttagggcgaatgctgctggacatcttaaaattcctttttatatactgcctggttctgctcgcatttgctaatggactgaatcagctttacttttactatgaagagaccaaagggctgacttgtaagggaatccggtgtgaaaaacaaaacaatgctttttcaactctcttcgaaactctgcagtcactgttttggagcatttttggcttgatcaacctgtatgtaactaacgtcaaagcccagcacgagtttaccgagtttgtaggtgcaacaatgttcgggacctataacgtgatatctttggtggttctgttgaatatgttaattgccatgatgaacaattcctaccagctgatagccgaccacgccgacatcgaatggaaatttgctagaactaagctatggatgtcctacttcgaggaaggcggaacccttcctacccccttcaatgtgataccctcacccaagtctttgtggtatcttattaagtggatctggacccatctgtgtaagaagaaaatgcggaggaaacccgagtcatttgggactatagggaggagagctgcagacaatcttaggaggcaccaccagtatcaggaggtgatgaggaacctggtgaagagatatgtggctgcaatgatacgcgacgcgaaaacagaggagggcctcacagaggagaattttaaggagctgaaacaagacatatccagcttccggttcgaggtgctgggactcctccggggaagtaagctgagcacaattcagagcgctaatgcttctaaggaaagttcaaactccgcggactccgatgagaaatctgatagcgaggggaacagtaaggacaagaaaaagaattttagcctatttgatctcaccacactcattcaccctcgctctgctgcaatcgccagtgagaggcacaacatcagtaacgggtccgcacttgtcgtgcaggagcctccaagggaaaaacagcgaaaggtaaactttgtcaccgatatcaagaactttggactatttcatagacgatcaaaacaaaatgccgccgaacaaaatgccaaccaaatctttagcgtgtctgaggaagttgctaggcagcaggccgccggtcctctggagagaaacattcagctggaatccagagggctcgccagcaggggagacctgagcatacccggtctttcggaacagtgtgtccttgtggatcatcgggagcgcaacaccgacacactgggcttacaggtggggaaaagggtttgtccgtttaagagcgagaaagttgtcgtggaagacactgtcccaatcattcccaaagagaaacacgcaaaggaggaggattcttcgatcgattacgatctgaatttgcccgatactgttacccacgaggattacgtcaccacacgattgtag

SEQ ID NO: 138394 - DNA, 1383 bp, Artificial Sequence
  Description of Artificial Sequence: Synthetic coding sequence
atggctcaattctactacaaaagaaacgtgaacgccccgtatagggacaggattcctttacgcatcgtgagggcagagtccgagttgagcccgtcagaaaaggcctatctgaatgccgtcgagaagggcgactacgcaagtgtcaaaaagtcgctggaggaagcggagatctatttcaaaatcaacatcaattgcattgacccactcggccggacagctctgttgattgccatagagaacgaaaacctggagctgatcgaactcttattgagctttaatgtttacgtgggtgacgcacttttgcacgctatcagaaaggaggtggtgggcgccgtggagctgctgctgaaccataaaaaacccagtggagaaaagcaggtccccccaatcttactggacaaacagttttccgagttcacaccagatataacgcctattattctggcggcacacacgaacaattacgagatcattaaactcctagtgcagaagggggtctccgtacctaggcctcacgaagtcaggtgtaactgcgtggaatgcgtctcctccagtgacgtagacagcctacggcattcccgcagtaggctcaatatctataaggcgttagcctccccctccctcatcgccttgtctagcgaagaccccttcctgactgccttccaactgagctgggaactgcaggagttatccaaggttgagaatgaatttaagagcgaatatgaggaactttctcgccagtgcaagcagtttgctaaggatctcctggaccagacaagatcctctcgggagctcgaaatcattttaaactacagggacgataatagtttgattgaggagcagtcagggaacgacttggccagactcaagctggccattaagtatagacaaaaggaatttgtagcacagcctaattgccaacagttgttagcatcaaggtggtacgacgagtttcctggctggagacgccgccactgggccgtgaagatggtcacttgtttcatcattggcctgttattccccgtattctctgtctgctatctgatagctcctaagagccccctagggctgttcataaggaaaccctttattaaattcatctgccacaccgcctcttatctgaccttcctgtttcttctactcctggcatctcagcacattgaccgatccgacctgaacagacagggaccaccgccaaccatcgtggagtggatgatccttccatgggtgctggggttcatttggggcgagatcaaacagatgtgggatggggggttgcaagattacatccatgactggtggaatcttatggactttgtaatgaatagcctgtatctcgcaaccattagtcttaagattgtggccttcgtgaaggtgatctag

SEQ ID NO: 138395 - DNA, 2511 bp, Artificial Sequence
  Description of Artificial Sequence: Synthetic coding sequence
atggcacagttttattataagcgcaatgtgaatgccccgtatagggatcgcatacccctccggatcgtccgggccgagtctgagctgagtccctctgagaaggcttacctgaacgccgtagaaaagggggactatgcaagcgtcaagaagagcctggaagaagcagagatttatttcaagatcaatatcaattgcattgatccattgggcagaactgcccttttgatcgctatcgagaatgaaaacctggagttaattgaactgcttcttagtttcaatgtctacgtgggagacgccctcttgcacgcaattaggaaagaggtggttggggcggtcgaactgctcctcaatcacaagaagcccagcggtgagaaacaggtgcctccgatcttactagataagcagttctccgagtttactccggacatcacacccatcattttagccgcccatactaataactatgaaataattaagttgctggtacagaaaggggtttctgtcccgcggccccatgaagtcagatgtaattgcgtcgagtgcgtgtcctcatctgatgttgattccctaaggcactcccgtagtaggttgaatatctataaagccctggcaagccccagcctcatcgccctgtccagtgaggacccctttctaactgcattccagctgtcctgggaactccaagaactgtcaaaggtggaaaatgagttcaaatctgaatatgaggagctctctcgccaatgtaagcagtttgccaaagatcttctggatcaaacgagatcatcacgagagctggaaattattttaaactacagggacgataattccctgatcgaggaacaatcaggcaatgacttggcacgcctcaaactggccatcaaatatcgacagaaagagtttgtcgctcagccaaattgccagcagcttttggcttctagatggtatgatgagttccctggatggcgtcgcagacactgggcggtcaagatggtcacatgcttcatcattggcctgttattccccgttttttcagtctgctatctgatcgctcccaaatcccctctcgggttgtttatccgcaagccattcatcaaattcatttgtcacactgccagctatcttacttttttattcctgctgttgcttgcttcacaacacattgacaggtccgacttgaacaggcagggtccccctcctacaattgttgaatggatgatccttccctgggttctggggttcatctggggtgagatcaagcagatgtgggacgggggcttacaggattatatccatgattggtggaacctcatggattttgtcatgaattctctctatctggccaccataagccttaagattgttgcctttgttaagtatagcgctctgaaccctagagaaagctgggacatgtggcatccaacactggttgcagaggccctcttcgcaatcgccaacatcttctccagcttaagactgatcagtctgtttactgcgaatagtcacctggggcccctccaaataagtctggggaggatgctcttggacattctgaagtttctcttcatctactgtcttgtcttgctggccttcgccaacggattgaatcagctatacttctattacgaagaaaccaaggggctgacttgcaagggtatcaggtgcgaaaaacaaaacaatgccttcagcaccctgtttgaaacattgcagagtctcttctggagcattttcggactgatcaacctttacgttaccaacgttaaggcccagcacgaatttaccgagttcgtcggggccaccatgttcggtacgtacaatgtaatctctctggttgtgttactgaacatgctgatcgcaatgatgaacaactcctaccaactgatcgcggaccacgccgacatcgagtggaaattcgctaggactaaattgtggatgtcttatttcgaagagggcggcacattgcctacccccttcaacgtgattccatcccccaaatctctgtggtatctcattaaatggatatggacgcacctgtgcaagaagaaaatgagaagaaagccagagtcatttggcacaataggccgcagggccgccgataatctgaggcggcatcaccaataccaggaggttatgaggaatctggtgaaacgctacgtagccgccatgatccgtgacgcgaaaacggaggaggtggctcgccagcaagcagctggtcccctagagaggaatatccagttagagagcagaggcttggcttcacgtggcgaccttagcataccgggccttagcgaacaatgtgtcctcgtcgatcaccgcgagaggaataccgacacactaggactgcaggttgggaaacgggtttgccccttcaaatctgagaaggtcgtggtggaggacaccgtgccaatcattcctaaggagaagcacgcaaaggaagaagattctagcatagactacgatctgaatcttcctgacaccgtgacccatgaagattacgtaaccaccaggctgtag

SEQ ID NO: 138396 - DNA, 2394 bp, Artificial Sequence
  Description of Artificial Sequence: Synthetic coding sequence
atggccgcagctcctgtcgccgccgggtctggagctggaagaggacggagatctgcagctacagtggccgcatggggcgggtgggggggccggccgcgtcctggcaatatattgttgcaactcaggcagggccaactcacaggccgcggcctggtgagagctgtccaatttaccgaaacctttctgaccgagagagataagcaatccaagtggtcaggtatcccacagctgcttctcaaattgcacacaacatctcacctgcacagtgacttcgtggagtgtcagaacatccttaaagaaatcagtccattgttgtcaatggaagcaatggctttcgtgaccgaagagagaaagctgacacaagagaccacttacccaaacacgtacatttttgacctgtttggaggagtcgacttgctggtggagatcttgatgcggcccacaatctctatccggggccagaagctcaaaatatctgatgaaatgagcaaggattgtctgtctattttgtacaacacctgcgtgtgcaccgagggggttacaaaaagacttgccgaaaagaacgatttcgtaatttttctgttcaccttgatgaccagcaagaaaaccttcctccaaactgctacgctgatcgaggacatcctgggtgtgaagaaagagatgattcgcctcgacgaggtgccaaacctgagcagtctggtgagtaactttgatcagcaacagctcgcaaacttctgtcggattctcgcagtaaccatctccgagatggacactggtaacgacgacaagcatactttattggccaaaaatgcgcagcaaaagaagagcctcagtttaggcccttccgccgccgagatcaaccaggctgcgctcctcagtatccctgggttcgtcgaacggttatgcaaactcgctacccggaaagtttccgaatcaacagggacggcttcgttcctacaggagctggaggagtggtacacgtggctggataacgcgctcgtactggacgcgctgatgagggtggccaatgaggaatctgagcacaatcaggctagtatcgtattccccccaccaggggcctctgaggaaaacggccttccccatacctcagcccggactcagctgccccaatcgatgaagattatgcacgagattatgtataaactggaggtgctttacgtgctgtgcgtgcttctgatgggtcggcaaagaaaccaggtccatcgaatgattgctgagtttaagcttatccctgggttaaacaacctcttcgataagcttatctggagaaagcacagcgcttccgcactggtcctgcacggacataaccaaaattgtgattgctcccccgatatcacgttgaaaattcagttcctccgcctcttacagagcttttccgatcaccacgaaaataagtatttgctgcttaacaaccaggaactgaatgaactcagtgcgatcagcctgaaggcaaacattcccgaagtcgaggcagttcttaacacagaccgaagtcttgtgtgtgacgggaagagaggccttctgacccgccttttacaagtgatgaagaaggaaccagccgaatcatcttttagattttggcaggcccgggctgttgaatcctttctcagagggacaacctcatatgccgaccagatgtttctgctgaagaggggtctactcgaacacattctgtactgcatcgttgattctgagtgtaagtctcgggatgtgctccaaagctacttcgaccttttgggagagctcatgaagttcaacgtagacgcatttaaaagatttaacaagtacatcaatactgatgcaaaatttcaggtctttctcaaacagattaattccagccttgtggactcaaacatgctcgtgcgctgcgtgaccctgagcctggaccgttttgagaaccaggtggatatgaaggtcgccgaggtcctttctgagtgcagactactagcatacatctctcaggtgcccacccagatgtcattcctgtttcgattaattaacattattcacgtccaaactctgacgcaggagaacgtcagttgccttaacacctcccttgtgatactgatgcttgctaggcgcaaggaacggctgcctctgtacctgcgcctcctgcagagaatggaacattctaagaagtaccccggcttccttctgaataacttccataacctgcttcgattttggcagcaacattacctccacaaagataaggattcaacctgtttagaaaatagttcttgcatctccttcagttattggaaggagacagtgtcaatattgttgaaccccgaccgccagagtcctagcgccctcgtgagctacatcgaggagccatatatggacattgatcgcgacttcacagaagagtag

SEQ ID NO: 138397 - DNA, 2277 bp, Artificial Sequence
  Description of Artificial Sequence: Synthetic coding sequence
atggctgctgccccagtcgctgcaggaagcggcgccggaagaggccgaagatccgctgctactgtcgcagcctggggaggttggggcggccggcctcgtccaggcaacatcttactgcagctgcgccagggccagctaactggcaggggtctggttcgcgccgtccaattcaccgaaacattcctaaccgagcgcgataagcagtctaaatggtctgggataccacagctgctgctgaagttacacaccacttcccatctgcacagcgattttgtcgagtgccagaacatccttaaactcttggtggaaatcttgatgcgtccaacgatatcaatcagaggccagaaattgaagatttccgacgaaatgagtaaggattgcctgtccatactctacaatacctgcgtgtgcactgagggagtgactaaaaggctcgccgaaaagaacgatttcgttatcttcttatttacgctcatgacctctaagaaaacgtttctgcagaccgccaccttgatcgaagatattctcggggtgaaaaaggagatgattcgtctggacgaagtgccgaacctgagttccctggttagcaactttgaccagcagcagctggccaacttttgtcggattctggccgtgactatttccgagatggataccggcaatgatgataaacataccctcctggctaaaaacgcgcaacagaagaagagcctgtcgctgggcccttccgcggcagaaatcaaccaggccgccctcctgtccatccccgggtttgtcgagcgcctatgcaaacttgctacccgcaaagtgagcgaaagtaccgggacagcaagcttcctccaagagctggaggaatggtatacgtggctggacaacgctctggtcctcgatgccctcatgcgtgttgcgaatgaggagagtgaacacaaccaagcgagcatcgttttccctcccccgggggcctctgaggaaaatggtctgcctcacaccagcgccaggacccagctgccccaaagcatgaagattatgcatgagattatgtacaagctggaggtcttgtacgtgctttgcgtgctcctcatggggaggcaacgtaatcaagtgcatcgtatgattgccgagtttaaactgatccccgggctaaataacctgtttgacaagctgatttggcggaagcactccgcatctgccctggtgttacacggccataatcagaactgcgactgctcaccagacatcacgctaaagatccagttcctgcggttgcttcagtcttttagcgatcaccacgaaaacaagtatctgctactgaacaaccaagaactcaacgagctttccgccattagcctcaaggccaatatccctgaagtggaagcggtcctgaacaccgatcgttcgcttgtctgtgatgggaagagggggttgctgacacgactcctacaggtgatgaagaaggaaccggctgaatctagctttcgattctggcaggctagggcagtcgaatcctttctgcgcgggaccaccagctacgccgatcagatgttcctgctcaaacgggggttgctggaacacatcttatattgcattgtggattccgagtgcaaaagtcgggatgtgcttcaatcatatttcgatctgctgggagaactgatgaagtttaacgtcgacgcgtttaagcggtttaataaatacatcaacacggacgccaagtttcaagtgtttttgaagcaaataaactcgagccttgtggactctaacatgttggttaggtgtgtgaccctgtcacttgatcgattcgagaatcaggtggatatgaaggttgcagaggttctcagcgaatgccggctgctcgcatacatctctcaggtgccaacgcaaatgagttttctgtttaggctgataaacatcattcacgtgcagactctgacacaggaaaacgtcagttgcttgaacacttcccttgtgatcctgatgttggctaggagaaaggagcgattgccgctgtacctgcgccttctgcagagaatggaacactccaaaaagtacccagggtttctccttaataatttccataacctgctgcgattctggcagcaacattatttgcacaaagataaggactctacgtgtttggaaaactcaagctgcatatcgttttcatattggaaagaaacggtctctattctgctgaatcccgatcggcagtccccatccgcgctggttagctatatagaagaaccctacatggatatagaccgagatttcacagaggagtag

SEQ ID NO: 138398 - DNA, 2370 bp, Artificial Sequence
  Description of Artificial Sequence: Synthetic coding sequence
atggcagcggctcccgtcgcagcagggtctggggccggccgtggccgacggtccgccgccactgtggcggcctgggggggatggggaggccgcccccggccgggaaacatacttttgcaactgaggcagggccagctgacaggccggggcctggttcgggcagttcagtttactgagacattccttactgagcgggacaagcagtcaaagtggtcaggaatcccccagcttctcctgaaattacacaccaccagtcatttacatagcgacttcgttgaatgccaaaatattcttaaagaaatatctccactgctgagcatggaagccatggccttcgtaactgaagaaagaaaattgacccaggagactacctaccctaacacttatatcttcgatctctttggaggagtggacctgctggttgagattttgatgcgtcctactatctccattaggggtcaaaagctaaagatatcagatgagatgtccaaagactgtttgtctatcctctataacacctgtgtctgtacagaaggggtgacaaagcgccttgcagagaagaacgacttcgtgattttcctcttcactttaatgacctccaagaaaacattcttacagaccgctacacttattgaagatattttaggagtaaagaaagagatgataaggctggacgaggtacctaatcttagctctctggtcagtaacttcgaccagcagcagttagccaacttttgtagaatcctagcagtcacaatcagcgagatggatacaggcaatgatgataaacacacattactggcaaagaacgcacagcaaaagaaatcgctcagtttgggcccaagtgcggcggagataaaccaggccgcgcttctctctatccccgggtttgtagaacggctctgtaaactggccacccggaaagtgagcgaatcgacagggacagctagttttctgcaagagctggaagagtggtacacatggctcgataatgcgcttgtcctcgacgcacttatgagggtagctaatgaagaaagcgagcacaatcagggtgcatctgaggagaacggcctgccgcatacaagcgcacgaacccaactaccgcagagtatgaagatcatgcacgaaattatgtataagctggaggtgctctatgtcttgtgcgtcctgttaatgggacggcaacgcaatcaagtgcaccggatgattgctgagttcaaactgattcctggcctcaacaatctgtttgacaaactgatctggcgaaaacactcggcaagcgcgctggtgcttcatgggcataatcagaattgtgactgttctccagatataactctgaaaatccaatttttgcgattgctgcagtctttctcggatcaccacgaaaataagtaccttctgctgaacaatcaggagcttaacgagttgtcagccatcagtctgaaggccaacatccctgaagtagaagccgtcttgaatacagatcgctccctggtttgtgacggaaagcgcggcctgctgacaagattgcttcaagtgatgaagaaagagcccgccgaaagttcttttcggttttggcaagccagagccgttgaaagcttccttcggggcactacttcatatgctgatcagatgttcttgcttaaaagggggttgctggaacatattctatattgcatcgttgattctgaatgtaaaagtcgcgacgtcctccagtcttattttgatttactcggcgaactgatgaagttcaatgtagacgcctttaaacggtttaataagtatatcaatacagacgccaaatttcaggtatttctgaaacagatcaactctagcctggtggacagtaatatgctggtcagatgcgtcaccctctcccttgacaggttcgagaatcaggtagacatgaaggtggctgaggtgctgtcagaatgccgcttactggcctatatttcacaggtaccgacccaaatgagttttcttttcaggctgataaacatcatacacgttcagaccctgactcaagagaacgtaagctgtcttaataccagtctcgtgatcctgatgttggctaggaggaaagaacgattgcccctgtatctccggctcttacagaggatggagcatagcaagaagtatcctgggtttctacttaacaacttccacaacctgcttcgcttctggcagcagcactatttacacaaagataaagactcgacctgccttgaaaactcgtcttgtatatccttcagctattggaaggaaaccgtctccatcctgctgaatcctgatcgccagtctccaagtgctctcgtcagctacattgaggagccatatatggatattgaccgcgacttcactgaagagtag

SEQ ID NO: 138399 - DNA, 1200 bp, Artificial Sequence
  Description of Artificial Sequence: Synthetic coding sequence
atgcgtagccagtcaaccattaaggtacaccggatgatcgccgagttcaaacttatccctgggttaaataatctgtttgacaagctgatttggaggaagcactcggcatccgccttggtgctccatggccacaaccaaaattgtgactgctccccagacattactctcaaaatccagtttctaagactcctgcagagcttttctgatcaccacgaaaacaaatatctgctcctcaacaaccaggaactgaacgagctcagtgccatatcgctcaaagccaacattcccgaagtggaagccgtactcaacaccgataggagcttggtgtgcgatgggaagagaggtctgctgactaggctgctccaggtgatgaagaaggaacctgctgaatcctccttccggttttggcaggccagagcggtcgaaagcttcttgcgtggaactacctcctatgctgatcagatgttcctgcttaaaaggggcctgctggaacacatcctatattgcattgtggactcagagtgtaaatcccgagatgtcctgcagtcttactttgacttgctgggcgagctgatgaagttcaacgtggatgctttcaaacggttcaacaagtacatcaatactgatgcaaaattccaagtgttccttaaacagataaacagctcactggtcgacagtaacatgctggtcagatgtgtgaccctgagcctcgatcgctttgaaaatcaagtcgacatgaaagtggccgaggtactctcagagtgcagacttttggcctacatttcccaggtgccaacccagatgagtttccttttcagactgatcaacattatccacgtgcagactttgacccaggaaaatgtgtcgtgtctgaacacttccctcgtgatcctgatgctcgctagacgaaaagagaggctgcccctctacctgcgactcttgcagaggatggagcacagtaaaaaatatccgggtttcttgctgaacaatttccataacttattgaggttttggcaacagcattacctacataaggacaaggatagcacctgcttagagaatagttcttgtatatccttcagctactggaaggaaaccgtatccatcttactgaatccggacagacagtccccaagcgcgttagtgtcttacattgaggaaccctacatggacatcgatcgggattttaccgaagagtag

SEQ ID NO: 138400 - DNA, 2349 bp, Artificial Sequence
  Description of Artificial Sequence: Synthetic coding sequence
atggcagcagcacctgtggccgccgggagcggtgctggaaggggccgaaggtcagccgcaacagttgccgcctggggaggatggggccagctcaccgggagagggctcgttagggccgttcaattcactgagactttccttactgaaagagacaagcagtccaaatggtctggcatacctcaacttttattaaagctgcacactacctcacacttgcacagcgactttgtcgaatgtcagaacattctcaaggagataagccccctactgagtatggaggcgatggccttcgtgaccgaagagcgcaaactcactcaggagactacatatccgaacacatacattttcgatctgtttggtggagtggatctgctcgtggaaatcctaatgcgacccaccatttccattcgtggacaaaaactgaagattagcgacgaaatgtctaaggactgtttgtctatcctgtacaacacatgcgtttgtaccgaaggagttacgaaacggcttgctgagaagaacgatttcgtaattttcttatttacccttatgacaagcaagaagacttttctgcaaacagcaaccctgatcgaagatatcctaggtgtgaaaaaagaaatgatacggttggatgaggtgcccaatctctctagcctggtgtcaaactttgaccagcagcagttggctaatttttgtagaatcctggccgtgacaatctccgaaatggataccgggaacgacgataagcatacactgctagctaagaacgcacagcagaagaaatcgctgtccctcggccccagcgctgccgaaatcaaccaggccgctctgttgtcgatccccggatttgtcgaaaggctctgtaagctcgctacgcgaaaggtgtcggaatctacagggactgcttcgttcttgcaagagctggaggagtggtacacgtggctggacaacgccctagtgttggacgctctcatgagagtagccaacgaggagtctgaacacaaccaagcaagcatcgtgttccctcctccgggagccagtgaggagaatgggctgccccatacctctgccagaactcagctgccgcagagcatgaaaatcatgcatgagattatgtataagctggaggtgctctatgtgctttgcgtcctcctgatggggaggcagcgaaatcaggtgcacaggatgatcgccgaatttaagctcatccctggtctgaacaatctgttcgacaagctcatatggcgaaagcactcagctagcgccctcgtcttgcacgggcacaaccaaaactgcgactgcagccctgatattacactgaagatccaatttctgagactgctccagagcttttcagatcaccatgagaataagtacctgctcctgaataaccaggaacttaacgagctgtccgctatctccctcaaggccaatataccagaggttgaggcggttctgaacactgaccgatcactggtctgtgatggcaaacgaggcctccttactcgcctgctgcaagtcatgaaaaaagagcctgcagagtcaagctttcggttctggcaagctagggcagtcgagagcttcctccggggaactaccagttatgccgatcagatgtttttgttgaagcgcggcttgctggagcacatcttatactgtattgtcgatagtgagtgtaagtcccgggacgtgttgcaatcctatttcgaccttctcggggaactcatgaagttcaatgtagatgccttcaagcgcttcaacaagtatataaatacagatgctaaattccaagtgtttctcaagcaaatcaatagtagtctggtggacagcaacatgctggtgcggtgtgtgacactgtccttagaccgtttcgaaaaccaggtagatatgaaggtggcagaagtattgagcgaatgtaggctgctggcctacatttctcaggtgcctacccagatgtcatttctttttcgcctgatcaacatcatccatgtgcagacactgacgcaagagaatgtgtcttgtctaaatacctccttggtgattctgatgctcgcgaggcgcaaagagcgactccctctgtatcttcggctgctgcaacggatggagcactcaaagaagtaccctggatttctcctgaacaacttccacaatctgctgcggttctggcagcaacactacctgcacaaagacaaagacagcacatgcttggagaattcctcctgcataagtttttcttattggaaggagaccgtgtcaattctgctcaatcctgacagacagagcccctcagcattagtttcttatatcgaggagccatacatggacatagatcgagatttcaccgaagagtag

SEQ ID NO: 138401 - DNA, 2922 bp, Artificial Sequence
  Description of Artificial Sequence: Synthetic coding sequence
atggctcagctttattacaaaaaggtgaattactctccttaccgcgatcgcattcccctgcagatcgtgagagccgagaccgaactctcagcagaggaaaaagcctttctgaatgcggttgaaaagggggattacgccaccgtgaagcaagctttgcaagaggccgagatctactataacgtgaacatcaattgtatggatcccctgggcaggtccgctctgctgatagccatcgaaaacgagaacttagagattatggaactactgcttaaccactctgtctatgttggtgacgcgcttctctacgcaattcggaaggaggtggtgggagcagtggagctcttgctgtcatataggagaccttccggagaaaagcaagtcccaactctgatgatggatacccagttttcagagttcacacccgacatcacacccattatgctggcagcccacactaacaattatgagattattaagctgctggttcagaaaagagtaactattcctagaccgcatcagattcggtgcaactgcgtggaatgtgttagcagctcagaggtcgatagcttgcggcacagtcgctcgcgcctcaatatctataaggccctggcctcgcccagtttgatcgccctgtcttcagaggatccaatcttaaccgctttccgactcggttgggagttgaaagagctgtcaaaagtcgagaatgagtttaaagccgaatacgaggaactgtcccagcagtgcaagctgtttgctaaggaccttctcgaccaagcccggtcgtcacgcgagttagaaattattctgaatcaccgcgatgatcattcggaggagctggatcctcagaagtatcacgatctggctaaattaaaggtggcaatcaaataccatcagaaggagttcgtagctcagcccaattgtcaacagttgttggccacattatggtatgacgggtttcccggttggcgccgcaaacattgggtggtcaaactgctcacatgcatgaccattggctttctgtttcctatgctgtcaattgcctacctaataagcccacgtagcaacctaggcttgttcataaagaagccatttatcaagttcatctgccatactgcgtcatacttgaccttcttatttatgctacttctcgcatcacagcatatcgtgcggaccgacttacatgtccagggtcccccaccaactgtagtcgagtggatgatcctgccttgggtgctgggattcatctggggagaaataaaggagatgtgggatggtgggttcactgagtatatacatgattggtggaacttgatggacttcgctatgaactccctttacttggccaccattagtcttaagattgtggcttatgtgaagtataatggctctcggccccgggaagagtgggaaatgtggcatccaaccttgatcgctgaagctctgttcgcaatctctaacatactgagctccctccggctgatatccttgttcactgccaatagccatctcggacccctgcagatttctttggggaggatgctgttagatattttaaagttcttgtttatttactgtctggtgctgctggcctttgccaacgggctgaaccaattgtatttctactatgaaacccgcgctatcgatgaacccaataactgtaaaggtatccgttgtgagaagcagaacaatgctttctccaccctgttcgagacccttcaatctctcttttggagtgtgtttggtctcctgaatttgtatgtcacaaacgtcaaagctcgtcatgaatttactgagtttgtgggggccaccatgtttggcacgtacaatgttatctcgctggtcgtcctgcttaatatgttaatcgctatgatgaacaatagctaccaacttatagctgaccacgctgacatcgagtggaagtttgcgaggacaaaattatggatgagttatttcgacgagggcggcacgctgccgccgccgttcaacatcatacctagcccaaaatctttcttgtatctgggcaactggtttaacaacacattttgccctaagagggaccccgacggtcggcggaggcgtcgtaacctgcggagctttaccgagaggaatgcagacagcttaatccagaaccagcattatcaggaggtgattaggaatctggttaaacgctatgtggccgctatgatccgtaacagcaagacccacgagggcctcacagaggagaactttaaagagcttaagcaggatattagctcgtttaggtatgaagtgctggatctgctgggaaatcggaaacacccacgtagcttttctacttcatcgaccgagctttcacagcgggacgacaacaacgacggctccgggggcgccagagccaagagcaaatccgtgtccttcaatcttggatgcaagaaaaagacatgccacgggccgcccctgatccgaacaatgccacgctcatcgggcgcccaaggtaaatccaaggccgagagttccagtaagcgaagttttatgggaccctccttgaaaaagctgggtttgctgttcagtaaattcaatgggcacatgtctgaaccttcctccgagccaatgtacactatcagtgacggaatagtgcagcagcactgcatgtggcaggacatacgctactcacagatggagaaggggaaagctgaagcatgctcacagtcagaaatcaatcttagcgaggtggaattaggcgaggttcagggagcggcccagtcttccgagtgcccgttagcctgctcatcttccctgcattgtgctagtagcatctgctcctcaaattctaagctgttagattcttcggaagatgtttttgaaacgtggggagaggcatgcgacttactgatgcataaatggggtgacggacaggaggagcaggtaacaacccggctctag

SEQ ID NO: 138402 - DNA, 2796 bp, Artificial Sequence
  Description of Artificial Sequence: Synthetic coding sequence
atgtcccaaagtcctgcttttggtcctagaagaggctctagcccccgcggagctgcgggtgccgccgcgcgtagaaatgagagccaagattacttgctgatggatagcgagctcggcgaagacggatgtccacaagcgcccctgccgtgctacggatattatccatgcttccgaggctcagataacagactggctcacaggcgacagaccgttttacgggagaaaggccggcggctagccaacaggggccctgcctatatgttttctgaccggtcaacatccttgtcgatcgaagaagagcgcttcctggatgccgccgagtacggaaacattccagtggtgcggaagatgctggaggaatgtcactcactcaatgtgaattgcgtagactatatgggacagaatgctctccagctggctgtagcgaatgaacacctggaaatcacagaattattgctaaaaaaagaaaatttatcccgggtaggggatgcgctgctcctggctatctccaagggttacgtgagaatagtggaggccattctgtcacacccagcgtttgcagaaggtaaaagactagcgacttctcccagtcagtctgagctgcaacaagacgatttttatgcctatgatgaggacgggaccaggttctcccacgacgtgacacccataattctggccgctcattgtcaggaatacgagattgttcatacactgttgaggaaaggtgccagaatcgagcgccctcacgactacttctgtaagtgtaacgattgtaatcaaaagcaaaaacatgatagctttagtcatagccggtcaagaatcaacgcgtataaaggactggcgagtcctgcttacctgagcctgtcttcagaagatcctgtaatgaccgcacttgaacttagcaatgaattagctgtcctcgccaatatcgaaaaggaattcaagaatgattacaagaagctcagtatgcagtgtaaggatttcgtggtaggactgctcgatctgtgccggaacacagaagaggttgaagcgattctgaacggcgacgtcgaaactctgcagtctggggaccatggaagacctaatctgtctcggctgaaactggcaataaagtacgaagtcaaaaaatttgtcgcacaccctaattgtcaacagcagctcctgtctatttggtatgaaaatctgagtgggctacgccaacagaccatggcagtgaagtttctggtggtattagcggtggctatcgggctcccattccttgcactgatctactggttcgccccatgttccaaaatgggaaagataatgaggggcccctttatgaaatttgtcgctcacgcggctagctttaccatattcctggggctattggtcatgaacgcggctgaccgattcgagggaaccaaactcctccctaacgaaaccagtaccgataacgcaaagcagctatttagaatgaagacttcgtgtttcagctggatggaaatgttaattatttcctgggtcataggaatgatttgggcagagtgtaaagagatctggacacaggggcctaaggagtacttgttcgaactgtggaacatgctggatttcgggatgctggccatctttgcagctagctttattgccagattcatggctttttggcatgcttcgaaagcccaaagcattatcgacgccaacgacacactaaaggatctgacaaaggtcacgctgggcgacaacgtcaaatattataaccttgcccgaatcaagtgggacccctctgacccccaaattatcagcgaagggctgtacgcaatcgccgtagtcctatcgttttctcgtatagcatatatcctgcccgccaatgaatcgttcggcccactgcagatctccctgggccgcactgtcaaagacatctttaagtttatggtgatttttatcatggtgttcgtggccttcatgatcggtatgttcaatctgtactcttattatattggggcaaaacaaaacgaagctttcacgaccgtcgaagaaagctttaaaactctgttctgggccatttttggactgtcggaagtcaagtctgttgtgatcaattacaaccataaattcatcgagaatataggctacgttctgtacggagtctacaacgttacaatggtgatagttctgctaaatatgctgatcgccatgatcaatagctcctttcaggagatcgaagatgacgctgatgtggagtggaagtttgcacgagccaaactttggttttcttattttgaagagggccgtacactgcctgtgccgttcaacctcgtacctagtcctaagagccttttttacttgctcctgaagttgaaaaagtggataagtgaactgtttcaggggcacaaaaaaggatttcaggaagatgctgagatgaataaaattaacgaggagaagaagctgggaattctgggttcccacgaagatttgtccaagctgtcccttgataagaagcaagtgggccataacaagcagcccagcataaggagttccgaggatttccatctcaacagtttcaataaccccccccggcagtatcaaaaaattatgaaacgtcttattaagcggtatgtcctgcaggctcagattgataaagaatccgacgaggttaacgaaggagagctgaaagagatcaaacaggatatttcatctttgaggtacgagctgctggaggaaaagagccaaaacaccgaagatttagctgagctgatccgcgagctcggggaaaagctaagcatggaaccgaatcaggaagagaccaatcggtag

SEQ ID NO: 138403 - DNA, 2448 bp, Artificial Sequence
  Description of Artificial Sequence: Synthetic coding sequence
atgtctcagagccctgctttcggtccacgccgcggaagtagccctcggggcgcagccggtgctgcagcccggaggaacgagagccaggactaccttcttatggattctgagttgggagaggatggctgcccccaagccccactgccctgctatggctattatccatgcttccgtggctcagataacaggttggcccacagacgccagactgtcctcagggagaaggggagaaggttagccaacagaggacccgcctatatgttttctgatcgaagcacttcgttgtctattgaggaagaacggttcctggatgcggccgaatacgggaatataccagtggtgcgtaagatgctggaagaatgtcatagtctgaatgtgaattgcgttgactatatggggcagaacgccttacagttggcggtcgcgaacgaacacctggaaatcaccgaactgcttttaaagaaggaaaacctgagcagagtcggggacgccctgcttctggcaatctctaaaggctacgtaagaatcgtcgaggccattctctcccacccagcatttgccgagggcaagagactagccacctctccgagtcagagcgaactacagcaggacgacttttacgcatatgatgaggatgggacccgcttcagccatgacgtgacccccatcattctggcggcacattgccaggagtatgaaatcgtgcacacgctgctacgcaaaggagcccggattgagcggcctcacgactatttctgcaagtgcaacgattgtaatcaaaagcagaaacacgattctttttcccattcacgtagcagaataaacgcctacaagggactggcatcgcccgcctacctttccttaagctccgaagacccggtgatgacagccctggagttgtctaacgagctggcggttctggccaatatcgagaaggagtttaaaatgggtaagataatgcgcggaccatttatgaaatttgttgcccatgcggccagctttacgatattcctaggcctgctggtgatgaacgcagctgaccgttttgagggcactaaacttttgcccaacgaaacctccaccgacaacgccaaacaactctttagaatgaagactagttgcttctcctggatggaaatgctgattatctcttgggtgattggcatgatttgggctgagtgcaaggaaatttggacgcaagggcctaaggagtatctgttcgaactttggaacatgctcgacttcggcatgttggccatcttcgcagcctcatttatagcccgcttcatggccttttggcacgcttccaaagcccagtctattatagacgcaaatgacacccttaaggatcttacaaaggtcacactaggcgacaatgttaagtactataacctggcccgaataaaatgggatcctagtgacccgcaaataatctcagaggggctgtatgccatcgctgtcgtgctttcattttcgcgaatcgcatacattctcccggccaacgagtcctttggacctctccagatcagcctgggtagaactgtaaaggatatatttaaattcatggtgatctttattatggtattcgtggccttcatgattggtatgtttaatctctattcctactacatcggtgccaaacagaatgaagccttcaccactgtagaggaatcttttaaaactcttttctgggccatttttggattgagcgaggtcaagtcagtggtgatcaattacaaccataagtttatcgaaaacattgggtacgtgctgtacggcgtgtataacgtcactatggtgattgttctgttgaatatgctcattgccatgattaattcgtcatttcaggaaatagaggacgatgccgacgtagaatggaaattcgcccgtgccaaattatggttttcgtactttgaagaaggtcgaactctgcctgtgcccttcaacctagtaccatcgccaaaaagtcttttttaccttctgctcaagctcaaaaaatggatcagtgagctgtttcaagggcataagaagggcttccaggaagacgcagagatgaataagattaacgaggagaagaaattaggcatcctcggctcccacgaagatctgtctaagctaagcttggataagaagcaggtgggccataataagcaaccctctattcggtcctccgaagattttcatctcaactcctttaacaacccgcctaggcagtaccaaaagataatgaagcggcttattaaaaggtatgtattgcaggctcaaatcgataaggagagtgacgaggtgaatgagggagagctcaaggaaattaaacaggatatctcatccctgcggtacgaactgttggaagaaaagtctcagaatacagaagatctggctgagttaatccgggaactaggtgagaagttgagcatggagcccaaccaggaagaaacaaacagatag

SEQ ID NO: 138404 - DNA, 2631 bp, Artificial Sequence
  Description of Artificial Sequence: Synthetic coding sequence
atgtcccagtcgcccgccttcggaccacgtcgaggatcctcccctaggggcgctgcaggggcggccgcacgccgcaacgaatcacaggactacctcctgatggattctgagttaggtgaagacggatgcccgcaggcacccctgccctgttatgggtattacccttgctttagagggagcgataaccgactcgcacacagacggcagactgttctaagagaaaagggaagaagactcgcaaacagagggcctgcctatatgttttcagacagaagtacctccctttccattgaagaggagagatttttggatgctgccgagtacggaaacatcccggtcgtgaggaagatgttggaggaatgtcatagcctgaacgttaattgtgttgactacatgggccagaatgctctgcagctggccgtcgcaaacgagcacttggagatcaccgaattactgctcaaaaaggagaatctgtcccgggtgggcgacgcgcttcttctcgccatttcaaagggctatgtgaggatcgttgaagcgatcttgagtcatccagcttttgctgagggaaaacgtctggccacgtcaccaagtcagagcgagttacagcaggacgatttctacgcgtatgacgaggatgggacccgcttctctcatgacgttacaccaataatcctggccgcacattgccaggagtacgaaatcgtccacactctgttgcgtaaaggtgcccgcatcgaacgcccgcacgattacttttgcaaatgcaacgattgtaaccaaaaacagaaacatgacagcttttcccacagtcggtccaggatcaatgcttacaagggattggctagccccgcctacctttcattgagtagtgaagatcctgtcatgaccgctctggaactttccaacgagttggcggttctcgcgaatatcgagaaggagtttaaaaacgactataagaagctgtctatgcagtgtaaagacttcgtcgtggggctgctggatctttgtagaaacaccgaggaagtggaggccatcctgaatggggacgtggagactctccagagcggtgaccacggacggcccaacctgtcacgacttaaactcgccattaagtatgaggtgaagaagatgggaaagataatgcgcgggccttttatgaaattcgtggcgcacgccgccagctttacgatttttctgggactcctggtaatgaatgctgctgacagattcgaggggaccaaactgcttcctaacgagacatccaccgataacgcgaagcagctctttcggatgaagacaagctgtttcagttggatggagatgctcatcatcagctgggtgataggcatgatttgggccgaatgtaaagaaatatggacgcaaggacccaaggagtaccttttcgagctttggaacatgttggatttcggaatgctggccatctttgctgcctcgttcatcgccaggttcatggccttttggcatgctagtaaggctcagagtattattgacgcgaacgacacattaaaggatctcacaaaagtgacacttggtgataatgtaaaatactataacctcgccaggatcaagtgggacccctccgatccccagatcatttctgagggactgtatgccattgctgtggtgttgagtttttcccggattgcatatatcctgcctgctaatgaatcttttggtccccttcagattagtctcggccggaccgtgaaagatatttttaaatttatggtgatctttataatggtattcgttgctttcatgattgggatgttcaacctttatagctactatataggagcgaagcagaacgaagcctttacgaccgtggaggaatcttttaagacactgttctgggcgatcttcgggctcagtgaagtaaagtccgtcgtcatcaactacaatcacaaattcatcgaaaacataggatacgtgctgtatggtgtgtataacgtgaccatggtcatagtattgctgaacatgttgattgctatgatcaatagtagcttccaggagattgaggacgacgcagacgtggaatggaaatttgcacgtgcaaagttgtggttttcttactttgaggaaggcaggaccctgcctgtgccattcaatctcgttccaagccccaaaagtcttttctatctcctgcttaagctgaagaagtggattagcgaactctttcaaggacacaaaaaggggtttcaggaagatgccgagatgaacaagattaacgaagagaaaaagctcggtattctgggatcacatgaggatctgagcaaactaagcctggacaagaaacaggtcggacacaacaaacagccctccatccggtcgtctgaggattttcaccttaactcctttaataatccgcccaggcagtaccagaagattatgaaacggctgatcaagaggtatgtcttacaggcccaaattgacaaagagtccgacgaagtaaacgaaggggaattaaaggagattaagcaggacatatcaagccttagatatgagctgttagaagaaaaatcgcagaatactgaagaccttgcagagctcattcgagagcttggcgaaaaattaagtatggaacctaaccaggaggagaccaatcggtag

SEQ ID NO: 138405 - DNA, 2406 bp, Artificial Sequence
  Description of Artificial Sequence: Synthetic coding sequence
atgttgcgaaatagtacctttaaaaacatgcaaagaagacacaccaccctgcgggaaaaaggaagaagacaagctatacgcggcccagcgtacatgttcaacgagaaggggacttccctaacacccgaagaagaacggtttctagattcagctgagtatggaaatatcccggtcgtgagaaaaatgttagaggaaagtaaaaccctgaacttcaattgtgtagactacatgggccagaacgccttgcagcttgctgtcgggaatgagcacttggaagttaccgagctgcttcttaaaaaggaaaatcttgctcgcgtcggggacgcactgctgctggccatctcgaagggctacgttcgaattgtggaagcaattctgaatcaccctgcgtttgcacagggacagaggcttacgttgagccccctggaacaagagctgcgagacgacgatttttatgcatacgacgaggacggcacccgtttttcccacgacatcacacctatcattctggcagcgcattgccaggaatacgaaattgttcatatcctgctactcaaaggtgcacggatagagagaccccatgattatttctgcaagtgcaacgagtgtaccgaaaaacagcgcaaggactcctttagtcactcaaggagtcgtatgaacgcttacaaggggctcgcttctgccgcatatttatcactatcttccgaggaccctgtcctgactgctctggagctgtccaatgaactggcccggcttgctaatatcgagactgagttcaaattcgttgcccatcctaattgtcagcagcagttgttaactatgtggtacgaaaatctgtctggcctccgccagcagtccatcgcggtgaagtttctcgctgtttttggcgtgtccatcgggcttccttttctggcaattgcgtattggatcgctccatgttccaaactcggacgaaccctgcggagccccttcatgaagttcgtggcacatgcagtgtccttcacgatcttcttaggtttgctggtcgtcaacgcctccgatcgcttcgaaggggtgaagaccctgcccaacgagacatttacggattacccaaaacagatctttcgggttaagaccacgcagttttcgtggacagagatgcttattatgaagtgggtgctcgggatgatctggtcggaatgtaaagaaatttgggaagaggggccccgcgaatatgtcttacatctctggaatttgttggattttgggatgctaagcatttttgttgcctccttcacggcccgatttatggccttcctgaaggctaccgaagcacagctgtatgtggatcaacacgttcaagatgacactctgcacaacgtatctttgccgccagaggtggcttacttcacctatgctagggataagtggtggccctcagatccccagatcatcagcgaaggcctctatgcaatcgcagttgtactctcattctccaggatcgcttacattcttcccgccaacgaaagttttggccccctacaaattagcctggggcgtacggtaaaggacatcttcaagttcatggtaatattcatcatggtattcgtggcctttatgatcggaatgtttaatctgtactcttattacaggggggctaaatataatcctgcctttacaacagtcgaggagagttttaaaaccctgttctggagtatctttggactttcagaggtcatatctgttgtgctcaaatacgatcacaaattcatcgaaaacataggttacgtcttatacggtgtctataacgttacaatggtggtagtgctgctgaacatgctgatcgcgatgattaacaattcctaccaggagatcgaggaagacgccgatgttgaatggaagtttgctagggccaaactgtggctgtcatattttgacgaagggcgcacactgcctgctccattcaatctagtcccctcccccaagagtttctattacttgataatgcggatcaagatgtgccttattaaattgtgtaaatctaaagccaaatcatgcgaaaacgacctggaaatgggtatgctgaattcaaagtttaaaaagacacggtaccaggcggggatgagaaattccgaaaacctcacagctaacaacacactgagcaaacccactaggtaccagaaaatcatgaaacgactaatcaaaagatacgtcctcaaggctcaggtagatcgtgagaacgatgaggttaacgaaggggagctcaaagaaataaagcaggacattagtagcttaaggtatgaattgctggaagagaaatctcaggcaacaggagaactcgcagacttaatccagcagctgtccgagaagttcggcaaaaacctcaataaggatcacttacgggtgaataaggggaaggatatctag

SEQ ID NO: 138406 - DNA, 2241 bp, Artificial Sequence
  Description of Artificial Sequence: Synthetic coding sequence
atgctacggaatagcacctttaagaacatgcagaggagacacactacattgagggagaaaggacgcagacaagcgattaggggacctgcatacatgttcaacgaaaagggcacgtccttaacccccgaagaggagaggttcctggacagcgccgagtacggtaacatccctgtggtgcgtaagatgcttgaggaaagtaagactctcaactttaattgtgtggactacatgggtcagaacgcactgcagctggcggttggtaacgagcacttggaggtgacagagctgttgctgaaaaaagagaatctggcacgagtcggcgatgccctgcttttagcaattagcaagggatatgtgaggattgtcgaggccatactgaatcatccggccttcgctcagggacaacgcctgactctttcgcctctcgaacaggaattgcgggacgatgatttctacgcttacgatgaggacggaactcgattttcacatgacatcactccaattattctcgccgctcactgtcaggagtatgagatagttcatattctgctcctgaaaggcgctagaatcgagagaccccatgactacttttgcaagtgtaatgagtgtacagaaaaacaaaggaaagatagcttttctcacagtcgctctcggatgaacgcctacaaaggtctggcgtctgccgcttatctgtcactgtcaagtgaggaccccgttttgaccgccctcgagctgagtaatgaattagcaagactcgctaacatcgagaccgaattcaagctggggcgcacgcttcggtccccttttatgaaattcgttgcccacgctgtgtctttcacaatattcttaggcttactggtcgtgaatgcatccgatcggttcgagggcgtgaaaacactgcctaatgagacttttaccgattaccccaagcagattttcagagtgaaaacaacacagttctcttggacagaaatgttgatcatgaagtgggtcctcggtatgatctggtcagaatgcaaagaaatatgggaggagggaccgagggagtacgtgctgcacctctggaacctgttggacttcggcatgttgtcaatattcgtggcttctttcacagcgcgcttcatggcctttttgaaggctacggaagcccaactctatgtggatcagcacgtccaggacgatacgctgcacaacgtgtccctgcctcctgaagtggcttacttcacatacgcgagagacaagtggtggccttccgacccacagatcattagcgagggcttatatgccatcgccgtcgtgctttcattctcccggattgcgtacattctccctgcaaacgagtctttcggccctctccaaatctcactgggacgtaccgtaaaggatatcttcaaatttatggtaatctttatcatggtgttcgtggcttttatgatcggaatgtttaacctatattcatactacaggggtgcaaaatataaccctgcatttaccaccgtcgaagagtcctttaagacccttttctggagcatttttggactgtccgaggtcatctccgtagtgctgaaatatgaccacaagtttatagaaaacataggatatgttctctatggggtgtacaacgtcactatggttgtcgtactgcttaacatgctgattgcaatgatcaacaactcttaccaggagatagaggaggatgccgatgtcgaatggaaattcgcacgggccaaactttggttgtcctatttcgacgagggtcggactctccctgctccattcaatctcgtgccatccccgaagagcttttactacctgattatgcgcattaagatgtgcctgatcaagctttgcaaatccaaagccaagagctgcgagaatgacctcgagatggggatgttaaatagtaaattcaaaaaaacccgatatcaggcagggatgagaaactccgagaacctgacggccaacaacacgctgagcaaacccacacgctaccagaagattatgaagcgcctgatcaagcgatatgtgctgaaagcacaagttgaccgggaaaatgatgaggtcaatgagggcgaactgaaagaaatcaagcaggatattagctccctcaggtatgaacttctggaagaaaagtcccaggccactggggagctcgccgatctgatacagcagctgagcgagaaattcggaaaaaacttgaacaaggatcatctgcgtgttaataaagggaaggacatttag

SEQ ID NO: 138407 - DNA, 2589 bp, Artificial Sequence
  Description of Artificial Sequence: Synthetic coding sequence
atgctacgaaattctacatttaaaaatatgcagcggcgtcatacaactctcagagaaaaggggcgccggcaggctattcggggccccgcttacatgtttaatgagaaaggaacaagcttaaccccagaggaagaacgattcctggatagcgccgaatatggcaatattcccgtggtgagaaagatgctcgaggagagcaaaactttaaattttaattgcgtcgactacatgggccaaaacgcacttcagctggctgtggggaacgaacatctcgaggtgactgaactgttgctgaagaaggaaaacctcgctcgggtcggggatgcgcttctgttggccattagtaaaggctatgtccgaattgtggaggctattctaaatcacccggcttttgcacaaggacagcgcttgacgctgtctcctttggaacaggagctgagggacgatgacttctacgcgtatgacgaggatggcacacgattttcccacgacattacccccatcatcctcgctgctcactgtcaagaatatgaaattgtgcatattctgctactgaagggggctcgcattgagagaccccacgattacttttgcaagtgtaatgaatgcacggagaagcagagaaaggacagcttcagccactctcggtccagaatgaatgcctacaaaggcttggcgtcagcagcttacctctccctgtcctccgaggatccggtcttaactgcgcttgaactgagcaacgaactcgcacgccttgcaaacattgaaacggagtttaaaaatgattacaggaagctatccatgcaatgtaaagattttgtcgtcggggttttggacctctgtcgcgacacagaagaagtggaagcaatcctgaatggggatgtgaacttccaagtgtggtccgaccaccatcggccttcactgagccgcataaagttagcaatcaagtatgaagttaagaagtttgtagcccaccctaattgtcagcagcaacttctcaccatgtggtacgaaaacctgagtggactgcgccagcagagcattgcagtgaagttcctagccgtgtttggtgtatccattggcctgccatttctagccatcgcatattggattgcgccatgctccaaactcggaagaacattgcgctctcccttcatgaaatttgtggctcacgctgtgtccttcacaatatttctgggtttattggtcgttaacgcatcagaccggttcgaaggtgtgaagactctgccaaacgaaacttttacggactatccaaagcagatcttcagagttaaaactacgcaattctcatggactgagatgctgatcatgaagtgggtcctgggaatgatttggtcagagtgtaaggagatctgggaggaagggcctagggaatatgtactacatctttggaacctgctcgacttcggcatgctctcgatatttgtggcgtcttttaccgcccggttcatggctttcctcaaggcaactgaagctcagctgtatgtcgaccagcatgttcaggacgacacccttcacaatgtcagcctcccacccgaagtcgcatattttacatacgctagagataagtggtggccttctgaccctcagatcatctccgagggattatatgccatcgctgtggtactgtcgtttagtaggatcgcctacatccttccagccaacgaaagttttggtccccttcaaatctcccttggcagaactgtgaaggacatttttaaatttatggtgatttttatcatggtgtttgtggcatttatgatcggcatgttcaacttatattcatattatcggggcgcaaaatataaccccgcctttaccactgtggaagaatcttttaagactctcttctggtccattttcggactctcagaagtgattagcgtggtgttaaagtatgatcacaagttcattgagaatattgggtacgtgctttatggagtgtacaacgtgactatggtggtggtgctcctcaacatgctcatcgcaatgattaataacagctatcaggaaattgaggaagatgccgacgtggaatggaaatttgccagagccaagctatggctgtcctacttcgacgaagggcgcactttaccagcgccctttaatctcgtgccttccccgaagtctttctactacttgataatgcggattaaaatgtgtttgataaaactctgtaagagcaaagcaaagagctgtgagaacgacttagagatgggcatgcttaactccaagttcaagaaaaccaggtatcaggccgggatgcggaactccgaaaatcttaccgcgaacaacactctttctaagcctaccaggtaccagaaaattatgaagcggttgattaagagatacgtcctgaaggcccaagttgacagggaaaatgacgaggtgaacgagggcgagcttaaagaaattaaacaagacatttcttccctgagatatgagctgttggaggaaaagtcgcaggccactggcgaattggccgacctgatccagcagctttccgagaaattcggaaagaacctgaacaaggaccacctgcgggtgaacaaagggaaggacatctag

SEQ ID NO: 138408 - DNA, 4350 bp, Artificial Sequence
  Description of Artificial Sequence: Synthetic coding sequence
atggaacctagcgccctgcgaaaggccggatccgagcaagaagagggatttgagggcctccctagacgcgtaacagatctgggaatggtcagcaatctccgaagatcaaactctagcttatttaagtcctggagacttcagtgccccttcggcaacaatgacaagcaggaaagtttatcaagttggatcccagaaaatattaagaagaaggagtgtgtatatttcgttgaatccagtaagctctcagatgcaggtaaggtggtttgtcaatgtgggtacactcacgaacagcacctagaagaggccacaaaaccacacacgttccaggggactcagtgggatcccaaaaagcacgttcaagagatgccgaccgatgcattcggggatatcgtgtttacaggcctgtcccaaaaagtgaagaaatacgtgcgggtaagccaagacaccccttcgagcgtaatttatcacctgatgacgcagcactggggactggatgtgccaaacctgctgatttctgtcacgggaggcgccaagaactttaacatgaaacccagactgaagtctattttcaggaggggcctggtgaaagtcgcacaaaccacgggagcgtggattatcacgggggggtcccacaccggagtgatgaagcaagtgggcgaagcagtgcgggactttagtctgagttcatcctacaaggaaggggagctgattaccattggggttgcaacgtggggaacagtgcacaggagagagggcctcatccacccaacagggtcctttcccgccgaatatattttggatgaggacggtcagggcaaccttacttgcctggatagtaatcactctcattttatactggtggatgacggaacgcacggccagtacggagttgagatccccctgaggactaggttggaaaagttcataagcgaacagactaaggaaagggggggagtggctattaagattccaattgtctgtgttgtgcttgaaggcggcccaggaacccttcatacgatcgacaacgccaccacaaacggcaccccatgcgtcgttgtcgagggctcagggagagtggctgatgtcattgcacaagttgcaaatctgcctgtcagcgacattactatctcactgattcagcagaagttgtctgttttttttcaagaaatgttcgagacatttactgagagcaggatcgtagaatggactaagaaaatacaagacatcgtgcggcggaggcaacttctgaccgtatttcgggaaggtaaggacggacagcaagacgttgacgtagctatcctgcaagcactattaaaagctagcaggtcccaggatcacttcggccacgaaaattgggaccatcagctcaaactggctgttgcatggaacagagtcgatattgcccgaagcgaaatttttatggatgagtggcaatggaagcccagcgaccttcatcctacgatgacagcagcactgattagcaacaaaccagaatttgttaagttgtttctggagaacggcgtccagctcaaggaattcgttacatgggacacattactgtatctatacgagaatttggacccatcctgtctgtttcacagcaaactgcaaatgcaccacgtggcccaggtgctccgggaacttttaggggattttacccagcctctgtacccgcgtcctaggcataacgaccggctgcgcctgctcctcccggtgccccacgtgaagctgaacgtacagggtgtgtcactacgaagtctctacaagcggagctctggccatgtgacttttaccatggatccaattcgtgacctgcttatctgggcaattgtccagaatcgtagggagctggcgggtattatttgggctcagagccaggactgcattgccgccgcgttggcctgtagcaaaatcctgaaggagcttagcaaagaggaggaagataccgattcctctgaggagatgcttgcattagcggaagagtatgagcatcgggctattggagttttcaccgagtgttaccgaaaggacgaggagcgcgcccagaaactcctcacgcgcgtctctgaagcctgggggaagacaacttgcctgcagttagctctcgaggccaaagatatgaagttcgtgagtcatggcggcatccaggcattcctgacaaaggtgtggtggggacagttaagtgtggataacggcctctggagggtaaccctgtgcatgctggcatttcctctgctgctgaccggcctaattagctttcgcgagaagagactgcaggacgtgggaactcctgccgccagggctagggccttttttaccgcaccggtcgtcgtgttccacctcaacatactctcatactttgcgttcctgtgcctcttcgcttacgtcctgatggtggacttccagcccgtcccatcttggtgtgagtgcgctatttacttatggctcttctctctggtttgcgaggagatgcggcaacttttttatgatcccgatgagtgcggccttatgaagaaagccgccctgtacttcagcgatttctggaacaaacttgacgtgggggctatccttctattcgtggcaggactgacgtgtcgactgattcctgcgaccttatatccaggccgcgtgatcctttcgctggactttatactgttctgcctgcgtctcatgcacatcttcacaatctctaaaaccctcggtccaaagatcattatagtgaagcgcatgatgaaggacgtcttcttttttcttttcctgttggccgtgtgggtcgtgtccttcggtgtcgccaaacaagccatacttatacataacgaacgcagagtcgactggctctttagaggggccgtctatcattcttatctgaccatcttcggacagatccctggatacattgacggagtgaacttcaatcccgagcactgttcaccgaatggaacagacccctataaaccaaaatgtccagagagtgatgctacccagcagaggcccgctttccccgagtggttgactgtcctattgctttgcctctacctgctgtttacaaacatattgctgttgaatttactgatcgccatgttcaactatactttccagcaagttcaagagcatacagaccagatatggaaatttcagagacacgacctaattgaagagtaccatggaagacccgctgcgccccccccttttattctcctgagtcacctccaattatttatcaagcgggtcgtcttgaaaacaccagcaaaacgccacaagcagctgaagaacaagctggagaaaaacgaggaggccgccttgctgtcttgggaaatatatcttaaagaaaattatcttcagaacagacagtttcagcaaaagcaacggcccgagcagaaaatcgaagatatctccaataaggtggacgctatggtagatttgttagatttagatcccctgaagcggtccgggtctatggaacagcgattggcctccctggaggagcaggtggcacaaacagcacaggcccttcactggattgtaaggacactgagagctagcgggttttcatccgaagccgacgtgccgactctggccagccagaaagccgccgaagaacccgatgccgagcctggcggaaggaaaaaaaccgaagagcccggtgatagctatcacgtgaacgccagacatctcctttatcccaactgtcccgtgaccaggtttcctgtgcctaatgaaaaagtaccatgggagaccgagtttctgatttacgacccgccattctacacagctgaacggaaagatgctgccgcaatggaccctatgggcgagaatcctatgggaagaacgggattacggggtagagggtctctcagttgttttggtccaaaccataccctgtatcccatggtgacccgctggaggcggaacgaagatggcgcaatctgcaggaaatctattaagaagatgctggaggtgctggtggtgaaactccctttaagcgagcactgggctctcccaggcggcagtagagagccaggagagatgctgcccagaaagctgaagaggatcttgcgccaagagcactggcccagcttcgaaaacctgctgaagtgtggtatggaggtttataagggctacatggacgacccccggaacaccgacaatgcatggatagaaacagtggctgtgagcgtccactttcaggatcagaacgatgtggagctgaacagattaaattcaaatctgcatgcttgcgactctggggcatccatccggtggcaggtggtggacaggcgcatacctctgtatgctaaccataaaacgcttttgcagaaagcagccgccgaatttggtgcccactattag

SEQ ID NO: 138409 - DNA, 4512 bp, Artificial Sequence
  Description of Artificial Sequence: Synthetic coding sequence
atggagccttcagccctccggaaggcaggatctgaacaggaagaggggtttgagggtctccctagacgggtcactgatctgggcatggtctctaacttgcggcgcagcaactcttccttatttaagtcctggagattacagtgtcccttcggaaacaatgacaaacaggagagcctttcatcctggattcccgagaacattaagaagaaagaatgcgtgtactttgtggagagcagcaagttgtccgatgcaggtaaagtggtatgtcagtgcggatacacgcatgaacaacatttagaggaagccactaaaccccacaccttccaaggtacccagtgggatccaaaaaaacacgttcaggaaatgcctacggacgcctttggagatattgtgttcactgggctgagtcagaaagtgaagaagtacgtgagggtgtctcaggatactcccagtagcgtaatctaccacctcatgacacagcactggggattggacgtgcccaatctactgatttccgtcaccgggggggcaaaaaattttaatatgaagcctaggttaaagtctatcttccgacgcggacttgtgaaggtggctcaaaccacaggagcttggatcatcacaggcggttcgcatacgggtgtgatgaaacaagtgggggaagccgttcgggatttctccctctcgagcagttacaaagagggggagctgattactatcggggtggccacttggggcacagtgcatagacgtgagggtttaatccatcctacaggtagcttccctgcagagtacatcctcgacgaggatgggcagggcaatctcacctgcttggattcaaaccactctcactttatcctagtcgatgatggcacccacggccagtatggcgttgaaatcccgctgcggacacgcttagagaagttcatttctgagcaaacaaaagaaaggggcggagtggcgataaagatccctatcgtatgcgtagtcctggagggtggaccgggaaccctgcacacgatcgacaatgccactacaaacggaacaccctgcgttgtcgtggaaggctcaggcagggttgctgatgtcatcgcccaggtggccaatctacccgtgtccgatattactatctctctgattcaacaaaagttgtcagtctttttccaagaaatgttcgagaccttcaccgaaagccgtattgtggaatggaccaagaaaatacaggacattgtgcgccggcggcagctgttaacagtgtttagggagggaaaagacggtcaacaggacgtggatgtggcaatcctgcaggccctcctaaaggctagccgttcccaggaccactttggccatgagaactgggatcaccagctgaagttggctgttgcttggaaccgagtcgatatcgcgcgtagcgagatcttcatggacgagtggcaatggaagcctagcgatctgcatcctacaatgactgcagcgctgatcagcaacaagccggaatttgtgaagttgtttcttgaaaacggtgtccaactaaaagagttcgttacttgggatacattactgtacttatatgaaaacttggacccatcctgtctgtttcacagcaaacttcagaaggtgctcgtcgaggaccccgaacgacccgcttgtgccccagccgccccaaggctgcagatgcatcatgtcgcccaggtactgcgagaacttctgggggatttcactcagccactgtacccgcgacctcgccataacgatagactcaggttactactgcccgtgccacacgtgaagcttaacgtgcaaggcgttagcctacgatctctttacaaacgctctagtggccacgtcacattcacaatggatcctatcagagacctgctgatctgggctatagtacagaacaggagagaactggcagggatcatctgggctcagagtcaggactgcattgcagcagccctcgcctgcagtaaaatccttaaagagctaagcaaagaggaagaggataccgattcgtctgaagaaatgctcgccttggccgaagagtatgaacaccgggccattggtgtgtttactgaatgttaccgcaaggacgaagagagagcacagaagcttctgacgagagttagtgaggcctggggaaagacaacatgcctgcaattggctctcgaggcgaaagacatgaagttcgtttcccatggaggcattcaagcattcctcaccaaggtatggtgggggcagttgtctgtcgataacgggctctggagagtcactctgtgcatgttagccttccctctgctgctgactgggcttatctcttttcgtgagaagaggcttcaggacgtcggtaccccagcggctcgagcaagagcgttcttcaccgcacccgtggtggtttttcacttaaacattcttagttactttgcgttcctctgccttttcgcctacgtactcatggtcgattttcaacccgtgccctcctggtgcgaatgcgccatttacctgtggctgttttctttagtatgtgaggaaatgaggcaattgttctatgaccccgacgagtgcggactgatgaagaaagcagctctttacttttccgacttctggaacaaacttgacgtgggcgccattctgctttttgtggccggtttgacctgccggctgatccctgcaacgctatacccaggcagagtgatattatcactcgatttcattctgttctgcttgcggctcatgcacatctttaccatcagcaagaccctcgggcctaagattatcatcgtaaaacggatgatgaaggacgtttttttcttcctgttcctcttggccgtgtgggtagtctcctttggtgtggccaagcaagccatcctgatccacaacgagcggcgggtggactggttattcagaggggctgtgtaccactcctatttgacaatcttcggccagattccgggctatattgatggcgttaattttaacccggaacattgctcgcctaatggtacagatccatacaaaccaaaatgtccagagtctgacgccacccaacaacgccctgcttttccagagtggttgacagtcttactattatgcctgtatctcctgtttaccaatattctgcttttgaatctgttgatcgcaatgtttaattacaccttccagcaagtgcaagagcacaccgaccagatctggaaattccaaaggcatgatttgatcgaggagtatcatggccgcccagcagcccccccacccttcatacttcttagccatctgcagctttttataaagagggtggttctgaaaacaccagctaagcggcacaagcagctaaagaataagctggaaaagaatgaagaggccgcccttttgtcctgggagatctacttgaaggagaactacctacagaaccggcagttccaacagaaacagcgacccgagcagaaaattgaggatatcagtaacaaagtggatgctatggtcgatctgttggatttggacccattgaagagaagtggcagcatggaacagcgcctcgcttcactggaggagcaggtggcgcagacagctcaggcgctgcactggatcgtccggactctgcgcgctagcgggttttccagcgaagcagatgtgcccaccctggcttcgcaaaaggccgccgaggaacccgacgctgagcctgggggacgtaaaaagacagaagagcccggggactcttatcacgtgaacgctcgtcacctgctataccctaactgtcccgtgacccgatttccagtgcccaatgagaaggtaccgtgggaaaccgagtttcttatatacgatcctccattctataccgccgaacgcaaggacgccgctgccatggatcctatgggcgacacgctcgaaccgctttcaactattcagtacaacgttgtcgatggtttgcgagaccgccgctcatttcatggaccgtatactgtgcaggccggcttgccattaaaccctatgggacgaaccggtcttagaggcagaggatccctgagctgctttggccccaatcataccttgtaccctatggtgactcgctggcgaagaaacgaagacggtgcgatctgcaggaaaagtatcaagaaaatgctggaggtcttggtcgtgaaactcccactgtccgaacattgggcgttgccgggaggctcccgggagccaggagagatgctgccacgaaagttgaagaggatcctccgccaggaacactggcccagttttgaaaatttgctgaagtgcggaatggaagtttataagggctacatggatgatcctcgtaataccgataacgcctggatcgagacagtggccgtgagcgtgcattttcaggatcaaaacgatgttgaactgaacaggctcaatagtaatcttcacgcttgtgattccggcgcgtctattaggtggcaggtggttgacaggcggatcccactgtacgccaatcataagaccctgttgcagaaggctgcagcagaattcggtgctcactactag

SEQ ID NO: 138410 - DNA, 4512 bp, Artificial Sequence
  Description of Artificial Sequence: Synthetic coding sequence
atggagccttccgctctgcgcaaagctggctccgagcaagaagagggatttgagggcttgccgagacgcgtgactgacctggggatggtgagcaacctgcggcggtctaactcgtctcttttcaagtcgtggaggttgcagtgtccctttggcaacaacgacaagcaggagagtctgtcgtcctggatccctgaaaacattaaaaagaaagagtgtgtttactttgtcgaatcctctaagctgtctgacgccggtaaggttgtgtgccagtgcggttacacccacgagcagcacctggaggaggccacaaaaccacacacctttcagggcactcaatgggatccgaagaagcatgttcaagagatgcccactgacgcatttggagacatcgtcttcacagggctgtcacaaaaggtgaagaagtacgtgagagtgtcccaggacaccccttcctcagtcatatatcatctgatgacccagcattggggactggatgttccaaacctactgataagcgtcaccggcggcgcaaaaaacttcaacatgaagccacggctgaagtccattttccggcggggtctggtcaaggtcgcacagactacgggagcgtggatcatcactggaggtagccatacaggcgtgatgaaacaggtaggagaagccgtgagggatttctctctttcgagctcatataaggagggggagctcattaccattggcgtggccacatggggtacagttcacaggagagagggcctgatccaccccaccggatcgtttcctgccgagtatatccttgatgaggacgggcaaggaaacctcacatgcctcgactccaaccattcacacttcatactggtcgatgacggcactcatggccaatacggcgtggaaatccccttgagaacaaggctcgaaaagttcatctccgaacaaacaaaggaaaggggaggagtagcgataaaaatccctatagtgtgtgtggtgctggagggtggtcccggcactctccacactattgataatgccacaaccaacgggacgccttgcgtagtcgttgagggatctgggagagtagccgacgtgatcgcccaggtggcaaacttgcccgtctcagacatcactattagtctgattcagcagaaactgtcagtgttctttcaagagatgttcgagacatttaccgagtctaggattgtggagtggaccaagaagattcaggacatagtgaggagaagacagctgcttaccgtgttccgggaaggtaaagacgggcaacaagacgtagatgttgcaattctgcaggcattgctgaaggccagcagaagtcaggaccacttcggccacgagaactgggaccatcagttgaagctggcagtggcatggaaccgcgtcgacatcgccaggagcgagatttttatggacgagtggcagtggaagcctagcgacctccacccaaccatgactgcggctcttatatctaataagccggaatttgtgaagttatttctggagaacggagtccagctcaaagaattcgtcacatgggataccctattatacctatatgagaatttagatccttcctgtctcttccatagtaagctgcaaaaagtattggtggaggatccggagcggcccgcatgtgcccctgcagcccccaggctgcagatgcaccacgttgcacaagtcctgagggagcttctcggcgacttcacccagcccctgtacccccgtcccaggcacaacgaccgcctccgactgctactacctgtgcctcacgttaagctgaatgtccagggggtatccttgcgatctctatacaaaaggtcctccggtcacgttactttcaccatggatcctattcgcgacttacttatttgggccatcgtacagaaccgccgggagctcgccggcattatttgggcacagagccaggactgtattgctgccgccctcgcctgttctaaaatactgaaagagttgagcaaggaagaagaagatacagattcctctgaggagatgctggcactggctgaagagtacgagcacagggcaatcggtgtcttcactgagtgttataggaaagatgaagaaagggcacagaaactgctgactcgggtttctgaggcttggggcaaaacaacctgtcttcagctggcactggaagctaaggatatgaagttcgtttcccatgggggcatccaggccttcctgaccaaagtctggtggggacagctgtcagtggacaatggtctgtggcgagtgaccttgtgcatgctggcttttccgctcctgcttactggcttaatctcctttcgggagaaacgtctgcaggacgtggggacaccagcagccagggcccgggcattctttaccgcccctgtagtggtgttccacttgaacattcttagctactttgcttttctttgtctctttgcatacgtactgatggtggatttccaaccagtaccgagctggtgcgagtgcgcaatatacctctggctgtttagcctggtgtgtgaggaaatgagacagttgttctatgaccccgacgagtgcgggctgatgaaaaaagccgctctctacttctctgacttctggaacaagctggacgtcggcgccattttactattcgttgccggactgacgtgtagactgatacccgctactctgtatcccggtcgtgtgatcctgtccttagatttcatcctgttttgccttcgcctgatgcacattttcacaatatccaaaaccttgggcccaaaaattatcatcgtgaaaagaatgatgaaggacgtcttctttttcctctttttactggctgtgtgggttgtgagctttggtgtggccaaacaggcgatcctgatccacaacgagagacgcgtcgactggttgtttagaggagccgtctatcacagctatctgaccatttttggtcagattcccgggtacatcgatggagtgaactttaatccagagcactgcagccccaacggcaccgatccgtataagccaaagtgtcctgagagtgatgccactcagcagcgacctgcgtttcctgagtggcttaccgtcttgctactttgtttgtacctgctgttcaccaatatcctccttctgaatcttctcatcgccatgttcaactatacattccagcaggtccaggagcacaccgatcagatctggaaatttcagcggcatgacctcatcgaggagtaccatggccgacccgcagccccaccgcccttcatcctgctgtcccaccttcagcttttcatcaagcgggttgtcctcaagacccctgccaagcgacacaagcagctcaagaacaagctcgagaagaatgaggaagccgcactgctaagttgggagatatacttgaaggagaattacctgcagaatcgtcaattccaacaaaaacagagaccagaacagaagattgaagacattagcaataaagtggacgccatggtggatttattagatctggatcctcttaagaggtctggaagtatggaacagcggctggcctccctcgaagagcaggtagctcaaacggcccaggcgctgcactggattgttcggacgttacgggcttccggttttagttcagaggccgatgtgccaacgctcgcgtcacagaaggcagcggaggagcctgatgctgaacctggcggtaggaaaaagacagaggaaccgggcgatagctatcatgtcaacgcccgccatctgctgtaccctaattgccccgtcacgcgattccccgtgccaaacgagaaggtcccttgggagaccgagtttttgatttacgatccaccattctatactgcagagcgcaaagacgccgccgcgatggatccaatgggagacaccctggagccattatctactattcagtataatgtggtcgacgggctccgcgatcgccgctcctttcacgggccgtacacagtgcaggcgggactgccactgaatcctatgggccgcactggactcagaggtcgaggaagtctgagctgttttggaccaaaccatacgctgtacccaatggttaccaggtggagacgcaacgaagacggagcgatctgtcggaagtcaatcaagaagatgctggaagtgttggtcgtgaagttaccgctgtccgaacattgggccctgccagggggcagccgggaaccaggtgaaatgctccctcggaaattgaaaagaattctacgccaggaacactggccttcctttgagaacctgctgaagtgtgggatggaagtgtataaaggatacatggacgatccccgtaacacagataatgcttggatcgagaccgtggccgtcagtgtccatttccaggatcagaacgacgtggagctcaaccgcctgaattccaacctccacgcctgcgattctggcgccagcataagatggcaggtcgtcgacagacgaatccctctgtacgccaaccataagacccttctgcagaaggcggcggccgagttcggagcccattactag

SEQ ID NO: 138411 - DNA, 435 bp, Artificial Sequence
  Description of Artificial Sequence: Synthetic coding sequence
atggagccatcagcattacggaaggctggaagtgagcaggaagaagggtttgaaggtctgccaagacgagtgacggatctgggaatggtttcgaatctcaggcggtcaaacagtagtctttttaaaagctggcgcctacagtgtccgtttggcaataatgacaagcaggagtcactcagcagttggattccagaaaatattaaaaagaaggagtgtgtgtacttcgtcgaatcttctaagttgtcagacgccggcaaggtagtgtgtcaatgtggatacacccacgaacagcacttagaggaggccacaaagccgcacacattccagggcactcaatgggatccgaaaaaacacgttcaggagatgcccacagacgcctttggcgatatcgtgtttaccggcctttcccagaaggtcaagaaatacgtcagatag

SEQ ID NO: 138412 - DNA, 744 bp, Artificial Sequence
  Description of Artificial Sequence: Synthetic coding sequence
atgttgtccagggaacaggaagaggatggaggcgcagggaggcagtaccacgtaaacgctagacacctcttatacccaaactgccctgtcaccaggttccccgtcccaaacgagaaggtgccctgggagactgaattcctgatttatgacccaccattctatacagctgagcggaaagatgcggccgccatggaccccatgggtgagaatcctatggggcgcaccgggcttcgcggcaggggaagcctgtcctgtttcggtccaaatcacacgctgtatcccatggtcacacggtggagacgcaatgaggatggggccatttgtaggaaaagcatcaagaaaatgttggaagtgctggtcgtgaagctgccactgtccgagcactgggctttaccaggcggaagtagagaaccaggagagatgcttccacgcaaacttaagaggatactcagacaggagcattggccttcattcgagaatttgctgaagtgtggcatggaagtgtataagggctacatggatgaccctaggaataccgacaacgcttggatcgaaaccgttgcagtcagcgtgcatttccaggatcagaacgatgtcgagttgaaccgcttgaactctaatctgcatgcttgtgatagcggcgcctccatcagatggcaggtggtagacaggaggattcccctatacgctaatcacaaaaccctgctgcagaaggcagcggctgaattcggcgcccattattag

SEQ ID NO: 138413 - DNA, 5136 bp, Artificial Sequence
  Description of Artificial Sequence: Synthetic coding sequence
atgggaaagaagtggcgcgacgccgctgaaatggagcgagggtgcagtgatcgggaggataatgccgagtcaaggcggagatctcggtctgcttcccgtggacgtttcgctgagagttggaagcgcctgagctcaaagcaaggcagtactaaacggtcaggtctgccttctcagcaaactcctgcccagaagtcctggatagagcgggcattctacaagcgtgaatgcgtccacattattccctccacaaaggacccgcatagatgctgttgcggacgccttataggccaacatgtgggcctgacaccctccattagcgttcttcagaacgagaagaacgagtccagactgtcaagaaatgatattcagtctgaaaagtggtctatttccaaacacacacaactctctccaactgatgccttcggaactatcgaattccagggcggtggccactcaaacaaagccatgtacgtccgcgtgtcgtttgacacaaagcccgatctgctgcttcatcttatgaccaaagagtggcagctggagctcccaaaattgttgatcagcgttcacggcgggctacagaattttgaactccaacctaaacttaagcaggtatttgggaaggggctcatcaaggccgctatgacaacgggcgcctggatcttcacaggtggggtgaatacgggtgtgatcagacatgtcggcgatgcactgaaagaccatgcttcgaaaagcaggggaaaaatctgtactataggtatcgccccctggggaatcgtcgaaaaccaggaagatctcatagggagggacgtggttaggccataccagaccatgagcaatccaatgtctaaactgacagtccttaacagtatgcatagtcattttatcttagctgacaacggtacaaccggaaaatacggagctgaggtaaagctgaggagacagttggaaaaacacatctctttgcaaaaaattaatacgcgtatcggtcagggagtccccgtggtggctctgatagtcgaggggggccccaatgtgatctctatagtgcttgagtatttaagagatacacctcccgttcccgtggtggtttgcgacgggtctgggagagcatcggatattttagcatttggacacaaatattccgaggagggcggtctcatcaacgagtctctcagagatcagctgctagtcacaattcagaagactttcacatataccaggacccaggcacaacacctgtttatcattttgatggagtgcatgaaaaagaaggagctgattaccgtgtttagaatgggaagcgaggggcaccaggacatagacctggctattctgaccgccctcctgaagggcgctaatgccagtgccccagatcaactgtcacttgccctcgcgtggaatagagtcgatatcgccaggtcacagatctttatctacgggcagcagtggcctgtcggttcgcttgaacaggccatgcttgacgctctggttttggaccgcgtggacttcgtaaagcttctgatagagaacggtgtcagcatgcaccgttttctgacaatttctcgcttagaggagttatacaacactcggcacgggcccagcaacactctgtaccatcttgttagggacgtgaaaaaaagggaatatcctggattcgggtggatctacttcaagggcaatttgccacccgattaccgtatttctctcatcgatatcggattagtcattgaatatctgatgggtggcgcatataggtgcaactatacacgcaaaagattccggaccctataccacaacctatttgggcccaagagagatgacatccccctgagaagagggcgaaagaccactaagaaaagagaagaggaggttgacattgacctggacgatccggagataaatcatttcccgtttccattccacgaattgatggtgtgggctgtgctgatgaaacgccagaagatggctcttttcttttggcaacatggggaagaggctatggcaaaggctctcgtagcatgtaagctgtgtaaagcaatggctcacgaagcctccgaaaacgacatggtggacgatatttcacaggagcttaatcacaattcgcgggactttggccagcttgccgtggaactgttggatcagtcctacaaacaggatgagcagttagccatgaagctgcttacttatgagctgaaaaactggtctaatgctacctgtttgcagctggcagttgctgccaaacacagggactttatcgcccacacctgttcccagatgctgctgacagatatgtggatgggtcgactaagaatgcgaaagaattccgggttaaaggtgattctgggtatcctgctccccccttccattctgtcattagagttcaagaataaagatgacatgccttatatgagtcaggcccaggagattcatctgcaggagaaagaggccgaggaacctgagaaacccaccaaagaaaaggaggaagaggacatggaactgacagccatgctcggccgcaacaacggcgaatctagccggaagaaagacgaggaggaggtgcagtccaagcaccgcctgatcccacttggcaggaagatctatgagttttataatgcccccattgtaaaattctggttctatacgttggcttacatcggatacctcatgttattcaactatatcgtgttggttaaaatggagcggtggccgagtactcaggaatggatcgtgattagctacatattcactctgggcattgaaaagatgagagagatcctcatgagtgaacccggcaaactgttgcagaaggtgaaggtgtggctccaggagtactggaatgtcacagacctgattgctatcttgctgttctctgtgggtatgattttacggcttcaggaccagccatttaggtccgacggccgcgttatttactgtgttaacatcatctattggtacatccgattactcgatatttttggcgtcaacaagtatttgggtccatatgtcatgatgatagggaagatgatgattgacatgatgtatttcgtgattatcatgttagtagtgctgatgtcttttggggtggctcgacaggcaatcttgttccccaacgaagaaccttcttggaaactggccaaaaatattttctacatgccgtattggatgatctacggggaagtgtttgcagaccaaatcgatcctccttgtggccaaaatgagacacgggaagacgggaagattatccaactgcctccctgtaagactggagcttggattgtgccagccatcatggcctgctaccttctggtagccaatatacttttggtaaacttactgattgctgtatttaataatacgttcttcgaagttaagagtatcagtaaccaggtatggaagttccagcggtatcaacttatcatgaccttccatgaacgccccgtgttgccccctccgcttatcatcttctctcatatgacaatgatttttcaacacctctgttgccgatggagaaaacacgagtcagaccccgatgaaagagattatggactaaaactctttatcactgacgacgagcttaaaaaagtacacgatttcgaagagcagtgcatcgaggaatatttccgggaaaaggatgatcggttcaacagcagcaacgatgaacgaattcgtgtgacatctgagagagtggagaacatgtccatgagattagaggaagtcaacgaacgcgaacactcaatgaaggcctccctgcagaccgtagatatcagactagcacagctggaggacttgatcgggagaatggccaccgcactcgaaaggttaacgggcctggagcgggctgagtctaacaagatccgttctcgcacatcgagcgactgtacggacgctgcctacattgtcaggcagtctagttttaattcacaggaaggaaacacatttaaactgcaagaatcaattgaccccgctggagaggagactatgtccccgacttctccgacactcatgcctcgcatgagaagccacagcttttacagcgttaatatgaaggacaaaggaggaatcgagaaacttgagtccatttttaaagagcgttcattgtcacttcatcgagcgactagctctcattctgtcgccaaagagcctaaagccccggctgcgcccgccaacactctcgcgatcgtacccgatagtaggcgtcccagctcctgtatagatatttacgtttccgctatggacgaactccattgtgacatcgatcccctcgataattccgttaacatactgggactcggcgagccttctttttctacccccgtgcccagcacggcgccttccagtagtgcctacgcaacactggctcccacagatcgtccccctagtagatccatagactttgaagacattacctccatggatactcgaagtttttcatctgattacacccacctccccgagtgccagaatccctgggatagcgagcccccaatgtatcacacaatcgagaggtccaagagcagtaggtaccttgctactaccccgtttcttcttgaggaggcaccaatagtcaaaagtcacagcttcatgttttctccatccaggtcctattacgctaatttcggcgttccagtcaagacggccgaatacacaagcatcaccgactgcatagacacccggtgcgtgaatgctccacaggccatcgccgaccgcgcagcctttccaggcggtttgggcgataaagtggaagacctcacctgctgccacccggaaagggaagcagaactcagccatccctcatcagatagtgaggagaacgaagccaagggtcgtcgggcaactattgctatttcgagtcaggagggcgataactcggagcgcaccctctctaacaatattaccgtccccaagatcgaacgggcaaatagctattccgccgaagaaccctccgctccttacgctcatactagaaaaagcttctccatttcagacaagttggatcgtcagcgtaataccgcgagtcttagaaacccctttcagaggtccaaatccagtaagcccgaagggagaggcgacagcctctccatgaggagactctctagaacatccgctttccagtcattcgaatccaagcacaactag

SEQ ID NO: 138414 - DNA, 4710 bp, Artificial Sequence
  Description of Artificial Sequence: Synthetic coding sequence
atgtatgttcgcgtgtccttcgacacgaaacccgacttgctgctgcaccttatgaccaaagagtggcagctggagctgcctaagcttctgatatctgtgcacggcggattgcagaattttgagctgcagcctaagctgaagcaggtcttcggaaagggcttgatcaaggcagccatgactaccggtgcctggatctttaccgggggggtcaacactggagttatccgccacgtcggcgatgctctgaaggaccacgctagcaaaagtagaggaaaaatctgcactatcggaatcgctccatgggggattgttgaaaaccaggaggatctgatcggtcgagatgtcgtcaggccttaccaaaccatgagtaatccaatgtccaaactgacagtgctcaattctatgcatagccatttcatccttgctgataatggaacaaccggaaaatacggcgcagaggtaaagctccggagacagctggagaaacacatcagcctgcagaagataaacaccagatgtcttcctttcttcagtctcgactcaagactcttctactctttctggggcagctgtcagctggacagcgtaggcatcggccagggagtgccagtggtcgccttgatcgtggaaggaggacctaacgtgatctccattgtgctcgagtatttgcgagataccccacccgtgcccgtcgttgtctgcgatggctccggtagagcgtctgacatcctggcttttggccataaatatagcgaggaagggggactgatcaatgagagcctgagagatcaactgttggtgactattcagaaaactttcacctatacgcggactcaggcccagcatttgtttattattctgatggaatgtatgaagaaaaaggaactgatcaccgtgtttaggatgggatctgaaggacaccaggatatcgacttagccattttaactgcattgctgaaaggggctaacgccagtgcgccggaccaactctcccttgccctcgcctggaacagggtggacattgctcgcagtcagattttcatatatggtcagcagtggcccgtcggctctctcgaacaggctatgctggacgcattggtgctggaccgggtggactttgtgaagctgctgatcgaaaatggcgtatctatgcacaggttcttgacgattagcaggctggaagagctgtataatacaagacacggacccagtaacactctttaccatctggtgagagatgtgaaaaaagggaatctccctccggattaccgcatatcattgattgatattggccttgttatcgaatacctgatggggggcgcctaccggtgtaactatacaagaaaacgttttagaacactataccacaatctcttcggacccaaacgcgatgatatcccactgagacgaggtcgcaagacaacaaaaaaaagagaggaagaggtggacattgaccttgacgacccagaaatcaaccactttccttttccgtttcacgagcttatggtctgggctgtattgatgaagaggcagaagatggcacttttcttctggcagcatggcgaagaggctatggcgaaggcccttgtggcctgtaagctgtgcaaagctatggctcatgaggccagcgagaacgatatggtggatgatatctctcaggaattaaaccacaattccagggactttggccagctggccgtcgaactgctggaccaatcttataagcaggatgagcaattggccatgaagctcctcacgtatgagctcaaaaattggtccaatgcaacctgtctgcagctcgctgttgcggccaaacatcgggactttattgctcatacatgctctcaaatgcttctcaccgatatgtggatgggcaggctgaggatgcgcaagaactcagggctgaaggtaatcctcggaatcctgctgcctccctccattctcagtctcgaattcaaaaacaaggacgacatgccatacatgtcacaagcccaagaaatacacctgcaagagaaggaagccgaagaaccagaaaaacccaccaaggagaaggaggaagaagatatggagctgaccgcgatgctcggtcggaataatggtgaaagctccaggaaaaaggatgaggaggaagtccaatcgaagcacagattgatccctttgggaagaaagatctacgagttctacaatgccccgatagtcaagttctggttctacaccctcgcatacattggttaccttatgttgtttaactacattgtgctggttaagatggagcggtggcctagcacccaggaatggatcgtgatatcatacatctttactctggggattgagaagatgcgggagatcttaatgtctgagccaggcaagctccttcaaaaggtcaaggtgtggctacaggagtactggaacgttactgacctaatcgccattctcctcttttccgtagggatgattctccggcttcaagatcagcctttccgatccgacggcagggtgatttattgtgtgaatataatttattggtacatcaggctgttggatatcttcggagtgaacaagtatttagggccatacgtgatgatgatcggaaagatgatgatcgatatgatgtactttgtgatcatcatgctcgttgtgctgatgtcttttggggtcgcgaggcaggcgattctgttccccaacgaggagccgagctggaagctcgccaaaaatatcttctacatgccatattggatgatttacggggaggtgttcgccgaccagattgacccaccatgtggccagaacgaaaccagggaggacgggaagatcattcagctgcctccctgcaagactggagcgtggattgtgcctgccatcatggcttgctatctgctcgtcgccaatatccttctggtgaacctgctgattgccgtgttcaataatacattttttgaagttaagagcatctccaatcaggtgtggaaatttcagagatatcaactcatcatgacatttcacgagagacctgtgcttccccctccgcttattatttttagccatatgaccatgatattccagcacctgtgctgtcgctggcgcaagcatgagtccgaccccgacgagcgcgattacggactgaagctttttatcacggacgacgaactgaaaaaagtgcacgacttcgaggagcaatgcatagaagagtactttcgagaaaaggacgatcggtttaattcctctaatgacgaacggatcagagttactagcgagcgggtggagaatatgagtatgcgcctggaggaggtcaacgagcgcgagcactcaatgaaagcaagcctgcagacggtggacattcgcttggcacagctggaagacctgatcggccgaatggcaacagcacttgagcgcctaactgggttggaaagagccgagtcgaataagatcaggtcgcgtacttcctctgattgcacagatgcagcctatatagtgaggcaaagttccttcaatagccaggagggaaacactttcaagctccaggaaagcattgatcccgccggggaggaaactatgtcaccgacctcccccactctaatgccacgcatgcgatcgcattccttctatagcgtgaacatgaaggataagggtggaattgagaagttggagagcattttcaaagagcggtcgctgtccctgcaccgggcaactagctcccacagcgtggcgaaggagcccaaggcccctgcagctcctgcaaatacacttgcgattgtcccagacagccgcaggccttcctcctgtatagatatctacgtgtccgcaatggacgagctccactgtgacatcgatccactggataattcagtgaacatcctgggcctgggtgagccgagcttctcaactcccgtcccttctaccgccccaagctcttccgcttacgccactctggctccgaccgatcgtccccccagccgatcaatagacttcgaggatataacttccatggacaccaggtccttttctagcgattacactcaccttcctgaatgtcagaacccctgggattcagaaccaccaatgtatcacactatagaacgctctaaaagctcccgctatttagctacaacccctttcttactcgaagaagctcccattgtaaagtctcattccttcatgttctcccccagtaggagctactacgcaaacttcggagtgcctgtgaaaactgccgagtacaccagcattactgactgcattgacacccgctgcgtaaatgcgccacaggctatcgcggaccgtgctgccttccctggtggcctcggggacaaggtggaagacctgacttgttgccatccagaacgggaggccgaactctcacacccttcttccgatagcgaagaaaatgaagcaaagggaagaagagccactatcgcaatctccagccaggagggcgacaattcggagcgaacgctgtcgaataatataactgtccccaaaatcgagcgtgcgaactcctattctgctgaggaaccatcagctccgtacgctcatactcggaagtcattcagcatcagcgacaaactcgaccgccaaagaaatacagcatccctgcggaatcccttccagcggtctaaaagctcaaagcccgaaggaaggggggatagtctctccatgcggagactgtctcgaacttccgctttccagagtttcgaatccaaacataactag

SEQ ID NO: 138415 - DNA, 4710 bp, Artificial Sequence
  Description of Artificial Sequence: Synthetic coding sequence
atgtacgtccgagtgagcttcgacacgaagcccgatctgctgcttcaccttatgaccaaagagtggcaacttgagctgcccaagctgcttatttctgttcatggcggacttcaaaactttgagctgcagccaaagctgaaacaggtctttgggaaggggctgataaaggctgccatgacaaccggggcctggatattcactggtggggtaaacacgggagttattcgacacgtgggagacgccctgaaagatcatgctagtaaatctagaggtaagatctgtacgatcggaatcgctccatgggggatagtggagaatcaagaagatttaatcgggcgagacgtcgttcggccctatcaaactatgagcaatcccatgtcaaagctgaccgtgctgaattcaatgcacagccattttatcttggctgataacggaaccactggtaaatacggcgctgaagtcaagctgcgtcgacagctagagaaacacatttcactccagaaaataaatactcgctgtctgccgttcttttctctcgacagtcgtctgttttactctttctggggaagctgccagctggatagcgtcggaatcggccagggagtacctgtggtcgccttgatcgtagaaggcggccctaatgtcatttcgattgtgctagagtacctaagagacacaccaccagtgccagttgtcgtctgcgacggttcaggtcgggcgtctgacatattggctttcggacacaaatactctgaggagggcggcttgatcaacgaatcgttacgtgaccagctgctggttacaatccagaagacctttacttacaccaggactcaggcacagcatctgtttattattctgatggagtgtatgaagaagaaggagcttattactgtctttcgcatgggcagtgaggggcatcaggacatagacctggccattctcacagctttgttgaagggagccaacgcttccgctccggaccagctttccttggcattggcatggaaccgcgtggatattgcccgctcccagatttttatttacggccagcaatggcccgttggaagcctagaacaagcaatgctcgacgctttagtgcttgaccgagttgatttcgtcaagctcctgatcgagaacggagtttctatgcataggttcctcaccatctcgcgcctcgaggagctttacaacactcgccacggtccgtctaatacactataccacctggtgagagatgtcaagaaagggaatctccctccagactatagaatatcactgattgatatagggctggtgatcgaatatctgatggggggggcataccgctgtaactatactaggaagcgatttcgcaccctataccacaatctctttggtcctaaaagagacgatatcccgctgcgtcgcggaaggaagacaacaaagaaaagagaagaagaggtcgacatcgatctcgacgaccctgagattaaccacttccccttcccattccacgaactgatggtttgggccgtgctgatgaaacgccagaaaatggctctgtttttctggcagcatggagaggaggccatggccaaggcattggtcgcatgtaagctctgcaaggctatggcccacgaagccagtgagaatgatatggtcgacgatatctcccaggaactgaaccacaactctcgggacttcggacaacttgctgtggagctactggaccagtcctataagcaggacgagcaactggccatgaagctgctgacctacgaactgaagaactggagcaacgcgacctgcctccagctggccgttgccgctaagcatcgcgatttcatcgctcacacttgtagccaaatgctcttgacagatatgtggatgggccgactaaggatgcgaaaaaactcgggcctgaaggtcatattaggcatcctgctccctccgagtatcctgtctctggaattcaaaaataaagatgatatgccctacatgtcccaagcccaggagattcacttgcaggaaaaggaggctgaagagccagagaagccgaccaaggaaaaggaggaggaggatatggaattaactgcgatgcttggaagaaacaatggggaaagctcacgcaaaaaggacgaagaggaagttcagtctaaacatagactgattccgcttggccggaaaatctacgagttctataatgcccctattgttaagttctggttctacactctggcctacatcgggtatctgatgctttttaactatattgtgcttgtgaaaatggagagatggccatccacacaggagtggatcgtgatatcctatattttcacccttggaatcgagaaaatgcgcgagattttaatgtccgagccaggcaagctcttgcagaaagtcaaggtgtggctccaggaatattggaatgtgactgatttaattgccatcctgctgttctctgtaggcatgatactcagactgcaggatcaaccttttcgttccgatgggagagtaatctattgcgtgaatatcatctactggtatattaggctcctggacattttcggagtcaataagtacctgggtccctacgtcatgatgattgggaagatgatgatcgacatgatgtatttcgttatcatcatgttggtagtgctgatgtccttcggagtcgcccgacaagccatccttttccctaacgaggagcctagctggaaattggcaaagaatatcttctatatgccttattggatgatctacggcgaagtgtttgcggatcagatagaccctccttgtggacagaacgagactcgagaagatgggaagattatacagctgcccccctgcaagacgggcgcctggatagtaccagccatcatggcctgttacctgctcgtggccaatatactgctcgtaaatcttctgatagccgtttttaacaacaccttcttcgaagttaagagtatctcgaatcaggtttggaaattccagcgttaccagctgataatgaccttccatgagcgccccgttttgccccctcccttaattattttttctcacatgaccatgatcttccaacatctgtgttgcagatggcgtaagcacgaatctgatccggacgaacgagactacggactaaagctgttcattaccgatgacgagctgaaaaaggtgcacgatttcgaggagcagtgtatcgaggagtacttcagggaaaaagatgatcggtttaactcaagcaacgacgagaggatacgcgttacgtcggaaagggtagaaaacatgagtatgcggctggaggaggtgaatgaaagggagcacagtatgaaggcctccctccaaactgttgacattcgactcgctcagctggaggatctcatcggtagaatggcaacagccctcgaacgccttactgggctcgagagggctgaatcaaacaagattaggtccagaacgagcagcgattgcaccgatgccgcatatatcgttaggcaaagctcattcaacagccaggagggcaataccttcaaactgcaggaaagtattgaccccgcaggcgaagaaacgatgagcccgacttcccctactctaatgccgaggatgagatcacacagcttctacagcgttaacatgaaagacaaaggtgggatcgagaaactggagagtatcttcaaagagaggtcactgtctctgcatagggctactagctcgcactctgttgcaaaggagccgaaagcccccgctgcgccggcaaacactctcgcaattgtgcctgattcacggagaccttcgtcttgcatcgatatatatgtgtctgcgatggacgagctccattgcgacattgatccactggataactccgtcaacatcctgggactcggggaaccgagcttctcgacccctgtgcctagtactgccccctccagcagcgcatatgccaccctggcgcctaccgatagacctccatctaggagcatagactttgaggatatcacatccatggataccagatctttctcttctgactacacccatctccccgagtgccaaaacccctgggattctgaacccccaatgtatcacactatcgaacgaagtaaatcgagccgttacctcgccactaccccctttcttcttgaagaggctccgattgtgaagtctcatagctttatgttttctccgagtaggtcatattatgctaactttggggtgcccgtaaagactgccgagtacacgagcattacagattgcattgacactagatgtgtgaacgcaccccaggcaattgccgaccgtgccgccttcccgggagggctgggagataaagtcgaggatttgacctgctgccatcccgagagagaagcagagctgtcacatccatcatctgactccgaggaaaatgaggccaaggggagacgcgcgacgattgcgatatcctcacaggagggagacaacagcgagagaacactgtctaataatattacggtgcctaagatagaacgggccaacagctattccgccgaggagccatcagctccatacgctcacactaggaagtccttcagtatttccgataagctggatcggcaaagaaatactgctagcctgaggaatccttttcagaggtctaagagtagcaagcctgaagggaggggggactctctatcaatgcggcgcctttcgaggacatctgcattccagagctttgaatccaaacacaactag

SEQ ID NO: 138416 - DNA, 4701 bp, Artificial Sequence
  Description of Artificial Sequence: Synthetic coding sequence
atgtacgtaagagtcagtttcgacaccaagcctgaccttctgcttcacctcatgaccaaggagtggcagctcgaattgcctaagctgctaatcagtgtccacggtggattgcaaaattttgagctgcagccaaagctgaagcaagtttttggaaaaggcctgatcaaggcagctatgactacaggcgcttggatcttcaccggaggcgtgaacaccggggtcattagacacgtcggtgacgccttgaaagaccatgcgtcaaagtccaggggcaagatttgcaccattggtatagccccttggggcattgttgagaatcaagaagaccttatcggtagggacgttgtcaggccataccagacgatgtccaaccccatgtccaaacttaccgtcctgaactccatgcatagtcacttcattctagccgataacggaactacgggaaaatatggggcagaagtaaaactgcggcgtcaattggagaagcatattagtctccagaaaataaatacccgtattgggcagggcgtcccagttgtagctttaatagtggagggcggtcccaacgtgatttcaattgtgctggaatacttgcgcgacactccaccagtccccgtggtcgtttgtgacggttcggggcgggcatcagatattctcgcctttggccacaagtactctgaggagggcggactcattaatgagtccctccgggaccagttgctcgtaacgatccaaaagacgttcacatatacacgcactcaggcccagcacttgtttattatcctcatggagtgcatgaaaaaaaaggagctaatcacagtttttcgcatggggagtgaaggccatcaggacatcgacctggctattctgacagctcttctgaaaggggcaaacgcctcagccccagatcaattgagcctggctctggcctggaatcgggtggatatagcacggtcgcagattttcatatatgggcagcaatggcctgtaggatccctggaacaggccatgctcgacgccttagtgttagatagggtggactttgtcaaactgctgatcgagaatggcgtgtctatgcaccgtttcctcacgattagtcggctagaggagctttacaataccaggcatggccccagcaatacgctgtatcacctcgtgcgagacgtcaagaagagagagtaccctggtttcggctggatctactttaagggcaatctcccccctgattaccgaatctccctgatcgacatcggcttggtcattgaatatcttatgggcggggcttacagatgcaattacacaaggaagcgtttcaggacactgtatcacaatttgtttggccccaaacgtcctaaggcactcaagctgctaggaatggaagacgatattccgctgaggcggggtagaaagactaccaagaagcgcgaggaagaagtggacatcgatcttgatgaccctgagatcaatcactttcctttccctttccacgaactgatggtctgggcggtgctcatgaagagacagaaaatggcactgttcttttggcagcatggggaggaggccatggccaaggctctggtggcttgcaagctgtgcaaggctatggcccacgaggcctcagagaacgacatggtggacgatatctcccaggaattaaaccacaattcccgggacttcggccagctggctgtggaattgctcgaccagtcatataagcaagacgaacagctcgcgatgaagctgcttacttacgaactgaagaactggagcaatgcaacatgcctgcaactggccgttgccgcaaaacaccgggatttcattgctcacacgtgcagtcagatgttacttactgacatgtggatggggcgcttgaggatgaggaaaaactccggccttaaagtcatcttgggaatcctcctccctccttctatactctccttggaattcaagaacaaggacgacatgccgtacatgtcacaggctcaggagatccacctgcaggaaaaggaagccgaggagcccgagaagcccactaaggaaaaggaggaagaggacatggaactgacggcaatgctgggaaggaacaatggcgagtctagcagaaaaaaggatgaggaggaagtgcagagcaaacaccggctcatccctctaggcagaaagatctacgaattttacaacgcccctattgtgaaattctggttttacacactcgcttatatcggctacttgatgctgttcaattatatcgtgctggtgaagatggaacgatggcccagcacccaggagtggatagtgatctcatatatatttacgcttggtattgaaaagatgcgggagattctcatgagcgagcccggcaagctcttgcaaaaagtgaaagtctggctccaggaatactggaatgtgactgacctgatagcaatcctccttttcagcgtcgggatgattctacgtcttcaggatcagccgtttcgctccgatggtagagtcatctattgcgtgaacattatttattggtacatcagactgctggatatattcggtgtgaacaaatacctggggccctatgtgatgatgattggcaagatgatgatcgatatgatgtattttgtgataatcatgctggtggtgcttatgtcattcggtgtggcacgtcaggccattctgtttcccaacgaagagccttcatggaagctcgccaagaacatcttttatatgccatactggatgatttacggtgaggttttcgctgaccagattgatcctccatgcgggcagaacgaaacgagagaagacgggaagatcatacaactccccccctgcaaaacaggagcctggatcgtgcctgcaatcatggcgtgctacctgctggtggcaaacattctcctagttaaccttcttatagccgtgttcaacaacactttctttgaagtgaaatctatttcaaatcaggtatggaaatttcagcgttatcaactcataatgacattccacgaacgccccgtcctgccaccaccattgattatattcagccatatgaccatgattttccagcacttatgctgcaggtggcgaaagcacgaatctgaccctgacgagagggactacggcttaaagctcttcatcacagatgatgaactcaagaaggtccacgactttgaggagcagtgcattgaagagtacttcagagaaaaggatgacagatttaactcttccaacgatgagcggatccgtgtgacatctgaacgagtcgaaaatatgtcgatgcggcttgaggaggtgaacgagagagagcacagcatgaaggccagcttgcagactgtggatatcagactagcccaactggaagatcttatcggcagaatggcaaccgcattagaacgcctgacgggactcgaaagagccgagtccaacaaaatccggtcacggacctctagcgactgcacagatgcagcctatattgtgcgtcagtcctccttcaacagtcaggaaggtaacacatttaagctgcaggaaagtattgatccagctggcgaagaaaccatgagccctaccagtccaaccctcatgcctaggatgagaagccactccttctacagcgtcaatatgaaagataaaggaggcatcgagaaattggagagcatctttaaagaacggtcactgtctcttcatagagcaacttcctcgcacagcgtagctaaagagcctaaagcaccagccgctcctgctaatacactggctattgtcccggactctcgaagaccttccagctgcatcgacatttatgtaagtgccatggacgagctccactgcgacatcgaccccctggacaattcagttaatatcctcggattaggggagccttccttcagcacccccgtcccttcaactgccccctcgagtagtgcatacgctactctagcacccaccgaccggcccccctctaggtctattgacttcgaagatataactagcatggacacaagatcgtttagctccgattacacacacctgccagagtgtcaaaacccttgggattctgaaccacccatgtatcacacgatagaaagatccaagtcctcgaggtacctggcaacgacgccatttctcctggaggaggcaccaatcgtcaagagtcattccttcatgttctccccaagcagatcctactacgccaatttcggagtacctgtcaaaactgccgagtacacttccatcacagattgcatcgatacacggtgcgtgaacgccccccaagcgattgccgatcgggcggcattccccggtgggctgggcgacaaggtcgaagatttgacatgttgccaccctgagagggaagctgaactgtctcatccatctagtgactcagaggaaaacgaggctaaaggcaggcgcgcgacgattgcaatcagctcgcaggagggcgataactccgagaggacactgagcaataacatcaccgtgccgaaaatagagcgcgcaaatagttacagtgcagaggagcccagcgcaccatacgcacatacaaggaagagcttttctatctcagacaagttagaccgacaacgtaatactgccagcttaagaaacccatttcaaaggtcaaagagctcaaagccagagggtagaggagatagcctatcgatgcgccgattaagtaggacctcagcttttcagagcttcgagagcaagcataactag

SEQ ID NO: 138417 - DNA, 4740 bp, Artificial Sequence
  Description of Artificial Sequence: Synthetic coding sequence
atgtatgtccgcgtgtccttcgataccaagccagacctgctgcttcatctgatgacaaaagagtggcaactggagcttcccaagttgctgatcagtgtgcacggtggtcttcagaatttcgagctgcagcctaagttaaagcaagtgttcggcaagggactcatcaaggccgcgatgacaaccggggcctggatcttcacgggtggagtgaacacgggcgtcattcggcacgtgggtgatgctctgaaagatcacgcatcaaagagtcgtgggaagatttgcaccatcggtattgccccatggggtatcgtagaaaaccaagaagatctgataggcagagacgtggtgcggccctatcaaactatgagcaaccccatgtctaagttaactgtacttaactctatgcactctcactttatccttgcggacaacggcactaccggaaaatatggcgccgaggtcaagctcagacgacagcttgagaagcacatcagcctgcagaagataaacaccaggtgccttcccttcttctcccttgactcacgactcttttattcattttggggctcttgtcaactagatagcgtcggcataggtcagggggtgccggttgtggctctcatcgtagaaggagggcccaacgtgatttcaattgtgctggagtatttgagggacactcctcctgttcctgtcgtcgtctgtgatgggtctgggagagccagcgacattctcgctttcggacacaagtactccgaggagggggggctgatcaatgaatcgctgcgcgaccaactgcttgtcacaatccagaaaacatttacgtacacccggacacaggcacagcacctgtttatcatcttgatggaatgcatgaagaaaaaagagctgatcaccgtgtttcggatgggctccgaaggtcaccaggacatcgacttggccatcctcaccgctctgttaaaaggggccaacgcaagtgcccccgaccagttgtcgttagctctggcttggaatagagtagacattgctagatcgcagatttttatctacggacagcagtggcctgttggctctttggaacaagcgatgctcgatgcccttgttctggatagggtggatttcgtcaaactgctgatcgaaaatggggtgtccatgcaccgattcctcacaattagtcggctcgaggaactgtacaataccagacacggtccctctaatacactgtatcatctggtacgcgacgtgaagaagggaaatctcccccccgactatcggatctctcttatcgacattggtcttgtgatcgagtatctaatggggggagcatacaggtgcaattatacccgaaaacgatttcgcacactgtaccacaacttgttcggaccgaaacgtccaaaagctctgaaactgttgggcatggaagacgatataccactgaggcggggacgcaaaactactaaaaagagggaagaggaggtggacatcgaccttgatgatccagagatcaaccacttcccttttccattccatgaactgatggtgtgggcagtgcttatgaaacgtcagaagatggcgttattcttttggcagcatggcgaagaggcaatggccaaagccttagtcgcatgcaaactctgcaaggccatggcccatgaggcctccgagaatgatatggtcgacgacatttcccaagagctgaaccataattctcgcgatttcggtcagcttgctgtggagctgctcgatcagtcctacaaacaggatgaacaactcgcgatgaagctgctgacatatgagctgaaaaactggagtaatgccacatgtcttcagttggccgtggctgctaagcaccgtgactttatcgcccatacatgcagtcaaatgctgctgacagatatgtggatgggtagactccgcatgcgtaaaaactccggactgaaggtgatactaggaatactacttcctccatctatactcagcctcgaattcaagaacaaagatgacatgccatacatgtcacaggcacaggagatccacctacaagaaaaggaggcggaggagccagagaagccaaccaaagaaaaggaggaggaagacatggaactgaccgcaatgcttggtcggaataatggcgagagctctaggaagaaggacgaggaagaagtgcagagcaaacatcggttaatcccgctcggaagaaaaatatacgagttctataacgcgcctattgttaagttttggttctatacactggcctatatcggctaccttatgctttttaattacatcgtcctggtcaaaatggagcggtggccaagtacgcaggaatggatagttatctcttatatctttacactgggaatcgagaagatgagggaaattctcatgagcgagccaggaaaactcctacaaaaagtcaaagtgtggctgcaggagtactggaacgtgactgaccttatcgccattctgttattttcagtgggcatgattctgcggctgcaggaccagccatttcgtagcgacggacgcgttatatactgcgtcaacatcatttactggtacatcaggttgctcgatatctttggcgttaataaatatttgggaccctacgtgatgatgatcggcaagatgatgatcgatatgatgtactttgtgattattatgctggtagtgctaatgagcttcggcgtggcccggcaggccattctgttccccaatgaagagccgagctggaaacttgcaaagaacattttttacatgccgtactggatgatctacggagaagtgttcgccgaccagattgatcctccttgtgggcagaacgaaacaagggaagatggtaaaatcatccagttgcccccctgtaaaacaggcgcatggatcgtaccagcgatcatggcctgttatctgttggtcgctaatatcctgctggtgaacctacttatcgctgtcttcaacaatactttctttgaagtaaagtccatcagtaatcaagtctggaagttccagcgttaccaactgatcatgacattccatgagcgccccgtgctgccccccccgctcatcattttctcacacatgacaatgatattccagcatttatgctgccggtggcgtaagcatgagagcgatcccgatgagagagactacggtctgaagctgttcatcacagacgacgagcttaaaaaagttcacgactttgaagagcaatgcattgaagaatattttcgcgagaaagatgaccggtttaattctagcaatgatgagcgcatccgtgtgacaagcgagagagtcgagaatatgtctatgcgcttagaagaggtgaacgagagggaacattccatgaaagcttccctacagaccgtggacatcaggctagcccagcttgaggatctgatcgggagaatggccaccgcactcgagcgactgactggtctcgagcgcgccgaatcgaacaagatccgctctcgcaccagcagtgactgtacagacgccgcctatatcgttagacagagctcattcaatagccaagagggaaatactttcaaactgcaggagagcatagatccggcgggcgaggaaacgatgtcccccacttcgcccacattgatgcctcgaatgcggtcacacagtttttacagtgtaaatatgaaggataagggaggcatcgagaagctggaatcaatctttaaagaaaggagcctgtccttgcaccgggctacatcgagccattccgttgccaaagaacctaaggcccccgccgctcccgccaacaccctggcaatcgttcccgactcccggaggccgagcagttgtattgacatctatgtgtccgctatggacgagctgcattgcgacatcgaccctttggacaactccgttaatatccttggacttggggaaccctcattctcaaccccagtgcctagtacagcgccctcttcatcagcatatgccacacttgcaccgacagaccgtccaccaagccgatccattgactttgaggacatcacaagtatggacacccggtcgttttctagcgattatacacatcttcccgagtgccagaatccctgggattccgagcctcctatgtatcacaccattgagagatccaagtcatctcggtacttggcaaccaccccgtttctgctggaagaggcaccaatagtcaagagccatagtttcatgtttagtcctagtcgatcgtactacgctaattttggcgtcccagtgaaaacagcggaatataccagtattaccgattgtatcgatactagatgtgtcaacgcacctcaggccatcgctgaccgtgcagccttccccggtggactcggtgacaaggtggaagatctcacttgttgtcatcccgaaagggaggcagaactctcgcacccatcctctgattcggaggagaacgaggcaaaaggtcggcgagctactattgctatctcctcacaggagggggacaacagcgaacgtacgctgtccaacaacatcactgtgcccaagatcgaaagggctaactcgtactcagccgaggaacccagcgctccctacgctcacactcgcaaatcatttagcatcagcgacaagctggataggcagaggaacactgccagcctgcgtaacccttttcagcggtcaaagtcatccaagcccgaaggcagaggcgatagcctgtctatgcgtcgcctaagccgcaccagcgccttccagagctttgagtcgaagcacaactag

SEQ ID NO: 138418 - DNA, 5124 bp, Artificial Sequence
  Description of Artificial Sequence: Synthetic coding sequence
atgccagagccatgggggactgtctatttccttgggatcgctcaagtcttctcgttcctgttttcctggtggaacttggaaggtgttatgaatcaagccgacgcccctagaccacttaattggactatccgcaagctatgtcacgcggccttcctgccgtctgtgcgcctcctgaaggctcagaaatcctggattgaacgggctttctataagagggagtgtgtgcacatcatcccgagcacgaaggatccacaccggtgctgttgcggacggctgatcggacagcacgtcgggttgactccgtccatctccgtgctgcaaaacgagaaaaatgaatcccgcctgagtcggaatgatattcagagtgagaaatggtccatctcaaagcacactcaactgagcccaactgatgcatttggtaccatcgaattccaggggggaggccattctaataaagcaatgtacgtgagagtatctttcgacacaaagcccgacctgctcctgcacctgatgaccaaggaatggcagctggagcttcccaagctgctcattagtgtccacggaggtctgcagaatttcgagctgcagcctaagttgaagcaggtatttggcaagggactgatcaaggccgcaatgacgactggcgcctggatatttactgggggagtgaacacaggagtgatcagacacgttggggatgccctcaaagatcacgctagtaagtctcgcggcaagatttgtacgattggaattgctccttgggggatcgtggaaaatcaagaagatcttattggcagggatgtagtgcggccataccagaccatgagcaatcctatgtccaagttgacggtgctgaacagcatgcatagtcatttcattttggccgacaatggcaccaccgggaagtacggtgcagaagtcaagcttagacgccagttggagaagcacatcagccttcagaagatcaacactcgaatcggccagggggtgccggtcgttgcactgatcgtagagggcggccccaatgttatcagcatagtgctggagtacttgcgcgatactccgcctgtgcctgtggtcgtttgtgacgggagcggtcgggctagtgacattttagcattcggccacaagtatagcgaagaaggagggttgatcaatgaatccctccgagaccagctactggtgactattcagaaaacttttacctacactagaacccaggctcagcatctgttcatcatcctaatggagtgtatgaaaaaaaaggaactgatcaccgtgttcagaatgggctcagaaggccaccaggatattgatctcgccattctcactgctttattaaaaggcgctaatgcctcggccccagatcagttgtctctggcgctggcctggaacagagtggacattgctcgtagccagatttttatctacggacaacaatggcccgtggggtccctagaacaggcaatgctcgacgcgcttgttctggaccgtgttgactttgtcaagctcctaatcgagaacggcgtgtcaatgcataggtttttgaccatctccaggctcgaagagctttataataccagacacggaccctcgaacaccctttaccacttggtgcgggatgtcaagaagggcaatctgcctcctgactaccggatctcattgatcgacatcggtctagtgatcgagtacctaatggggggggcctatcggtgcaactatacaagaaaacgatttcgcacgctataccacaacctctttggcccgaagagacctaaggcccttaagcttctgggcatggaagatgacatcccattacggcggggccgaaagacaacaaagaaaagagaagaagaagtcgacattgacctcgatgatccggagattaaccacttccccttcccatttcatgagctgatggtgtgggccgtcctcatgaaacgccagaaaatggccctttttttctggcaacatggcgaagaagccatggccaaagccttggtggcctgcaaactgtgcaaggctatggctcacgaggccagcgagaacgatatggttgatgatataagccaggagcttaatcataacagccgcgactttggtcagttggccgtcgagttgcttgaccagtcatacaagcaggacgaacagctggccatgaaactcctgacttatgaactgaaaaactggtcaaatgccacatgtctacagctggccgtcgctgccaagcaccgggactttatcgcgcacacatgctcacagatgctgctgactgacatgtggatgggacggctccgcatgcgcaagaactccgggctaaaagtgatactcggaattctgctaccaccgtcaatcctgtccctggagttcaagaacaaggacgatatgccgtacatgtcacaggcgcaggaaattcatcttcaggaaaaagaggcagaggagccagaaaagcccacaaaagaaaaagaagaagaggacatggagctaactgcgatgctcggccggaataacggagagtcgtccagaaagaaagacgaggaggaagtgcaatcgaagcaccgcctgatccccttaggacggaagatttacgagttttataacgctcctatcgtcaagttttggttttacaccctggcctatatcggctacctcatgctgttcaattacattgtcttggtaaaaatggagagatggccctctactcaggaatggattgtgattagctatatcttcactcttggtatcgaaaagatgagagagattttgatgtctgaaccgggtaagctgctccaaaaggtgaaggtgtggctacaggagtactggaacgtcactgacctcatagccatactcctcttcagcgtgggaatgattttaaggcttcaagatcaacctttccgctccgacgggagagtgatttactgtgtcaatattatttactggtacattcggctcctggacatctttggtgtgaataaatacctgggcccctacgtaatgatgattggaaagatgatgatagatatgatgtattttgtgattataatgttagtggtcctgatgagcttcggggtggctcgacaagctatactgttcccaaacgaagaaccgtcttggaagctggctaagaatatcttctacatgccgtactggatgatttacggagaagtctttgctgaccagatagaccccccttgcggccagaacgagacacgagaggatgggaagattatccagttgcctccatgcaaaaccggcgcctggatcgtgccagctatcatggcatgttacctgctggttgccaacatccttctcgtaaatctgctcatagccgtctttaacaacacattcttcgaagtaaagtccatcagcaatcaagtctggaagttccagcggtatcaattgatcatgactttccacgaacggcctgtactccctcccccattaatcatattctctcatatgaccatgatatttcagcacctttgttgtcggtggcgcaaacacgagtctgatcctgacgagcgcgactacgggctcaaacttttcattacggatgatgaattgaaaaaggtgcacgatttcgaagaacagtgcattgaggagtactttcgcgaaaaggacgatagatttaactcttctaacgatgagagaatacgggtgacatctgagagagtcgagaacatgtccatgagactggaggaagtgaacgaacgggagcattcaatgaaagcatcccttcagacagtcgacatcagactggcccagctagaggatctaattggacggatggcaacagcgctcgaacgcctcaccggcctcgagagagccgagtccaataagatacgtagccgcacatcgtcggattgcacagatgctgcctacatcgtgcgccagtcaagctttaatagccaggagggtaacaccttcaagctgcaggaaagcatcgaccctgccggggaagaaaccatgagtcccacaagtcccactttgatgcccagaatgagaagtcattccttctattccgtcaacatgaaagataagggcggcatagaaaagctcgagtcaatctttaaagagaggagcctttcactccatcgtgctactagcagccattctgtcgccaaggagcccaaggctccagctgcacccgctaatactcttgcaatcgtacccgactctaggcgcccttcttcatgtattgacatttacgtttcagctatggatgaactgcattgtgatatcgatccccttgataactctgtgaatatactcggactgggcgaaccaagcttctctacaccagttccctcaaccgcgccatcctctagtgcgtacgctactttagcccccacggaccgccccccttcacgcagcatagatttcgaggacatcacctcgatggatactcgatccttcagctcagactacacgcatctcccagagtgccagaacccctgggactcagagcctcctatgtatcacacaattgagcggagcaagtcttcccgctaccttgctaccacgccgttcctgctagaggaagcccctattgttaaaagccattcgtttatgttcagcccatcccgctcctattatgctaattttggagtgcctgtgaaaaccgcagagtacacaagcattactgactgcattgacacacggtgtgtgaatgcccctcaggccatcgccgaccgagccgcattcccaggaggcctcggggacaaagtggaagatttaacctgctgtcaccctgagcgcgaggccgaactgtctcaccccagctctgatagtgaagagaacgaggcaaaggggcgccgcgctaccatcgccatttccagtcaggaaggtgacaacagcgagcgcactctgtctaataatataaccgtgccaaagattgagagagcaaacagttactccgctgaagaacccagtgctccctacgcccacacgagaaaatcattcagcattagtgacaaactcgacaggcaaaggaacaccgccagtttgcgcaatcctttccagagatcaaagagttctaagcctgaaggtcgaggggattccttatctatgagacggctgtcgcggacatctgcctttcaatcttttgagtctaaacataactag

SEQ ID NO: 138419 - DNA, 3978 bp, Artificial Sequence
  Description of Artificial Sequence: Synthetic coding sequence
atgcccgagccctgggggaccgtttacttcttgggaattgctcaggttttttccttcttgttcagctggtggaacctggagggagttatgaatcaggccgatgcgcctagacctttgaactggaccattcgcaagctgtgtcacgcggcctttttgcccagcgtgcgtctattgaaagctcaaaaaagttggatagaacgggctttttacaagagagagtgcgtccacattatccccagcacgaaggacccccaccgttgctgctgcggacggctgattggccagcatgtcggcctcacccccagcattagcgtactccagaacgagaaaaacgagagcagactctcccggaatgacattcagagtgaaaagtggagtatctctaagcacacccaactgtctcccacagatgccttcggcacaattgaatttcaaggcgggggacatagtaacaaggcaatgtatgtgagagtgtctttcgacacaaaaccagatttacttctccatctaatgacaaaggagtggcaacttgagttgcctaaactgctgatttctgtgcatggaggtcttcagaatttcgagctccagcccaaactcaaacaggtcttcggcaagggtctgatcaaggcggctatgaccaccggagcttggattttcactggaggagtcaataccggcgtcatcaggcacgtcggggacgcactcaaggatcacgcaagcaagagtcggggaaaaatttgtacaattgggattgccccctggggcatagtagagaaccaggaagatctcattggtcgggatgtggtgaggccctaccagaccatgtccaacccaatgagtaagctgactgttttaaattccatgcactcacattttatcctggccgacaacggcactacggggaaatatggtgcggaggtcaaattgcgacggcagctcgagaaacacatttcactccaaaagattaacacgaggatcgggcaaggcgtgccagttgtggcccttattgtcgaggggggaccaaacgtgatatccatcgtgctcgagtatctgcgggatacacccccagtcccagtggttgtgtgcgatggctccggtagagcctccgatatcctggcttttggacacaaatacagcgaggaggggggtcttataaacgaaagtctccgggaccagctcctagtcacgattcaaaagaccttcacatacacacggacccaagcccagcatctgttcattatccttatggagtgcatgaagaaaaaggaactcatcacagtgtttcgtatgggctccgaaggacaccaggatatagatctggccattctgactgcccttctcaaaggcgctaacgcgtccgcccctgatcaactgtcgctggcattggcttggaatcgcgttgatatagcgagaagccagatctttatttatggccagcaatggcccgtgggcagcctcgagcaggcgatgctcgatgctttagttctggatcgtgtggacttcgtgaagttgctaatagagaatggtgtttccatgcaccgattcctaacgatcagccggttggaggagctctacaacacgcggcacggaccctctaacaccttgtatcatctggtgcgggatgtgaagaagggcaatctgccacctgattaccgcatttcactgattgatatcgggctggtgattgaatatctgatgggcggtgcctatagatgtaattacactcggaagcggtttcgcacactttaccacaatttattcggacctaaaaggccaaaagctttaaagctgctcgggatggaggacgacattcccctgcggcgagggcggaaaactacaaagaaaagagaggaggaagtcgatatcgacctcgatgaccccgagatcaaccacttccccttcccctttcacgagctgatggtgtgggccgtactgatgaaacgacagaagatggcactcttcttctggcaacatggagaggaggctatggctaaagccctggttgcctgcaagctctgcaaggccatggcccacgaggcatccgagaacgatatggtcgatgatatctctcaggagcttaatcataacagcagagattttggacagctggctgtggaattattagaccaatcgtacaaacaggatgagcagctggccatgaagctactgacatatgagctgaagaattggtcaaatgccacatgtctccagctagccgtggctgcgaaacatcgagatttcatagcccacacgtgcagtcaaatgctgctgacagacatgtggatgggacgactgaggatgagaaaaaactctggcctgaaggtgattctcggcattttactgccccccagcatcctctcacttgagtttaagaataaagacgatatgccttacatgagccaagcccaggagatccacctccaggagaaggaggcggaggagcccgagaagccaactaaggagaaagaggaggaggacatggagctgactgctatgctgggcaggaacaatggcgagagctcccgcaagaaggacgaggaagaagtccagtccaaacatagactcataccactggggagaaagatctatgagttctacaatgcccctatagtcaagttctggttctacactctggcatatattggttatctcatgctcttcaactatatagtcctggttaagatggaacgctggccttccactcaggagtggatagtcatttcctacatctttaccctggggatagaaaagatgcgtgagatcctgatgagcgagcctggcaagctcctccagaaggttaaagtttggctgcaggagtactggaacgtgacagacctgatcgccattctgctgttctcggtgggcatgatcctccggctgcaagaccagccctttcggtccgacggaagggtgatttattgcgtaaacatcatatactggtacattaggttacttgatatttttggcgtgaacaagtatctggggccgtacgtgatgatgatcgggaagatgatgatagacatgatgtacttcgtgatcataatgcttgtggtactcatgtcgttcggcgtggctaggcaggccatactgtttcccaatgaggagcccagttggaaattagcaaaaaatattttttacatgccatattggatgatttatggagaagtgttcgctgaccagatcgatcctccttgtggacagaacgagactcgagaagacggtaagatcattcaactccccccttgtaagacaggcgcatggatcgtgccagccataatggcatgctaccttttggtcgcaaacatcttgctggttaacctcctcattgctgtgttcaacaatactttttttgaagtgaagtccatcagtaaccaggtgtggaaatttcagcggtatcagctgattatgacctttcatgagcgcccagtgctacccccccctctgatcatcttcagccacatgactatgatcttccaacatctttgctgccgctggcgaaagcatgagtccgaccccgacgagagggattatggactaaaattattcatcacggacgacgagcttaaaaaggtgcacgattttgaggaacagtgcatcgaggaatacttcagggaaaaggatgataggtttaatagcagtaacgatgagcgcattcgagtaactagcgagcgcgtagagaacatgtccatgcggctcgaggaggtgaacgaaagagagcatagcatgaaagcatcactgcaaacggtggacattcgcctcgcccagctcgaagacctcattggccggatggcaactgcgctcgaaagactgaccggcctcgaaagagctgaatcaaataagattcgctctcgcaccagctccgactgcacggatgccgcctatatcgtcaggcagagcagctttaacagtcaggagggcaataccttcaagctccaggaaagcattgatcctgccgaacaccccttatactcagtatag

SEQ ID NO: 138420 - DNA, 4671 bp, Artificial Sequence
  Description of Artificial Sequence: Synthetic coding sequence
taatacgtgcgcgtcagctttgacactaaacccgatcttctcctccacctgatgaccaaggagtggcaactggagctgcctaagttgctgatctctgtgcacggcggactacagaacttcgagctgcagccaaagctgaaacaggtgttcggaaaggggttaatcaaggcagccatgactacaggagcttggatatttacaggcggcgtcaacacaggcgtcattcgacatgttggcgatgctctaaaggaccacgcctccaagtctagagggaagatttgcacaattggaattgccccctggggtattgtcgaaaaccaggaagaccttatcggcagggatgtagtgcggccttatcaaaccatgtcaaatccaatgtctaagctgactgtgctcaattcaatgcactctcactttatcctggctgataatgggaccaccgggaagtacggggccgaagttaagctgcggcgacagttagaaaagcacatcagtttacagaagattaacactcgtataggccagggggtccccgtggttgccctgatcgttgagggcgggcctaatgtgataagcattgttttggagtacctcagagatacacctcctgtccccgtagtggtttgtgatggatctggacgagcctccgacatccttgctttcggacacaaatactccgaagagggcggattgataaatgaatctctgcgggaccagttactggtgaccattcaaaagacatttacatatacccgaacacaagcgcagcacttgttcatcattctgatggaatgtatgaagaaaaaggagctgatcactgtgtttagaatgggttcggaaggacatcaggacatcgacctcgcaattctgaccgcgttgcttaaaggagccaacgccagtgcccccgaccaactgagcctcgctctcgcctggaatcgcgtcgatattgctcggtcccagatcttcatatacggtcagcagtggcccgtgggctccctcgagcaagcgatgctggacgctctggtcctcgaccgagtggactttgtaaagttgctgatcgagaatggcgtttctatgcaccgtttccttaccatttcaaggttggaggagctgtataatactcggcacggccctagtaacaccctgtaccacctggtccgcgacgtgaaaaaaagggaatatccagggtttggatggatctacttcaaagggaacctcccccctgactacaggatttcgctgattgatataggattagtgatcgaatacttaatgggcggcgcataccgttgtaactacacaagaaaacggttccgcactctctaccacaacctgttcggtcctaagcgggatgacatccccttgcgaagaggaaggaagaccaccaagaaacgggaagaggaggtggacatcgacctggacgatcctgaaataaaccattttcctttcccgttccacgagttgatggtgtgggccgtgctgatgaagcgacagaaaatggcactgttcttctggcaacatggagaggaggcaatggccaaggcccttgtggcttgcaaattatgcaaggccatggcacatgaagcttctgaaaatgatatggttgacgacatttcgcaggagcttaatcacaattctcgagattttggacaactcgctgtggagctcctggatcagtcctataagcaggacgagcagctcgccatgaagttgctgacatatgaattgaagaactggagcaatgctacttgcctgcagctcgccgtggccgctaagcatagagactttatcgcacatacatgttctcagatgctgttaacagatatgtggatgggccggttgcgcatgaggaagaacagcgggctgaaagtcatcttaggcatcctgctacctcctagcatcctcagcttggaattcaagaacaaagacgatatgccttatatgtcgcaggcacaggagatccatcttcaggagaaagaggcggaagagcctgaaaagccaaccaaagaaaaggaagaggaagacatggaactgaccgcaatgctcggacggaataatggggagagtagtagaaaaaaagacgaggaagaggttcagagtaagcatcgactgattccactcggtagaaagatctacgagttttataacgcccctatcgttaaattctggttctataccctggcctatattgggtatcttatgctgttcaattacatcgtgctggtgaaaatggaacgctggccctccactcaagagtggatcgtgatcagctacatcttcacgctgggcattgaaaaaatgagggagatactgatgagtgagcccggcaagttgctgcagaaggtgaaagtgtggcttcaggagtactggaatgtgaccgacctgatagctattttactcttcagcgtggggatgatcctccggttgcaggatcagccattcaggtcagacggacgcgtgatttactgtgtcaatataatttattggtacattaggctgttagacatctttggagtgaataaatacctcggcccttacgttatgatgattggcaagatgatgattgacatgatgtattttgtgattatcatgcttgtcgttttgatgagctttggcgtcgctagacaagccatcctcttccccaacgaggagccatcctggaagttagcaaagaacattttttacatgccttactggatgatatatggggaagtcttcgcagatcagatcgaccccccttgtgggcaaaatgaaacaagggaagacggaaaaattattcagttacccccctgtaagactggcgcctggatagttcctgccattatggcttgctacctacttgtggccaacattctgttggttaacctccttattgctgtgttcaacaatacctttttcgaggttaaatcaatatcgaatcaggtttggaagtttcaaaggtatcagcttattatgacattccatgagcgccccgtactgccccccccactgatcattttctctcatatgactatgatttttcagcatctgtgttgtagatggcgcaagcatgagtccgaccccgacgagagggactatgggctgaagttgttcattacagacgatgaattgaagaaggtccatgacttcgaagagcagtgcatcgaggaatattttcgagagaaagacgataggtttaatagctctaatgacgagcgcattcgagtaacgagcgagcgggtcgaaaatatgagcatgagattagaggaggtgaatgagagagagcactctatgaaggccagcctacagaccgtggacatacgcttagctcaactggaggacctcattggtcgaatggccactgcgctggagagactgacaggattggaaagagccgagtctaataaaatcagaagcagaacaagcagcgactgcaccgatgctgcttatattgtgcgccagtcctctttcaattcccaggaagggaacacatttaagctccaggaatccatcgaccccgcgggcgaggagaccatgtctccaaccagtccgactctgatgccaaggatgagatctcactctttctacagcgttaacatgaaggacaaaggcggtatcgagaaactcgaaagcattttcaaagagcgatcactctctttacaccgtgccacaagtagccacagcgtggccaaagagccaaaagcccctgccgccccggccaatacactggccattgttcccgattctcggcgaccaagcagttgtattgatatctacgtgagcgcaatggacgagctccactgtgacatagacccactggataattcagtgaatatcctaggtctgggcgagcccagcttctcaactccggtgccttccactgctccaagctcatcagcgtatgccaccctcgccccaactgataggcctccatctcgcagcatcgacttcgaagatattacgtcaatggacacccgcagtttttcgtctgactacacccatcttcccgaatgtcagaacccatgggatagtgagccaccaatgtatcacacaattgaaagaagcaaaagttcccgatacctagccacaacgcctttcttactcgaagaagcgcccatcgtcaagtcccattccttcatgtttagcccctcccggagctactacgccaactttggagtaccagtgaagaccgcggaatacacgtcaataacagattgtatcgatacccggtgcgtgaacgcaccgcaagctatagccgacagagccgccttcccagggggtttaggcgacaaggtcgaggacctgacatgctgtcaccctgagagagaggcagagctgtctcacccctccagtgacagcgaagaaaatgaggcaaaggggagacgagctacaattgccatctcctctcaggaaggcgataactcagagcggacactgtcaaacaacataactgtgcctaagattgagcgggccaattcatatagcgctgaggagcccagcgcaccatatgcacatacccgcaaaagtttctccattagtgacaagctggacaggcaaagaaacacagcctcccttagaaatccttttcaacgcagcaagtcttctaagcctgagggacgcggagactcactctccatgagacgcctgtccagaaccagtgcttttcagtcctttgaatccaagcataactag

SEQ ID NO: 138421 - DNA, 4701 bp, Artificial Sequence
  Description of Artificial Sequence: Synthetic coding sequence
atgtatgttagagtctctttcgacacgaagccggaccttttactccatcttatgactaaagaatggcaactggagctcccaaagcttctgatcagcgtccacgggggcctgcagaattttgagctgcaaccaaagctgaagcaggtgtttgggaaaggactgataaaagctgctatgactaccggcgcgtggatcttcacaggaggcgtgaatactggtgtcatacggcacgtcggagatgcactgaaagaccatgcctctaaatcccgcgggaaaatttgcaccatcggaatcgccccatggggcatagttgagaaccaagaagatcttatcggcagggatgttgtcaggccctaccaaactatgagcaatcccatgagcaagctaacagtgctgaatagtatgcattctcactttatcctcgccgacaatgggaccactgggaagtacggcgccgaggtcaaactgagacgccagttggagaagcatataagccttcagaagatcaatacacgaattggacagggggtgcccgtggttgcgctgatcgtagaagggggccccaatgtgattagcatcgtgttagaatatttgcgcgacactccaccagtcccagtagtggtctgtgatgggagcggtagagcctctgatattttggctttcggccataaatacagtgaagaaggtggtctgataaacgagagtctcagagatcagttgctcgttactattcaaaagacattcacttacacacggactcaggctcaacacctgtttattatcctcatggagtgtatgaagaagaaagaactcattacagtcttccggatgggctcagagggccaccaggatatagatctggctatcttgactgccctactgaagggagctaacgcttccgcacccgaccagctgtccctggcgctggcttggaatcgcgttgacatagcaagaagtcaaatcttcatatacgggcaacaatggcctgtcggttcactcgagcaggccatgctcgatgctctggtcttagatagggtagatttcgttaagctgttgatcgagaatggcgtctcaatgcatcgattcctaacaattagtaggctcgaggagctgtataacacccgccatggcccatccaatactctgtaccaccttgtccgagatgtgaagaagggtaacctgccgcccgactaccggattagtctgattgacattgggctagtaatcgaatacctgatgggtggggcctacaggtgtaactatacgaggaaaagatttaggacactgtaccacaatctgttcggtcccaaaaggcctaaagcactcaagttgctcggtatggaggatgacatacctctgagaaggggcagaaaaaccacaaaaaagcgagaagaggaggttgacatagatctagacgaccccgagatcaaccacttcccgttcccttttcacgagctcatggtctgggctgtcctcatgaagagacagaaaatggctctgtttttttggcagcatggcgaagaggccatggctaaggcacttgtggcttgtaaactctgtaaagccatggcccatgaggcctctgaaaatgacatggtcgacgatatcagccaggaactgaaccacaattctcgggactttgggcaactcgctgtggagctgttggaccagagctacaaacaggacgaacaactcgcaatgaagctactcacttatgaactcaagaactggagcaatgccacatgtttacagctcgctgtagccgctaagcatagggacttcatagctcatacctgcagccagatgctgctgacagatatgtggatgggcaggctgcggatgagaaaaaactccggcctcaaggttatactcggtatattgctgcccccctcaatattatcactggaatttaagaataaggatgacatgccctacatgtcccaagcccaggagattcatttacaagagaaagaggcagaagagccagaaaagcccacaaaggaaaaggaagaggaagatatggagctgactgccatgttagggagaaataatggcgagagttcacggaaaaaagatgaggaagaggtccaatcaaaacacagactgattcctctggggaggaagatttacgagttttataacgcaccaatcgtaaaattttggttttacactctagcttatattgggtatctaatgctgtttaactacatcgtgctggtgaagatggagcgatggccctctacacaggagtggattgtgatttcttacatttttacgctgggcattgaaaagatgagagaaatactgatgtcagaacccgggaaacttctgcagaaagttaaagtctggctccaagaatattggaacgtgaccgacctgatagcaattttgctgttttccgtcggtatgatcctccgccttcaggaccagccatttcggtccgacggacgcgtaatttactgtgttaatatcatctactggtatatacggctcctggatattttcggcgtaaataagtacctggggccgtatgtcatgatgatcggtaaaatgatgattgatatgatgtacttcgtcatcattatgcttgtggttctgatgagcttcggcgttgcacgtcaggctattctgtttccaaatgaggaacctagttggaagcttgccaaaaatattttttatatgccctactggatgatttatggagaggtctttgctgaccagatcgataggaagcaagtctatgacagccacacacctaagagtgcaccttgcgggcagaacgagaccagagaggacgggaagatcattcagcttcccccttgtaagaccggagcctggattgtgcccgctatcatggcctgctacttgctagtcgcgaatatactgctggtcaacttgctgatagccgtgttcaataataccttcttcgaggtgaagtccatctcgaatcaggtatggaaatttcaacgctaccagctaattatgacctttcacgaaaggccggtgctgccgcccccacttattattttttcacacatgaccatgatattccagcacctgtgttgccgatggcgtaaacatgagtctgaccctgatgaacgcgactatggcttaaagctctttatcaccgacgatgaattgaagaaagtgcacgattttgaggagcaatgcatcgaggagtactttagggaaaaggacgatcggtttaacagtagcaatgatgagaggatccgcgtgactagcgaacgcgtagagaatatgtctatgcggctggaagaagtgaacgaaagggagcactctatgaaagccagcctgcaaaccgtggacataagactcgcgcaactcgaggatctgattgggaggatggcaacagcccttgaaagactgaccgggttggaaagggccgaaagtaacaagatccgctctcggacttcctctgactgtaccgatgctgcctatatcgttagacagtcaagcttcaactctcaagagggcaatacatttaaacttcaggagagcatcgaccctgccggggaggaaaccatgagtcccactagcccaaccctaatgcccagaatgaggtcccattctttttattcggtgaatatgaaagataaggggggtatcgagaaactcgagagcatctttaaggaaaggtccctgtctctgcaccgggcaacgtctagccacagcgtggctaaggaacccaaagcccccgctgctcccgcaaatactctggcaatcgtcccagacagccggcgcccgagcagctgtattgacatatacgtgagcgcaatggacgaactccattgtgacattgatcctcttgacaatagtgtcaacattctggggctgggtgagccatctttctccactccagtaccgtcaaccgctccatcttcctctgcttacgccaccctggccccaacagaccggcctccatccagatctatcgactttgaggacattacttctatggacacgaggtcgtttagtagcgattacacacacctccccgagtgtcagaatccctgggattctgagccgccgatgtaccatacaatcgagcgtagtaagagctcccggtatttagctaccaccccatttctactcgaagaggcccctattgtcaaatcccacagcttcatgttctcaccttcgcggagctattacgcgaacttcggcgtccctgtgaaaacagccgaatatacctccattacagattgcatcgatactcgctgcgtaaatgcaccacaggccatcgcggatcgagctgccttccctggggggctgggggacaaggttgaggatctcacttgctgccaccccgaaagagaagcagagcttagccatccttccagcgactccgaagagaatgaggccaaaggaagaagagcaaccatcgcaatctctagccaggaaggtgacaactctgagaggacgctgtcgaataatatcacagtacccaaaattgagcgcgctaattcttattcggccgaggaaccctctgcgccctacgcccacacacgaaagagcttttcaatctccgacaagctcgataggcaacggaatacggcatcactaaggaatccgttccaacggtccaagtcatccaaacctgaagggaggggggattccctatccatgagacgtctcagtcgcacctccgcctttcagtcattcgagagcaagcacaactag

SEQ ID NO: 138422 - DNA, 4740 bp, Artificial Sequence
  Description of Artificial Sequence: Synthetic coding sequence
atgtacgtacgcgtgtctttcgataccaagccagatctgcttttgcacttgatgaccaaagaatggcagctggaactccccaagctgctgatctctgttcacgggggccttcaaaattttgaattacagcctaagctgaagcaagtgttcggcaaggggctgattaaggccgctatgacgactggggcctggatctttaccggtggtgtcaacacaggtgtgatcaggcacgtgggcgatgcactgaaggatcacgcatccaagagcaggggcaagatctgcacgatcggtatagccccatggggaattgtggaaaaccaggaagaccttatcgggagagacgttgtgaggccctatcagaccatgagtaacccgatgagcaagcttaccgtccttaacagtatgcactcacatttcatactggctgataatggcactaccggcaagtatggtgccgaggtgaagctcaggcgccagttggagaaacacatttccctgcaaaagatcaatacacgatgtttaccgttctttagccttgacagcaggctattttactctttctggggcagctgccagctagattcagttggaataggacagggggtgccagtagtcgcacttattgtggaaggtgggccaaatgtgatctctatcgtcctggagtacctgagggacactccccccgtgccggtcgtggtctgcgacggaagcgggagggcaagtgacatattagcgttcggtcataagtattcagaagaaggggggctcatcaacgaaagtttgcgggaccagctgctggtgaccattcagaagacctttacatatactaggacccaagctcagcatctgttcatcattctgatggaatgtatgaaaaagaaggaactgataaccgtgttccggatgggttccgaaggccatcaggatattgacctcgcaatcctcactgcattattaaagggtgctaacgcctctgctcctgaccagctaagcctggcactggcatggaaccgcgtggacatcgcacggtctcagatcttcatttacggccagcaatggccagtcggatcgctagaacaggcgatgctagatgcattagtcctcgacagagtagattttgtcaaactgcttatcgagaatggggtctccatgcatcgattcttgacaatttctcgcttagaggagctgtacaatacaaggcacggtccatcgaataccctctaccacctggtgagggatgttaagaagggcaatctgcctcctgactacagaatttctctgatagatatcggtttggtgattgaatatcttatgggcggggcctatcggtgcaattacacccgcaagaggtttaggaccctgtaccataacctctttggtcctaagagaccaaaggctctgaagctcttaggaatggaggacgacatccctttgcgcaggggccgaaaaactacaaagaagagggaagaagaggtggacattgatttggacgatcctgagatcaatcatttcccttttccctttcatgaactcatggtatgggcggtcctgatgaagcgccagaagatggccctctttttctggcagcacggcgaagaggcgatggcaaaggcactggttgcatgtaaattgtgcaaggccatggcccacgaggcatcagaaaatgatatggtcgacgatatttcccaggagcttaaccataacagtagggacttcggccaattggctgttgaactcctcgatcagagctataagcaagacgagcagctcgccatgaaactgctgacatacgagctgaaaaactggtctaatgccacttgtctgcagctcgctgtcgccgctaagcacagagatttcattgcacacacttgttcccagatgctgctgaccgacatgtggatgggcagactgcgcatgcgcaagaactctggacttaaggtgattctggggatcctcctacctcctagtatcctcagcttggagttcaagaataaagatgacatgccttatatgagtcaagctcaggagatacacctacaggagaaagaagctgaagaaccagagaaacctacgaaagaaaaggaagaggaagacatggagctgacagccatgcttggtagaaacaacggggagtccagcaggaaaaaggatgaagaggaagtccaatccaagcacaggctgatacctttgggacgcaagatatacgagttctataacgctccaatcgtcaagttctggttttacaccctcgcgtacattggatatctgatgttattcaactatatcgtcctcgtaaagatggaaagatggccaagcactcaggagtggatagttatttcctacatcttcacactgggcatcgaaaaaatgagggagatccttatgtctgagcctggtaagctccttcagaaggtcaaggtgtggctgcaggaatactggaacgtgaccgacctaattgctatcttgctgttctcagtaggcatgattttgcggctccaggatcaaccgttcaggagtgacggcagagtgatttactgtgtcaatatcatatattggtacatacgcctgctcgatattttcggcgttaataaatacttgggtccctacgtcatgatgattggaaagatgatgatagacatgatgtatttcgtaattatcatgctggtagttttgatgagcttcggagtcgcgcggcaggccatactcttccccaatgaagagccttcatggaagctggctaaaaatatattttacatgccgtattggatgatttatggggaagtgttcgcagatcaaatcgacccaccatgcggtcagaatgagactcgggaagacggtaagatcatccagcttcccccctgtaagacgggcgcttggatagtcccagccatcatggcttgttatctgctcgtcgctaatattttgttggtgaacctccttatagctgtttttaacaacacgttcttcgaagttaaatctatctcaaatcaggtgtggaaatttcagcgttatcagctcataatgacattccatgagcggcccgtgctgcccccacccctgattatcttctcacacatgacaatgatcttccagcatctttgctgtcgctggcggaagcacgagtctgaccccgatgagcgggattatgggctgaaactcttcatcaccgatgatgagttgaagaaggtgcacgactttgaagaacagtgcattgaggaatactttagggaaaaagatgaccggttcaacagttcaaacgacgagagaatcagggtgacctctgaaagagtggaaaatatgagtatgcgattggaagaagtgaatgagagagaacacagcatgaaggctagccttcaaacggtggacattaggttagcgcaacttgaggatctgatcgggcgcatggccaccgcactcgaacggctgaccgggctcgaacgcgccgagtccaataaaattaggtctaggacgagtagtgattgtaccgatgccgcatacattgttagacaatcatctttcaatagtcaggaaggcaacacgtttaagctgcaggagagcatcgaccccgctggcgaggaaaccatgagccccactagccccactctcatgccaaggatgaggagtcatagtttttatagcgttaacatgaaagataagggtggtatcgaaaagctggaatccattttcaaagagagatccttgagtctacacagagctacgtcttctcactccgttgccaaagaacctaaggctcctgccgcaccagccaacaccttggcaatagtgccagatagtcggcgtccaagtagctgcatcgatatctatgtgagcgccatggacgaactgcactgtgacatagatccactggataattccgttaatatcctgggcctcggggagccaagcttctcgacacccgttccttccactgcccctagtagtagtgcttacgcaactctggcccctaccgacagaccaccaagtcgatccatcgattttgaggatatcactagcatggatacgagaagcttttcatctgattacacacatctaccggaatgccaaaacccatgggactctgaaccgcctatgtaccacactatagagcgctctaaaagctctcggtatctggctacgacccctttccttctggaagaagcacctatcgtgaagtcccactccttcatgttcagcccttcccgctcctattatgccaacttcggtgtgcctgtgaagacagccgaatacacctccattaccgactgcatcgacacacggtgtgtaaatgcccctcaagccattgctgatcgagccgctttccccggcggtctgggcgacaaggtggaagatctgacatgctgccacccagaaagggaagcagagctctcccatccaagctcggattctgaagagaatgaagccaagggtcgacgggcaactattgccatctcatcacaagagggtgacaacagtgaacggactctgagtaacaacatcactgttccaaaaattgagagagctaactcctactcggctgaggaaccttccgctccgtacgcccatacccgcaaatcttttagcatctccgataaactggaccggcagagaaacacagccagcttacgcaaccccttccagcgctcaaagtcatcgaaaccagagggcaggggggacagtctgagtatgagacgcctcagcagaacctcagcatttcagagtttcgaaagtaagcataactag

SEQ ID NO: 138423 - DNA, 4701 bp, Artificial Sequence
  Description of Artificial Sequence: Synthetic coding sequence
atgtacgtgcgagtcagctttgacactaaacctgatctgctcctacatctcatgaccaaggagtggcaactggaactaccgaagctgttgatttccgtccacggcggcctgcaaaacttcgaactccaacctaagttgaagcaggtgtttggcaaagggctgataaaagcagccatgaccacaggcgcttggatcttcaccggtggtgtgaacactggggtgatcaggcacgtcggtgacgctctgaaagaccatgcctcgaagagtcgaggaaaaatttgcactattggcattgcaccatgggggatagtcgagaaccaggaggacctgattggacgggacgtcgtaaggccataccagacaatgagcaatcctatgtctaagctgactgtgctgaactcgatgcacagccatttcatcctagctgataatggaaccacaggtaagtacggggccgaggtgaagctccggaggcaactagaaaagcacattagcctgcaaaaaattaatacacggatcggtcagggagtgccggtggtggctctgatcgtggagggcggcccaaacgttatttctatcgtattggagtatctgagggatactcccccggtccctgttgtcgtgtgcgatggatcgggacgagcatcagacatcctggcctttggacataagtactctgaagagggcggattgatcaatgaaagcttaagagatcaattgctagtgaccatccaaaagaccttcacctacacaaggactcaggcccagcatttgttcatcatcctgatggaatgtatgaagaagaaagagctaattacagtgttccgcatggggagcgagggacaccaagatatcgacctggccatcctgactgcattactgaagggcgctaacgcctctgccccagaccagctcagtctggcccttgcatggaacagggtagatatagcaagaagccagatttttatttatgggcaacaatggccagtaggcagtctggaacaggccatgctcgacgctctcgtgttagatagagtcgacttcgtgaaactgctaatcgaaaacggcgtctcaatgcaccgtttcctgacgataagccggctcgaggaactctataacacccggcacggcccaagcaataccctctatcacctcgtgagggacgtcaagaagcgtgagtatcccggctttgggtggatctacttcaagggaaatcttccgccagattatcggattagccttatagatatcggtctagtaatcgaatatctcatgggcggtgcctatagatgtaactacacccggaaacgcttcagaacactctaccataaccttttcggtccaaagaggcccaaggctctgaagctgctggggatggaggacgacattccattgcggcgcggaaggaagaccaccaaaaaaagggaggaggaggtggatattgaccttgatgatccagagattaatcactttccctttccgtttcatgagctcatggtttgggccgtgctcatgaaacggcagaagatggctctattcttttggcagcatggcgaagaggccatggcaaaagcgctagttgcttgcaaactctgcaaggctatggcgcacgaagccagtgagaatgatatggtagacgacatttcgcaggagctgaatcacaattctcgcgatttcggccaactggcagtggaactgttggaccagtcttacaaacaggacgagcagttggcaatgaaactgctgacatacgagttgaagaactggtcaaatgctacatgtctccagctggccgtggctgcaaagcaccgggacttcattgctcacacttgctcccaaatgctcctcaccgatatgtggatgggccggctgagaatgagaaaaaactccggattaaaagtgatcctcggaattctactgccaccatccatcctgtccctggagtttaagaataaggacgatatgccttatatgtctcaggcccaagagatccacctgcaggagaaggaggccgaagagcccgaaaaacccactaaagaaaaagaggaagaagatatggaactcacagcgatgctaggacgaaacaacggagagtctagtcggaagaaggatgaagaagaggtacagtctaaacaccgactaatcccactggggagaaaaatttatgagttttataatgcgccaatcgttaaattctggttttacaccttagcatatatcggatacctcatgctgtttaattacattgtgcttgttaaaatggagcgttggccgtccacccaagagtggatcgtaatttcttacatattcaccctgggaattgagaaaatgcgcgaaattcttatgtccgaaccggggaagttgttacagaaggtgaaggtgtggcttcaggaatattggaatgtaaccgacttgatcgccatcctcctattctcagtagggatgattttaagattacaagaccagccattccggagtgatggacgagtgatctattgtgtgaacataatatattggtatatccgcctgctggatattttcggggtgaacaaatacctgggcccttatgtgatgatgattgggaagatgatgatagacatgatgtacttcgttatcatcatgctggtggtgttgatgtccttcggcgtggcaaggcaagctatcctgtttccgaacgaggagccaagttggaagcttgccaaaaatatcttttacatgccttattggatgatttacggggaagtcttcgccgaccaaattgatcccccctgcggccagaatgagactagagaagatggcaagattatccagttgccgccttgtaagacgggcgcttggatcgtacccgccattatggcctgctacctcctagttgccaatattctccttgtgaaccttctgatcgctgtgtttaataatacgttttttgaagtgaagtccatctccaatcaagtatggaaattccagagatatcagctgatcatgacatttcacgagagacccgtcctgcctccacctctgatcatcttctcccatatgacaatgattttccagcacctctgctgtcgctggaggaaacatgagtctgatccggacgaaagggattatgggctgaagttattcattacggacgacgaattgaaaaaagttcacgacttcgaagagcagtgtattgaagaatatttcagggagaaggacgaccggttcaatagttccaacgacgagaggatccgagtcaccagcgaaagggttgagaatatgtcaatgaggcttgaagaagtgaatgaaagggagcactcgatgaaggcgtccctgcaaaccgtggatatacgcctggcccagctggaggacttgattggccgaatggcaaccgccttggagaggctgactggcttggaacgtgccgagagcaacaagatccgaagtcgcactagcagtgattgtacagacgccgcttacatcgttcggcagtcctctttcaattcgcaggagggtaacacctttaagcttcaggagagtatcgacccggctggagaagagacgatgtctccaactagccccactttgatgccccggatgaggagccactccttttattcagtgaatatgaaggataaaggggggattgagaaactggagagcatcttcaaagaacgctccctgtcgctccacagggctacaagcagccatagtgttgctaaggaaccaaaggcaccagctgcacctgcaaacactctcgctatcgtgcccgattcacggagaccctcttcgtgcatcgatatctatgtgtctgcaatggatgaactacactgcgacatagatccgttggataacagtgttaacatactcggtctgggagaaccaagcttcagcactcccgtgccaagcaccgctccttcgtcctctgcttatgctactctggcgccaactgatagacccccctcccggagtattgactttgaggacattaccagcatggatacacgcagcttcagctcagattatacccacttgcctgaatgccagaatccctgggacagtgaacctccaatgtatcacacaattgagcggtcaaagagttcacggtaccttgccactaccccgttcctgcttgaagaggcgccaattgttaagagccactctttcatgttctctccgtccaggtcctactacgcaaattttggcgtccctgtgaaaaccgcggaatacactagcattactgactgtattgacacccggtgcgtgaatgccccacaggccatcgccgaccgagccgccttccctggtggacttggagacaaggtcgaagatttaacttgttgccacccagaacgggaggctgaactgtctcacccttctagcgactctgaggaaaatgaggccaagggtagaagggccaccattgccatctcaagccaggaaggggacaatagcgagcggacactgtctaataacataacggtccccaaaattgagcgcgccaattcctacagcgccgaagagccaagcgctccttatgctcacactcgcaagtcttttagcatttctgataaactggacagacaacgcaacaccgccagtttaaggaatccctttcagcggagtaagagcagtaaaccagaggggcgcggcgattcactatcaatgagacggttgtcccgaaccagcgcctttcaatcctttgagtctaaacacaattag

SEQ ID NO: 138424 - DNA, 5205 bp, Artificial Sequence
  Description of Artificial Sequence: Synthetic coding sequence
atgggtaaaaaatggcgggacgccgcggagatggaacgcgggtgttccgaccgagaggataacgccgagtcacgcagaagaagcaggagcgccagtaggggtcggttcgcagagtcctggaaacgtctcagttctaagcagggctcaaccaaacgttctgggcttcctagtcagcagactcctgctcaaaaaagttggatcgagcgcgccttctacaaaagggagtgcgtgcacataattcctagcaccaaagacccccatcgatgttgttgtggccgactgatcgggcagcacgtcggactcaccccctccatcagcgtcctccaaaacgagaagaacgagagccgcttgtctaggaacgacatccagtcggaaaagtggtccattagtaaacatacccagctgagccctactgacgccttcggaaccattgagttccaaggggggggccactccaacaaggcaatgtacgttcgggtctcttttgacaccaaacccgacctgttactacacctgatgacaaaggaatggcagctggaactccctaagctcttgatctcggttcatggcggtcttcagaatttcgagcttcagcctaagttgaagcaagttttcggcaaggggcttatcaaagccgccatgacaactggcgcctggatcttcacggggggagtgaatacaggggtaataagacatgtgggtgacgctctgaaagatcatgctagcaagtctcggggaaaaatttgtacaatcggcatcgccccctggggtatagttgaaaaccaggaagacctgatcgggcgggacgtggtgcgcccctatcagaccatgagcaacccaatgtctaaactgactgttctgaactctatgcacagtcactttatcctagctgacaacggcaccaccggcaagtatggagccgaagtgaaactcagacggcagctagagaagcatataagtctccaaaagattaacacaaggtgccttcctttctttagtttagacagccggctcttctacagcttttggggaagctgccagctggattcagttggcattggtcaaggcgtgcctgtcgtggccctgatcgtggagggaggccccaacgtaatcagcatcgtgctggagtacctgcgagacacgccccctgttccagtggtggtttgcgacgggtctgggagggcgtcagacatcctggcctttggacacaagtactcagaagaaggaggcttaataaacgaatccttgcgggatcagcttctcgttacaatccaaaaaacatttacctatacccgcactcaggctcagcacctgttcatcatcctgatggagtgtatgaaaaagaaggaactgattactgtgttccggatgggtagcgaaggccaccaggacatagatctggccatcctaactgccctcctaaagggcgctaatgccagcgcgccagaccagttgtccctggcgctggcttggaacagagtcgacatcgcccgctctcagatcttcatctacggccaacaatggcctgtgggtagcctggagcaggccatgcttgatgccctggtgctggatagggtagatttcgtcaagctcctgatcgagaatggtgttagcatgcaccgattcctgaccatttctcgactcgaagagctatacaatacacgccacggccccagcaacacgctgtaccatctggtgagagacgttaaaaaaggcaacttgccccctgattatcgcatcagcttaattgacatcggcttagttatcgagtatctgatgggtggtgcctataggtgtaattacacaaggaagagatttcgaaccctctatcacaacctgtttggcccaaagcgtccaaaggcgctgaagctgctcggaatggaagatgatattccactgagacgggggaggaagacgaccaaaaagagggaggaggaggtagatattgacctcgacgaccccgaaattaatcactttccctttcctttccacgagctgatggtgtgggccgttctcatgaagcgccagaagatggccctgtttttttggcagcatggggaagaggccatggcgaaggccctggtcgcatgtaagctgtgcaaagcaatggcccacgaggcctctgagaatgatatggttgacgacatttcacaggaattgaaccacaacagtcgggactttggccagctggctgtcgagcttctggaccagtcatataagcaagacgagcagctggcaatgaaactcctcacctatgaactgaagaactggtcaaacgccacctgtctccaactggccgtcgccgcgaagcacagggactttattgcccacacttgcagtcagatgctgctcactgatatgtggatggggcggctgcggatgcggaaaaactcaggactgaaagtcatccttggcatccttctccctccttctatcctcagtctggaatttaaaaacaaggatgacatgccttacatgtcccaggctcaggaaatccatcttcaggagaaagaggcggaagagcccgaaaaaccaacaaaagaaaaggaagaggaggacatggaattgaccgccatgctaggaagaaacaatggtgagtcaagccgtaagaaggacgaggaggaagtccagtccaaacatcggttaatcccactcggaagaaagatctatgagttctataacgcacccatcgtgaaattttggttctatactctggcctatatcggctatttgatgctttttaattacattgtgcttgttaaaatggaaagatggccaagcacgcaagagtggattgttatctcttacatcttcaccctgggaatcgaaaagatgcgagagatcctgatgagtgagcccggaaaactcctgcaaaaagtgaaggtatggctgcaggagtactggaacgtgaccgatttgatagcaatcctgctgttcagcgtgggcatgatcctgcgactccaggatcaaccttttcgttcagacgggcgggtgatttactgtgtgaacatcatttactggtatattaggttgttggatattttcggtgtcaacaaatacctgggcccctacgtgatgatgatcgggaaaatgatgatcgatatgatgtacttcgtcatcattatgctcgtggtcctcatgagctttggggtcgcaaggcaagctatactgtttccgaatgaggagccatcctggaaattagccaaaaacattttctacatgccctattggatgatctatggagaagtttttgcggaccaaatagatccaccctgcggtcagaacgaaaccagggaagatggcaagattatccaactgccaccctgcaaaactggtgcctggattgtgccagcaatcatggcgtgctatctactggtggccaatatactgttggtcaatttgctgattgctgttttcaataataccttttttgaggtgaagtctatctcaaaccaggtttggaaattccagcgatatcagctgatcatgacatttcacgagcgtcccgtgcttcctcctccactgatcattttctcccatatgactatgatattccaacacctgtgttgtcgctggcggaaacacgaaagcgatccagacgagcgcgactatggtctaaagttgttcatcacggacgacgaactcaaaaaagtccatgattttgaagagcagtgcattgaggagtactttcgagaaaaggatgaccgattcaactctagtaacgacgagcggattcgggtcacatccgaaagggttgagaacatgagcatgagactcgaagaagttaacgagagggaacattcgatgaaagcctccctgcagactgtcgatatcagactggcccaactggaagaccttattggtcgtatggcgacggcgctggagaggctgactggccttgagagggcggaatctaataagatccgaagcaggacttcaagcgattgtacagatgctgcttacatcgtccgtcagagttccttcaacagccaagaaggcaatactttcaagttacaagagtcaatcgatcctgctggggaggagaccatgtccccaacatctccaaccctaatgccaaggatgcggtcacactccttctattccgtgaacatgaaagacaaaggaggcattgagaagctagaatctatcttcaaggagaggtctctctcgctgcaccgcgccacatcctcacactcggtggccaaagagcctaaggctcccgctgcgcccgccaacacccttgccattgttcccgattcccggcgaccgagctcatgcatcgatatctacgttagtgctatggatgaactgcactgtgatatcgaccctctggataacagcgtgaacattcttgggttgggtgagcccagcttttcaacgcccgttccttccactgcgccttccagcagtgcatacgccacactagcccctacagacaggcccccatcgagatccatagacttcgaagacattacatctatggatactcggtccttttcttcagattatacacacctgccagagtgccagaatccatgggactctgagccaccaatgtatcatactatagagagatcgaagtcgtccagatatttggctaccaccccatttttattggaagaggcaccgattgttaaaagccacagctttatgttttccccgtcgcggtcctattatgctaattttggcgtgcctgtgaagaccgccgagtataccagcattactgattgcattgatacacggtgtgttaacgcaccacaggctatcgcagacagggccgccttccctggtggccttggcgataaagtcgaggatctaacctgttgccatcctgaaagagaggcagagctgagccaccctagctctgatagcgaggagaatgaggccaaaggcaggagagccactatcgccatttcatcacaggaaggcgacaattcggagcgtaccctgtccaacaacatcaccgtccctaagattgagcgtgcgaattcctatagtgccgaggagccctcggccccctatgcccacacgcgtaagtccttttcgataagcgataaattggatcgacagcggaatacagcatcactcaggaatccatttcagaggtctaaaagtagtaaacccgagggtcgaggcgacagccttagcatgaggagactcagtcgcacctcggccttccagtcatttgagtcaaagcacaattag

SEQ ID NO: 138425 - DNA, 645 bp, Artificial Sequence
  Description of Artificial Sequence: Synthetic coding sequence
atgtatgtgcgggtctctttcgatactaagccagatctgctgcttcatcttatgacaaaggagtggcagttagagttacctaagttgttaatatccgtccatggaggactccaaaacttcgaactgcagcccaaactaaaacaggtatttgggaagggactcatcaaggccgccatgactaccggagcgtggattttcacaggtggggtgaacactggtgtcatcaggcacgtcggagacgccctgaaggatcacgctagtaagagcagggggaagatctgtactattggtatcgcaccctggggaatcgttgagaaccaggaggacctgataggtagggacgttgtcaggccctatcaaaccatgagtaaccctatgtccaagttgactgtgctgaattcaatgcactcacattttatactggcggataacggcactaccggcaagtatggcgccgaagtcaaactgcgcagacaattggaaaagcacatatcactgcagaagataaacacatcgttccattcctacaagaccgcccatgttgacttacaggataagcggcaggtaaaaaccgccctggaacaggctgagtggcagcccggacggggcatgtttgatcacgacaacctgatgcagagcacctag

SEQ ID NO: 138426 - DNA, 3645 bp, Artificial Sequence
  Description of Artificial Sequence: Synthetic coding sequence
atggtggttccagaaaaggagcagtcttggataccaaagatcttcaagaagaagacttgtacaacgtttatcgtcgattcaaccgaccctggcggcactttatgccagtgtgggcggccacgaacagcccaccccgccgttgcaatggaggatgcattcggggctgccgtggtcaccgtatgggatagcgacgcgcacactacagaaaaaccaacggatgcctatggggagttagacttcaccggtgccggcaggaaacactccaatttcctgaggctcagcgataggaccgatccagccgcggtgtattcgcttgtgacgcggacatggggcttcagagctcccaacctagtggtgtcagtgctcggcggatctggcggcccagtgctccagacctggctccaagacctcctgcgccgaggcctggtgagagctgcacagtctacaggggcgtggatcgttaccggcggtctgcacaccggaattgggcggcatgtgggcgttgccgtgagggatcaccaaatggcgagcaccggagggaccaaagttgtggcaatgggcgtcgctccgtggggagtggtcagaaatagagatacgctgattaacccaaagggatcctttccagctaggtacagatggcgaggggatccggaagacggagtgcaattccctttggactacaactactcagctttctttctcgtggatgatggcacacatggctgcctggggggggagaaccgcttccgacttcggttggagtcatatatcagtcaacagaagaccggcgtcggtggcactggaattgacatcccggtgctactcctgctgatcgatggggatgagaaaatgttaacgaggatagagaatgctacacaagcccagcttccctgcctgctggttgccgggtctggcggggccgccgattgtctggcagaaacactggaggacactttagctcctggcagcggcggggcaaggcagggcgaagcccgggatcggattcgcaggtttttcccgaaaggcgatctggaggtgttacaggcccaggtcgaacggattatgacccgaaaggagctcctgacagtgtactcttcggaggacggcagcgaggaatttgaaacgatcgtcctcaaggccctcgtcaaggcatgtggtagcagtgaagccagcgcatacctcgatgaattgagactggccgtggcatggaatcgggtggatattgcgcagtctgagcttttccgtggggacatccaatggcgcagctttcacctcgaggcttctctcatggatgcactcctgaatgatcgccctgaattcgtgaggctgcttatatcgcacggcttatctcttgggcacttcctgacgccgatgcgccttgcgcagctctacagtgccgcaccaagtaacagcctgatcaggaatcttctagaccaagcgagccattcagcaggaactaaggctcctgcattaaagggcggagctgcagagctaaggccgccagacgttgggcatgtgcttcgaatgctccttggcaagatgtgtgctcctagatatccatccggcggtgcttgggatccgcatccaggacaagggtttggggagtctatgtatctgctgtccgacaaggctacctcacctctctccctcgacgcaggcttgggtcaggctccctggtccgatctactcttgtgggcactcttattgaatagggcgcagatggccatgtacttctgggaaatgggatctaatgcagtgagctccgccctgggcgcctgtctcctgttaagggtgatggcacggctggaaccagacgctgaggaagcagcgcggcggaaagacctggcattcaaatttgaaggtatgggtgttgatctgttcggggagtgctatcgcagtagcgaagtgagagccgctcgactcttgcttagacgctgtccattgtggggtgacgctacctgtttgcagcttgcgatgcaggctgacgcgcgagctttcttcgcgcaagatggcgttcagagcctgcttactcagaaatggtggggcgacatggctagtactacccctatttgggccctcgttctagccttcttctgcccccccttgatttatactcggctaattaccttccgtaaatcagaggaagaaccaacaagggaggaactcgaatttgatatggactccgtgatcaatggagaggggcctgtcggaacagcagacccggccgaaaaaacaccactcggcgtgcctcggcagagtgggagaccgggatgctgcggtggaagatgtggggggaggagatgtttacggagatggttccatttctggggggcgcctgtgactatttttatggggaacgtggttagctatcttttatttttacttctgttcagcagagttctgttagtcgattttcagccagcgcctcctgggagcttagaactattgctttacttttgggcattcactctgctgtgcgaggaactgaggcaggggctgtctggaggcggaggctcattagcatcaggtggtcctgggccaggccacgcctctctgtctcagaggttgagattgtaccttgctgattcctggaaccaatgcgaccttgtggcattaacctgttttttactgggtgtgggttgtcgcctaactcccggcctgtatcacctcgggcgaacagtactatgtatcgacttcatggtgtttaccgtccggcttctgcacatcttcaccgtgaacaaacagttggggccgaaaatcgtcatagttagtaagatgatgaaggacgtgttcttcttcctcttttttctgggtgtgtggttagtcgcttatggggttgcaaccgaggggctcctcagacctagggacagcgacttcccttccatccttcgtcgggtgttttatcgaccctaccttcagatttttggacagataccgcaagaggacatggacgtggctcttatggagcactctaattgctcctcagaacccggattctgggcccacccccccggggcgcaggctgggacctgtgtttcccaatacgctaattggctggtggttttgctgctcgtaatcttcctcctggttgccaatatcctgttagttaacctactgatcgccatgttcagctatacattcggaaaggtgcaaggcaactctgatctgtactggaaggcccagagatataggctgattagggagtttcatagcaggccggccctagccccccccttcattgttataagtcacctgagattgctactcagacagttgtgtcgacggccccggtcacctcagccatcttcaccggccctcgaacactttcgcgtctacctgtcaaaagaagctgagagaaaactactgacctgggaatccgttcacaaagaaaactttctgctggccagggcaagggataaacgagaatccgacagtgagagacttaaacggacctctcaaaaagtggacctggctctgaaacagttaggacacatccgagagtacgagcagaggctcaaggtgcttgagcgcgaagtccaacagtgttcaagagttttaggatgggtcgcagaggcactcagtcgcagcgcactgctgcctcccggcggaccacccccaccagatctccccggcagcaaggactag

SEQ ID NO: 138427 - DNA, 2583 bp, Artificial Sequence
  Description of Artificial Sequence: Synthetic coding sequence
atgctgactagaattgaaaacgctacacaggcccaactgccatgcttgctcgtcgcggggagtggaggggcagcagactgcctcgctgagactttggaagatactctcgcccctggtagtggaggagcacgccagggtgaggcgcgggaccgcattcgaaggttttttcccaagggggatttggaggtactacaggcccagtccttccacctggaggcttctttaatggacgcccttttgaacgataggcctgaatttgtgcgacttctgatatcgcatggcttgtcactgggtcattttctgacccctatgagactggcccagctgtattcagccgcaccaagcaatagtctcattcggaacctgttggatcaagccagtcatagcgctgggacgaaggccccagctctcaagggaggcgccgccgaactgcgcccaccagatgtgggacacgtgctccgaatgctcctcggcaaaatgtgtgcacctaggtatccctccggaggggcatgggaccctcatccgggacagggatttggtgagtcaatgtacctgctgtccgacaaagcaactagtccgctctccctagacgccggcttgggacaggctccttggtctgatcttctgctctgggctcttctcctgaacagagcccaaatggctatgtatttttgggagatgggtagcaatgcggtttcctcagccctgggggcgtgtctacttctacgtgtcatggcgcgcctcgaacctgatgctgaagaagccgcccgtcgcaaagatctcgccttcaagtttgaagggatgggtgttgatctgttcggagaatgctatcgcagctccgaggtccgtgcagcacgactcctgcttcgaaggtgccccctgtggggcgatgcaacctgcctgcagcttgctatgcaagccgatgctagggccttttttgcccaagacggagtgcaatcactgctcacacaaaaatggtggggagacatggcttcgacaaccccaatttgggcactcgtgttagctttcttctgcccacctttgatctacacacggctgatcactttcaggaaaagcgaagaggagccaacgcgagaggaactggagtttgatatggattctgtcattaacggggaggggcctgtaggcacggctgatccagctgagaaaaccccattgggcgtgccacggcagtcaggccgcccagggtgttgcggcggccgatgtggagggagaaggtgtctgcgtaggtggttccacttctggggggctcctgttaccatctttatggggaacgtagtgtcctatttgctgtttttactcttgttttcacgtgtgctgctggtcgatttccaacccgcgcctccgggtagtttagagctcctactatacttttgggcttttactctactgtgcgaggagctacggcaaggcctgtctggtggaggtggctcactcgcctctggtggcccgggccccggccacgcaagccttagccagcggctgcgcttgtacctggccgactcttggaatcagtgcgatctagtagctctgacttgcttcctgctcggggtgggatgtaggctcacacctgggctctaccacctgggaagaaccgtgctgtgcatcgactttatggtgttcaccgtgcggcttttacacatatttaccgtaaataaacagctgggtcccaagatcgttatcgtgagtaaaatgatgaaagatgtgttcttcttcctattcttcctgggcgtgtggttggtggcttacggggtggccacagaagggctgctccgaccccgcgatagcgactttccttcaattctgagacgcgttttctatcgcccttacctgcagatttttggtcagattcctcaggaagacatggatgtggcattgatggagcactcaaactgttcttctgagcctgggttctgggcccaccctcccggagctcaagccggcacctgcgtctcccagtacgctaattggctcgtggttttacttttggtgattttcctcctcgtggctaacatcttgctagtgaatttgttgatcgccatgtttagctacaccttcggtaaggtacagggcaactctgacctctactggaaagcccaaagatatcggctaatccgggagttccacagcagaccggcgctcgctccaccattcatcgtgatcagtcacctgagactgcttctgaggcagctgtgtcggcgcccccgctctccccagccctcctcacccgcgcttgagcacttccgagtgtatctttctaaggaggcagagcgaaagttgctgacctgggagtctgtgcacaaagagaactttcttcttgcccgtgcgagggataagagggaatctgacagcgagcggctgaaaagaacatcccaaaaggtcgacctggctctgaaacaactgggccacatacgcgagtatgagcagagactcaaggtgctggaaagagaggtgcagcaatgctccagggttttgggttgggttgccgaagctctgagtcgtagcgccctgttgcccccaggtggcccccctcccccagacctgcccggcagtaaagactag

SEQ ID NO: 138428 - DNA, 3210 bp, Artificial Sequence
  Description of Artificial Sequence: Synthetic coding sequence
atggttgtgcccgagaaggagcagagttggattcccaaaatttttaagaagaaaacctgcacgacctttatagtcgacagcaccgatcctggcggtacattgtgccagtgcggacgaccgcgtactgcgcacccggccgtggccatggaggacgcctttggcgctgccgtagtcaccgtgtgggatagcgacgcgcatacaaccgaaaagccaactgacgcatacggcgagcttgactttacgggagccggccggaagcattcgaatttcctgcgcctttctgatcgtactgacccagccgcagtctattctctggtgactcgaacctgggggttccgtgccccaaatctggttgtctccgtcttaggcggctctggtggccccgtcctgcagacttggttacaggatctcctgaggcggggactggtccgggctgctcagtcaacgggggcctggattgtgacagggggacttcacactggtattggccggcatgtgggagtcgccgtgagggatcaccaaatggcttctacaggcgggaccaaggtagtggctatgggagtggccccgtggggggtggttcggaatcgtgacactctgattaaccctaagggttcgttccctgcccggtatagatggcgcggcgatccagaggacggggtccaatttcccctcgattacaactacagtgcttttttcctcgtcgacgacggcacgcatggctgtctgggaggggagaacagattccgcctgcgcctcgaatcttatatttcacagcagaagacaggagtaggcgggacaggaatagacatacctgtgctgcttctcctaattgatggagacgagaaaatgctcacacgcatcgagaacgccacacaggcacagctgccttgcctgctggtcgccgggtcgggcggcgccgcagactgtctggctgaaactctggaagataccttggcaccggggagtggtggagctcgtcaaggcgaggctcgcgaccgtattaggcggttctttcccaagggggacctggaggttctgcaggctcaggtcgaacgcatcatgacaaggaaggaattactaaccgtttattcctcagaagacggcagtgaggagttcgagacaatagtgctgaaagcgcttgtgaaggcctgcggctcatctgaggcaagtgcctatcttgacgaattgaggctggctgtagcctggaacagagtagacatcgcacaaagcgaactctttcgcggtgacatccagtggaggtcattccacctcgaagcatcacttatggatgcgctcctgaacgaccgcccggagttcgtgaggcttttaatatctcatggactttcccttgggcactttttgacacccatgcggctcgcccaactctattccgctgcccctagtaattccctaattcgcaatctgctggaccaagccagccattccgctggtacaaaagcccctgctttgaaaggtggtgccgccgagctgcggcccccagatgtgggacacgtactgagaatgttgctaggaaagatgtgtgctccaaggtacccatccggcggcgcttgggaccctcacccaggtcagggtttcggagaatcaatgtacttactgtcagataaagccacctcaccactgtcactggacgctgggctggggcaagccccttggagcgacctcctcttgtgggctctcctccttaacagggctcagatggcaatgtacttctgggagatgggctctaatgctgtgtcatcagccctgggagcctgtctgctgctgagggtgatggcccgcctcgaacctgacgctgaggaggctgcaagacggaaggacctggcctttaagttcgaaggaatgggagtggatctgttcggtgaatgttaccgatcctcggaggtgagagcagccagacttctgctccgacgctgtcccctgtggggtgacgcaacctgcctacaactcgcaatgcaggctgacgccagagctttttttgcgcaagatggcgtgcagagtctgctgacgcaaaagtggtggggagatatggccagcacaacccccatctgggctctggtgctcgcttttttctgtccccccctgatatacaccaggctgatcacatttaggaaaagtgaggaagaacctacccgggaggagctggaatttgacatggattccgtgatcaatggggagggccctgtgggattgacccctggcctttaccatttgggaagaaccgtgttatgtattgatttcatggtgtttacggtccgcctccttcatatcttcacggtgaataagcaattgggccctaagatcgtgatcgtttctaaaatgatgaaagacgtgtttttcttcctctttttcctaggagtgtggctcgttgcatacggggtggccaccgaaggcctcctgcgcccacgggactcggattttccttctattcttagaagagtcttttatcgaccatatctgcaaatatttggccagatcccacaggaggatatggacgtggccctgatggaacacagcaactgcagcagcgaacccgggttttgggcgcacccccctggagcgcaggccggcacatgtgtttctcaatatgctaattggcttgtggttctgttgctcgtcatctttttattggttgccaacatcctgttggttaatcttctgattgccatgttcagctataccttcggaaaagtccagggtaattcagatctctactggaaagcccagaggtataggctgatccgggagttccacagtaggccggccctggcacctcctttcatcgttatcagtcacctgcgcctcctgttgagacaactatgtcggaggccaagatccccacagcctagctcacccgctctggaacatttcagggtgtacctgagtaaggaggctgagaggaaactgctcacttgggagtccgtccacaaggagaactttctacttgctcgtgccagggacaaacgtgaatccgacagcgagcggctgaagcgaacaagtcagaaagtggatctggcccttaagcaattgggacatattagggaatacgagcagaggttaaaagtgctcgaacgtgaggtccagcaatgtagccgcgtattgggatgggtggcggaggcgctgtcacgaagtgccctgctcccacccggtggccctccacccccagatctgccaggaagtaaggattag

SEQ ID NO: 138429 - DNA, 3498 bp, Artificial Sequence
  Description of Artificial Sequence: Synthetic coding sequence
atgcaggacgtgcaaggccctaggccggggtctcccggcgatgctgaggacaggcgcgaactcggattacaccgcggagaggtgaattttggaggctccggcaaaaagcgcgggaaatttgtccgggtgccctccggcgtggctcccagcgtgctgttcgacctcctgctggccgaatggcacctgccagccccgaacttggtagtcagcttggttggagaggagcagccattcgctatgaagtcgtggctgcgagatgtgctccgcaagggtcttgttaaggctgcccagtcaactggggcctggattctgaccagcgcattgagggtcggactcgcgcgacatgtgggacaggcggtgagggatcactctctcgccagtacctccactaaggtgcgcgtggtggccgtgggcatggcctccttggggcgagtgctccaccggcgaatactggaggaggcacaggaagacttcccggtccactacccagaagacgatggcggctcacaggggccattgtgctccctggactccaacctgagccactttatcctggtggagccaggcccacccgggaaaggggatggtttaactgaattgcgcctgcggctggagaaacacatttcagaacagagagcagggtacggggggacaggttcaatagaaatcccggttctgtgcctacttgtgaatggcgatcccaatacacttgagagaatctctcgggctgtggaacaggctgctccttggctgatccttgtggggagcggcggcattgctgacgtgctagccgcactcgtcaaccagccccacctgctggtgcccaaggttgcggaaaagcagttcaaagaaaagttccccagcaagcatttctcatgggaagatatagtccgctggactaagctacttcagaacatcacctcccatcagcatctcctcactgtgtacgatttcgaacaggaagggagcgaagagctcgatacagtgatccttaaagcattggtgaaggcctgcaaatctcactctcaggagccccaagattaccttgacgagttgaagcttgcagtcgcgtgggatagggttgatatcgccaagtccgagatctttaatggagacgtcgaatggaaatcttgtgatcttgaggaagtcatggtggacgccctggtctctaataaacccgagtttgttagactgttcgtggataacggcgctgatgtggccgattttctcacttatgggagattgcaggagctgtatagatcagttagccggaagtctttgctctttgacttgctgcaaagaaagcaggaggaggccaggctgacactggcaggcttgggaacacaacaagccagggaacctccagccgggccccctgcatttagcctccatgaggtgtcaagggttctcaaagacttccttcaggatgcctgccgagggttttaccaagacggaagaccgggagatcgaagaagggctgaaaaaggaccagctaaaagaccaaccggtcaaaaatggcttttagatcttaaccagaaatcagaaaatccctggagagatctcttcctgtgggccgtgctgcagaataggcatgagatggcaacatacttttgggcaatgggccaggagggtgtggctgcggccctagctgcctgtaaaatcctgaaagagatgagccaccttgagaccgaggctgaggccgcccgagccacacgtgaggcaaagtacgaaaggctcgctctcgatctgttctctgaatgttactctaattcagaggcgagagccttcgcacttcttgttagacgaaaccggtgctggtcaaagactacatgcctgcacctagccactgaagccgacgccaaggcattttttgctcatgatggagtgcaagcctttcttacacgtatttggtggggggatatggcagccggcacgccaatcctgcgtttactgggcgcctttctctgccccgccctggtgtataccaacctgattaccttctccgaagaggcacccctgcgcacgggcttggaagatctgcaggacttagacagtttggataccgagaaatccccgctttatggtctccagtccagggtcgaggaactagttgaagcaccacgggctcaaggcgaccggggtcccagagctgtattcttgctcacgaggtggcggaaattttggggagccccagtgaccgtgttcctcggcaatgtcgttatgtatttcgcattcctgtttctgttcacatacgtccttctggtcgatttccggccgccaccacaagggcccagcggcccagaggtgacgctgtacttttgggtgttcacactggttctggaagagatcagacagggtttttttaccgatgaggacactcatctggttaaaaagttcaccctgtacgtgggagataactggaacaagtgtgatatggtggcgatattcctttttatagtgggagtcacgtgccggatgttacccagcgcgttcgaagccggaagaaccgttctggctatggacttcatggtgttcaccttacgacttattcacatctttgctatccataaacagcttggacccaagattatagtggtggagcggatgatgaaggacgtattcttctttctgttcttcttgtccgtctggctcgtggcctatggggtgactactcaggcattgttgcaccctcacgacggacgcctggaatggatcttcagacgggtgctgtaccgtccctatctgcagatttttggtcagataccgctcgatgagatagacgaagctcgtgtcaattgctccacccatccgctgttgctggaggatagtcccagctgtcctagcttgtatgccaactggctggtgattctcctcctagtgaccttcctgctcgtgactaatgtgctgctgatgaacctgctgatcgccatgttctcctatacatttcaggtagttcaggggaacgccgacatgttctggaaattccagagatacaatttaatcgtggaatatcacgaaagacccgcgctggccccgccttttatcttgctgagccacctgtcactaaccctgaggagagtctttaagaaggaggctgaacataaacgggagcacctggaacgcgacctacctgatccgctcgaccaaaaggtggtgacttgggagacagtgcaaaaggagaactttcttagcaagatggaaaagcgccgcagggacagtgaaggcgaggtgctgcgaaaaactgcccatcgggttgacttcatcgccaagtacctgggaggacttagagagcaggaaaagcggattaaatgcttggagtcacagataaattactgtagcgtgctcgtatcttctgtcgcagacgtattagcccaggggggggggccccggagcagccaacattgcggtgagggcagccagctagtcgctgcggatcacaggggaggattggacggatgggagcagcccggcgccgggcagccaccatcggatacctag

SEQ ID NO: 138430 - DNA, 2619 bp, Artificial Sequence
  Description of Artificial Sequence: Synthetic coding sequence
atgcaagacgttcaaggacctaggccaggctcccccggagacgctgaagaccgtagggaactcggcctgcatcggggcgaggtaaacttcgggggcagcggcaaaaagagagggaaatttgtgagggtgccaagcggcgtggccccttctgtgttgttcgatctgctgctcgccgagtggcacttgcccgctccaaacctcgtcgtatcacttgtgggtgaggaacagcctttcgccatgaaatcttggctgcgagacgtcctaagaaaaggcctagtgaaggccgcccaatctacgggcgcctggatcttgacatcagcattgcgggttggattagctaggcacgtgggccaggcggtgcgcgatcatagcctggccagcaccagcaccaaagttagagttgtcgctgtgggaatggccagtctgggcagggtgcttcatcggcggattttggaggaggcccaggaggactttccagtccattacccagaagatgatggaggctctcagggccccctctgctcccttgattccaacttgagtcattttatcttggtggagcccggccctccgggaaagggtgatgggctgacagagttgcggctgcggctggaaaagcacattagcgagcaacgggcaggctacggcgggactggcagcatcgagatccccgtcctgtgcctgcttgtaaatggggatccgaacacattggagaggataagccgggctgtggaacaggcagccccttggcttatcctcgtaggctccggagggattgctgacgtccttgcagctctggtgaaccagccccatctcttggtgcccaaggttgctgagaaacagttcaaggaaaaattcccttcgaaacatttctcatgggaggatattgtgcggtggaccaagttactgcaaaatatcacaagtcatcagcacttactcaccgtctacgacttcgaacaggaagggtcggaggagctcgatactgtgatcctgaaggcccttgtgaaagcctgtaagagtcactctcaggaaccccaagattacctggacgaactgaagctggccgttgcctgggatcgtgtcgacatcgccaaatcggaaatttttaatggagatgtggaatggaagtcttgcgacttggaggaagtaatggtggacgcactggtaagcaataagccagaatttgtgcggttgttcgtggacaacggagctgatgtagctgactttctgacatatggccggctgcaagagctctaccggtccgtatctagaaagagcctcctgtttgatctgctgcagcggaagcaggaagaggctcgtctgactcttgccggccttggcactcagcaggcccgggaaccaccagccggaccacctgctttttctctgcacgaggtctcccgtgttctgaaagattttcttcaggatgcctgccgcggattctaccaggacggaaggcccggagataggcgtcgtgcagaaaagggtcccgctaaacgaccaactgggcaaaaatggctgctggacttaaatcagaaatccgagaatccgtggcgtgacctgtttctgtgggccgtgttgcaaaacagacatgagatggccacatatttctgggctatgggccaagaaggcgtggcggctgccctggccgcctgcaagatcttgaaggaaatgtcccatctcgaaacagaggcagaggccgcccgtgctaccagagaggccaagtatgaacggctggcgcttgacctcttttccgagtgttactccaactcagaggcgagggctttcgctctcttggttcggagaaacagatgttggagcaaaacgacatgtctgcatctggcaactgaggcagacgctaaagccttcttcgctcacgacggagtacaagcttttctgaccagaatctggtggggcgacatggcagctggaactcctatcctcaggctgctgggagccttcctgtgccccgctctggtgtatacaaacctgatcacattctcggaggaagcacccctccgtaccggactcgaggatttgcaggatctcgactctctggataccgagaagtctccactgtacggcttgcagagcagagtggaagagcttgtggaggcccctagagcgcagggtgatcgagggccccgcgctgtcttcctattgacgagatggaggaagttttggggggcccccgtaaccgtattccttgggaatgtagtcatgtactttgctttcctgttcctgttcacatacgtgttgttggtcgacttcagaccaccaccacagggaccaagtgggcctgaagttactttgtatttttgggtctttaccctggtcttagaagagataaggcaaggttttttcacggatgaagacactcatctggttaagaaatttacgctgtacgtgggagacaattggaacaaatgtgacatggtcgctatttttctcttcattgtcggggtgacatgccgcatgttacccagcgctttcgaagcaggacggacagtcctcgcgatggattttatggtattcacacttcgattaatacacatcttcgctattcataagcagctggggcctaagattatcgtagtggaacgcatgaagcctgtgtag

SEQ ID NO: 138431 - DNA, 3504 bp, Artificial Sequence
  Description of Artificial Sequence: Synthetic coding sequence
atgcaggacgtgcagggaccacggcctggtagtcccggagacgctgaggaccggagagagctggggctccaccgcggtgaggtgaatttcggcggctctggaaagaagagagggaaatttgtccgcgttccctccggggtggcgccatctgtccttttcgatctcctgctggcagagtggcacctgcctgcacctaacctcgtggtgagcctggttggcgaagagcagcctttcgctatgaagtcttggctgagggacgtcctccggaagggcctggttaaagcagcccagagtacgggtgcatggattctgacgtctgccctgagggtaggcctagccaggcacgttggccaggcagtgcgggatcattcgttagcttccacttctacgaaagttagagttgttgccgtgggcatggcctccttaggcagggtcctgcacagacggattctcgaagaagctcaggtgcatgaggacttcccagtgcactaccccgaggatgacggcggatctcagggccctctctgctcactcgactcaaacttgagccattttatcctcgtggaaccgggaccgcctggcaagggcgatggtctgacggaactcagactgagactcgaaaaacacattagcgaacagagagccggctacggtgggaccggaagtatagaaatccccgtactctgcctcctggtgaatggagatcccaatacactggagcggattagtagggcggtcgaacaggcggctccatggctgatcctcgtaggaagcggtggaatcgctgatgtcttagctgcactcgtgaatcagccacatcttctggtcccaaaggtggccgagaagcagttcaaagaaaagttcccctcaaagcacttcagctgggaggatatagtgcgctggacaaaactccttcaaaatatcacaagccatcagcacctgctgaccgtctacgacttcgagcaggagggatcagaagagctggatacggttatcttgaaagctctggttaaggcttgtaagtctcactctcaagagcctcaggactacttagacgaactgaagctagccgtggcctgggaccgtgtcgatatagcaaagagcgagatcttcaacggagacgtggaatggaaatcttgcgacttagaggaggtgatggtggatgccctggtcagtaataaacccgaattcgtgcgcttgttcgtggacaacggggcagacgtggccgatttccttacctacgggcggttgcaggagttatataggtcagtctctcgcaaatcactcctgtttgatctgctgcagagaaaacaggaagaggcccggctcaccctggctggacttggcacccagcaggctagggaaccacccgccggcccacccgcattttcattacacgaggtgagtagggtgctgaaagatttcctccaggacgcatgcaggggcttctaccaagacggcaggccaggtgaccgaagaagggccgaaaaaggcccagccaagcgtcccactggccaaaagtggctgctcgatctcaaccaaaaaagtgagaatccttggagggacctgttcctgtgggcggtgctccaaaaccgccatgaaatggccacttacttttgggctatgggccaggagggggtggccgcggctctggccgcgtgtaaaatcctaaaggagatgagccacctggagactgaggcagaagcagccagagcaacccgagaagctaagtatgagaggttggcactcgatctttttagcgagtgttactcaaactcagaggctcgggcattcgccttattagtcaggcggaacagatgttggagcaagacaacttgcctgcaccttgccactgaagccgatgctaaagctttttttgcacacgacggggtgcaggcgtttttgacccgtatctggtggggggacatggcagctggtactccaatcctccgactccttggcgcttttctttgcccagcccttgtgtacacaaatctgatcaccttctcagaagaggctcctctgaggacagggctggaagacctgcaagatctggactccctggataccgagaagtcccctctgtacgggttgcaatcccgggtggaggaactggtggaagcgccccgcgctcagggggaccggggcccgagggccgttttcttactgaccaggtggcggaagttctggggagcgcctgtcacggtgtttcttggcaacgtcgtgatgtattttgcgtttctgttcttgttcacctacgtactgttggtggatttccgtccccccccacagggcccctctggccccgaggtcacattgtacttttgggtgtttaccctagtattagaggaaatccggcaaggatttttcacagacgaagacacacacctggtgaaaaagttcactctgtacgtgggtgacaactggaacaaatgcgacatggttgccatattcttgttcattgtcggtgtcacctgccgcatgctgcccagtgcctttgaagccggcagaaccgtactggctatggattttatggtgttcactctgaggttgatccacatctttgcaatacacaagcagttggggccgaaaatcattgttgtggaacgcatgatgaaggatgtattcttcttcctgttcttcctcagcgtgtggctcgtggcctatggggttacaacccaggcactcctccacccacatgacgggcggcttgagtggatcttcaggagagtcctctatcggccctatctccaaatctttggacaaattcctctggatgagattgacgaggctagggtgaactgctcaactcaccccttgctactagaggactcgccctcgtgtccttctctctacgcaaactggcttgtgattctactgttggtcacgtttctcctggtgacgaacgtactcctgatgaatctgttgattgcaatgttctcctacacatttcaggttgtgcagggtaacgccgatatgttttggaagttccagcgttacaacctcattgtggagtatcatgagcggcccgccttggcgcctccttttatactcctgtcccacctcagcctcacccttcgacgagtgtttaaaaaagaagcagagcacaagagggagcatctggagcgagacctcccagacccgttggatcagaaggttgtaacatgggagactgttcagaaggagaacttcctcagcaagatggaaaagagaaggcgggatagtgaaggtgaagtactcagaaagaccgcccaccgagttgacttcatagccaaatatctcggcggtctccgggagcaggagaagcgaatcaaatgtctcgagagccagattaattactgttctgtattggtaagctccgtcgccgacgtcttggcccaaggaggaggtcccagaagctcacagcattgtggagagggaagtcagcttgtagctgctgaccaccgaggtggtctggatggatgggagcagcccggggcaggtcaaccaccgtcggatacatag

SEQ ID NO: 138432 - DNA, 3480 bp, Artificial Sequence
  Description of Artificial Sequence: Synthetic coding sequence
cctgggtcccccggcgatgctgaggatcgccgcgagttaggcctgcaccgcggggaggtgaactttgggggctctgggaagaaaaggggaaaatttgtgcgggtgccatccggcgtcgcgccaagtgtgctgttcgaccttctactcgcagagtggcacttacctgcccctaacctggtggtctctctggtgggggaagagcagccttttgcgatgaaaagttggctcagagacgttcttcgaaaggggctggttaaggcggcccaaagcaccggtgcatggatcctgacatcggctctgagagttggtctggctcggcatgtcggccaggccgtcagagatcactcactggcatcaacatctaccaaggttagggtcgtggcggtgggcatggcgtctctgggccgagtcctccaccgccggatactggaagaagctcaggtgcatgaggacttcccagtgcattaccccgaagacgacggggggagccaagggcctttatgttctttggattcaaacctgtcccattttattttagtagagcccgggccaccaggcaagggcgacggcttgaccgagttgcggttgcggcttgagaagcatatctcggagcagagagccggctatggaggaacagggtcaatcgagatacccgtgctttgtctgctggttaacggggaccctaataccttagagcgcattagcagagccgtggaacaagccgcaccgtggctcatcctcgtgggatccggcggtatagccgacgtgttggccgcgctggtcaatcagcctcacttgcttgtccctaaagtggccgagaaacagttcaaggagaagtttcctagtaagcatttctcttgggaggatatagtgcggtggaccaaacttctccaaaacatcacatctcaccagcacctgcttacagtgtatgactttgagcaggagggatccgaagaactggatacggttatactgaaggcgctggtgaaggcttgcaagtcccattctcaggagccccaggactacttagatgagctgaaactggccgtggcgtgggatagagtggacatcgcaaaaagcgagatttttaacggagacgtggagtggaaatcttgcgacctcgaggaggtgatggtagacgctctcgtgtccaacaagcccgaatttgttaggctattcgtggataatggtgccgacgtagcagatttcctgacctatggccggctccaggagctttacagaagtgtgtctcgaaagtctctcctctttgacttgctccagagaaagcaggaggaggcgcggttgactttggcagggttgggaactcagcaagctcgagagcctcccgccggccctcctgctttctctctgcatgaggtaagcagagttctgaaggacttcctgcaagacgcctgcaggggattttatcaagatggccggccaggggataggcggcgggccgagaagggcccggctaagaggcccacaggacagaaatggctgctggacctaaatcaaaagtccgagaatccctggcgcgatttattcctctgggctgttctacagaatagacatgagatggctacctacttctgggccatgggccaggaaggggtggcggctgcgctcgccgcctgcaagattctcaaggagatgtcccatctcgagactgaagccgaggccgcaagggccacgcgtgaggccaagtatgagcgtctggcactggacctgttctctgaatgctattcgaatagtgaggccagggcctttgcgcttttggtacgacgtaatcgatgctggagcaaaaccacttgcctgcatcttgctacagaggccgatgccaaggcattttttgctcacgacggggtgcaggcctttctgacacgtatctggtggggggacatggccgcagggacccccatcttgagactcctgggagcgttcctctgcccagccttagtgtacactaacctgatcacctttagcgaggaggcacccctcaggactggcctcgaggatctgcaggatctcgatagcctggatacagaaaaatctcccttatacggactccagtctagggtggaagaactggtcgaagcccctcgagcccaaggggacagagggccaagagccgtgttcttgctgaccagatggcggaagttttggggggctccagtcacggtttttctgggtaacgtagtcatgtacttcgcttttctcttcttattcacttatgtgctcttagtggatttccggcccccgccacagggaccaagtggaccagaggtgaccctgtacttctgggttttcaccctggtgctggaagaaatcagacagggctttttcaccgatgaggacacgcacctggtgaagaaatttactctctatgttggagacaattggaataagtgcgatatggtggcaatcttcctatttatagtcggagtcacctgcaggatgctccctagtgccttcgaagctggccgtacggtcctggccatggatttcatggtttttactctgagactgatccatatctttgctattcataaacaactggggccaaagatcatcgtggtggagcggatgatgaaggacgtattcttctttctttttttcctgagcgtgtggctagtcgcgtatggggtgaccacccaggcccttctgcatcctcacgacggaagactggagtggatattccggcgagtgctgtacaggccatacctgcagatctttgggcagataccattagatgagattgacgaagcacgtgtcaactgcagcacccatccgctgctgctcgaagactctcctagttgcccatcactctacgctaactggttggtgatcctgctgttagtaacctttctgcttgtgactaatgtcttattaatgaacctgttaatagcaatgttctcatatacatttcaggtggtccaggggaacgccgacatgttctggaaatttcaacgatacaatctgatcgtggagtaccatgaaaggcccgccctcgcccctccgtttatcctgctttcacacctgtctctgactctcaggcgagtgtttaaaaaagaggcggaacataagagggaacacctggagcgggatctgcctgaccctctagatcagaaggtcgtgacctgggagaccgtccagaaggaaaactttttgagcaagatggaaaagcgccgccgcgattccgagggcgaagtcctgcgaaaaacagcacaccgcgtcgattttatcgctaaatacctcggtggcctgcgggagcaggagaagcgtatcaaatgcctcgagtcccagattaactactgctccgtactcgtatctagcgttgctgatgtactggcccagggaggcgggcccaggtcctctcagcactgcggagaggggtcccagctcgtggccgcggaccaccgaggagggcttgacggatgggaacagcccggagccggtcagcctccatcagatacatag

SEQ ID NO: 138433 - DNA, 3402 bp, Artificial Sequence
  Description of Artificial Sequence: Synthetic coding sequence
atgctccgtccacaggtcaaggaggagatcatctgcatgattcaaaacaccttcaacttctctctgaaacagagcaaacatttgtttcagatcctgatggaatgtatggtccatcgggattgcattacaatatttgacgcagattccgaagaacagcaggatctggatctggctattctgacagccctgttaaaaggcacaaacctctctgctagcgagcaactcaatcttgccatggcatgggaccgtgtggatattgccaagaagcatattttaatttacgagcaacattggaagcctgacgccttggagcaggctatgagtgacgccctggtgatggaccgagtggatttcgtaaagctgctgatcgagtacggcgtaaacctccatcggttcctgactatacctcggctggaagaactctataatactaagcagggccccactaatacactcctgcatcacctcgtacaggatgtcaaacagcacacacttcttagcgggtaccgaatcacactgatcgatattggactggtggtggagtatttgatcggtcgcgcttacaggagcaattatactcgaaagcactttagagcactgtacaataatctgtataggaagtacaaacaccaaaggcactcaagcggcaacaggaacgagagcgccgagagtacgttgcactcacagttcattaggactgctcagccgtataaattcaaagaaaaatctatcgttttgcataagagcaggaaaaagtccaaagaacagaacgtctcggatgatccagaaagcacaggattcctttatccttataatgacctgctggtgtgggccgtgctcatgaagcggcaaaagatggctatgtttttttggcagcacggcgaggaagcaactgtgaaagcagtgatcgcctgtatactgtatagagctatggcacacgaagccaaggagagtcacatggttgatgacgcttctgaggagttgaaaaattactctaagcagtttggccagctggccctagacttgctggagaaggctttcaagcagaatgaacgaatggcaatgactctattaacttacgagcttaggaactggagcaattcaacatgcctgaaattggccgtgtccggtggcctcaggccatttgtgagtcacacctgcacccagatgctgttgaccgacatgtggatgggcagattgaaaatgcgcaaaaattcttggctcaagattatcatcagcatcatcctgcctccaaccatccttactctcgaattcaagagcaaggcagaaatgtcccacgttccccaaagccaggacttccaatttatgtggtattattccgatcagaatgcctctagctcgaaggagtccgcttccgtgaaagaatatgacctggagcgggggcacgacgaaaagctggacgagaatcaacattttggcctcgaatcaggccaccagcaccttccatggacccgcaaagtgtacgagttctacagcgcacctatcgttaaattttggttctataccatggcatatctggcattcttaatgttgttcacctatacagtgctggtagagatgcagccacaaccatccgtgcaggaatggctagtgtccatttacatatttacaaatgcgatcgaggtcgtccgggagatttgcatatctgagcccgggaaatttacacagaaggtaaaagtgtggatatccgaatactggaatttgactgagactgtcgccatcggtctgtttagcgcaggatttgtgctgaggtggggggatccgccctttcacacagcaggacgcctgatttactgtattgacatcatcttttggttttcgcgactgctagatttcttcgccgtgaatcagcacgcggggccctacgtaacgatgatcgccaagatgactgccaatatgttctatatcgtgatcataatggcgatcgttctcttgtcattcggggttgctaggaaggccatcctatccccaaaggaaccaccttcctggagtctggcccgtgacatcgtgtttgaaccctactggatgatatatggcgaagtctatgcaggagagattgacgtctgctcctcacaaccttcctgccctccaggatccttccttactccatttctccaggcggtgtacctatttgtccagtacataattatggtaaatttgctgatcgctttctttaacaacgtgtacctggatatggagtccatctccaacaatttatggaagtacaatagataccgctacattatgacataccacgagaaaccatggttgcccccccctctcattcttctttcacacgtaggcctgctactccgaagactatgctgtcatagagccccacacgatcaggaagagggggatgtcggcttgaaactgtatctgagtaaggaagatctcaagaaattacatgacttcgaagaacaatgcgtagagaaatactttcacgaaaaaatggaagacgtgaattgtagttgtgaggagcggatcagggtgactagcgagcgggttacagaaatgtactttcagctcaaggaaatgaatgaaaaggtatccttcattaaggactctttattgagcctggactcacaggttgggcatctgcaggacctttcggccctaacagttgacaccctcaaggtcctgtcagccgtggataccctgcaagaggatgaagctctgctggctaaacgtaagcattcaacctgtaagaagttgccacatagctggtctaacgtgatctgcgctgaagtcctgggtagcatggaaatcgcaggcgaaaagaagtaccagtattactcgatgccgtcatccttgctgcgctcactggctgggggacgtcatccgccaagagtgcaaagaggtgcactgctggagattaccaacagcaagcgcgaagcaacaaacgtccgcaacgaccaggagcgtcaggaaactcagagctccatcgtcgtgagtggcgtatcccccaaccgtcaggcccactccaagtatggccagttcctcctcgtccccagtaatctcaaaagagttccgttttccgccgagactgttttgccactctccaggccatccgttcctgatgtcctggctacagagcaggatatccaaaccgaagttctggtgcatctgactgggcagacacccgtcgtcagtgactgggcgagtgtcgatgaaccaaaggagaaacacgagccgattgcccacctcctcgacggccaggataaagccgaacaggtgcttcccaccctgtcctgcactccagagcctatgaccatgtcttctccactgcgccgctacaggcctttcgcccgctctcacagttttagattccacaaggaggagaaactcatgaaaatctgcaagattaagagtaaagagtag

SEQ ID NO: 138434 - DNA, 912 bp, Artificial Sequence
  Description of Artificial Sequence: Synthetic coding sequence
atgaaagaacagccagttttggagagactgcagtctcagaagagttggattaaaggtgtgttcgacaaaagggagtgttctactattattccctcgtctaaaaatcctcatagatgtacaccagtatgccaggtctgccagaacctcattcgttgctactgcggccggctaattggcgaccacgccggcatagactacagttggacaatcagcgccgccaagggtaaagagagcgaacagtggtccgttgagaaacacacgaccaaaagtcccaccgatacattcgggacaattaatttccaggatggagaacacacccatcacgctaaatacatccgaacgagctatgacactaaactcgaccatctgttacatctgatgcttaaagagtggaagatggaacttccgaaactggtgatttcagtccacggaggcattcagaattttactatgcccagcaagttcaaagaaattttttctcagggacttgtgaaggcggccgagacaacgggcgcctggattatcaccgaaggcatcaatactggggtttctaaacacgtcggagacgcactgaagagccacagctcccactccctgaggaagatctggacagtagggatcccaccttggggcgtgatcgagaaccaaagggatcttatcggtaaagatgtggtatgcctctaccagacactggacaatcctctctcgaaactgaccactttgaattccatgcacagtcatttcattctgtctgatgacggcaccgtggggaaatatggcaatgagatgaagctccggagaaatctcgagaaatatttgagcctgcagaaaatacactgccgggaataccaccgaggctcagtcactcaaagcggttgtcggccagcagaggtctttcacgggttgccctag

SEQ ID NO: 138435 - DNA, 6069 bp, Artificial Sequence
  Description of Artificial Sequence: Synthetic coding sequence
atgaaggaacagccagtgctggaacgattgcagagccagaagagttggattaaaggcgttttcgataaaagggagtgctccacaatcatcccttccagcaaaaacccccacaggtgcactccagtgtgccaggtttgccagaatttgattcgctgctattgcggtaggctgattggcgaccacgccggcatcgattattcttggacaatttccgcggctaaaggtaaggagagtgagcagtggagcgttgaaaagcacactacgaaatcacctaccgatacttttggaaccattaactttcaggatggggaacatacccaccacgcgaagtatatccgaacgtcttatgacacaaagttagatcacctactgcacctcatgcttaaagagtggaagatggaattacctaagcttgtgatcagcgtgcacgggggcatccagaattttaccatgccctccaagttcaaagagatcttttcccagggactggtgaaagctgcagaaaccaccggcgcctggattataaccgagggcattaacacaggcgtttccaaacacgttggagacgccctgaaatcccactcaagtcattccctacgcaagatttggaccgtaggaatccctccctggggtgttatcgagaatcagagggacctcataggcaaggacgtagtgtgtctgtatcagaccctggataacccactctctaaactgactacactgaactctatgcatagccatttcattttgtcagacgacggcaccgtcggcaagtacgggaacgagatgaaacttcgcaggaatctcgaaaagtacctaagtttgcagaaaattcactgccggtctcgccagggcgttcccgtcgttgggctagtggtagagggcgggccaaacgtcattctgtcagtctgggagacggtaaaagacaaggatcccgttgtggtgtgcgaggggacaggacgggctgcagatcttctggcattcactcataaacaccttgcggacgaggggatgcttaggcctcaggtgaaggaagagataatttgtatgattcagaatacattcaacttttcccttaagcagtccaagcatctcttccagatccttatggaatgcatggtccatagagattgcattacgatctttgatgcggacagcgaagaacagcaggatcttgatcttgccattctgactgctttactcaagggtaccaacctgtccgccagcgagcagttaaacctggcaatggcgtgggatagggtagacatcgcgaagaagcacattttgatctacgagcagcattggaaacctgatgccttagagcaggcgatgagtgacgctcttgtgatggatcgggttgatttcgtgaagctgctgattgagtatggtgtgaacctacaccggtttctgacaattcccagactggaggagctgtataatacaaaacagggtcctaccaacaccctgttgcatcatctggtgcaggacgtgaagcaacataccctcctgtcaggctacaggatcaccctgatcgacatagggctggttgtggaatacctgataggacgcgcgtatcgcagcaattataccaggaagcactttcgggcactgtacaataacttgtatcgaaaatataaacatcagaggcatagcagcggtaatcgaaacgaaagtgccgaaagcaccctgcatagccagtttatccgtactgcccaaccatacaagttcaaagagaagtctattgtccttcataagtctaggaaaaaatctaaagaacagaacgttagcgatgacccggagtccaccggattcctctatccctacaatgatctgctggtgtgggcggtcttgatgaaaagacagaagatggccatgttcttctggcagcacggcgaagaagctactgtcaaagctgtgattgcttgtattttatacagggcaatggcccacgaagctaaagagtctcacatggttgacgacgcctcagaggaactcaagaattactctaagcagttcggccaattggccctggatctgttggagaaggcgttcaaacagaatgagagaatggcaatgactttactcacttacgagttgaggaattggagcaattcaacctgcctcaaactggctgtgtctggtggcttgaggccattcgtgtcacatacctgcacacagatgctgctgactgatatgtggatgggtagactcaagatgcgcaagaactcttggctgaagatcataatcagcatcattctacctcccacgatcctgaccctcgaattcaaaagcaaggcagaaatgagtcacgtcccccagtctcaggacttccaatttatgtggtattacagtgatcagaatgcaagctcaagcaaggagtctgcgtctgtcaaggaatatgacctggaacgcggtcatgacgagaagttggatgaaaaccagcactttgggttggaatccggacatcagcacctgccctggacacggaaagtgtacgagttctactccgctcccatagtcaagttctggttctataccatggcctacctggcattcctcatgctgttcacatacaccgttctggtggaaatgcaaccacagccatccgtccaggagtggttggtctctatctatatcttcactaacgcgatcgaggtcgtgagagaaatctgcatcagtgaacctggcaaatttacgcagaaggtgaaggtgtggataagcgaatactggaatttaaccgagaccgtggctatcggcttgttttccgctggctttgtgctgaggtggggggatccaccttttcatactgctggccgattaatttattgcatcgatatcatcttctggttttccaggctcctggacttcttcgctgtcaatcagcatgctggcccatacgtaactatgatcgctaagatgaccgctaacatgttctacatcgtgatcattatggcaatcgtgctgctcagtttcggagtcgcccgcaaggctattctgagcccaaaggaacctccctcatggagcctcgcgcgggatattgtgtttgagccctattggatgatttacggagaggtctacgcgggcgagatcgacgtctgctcctctcagcccagctgcccgccaggatctttcctgactccttttctgcaggccgtctatctctttgtgcagtatattatcatggtaaatctcttgatcgcctttttcaacaatgtctacttggatatggagagcattagcaacaatctttggaaatacaacagatataggtatataatgacatatcacgagaagccttggctgcccccacctctcattctcctctcccatgtgggattactcttaaggagattgtgttgtcaccgtgctccccatgatcaggaagaaggcgacgttggcttaaagctgtatctttccaaggaagacctgaagaaacttcatgacttcgaagagcaatgcgtcgagaagtacttccacgaaaagatggaggatgtgaattgtagttgtgaggagaggattcgggtgacctcagaacgagtgacggaaatgtacttccagttaaaggagatgaatgaaaaagtgagcttcattaaagattctcttctctccctcgatagtcaagtggggcaccttcaggacctcagcgctctcaccgtcgataccctgaaagttctgtcagccgtagatactttgcaggaagatgaggccctattggcaaagaggaaacactccacctgcaagaagctcccccattcctggtctaacgtaatctgcgctgaggtacttggctcgatggagatcgccggggaaaagaaataccaatactattccatgccctctagtttactgaggtccctggctggaggacggcaccctccacgtgtgcaacgcggcgctctgctggaaattacaaactccaaacgagaggcaaccaacgtgcggaacgatcaagaacgccaagagacacagagctcaatagttgtctctggagtgtctcccaacagacaggcacactccaagtatggacagtttttgctcgttccctccaatctgaagcgagttccatttagcgcagaaacagtgctcccactgtcacggccttctgtgcccgatgtgttagccacagaacaggatattcagaccgaagtcctggtgcacctgacggggcaaacgccggttgtttccgactgggcctctgtggatgaaccaaaagaaaaacacgagcctattgctcatcttctggacggacaggataaagcggagcaggtcctgccaactctctcttgcaccccagaaccgatgactatgtctagcccactctcacaggctaagatcatgcagacaggcggagggtacgtgaattgggccttctccgagggtgatgaaacaggggtgttctccatcaagaagaagtggcagacatgtttgcctagcacatgtgatagcgactcttctcgcagcgagcagcaccagaaacaggcccaggattcgtcactgagtgataactcgaccagatcagcccagtcctctgaatgcagcgaggtgggtccatggctacagcctaatacaagtttctggattaatcccctgaggcgatatcggcctttcgctcggagccacagtttccggttccacaaagaggaaaagcttatgaaaatttgcaagataaagaacctgtctggttcgagcgagataggtcaaggcgcctgggtaaaggctaaaatgctcaccaaggataggaggctgtcaaaaaagaaaaagaatacccaggggctgcaggtacctataatcactgttaacgcgtgttcacagagcgaccagctgaatccagagccaggggagaatagtatttccgaggaggaatatagtaaaaactggttcactgtaagtaaattctcacacaccggcgtggaaccgtacatccaccagaagatgaaaactaaggagataggacaatgcgccattcagattagtgactacctgaaacagtcccaggaggacctgagtaaaaactccctgtggaacagccggtctactaatcttaaccgaaacagtctgcttaagagtagtataggcgtggacaagatttctgcatcactgaaaagcccccaggagccccaccaccattatagtgccatagagaggaacaacctgatgcggctatcgcagactattcccttcacccccgtccagctattcgccggcgaggaaatcactgtctaccgcctggaggaatcctcaccactgaacctggataagtccatgtcctcatggtcgcagaggggccgagctgcgatgatacaggtgctgtcaagggaagaaatggacggcggcctccgtaaagctatgcgcgtagtgtccacatggagcgaagatgatatcttaaagccagggcaggtgttcatagtcaagagctttctgcctgaagtcgttcgcacttggcacaagattttccaagagagtacggtgctgcacctgtgcctgcgggaaatacagcagcagcgggcggcacaaaaactcatttatacattcaaccaagtaaaaccacagacaattccctacactcctaggtttctggaggtatttttgatctattgtcattcagccaatcagtggcttaccatcgaaaaatatatgacgggggaattcagaaagtataataacaataatggggatgaaataacgcccaccaacacactcgaggagctcatgttggccttttcacactggacttatgaatacactcgaggggagttacttgtgttggacctgcagggcgtcggcgagaacctgactgacccgagcgtgatcaagccagaggtgaagcaatctaggggaatggtcttcggccctgccaatctcggagaagacgcaatccgaaattttatcgccaaacatcactgtaattcctgttgtcggaaattgaaactgccagacctgaaacgtaacgactattcacctgagagaattaacagtacatttggcttggaaataaaaattgagtccgctgaggaacctccagcccgggagaccggaaggaactcgcccgaggacgacatgcagttatag

SEQ ID NO: 138436 - DNA, 6054 bp, Artificial Sequence
  Description of Artificial Sequence: Synthetic coding sequence
atgacggctccagtgacaagccagaaatcttggatcaagggtgtcttcgataagcgcgagtgttccaccattatcccctcatctaagaaccctcatagatgcactccagtgtgccaagtgtgtcagaatctcatacgttgttattgcggtcgcctcatcggcgatcacgccggcattgattattcctggaccattagcgccgctaagggaaaggagtccgagcagtggtcagttgaaaagcacacgaccaaatccccaactgacaccttcgggactatcaactttcaagacggagaacacacccaccacgcaaaatatatcagaaccagctacgacactaagctggatcaccttctgcatctgatgctgaaggagtggaaaatggagctgcccaaactcgttatcagtgttcacggtggaatccaaaactttacaatgccctccaagtttaaagaaatctttagccaaggtctagtgaaagccgccgaaacaacaggtgcatggataattactgagggaataaacactggggtgagcaagcacgttggagacgcgctgaagtctcactcttcacacagccttaggaagatttggacagtcggaatcccaccctggggtgtaatcgagaatcagcgggacttgatagggaaggatgttgtttgtctctaccagacgcttgacaatcctctttctaaactgacaacactcaacagtatgcattctcacttcattctcagcgacgacgggacagtgggcaagtatggcaatgaaatgaagctgaggcgcaatctggagaaatatctcagcctgcaaaagatccattgccggtctaggcagggcgtaccagtggtgggcctcgttgtggagggaggccccaatgtgatcctaagcgtgtgggaaaccgtgaaggacaaggatccagtcgtcgtctgcgaggggacgggcagagccgcagacctcctcgcattcacacataaacatctagccgacgaggggatgctgcggcctcaagtcaaagaggaaatcatttgcatgatacagaacaccttcaattttagccttaagcagagcaagcatctgttccagatcctgatggaatgtatggtgcatcgcgattgcataacaatcttcgacgccgacagcgaggagcagcaagacctggaccttgccatcttaacagccttgctgaaaggtacaaacctttccgccagcgagcagctcaatctcgccatggcctgggaccgggtagatatcgcaaaaaaacatatcttgatctatgaacagcattggaagccagacgcgttggagcaggctatgagtgacgccctggttatggaccgagtcgactttgtgaaactgttgatcgaatacggagtgaacctgcaccggttcttaacaattcccagattagaagagctatacaatactaagcagggacctaccaacaccttgctgcaccacctcgtgcaagacgtcaagcaacacaccctgctcagcggatatagaattactctcatcgacattggcctggtcgtggagtatctgattggccgcgcctatcgaagcaattacactcgcaagcacttccgcgccctgtacaataatctgtaccgcaagtacaagcatcagcggcacagctctggcaatcgaaatgagtcagctgagagcaccctacactcacagttcattcgaaccgcccagccttacaagtttaaggaaaagagtatcgtcctccataagagccgcaagaaatctaaggaacagaacgtctccgacgatccggagtctaccgggtttctgtatccatacaatgacctgctggtctgggccgtgcttatgaagaggcagaaaatggccatgtttttctggcagcacggcgaagaggctaccgtgaaggctgtcatcgcttgtatcctctaccgcgcaatggcccacgaggcaaaggagagccatatggtggatgatgcatcagaagaattgaaaaattattctaaacagttcgggcagctcgccctcgacctgctcgaaaaagcctttaagcagaacgagaggatggctatgacactgctgacctatgagctcagaaattggtccaacagcacttgcctgaagctggctgtttccggtggcctgcgaccattcgtctcccatacctgtacacagatgctcctaaccgatatgtggatgggccggctcaaaatgagaaaaaactcttggctgaaaattatcatcagtattatcttgccaccaacgattctaactctagagttcaagtctaaggcagagatgtctcatgtcccgcagtcccaagactttcagtttatgtggtattatagcgatcaaaacgccagtagctcaaaggaaagtgcctccgtgaaggaatacgatctggagcgcggccatgacgagaagttagatgagaaccagcacttcgggttggagtccggccatcagcacctcccttggacaaggaaggtttatgaattttactcagcccctatcgtgaagttctggttttacacaatggcttacctggcctttctgatgctattcacatatacagtgctggtcgagatgcagccacagccatctgttcaggagtggctggtgtctatatatatcttcacaaacgctattgaggtcgtgcgcgagatctgcatcagcgagcccggcaagtttacacaaaaggtgaaggtttggattagtgaatattggaacctcactgaaactgtggctataggtttattcagcgctgggttcgttctccggtggggcgaccctcccttccacacggcggggagactgatctattgtatagacataattttttggttctctcgcctgctggattttttcgcggtcaatcagcatgcagggccatatgtgactatgatcgcgaaaatgactgctaatatgttctacattgtgattatcatggcgatcgtgctgctttcattcggggtggctagaaaggcaattttatcccccaaagaacccccctcttggagtcttgcccgagacatcgtgttcgaaccgtactggatgatttacggagaggtgtatgccggcgagatcgatgtgtgttccagccagcccagttgtccaccagggagcttcctgacaccgtttctgcaggccgtgtatctgtttgtccagtatatcatcatggttaacctgctgatagccttcttcaacaacgtgtatttggatatggaatcaatctcaaacaacctttggaaatataacagataccggtacataatgacctaccacgaaaagccttggttaccgcctcctttaattctattaagtcatgtcggtctgttgttaaggagactgtgctgtcaccgggcgccccacgaccaagaagaaggggatgttggcctaaagctgtatttatccaaagaggaccttaagaagttgcatgatttcgaagagcagtgcgtggagaaatattttcacgagaagatggaagatgtgaattgttcatgtgaagaacggatccgggttacaagcgagcgggtgaccgagatgtatttccaattgaaggaaatgaacgaaaaggtgtccttcataaaggactctcttctgtctttggacagccaggtgggccatctccaggacctctctgctctgactgtcgacacattaaaggtcttaagtgccgtggatacattgcaggaagatgaagctctccttgctaaacgaaagcatagcacatgtaagaaactcccacatagttggtcaaacgttatctgcgccgaggtgctagggagcatggaaatcgctggtgaaaagaagtatcagtactatagcatgccgagctccttactcaggagccttgctggcggccggcacccacctagggtccagcgtggcgctctgctggagattaccaattctaagcgcgaggctacaaatgtgaggaacgatcaggagcgacaggagacccagagttctatcgtagtatctggtgtgtctcccaacaggcaggctcatagcaaatacggccagtttctactcgtcccctcaaacttaaaaagagtcccattttctgcagagactgtgctgccactgtcgcggcccagtgtgccggatgtcctggccaccgagcaggatatccagacggaggttcttgtacatctgaccggacagacccctgtcgtgagcgactgggctagcgtggacgagccgaaggagaaacacgagcccatcgcgcatttgctagatggtcaggataaagctgagcaggtgctgcccaccttaagctgcactccagagcccatgacaatgtcctcacccctgtcacaagcaaagattatgcaaaccggggggggatatgtgaactgggcctttagcgagggagatgaaacaggcgtttttagcatcaagaaaaaatggcagacttgcttaccaagcacctgtgactcagattcttcccgctcagaacagcatcagaagcaggcccaggacagcagcttaagcgataactcgacccgctccgcgcagtcatctgaatgctctgaagtgggaccctggcttcaacccaatacctctttctggattaatcctctgagacggtaccgcccatttgcgaggtctcactctttcagatttcataaggaagagaagttaatgaaaatctgtaaaatcaagaacctgagcggatcttcagaaattggtcagggagcttgggtgaaagctaagatgcttactaaggatagacgcctgagcaaaaagaagaaaaatacacagggactgcaggtacccatcattacggtaaacgcctgtagtcagagcgaccagttaaacccagagcccggagagaattcaataagtgaagaagagtactctaaaaactggttcacggtgtccaagttctcgcacacaggcgttgagccctacattcaccagaagatgaaaacaaaggaaattgggcaatgcgccatccagatctctgattatctgaaacaatcacaggaagacctttcaaagaacagcctgtggaatagtcggtcaacaaacctgaaccgcaatagcctgctgaaatccagtatcggtgtggacaagatcagcgcatcccttaaatcccctcaagagccgcaccaccattacagcgccatcgagcgtaacaatctgatgaggctgtcacagacaatcccgtttacccccgtccagttattcgccggcgaagaaattaccgtgtatcgtctggaggaaagcagtcccctcaatttagataaatctatgtccagttggtcccagcgaggaagggccgccatgattcaggttctgtctagagaggagatggacgggggcctgcggaaggctatgcgagtggtgtctacttggtcggaggacgatatcctaaagcccgggcaagtgttcatagtgaagtcctttttgccagaagttgtgagaacatggcacaaaattttccaggagtcaaccgtgttgcatctgtgtttaagggagatccagcaacaacgagcagcacaaaaactgatctacacttttaaccaggtgaagcctcagactatcccgtacaccccaaggtttctagaagtgttcttgatctactgccactctgcaaaccagtggctgacgatcgagaaatacatgaccggtgagttccgaaagtacaataataacaatggcgatgagattaccccgactaacacgctggaagagcttatgctggccttctcacattggacttatgagtatacccgcggggaactcctggtgctggatctacaaggtgtgggagaaaacctgaccgatcctagcgttatcaaacccgaagtgaaacagagcaggggtatggtttttggaccggctaatctaggagaggacgctatcaggaactttatagcgaagcaccattgcaattcttgttgtcgcaagctcaagttaccagatctgaaacggaacgactacagcccggaacggatcaattccaccttcggcttggaaataaaaatcgaaagtgcggaggaacccccggcccgggagaccgggcgcaatagccctgaggatgacatgcaactgtag

SEQ ID NO: 138437 - DNA, 5844 bp, Artificial Sequence
  Description of Artificial Sequence: Synthetic coding sequence
atgaaggagcaacctgtgctggagcgtctgcagagtcagaagagctggatcaaaggagtcttcgataagcgcgagtgcagcactatcatcccgagtagcaagaacccacataggtgtaccccggtgtgccaggtgtgtcagaacctgataaggtgttattgtggtagactcattggtgaccatgccgggatagactatagctggactatctcagccgctaaaggcaaggagtccgagcaatggtctgtggagaaacacacaactaagtcacctacagatacatttggaaccattaattttcaagacggggagcacacgcaccatgctaaatatattagaacctcatacgatactaagctggatcatctcctccacttgatgctgaaggagtggaaaatggaactgcccaagttagtaatctccgtccacggcggcatacagaactttactatgccttctaaattcaaagagattttcagccagggtctagtcaaggctgctgaaacaaccggcgcttggataattacagaggggattaacaccggagtgagcaaacacgtgggagatgccctgaaaagccatagctcgcacagtctaaggaaaatatggactgtgggaattcctccatggggggtgattgagaatcagagagacctgattggaaaggatgtggtgtgcctgtaccaaacacttgataacccgttaagcaagctgacaacactgaacagcatgcatagccatttcattctgtctgatgacggcacagtggggaagtacgggaacgagatgaagctaagacggaacctcgaaaagtatctgagtctccaaaaaatacattgccgaagtaggcagggagttcctgtcgtaggtctggtcgttgaaggtgggcccaatgttatcctgagtgtctgggagacagtgaaagacaaggaccccgttgtggtttgcgagggaaccgggagagcagctgacctgctggccttcacacacaaacaccttgccgatgaggggatgcttcggccccaggttaaggaggaaatcatttgtatgattcagaacacctttaatttcagcctgaagcagagcaagcatctttttcagatactcatggagtgtatggtccacagggactgtatcacaatctttgacgccgactctgaagagcagcaggacctggacctggctatcctgacagcgttgcttaaagggacgaatctgagtgcttctgaacagctgaacctagccatggcttgggacagagtggacattgccaagaaacacattttgatttatgaacaacattggaaacccgatgccctcgagcaggctatgtccgatgctctggtgatggatcgcgtggacttcgtgaagctgttgattgagtatggagtcaatctgcatagattcctgaccattcccaggctcgaggagctgtataataccaagcaaggtccgaccaacactctattgcatcacctcgtacaggacgtgaaacaacacacactcctctccgggtaccggataaccctcatagacatcggactggttgtggagtacctgattgggcgagcttaccgcagcaattatacaaggaagcactttcgcgccctctacaacaatctgtatcgcaaatataagcaccagcgacatagtagtggaaatcgaaatgagagtgccgagtcaactctccacagtcagttcattcgtaccgctcaaccatacaagttcaaggaaaagagtatcgtgctccataagtcacggaaaaagtcaaaggaacaaaacgtgtctgatgaccctgaatctaccggtttcttatacccctacaatgatctgctggtatgggcagtactaatgaagaggcagaaaatggccatgtttttttggcagcacggggaagaagccacagttaaggccgtcatcgcttgtatcctgtacagagctatggcacatgaggctaaggagagccatatggtagatgatgcttcagaagagttaaagaactattctaagcagttcggtcagttggcactcgacctcttagagaaggcttttaaacagaatgagcgcatggccatgaccttactgacttacgagctgcggaattggtcaaacagcacttgtctgaaactggccgttagtggaggtctgagaccattcgtgtcccacacatgtacgcagatgctgctgactgatatgtggatgggacggctaaaaatgcgcaaaaactcctggctgaagattatcattagtatcattcttcccccaacaatcttgactctagaattcaagtctaaggccgaaatgagccacgtcccccagagccaggattttcaattcatgtggtactatagcgaccagaacgcaagcagcagcaaggagagcgcctcagtgaaagagtacgacttggagagagggcacgacgaaaaacttgacgaaaaccagcattttggtctggaatctgggcatcagcacctcccttggacaaggaaagtttacgagttttatagcgctcctatcgtcaaattttggttctatactatggcctacttggcattcctcatgctgtttacttacaccgttctggtcgaaatgcaacctcagcctagtgttcaagagtggttggtgtctatttacatcttcacaaacgctatcgaagtggtacgggaaatttgtatcagtgagccggggaaatttacacagaaagtaaaggtgtggatcagtgaatactggaatctgactgagacagtcgctattggcctctttagcgctgggtttgtcctgcgctggggagaccccccatttcacactgccgggcgtttgatttactgcatagacattattttctggtttagcagactgttggattttttcgcagtaaatcagcatgcaggaccatacgttacgatgattgccaagatgaccgccaatatgttctatattgtcattattatggccatcgtgctcctgtcgtttggcgtggcgcgcaaggccatcttaagccccaaagaaccaccctcttggtcactggcgagagacatagtgttcgagccttattggatgatctatggcgaggtgtacgcaggggagatcgacgtgtgtagctcacagccaagctgtcccccaggaagctttttgacgccattccttcaagccgtatatctgttcgtgcagtacattatcatggtgaatcttttgattgcttttttcaataacgtgtacctcgacatggagtctattagcaacaatttatggaagtacaataggtatcggtacatcatgacataccacgagaagccgtggctccctccgccattgattctcttgtcccacgtggggctgctcctaagacggctttgctgccaccgcgctcctcacgaccaggaagaaggagacgtcgggttaaagctgtacctaagcaaagaggatttgaaaaagctgcatgattttgaagagcagtgtgttgagaaatacttccatgagaagatggaggatgtcaattgtagttgcgaagagcggattcgtgtgacctctgagcgtgtgactgaaatgtacttccagctgaaggagatgaacgaaaaagtgtccttcatcaaagactccctgttgagcctggacagtcaagtcggccatttgcaagacttaagcgctctcactgtagatacactcaaagttctctctgctgtcgatacattgcaagaagatgaagcactcctggcaaaaagaaagcacagtacctgcaagaagttaccgcacagctggagcaatgtgatctgcgctgaggttcttggatcaatggagattgccggcgagaaaaagtaccagtattatagcatgccctcttcgcttctccggagtctggctggcggccgccacccacctcgcgtgcagcgaggcgctctcttggagatcactaactccaaacgggaggccactaatgttcgaaacgatcaagagcgtcaggagactcagtcttccatcgtggtgtcaggggtgagcccgaatcgccaggctcacagcaaatacgggcaattccttctggttcctagcaatcttaaacgcgtccctttcagcgcggaaaccgtcctacccctgtctcggcccagtgtgccagatgtcctggctaccgagcaggatattcagactgaggttctagtccacctgaccggccaaacgcctgtggtctctgactgggcatctgtggacgaacctaaagagaagcatgagccgattgcacacctgttagacggccaggataaagccgagcaggtgctgcctacactttcgtgtactcccgaacctatgacaatgagttcgcccctctcacaagccaaaataatgcagactggagggggttacgtgaactgggcctttagtgagggggacgaaacaggagtgttttcaattaaaaaaaagtggcaaacgtgcttaccctcaacctgcgacagtgattcatcacgtagcgagcaacaccagaaacaggcgcaggactcctccttatcagataacagcacgcggtctgcccagagcagcgagtgctcagaggtgggaccctggctgcagcccaacacttcattttggatcaatcctctgagacgttatagaccctttgccagatcacactctttcaggtttcacaaggaggagaagctgatgaaaatctgcaaaattaagaacctctcgggcagctctgagattgggcagggcgcctgggttaaagctaagatgctgacgaaggacagacgactctccaagaaaaagaagaacacgcagggtctacaggtgccaatcatcactgtgaatgcctgctcacagtctgaccagctcaacccagagcctggcgagaacagcatcagtgaggaggagtacagcaagaattggtttaccgtttcaaagttcagccatacgggggtggagccatatatacaccaaaagatgaagactaaggagatcggccagtgtgccatccagatctccgactatctcaagcaatcccaagaagatctgagcaagaacagtctgtggaatagcaggagcaccaatcttaacagaaacagtctgcatgtgattaagatgccaatctccagccttatctctgaaatctctgccagtcttaaatcgccccaggaaccgcaccaccattatagtgcaattgagaggaacaacttaatgcggctgtcacaaaccattcccttcacgcccgtgcaactgttcgccggcgaagaaataaccgtgtaccgcttggaagagtcctcacctttaaatctcgataagagcatgtcttcctggagccagcgggggcgcgccgcaatgattcaggtgctatcaagagaagagatggacggcgggctgaggaaagccatgcgggtggtgagtacctggtccgaggacgacattctgaaaccgggccaggtgtttatcgtaaaatccttcttgcctgaagtggtaagaacatggcacaaaatattccaggaatcaaccgtccttcatctctgcctgcgagaaatccaacaacagagagcagcacagaagctcatatacacatttaatcaagtaaaaccccagaccattccgtatactcctcgattcctggaggtgtttctaatctactgtcattccgccaaccagtggctgaccattgagaagtacatgacaggagaatttaggaagtacaataataataatggagatgagattactcccacaaataccctggaggaactaatgctggccttctcgcactggacgtatgaatatactcggggggaactgctggtgttagatctccaggcactttggttctgggatagcatgctcaaggcacgcctcggagggtggaggatgtag

SEQ ID NO: 138438 - DNA, 1707 bp, Artificial Sequence
  Description of Artificial Sequence: Synthetic coding sequence
agagagtctccccaccctgccctgctccagtctcagaaaagctggattaagggcgtctttgacaaaagggaatgttctacaattataccgagttccaagaatccgcacaggtgcactccggtgtgccaggtctgccagaaccttatccgctgttattgcggaagattgatcggagatcacgccgggattgactatagctggaccatttctgcagccaagggcaaggagtccgaacagtggtcagtcgagaaacatacaacaaagtcgccaactgacacattcggtaccatcaatttccaagacggggagcacacacaccacgctaaatacattcggacatcctacgacacaaaattggatcacctgttacatctcatgcttaaagaatggaagatggaactccctaaactggttatatccgtacacggaggtatccagaattttacaatgccttccaaattcaaggagatttttagccagggactggtgaaagccgccgagacaacaggcgcatggattattactgaagggataaacacgggcgtgagtaaacacgtcggggatgcgctgaagtcccacagttcccattcactgcgtaagatttggactgtgggaatcccaccctggggggtaattgaaaatcaacgcgacctaatcggcaaggacgtggtgtgcctgtaccagaccctggacaacccgctgagcaaactgactaccctcaattctatgcatagtcactttattctctccgacgatggaacggtcggaaaatacggcaacgagatgaagctgagaaggaatctggagaagtacttaagtcttcaaaaaatccactgccccggcgaggaaatcactgtctatagacttgaagaaagctctccacttaatttagacaaatcaatgtcttcatggtcccagcgaggcagggccgccatgatacaggtactgagccgggaggaaatggacggaggtcttaggaaagctatgcgggtggtgtctacatggtccgaagacgacatcttaaagcctgggcaagtcttcatcgtgaaatcgtttctcccagaagtcgtaagaacgtggcataaaattttccaggagagcacagtgcttcatttatgtctgagagagattcagcaacagcgggccgcgcaaaagctcatctatacatttaaccaagtcaaaccccagaccatcccttatacacccagatttctggaggtgttcctgatctactgccacagtgcgaaccaatggctcaccatcgagaaatacatgaccggcgagtttagaaaatataataacaataacggggacgaaatcaccccaactaacaccctcgaggaattaatgttagcctttagccattggacatatgagtatactcgtggggaactactggtgttagatttgcagggggtaggcgagaacttgaccgacccaagtgtgataaaacctgaagtgaaacagagtcgcggcatggtgtttggccctgccaacctcggcgaggacgctatccggaactttattgctaagcaccattgcaactcatgttgcaggaaattgaaactgcctgatctgaaaagaaacgactattcacctgaaagaatcaactccacatttgggctcgaaatcaagatcgaatcggccgaagagccaccagctcgcgagacaggtcggaactctccagaagatgacatgcagttgtag

SEQ ID NO: 138439 - DNA, 2580 bp, Artificial Sequence
  Description of Artificial Sequence: Synthetic coding sequence
atgaaagaacagcccgtattggaacgactccagtcacagaagagttggatcaagggggtgttcgataagcgagaatgtagcaccattatccctagctcgaagaaccctcacaggtgcaccccagtgtgtcaagtgtgccagaacctgattaggtgttattgcggccggctgattggagatcacgcgggaattgattactcctggaccatcagtgctgccaaggggaaagaatccgagcagtggagtgtcgagaagcatactacgaagagtcccacggatacatttggcactataaacttccaggacggcgagcatacgcaccatgccaaatatatccgcacttcttacgatacgaagctggaccatttgctccacctgatgctgaaggaatggaaaatggagcttccaaagctcgttatttctgtgcacgggggaatccagaactttacaatgccttcgaagttcaaggaaatctttagtcagggcctggttaaagccgccgaaaccacgggagcgtggataatcacagagggcatcaacacaggcgtttccaaacatgtcggcgacgctctgaaatcccactcctcacattcactgagaaagatctggacagtagggataccaccatggggggtgattgagaatcagagagacctcatcggaaaggatgtggtctgtctgtaccagaccctggacaaccccctttccaagcttacaacgttaaattccatgcactcccatttcatcctgagcgatgatgggacggtcgggaagtatgggaatgagatgaaactgcgacgtaatcttgagaaatatctgtcccttcagaagatccattgccgctcccggcaaggtgtgccggtcgtgggcctggtggtcgagggtggccccaacgtgattttgtctgtgtgggaaaccgttaaggacaaggaccctgttgtcgtctgtgagggtactggtcgggccgcagatctgctcgcctttacccacaagcacttggcggatgaaggtatgctccgacctcaggtgaaggaggagatcatctgcatgatccagaacacatttaactttagcctgaagcagtcaaagcacttgttccagatccttatggaatgcatggttcacagggattgtataactatcttcgatgctgattccgaggagcagcaggatctagacctggcaatcctgactgccctgcttaaaggtacgaatctctccgcttccgaacaacttaaccttgctatggcctgggaccgtgttgacatcgccaagaaacacatcttgatatacgagcaacattggaagccagatgccctcgagcaggccatgtctgatgccctagtgatggatagggtcgatttcgtcaagttgctgattgagtacggtgtgaacctccaccgtttcttaactattccgcggcttgaggaactctataacaccaaacaggggcccactaatacactgcttcaccacctcgtccaggacgtgaagcaagatttgagtaaaaacagcctttggaattcccggagtaccaatcttaacagaaactctttacacgtgataaaaatgccaatcagtagcctgataagcgagatttcagcttccctcaaatcaccgcaggaaccccaccaccattactcagctatcgaaagaaataatctcatgcgcttatctcagacaatccctttcactcccgtccaactcttcgccggcgaagaaatcacagtctaccggcttgaagagagttcccccctcaacctggataagtcaatgagcagctggagtcagcgcggccgtgctgctatgattcaggtcttgagcagggaggagatggatggcggcctcagaaaagctatgagagttgtcagcacgtggagtgaggacgatattctgaaacctggtcaggtctttattgtgaagtcttttttgccagaggtggtgagaacatggcataagatctttcaggaaagcaccgtgcttcatctatgtctccgggaaattcagcagcagagagcagcccagaagctgatctataccttcaatcaggttaagcctcaaacaatcccttacaccccacggtttctcgaagtttttctcatctattgccactctgcaaaccagtggttgaccatagaaaaatatatgacgggcgaattcaggaaatataacaataacaatggagatgaaattacccctacgaacacccttgaagaactgatgttagcattttcccattggacttatgaatacactagaggcgagttgcttgttctggacctgcagggagtcggcgaaaatttgaccgatccaagtgtgatcaagccggaagtgaaacaaagcagagggatggtgttcggtcctgccaatctgggggaagatgcaattaggaactttatagccaagcaccactgtaactcgtgctgtaggaaactcaagcttcccgacctgaaaaggaacgactattcccccgagcgcatcaacagcactttcggtctggaaattaagattgaaagcgcggaggagcccccagccagggagactggaagaaactctcctgaggatgatatgcagctctag

SEQ ID NO: 138440 - DNA, 2934 bp, Artificial Sequence
  Description of Artificial Sequence: Synthetic coding sequence
atgaaggagcaacctgtcctggaaagactgcagtctcagaagagctggattaagggggtctttgacaagagagaatgctctaccatcattccatcaagcaagaatccccacaggtgcactcctgtctgccaggtgtgtcagaacttaatcagatgttactgtggccgtctcattggagaccacgccgggatcgactatagctggaccattagcgcagccaaaggaaaggagtccgaacagtggtccgttgagaaacataccactaagagccccaccgatacgttcgggaccatcaacttccaggacggggagcatacacaccatgctaaatacattcgcacttcttacgatacaaaactggaccacttgctgcatctgatgttgaaggaatggaagatggaattgccaaagttggtgatttccgtgcacggtggcatccagaatttcactatgcctagtaaattcaaagaaattttcagccagggtctcgtgaaggcagcagaaactaccggagcctggatcataactgaggggatcaataccggggtctctaaacacgtcggcgatgcattgaagagccactcctctcactccttgcggaaaatctggaccgtgggaatacccccatggggcgtgatcgagaatcagcgcgatctcatcggtaaggacgttgtctgcctgtaccagaccctggacaaccctctgtctaagcttaccacgctgaacagcatgcattctcacttcatacttagcgacgacgggacggttggcaaatacggcaatgagatgaagcttcgtcgaaatcttgaaaaatatctttcactgcagaagatccactgtcggagcagacagggtgttcccgtggtgggcctggtggtggaagggggacctaatgtgatcctatccgtgtgggagaccgtcaaggataaggaccctgtagtagtctgtgagggtacaggccgggcagccgacctcctggcatttactcacaaacacctcgccgacgagggcatgctgaggccccaggtcaaagaagagatcatctgtatgatccagaacacttttaacttttctctgaagcaatctaaacacttattccaaattttgatggagtgcatggtccacagggactgtattaccattttcgatgccgattctgaggagcaacaagacttggacttggcgattctgactgcattgctgaagggcaccaatttgtccgcctcagaacagctaaaccttgctatggcctgggaccgtgtggacattgctaagaagcatattttaatctacgagcaacactggaagcccgatgctttggagcaggctatgtccgacgccctggttatggaccgggtggatttcgtcaagttgctaattgaatacggagtgaacctgcatagatttttaactattccccgcctggaggagttatataacacaaagcagggtccaacaaatactctcctacaccatttagtgcaggatgtgaagcaacataccctgctatctgggtaccgtatcacactgatcgacattggtctggtggtagagtacctgattggcagggcgtatagaagcaactacacgcgcaagcactttcgcgcgctttacaacaatttataccgcaagtacaagatcatcaccgtcaatgcctgtagccagtcggatcagctcaatcctgagccaggagagaattctatctccgaagaggagtacagcaagaactggtttacagtgtctaaattctcacataccggcgttgagccatacattcaccaaaaaatgaaaaccaaagagatcggtcaatgcgcgatccagatctcagactatttgaagcagtcacaagaggatctgagtaagaactctctgtggaactcaaggtccaccaatctcaatcgcaacagtttgcatgtgattaagatgcccatttcttccctgatcagcgaaatctctgcttctttaaaatctccccaagaaccacaccaccattattcagctattgagagaaataacctcatgcgtctgagccagaccatcccattcacgccggtgcagctcttcgctggagaggagattacagtgtaccggttagaggagtcaagccctcttaacttagacaagtcgatgtcaagctggagccagcgggggcgggcagcaatgatccaggtgttgagccgtgaggagatggatggcgggctcaggaaagctatgcgtgtcgtgagcacctggagtgaagacgatatccttaagccagggcaggtatttatagttaaaagttttcttccagaggttgtgcgtacttggcacaagatcttccaagagtccacggttctgcacctgtgtctcagggagatccagcagcagagagccgcccagaagcttatttatacgtttaatcaggtgaaaccgcagacgatcccttatactcctagattcctggaggttttcctcatctactgccactctgccaaccagtggcttactattgagaagtatatgaccggcgagttccgcaaatataacaataataacggtgatgagataacacccaccaataccctcgaggaattgatgttggccttctcacactggacctacgaatatactaggggggaactcctggttcttgaccttcagggggtgggggaaaatctcactgacccctctgtaatcaagcccgaagttaaacaatcccggggcatggtgttcggcccagccaacctgggggaggatgccattcggaactttattgctaagcaccactgtaacagctgctgtcgtaagctgaaattgcccgatctgaagcggaacgattacagtcccgagcgcatcaatagcactttcgggctggaaataaagattgaatcagcggaggagcccccagctcgtgagactgggcgaaattctccggaagatgacatgcagctgtag

SEQ ID NO: 138441 - DNA, 3402 bp, Artificial Sequence
  Description of Artificial Sequence: Synthetic coding sequence
atgttgcggcctcaggtgaaggaagagattatctgcatgatccagaatacatttaatttctcactcaagcagtctaagcacctgttccaaattttgatggagtgtatggtacaccgcgactgtatcacaatctttgacgctgattctgaagaacagcaggacctcgatctagccattctcactgctttgctgaaaggaaccaacctttccgcaagcgaacagctcaacctggctatggcctgggatcgggtggatatcgctaagaagcatatcctcatctacgagcagcactggaagccggatgccttggaacaggcaatgtccgacgctctcgttatggatcgtgtagacttcgtcaagcttctaattgaatacggtgtaaacctccacagattcctgaccatcccaagactcgaagaattatacaataccaagcagggcccgaccaacacccttctgcaccatctggtacaagacgtcaaacagcataccctcctcagcgggtatcgtatcaccctgatagacatcggtctggtggtggaatacctcattggtcgagcctatcgatctaactatacccgcaagcactttagagcgctttacaacaacctctatcggaagtataaacaccagcggcactcaagtggcaatcgcaatgagtcagccgaaagtactttgcatagccagttcattcgcactgctcagccctacaagtttaaggagaaaagcatcgtactgcacaagtcacgcaaaaagtctaaggagcagaatgtttccgatgacccagaaagcaccggattcctctacccctataacgacttgctggtgtgggcagtgctcatgaagagacagaagatggccatgttcttttggcagcacggagaagaggcaactgtcaaagccgtgatcgcgtgtattttgtaccgagctatggcacatgaggcgaaagagtcccacatggtggacgacgcttctgaggaactgaagaactattctaaacagttcggccagctggctctggatctgttggagaaagccttcaaacagaacgagcggatggccatgaccctgctaacctacgagctgcggaattggtctaactccacgtgcctgaaacttgccgtgtcaggagggcttagaccattcgtgagccatacctgcacccaaatgctcctgaccgatatgtggatgggcagactgaagatgcggaaaaattcgtggttaaaaattatcatttctatcatcctgccacccacaatcctgacattagagttcaagtcaaaagccgagatgagccatgtgccccagagccaggattttcagtttatgtggtactactcagatcagaacgcaagtagctccaaagaaagcgctagcgtcaaggaatatgacctcgagagggggcacgatgagaagctggacgagaatcaacattttggacttgagtcaggccaccaacatctgccctggacccgcaaagtgtatgagttttactccgccccaatcgtgaagttttggttttatacaatggcatacctggctttcttgatgctttttacctacacagttttggtggaaatgcaacctcagccctcagtacaagaatggttggtctccatatatatcttcactaacgcaattgaagtggtgagagagatttgcatcagcgagccaggaaagttcacccagaaggtgaaagtgtggatctccgaatactggaacctgacagagacagtggccatcgggctgttctcagctggatttgtcctgagatggggggatcccccatttcacaccgctgggcggctgatttactgtatcgatattattttttggtttagccgtttgttagatttctttgcagttaaccagcacgctggcccctatgtgacgatgattgccaaaatgactgcaaacatgttctacatagtgataataatggcgatcgtactgctatcattcggagttgcgcgtaaagcaattctgtctccgaaggaaccacccagctggtcgctggctagagacatcgtgtttgaaccttattggatgatctacggggaggtgtacgccggggagattgatgtgtgttcaagtcagccgagttgcccaccaggaagcttcctgactcctttcctgcaggcggtgtatctcttcgtgcagtacatcatcatggttaacttgcttatagccttttttaataatgtttacctagacatggagtctatatccaataacctctggaaatataacagatatagatacattatgacctatcacgagaagccttggttgccccctcccctgatattgctaagtcacgtggggcttctgctacgacggctgtgctgccatagagcacctcatgaccaggaagagggcgacgtcggcctgaagctatacttgtcaaaagaagatctcaagaagctccacgacttcgaggagcagtgcgttgagaaatactttcacgaaaagatggaagatgtgaattgttcttgcgaagaaaggatccgtgtgacctctgaaagggtgacggagatgtattttcagctgaaggagatgaatgagaaagtgtccttcatcaaagactctttgctttcattagatagtcaggttggtcacctacaggatctctctgccttgactgtcgatactctgaaggtgctgtccgcagtagatactctgcaagaggacgaggccctgctcgcaaaaaggaagcatagcacttgcaagaaactcccacactcctggtccaacgtcatttgtgctgaagttctgggatccatggagatcgctggcgaaaaaaaataccagtactattccatgccaagctctcttctgcggagcttagccggcggaaggcaccccccaagggtgcagaggggggcactgttagagatcacaaactccaaacgtgaggcaacgaacgtacgcaatgaccaggaaaggcaggagacccagtcgagcatcgtggtttcaggggtcagccctaatagacaagcccacagcaagtacggccaatttttattggtgccttctaacctgaaacgggtgcccttctctgctgaaaccgtactgcccttgtctagaccatccgtgccggacgtcctggcgacggagcaggatatccagacagaagtgcttgtccacctgacaggacagactcccgtggtctctgactgggctagcgtggatgagcctaaagagaagcacgagccaatcgcacatctgctagacgggcaggacaaagctgagcaggtgcttcccaccctgagctgtacgccagagccgatgaccatgtcctctcccctgtcccggtacaggccattcgctaggtcccacagcttcagatttcacaaagaagaaaagctgatgaagatttgtaaaataaagtccaaagagtag

SEQ ID NO: 138442 - DNA, 6054 bp, Artificial Sequence
  Description of Artificial Sequence: Synthetic coding sequence
atgattatcctcagcaagagtcagaaaagctggatcaagggcgtattcgataagagagagtgctctacaatcatacccagtagcaaaaacccccacaggtgtaccccagtgtgtcaggtctgccaaaaccttattcgctgttactgtgggcgcctgatcggcgatcacgccggcatcgattattcttggactatatccgcagccaaaggcaaagaatccgagcagtggagcgtggaaaaacatactactaagtcccctacagatacatttggtaccatcaatttccaggacggcgagcatacccaccacgcgaagtacatcagaacaagctacgacaccaagcttgaccatctccttcacctaatgctaaaggagtggaagatggagctgccgaagttagttatcagcgttcacggggggattcaaaatttcacaatgccatcaaagttcaaggagatcttctctcaggggctagtgaaagcggcagagacgacgggtgcctggatcatcacggaggggatcaacacgggggtcagcaagcatgtgggggacgccctgaaatcacacagtagccatagcctgaggaaaatttggacagtgggcatcccaccatggggggtcattgaaaaccagcgggatctgatcggcaaagatgtggtgtgcttgtaccagaccctggataaccctctgagcaaacttactacccttaattccatgcattctcatttcatcctgagtgatgacggaacagtaggaaaatatggcaatgagatgaagctgcggcggaatctggagaaatacctgtctcttcagaagattcattgcaggagccgccaaggcgtacccgtggtcggactcgtggttgagggtgggccaaacgttattctgtctgtgtgggagaccgtgaaagacaaagatcctgtggtcgtctgtgagggcaccgggagagcggccgacctgttagctttcacccacaaacacctggctgacgaaggaatgcttagaccacaggtcaaggaagagatcatctgtatgatacaaaatacttttaacttttctttgaaacaatccaaacatctatttcagatcttaatggaatgtatggtacacagagactgtattacaatttttgacgccgactccgaagagcagcaggatttggatttagccattctcaccgcactgcttaagggcacaaatttatccgcatcagagcagctgaatctcgcgatggcgtgggatcgagtggacattgcaaagaaacacatcctaatctatgaacagcattggaagcctgatgcactggagcaggcaatgtctgatgcactggtgatggatagggtggatttcgtcaaactgttaattgagtacggcgtgaatttgcatagatttctgacaatccccagactcgaagagctctacaataccaagcaagggcctaccaatactctgttacatcacctggtgcaggacgtcaaacagcataccctcctctccggctataggattaccctgatcgatatcggccttgtcgtggagtacctgattgggcgtgcctacagaagtaactacaccagaaaacactttagagccctgtataataacttgtataggaagtacaagcatcagcgacacagctcaggtaaccgcaatgaaagcgctgaatctacacttcactctcagtttatccgtactgcccaaccttataagtttaaagagaaaagtatcgtgttgcataaaagtagaaagaagtctaaggagcagaacgtgtccgacgaccccgagtcgaccgggttcctgtatccatataatgaccttctggtgtgggccgtgcttatgaaacggcagaaaatggccatgtttttctggcagcatggcgaggaagccacagtcaaagcagtgatagcatgtatcctctaccgcgcaatggcacacgaagccaaagagtcacatatggtagacgacgcaagtgaagagttaaaaaactactcaaaacaatttgggcaattggccttggacctgctggagaaagcttttaaacagaacgagcgaatggcgatgactctgctgacctacgagctgaggaattggtcaaattccacgtgtctaaagttggccgtgtccggcggacttagaccatttgtgagccatacatgtacccagatgttgctaaccgacatgtggatggggcggcttaagatgagaaagaacagctggcttaaaatcattatctcaattatcctgcctcccactatactaacactggagtttaagtcaaaggccgagatgtctcacgtgccacagagccaggacttccagttcatgtggtactatagtgatcagaatgcctcatccagtaaagaatctgcctccgtgaaggagtacgatctggaacgcggccatgacgagaagctggatgaaaatcagcacttcggactggaatcaggacatcagcacctgccatggactcgtaaagtatacgagttttactctgcccctatcgtgaaattttggttctataccatggcctatttggcctttttgatgctgtttacatatacagtactagtggaaatgcaaccccaaccatcagtgcaggagtggctggtgagcatttacatctttaccaacgccattgaggtggtccgggagatctgcattagtgaacccggcaagtttactcagaaagtgaaagtctggatcagtgaatactggaaccttaccgagaccgtggcaattggtctgttctccgcgggatttgtgttgcgctggggagatcccccgttccacacagctggcaggcttatatactgtatcgatatcattttttggttctcccggctgctagacttctttgcggtgaatcaacacgctgggccatacgtgaccatgatcgcaaaaatgacggccaatatgttctatatcgtgatcattatggcaattgtcctgctgtcctttggtgtggcacgcaaagccatactgtctcctaaggaaccaccctcctggagcctggcacgggacatcgtgtttgagccatattggatgatctacggcgaagtgtacgcgggggaaatcgacgtgtgtagcagtcaaccttcctgcccaccgggatcctttttgactccatttctgcaggctgtgtaccttttcgtgcagtatatcatcatggtcaatctcctcattgccttttttaacaacgtgtatctggatatggaatccatctctaacaatctttggaaatacaatagatacagatatattatgacatatcatgaaaagccatggctcccacccccactgatcttgctctctcatgtggggttgctcttgcgtaggctatgctgccaccgggccccccatgaccaggaggagggtgatgtcggactaaagctgtacctgtctaaggaagatctcaagaagctgcatgactttgaggagcaatgcgttgaaaaatacttccacgagaaaatggaggatgtgaactgttcatgtgaagagcggatcagagtgacctctgagcgggtgaccgaaatgtactttcagctcaaggagatgaacgagaaagtgagtttcataaaggattccctcctgtcactcgattcgcaggtcggacaccttcaggatctttcagcccttactgtggatactttgaaagtcctgtccgccgtcgacacgttacaggaggacgaggctctccttgccaaaagaaagcattccacgtgcaagaagctgcctcacagctggtccaacgtgatctgcgctgaggtcctcggaagcatggagatcgcgggcgagaaaaaataccaatattactctatgccctcctctctcctacgcagcttggcgggcggacgtcaccccccccgagttcagagaggtgcgctgcttgagatcacaaactccaagcgggaggccacaaatgtgagaaacgatcaggagagacaagagacacagtcgagtatagttgtgtccggagtgtcaccaaacaggcaagcccacagcaagtacggtcagttcttgctcgtaccctccaacctgaagcgtgtgccattcagcgccgagacagtgcttccacttagcagaccttcggtgcccgacgtgcttgccacagaacaagatatccaaaccgaagtgttggtgcacctgactggtcagacacccgtagtgtcagactgggcgtccgtggacgagcccaaagaaaagcatgaaccaatagcgcacctgctagacggccaggacaaggcagagcaggtattgcccacgctatcctgcacccccgaacctatgaccatgtcatctcctctgtcgcaggcaaaaatcatgcaaactggcggcgggtatgtaaattgggcgtttagtgaaggtgacgagacgggcgtttttagtatcaaaaagaaatggcagacgtgccttccttcgacttgcgactccgactccagtaggtctgaacaacatcaaaagcaggcccaagactcatcactcagcgacaacagtacacggagcgctcagtcaagcgaatgctctgaggtgggcccgtggctccagcccaatactagcttttggatcaatcctttacgccggtacaggccctttgcacggtcacacagttttcgcttccataaggaggagaaactgatgaagatctgcaaaattaagaatttgtccggaagtagcgagattgggcagggagcctgggtcaaggcaaaaatgttgaccaaagataggcggttatcaaaaaagaaaaagaatacccaggggctgcaggttccaattataacggtcaacgcgtgctcccagtcagatcagttgaaccccgagcctggtgagaattcgatatcagaagaagagtactctaaaaattggttcacagtcagtaaatttagccatactggcgtcgagccttacattcaccagaaaatgaagactaaggagatcggacaatgtgcaatccaaatatcagactaccttaagcaaagtcaggaggacctcagcaagaacagcctgtggaatagtcgctcaaccaatttgaacagaaacagtttgcttaaatcctccattggggtggataaaatcagcgcatcactgaagtctccacaggagcctcaccaccattactctgctattgagagaaacaatctcatgcgactgtcgcagacgatcccatttacacctgttcaactgttcgctggtgaagagattacagtatatcgcctggaagagagcagtcctctgaacttggataagtctatgagctcgtggagccagagagggcgggcagccatgattcaagttctgtctagggaagaaatggacggcggattaaggaaagccatgagggtggtgtctacatggtcggaagacgacatcctcaagcccggccaggtgttcatagtcaaatcttttctccctgaagtggtcaggacctggcacaaaattttccaagaatccaccgtactgcacctttgtctgcgcgagatacagcagcagcgggctgcacagaagttgatttataccttcaaccaggtgaagcctcagactattccatatactcctcgatttctggaagtattccttatttactgccatagtgccaatcagtggttaacaatagagaagtacatgacaggtgaattccgaaagtataacaacaataacggagatgagataactcccactaatacccttgaagagctgatgctggcgttttcacactggacctatgagtacacaaggggcgaactgcttgtgctggatttacagggcgtgggagagaatctcacagacccttccgtgataaagcctgaagttaagcaaagcaggggcatggtgttcggccctgccaatttgggagaagatgcaatcagaaacttcattgctaaacaccattgtaactcttgttgccgcaagctaaaactccctgaccttaagcgcaacgactacagcccggaaagaatcaactcaacctttgggctcgagattaagatcgaaagcgccgaggagccacccgctagggaaaccgggcggaacagccctgaagacgacatgcagctctag

SEQ ID NO: 138443 - DNA, 6081 bp, Artificial Sequence
  Description of Artificial Sequence: Synthetic coding sequence
atgaaggagcagccagtgttggaacgcctgcagtctcagaaaagttggataaagggagtgtttgataagcgggaatgttcaacgattatcccatctagtaagaatccacacaggtgcacacccgtgtgtcaggtgtgtcagaatctcatcagatgctactgtgggaggctaattggggatcacgcgggtatagactacagctggaccattagtgccgctaaagggaaagagtcagagcagtggagcgtggaaaaacacacaaccaaaagccctacagataccttcggcaccattaattttcaggatggagagcacactcatcatgccaagtatattcggacctcctacgatacgaagcttgaccatttgctgcacttaatgcttaaggagtggaagatggaactgcctaagttggtcatttcggttcacggcggcattcagaattttactatgccctctaagtttaaagagatcttctctcagggcctggtaaaggccgccgagacaacgggggcgtggatcattaccgaaggcatcaatacaggtgtctctaaacacgtgggtgatgctctgaagagccatagcagccatagtctgcgcaagatctggaccgtggggatcccaccctggggcgtcatcgaaaaccagagagacctgatcggtaaggacgtcgtttgtctctaccagactctggataatcccctgtctaagctgacaaccctcaattccatgcactcgcatttcatactgagcgatgatgggacagtgggcaagtatgggaatgagatgaaactccggaggaatctcgaaaagtacctgtcgctacagaaaatacactgtaggtcaaggcagggggtgcccgtcgtgggcctcgtggtggaaggtggccccaacgtgatcctgtctgtctgggagactgtgaaggataaggatcctgtagtggtttgcgaaggaacaggtagagcagccgatctcctggccttcactcataaacacctcgctgatgagggcatgctcagaccacaagttaaagaggagattatctgcatgatccagaatacctttaacttttccctgaaacagagtaagcatctgtttcagatcctcatggaatgtatggtccaccgggactgtatcactatcttcgatgcagacagcgaggagcagcaagacctggatctggccatcctcacagctctgctgaaaggcacaaacctaagcgcctcagagcaactgaatctggcgatggcatgggacagagtggacatagcgaagaagcacattttgatctatgaacagcactggaagcccgatgctttggagcaagcaatgtcggacgcgctggtgatggacagagtcgactttgttaaactgctgatcgagtacggggtcaacctgcaccggttcctaacaatcccacgacttgaggagttatacaacaccaagcaggggccaacgaacacgctgctccaccatcttgtccaagatgttaagcaacacacactgctttctggctaccggatcacacttatcgatattgggttggttgtggagtacctaatcggccgcgcatatcgtagcaactatacccgtaaacatttcagagccctatataataatctgtatagaaaatataagcaccagcgacacagctcaggtaataggaacgaatctgccgagagcactttgcatagtcagttcatccgtaccgcccagccatacaagttcaaggaaaagagcattgtcctgcacaagtcccgaaagaagtctaaagagcaaaacgtcagtgacgacccagagtccaccgggttcttatacccttacaatgacctactggtgtgggcagtactaatgaagcgtcagaagatggccatgtttttttggcagcacggtgaggaggccactgtcaaagcagtgattgcgtgtattctctatcgcgcaatggcacacgaggctaaagagagccatatggtcgacgatgcctctgaggaattaaaaaactactccaagcagttcggccaactggctctagatctactggagaaggctttcaaacaaaacgagagaatggctatgacgctactgacttacgaactgaggaactggtctaactccacctgtctaaagctagccgtgtcaggaggtttacgaccttttgtatcacatacctgtacccaaatgttattgaccgatatgtggatgggaaggttgaaaatgaggaagaacagttggttaaaaataattatcagtatcatactgcctccaaccatccttacactagaattcaagtccaaggccgagatgtcacacgttccccaatcccaggactttcagtttatgtggtattattctgaccagaacgcctcctcaagcaaagagagcgcttcggttaaggagtatgacttagagcgaggccatgacgagaaactggacgagaatcagcattttggcctagagagcggacatcagcacttaccgtggacacgaaaggtgtatgagttttatagcgcacctattgtcaagttctggttttacacaatggcatacctggcatttctcatgctgttcacttacacggtgttagtggagatgcagcctcagccatccgtgcaggagtggctggtatcaatttatatattcaccaatgcaattgaggttgtccgcgaaatttgcatttctgagccaggtaaattcacacagaaggttaaggtctggattagcgagtactggaacctcacggaaacagttgcgataggccttttttccgctggctttgtgctgcggtggggagatcctcctttccatacagcgggtaggctgatctactgcatcgacatcatcttttggttctctcggctgctggactttttcgccgtcaaccagcacgcgggtccatatgtgaccatgattgcaaagatgacagctaatatgttctacatcgtgataatcatggcgattgtcttactgagctttggtgtggcaagaaaggccatcttatctccaaaagagcccccaagctggtccctggctagagatatcgtttttgagccttattggatgatttacggggaggtctatgccggcgaaatcgacgtatgttcctctcagccttcatgtccaccgggaagcttccttaccccattcctccaggccgtgtatttgttcgtacagtatataattatggtcaaccttcttattgccttcttcaataatgtttatctggatatggagagtatcagcaacaacctgtggaagtacaatcgctacagatatatcatgacctatcacgaaaaaccatggctcccaccacctctgatccttctgagccacgttggactcctgctgcgtaggctctgctgccatcgtgcaccacatgaccaggaggaaggagatgtaggcctgaaactttatctgtccaaagaggacctgaaaaaactgcacgattttgaggagcaatgtgtggagaagtatttccacgaaaagatggaagacgtgaattgttcatgtgaagagagaatacgagtcactagtgaacgagtgaccgagatgtacttccagctaaaagagatgaacgagaaggtatcctttattaaggattcccttttgtccctggactcacaggtagggcatctccaagatctgagcgcgttgactgtagacactctcaaggtgctctcggccgtagacacactccaggaagacgaggcgctgttggctaaacggaagcattccacatgtaaaaagttgccgcattcctggagtaacgtcatctgcgcggaggtgctcggctcaatggagattgccggcgagaagaaatatcagtattactcaatgccctcctccctgcttagaagccttgccggcggcaggcatccgccgagggtccaaagaggagcactccttgagataaccaactccaagagggaggctaccaatgtgcgaaatgatcaggaacgccaagagacacaatcctcaattgttgtgtcaggcgtgtctcccaataggcaggcacactccaagtatggccaattcttactcgtcccaagcaacctgaagagagtacctttctcagcagagacggtcctgccgctgagcagacctagcgtgcctgacgttcttgcaactgagcaggatatccagacagaggtactagtccacctcaccgggcaaacacccgtcgtctcggactgggcttcggttgatgagcctaaagagaagcacgagcctatagcgcaccttctcgacgggcaggacaaggctgagcaggtgcttcctaccctgtcgtgcacgcccgagcccatgacgatgtcctctccccttagtcaggctaaaattatgcagaccggcggtggttacgtgaactgggctttcagtgagggtgatgaaaccggggtcttctccattaagaaaaagtggcagacatgtcttccttccacttgcgatagcgactctagtcgctcagaacagcaccagaaacaagcacaggattcttctttgagtgacaactccacccgtagcgcccagagcagcgaatgttcagaggtcggcccgtggctgcaacccaacacctccttctggatcaaccctttgaggcgttacagaccctttgcgagatcacacagttttagatttcacaaagaggaaaaacttatgaaaatctgtaagatcaagaatctctccggcagcagtgagatcggtcagggcgcttgggtcaaggcaaagatgctgaccaaagaccgccgcctgagcaaaaagaaaaagaatactcaaggtctgcaggtcccaataatcactgtcaacgcctgtagccaaagtgaccagttgaaccctgagcccggtgaaaattccatctcagaggaggagtactccaagaattggttcactgttagtaaattctcccacacgggcgtcgagccctatatccaccagaagatgaagacaaaagagatcggacagtgtgccatccagatctctgactacctgaagcagtcgcaggaagatctcagcaaaaatagcctgtggaacagccggagtactaatctcaacagaaactcattacatgtgatcaaaatgccaatttccagcctgatttctgaaatatctgccagtctgaaaagcccgcaggaaccccaccaccattatagcgcgattgaaaggaataatctgatgcgtctgtctcagactatccccttcacgcctgttcaactgttcgctggtgaagaaatcaccgtttaccgcctggaggagagcagccccctgaatctagataaatctatgtcctcgtggagccagcggggaagggcggctatgatacaggtgctgtctagggaagaaatggacggcggattaagaaaggcaatgagagtggtttccacttggagcgaagatgatattctgaagccaggacaagtttttattgtgaaaagttttcttccagaagtcgtgagaacctggcataagatctttcaggaatcaaccgtgttacacttatgtttaagggagatccagcagcaacgcgctgcccaaaagctgatctatacgtttaatcaagttaagcctcagacaattccttatacgccgcgctttctggaggtgtttctcatctactgtcattcagcgaatcagtggcttacgatcgaaaaatatatgaccggcgaattccgtaaatataataacaacaatggggacgagatcacacctaccaatacactagaagaactcatgctggctttcagtcactggacctacgagtatacacgcggcgagctgctcgtgctggacctacagggtgtgggtgagaatctcactgatcccagcgttataaagcccgaagtcaagcaaagtagagggatggttttcggacccgctaacctgggcgaggatgcaattcggaatttcatagccaaacatcattgcaacagttgttgtcgaaagctgaaattgcccgatctgaagcgaaacgattactcccccgaaagaattaatagcacctttggtctagagatcaagatagaaagtgctgaggaaccccctgctcgcgaaacaggccgcaatagccccgaagatgacatgcagctttag

SEQ ID NO: 138444 - DNA, 5598 bp, Artificial Sequence
  Description of Artificial Sequence: Synthetic coding sequence
atgtcccagaaaagttggattgagagtaccctgactaaacgcgaatgcgtgtacatcatcccgagctccaaggatccccatcgctgtctgcccggttgccagatttgccagcagctcgttcgctgcttctgtggacgacttgttaaacagcatgcttgctttacagcctccctggcaatgaaatactctgatgttaagcttggcgaccactttaatcaggcaattgaagaatggagcgtcgaaaaacacactgagcagtcgccaaccgacgcatatggtgtgatcaacttccaagggggaagccattcctatcgcgctaagtacgtgcggctctcatacgatactaagcccgaggtgattctgcaactgcttctcaaagaatggcagatggagctgcccaaactggtgatctccgtccatggagggatgcagaaattcgagctgcatcccagaatcaaacagcttttaggcaaagggctcatcaaagccgccgtgacaaccggagcctggattcttaccggtggagtgaatacaggggttgccaaacacgtcggggacgctttaaaggagcacgcttcacgctcttcacgcaagatctgtactataggtatcgccccatggggagttatcgaaaatagaaacgatctggttgggagggatgttgtggccccataccagacgttgctgaaccccctctcaaaactgaacgtgttaaataatttacacagccactttattctggtggatgatggaacagtcggtaagtacggggcagaggttagactgcgccgggagcttgaaaagacaattaaccagcagcggattcatgcaagaatcggacaaggcgtgccagtcgtcgcactaattttcgagggaggcccgaacgtcatcctgactgtcctggagtatctccaagaatctccccccgtgccagtagtggtgtgtgaggggacagggagggccgccgacctgctcgcctatatccacaaacaaaccgaggagggcggaaatctgcctgacgccgccgagccggatataattagcaccattaaaaaaacttttaattttggtcagaacgaagctttgcacctgttccagacactgatggagtgcatgaagagaaaggagcttataacagtctttcatatcggaagcgatgaacatcaagatattgatgtcgccattctcacggcccttttgaaagggacaaacgcttccgcctttgatcagctcatcctgacattagcttgggacagggtggacatcgctaagaaccatgtgttcgtgtacggccagcagtggctcgtgggcagtctcgagcaggctatgcttgacgctctcgtaatggacagggtggctttcgtgaagttgctgatagagaatggagtctcaatgcataagttcctaactatcccccgtctggaggagctgtacaatacaaaacaaggacctacaaacccgatgttatttcatctcgttagggacgtgaagcagggcaacttaccgcccggctacaagatcaccctcatcgatatcgggctcgtgattgagtacctgatggggggcacttatcgttgtacgtacacacgcaaacgctttcgcctgatttacaacagcctggggggcaataaccggagaagcgggcgcaacacctccagcagcactccacaacttagaaagagtcacgagtccttcgggaatagagctgacaaaaaggagaaaatgaggcataaccactttataaagactgctcaaccctatcgccccaaaatcgataccgtgatggaggagggcaagaagaaacgcaccaaggatgaaatcgtggatatagatgaccccgagacgaagaggtttccctacccattaaatgagctcctgatctgggcatgccttatgaaaagacaggtcatggcgcgcttcttatggcagcacggtgaagaatctatggccaaggccctagtggcctgtaagatttacagaagtatggcatatgaagccaaacagagtgacctggtagatgacactagcgaggaactcaaacagtactctaatgacttcggccagctggctgtggaactactagaacagagtttccgccaagatgagaccatggccatgaagctgctgacgtacgagctgaaaaactggtccaatagcacttgccttaaacttgcagtctcttctcgtctgcgaccctttgtggcacacacgtgtacacagatgcttctgagtgacatgtggatggggcgtttgaatatgcgtaagaactcttggtataaagtaattttatccatactagttcctcccgcaattctgttactggaatacaaaactaaagccgagatgagccacatcccacagagccaagacgcccaccagatgaccatggatgacagcgaaaacaattttcaaaacatcacagaagaaattcccatggaagtgttcaaggaggtccgaatccttgacagcaatgaagggaagaatgagatggaaatccagatgaagtccaagaaattacccatcacaagaaagttctatgccttctaccacgctcccattgtaaagttctggttcaacacactggcctacctgggattcctgatgctttacacatttgtcgtgctggtccagatggagcaattgcccagcgtccaggagtggatagtgatcgcctatatttttacctacgcgatcgagaaggtcagagagattttcatgagcgaggccgggaaagtgaaccagaaaatcaaagtttggttctccgattactttaatatttccgacactatcgcaataatcagtttctttataggatttggcctccggttcggagcgaagtggaattttgctaacgcttacgataatcacgtgttcgtggccggccgattgatctactgcctgaatattatattctggtatgtgagactgctggactttttagctgtcaatcagcaggccggaccatacgtaatgatgattggcaaaatggtggcaaacatgttctatatcgtcgtgattatggccctcgtccttttgagtttcggagtccccaggaaagctatcctgtaccctcacgaggccccgagttggaccctcgccaaagacatcgtgttccacccttactggatgatcttcggtgaagtgtacgcgtacgaaatcgatgtgtgtgcaaacgattctgttatccctcagatttgtgggccaggcacatggctgacaccttttctgcaagctgtctacctgttcgtgcagtacatcataatggtgaatctgctgatcgccttttttaacaacgtgtacctgcaagtgaaagctattagcaacatcgtgtggaaatatcagaggtaccatttcattatggcttaccacgaaaaacctgtcctgcccccacccctgatcatcctgtcccatattgtcagtttgttctgttgtatttgcaagcgtcggaagaaagacaagacatctgatgggccaaaactgtttctaacagaggaggaccagaagaagcttcacgactttgaggaacagtgcgtggagatgtatttcaacgagaaggatgacaagtttcacagcggaagtgaggagagaatacgggtaacctttgagcgggtagagcagatgtgtatccagatcaaggaggtgggcgaccgagtgaactacataaagaggagcctccagagtctggactcgcagataggccacctccaggatctctcagctctgactgttgacaccctcaaaaccctgacggcccagaaggcgtccgaggcttcaaaggtgcataatgaaattactagggagctatctataagcaaacacttggctcagaatctgattgacgacgggcctgttcgccctagcgtctggaaaaagcacggagtagtgaataccctatcaagtagcctcccccagggagatttggagtcaaacaaccccttccactgcaacattttgatgaaggacgacaaagatcctcagtgcaatatcttcggccaggaccttcctgcggtcccccagcgaaaggaatttaattttcccgaggcaggctcttcaagcggggctctgtttccatccgcggtgtcccctcccgaactccgtcagagactccacggagtggaactactgaaaatttttaacaaaaatcagaagctggggtcctcaagcacatccattccgcacctgtcctcacctcctaccaagttttttgtgtccacgccatcacagccaagctgtaagagccacctcgaaaccggaacgaaggatcaggaaactgtgtgctcgaaggccacagagggggacaacactgagttcggagccttcgtcgggcacagagactcaatggaccttcaacgtttcaaagaaacaagtaataagatcaaaatcttaagcaacaacaacacatcagaaaacactctcaagagggtgtcatcactggctggatttaccgattgtcatagaacgagtattcctgtgcactctaaacaggccgaaaagatcagccgccggccttctactgaagacactcatgaggttgattctaaagcagccctgatcccagattggctgcaagatcggccatcaaaccgcgagatgccaagcgaggagggcaccctcaatgggcttacgagcccatttaaaccagccatggatactaattattattatagtgctgttgagcggaacaacctgatgcgcctgtctcaaagcatcccattcactccagtgccgccgaggggtgagcccgtcaccgtatataggctcgaggagtcatcaccaaacattctcaacaacagcatgagttcctggagtcagttgggcttgtgcgccaaaatcgagtttctgagcaaagaggagatgggcggcggtctgaggagagctgtgaaggtacagtgtacttggagcgagcatgacattctaaaaagtggccatctatatatcataaagtctttcttaccagaagtggtgaacacctggtcctcaatctacaaagaggacacagtcctgcacctatgtctgagagaaatccagcaacagcgggctgctcaaaaactcacgttcgcatttaaccagatgaagccgaaaagcattccatattccccacgattcctggaggtgtttctgctctactgccactcggccgggcagtggtttgctgttgaggagtgcatgaccggggaattccggaagtataacaacaataatggcgacgaaatcatcccaaccaacacgctcgaagaaatcatgctggccttttctcactggacatacgaatacacgagaggggaactgctggtgctagaccttcagggggtaggagagaatcttaccgatcctagtgtcatcaaagctgaggagaaacgtagctgtgacatggtctttgggcctgctaatctgggcgaagacgcaataaagaacttccgggctaaacaccactgcaacagctgctgccgcaagctgaaactgccggaccttaaaaggaatgattacactcccgataaaatcattttcccccaggatgaacctagcgatctgaacctgcagccgggaaattctaccaaagaatcagaaagcacaaacagcgtgaggctgatgctgtag

SEQ ID NO: 138445 - DNA, 3315 bp, Artificial Sequence
  Description of Artificial Sequence: Synthetic coding sequence
atgtctttcagagcggcacgactgtccatgaggaatcgcaggaacgacaccctggactctactcgcaccctctacagctcggcctcacgctccacagatctgtcttatagtgagtcagatctggttaattttatccaggccaacttcaagaaaagagaatgcgtgttttttaccaaagactctaaagctaccgaaaatgtgtgtaaatgcggctatgcgcagagtcagcatatggaaggtactcagattaaccagtctgaaaaatggaattataagaaacataccaaggaattcccaactgacgctttcggagatatccagttcgaaacactggggaaaaaggggaagtacatccgcctgagttgtgataccgacgctgagatcctgtacgagctgttgacacagcattggcacctgaaaacccccaacctagtcatttcagtgacaggcggggcaaagaattttgctctgaagccacgcatgcggaaaattttttcccgcctcatttacatcgcccagtctaaaggagcctggatcctgaccggaggaacccactacggcctgatgaagtatataggcgaggttgttcgagacaacaccatatcacgctccagcgaagagaatatcgtggccatcggaatagcggcgtggggcatggtgtcaaacagggacactctgattaggaactgcgatgccgagggctactttctggctcagtacctgatggacgactttacaagggaccccctgtatattctggataacaaccacacccacctgttgctggttgacaatggctgccatggccatccaaccgtggaggcaaagctgcggaaccagctggagaaatatatctccgaaagaacaatacaggatagcaattacgggggaaagattccgattgtgtgcttcgcccaagggggtggtaaggagactctcaaagcaattaacacaagtatcaagaacaaaatcccctgtgtcgtagtggaaggcagtggccagattgcggacgtgatcgccagcttggtggaggttgaggatgcacttacttcaagcgccgttaaggaaaaactcgtgcgatttttgccccggactgttagtcgactgcctgaggaagagaccgaatcctggataaagtggctgaaggaaattctagagtgcagtcaccttctgactgtaattaagatggaagaagccggtgatgagatcgtttccaatgcaatctcctacgcattgtacaaggcattctctacctccgagcaggataaagacaattggaacggacagttaaaactgctgttagaatggaatcaattggacttggccaacgatgaaatcttcacaaacgacaggaggtgggaaagcgccgaccttcaagaagtgatgttcactgctctgatcaaggataggcccaagttcgtgcgactctttctcgagaacggacttaatctgcgtaagtttctgacacacgacgttctgacagagctcttttccaaccacttctcaaccctagtctacagaaatctccaaatcgcgaaaaatagttacaatgacgccctgctgactttcgtgtggaagctagtggctaacttccgaaggggctttaggaaggaggatcgcaatggccgggacgaaatggacatagagctgcatgatgtttcgcccattacacggcatccccttcaagccctcttcatctgggccatcctgcaaaacaaaaaggagctgtctaaggtgatttgggaacagacaagaggctgtacacttgctgcactcggcgcatctaagctgctaaagaccttagctaaagtgaaaaatgacattaatgcggccggcgagtctgaagagctagcaaatgagtatgagacgagagctgtggagctgttcacagaatgctactcctctgatgaagacttagccgagcaactcctggtgtatagctgtgaagcctggggtggaagcaattgcctcgaacttgctgtcgaggctaccgatcagcactttatagcccagccaggcgtgcagaacttcctttctaagcaatggtatggagaaatctcccgcgacactaagaattggaagattatcctgtgcctgttcatcataccccttgtgggctgtggcttcgtgagcttcaggaagaaacccgtggataagcataagaagctgctgtggtactatgtcgcgttctttacgtccccattcgtggttttcagctggaacgtcgtgttctacatcgcatttcttcttctcttcgcttatgttctgctcatggatttccatagcgttccccatcctcccgaattggtgctttatagcctggttttcgttctgttctgcgacgaggtgaggcagtggtatgtcaatggtgtaaattattttaccgacttatggaacgtaatggacacgctgggcctcttctattttatagctggtatcgtgttccggctgcatagcagcaacaaaagtagtctctacagcggccgggtgatcttttgcctcgattatatcatctttaccctgcgcctgattcatatctttaccgtgtctaggaatcttgggcccaagatcataatgctgcagagaatgctgatagacgtcttcttcttcctgtttctcttcgcagtctggatggttgccttcggcgtggctcgtcaggggatccttcgacagaatgagcagcggtggcgttggatttttagatcagttatctatgaaccttacttagcaatgtttggacaggtgcctagcgatgttgatggaacaacatacgatttcgctcactgtacctttaccggcaacgagtcaaaacctctctgtgtcgaactggatgagcacaatcttccacggtttccagagtggattacaatcccattggtgtgtatctatatgctgtccaccaacattctgttggtaaatttgcttgtggcgatgttcgggtatacggtcgggacggtgcaggagaacaatgaccaggtttggaagttccagagatatttcttggtgcaggaatactgcagcaggctcaatatcccctttcctttcatcgtttttgcatacttttacatggtcgtcaagaaatgcttcaaatgttgctgtaaggagaaaaatatggagtcatcggtgtgctgcttcaagaatgaggacaatgaaactctggcatgggagggggtgatgaaggagaattacctggtgaaaatcaatacaaaagctaacgacactagcgaagagatgcggcatcgtttccgtcagcttgacactaaattgaatgacctaaaagggctcctaaaagagattgcaaacaagatcaagtag

SEQ ID NO: 138446 - DNA, 579 bp, Artificial Sequence
  Description of Artificial Sequence: Synthetic coding sequence
atgaagagcttcttgcctgtgcacactattgtccttatccgcgagaacgtgtgcaagtgtgggtatgctcagtcccagcacatggaaggaacacagatcaaccagagcgagaaatggaactacaaaaagcacacaaaagagtttcccaccgatgcctttggggacatccagttcgagacactgggcaagaaaggtaagtatatcagactgagttgcgacaccgatgccgagatcctttacgagctgctgacccagcattggcacctgaaaacccccaatctggtgatcagtgtgacaggcggcgctaagaactttgcccttaagccaaggatgaggaaaatctttagcaggctcatctatatagcccaatccaagggggcctggatattgaccggggggacccactatgggctgatgaaatatatcggcgaggtggtgcgagataatactatttcccggagttctgaggagaacatcgtcgctataggaatagcggcctggggcatggtttcgaatcgagataccctaatcagaaactgcgatgcagaagttcccgtggggcaggaggaggtgtgttag

SEQ ID NO: 138447 - DNA, 498 bp, Artificial Sequence
  Description of Artificial Sequence: Synthetic coding sequence
atggaaggaacgcagatcaaccagtcagaaaaatggaactacaagaagcacactaaggagtttcccacagacgcctttggagatattcagtttgagacattaggtaagaaggggaaatacatcagactcagttgtgatacggacgctgaaattctgtatgagctgctaacacagcactggcacctgaaaaccccaaatttagtaatcagcgtgaccggtggggctaaaaacttcgctctcaaaccaagaatgcggaagattttcagtagacttatctatatcgcacagtctaaaggggcttggattctcaccggcggaacacactacggcctcatgaagtatataggggaggtcgtgcgcgacaacaccatcagtagatcctccgaggaaaacattgtggctatcgggatcgcggcttgggggatggtatccaatagggataccttgatcaggaactgcgacgctgaagtcccagtggggcaggaagaagtctgctag

SEQ ID NO: 138448 - DNA, 2049 bp, Artificial Sequence
  Description of Artificial Sequence: Synthetic coding sequence
atgcaggccatcaatacctccattaagaataaaattccatgtgttgttgtggagggttccggacagatcgccgatgtgatcgcttctttggtggaggttgaagatgctctgacttccagtgccgttaaagaaaagttggttcggttcctgccgcggactgtgtcgcggctaccggaggaggagactgaatcatggatcaagtggctgaaagagattctggaatgtagtcacctactgactgtcatcaagatggaggaggcgggcgatgagattgtcagcaacgcaattagctacgccttgtacaaagctttcagcactagtgaacaggataaggataattggaacggacagttaaagctgctgctagagtggaatcaactcgacttagctaatgacgagatctttaccaatgatagaagatgggagtccgccgacctccaggaggtaatgttcacggcactgattaaagatcggcccaagttcgttcggctattcctggaaaatggtctcaaccttagaaaattcctgacacacgacgtcctgaccgagttgtttagtaatcacttctctacgttagtgtaccgaaacctccagattgccaagaattcctacaatgatgctcttctgaccttcgtatggaaattggtggccaacttccgcagaggatttcggaaagaggatagaaatgggagagacgaaatggacatcgagctgcatgatgtgagtccaattacgaggcaccccttgcaggccctgtttatctgggcaatactgcagaacaaaaaagaactgtcgaaagtaatttgggaacagactcgcggttgcaccctagcagctctcggagccagcaagttacttaaaacactcgcaaaagttaagaacgatatcaacgctgccggcgagtccgaggaactcgctaatgaatacgagacccgggccgtagaactcttcactgaatgctattcctccgacgaggacttggcggagcagttgttagtgtacagctgtgaggcctggggcggctcgaattgcctggagttggcggtggaagcaacagaccagcacttcattgcgcaacctggcgtccagtggtacgtcaatggagtgaactattttaccgacttgtggaatgtaatggacacgttaggcctgttttacttcatcgctggaatcgtcttccgcctccactcatcgaataagagtagcctgtactctggaagagttatcttctgcctcgactatattatctttacactgagattaatccacatctttaccgtaagtcggaatttgggaccaaaaatcattatgctgcaaaggatgctgatcgacgtctttttcttcctgtttcttttcgctgtctggatggttgcttttggggtcgcacggcagggcattctcagacaaaacgaacagaggtggcgctggatcttcagaagtgtcatctatgagccttacttggcgatgtttggccaggtaccgtcagacgtggatggaacaacctacgacttcgctcactgcacctttacggggaacgaatccaagccgctctgtgtagaactggatgagcataatctcccccgtttccccgaatggatcacaatacccctggtgtgtatttatatgctgtctaccaacattctgctagtgaacctgctcgtggccatgttcggctacacagttggaacagtacaggaaaataacgaccaggtatggaaattccagcggtactttttggtgcaggaatattgcagtcgccttaatatcccctttcccttcatcgtgttcgcttatttctacatggttgtcaaaaagtgttttaagtgctgctgcaaagagaagaacatggagtccagcgtatgttgttttaagaacgaagacaatgaaacattagcctgggagggcgtcatgaaagaaaattacctggttaagataaacactaaggccaacgatacttcggaggagatgcgccacaggttccgacagctggacactaagctgaatgaccttaaagggctcttaaaggagatcgcaaacaagatcaagtag

SEQ ID NO: 138449 - DNA, 2514 bp, Artificial Sequence
  Description of Artificial Sequence: Synthetic coding sequence
atggagactctgacccccggtcacctacagccttcccccagttctcccagacctagggcggcccctggcagtttagggcgagtcacgcggcgacgcctatctaggtggattgctctgacccggaaagtctcctggacacccgcacgcccctcccagtctgccctcctgtccccttctagagggcaggaaacagcccctcctgtccccggctgctgccctcggaccctgtccccacctgctccacgtcgcccatcaggatcaatgatcgcgggcgtcagccttaaaccactgttgcgaattacagcccgcatatggagggcctgctgctcctcatgccggagggccaggagcactagtcagacaactagttccaaggtggcccccgccttaggaagtggcagggcccccgcccttgcatgcccagatccacctttgtgcctgtcggaccctgagacagggaagacctgcctcttaaaagctatgctcaacctgcatgatggacagaataccacaatccctctgctgctcgagatcgctaggcagacggacagcctcaaggaactcgtcaacgcaagctacaccgattcctattacaagggtcagactgccctccacattgcaatagagaggcgaaatatggcactggttacgctgctcgtggagaacggagcggacgtccaggctgctgcacacggagacttctttaagaagaccaagggacgccccggcttttacttcggcgagctccccctgagcctcgctgcctgcaccaatcaactgggtattgtgaagtttctgctgcaaaatagctggcaaacggccgacatctccgcacgggactctgtaggcaacaccgtattgcatgcactggtggaagtagcagacaatactgccgataacactaagtttgtgactagcatgtataacgagatcctgatgctcggggccaaactccaccctactcttaaactcgaggaactaactaacaaaaagggcatgactcctctcgccctggccgccggcactggcaaaattggcgttttagcatatatcttgcaacgagaaattcaggaacctgagtgtcggcatctgtcacggaaatttaccgaatgggcctacggccctgttcactcctctttatatgacctgtcttgtatcgatacctgtgagaaaaattcggtgctagaggttatcgcctactcttcttctgagactccaaatcgacacgacatgcttcttgtggagcccttgaaccggctactgcaggataaatgggatcggttcgtcaagaggattttctacttcaacttcctggtttattgtctctatatgattatcttcacaatggctgcctactatcggcccgtggacggccttcccccgttcaaaatggaaaaaaccggcgattacttccgggtgaccggggagattctgtctgtcctgggaggtgtatactttttcttccggggaatccagtattttctgcagcgccggcccagtatgaaaaccctctttgtcgattcatactctgagatgcttttttttctgcaatcgttattcatgcttgccacagtggtgctttacttctcacacctgaaagaatacgtggcgtctatggtgttctccctggccctcggatggaccaacatgctgtactacacccgcggctttcagcagatggggatctacgccgttatgatcgaaaagatgattctgagggatctgtgccgctttatgttcgtctacattgtttttctgtttggattttccacggcggtggtgactttgatagaggatggcaagaacgatagtctccctagcgagagcacttcccacaggtggaggggtccggcatgtaggccaccagatagtagctataacagcctctatagcacttgtttggaactgtttaagtttacaataggtatgggggacctggaatttacggagaactacgatttcaaagctgtgtttattatcctgcttttagcttatgtaatacttacatatattcttcttctgaacatgctgatcgcgctaatgggcgaaacagtgaacaagattgctcaggagagcaaaaacatttggaagttgcagagagccatcacaatcctcgatacagaaaagagcttcctgaagtgtatgaggaaggccttccgctctggcaagttactgcaagttggatacactccggacgggaaggacgactacaggtggtgtttccgggttgacgaggtgaattggactacatggaatacaaacgtcggcattatcaatgaggatccagggaattgtgagggcgttaaacgtaccttaagcttcagcctacgatcctcccgcgtgtctggccgtcactggaagaattttgccctggtccctttactcagggaggccagtgccagggacaggcagagcgcgcagcccgaggaagtgtatctccggcagttctctggttctctaaaaccagaagacgcagaggtgtttaagagccccgcagcctccggagagaagtag

SEQ ID NO: 138450 - DNA, 2340 bp, Artificial Sequence
  Description of Artificial Sequence: Synthetic coding sequence
atgaaaaaatggtcttccacggaccttggggccgctgctgatcctcttcagaaggatacctgtccagacccactggacggggaccccaatagccggccacctccagccaaaccccagctaagtaccgctaaatccaggacgcgcctctttggaaagggcgattccgaggaagcctttcctgtcgattgcccccacgaagaaggggaactcgatagttgtccaaccatcactgtctccccagtaatcacaattcagaggcctggagatggccctaccggagctagacttttatctcaagattctgtggctgcctccaccgagaagaccctgaggctttacgatcgccgctccatcttcgaagctgttgctcagaacaattgtcaggacctggagtcactgcttttgttcctgcagaagtccaagaaacacctgaccgacaatgaattcaaggaccccgaaaccggaaagacatgtctcctgaaggccatgttgaaccttcacgatggacagaatacgaccatcccgctgttactggagattgctcgtcagacagactctcttaaggagcttgtgaacgcatcctataccgattcatattataaaggacaaaccgcactacatatcgctatagaaagacgaaatatggctctggttacgctgctggtcgagaatggagcggacgtgcaagccgctgcccacggagatttcttcaaaaaaacgaaaggccgcccgggcttttacttcggcgagctcccgctttcactcgccgcatgtacgaatcagctgggcatcgtgaaattcttgctgcagaattcttggcagaccgcagatatcagcgcccgtgacagcgtcggaaatacagttctccacgccctggtcgaggtggcagacaataccgccgacaacactaaatttgtgacctctatgtataatgaaattcttatgctcggggccaagctgcaccccaccttgaagctcgaagaactgacaaacaagaagggcatgaccccactggctttggctgcagggactggtaaaatcggcaaccgccacgatatgctcttagtggaacccctgaatagactcctgcaagacaaatgggaccggttcgttaaaagaatattctattttaatttcctggtgtattgtctgtacatgataattttcacgatggccgcttactatcggcctgtggacggcctcccgcctttcaagatggagaagactggggattacttccgtgttaccggagagatacttagtgtgctgggcggcgtgtatttctttttccgcggcatccagtactttttacagcgcagaccctctatgaagaccctatttgtcgactcatacagcgaaatgctcttcttcctacagtccctcttcatgctcgcgaccgttgtcctgtatttctcgcacctgaaagaatacgtggcaagtatggttttctctttggctctgggctggacaaacatgctctactacacacgagggtttcaacagatgggcatctacgcggttatgatagagaagatgatcctacgggatctgtgtcgtttcatgtttgtgtacatcgtgttcctgttcgggttcagcacggcagtagtgacattaattgaggacgggaaaaatgacagtcttccaagcgagtcaacatcacacagatggcgcgggcccgcatgtcggccacccgactcttcttacaatagcctctattccacctgcctcgagctgttcaagttcacaatcggcatgggggatcttgaatttacagagaactatgacttcaaagccgtttttattatcctgctgctagcatacgtcatattgacttatatactcctgctgaacatgctcatagccctcatgggtgagacagtcaataaaatcgctcaggaatcgaagaatatttggaagcttcagcgcgccatcactattctggacactgagaaatctttccttaagtgtatgcgaaaggcttttcgcagcgggaaactcttgcaggttggctatacccccgacgggaaagacgactatagatggtgctttcgggtggatgaggttaactggactacctggaatacaaatgttggaattattaatgaggatccaggaaattgtgaaggagtgaagcggacactgagtttctccctccgcagctcaagagtgagcgggcggcattggaaaaactttgctctggtgccacttcttagagaagcctcagctcgcgacaggcaatctgctcagcctgaggaggtctacctacgtcagttcagtggcagcctaaagcccgaggacgccgaagtgtttaagtcgcccgctgctagtggtgaaaaatag

SEQ ID NO: 138451 - DNA, 2520 bp, Artificial Sequence
  Description of Artificial Sequence: Synthetic coding sequence
atgaagaaatggtcaagcaccgacctgggcgcagccgctgatcccctgcagaaggatacttgccctgacccgctggatggggaccccaatagtcggccaccacctgccaagccgcaactgtctacggccaagagtcgtactcggctgtttggcaaaggagactccgaggaagctttccccgttgattgccctcacgaggaaggcgaactggattcctgcccaactatcaccgtgagcccagtaatcaccattcaacgtcctggcgacggaccaactggagcccgactcctgagtcaggatagcgtggcggcgagcactgagaaaactctaaggttgtacgaccgtagaagtatctttgaggcagttgcccagaacaattgtcaggaccttgagtctctgctcctgttcctgcagaagtcgaagaaacacctaacggataacgagtttaaggaccccgagacaggcaagacctgtctgctcaaagctatgttaaacctccacgatgggcaaaatacaacaatccctctgctactagagatagctcggcaaactgattccttaaaggagctggtcaacgcctcctacacagattcctactacaaggggcaaacagccttacacatcgcgattgagagaagaaatatggctctcgtgacactgctcgtagaaaatggggccgacgtgcaggctgccgcacatggcgacttttttaaaaagactaaaggtcgccccggcttctattttggcgagctcccattgagcctggccgcgtgtactaaccagctgggcatcgtaaaattcttactgcagaattcttggcagactgccgacatcagcgcaagagatagcgtagggaacaccgtgctacatgcccttgtcgaggtggcggacaacactgctgacaatacaaaattcgtgaccagtatgtacaatgaaatactcatgcttggcgccaagctgcatcccacactgaaactggaggagttgacgaacaagaaaggcatgaccccactcgcattggcagctggcaccggaaaaatcggggtgttggcctatatactgcaaagggaaatccaagagccagaatgtaggcatctgtccaggaaattcaccgagtgggcctacggtccagtgcactcctctctctacgacctctcttgcattgacacgtgcgagaagaactcggtactagaggtgatcgcctacagtagcagcgaaaccccgaatcggcacgacatgctattagtggaaccattgaaccggcttctccaggacaagtgggaccgctttgtcaagcgaattttttacttcaacttcctcgtgtattgtctctatatgattattttcacaatggccgcatactatcgccccgtcgatggtcttccacctttcaagatggagaagaccggagactacttccgagtgactggcgagattttatccgtcctggggggcgtctatttcttttttagaggcatccagtactttctccagcgaagaccatcaatgaagaccctcttcgtggacagctactccgagatgctgttttttcttcaatctctgtttatgctcgcgaccgtggtgctgtacttttcccatctgaaggaatacgtggcatccatggtgttctctttggcactgggctggaccaacatgctgtactacactagaggatttcagcaaatgggcatatacgccgtgatgatagaaaagatgatactgcgcgatctctgccggttcatgtttgtgtatatcgtttttctatttggcttcagcacagctgtcgtgacactcatagaggacggcaaaaacgattcattgccttccgaatctacctcacacagatggagaggacctgcctgcaggccaccagattctagttacaattccctgtatagtacttgtctcgagctgtttaaatttactatcgggatgggcgacctcgaatttaccgagaactacgatttcaaggccgtattcatcattctgctgctggcatacgtcatcctgacatatattctgctgctaaacatgttgatagctctcatgggggaaactgtcaacaaaattgcacaggagtcaaagaacatctggaagctgcaacgggcaattactatcctagacaccgaaaagagtttcttaaaatgtatgcggaaagcctttcgttctggaaagctgctccaggttggttacaccccagatggcaaagacgattaccgctggtgcttccgagttgacgaagtgaactggacaacttggaacacaaatgtggggattattaatgaggaccccggcaactgcgagggagtcaaaagaactctatccttcagcttaaggtcatcaagggtttcaggccggcattggaagaattttgccctagtgccgctcctgagggaggcctccgcgcgcgaccggcaaagcgcccagcccgaagaagtttacttgaggcagttctccggaagcctcaagcccgaggacgctgaagtgttcaagagcccagcggcaagtggggagaaatag

SEQ ID NO: 138452 - DNA, 2520 bp, Artificial Sequence
  Description of Artificial Sequence: Synthetic coding sequence
atgaaaaagtggagtagcaccgatctgggtgccgctgccgatcccttgcagaaagacacttgtcccgaccccctggacggcgatccaaactctcggccaccccctgctaagccacagctttcaacagccaaatcacgcacccgcctgtttggaaaaggggatagcgaggaggctttccccgtggactgtccccacgaagaaggcgaacttgacagctgccccacgatcacagtcagccccgtcatcaccattcagaggccaggcgatgggcctaccggggcacgcctgctttcacaggattccgtggccgcaagtactgagaagacgctcaggctgtacgaccggagatctatctttgaagcggtggctcaaaataactgtcaggacctcgaaagcctcttacttttcctgcagaaaagcaaaaagcaccttactgacaatgagtttaaagaccctgaaacaggcaaaacctgtcttttaaaagcaatgctgaacttacacgatggccagaacactaccattcctttattgcttgaaattgccaggcaaacagatagcttgaaggagctcgttaacgcgtcctacactgattcatactataagggtcagacagcattgcatatcgccattgagagacggaatatggcgctggtgactttgctggtggagaatggcgccgacgtccaagcagccgcccatggggacttcttcaaaaaaaccaaggggcggcctggtttctatttcggcgaactgccactctcactcgctgcctgtacaaatcagctgggtatcgtgaaattccttctgcaaaacagttggcagacggccgatattagtgcccgcgacagtgtgggcaatacggtgctgcacgccctggtggaagtggcagataacactgctgataacacgaagttcgtgacaagtatgtacaatgaaatcctgatgctgggagcaaagctccatccgaccctaaaactggaagaattgaccaacaaaaaaggcatgacgcctctcgccctggcagccggaacagggaagatcggcgtgttagcatacatcctgcagagagaaatccaggagcctgagtgtaggcatctgtcaaggaaatttaccgaatgggcatatggaccagtgcactcgagtctgtacgatcttagttgtattgatacatgcgaaaagaattctgttcttgaggtgatcgcctacagttcttcagaaactccaaatcgacacgacatgcttttggtagagccgctgaatcgacttttacaagacaagtgggacaggttcgttaagcggattttctactttaactttctggtctattgtctgtatatgatcatattcaccatggcagcttactatcgtcctgttgacggcctgcctccctttaagatggagaagacaggggactatttccgagtcaccggggagattcttagtgtcctcgggggggtatattttttcttccgcggcatccagtactttctgcaacgcagacctagtatgaagaccctgtttgttgattcttatagtgagatgctgttttttcttcagagtttgtttatgttggccactgtggtgctatatttttcccatctcaaggaatacgtggcatctatggtcttcagcctggcacttggctggactaatatgctgtattatacccggggattccagcaaatgggcatttatgccgtgatgattgaaaagatgattctgcgagacctgtgtcggttcatgttcgtttatatcgtgttcctgtttggtttttcaacggcagttgtgaccctgattgaagacggaaaaaatgattccctgccttctgaatcgactagccaccgctggagggggcctgcatgccgaccgcccgactcaagctacaattccctgtattctacatgcctggagctgttcaaatttacaatcggaatgggggacctcgagttcaccgaaaattacgactttaaagctgtatttataatcttgttgctagcctacgttattctgacctacattctgttattaaatatgctcatcgcactgatgggcgagactgttaataagatcgcccaagagagcaaaaatatatggaagcttcagcgtgccatcaccatcttagacacagaaaagtcttttctgaaatgcatgagaaaagcctttcgatctgggaaattgttgcaagtggggtacacacctgacggaaaagacgattaccgctggtgtttcagggtggatgaggtcaattggacaacatggaacaccaatgtcgggattatcaacgaggatccaggaaattgcgagggagtgaaacgcaccctgtccttctcgctgcgaagctctcgggtgtccggccggcattggaaaaactttgccctagttcctttgctccgggaagcctcagctagggatcgccaatcagcacagcctgaagaagtgtatttgagacagttcagtggatccctgaaacctgaagacgccgaggtctttaagtcccctgcagctagtggcgaaaaatag

SEQ ID NO: 138453 - DNA, 2553 bp, Artificial Sequence
  Description of Artificial Sequence: Synthetic coding sequence
atgaagaaatggtccagtactgacctgggtgcggccgccgatcctctacaaaaggatacatgtccagacccactcgatggcgaccccaatagccgccccccgccggccaagccccaactaagtacggccaagagcagaactcgcctgtttggcaaaggtgacagcgaggaggcctttcccgtggactgcccccatgaggagggcgagttagattcctgccccactataactgtttctcccgtgattactatccagaggccgggggatggtcccacaggcgccaggctcttgagccaggacagtgtggccgccagcactgaaaagaccctgaggctatatgatcggcgcagcatatttgaagccgtggcacaaaacaactgccaggacctggagtcgctcttactgttcttacagaaatccaaaaaacacctgaccgacaatgaatttaaggaccctgagactgggaagacctgcttactgaaggccatgctgaacctgcatgacgggcagaacaccacaatccccctcctgctcgagattgctcgccagaccgacagtctaaaggagttggtcaatgccagttacactgactcctactataaggggcagacggccctgcatatagccattgagaggaggaatatggcccttgtcaccctcttggttgaaaacggcgccgatgttcaagctgccgcgcatggggactttttcaagaaaacaaaaggcagacccggtttctactttggcgagctgcctttgtcactcgctgcctgtacaaaccagctgggtatagtaaaatttctcctgcagaattcctggcagacggccgatatctccgccagagattcagtggggaatactgtcctccacgccctggtggaggtcgcagacaatactgctgacaatacaaagttcgtgaccagcatgtataacgaaattctgatgctgggagccaaacttcatcccacgttaaagttggaggagcttacaaacaagaaagggatgacacccttggccctggccgctgggacggggaagatcggggtcatcgaaaacggccctcccctctctttcatggtcctggcatatatccttcagagagagatccaagagcctgaatgcagacatctttcccgtaagttcactgagtgggcgtacggtcctgtgcattcgagcctatacgacttgagctgcattgatacatgcgaaaagaactcggtactggaagtaatcgcttactcctcatccgagacccccaataggcacgatatgcttctggtggagccgctgaacaggttactccaggataagtgggacagattcgtgaagagaatcttttatttcaacttccttgtttattgtctttacatgatcatattcacaatggccgcttactaccgtcctgtcgacgggctccctccttttaaaatggaaaaaacaggcgactatttccgcgtcaccggcgaaatcctttccgtgcttggaggcgtctactttttctttcgcggcatccagtatttccttcaacgccgtccaagcatgaagacgctcttcgtggacagttacagcgaaatgctcttcttccttcagagcttgttcatgctggctacggttgtcttgtatttttcccacttaaaggagtacgttgcctctatggtgtttagtctcgcactgggctggacaaacatgctgtattatacccgcggcttccaacagatgggaatctatgccgtgatgatcgaaaagatgatcctccgcgatttatgccggttcatgttcgtttacatcgtgtttctcttcggtttttcaacagcagtagtgacgctgatcgaagatggtaagaacgacagcctgccgtccgaatcaacatcccacaggtggcgtggccctgcctgtcgcccacctgattctagctacaatagcctttactccacttgccttgagcttttcaaattcacaattggtatgggtgatctggaattcacagaaaattacgatttcaaagcggtcttcatcatcctactgcttgcttacgtgatcctcacctatatcttactcctgaatatgctaattgcactgatgggtgaaacggtgaacaaaattgcgcaggagagtaagaatatctggaaattacagagagcaattacgatcctggatacagagaaatctttcttgaaatgcatgcggaaagccttccggtcgggaaaacttctgcaggtgggatacacgccggatgggaaagacgactatcgctggtgctttagggtcgacgaagttaattggacaacgtggaataccaacgttgggattattaatgaggatccaggcaattgcgaaggggtcaagcgtactctatccttcagccttaggtcctccagagtgagtggacgccactggaagaatttcgctctggttccactcctgagagaggcgtccgctcgtgaccgtcagtctgcccagccagaggaagtgtaccttcggcaattcagcgggagtctcaaacctgaggacgccgaagtgtttaagagcccagccgcttcaggggagaagtag

SEQ ID NO: 138454 - DNA, 2295 bp, Artificial Sequence
  Description of Artificial Sequence: Synthetic coding sequence
atgacaagtccgagtagctcccccgtgtttcggctcgagacactagatggaggccaggaagacggatctgaagcggaccgcggtaagttggatttcggctctggactgcctcctatggagtctcagttccagggcgaggaccgtaagtttgctccccagatcagggttaacctgaattacagaaagggcactggggcaagccagcctgacccgaacagatttgaccgggataggctctttaatgccgtctcaagaggcgtcccagaagacctggccggcttgcctgaatacttgagtaaaactagcaaatacctgacagattctgaatacaccgaggggagcacaggcaagacctgcctcatgaaagcagtccttaatctgaaggacggggttaatgcttgtatccttcccctcctgcaaatcgatcgtgactcagggaacccgcaacccttagtcaacgctcagtgtacggatgactattatagaggtcactccgccttgcacatagctattgagaaacgttctctacagtgtgtgaagctgctggtcgagaatggtgctaatgtccacgccagagcttgtggtcggttttttcagaaggggcagggcacctgcttctatttcggtgagctccctctgtctctcgcggcctgtacgaagcaatgggacgtcgtctcatacttgctggagaacccccaccaacctgcctcactgcaggctacagatagccaggggaataccgtcctgcatgccctggttatgatcagcgacaactccgccgagaacattgcacttgtgacatccatgtacgatggcctgctccaagcaggcgcccgtctgtgcccaaccgtccagctggaagatatccgcaatttacaggacctgacgccactgaagcttgcggcgaaagaagggaagatagagattttcagacacatccttcagagggagttcagcggtctttcccacctatcgcggaagtttaccgagtggtgctatggaccagtccgtgtttccctttacgatctagccagcgtggatagctgcgaggaaaactctgtgctcgagatcattgcctttcactgcaaatctcctcaccggcatcggatggtagtcctggagcccctgaacaagctgctgcaggcaaaatgggatttgttaataccgaaattctttttgaactttctctgcaatctgatctatatgtttatcttcactgccgtcgcctatcaccaaccaaccctgaagaaacaagcagcaccgcacctgaaggccgaagtggggaattcaatgctgctcacaggtcatattctgatcctactgggcggaatttacctgttggtggggcagctgtggtatttttggcgcagacacgttttcatttggattagctttatagattcttactttgaaatccttttccttttccaagctctgcttacagtggtgtcacaggtgctctgtttcctggcgatcgaatggtacctaccccttctggtgtccgctctggtccttggctggttgaatcttttgtactacaccaggggatttcaacacaccggcatctactcggtcatgatccagaaggttatcctgcgcgacctgctcagattcctgctgatttatctggtgttcctgttcgggtttgccgtggctctcgtcagcttgtcccaggaggcttggcgtcctgaagcccctactggaccaaacgctaccgagtccgtacagcctatggagggacaggaggacgaggggaacggggcgcaataccgcggaattttagaagcgtccttagagctgttcaaattcaccattggtatgggggaattggcattccaagagcagctgcacttccggggcatggtcctcctgctgttgctggcttacgtgctgcttacatacatcctgctgctaaacatgctaatcgctctcatgtcagaaacggtgaacagcgttgcaactgacagttggtccatctggaagcttcagaaagcaatctcggttctggaaatggaaaacgggtactggtggtgtcggaagaaacagcgcgccggcgttatgctcaccgtgggaaccaaaccagacggatcccctgatgagcgctggtgctttcgtgttgaggaagtcaattgggcgtcctgggaacagacactccccaccctgtgtgaggatccaagcggtgccggggtgcctagaacactggaaaatccagtcttagcctcgcccccgaaggaggacgaagacggcgcatcggaggagaactatgttcccgtgcaattgctccagtcaaattag

SEQ ID NO: 138455 - DNA, 801 bp, Artificial Sequence
  Description of Artificial Sequence: Synthetic coding sequence
taagatttttccctgggagttccatcctggtggtgcctcatctgtttcaatatcggaccgtccgtcggcccttcccagcctgaccctaatcgctttgaccgggaccgtctctttaacgcagtgtcccgaggtgttcctgaggatctggccggtcttccagaatacttgtctaagacctccaagtatctgacagactctgaatacacagagggctcaaccggaaagacatgtctgatgaaggccgtcctcaatctcaaagacggcgtcaacgcgtgtattctacctctgttacagatcgatagagatagcggcaatccacagcctcttgtcaatgcccaatgtactgatgattattacaggggacattccgccctccacatcgctatagaaaagcgcagcttgcaatgtgtcaaactactcgtggagaacggcgctaatgtgcacgctagggcttgcgggaggttcttccagaaaggccagggcacttgtttttattttggcgagctccctctcagcctagcagcatgtacaaaacagtgggatgtggtgtcttacctcttagaaaatccgcaccagcccgcgtccctgcaggccactgattcgcagggcaacaccgtccttcacgcgctcgtgatgatctccgacaactccgctgagaatatagctctcgtaacctcgatgtacgatgggctccttcaagcaggcgcgcgcctgtgcccgacggtgcagctggaagacattcgcaatctgcaggatctgacgcctctgaagctcgctgcaaaggagggcaaaatcgagtag

SEQ ID NO: 138456 - DNA, 2373 bp, Artificial Sequence
  Description of Artificial Sequence: Synthetic coding sequence
atgaaggcacatcccaaagagatggtgccactaatggggaagagagtagccgctcccagcggcaacccggcaatacttccagagaaacgcccggccgaaataactcctacaaaaaagtccgctcatttcttccttgagatcgaggggtttgagcccaaccctacagtggctaagacaagccccccggtgttcagtaaacctatggacagtaatatccgccagtgtatttccggaaactgtgacgatatggattcaccccagtctccccaggatgatgtgacagaaacccctagcaatcccaattcaccttctgctcagctcgctaaagaggagcaacggagaaaaaagcggcgattgaagaaacgtatttttgcggctgttagtgagggttgcgtggaagagctcgtggaactgctggtggaactgcaggaattgtgtaggcggagacacgacgaggatgtgcccgatttccttatgcacaagctgacagccagcgacactgggaagacttgcctgatgaaggcactgctgaatatcaacccgaatactaaggagattgtgcgcattctgctggcctttgccgaggagaatgacatccttggccgcttcattaatgccgagtatacggaggaagcctatgagggccagactgccctgaacatagcaatcgaaagacgacagggcgatattgccgccctgttgatcgcagctggggcagacgtcaacgcccacgccaaaggagctttcttcaatcccaaataccaacatgagggcttttacttcggagaaacacccctggcgctggctgcctgtactaatcagccagagatcgtgcaactgctaatggagcacgagcaaacagatatcaccagtagggacagtcggggaaacaatattctccatgccctggttactgttgctgaagactttaaaacccagaatgatttcgtcaagagaatgtacgatatgatactgctgcggagtggtaattgggagctagagactacaaggaacaatgacggtctgacccctttgcagttggcggctaagatgggcaaggcagagattctcaaatacatcctgtctagggagatcaaagaaaaacggctgcggtcattaagtcgcaaatttaccgattgggcttacgggcccgtctcgtcctccctatacgatctgacgaacgtcgacacgacaaccgataactccgtcctggagatcacagtgtacaacactaatatcgataacaggcacgaaatgctaactctggagccacttcataccctactgcatatgaagtggaaaaagtttgcaaagcatatgttcttcttgtctttctgtttctacttcttctacaacatcacactcaccctcgtgagctactaccggccgagggaagaggaggccatcccacatccgctggctctgacacacaagatggggtggctccagctgctgggtcgaatgtttgttctcatatgggctatgtgcatttcagtaaaagagggtatagccattttcctactgcgccctagcgatctgcaatcgattctgtctgacgcctggtttcatttcgtgttcttcattcaggcagtgctagtgatactaagcgttttcctgtacctctttgcctacaaggaatatctggcatgcttagttctggccatggccttggggtgggccaacatgctctattataccagaggctttcagtccatggggatgtactccgtaatgattcagaaggtaattctacatgatgttctcaagttcttgttcgtgtatatcgtctttctcctgggctttggagtagctctcgcgtctctaatcgaaaagtgtcctaaagataacaaggattgtagctcttacggatccttttcagacgcagtactggagcttttcaagctcacgatcgggttgggggacttaaacatccagcagaactccaaataccccattctgtttctcttcctcctcatcacatatgttatacttacctttgtgcttctcctcaacatgctaatcgctctgatgggtgagacagtcgagaacgtgagtaaagaatcagagcgcatttggcggctgcagagggcccgcactatcctagagtttgagaagatgctgcctgaatggctccgcagtcggtttaggatgggcgagctgtgtaaggtcgctgaggacgactttcgcctgtgcttgaggattaacgaagttaaatggactgagtggaaaacgcacgtgtctttcctgaatgaagaccctggaccagtgagacgcactgattttaataaaattcaggacagctctagaaataacagtaagacaacattaaacgctttcgaggaggtagaggaattccctgagacaagcgtttag

SEQ ID NO: 138457 - DNA, 2376 bp, Artificial Sequence
  Description of Artificial Sequence: Synthetic coding sequence
atgaaggcacatccaaaggagatggtgcctctgatggggaagagggtagctgccccgtcaggcaaccctgccatcttgccagagaagcgccctgctgaaatcacacccaccaagaagtctgcacacttctttctggagatcgaaggcttcgaacccaaccctactgtcgctaagacaagcccccccgtgttcagcaagccaatggactccaacatacggcaatgcatttcaggtaattgcgacgacatggacagtcctcaatctccacaggacgatgtgaccgaaaccccgtcaaatcctaattctccgtctgcccagctcgcgaaggaggaacagagaagaaagaagcgacggttgaagaaacgtattttcgccgcggtgagtgagggatgtgtggaggagctggttgaattactagtggagttgcaggaactgtgtaggagaaggcacgacgaggatgtgccagacttccttatgcacaagctcacagcttcagacacagggaagacatgcctcatgaaggccttgctgaacatcaacccaaacaccaaagaaatcgtacggattctactggccttcgctgaagaaaacgatatcctgggcagattcataaatgccgagtataccgaggaagcttacgaagggcagacagctctgaacattgctatcgaacgacgccagggcgacatagccgccctgctgatagccgcgggtgccgacgtgaacgcccatgccaagggggcctttttcaacccaaaatatcagcacgaggggttctacttcggggaaacaccactagccttggcagcatgtacgaaccagcctgagatcgtacagctgcttatggaacatgagcagacagatatcacatcgagagacagccgtgggaataacattctgcacgctttggttaccgtggcggaggacttcaaaacacaaaacgatttcgtcaagcggatgtacgacatgatcctgcttcggtcggggaattgggaactggaaactacccgcaacaacgacggcctcactcccttgcagctggcagccaagatggggaaggcagaaattctcaaatacatactatcaagggagatcaaggaaaaacgcttgagaagcttgtctcggaaattcacagattgggcctacggccctgtgtcttccagtctgtacgatctgaccaatgtcgatactactaccgacaactccgttctggaaatcactgtgtataacacaaacatcgataaccggcatgagatgctgactctggaacctttacatacgctgctgcacatgaagtggaaaaagttcgccaagcacatgttttttctgtctttctgcttttactttttttacaacattaccctgaccctcgtgtcttactatagacctcgcgaggaggaagctattccccaccctctggccttgactcacaaaatgggatggctacaacttctaggtaggatgtttgttctgatctgggccatgtgcattagtgtgaaggagggcatagctatcttcttgctgaggcccagcgatctgcagtccattttgtcagacgcctggtttcacttcgtgttctttatccaggccgtgttagtaatcctatctgtttttttatacctttttgcgtacaaagagtatctcgcgtgtctcgtgcttgcaatggccctcggctgggctaatatgttgtattacacacgcggcttccagtcgatgggaatgtactccgtaatgatccagaaggtgatacttcacgatgtgcttaagtttcttttcgtatatattgtctttctcctgggctttggagtggctttggcatccctcattgagaaatgtccaaaggataacaaggactgctctagctatggctccttctctgacgctgtgctggagctatttaagctgactataggcttgggagatctcaacatccagcagaactctaagtatcccatactgtttctctttctcctgatcacttacgttatcctgaccttcgtgctgttgcttaatatgctcatagccctgatgggagagaccgtggaaaatgtcagcaaggagtccgaaaggatttggcgcctgcagcgtgcaaggaccatcctcgagtttgagaagatgcttcccgagtggttaagatcccgcttcagaatgggcgaactctgcaaagtcgccgaggatgactttcgactgtgtttgagaattaacgaggtaaagtggaccgagtggaagacacacgtttctttcttgaatgaggaccctggcccagtccgaagaacggctgacttcaataaaatccaagattcttcaagaaataatagcaaaacaaccttgaatgcgtttgaggaagtggaagaatttcctgaaacaagtgtgtag

SEQ ID NO: 138458 - DNA, 2328 bp, Artificial Sequence
  Description of Artificial Sequence: Synthetic coding sequence
atgagccatcacacttggcccagcccagctctgaatcttgacttcgcaacgtacctgttgagagaccttggtgcacacttcttcttagaaattgagggctttgaaccaaatccgacggtcgcaaagacgtcccccccagtttttagcaaaccaatggactcaaacattcggcagtgtatctctggaaattgtgacgatatggatagcccacagtctccccaggatgacgtgaccgagacgccctctaatccgaactctccatcagctcaactggctaaggaggaacagagaagaaagaagcggcggcttaagaaacgaatctttgcagcagtgagcgagggatgcgtcgaggagctcgttgaactgctagtcgagctgcaggagttgtgtcgaaggagacatgacgaagacgtacccgattttctgatgcacaagctgaccgcttcggataccgggaagacatgccttatgaaggctctactgaacattaatcccaatactaaggaaattgtgagaatactcctcgcctttgctgaagagaatgatatcctggggagattcatcaacgccgaatacaccgaggaagcgtatgagggacagacagctctgaacatcgcaatagaaaggcgccagggtgacattgctgctctacttattgctgcaggcgcagatgttaatgcccatgcgaaaggggccttcttcaatccaaagtatcaacatgagggtttttattttggcgagacccccctcgcccttgcagcttgcacaaatcaacctgagattgtgcaactgttaatggagcacgagcagaccgatatcacgtcccgggactcgcggggcaataacatcctgcatgctcttgtgactgtcgctgaagattttaagacccagaacgatttcgtgaagcgtatgtacgacatgatcctccttcggtccggcaactgggagctggaaactacccggaacaacgatggacttactcctctacagctggcggcaaagatgggaaaggctgaaattctgaaatacatccttagccgcgagataaaggagaaacggctgagaagcctgagccgcaaatttactgattgggcatacggacctgtgagcagtagtctatatgatctaacaaatgtggacacaactactgataacagcgtactggagatcacggtgtacaataccaacattgacaacagacatgaaatgctgactcttgaaccattacacaccctgttgcacatgaaatggaagaagtttgcaaagcacatgttctttctgagcttttgcttctactttttctacaacattaccctgacactggtcagttattaccggcctagagaagaggaagcaatcccacatcccctggctttaacacataagatgggctggctgcaactgctggggcggatgtttgtgctgatatgggcgatgtgcatctctgtgaaagagggtattgccatctttcttctgcgaccttctgaccttcagtcaatcctcagcgacgcttggtttcacttcgtcttcttcatccaagccgtactggtgatcctgagcgtgtttctgtatctgttcgcctataaggagtatctggcctgtctggtgctcgccatggctcttgggtgggcaaacatgctgtattatactaggggcttccagtctatgggcatgtattccgtgatgatacagaaagtgattctccatgatgtattaaagtttctttttgtgtacatcgtgtttctgctcgggttcggtgtcgccctggcatcccttatcgaaaaatgtcccaaggacaataaggactgtagcagctatggaagttttagtgatgctgtgctggagttgttcaagctgacgatcgggcttggggatctgaacatccaacagaacagcaaatatccaattctgttccttttcctcctgatcacgtacgtgatcctcactttcgttctgttattaaacatgctaatcgccctcatgggggagaccgttgaaaacgtttccaaagagagtgagaggatctggcgtctgcagagagcgcgcaccatcttggagttcgagaaaatgctgccagagtggctgcgatccaggtttcgcatgggcgagctgtgcaaggtggccgaggacgatttccgactttgccttcgcatcaacgaagtcaaatggactgagtggaaaacacacgtgtcctttcttaatgaagacccggggcccgtgcggcgcacagctgattttaacaaaattcaggacagctcacgaaacaactcaaagaccacattgaacgctttcgaagaagtagaggagtttcctgaaacctcggtttag

SEQ ID NO: 138459 - DNA, 2616 bp, Artificial Sequence
  Description of Artificial Sequence: Synthetic coding sequence
atggctgatagctctgaggggccgcgggccggccccggcgaagtggccgaattgcccggggatgagagcggcacccctggaggagaagccttcccgttaagttcacttgcgaatctgtttgaaggagaagacggctctttgagtccctcacctgccgatgcctcgcgacccgcggggcctggtgatggtagacctaacctgcgtatgaagtttcagggggccttccggaaaggagttcctaaccctatagatttgctggaatccacactatacgagagtagcgtggtccccggaccaaagaaggcaccaatggattcactgtttgattatgggacttacagacatcactccagcgacaacaaacgatggcgtaaaaaaatcattgagaaacagccgcaaagtcctaaggctccagctccccagcccccacccatcctcaaagtctttaataggcccatcctgttcgatatcgtgagtcgcgggtctaccgccgatctggacgggttattgccatttctccttacacataaaaaaaggctcacagacgaagagttcagagagccctcgacagggaagacatgtttgcctaaagccctgctcaatctcagtaatggaaggaatgataccatacctgtgttgctggatatagcagagcgaaccggaaacatgagggaattcattaacagccccttccgagacatatactaccggggacagactgcactgcacatagcgattgagcgaagatgtaagcactacgttgagctgctagttgctcagggagccgacgtgcatgcccaggcaaggggtcgttttttccagccgaaagatgaggggggttatttctatttcggtgaactccctctgagtcttgccgcttgtacaaatcagccacatattgtgaactatctcactgagaatccccataaaaaagctgacatgaggaggcaggactctcgcgggaacacagttcttcatgccctggttgctatcgctgacaacactagggaaaataccaagtttgtgaccaaaatgtacgatttgctgctgttgaaatgcgcaagactattcccagattccaacctggaagctgtcttgaataacgatgggctgagtccactcatgatggctgcaaagacaggcaagatcggcatctttcagcacattattcgcagggaggtgaccgatgaagacacaagacacctgtcacgaaagttcaaagattgggcctatggacctgtgtattcctcgctttacgatctttctagtttagacacctgcggagaggaagcatccgtcctggagatcctcgtttacaattcaaagatagaaaaccggcatgagatgttggctgtggagccaattaacgagctgctgagagacaaatggcgtaaattcggagccgtgtcgttttatatcaatgtggtgagctatctgtgcgcaatggtcatcttcactctaacagcttattaccagcctctcgagggaactcctccatacccctacagaaccactgttgactacctgagactggcaggggaggtaatcacacttttcacgggcgtgctttttttttttactaacattaaggatctgtttatgaagaaatgtcccggggtgaattctctgttcattgacggatcctttcagttgctctacttcatctattccgttctggttatagtttccgctgctctctacttggccggcattgaggcatacttggcagtgatggtgtttgcgctggtactgggctggatgaatgcattgtattttactagggggctgaagctgactgggacatactccattatgatccagaagatcttattcaaggatctgtttcgctttcttctcgtgtatctcctgtttatgataggttatgccagcgctctggtgtcactgttgaacccatgcgccaacatgaaggtctgcaatgaagatcaaactaattgtacagtccctacctatcctagctgtcgggattccgaaacattctccacttttctgctggacctgtttaaacttacgataggtatgggcgatctggagatgcttagctccacaaagtatcccgtcgtcttcataattctgctggtgacatacattatcctcaccttcgttctactactcaatatgctcatcgccttaatgggagagacagttggccaagtgtcaaaggagagcaaacacatttggaagctacagtgggccacaaccatcttggacatcgagcggagctttccagttttcctgaggaaggcctttcgttctggagagatggtcactgttggaaagagctcagatgggaccccagaccggcgctggtgctttcgcgtagatgaggtgaactggagtcattggaaccagaacctggggattattaatgaagatccagggaaaaacgagacctatcaatactacgggttttcacatactgtcggacggcttaggagagatcgttggtctagcgtggtgcctagggtcgtggagctgaacaaaaactcaaacccagatgaggtcgttgtcccacttgactccatggggaacccccgttgcgatgggcaccagcaagggtatcctcgcaaatggcgaaccgacgacgctccactttag

SEQ ID NO: 138460 - DNA, 2436 bp, Artificial Sequence
  Description of Artificial Sequence: Synthetic coding sequence
atggccgactcatctgaagggcccagggctgggccaggtgaagtggccgaactgcccggtgatgagtctggtacaccgggcggggaagctttccctctgtcgagcctggccaatcttttcgagggagaagatggctccctgtcaccatctcctgccgacgcttccaggcctgcaggaccaggagatgggcggcctaacctgcgaatgaaatttcagggggccttccggaagggggtcccgaaccctatcgacctgcttgaatctaccctgtacgagtcttcggtcgtgcccggccccaaaaaggctcccatggacagcctctttgactatggcacataccgtcaccattcttctgacaacaaacgctggcgaaaaaaaattattgaaaagcaaccccagagtcctaaggcccccgcacctcagccacccccaatcctaaaagtgtttaatcggcctattctttttgatatcgtgagtcgcggatctaccgcggatctggatggcctgcttccatttctgctgactcataagaaaaggcttaccgatgaggagttccgagaaccaagcacaggtaaaacctgtttacctaaagccctgctgaatctgtccaacggcagaaacgatacaattcccgttctcctggacattgctgaaagaactggcaacatgagagagtttatcaattctccgtttcgggacatctattacagggggcagacagccctgcacatcgcaatcgaaagaaggtgtaagcactacgtcgaactgctcgtggcccagggcgccgacgttcacgcccaggccagaggcaggttcttccagccgaaagatgagggcggctatttttatttcggcgaattgcccctgagtctggccgcctgtacaaaccaaccgcatatcgtgaactacctgactgagaatcctcataagaaagccgatatgcgccgacaggacagcagaggcaatactgttcttcatgcgcttgtggccattgccgacaatacccgggaaaatactaagttcgtaacaaaaatgtacgatcttcttctcttgaaatgcgcgcgattgttcccggactcgaatttagaggctgtgctgaataacgatggtctctccccccttatgatggctgctaaaacaggcaagatcggtaatcgacacgagatgttggccgtggaaccgatcaatgagctcctgcgggacaagtggagaaagtttggggctgtgtccttctacatcaacgtggtcagctacctgtgcgccatggttatctttacactgactgcctattaccagcccttggaagggaccccgccatatccctatcgcaccacggtcgactaccttcgactggccggtgaagtgataaccctgttcacaggcgttctgttctttttcaccaacataaaggacctgttcatgaagaagtgccctggggtaaactcactctttatcgatgggtccttccagcttctgtactttatttattccgtgctggtgatcgtgtctgctgccctgtatctggctggaatcgaagcctacttggcggtaatggtattcgccctggttcttggatggatgaatgctctgtatttcaccagagggctgaaattgactggaacgtacagcattatgattcagaaaatcttgtttaaagatttgtttaggtttcttttagtctatttattattcatgatcggctatgccagtgccttggtttctctactcaacccttgtgctaatatgaaggtgtgtaatgaagatcagaccaactgcacggttccaacctatccctcctgcagagatagtgaaaccttttcgactttcctgctcgacctgttcaagctcacgattgggatgggcgatctggaaatgctatccagcacgaagtaccccgtagtctttattattcttctggtgacgtacattatattgacctttgtcctgttgttaaatatgctcatcgctcttatgggagagactgttggccaggtctccaaggagagcaagcacatttggaagcttcagtgggctaccactattctcgatatagaaaggagttttcccgtgttcctaaggaaagcgtttaggtctggggagatggtaaccgtgggcaagagcagtgatgggacaccggatcgacggtggtgcttcagagttgatgaggtgaattggtcgcactggaatcagaacctggggataatcaacgaggaccctgggaaaaatgagacctatcagtattatggttttagccatacagtcggccggctgaggcgagacagatggtcctccgtcgtgccaagggttgtggagttgaacaaaaactccaaccctgatgaagtggtggtgcccttagattcaatggggaaccccaggtgcgacggccatcaacaggggtacccaaggaaatggagaaccgatgatgcaccgctgtag

SEQ ID NO: 138461 - DNA, 2475 bp, Artificial Sequence
  Description of Artificial Sequence: Synthetic coding sequence
atggccgattccagcgaagggccgagagccggccctggcgaggttgcagagctgcccggggacgagtccggaacaccgggtggggaggcctttccgctttcaagcctggccaatctttttgagggcgaggatggcagcctgagtccttctccagcagatgcctcccgcccagccggccctggtgatggcaggcctaatctccgcatgaaattccagggagcctttaggaagggggtccctaatccgatcgatctgttagagagcactctctacgagtcctctgtcgttcccgggcctaagaaggctcccatggacagcctgtttgactacgggacctacagacatcatagcagtgataataagcggtggagaaaaaagattatcgaaaaacagcctcagtctcccaaggcccctgcaccacaaccgccacctatcttaaaggtgttcaacaggccgatacttttcgacattgtctcaagaggatccactgctgatctggacggacttctgcccttcctcctgacccataagaagcggctgactgacgaagagttcagggagccttcaactggcaagacatgtctccccaaggctcttctgaatctatccaacggaaggaatgacacaatcccggtgctgctcgacatagctgaaagaacagggaatatgcgagagttcatcaactcccctttccgcgacatttactaccgaggcgagctgccactgagccttgcagcctgcaccaaccagcctcacattgtgaattatcttaccgaaaatcctcataagaaagccgacatgcgacgccaggattcacgaggtaataccgtccttcatgccctggtggccattgccgacaacacgagggaaaataccaagttcgtgaccaaaatgtacgatcttcttttgctgaaatgcgctcgcctttttcccgactcaaacctcgaagccgtcctaaataatgacggcctgtctcccctcatgatggctgctaagacaggaaagattggaattttccagcacatcattaggagagaggtgacagacgaggacacaagacatctgtcaaggaaattcaaggactgggcctacggtccagtttatagctctctgtacgacctctcgagtcttgatacgtgtggtgaagaagcgtcagtgctggagattctggtgtacaactcaaaaatcgaaaaccgccatgaaatgttggctgttgagccgattaatgaacttctgcgagacaaatggaggaagttcggtgccgtttcattctacatcaatgtcgtgagttacctctgtgccatggttatctttactttgactgcttactaccagccgctggagggaaccccaccatatccttatcgaaccactgtggactacttaagacttgctggagaagtgattactctgtttacgggagttctgtttttcttcacgaatatcaaggatctctttatgaaaaaatgtccgggagtgaacagcctctttatcgatgggagctttcagctgctgtatttcatttattccgttctggtgatagtgtcagcagccctctacctggctggtattgaggcctacctggccgttatggtgttcgcactcgttcttgggtggatgaacgctctctactttacccgtgggctgaagctcacagggacttatagcattatgatccagaagatactctttaaagaccttttcaggtttcttctcgtgtacctgttgtttatgatcggttatgcctctgcgctcgtctcacttttaaacccgtgcgccaacatgaaagtgtgtaatgaggatcagacaaactgtacagtgcctacctatccgtcctgccgagatagcgaaacgttttccacgtttttactggacctcttcaagctgacaatcggcatgggggaccttgagatgctgagcagcaccaaataccccgtcgtattcatcatattgctagtaacatacatcatcctgacattcgtactacttctgaatatgctcattgcccttatgggcgaaactgtggggcaagtgtctaaggaatctaagcacatttggaagctgcagtgggctactaccatcttggacatagaaaggtcattcccggtatttttgaggaaagccttccgctcgggcgaaatggtgacagtcggaaagagttctgatggaaccccagatagaagatggtgcttcagagtggacgaagtgaactggtctcattggaatcagaacctgggcattataaacgaggacccagggaagaatgagacataccagtactatgggttctctcataccgtaggaaggctacggcgagatcggtggagctctgttgtgccaagggtagtggaactgaacaagaactcgaatcctgacgaagttgttgttcccctggattcaatgggtaatcctcggtgcgacggacaccagcagggatacccccggaagtggagaacagatgatgcaccactgtag

SEQ ID NO: 138462 - DNA, 2616 bp, Artificial Sequence
  Description of Artificial Sequence: Synthetic coding sequence
atggctgactcttctgagggcccccgcgcgggacccggagaggtggccgagttgccgggagatgaaagtggcacaccgggcggagaggcatttcctcttagtagtcttgcgaatctgtttgaaggggaggacggcagtttaagtcctagtccagccgatgcatcccggccagccggcccgggagatggaagacctaatttacgcatgaagttccagggggcgttccggaaaggcgttcctaaccctatcgacctgctggagtccaccttgtacgaatcgtccgtggtgccgggccctaaaaaagcccccatggattctctgtttgactacggcacatacagacaccacagctccgataacaagcgctggaggaaaaaaatcattgagaagcagccgcagtctcccaaagcacctgccccacaacctccaccaattttgaaggtcttcaatcgtcctatcttattcgatattgtctcccgtgggtctacagccgacttggacgggttgctcccatttctgctcacccataagaaaagacttactgacgaagagtttcgcgaaccaagtaccggaaagacgtgcctacccaaggcgctgctcaatttgagcaacggccgcaacgacaccattccggttcttctggatatagcagaacggacaggcaatatgcgggaattcatcaattctccattccgggacatctactatcggggccagacagctttgcatatcgccatagaaagacgatgcaaacattatgtcgagctgctggtagcccagggggccgacgtgcacgctcaggcccgaggccggttctttcagcccaaggacgaaggtggttatttttatttcggcgagctgcccctctcgctggctgcttgtacaaatcaaccccacatcgttaattacctcactgaaaatccacataagaaggccgacatgcgcaggcaggatagccggggcaacaccgttcttcacgcactcgtagcaatcgctgacaacacccgggaaaacacaaagttcgtgaccaaaatgtatgacttgttgctcctgaaatgcgcccggctgtttccagattcgaacctggaagctgtgcttaacaacgatggcctgtccccgctgatgatggcagctaaaacgggtaagatcggtatttttcaacatataatccgtagagaggttaccgatgaggacacgcggcaccttagccgaaaattcaaggattgggcatatggccccgtctactcctctctgtatgatctatcctccttagatacttgtggggaagaggcttctgttctggaaatcctggtgtataattcaaagatcgaaaatcggcatgagatgcttgccgtcgagccaataaatgagctcttgagggataaatggcgcaagttcggcgccgttagcttctatatcaacgtggtatcatatctgtgcgccatggtgatcttcactctgaccgcttactatcagccactggaggggacgcctccctacccatacaggaccaccgtggactacctgagactggccggggaggtgataaccctctttaccggtgtgttatttttctttaccaacattaaggacttgttcatgaaaaagtgtcccggtgtgaacagccttttcatcgacggcagctttcagcttctctactttatctactcagtgttagtgattgtttcagcagctctctacctcgcaggtatagaagcatatctcgcggtgatggtcttcgctctggttctggggtggatgaatgctctttactttaccaggggactcaagctgacaggtacctactccattatgatccagaaaattctttttaaggacctattcaggttccttctggtgtaccttcttttcatgataggatacgcctcagcacttgtgagtctgctgaacccctgcgctaatatgaaggtgtgtaacgaggaccagactaactgtactgtgccgacgtaccccagctgccgagatagtgaaactttttcaacattcctgctggatctgttcaagctgactatcggaatgggggacttagagatgcttagcagtacaaaatatccagtcgtgttcataattctgttagtaacatacattattttgaccttcgtgttattgctgaatatgctcatcgcccttatgggcgagacagtcggacaggtttcgaaagagagcaaacatatctggaaactgcagtgggctacgactatactggatattgaacgctccttccccgtcttcctcaggaaagcctttaggtcgggcgagatggtcacagttggcaagtcgtcagatggcactcccgataggcgatggtgcttccgagtggatgaggtgaattggagtcattggaaccaaaacctaggtatcatcaacgaggaccctgggaagaatgaaacctaccaatactatgggttcagccacactgtcgggaggctgcggcgtgacaggtggtccagtgtggttccaagagtggtcgagctgaataagaatagtaatcctgatgaggtggtggtgccgttggactctatgggcaacccccgctgtgacggtcatcagcaaggatacccgcgcaaatggcggacagatgacgccccactgtag

SEQ ID NO: 138463 - DNA, 2514 bp, Artificial Sequence
  Description of Artificial Sequence: Synthetic coding sequence
atggctgatagctcagagggacctcgcgcgggtccaggcgaggtggcagaactaccaggggacgagagcggtacccccggcgacggccgcccaaatctgcgcatgaagttccaaggtgccttccggaagggagtaccaaacccaatcgatttactggagagcactttgtatgaaagctcggtggtgcctgggcctaaaaaggccccgatggactcgctgtttgactatgggacctacaggcatcacagttctgataacaaacggtggagaaaaaaaattattgaaaaacagcctcaatctcccaaggccccagctcctcagcctccccctattctgaaagttttcaacagacccattctgtttgatattgtatctcgtggttccactgcagacctcgacggccttctgcctttcctgctgacacataagaaacggctaacagatgaggaattcagggagcccagcacaggcaagacgtgcctgcccaaagcgttgctcaacctatcaaatgggcgaaacgacaccatccccgtgttattagatatcgccgaaagaacaggtaacatgcgcgagttcattaactcaccctttagggatatttattataggggccagacagccttgcacatagccattgagcggcgctgcaagcattacgtggaattacttgtggcacagggcgctgatgttcacgctcaagcccgcggcaggtttttccagcccaaggatgaaggcggttacttttactttggcgagttacccctttctctggcagcatgcacgaaccaaccccatattgttaactatcttactgagaacccgcataagaaagcagacatgcgcagacaggactcgcgaggcaacaccgtgctccatgctctcgtggcaatcgcggacaacacccgggagaacaccaaatttgtgactaaaatgtacgatctgctgctgcttaaatgcgcccgattgttccctgattcaaacctagaagcagttcttaacaacgacggtctgtcccccttgatgatggctgcaaaaacaggaaagatcgggatcttccagcatattatcaggcgggaggttactgatgaggataccaggcatctttccaggaaatttaaagactgggcttacggcccggtttactcaagtctctacgatctgtcaagtctggatacatgtggagaagaagctagcgtgcttgagatcctggtgtataattccaaaatcgaaaatcggcacgaaatgctcgctgtcgagccaataaacgagctcttgcgggacaagtggagaaagtttggggcagtgagcttctatataaacgtcgtgagctacctttgcgctatggtgatcttcactctgacagcttactaccagccactggaaggcacccctccctatccctacagaacgaccgtagactacctgagacttgcaggagaagttataactctgttcacaggcgtcctcttttttttcactaatattaaagatctttttatgaaaaagtgtcctggggttaatagtctttttatcgacgggtcatttcagttactgtatttcatttattcagtactcgtcatcgtctcagcagctctctatctggctggcattgaggcctatctggctgtgatggtgtttgccttggtgctggggtggatgaatgcactgtactttacacggggcctgaagttgacaggaacttattccataatgatccaaaaaatcctgtttaaggacttgtttcggtttcttttggtgtacctcttattcatgatcggatatgctagcgctttagtatctctgttgaacccatgtgcaaatatgaaagtttgtaacgaggatcaaacaaactgcactgtaccaacctatccatcctgtagagacagtgaaacctttagcacattcctcctggacctgtttaaattaacaattggtatgggcgatctggaaatgctgtccagcactaagtacccagtcgtcttcatcattctcctggtgacatatattatattgacgtttgttcttttactcaatatgttaatcgccctaatgggtgagacggttggccaggtcagtaaagaatccaagcacatttggaagctccagtgggccacgacaatccttgatattgaacggtcatttcccgtgttcttgcgtaaagctttccggagcggcgagatggtgaccgtgggcaagagctctgacggcacaccagacaggcgttggtgctttagggtggacgaggtcaactggtctcactggaaccagaatctgggaatcatcaatgaggaccctggaaagaacgaaacttaccaatattacggattctcccatacggtggggagactgcggagggaccgatggtccagtgtggtcccgcgggtggtcgaactgaacaagaactctaacccggacgaggtagtagtgccgctggactccatgggaaatccccgttgtgacggccaccagcaagggtatccgcggaaatggagaactgatgacgcaccactctag

SEQ ID NO: 138464 - DNA, 2436 bp, Artificial Sequence
  Description of Artificial Sequence: Synthetic coding sequence
atggccgactcgtccgaaggacctcgggccggaccgggcgaggttgcagagctgccaggcgacgaatccgggacacctgggggcgaagccttccctctctcaagcttggccaacctgttcgaaggggaggacgggagcttaagccctagtcccgccgatgcttccaggccagctggaccaggcgacggtaggcccaacctgcgaatgaagttccaaggagcttttagaaaaggcgtcccaaatccgatcgacctcctagagtctaccctttacgagtcatctgtggttcccgggccaaagaaagcccccatggattctctctttgattacggaacctatagacatcactcctcggataacaaacggtggaggaagaagatcatcgaaaaacaacctcagagtccgaaggcgcccgctccccagccacctccaattctaaaggtcttcaataggcccattctgttcgatatcgtttctagaggttccaccgctgacctggacgggttactgccgttcttgctcactcacaaaaagagactgaccgatgaggaatttagggagcccagcaccggtaaaacctgtctacccaaagccttgctgaacctgtccaatggccgtaatgacaccattcctgttctgctggatatcgcagagagaacaggcaacatgagggagttcattaatagtccctttcgggacatatattacaggggccaaaccgctcttcacatcgctattgagcggagatgcaagcactacgttgaattgctagttgcccagggcgctgatgtgcacgcacaagctagggggaggtttttccagcctaaagacgaagggggttacttttactttggtgagctaccactgagcttggccgcctgtacgaatcagccccacatcgtaaactatcttacggagaatccgcacaaaaaagccgatatgcgcaggcaggattcgcgcggcaataccgttcttcatgctctagttgccatcgccgataacacacgagagaataccaagtttgtgactaaaatgtacgacctcctccttctgaaatgcgcacggctgttcccagactcaaacctggaagccgtcctcaataacgacgggctctcacctcttatgatggcagcaaagacgggaaagatcggcaaccgtcacgaaatgctcgcagtggagccgatcaacgaactgctccgcgataagtggcgtaagtttggagctgtctctttttacattaacgtggtatcctatctctgtgccatggtcattttcactctgactgcatattatcagcccttggagggaacgcccccgtatccctatcggactaccgtggactatctgcgtcttgctggtgaggtgatcaccctcttcactggcgttctgttttttttcacgaatattaaggatctctttatgaagaaatgcccaggcgtgaactccttgtttatcgacggtagctttcagctgttgtactttatctatagtgtgctggtaatcgtgagtgcagccctgtatctggcgggaatcgaggcttacttggccgtgatggtgttcgctctcgtgttggggtggatgaacgccttgtactttactcgtggtctgaaattgaccggtacatacagcatcatgattcagaaaatcctctttaaagacctctttagatttttgctggtatatctgttgtttatgatcggttacgcctctgccctggtatccctgctgaatccatgcgccaacatgaaagtgtgtaacgaggaccaaacgaactgcacagtaccaacataccctagttgccgggattcagaaaccttttcgaccttcctgttagatctttttaagctcactattggaatgggcgatttagagatgctctcttctaccaaatatcctgtcgtgttcatcattctgctggtgacttacatcatccttacattcgtcttacttctgaatatgttaattgccctgatgggggaaactgtgggacaggtgtcaaaggaatctaagcacatctggaaactccagtgggcgaccacaatcctggatattgagcggagttttccagtgttcctgaggaaagccttcagatctggggagatggtgaccgtggggaaatcctccgatggaaccccagaccgccggtggtgttttagagtcgatgaggtcaactggagccattggaatcagaacttggggattatcaatgaggatcctggtaaaaacgaaacttaccagtattacggattctcccacactgtcgggcgactccggagagataggtggtcaagtgtcgtaccaagagtagtcgaactgaacaagaattctaatccggacgaggtggtggttcccctcgactcaatgggcaatcccagatgtgatggacatcagcagggatacccacgcaagtggcgcacagacgatgctcccctgtag

SEQ ID NO: 138465 - DNA, 2475 bp, Artificial Sequence
  Description of Artificial Sequence: Synthetic coding sequence
atggctgactcttctgaggggccgagggccggacccggcgaggtggcagagctccctggcgatgaaagtgggacgcccgggggggaagcttttcccttgtcatctctggctaatttgttcgaaggagaagatggctccctgtcacccagccccgcagatgcatcccgaccggctggcccaggggatggtcgacctaacctgaggatgaagtttcagggcgcttttcgtaagggggtgcctaatccaattgacctgctcgaatcgacattatatgaatctagcgttgtcccagggcctaagaaagcacccatggacagtctgtttgactacggcacatacaggcaccactcttcagataataagcgctggcggaaaaagataatcgagaaacaacctcaatcccctaaggcccccgcaccacagccgccaccaatcctcaaagtattcaacagacctatcttgttcgacattgtatctaggggcagcaccgcggaccttgatggtctcttaccattcctcctcacccacaagaagcgacttaccgacgaggagttcagggaacccagcaccggcaagacgtgtctgccaaaagctcttttaaatctgtcaaatggacgcaacgacaccatacccgttcttctcgacattgcagaaaggaccgggaacatgcgagagttcatcaacagcccctttcgcgatatttattaccggggagagctgccgttaagcctggcagcgtgtactaaccagccgcacatcgtgaactatctgactgagaatccacacaagaaagccgacatgcgaagacaagatagcaggggaaacaccgttctccacgcgctggtggccatcgccgacaacacccgggaaaataccaaatttgttacaaaaatgtacgacctcctgctgcttaagtgtgctcggctcttccctgactcgaatctagaagctgtgcttaataacgatggtctgagtcccctgatgatggccgcaaaaacagggaagatcggcatatttcagcacatcattcgacgggaagtgactgacgaggacacaagacaccttagcagaaagtttaaggattgggcttacggccctgtctactcctcactatacgacttgagcagcctggacacgtgtggagaggaggcgtccgttctggagattttagtgtataactccaaaatcgagaaccgccatgagatgctcgcggttgagccaattaatgagctgctgcgagacaagtggagaaagttcggagccgtttccttctatattaacgtggtgagctacttgtgtgctatggtgatctttaccctgacggcgtactaccaaccactcgagggcacacccccttacccctacagaactaccgtggactatctgagactcgccggagaggtcatcactctgtttactggggtgttattcttcttcaccaacataaaagatctgttcatgaaaaagtgccctggcgtgaattccctttttatcgacggatcgttccagctcctctactttatctattctgtgttggtgattgtatcggctgcattgtacctggctggaatcgaagcctacctcgccgtcatggtgtttgccctagtactgggctggatgaatgcgctgtatttcacgcgtggtctcaaacttactggcacatactcgataatgatacagaagattctcttcaaagacttattccgatttttactggtttatctgttgttcatgatcggctacgcaagcgcactggtgtccctcctgaatccatgcgctaacatgaaagtgtgtaatgaagatcaaacaaactgtactgtcccaacctacccatcttgtcgcgattctgagacattcagcacctttcttcttgatttgttcaagttgacaatcggcatgggcgaccttgagatgctgtcgagcaccaagtatcctgtggtctttatcattctgctggtcacctacattatccttactttcgttttgttgcttaacatgctgatcgccctgatgggtgaaaccgtgggccaggtcagcaaggagagcaagcacatttggaagttgcagtgggcgacaaccattctggacattgagcgctctttcccagtgtttctcagaaaagcatttcggtctggcgaaatggtgacagtcggtaagagctcggatggtacaccagaccgtcgatggtgcttccgggtagacgaggtaaattggtcccattggaatcagaatctgggcatcatcaatgaagatcctgggaagaatgagacctaccagtattatgggttttctcacacagttgggcggcttagaagggaccgttggagcagtgtcgttccgagggtggtcgagctgaataaaaacagtaacccagacgaagtggtggtgccattggatagtatgggcaaccctcggtgtgacgggcaccagcagggctatccaaggaaatggagaaccgatgatgcacctctctag

SEQ ID NO: 138466 - DNA, 2295 bp, Artificial Sequence
  Description of Artificial Sequence: Synthetic coding sequence
atggctgactccagcgagggtccccgcgcagggcctggagaggttgctgaactcccaggtgacgaaagcggcaccccgggcggggaggcttttccactgtcttccctagccaacctctttgagggggaggatggctcattgagtcccagtccggcagatgcatcacggccagccggaccaggtgacgggcgcccaaaccttagaatgaaatttcagggggcattccgtaaaggcgtgcccaaccccattgacctgctggagagcacactgtacgagagtagcgtcgttcccgggcctaagaaagcacctatggatagcctgtttgactatgggacatacaggcatcatagctctgacaacaagcgatggaggaagaagatcatcgagaaacagccccagagccccaaggccccagcccctcaaccaccacctatactcaaggtgtttaacagacccattttattcgatatcgtgagccgcggatccacagccgacctagacgggctcttgccatttctcctcacgcataaaaagcgcctgactgacgaggaattcagggaaccttctaccggcaagacatgcctgccaaaggcactgctgaacctgtccaatggacggaacgataccatcccagtcttactggacattgccgaacgaaccggtaatatgcgggaatttatcaattccccgttccgggatatctattacaggggggagcttcctttatcactggcagcctgtacaaaccagcctcacatcgtcaattacttgaccgagaacccacacaaaaaggccgatatgcgtaggcaggacagccgaggaaataccgttctgcacgcgcttgtcgctatcgcagataacaccagggaaaacacaaaatttgtcacaaagatgtacgatctcctgctgctgaagtgcgcacgcctgtttcctgatagtaatttggaagccgtgctcaacaatgacggcttatccccgcttatgatggcagcgaaaactggtaaaatcgggaatcggcacgagatgctggccgtggaacctattaacgaattattacgggacaagtggagaaagttcggcgcagtttctttttatataaacgtggtaagttacttgtgtgccatggttatcttcaccctgacagcttactaccagcccctggaaggcacaccaccttacccctatagaacaactgtcgactatctgcgcctcgccggcgaggtcatcaccctttttacaggcgtcctttttttcttcaccaatattaaagatctcttcatgaaaaaatgcccgggcgtgaatagcctcttcatcgacggcagttttcaattactctatttcatctactcagtactcgttatcgtatcagccgccctctacctcgcaggtattgaagcatacctggctgtgatggtcttcgctcttgtgcttgggtggatgaacgctctatattttactagaggcctcaaactgactggcacttatagcattatgattcagaagatcttatttaaagatctctttcggttcctcctagtgtacttattgtttatgatcggatacgcctccgccctggtgagcttgttaaacccttgtgccaatatgaaggtctgcaatgaggatcagaccaattgtaccgttccgacataccccagctgtcgggattccgaaaccttttccacttttctgttagatctgttcaagctcaccattggcatgggtgatttggagatgctgagttccacaaaatatcctgtggtctttatcattctactcgtgacctacatcatcctgactttcgttttgctcttaaacatgctgatcgcgctcatgggcgagacagtaggtcaggtgagcaaggagtctaaacacatctggaagctgcagtgggcaactaccatcctggacattgaacggtcatttccagtcttcctgaggaaggccttcagaagtggtgagatggtcactgtcgggaagtcgtctgacgggacgcccgatcgcaggtggtgttttagagtggatgaggtgaactggtcacactggaatcagaacctgggcataatcaatgaggaccctggcaaaaatgagacctatcagtactatggattttctcacacggtcggtagactgaggcgggataggtggagctccgtggtgcccagggtcgtcgagctcaacaaaaatagtaacccagatgaagtggtggtccccctggatagtatggggaatcccagatgcgacggtcaccagcaaggctatccccggaaatggagaacggacgacgccccgttatag

SEQ ID NO: 138467 - DNA, 2190 bp, Artificial Sequence
  Description of Artificial Sequence: Synthetic coding sequence
atggggggctttctacccaaggccgaaggtcctgggagccagttgcagaagctcctcccttcattcctggttagggagcaggattgggaccagcacctagacaaattgcatatgctgcagcagaaaagaatcctagaatctccgctgctgagggcatctaaggagaatgatttgagcgtgcttcgccaattgcttttagattgcacttgcgacgtgagacaaaggggtgccttgggcgagacagctctccacattgccgcactgtacgacaacctggaggccgcccttgtcttgatggaggcggctcccgaattagtgttcgagccaacaacctgcgaggcttttgccggtcagacagctctgcacatcgcagtcgtcaatcagaacgtgaatctagttcgagcattgttgacccgccgggctagcgtatctgcgcgcgcgactggaactgcctttcggaggtctccacgaaatcttatctattttggcgagcatccattatcgttcgcagcctgcgtgaacagcgaggaaattgtgcgactgttgattgagcacggagcggacatccgggcacaagattccttaggcaacactgtccttcacatcctgatcttgcagccaaacaagactttcgcctgccagatgtacaaccttcttctctcatatgacggacatggggatcatcttcagcctctggaccttgttccaaatcatcaggggctgactccttttaagctggctggtgtggaaggaaatactgttatgtttcagcatttaatgcagaagagaaggcacatccagtggacttacgggccccttaccagcattctctatgatctgaccgagatcgactcctggggcgaagaactgagcttcctggaacttgttgtgtccagtgataaaagggaagcaagacagattctggaacaaactcctgtgaaagagttagtttccttcaagtggaataagtacggtcggccttacttttgtatcctggcagctctataccttctctacatgatttgcttcacaacctgctgcgtttaccgccccctgaaattcaggggcggaaaccgcacacactctcgtgatatcaccattctccaacagaagctcttgcaggaggcctacgagacaagggaggacattattcggctggtaggtgagcttgtcagcattgttggagccgtgatcattcttctgctcgaaatcccggatatattccgagtgggtgccagccgctacttcggcaaaactattttggggggaccgttccatgtgatcattatcacctacgcttccctcgtgctcgtaacaatggtcatgaggctgacgaatacgaatggggaggtggttccaatgtctttcgctctcgtccttggctggtgttcagtgatgtacttcacgcgcggatttcagatgctgggaccttttaccatcatgattcagaagatgatatttggggatcttatgcggttctgttggcttatggccgtcgtgattctggggttcgcttctgcattctacattattttccagacggaagatccaacttctctcggccagttctacgactacccaatggcattgttcactacttttgagctgttcctgaccgtcatcgacgctccagccaattatgatgtcgacttgccttttatgttttccatagtcaatttcgcattcgctatcatcgccaccctgctgatgttgaatctatttattgccatgatgggtgatacgcactggcgtgtggctcaggaaagggatgaactgtggagggcacaggtcgtggccactacggtgatgctggagcggaaactccctaggtgtctgtggcctcgaagtggtatctgtgggtgtgaatttgggcttggtgatagatggttcctccgcgtggaaaatcacaatgatcagaatcccctccgtgttctcaggtacgtagaggtcttcaaaaatagcgacaaggaggacgaccaggagcacccttccgagaagcagccgtcgggggccgagtctggtaccctggctagggcgagtcttgccctgcccaccagcagcctgtctagaacagccagccagagctcttcccatcggggctgggaaattcttcggcagaacactctcggtcacctcaatctgggcctgaacctgtccgagggtgacggagaagaagtctatcacttttag

SEQ ID NO: 138468 - DNA, 1146 bp, Artificial Sequence
  Description of Artificial Sequence: Synthetic coding sequence
atgggcggttttctaccaaaggctgagggtccagggagccagctgcagaaactcctgccctcgtttttggtcagagagcaggattgggatcagcaccttgacaagctgcacatgcttcagcagaaacgcattcttgaaagccctttattgagggcctcaaaagaaaacgatctcagcgtgttgaggcagctccttctcgactgtacgtgcgacgtgcgacagcggggggctttgggcgagactgcactgcatattgccgcactctatgataatttggaggctgccctggttttgatggaagctgcccccgagctggtctttgagcccaccacatgcgaggcttttgcagggcagaccgcgcttcacattgcagtggttaatcagaacgtgaacttggttcgagcgcttctgacccgccgggcctcagtctccgccagagctacgggtacagcctttagaaggagcccacggaatcttatctacttcggggaacatcctctctccttcgctgcttgtgtcaattccgaggaaattgtccgcctgctaatcgagcatggcgccgacataagagcccaggacagcctggggaatacagtcctccacattctcattctacagcctaacaagaccttcgcctgccagatgtacaacctgctgctgtcatatgatggccacggtgaccacctgcagccgctggatctcgtaccgaatcaccaaggcctgactccctttaagttagccggcgtggaagggaatacagtgatgttccaacaccttatgcagaagcgacgacatatccagtggacctacggccccctcacctcgatcctctatgacctcactgagatcgattcgtggggagaggagctcagttttcttgagctggtcgtgtctagtgataagcgtgaagctcgccaaatactggaacagacaccagttaaagaactcgtgtccttcaagtggaataagtacggtaggccctacttctgcatcctggcggccctgtacttgctgtatatgatttgtttcacgacatgctgtgtgtaccgcccactcaaatttagaggggggaaccgcacacactccagagatatcacaatactccagcagaagttactgcaggttatcctcttacgcaggggatag

SEQ ID NO: 138469 - DNA, 1674 bp, Artificial Sequence
  Description of Artificial Sequence: Synthetic coding sequence
atgggcttgtctctgccaaaagagaagggacttatcctgtgtctctggtccaaattctgtcgatggtttcaggatagcctggggaacaccgtgctccacatattgattctgcaacctaacaagactttcgcatgccagatgtacaacctactactgagctatgacaggcatggggaccacctacagccactggacttggtgcctaaccaccaggggctcaccccgttcaagctggcgggtgtagagggcaataccgttatgttccagcatctcatgcagaaaaggaagcacacccagtggacatatgggcccctcacatcaacactctacgatctgacagagatcgatagctccggcgatgagcagtcgctcttagaactgataatcactacaaagaagagggaggctcgacagatcctggatcagaccccagtgaaagagttggtgtccctgaaatggaagcgctatgggagaccctacttttgcatgctgggtgctatttatttactgtacataatttgttttacaatgtgctgcatctataggcctcttaaaccccgtaccaataacagaacaagcccccgggacaacacccttctccagcaaaagctcctccaggaggcctacatgactcctaaggatgacatacgactggtgggggagttagttaccgtgatcggagcaatcattatattgttggtcgaagtgccagacatctttaggatgggcgtgacccggtttttcgggcagactatcctaggtggacctttccatgtcctgatcatcacatatgctttcatggtgcttgtgacaatggtgatgaggctgataagcgcaagtggtgaggttgtacctatgtccttcgccctggttctcgggtggtgtaatgtcatgtatttcgcgcgtgggtttcagatgctgggccccttcaccattatgatccagaaaatgatttttggagacctaatgcgcttctgttggctgatggcagtggtgatcctaggcttcgcttccgcattttacattatctttcagacagaggatcccgaggagctgggtcacttctacgactacccaatggccctgttctccacatttgagctgttcctgacaatcatcgatggcccggccaattataacgtcgacttgcctttcatgtactccatcacttacgcagccttcgctattattgctacactactgatgttaaatctgctcatagccatgatgggagacactcactggagagtagcacatgaacgagatgagctgtggagggctcagattgtggcgaccaccgtcatgctggagagaaagctgcccaggtgtctctggccccgcagcggcatttgcggcagggagtacggccttggggaccggtggttcctgcgcgtggaagaccggcaggatctcaaccgacagcgtattcagagatatgctcaggcctttcacactaggggatctgaagatctggacaaagacagcgtggaaaagctggaacttgggtgtccgttcagcccacacctttctctcccgatgccaagtgtcagccgatctacttccagaagctcagccaactgggaacgcctgaggcagggcaccctgagaagggacctaagaggaatcatcaacagaggtctcgaggatggcgagagttgggagtatcagatttag

SEQ ID NO: 138470 - DNA, 2178 bp, Artificial Sequence
  Description of Artificial Sequence: Synthetic coding sequence
atgggactgagccttcctaaagagaagggacttattctttgcttatggtccaaattctgtcgatggtttcagaggagagagagctgggcccagtcccgggacgagcagaacctgttacagcagaaaaggatctgggaatctcctctactgctggctgccaaggacaatgacgtccaggctttgaataagttgctcaagtacgaagactgtaaggttcatcaacgaggtgccatgggtgagacagctctgcacattgccgccctgtatgacaatctggaggccgctatggtcctgatggaagccgccccagagttagtatttgaacctatgacctccgagctgtacgagggccagaccgcactccacatagccgtggttaaccagaatatgaacttggtgcgcgcactgttggctcgccgtgcaagcgtctccgcccgtgctacaggtacagccttcaggcgatctccttgcaatctgatttactttggtgagcatccgttatcatttgctgcatgcgtaaacagcgaggagatagtgcggcttctgatagaacatggggccgatatacgcgcccaggacagtctgggcaacactgtgttgcacatcctgatcctccagccaaacaagacgttcgcttgtcagatgtacaacctgcttctttcctacgataggcatggcgaccatctgcaacccctagatttggtccccaaccatcaggggttgacaccctttaagctggccggggtcgagggcaacactgtgatgttccagcatctgatgcagaaaaggaagcacacccagtggacatacggacctctgacttctacattgtacgacttgactgaaatcgactcaagcggcgacgaacagagcctgctggagctgatcattaccactaagaaacgtgaagcccgccagatcctcgaccagacacccgtgaaagaattggtcagtctgaagtggaagcgctacggtcgcccatatttttgtatgctcggtgctatctatctgctttacatcatctgttttaccatgtgttgcatctataggcctctcaagcctagaaccaataacaggacatccccccgagacaatactcttctgcagcagaaattgctgcaggaagcatatatgacaccaaaggacgacatccggttagtgggagagctcgtcacagtgattggggccataattatccttcttgtggaggtgcccgatatctttagaatgggggtaacccgattctttggccagacgatcctgggggggccatttcatgttctgattattacctatgccttcatggtcctggtgacaatggtgatgcgtcttatatcagcatccggcgaggttgtgccaatgagctttgccctggtcctggggtggtgcaacgtaatgtactttgcaagaggcttccagatgctgggaccctttactatcatgatccagaagatgatctttggagaccttatgagattctgctggttgatggctgtcgtaattctcggatttgcaagcgccttctatattatatttcagacagaagatccagaagagcttggccatttttacgactatcccatggcactgtttagcacctttgaactgttcctcactatcatcgatgggccagctaattacaacgtggacctgccatttatgtatagtatcacgtacgcggcgtttgcaatcattgcaactctgctcatgctgaatttactcattgctatgatgggtgatacccattggagagtcgcccatgaaagggacgagctttggcgcgctcaaatcgtggcaactactgtgatgttggagaggaagctgccccggtgtctctggccccgcagcggcatctgcgggagggaatacggcctaggggacaggtggtttctgcgcgtcgaagatcgacaggacctcaaccgtcaacgtattcagagatacgcacaggcctttcatactaggggaagtgaggacctcgacaaggatagcgtggagaagctcgaactaggctgccctttcagcccacacctatcgctgcccatgccctccgttagtagatctacatctcggagctccgccaactgggagaggcttcgtcaggggacacttcgaagagatctgcgcggcatcataaaccgcgggctggaagacggcgaaagctgggagtatcagatctag

SEQ ID NO: 138471 - DNA, 168 bp, Artificial Sequence
  Description of Artificial Sequence: Synthetic coding sequence
atgtccacaagtaggaagcttaaatctcacggaatgaggcggtcgaagtctagatcaccacataagggcgtaaagcgcggagggtctaaacggaagtacagaaaaggaaatttaaaatctcggaagcggggggatgatgcaaacagaaattatcggtcccatctttag

SEQ ID NO: 138472 - DNA, 417 bp, Artificial Sequence
  Description of Artificial Sequence: Synthetic coding sequence
atggacacacagacgcacagccttcccattacacatacccagttacactctaatagccagccacaatcaagaacatgtacacgtcactgccaaaccttctcacaaagctgccgccagagccacagaggcagtagaagccagagttcatcacagagtcccgcctcacatagaaatcctacgggggcacattcctcaagcggccaccagtcgcaaagccccaacacatcgccccctcccaagagacataaaaagactatgaactctcaccactcccccatgaggccaacaatccttcactgtcgatgtccaaagaatcgcaagaacctggaaggaaagctaaagaaaaagaaaatggccaagaggattcagcaggtttacaaaaccaaaactagatccagtggttggaagagtaattag

SEQ ID NO: 138473 - DNA, 1731 bp, Artificial Sequence
  Description of Artificial Sequence: Synthetic coding sequence
atggccgtgcttttctttcacaccatgcgctacaagagccaagatccgcggaaccctcataacgacagattcgtcctgagtaaagggcacgctgcccctattttgtacgctgtctgggcagaggctggatttttggccgaggctgagctccttaacctcaggaagattagctctgacttagatggacatcctgtacctaaacaggcattcactgacgtagcgacggggtccctaggccagggcctgggtgcggcatgcggaatggcttacacaggcaaatatttcgacaaagcatcatacagggtgtactgtctgcttggcgacggagagttgtcggaagggagcgtctgggaagccatggccttcgcatccatctacaaacttgacaatctcgtcgccatcctggatatcaatcgactcgggcagtctgacccagcacctctccagcaccagatggacatttaccagaaaagatgtgaagctttcggctggcacgccatcattgtcgatggacacagcgttgaggagctctgtaaagccttcggccaggctaaacaccagcccaccgccattattgctaaaactttcaagggccggggaatcactggggtcgaagataaggaatcctggcatggaaagcctctcccgaaaaatatggccgaacagattattcaggaaatctacagtcagatccaatcaaagaagaagatcctcgcaacgccccctcaggaggatgctccatcagtggatatcgcgaacattcgcatgccctccctgccgagctataaggtgggcgataagattgcaacaaggaaggcatatggccaggcattggccaaactgggccatgcctctgaccggattattgccctggacggtgacacgaagaattcaacatttagcgaaatatttaagaaagagcaccccgaccgattcatcgaatgctacatcgcagagcagaacatggtgtctattgcagtaggttgcgccacacgaaaccgaacggtgccgttttgctccaccttcgcagcctttttcaccagagctttcgaccaaatcaggatggccgccatcagtgaatccaatattaatttatgtgggagccactgcggcgtctctatcggagaagatggcccctcacaaatggccttagaagatcttgccatgttcaggagcgttcccacctctaccgttttttaccctagcgatggcgtggccacggaaaaagcggttgaactcgctgctaacaccaagggcatctgttttatccggacaagtagacctgagaatgctatcatttacaacaataatgaggacttccaggtagggcaggccaaagtagtcctgaaaagtaaagatgatcaagttaccgtcatcggcgctggggtgacacttcacgaagcactcgcagccgcagagttgctcaagaaagagaaaatcaatataagagttctggatccattcactatcaagcccctggacagaaagctcattctggactccgctcgggccacgaaagggcggatattgactgtggaagaccactattacgagggcgggatcggtgaggcagtaagctctgccgtggtcggggagcctggcataactgttacacacctggccgtgaacagggtcccccgctccgggaaaccggctgagctgctaaagatgtttggaatcgatcgtgatgcaatcgcccaggccgtgcgtggactcataacaaaggcctag

SEQ ID NO: 138474 - DNA, 1374 bp, Artificial Sequence
  Description of Artificial Sequence: Synthetic coding sequence
atggcttttgccagcatctacaagctcgacaacctcgtggccatcctggatattaataggctgggccaatcagaccccgcccctctccagcaccagatggacatctaccagaaaaggtgcgaagcctttgggtggcacgcaatcatcgtcgacggtcactccgtggaagagttgtgtaaggcttttggccaggccaaacaccagcctaccgctattattgccaagacctttaaaggcaggggtattacgggcgtcgaggataaggaaagctggcacggcaagcccctgccgaaaaatatggctgaacagataatccaagagatttactcccagattcagtccaaaaagaagatacttgccacgcctcctcaagaagacgctccctcagtagatattgctaacatcaggatgccctcactgccgtcatacaaggtgggcgataaaattgctacacgaaaggcctacggccaagcacttgccaaactcggccacgctagtgatcggattattgcactcgatggtgacacaaagaattctaccttcagtgagatctttaagaaagagcaccctgatcgctttatcgaatgctatattgccgagcaaaacatggtgagcatcgccgtcggatgtgcgaccaggaaccggacagtaccgttttgctcaacttttgctgcgttcttcacccgcgccttcgaccagatcaggatggcagccattagcgagtccaatataaatttatgcggctctcactgtggagtctccattggcgaagacggaccctcacagatggcactcgaggatctcgcaatgtttcgatcggttcccacaagcacggtgttttaccccagtgatggcgtggccacagagaaggctgtagaactcgccgccaacacaaagggcatatgctttattaggacctccaggcctgaaaacgccataatctataacaataacgaggacttccaagtggggcaggctaaagtggtgttgaagagcaaagatgatcaggttactgtgatcggtgctggagtaaccctccacgaagccctcgccgccgccgagttgttgaaaaaggaaaaaattaatattagggtcctggacccattcaccatcaagccgctggataggaagctcatacttgattccgcaagagctacaaagggccgaattctgacggtcgaggaccattactacgagggaggcattggcgaggccgtgtcctctgctgtggtcggggaaccaggaataacagtgacccatctggctgtgaatagagttcctcggtcaggtaagcctgctgaactgctcaaaatgttcggcatcgatcgggatgctattgcgcaggcggtgcgtggactgattacaaaagcctag

SEQ ID NO: 138475 - DNA, 1872 bp, Artificial Sequence
  Description of Artificial Sequence: Synthetic coding sequence
atggagagctaccataaacccgatcagcagaagctccaggccctcaaagacaccgcgaaccgactccgcatttcatcaattcaagctaccaccgccgcagggtcaggacacccgacctcctgctgttcagccgccgaaattatggccgtgctcttctttcataccatgcgatacaagagtcaggacccaagaaaccctcacaacgaccggtttgtactgagtaagggacatgccgcccccattttgtacgccgtctgggccgaagccggctttctggcagaagcagaactccttaacctgcgcaagatttccagcgacctagacggtcatcctgtgcccaagcaggcatttacagacgtggccaccggcagcctgggacagggactgggggccgcgtgtgggatggcctatacaggcaagtacttcgacaaagcgagctaccgcgtctattgcctcctgggcgatggagagctctctgagggctcggtttgggaggccatggccttcgcttccatttacaaactagataatcttgtcgcgattctcgatatcaacaggctgggccagtccgaccccgcccctcttcagcaccaaatggacatctatcaaaaaagatgcgaagctttcggttggcatgccatcattgtggacggacatagcgtggaagaattatgtaaggctttcggacaagccaagcaccagcccaccgcgattatagccaaaacattcaaaggaagaggaattacaggagtcgaagacaaggagagctggcacggaaaaccactccccaaaaacatggcggaacagatcatccaagagatctatagccagattcagtctaagaaaaagattctggcaactccacctcaggaagatgcccccagcgtagatattgcaaacatcaggatgcccagcctcccctcttacaaggtaggagacaaaattgctacaagaaaggcatatggacaggcccttgctaagctgggccatgctagtgatcggattattgccttggacggcgacaccaagaactctaccttttccgaaattttcaagaaagaacaccctgaccggtttatcgagtgctatatcgctgagcagaacatggtgtctatcgcggtgggatgcgcaacgcgaaaccggaccgtacctttctgttctacttttgctgcttttttcacccgagccttcgatcagattcgcatggccgctatttctgaaagtaatattaacctctgcggcagccactgtggggtgagcattggagaagatggccccagccagatggctctggaggaccttgccatgtttaggagtgttccaactagcaccgtgttctacccgtccgacggcgtagctacggaaaaggccgtggagcttgccgcaaatacgaagggcatttgcttcattcgtacatctcggcctgagaatgcgatcatttacaacaataatgaggattttcaagttggccaggccaaagttgtgctcaagagtaaagacgaccaggtgacagttattggggcaggggtgactctccacgaggctttagcagccgcagagctcctgaagaaggaaaagatcaatatacgtgtgctcgatccatttaccatcaagcccctcgaccgaaagctgattctggatagcgcacgcgccaccaaaggcaggattctgacggttgaggatcactactatgagggaggaattggtgaagccgtttctagcgccgtggttggggaacctggcataaccgttacacacttggcagtcaatagagtgccgagatctggtaaacccgccgaattgctgaagatgtttggcattgaccgcgacgctatcgcgcaggcagtgcgcggactcattaccaaagcatag

SEQ ID NO: 138476 - DNA, 1872 bp, Artificial Sequence
  Description of Artificial Sequence: Synthetic coding sequence
atggaaagttaccataaaccagaccaacaaaagcttcaagccctgaaggacaccgccaaccggttgcggatatcatcaatccaggctacaacagctgccggcagcggtcatcctacaagctgttgttcggcggcagaaatcatggcagttctattttttcacacaatgaggtacaagtcacaggaccctcgtaatcctcacaatgacagattcgtgctgagcaagggccacgccgcgcccattctgtacgcagtatgggccgaagcaggcttcttggccgaagccgagctacttaacctacgaaagatttcctccgatctcgatgggcaccccgttcccaaacaggcatttacagacgtggccacagggagcctcgggcaagggctcggggccgcctgcgggatggcttacaccggaaagtacttcgacaaggccagctatagagtttactgcctgttgggagacggcgaactgagtgaggggtccgtgtgggaggccatggcctttgcctccatttacaagctagataatctggtagctatcttagacatcaatcgcttgggacagtccgacccagcacccttgcagcaccagatggacatctatcagaagcgctgcgaggccttcgggtggcatgccattatcgttgacggccacagcgtcgaagagctctgcaaagcctttgggcaggcaaagcaccagcccactgccattatcgcaaagacttttaaaggacgtgggattacgggtgtggaggacaaggagtcttggcacggaaagccactgccaaaaaacatggcagagcagattatccaggagatttactctcagatacagtcaaagaaaaagatcctcgcgactccaccacaggaagatgcaccaagcgtggatatcgctaacatcagaatgcccagcctgcctagctacaaagtgggtgacaagatcgccacccggaaggcttacgggcaggctctggccaagctaggacacgcctcagaccggataatcgcccttgacggcgatactaaaaattctaccttctcggaaatcttcaaaaaggaacatcccgacagattcatcgagtgctatattgccgaacagaacatggtgtcaattgccgtgggctgtgcaacacggaaccgtacagtgccattttgcagcacttttgccgcctttttcaccagggccttcgaccagatccgaatggcagccatctcagagtctaacattaatttgtgcggcagccactgtggagtttcaattggcgaagacgggcccagccagatggcgctggaagatctggcaatgttcaggtccgtccccacctcaacggtcttttacccctcagacggcgttgctaccgaaaaggccgtggaactggccgccaatacaaaaggtatctgttttatccgtacctcacgccccgagaacgcaatcatctataataacaacgaagatttccaggttgggcaagccaaggtggtattaaaatcaaaggacgaccaggttactgtgattggggctggcgtgacattgcacgaagcgttggccgccgccgaactgttgaagaaggagaaaatcaacattcgggtgcttgatccattcactataaagccactggataggaaactgattcttgacagtgcacgcgccaccaaaggaagaatcctcaccgttgaggaccactactacgaaggcgggatcggggaggcggtatctagcgccgtagtaggtgagccaggaatcacagtgactcaccttgcggtcaacagagtgccccggagcggaaagcctgccgagctgttgaaaatgtttggcattgaccgggatgccatcgcacaggccgttcgcggactgattaccaaggcatag

SEQ ID NO: 138477 - DNA, 1896 bp, Artificial Sequence
  Description of Artificial Sequence: Synthetic coding sequence
atggagtcctatcataagcctgaccagcaaaaactccaagccttaaaagacaccgccaaccggttgcgcattagctcaattcaggcaaccactgccgccgggtctggccatcccaccagctgttgttccgctgcggaaattatggctgtattattcttccataccatgaggtacaagagtcaggaccccagaaacccacacaacgatagattcgtcttgagcaaaggacacgctgcacctatactgtatgctgtttgggcagaggcaggcttcttggcagaagccgaactccttaacctgagaaaaatttctagtgacctcgatggtcatccagtgccaaaacaggccttcacagacgttgccactgggagtttagggcaggggctgggcgccgcatgtggtatggcatatacgggtaagtatttcgataaggcctccttaccctccagttgggactattcttacagagtgtattgtctgcttggcgacggcgagttgagcgaggggtccgtttgggaggctatggcctttgctagcatctataaacttgacaacctggtggcaattctcgatatcaataggctgggtcaatcagatccagcccccttacagcaccagatggacatttaccaaaaaaggtgcgaggcgttcgggtggcatgccatcatagttgatggtcattcagttgaggaattatgtaaagccttcgggcaggccaaacaccaaccaaccgccatcatcgcaaagacctttaagggaagaggcataaccggagtcgaagataaggagtcttggcacggtaagcctctacccaagaatatggcggagcagatcattcaggaaatctatagccaaatccagtcaaaaaagaagatcctagccaccccaccccaggaggacgcaccttcagtagacattgctaatatacggatgcctagcttgccttcctataaggtgggcgataagatagccacaaggaaggcttacggccaggctctcgccaagctcggccacgcctccgaccgtattatagccttagatggggatacaaaaaattctacattttctgagatttttaagaaggaacacccggatcgtttcatagagtgctatatcgctgagcagaacatggtttctatcgctgtaggttgcgcaacgcggaaccgcacagtgccattttgctcgacattcgctgctttttttaccagggcgttcgaccagattcgtatggctgcgatcagcgagtccaacatcaacctctgcggatctcattgcggtgtttcgattggagaagacggacccagtcaaatggcgcttgaagacctggcgatgtttcgctccgtccccacgagcactgtgttctacccctccgacggcgtagcgacagagaaagctgtggaactggccgctaacacaaaggggatctgtttcattcgtacaagtcggcccgaaaacgcaattatatacaacaataacgaagacttccaggtgggacaggctaaggttgtgctgaagagcaaagatgaccaggtcactgtaatcggagctggcgttactttgcatgaggcccttgccgccgccgaattactgaagaaagagaagattaatatccgggtgctcgacccattcacaattaagcctctggatcgtaagctgatcctggatagcgccagagccaccaaaggcagaatcctcaccgtagaggatcattattacgaggggggcatcggggaagccgtcagttccgcagtcgtgggggaaccgggaattacagtgacccacctcgcggtcaatcgagtaccacgctctggaaaacccgctgagttgttgaagatgtttggcattgacagagacgccattgctcaggctgttcgcggcctgataaccaaagcctag

SEQ ID NO: 138478 - DNA, 1182 bp, Artificial Sequence
  Description of Artificial Sequence: Synthetic coding sequence
atggcactgaaggtagccactgtagcaggctcggcagccaaagctgtgctcgggccagccctgctgtgtcggccttgggaagtattaggagctcacgaagtaccctcacgtaatatctttagtgagcaaaccatccccccaagcgcaaaatatggcgggaggcatacagtcaccatgatccctggggacggaattggccctgaattgatgctgcacgtcaagtctgtgtttcggcacgcttgcgtgccagtcgattttgaagaggttcatgtttcttccaatgctgatgaagaagatattcgtaacgctatcatggctatccgcagaaatcgggtggccctgaagggtaacatagagaccaaccataacctccctccatcgcacaagagtcggaataatattctgcgtacttctctggacctctacgccaatgtcatccactgcaagtcactgcccggagtggttacccggcacaaggatattgatatccttattgtgcgcgagaacactgagggcgaatattcctccctggaacacgaatccgtagcaggagttgtggagagcttaaagatcataacaaaagccaagtcactgaggattgcggagtacgcattcaagctggcccaggagagtggcagaaagaaggtgactgcagttcacaaggcaaatataatgaagcttggcgacggcctctttctgcagtgttgccgggaggtggccgctcgctacccgcagatcacctttgagaatatgatcgtggacaacaccactatgcagctggtgagtcgcccacagcagttcgacgttatggtgatgcctaatctctacgggaatatcgtgaacaacgtgtgcgccggcctggtaggtggaccaggcctcgtagcaggcgcgaattacgggcacgtctacgcagtgtttgaaaccgccacacgcaatacaggaaaaagcattgccaacaagaacattgctaatcccactgccactctccttgcttcctgcatgatgctcgatcaccttaaattgcattcatatgcaacttccatacgcaaagctgtgctagcgtctatggataacgagaacatgcacacacccgacatcggagggcagggaacaacatctgaggctatccaggatgtgattaggcacatccgtgtgatcaatggtagggctgttgaggcctag

SEQ ID NO: 138479 - DNA, 1791 bp, Artificial Sequence
  Description of Artificial Sequence: Synthetic coding sequence
atggccgatgcagaggccagggccgagtttcccgaggaggccagacctgaccgtggaaccttacaggtgctgcaggacatggcgtctagactcaggattcatagtattagggcgacgtgctctacttcatcaggtcacccaacctcctgttcatctagtagtgagattatgagcgttctgtttttctatattatgagatacaagcaaagcgaccctgagaaccctgacaacgaccggtttgtgttagctaagcgtctatccttcgttgatgtcgccacaggatggttggggcaagggcttggggtggcatgcggcatggcctatacagggaaatattttgaccgcgctagctatcgagttttctgtctgatgagtgacggagaatcaagcgaagggtccgtctgggaggctatggcgttcgccagctactacagtctggacaatctggtggctattttcgacgtgaataggctagggcactcaggggccttgccagccgaacactgtattaacatctaccagcggcgctgcgaggcctttggttggaatacttatgtcgtcgacggcagagatgttgaagctctatgccaggttttctggcaggcttctcaggtgaaacacaagccaactgctgtggtagcgaagacctttaaaggacgcggaaccccgagtatcgaggatgccgaatcctggcatgccaagcctatgcctcgagagagggctgacgcaatcatcaaattgattgagtcgcaaattcaaacgagtcggaaccttgacccccagccgcccatcgaggacagtcccgaggtaaacataaccgacgttcgtatgacctccccccccgattacagagtgggggataaaattgcgacaaggaaagcttgtggcctcgcactagcgaagctcggttacgctaataatcgtgtcgtggtgttggatggcgacacgcgttactcaacattttctgaaatctttaacaaggagtaccctgagagatttatagagtgctttatggccgagcagaatatggtcagcgtcgccttggggtgcgcttccagaggccgcaccatcgcattcgcatccacttttgctgcgtttttgacaagggcttttgaccatatccgcattggaggtttggcagaatccaacatcaatattattggatcacattgtggcgtgagtgtcggcgacgatggggctagccagatggctttggaggacattgctatgttccgcacaatacctaagtgcactatcttctaccctactgatgcggtcagcactgaacatgcagtggcactcgccgcgaatgcaaagggaatgtgtttcataagaaccactcggccagaaacgatggtgatttatacaccccaggagcggttcgaaatcgggcaagctaaagtgctccggcactgcgttagcgacaaggtgaccgtgattggagctggcatcacggtgtacgaggcactggccgccgcggacgagctttccaagcaggatatctttattagagttatcgatctgtttaccatcaaaccacttgacgttgccactatcgtgtcaagcgctaaagcaacagagggacggatcattacggtcgaggatcattatccccagggaggcattggcgaagccgtctgcgcagcagtgtccatggacccagatatccaagtccattcgctggctgtgtcaggcgttccccagagcgggaagtctgaggaacttctagacatgtatgggatctcggcgagacatattatcgttgcggtgaagtgcatgctgctaaactag

SEQ ID NO: 138480 - DNA, 1674 bp, Artificial Sequence
  Description of Artificial Sequence: Synthetic coding sequence
atgtccgtgcttttcttctatatcatgagatataagcagtccgaccctgaaaaccctgacaacgatagatttgttctggccaaaaggctctcgttcgtggacgttgcaacaggctggctgggccagggactgggcgtggcatgcggcatggcttatacagggaagtactttgatcgagcttcataccgcgtgttttgcctaatgagcgacggtgagtcatccgaggggtcagtttgggaggccatggccttcgcttcttactatagcttggacaacctggtggctatctttgacgtgaatcggctgggccacagtggcgccttacctgccgagcactgtatcaatatctaccagcggagatgcgaggcttttggatggaacacctacgttgtagacgggagagacgtggaagctctttgtcaggtcttctggcaggctagccaggttaagcacaagcctaccgccgtggtggccaagactttcaagggtagaggaacaccttctatcgaggacgccgaaagttggcacgccaagcccatgccacgagaacgggctgacgccattatcaagctaattgaaagtcagatacagacctctcggaacctggacccacagccgcccatcgaggatagtcccgaagttaatatcacagacgtgagaatgacttcaccccctgactatagagttggcgataaaatagctactaggaaggcttgcggattggccctggccaagctgggctacgccaataatcgcgtggtcgtcttagatggagatactagatacagtaccttctcagagatctttaataaagagtaccctgagaggttcatcgagtgtttcatggccgagcaaaacatggtgagcgtagcacttgggtgcgcttcccggggtcgcaccatcgcattcgcgtctacctttgctgctttcctcacgcgcgcctttgaccatatccgcataggggggctggccgaatccaatattaacattataggaagccattgcggggttagtgtaggggacgacggcgcctcccagatggccctggaagacatcgccatgttcaggactattccgaaatgcaccattttctatcctaccgatgcagtatcaaccgaacacgccgtggccttagccgctaatgcaaaggggatgtgttttatacgaactacccgacctgaaactatggtcatctataccccgcaggagaggttcgagatcggtcaggctaagggtgtgtcaatgctccaggacagctggtcaagcgtaatttcctaccagaaagtgctcaggcactgtgtgtctgataaagtgactgtcatcggagcaggcattacagtctacgaagctttagctgcagccgacgaattgtctaaacaagacatctttatacgagttatcgatctgttcacaattaaacctctggacgtcgccaccatcgtgtcctccgccaaggccactgaggggcgtattatcaccgtggaggatcactacccccaaggggggatcggagaagcagtgtgcgcagctgtgtctatggacccagacatccaggtgcatagtctcgctgtctctggtgttccacaaagtggcaaaagcgaggagctgctagatatgtatggtatttccgcacggcacatcatagtggcggtgaagtgtatgctccttaattag

SEQ ID NO: 138481 - DNA, 1623 bp, Artificial Sequence
  Description of Artificial Sequence: Synthetic coding sequence
atgtccgttctgtttttttacattatgaggtataagcagtccgatccggaaaacccagacaatgatcgtttcgtcttggcgaagcgcctttccttcgttgatgtggcgaccggctggttagggcaggggctcggtgtcgcctgtggtatggcttatacgggtaagtattttgatagagctagctaccgagtgttctgtttaatgagcgacggcgagagctctgagggctccgtgtgggaggccatggccttcgccagttactactcactggacaacctcgttgcgatctttgacgtcaaccgtttagggcattctggcgcattgcctgcggagcactgcatcaatatctaccagcgcaggtgcgaggcattcggctggaacacatacgttgtggacggaagagatgttgaggctctgtgccaagtgttctggcaggcaagccaggtgaagcacaagcccacggccgttgtagcaaaaacgtttaaagggcgaggcacaccatcaatcgaggacgccgagagctggcatgctaagccgatgccacgggagcgggctgacgcgattatcaagctgattgagtcccaaatccaaactagtaggaatctagatccacaaccacctattgaggactctcccgaggttaatattacagatgtgaggatgacgtcgccacccgactacagggtgggggataaaattgcaactcgtaaggcttgtggccttgccctagctaagctggggtacgctaacaaccgcgtggttgtccttgacggtgatactcggtatagcaccttttctgaaatattcaataaggagtatccagagcgtttcatcgagtgtttcatggcggagcagaacatggtgtctgtagccttgggatgcgcatccagaggcaggaccatagccttcgcctctacctttgcagcctttttgacacgcgctttcgaccatattaggattggcggtctggctgagtccaacatcaacataatcgggagtcactgtggtgtttcagttggagatgacggcgcaagtcagatggccctagaagatattgcaatgtttaggactatccccaaatgcacgattttctacccgacagacgctgtgtcgactgaacatgcggttgccctggccgcaaatgctaaggggatgtgttttatccggaccacacggcctgaaacgatggtgatctatacaccccaagaaagatttgagattggccaggctaaggttcttaggcactgcgtctccgacaaagtaaccgtgataggagcgggaatcaccgtgtacgaggctttagccgctgcggatgagctgagcaagcaggatattttcatccgagtgatagatctgttcaccattaagcctctggatgtggccaccatcgtgagtagcgcaaaagccacagagggccgtattattaccgtggaagaccattaccctcagggaggaatcggggaggccgtgtgcgctgcagtctctatggacccagatattcaggtgcactcacttgcagtgagcggagtgccccagtccgggaaatccgaagagctgctcgacatgtatgggataagtgcccgacatattatcgtggccgttaagtgcatgctcctcaactag

SEQ ID NO: 138482 - DNA, 894 bp, Artificial Sequence
  Description of Artificial Sequence: Synthetic coding sequence
atgtcagcttgggccgcagcctccttatcacgggccgccgcccgctgtctcctcgccagaggccccggtgtgcgagcagctcctccccgtgatcctaggccgtcacatccagagccacggggatgtggcgccgccccaggccgcacactccactttactgcagccgtaccagctggtcataacaaatggagcaaggtcagacacataaagggccccaaggatgttgagcgctccagaatcttttcaaagttatgcctaaacattaggctcgccgtgaaggaaggagggcctaacccagagcataactccaatttggcgaatatcctggaggtgtgccggagtaaacacatgccgaagtccaccatagagacagctctcaaaatggagaagtctaaagacacgtaccttctatatgagggcaggggaccaggcggctcatcactcctgatcgaagccctgagcaacagctctcataaatgccaggccgacatcagacacattctgaataaaaacggtggcgtaatggcggtgggcgcgcgacacagcttcgacaagaagggcgtcatcgtggtcgaagtcgaggacagggagaaaaaggccgtgaacttggagcgggcactcgaaatggcgatcgaggccggggccgaagatgtcaaagaaacagaggacgaggaggaaagaaatgtttttaaattcatctgtgatgccagttccctccaccaggtacgcaagaagctggatagtctgggactgtgcagtgtgagttgtgcactcgaatttattcctaattccaaagtccagttggctgaaccagacctcgaacaggctgcgcatctgatacaggccctgtctaaccacgaggatgtaattcatgtctacgacaacatcgagtag

SEQ ID NO: 138483 - DNA, 687 bp, Artificial Sequence
  Description of Artificial Sequence: Synthetic coding sequence
atgtcagtctctgaaatcttcgtcgagctgcaggggttcttggccgccgagcaggatatccgggaggagattcggaaggtggtccagtccctggagcagacagcccgagaaattttaactctgctgcagggcgtccaccagggggccggttttcaggacatcccaaaaagatgcttgaaggcccgcgaacactttggaactgtgaaaacacatctgacctcccttaaaaccaaatttcccgcagaacaatattaccggttccacgaacattggcgattcgtgctccagcgtctggtgttcttggccgctttcgtagtctatctggaaaccgagacgttagtaacaagggaagccgtcacagagattcttgggattgagccagatagggagaaaggattccatcttgacgtcgaggattatttaagcggtgtgctcatccttgcctccgagctctctaggctctctgtcaattcagtaacggccggggactactcacgtccgctccatattagcacattcataaacgaattagactcgggctttcgactcctgaacctgaagaatgacagcctccggaaaaggtacgatggcctgaagtatgacgtgaagaaagtggaagaggtcgtttatgacttatcaatacgcggttttaataaggaaacggctgctgcctgtgtggagaagtag

SEQ ID NO: 138484 - DNA, 585 bp, Artificial Sequence
  Description of Artificial Sequence: Synthetic coding sequence
atgagcgtgtccgaaatcttcgtggagctgcagggcttcttggcagccgagcaggatatccctaagagatgtcttaaagcaagggaacatttcggcaccgtgaaaacccacctgacctccctgaaaacaaaattccccgccgaacagtactataggtttcacgagcattggcggttcgtgctgcagaggctggttttcctcgccgcttttgttgtgtacctcgaaacggagacactcgtgaccagggaggctgtgaccgagatcctaggaattgaacccgatagagagaagggcttccacttggatgtcgaggattatttatccggtgtgctaatattggcaagcgagctgtcaaggctcagtgttaactcagtgactgcgggggactactctcggccactgcacatctcaacctttatcaacgagctcgacagtgggttcaggctgctgaatttgaaaaatgattctctccgcaaaagatacgatggacttaagtacgatgttaaaaaggtcgaagaagttgtttacgacctcagtatccgtgggtttaacaaggagaccgcggccgcctgtgtggaaaagtag

SEQ ID NO: 138485 - DNA, 447 bp, Artificial Sequence
  Description of Artificial Sequence: Synthetic coding sequence
atgtcggtgtcggagatcttcgttgagctacagggatttcttgctgccgaacaggatatccgggaagagattagaaaggtggtgcaatccttggaacagacggcaagagagattctcaccctcctgcagggggttcaccaaggggccggctttcaggacatccctaaacgatgcttgaaggcccgggaacatttcggaaccgttaagacacacctcacatcgctgaaaacaaagtttcccgccgagcaatactatcgattccatgaacactggaggtttgtcctgcagcgactggtgttcttggctgcttttgtggtgtatttggagactgagaccctggtaacacgcgaagccgtcaccgagatactaggtattgaggcggtgtgtcaacagagagattgttggcggttgctacctactccgcctcatctccacctgcatcagtag

SEQ ID NO: 138486 - DNA, 873 bp, Artificial Sequence
  Description of Artificial Sequence: Synthetic coding sequence
atgagcaacaaggagggatcaggagggttcaggaaaagaaagcatgacaatttcccacacaatcagcggcgggagggaaaggatgttaactcgagcagcccagtgatgctcgcattcaagtcctttcagcaggagttagacgctagacacgacaagtatgaacgcctggtaaagttgagcagagacatcactgtggagtcaaagcggacgatcttcttgttgcatcgcattaccagcgccccggatatggaagatatcctgactgagtccgaaatcaaactggatggggttcggcagaaaatcttccaggtggctcaggagctatctggtgaagacatgcaccagttccacagagccattacgaccggcctgcaggaatatgtcgaggcagtgtcatttcaacatttcatcaaaactcgctccctcatctccatggacgagattaataaacagctcatcttcacaactgaggataacggaaaggaaaacaagacccccagctctgatgctcaagataagcagtttggaacatggcgtctgcgggtaacaccagtcgattacttgctgggtgtagctgacctcaccggagagctcatgcgaatgtgcatcaattcagttggcaatggggatattgacactccctttgaggttagtcagttcctgcggcaggtgtatgacgggttttcgttcatcggcaacaccggcccatacgaagtaagcaaaaagctctatacactgaagcagagtttggcaaaggtggagaatgcttgctacgcactgaaggtcagggggtctgaaattcctaagcatatgctcgcagacgtgttctctgtcaagactgagatgatcgaccaggaagaggggataagttag

SEQ ID NO: 138487 - DNA, 492 bp, Artificial Sequence
  Description of Artificial Sequence: Synthetic coding sequence
atgtctaataaggaggggtcgggaggattcaggaagcgcaaacatgataacttccctcataatcagagacgagaggggaaggacgttaattcatccagcccagtgatgctggctttcaagtcctttcaacaggagctcgacgcacgccatgataaatacgaacggctggtaaagctctctcgcgatataacggtggaaagcaagaggacaatttttcttctccaccgtatcacgagtagccagtatctggatcattcagctcctgacatggaggacattctgaccgaaagtgaaattaagcttgatggcgttcgccagaagattttccaggttgcccaggaattgagcggtgaggatatgcaccaatttcatcgcgcaattacaaccggcttacaggagtacgtggaggcagtgtcgttccagcatttcattaagacgaggagcctcataagcatggacgagatcaataagcagttgatctttacaacctag

SEQ ID NO: 138488 - DNA, 273 bp, Artificial Sequence
  Description of Artificial Sequence: Synthetic coding sequence
atggaccctctgagagcccagcagctcgccgccgagttagaggtcgaaatgatggctgatatgtacaaccgaatgacctccgcctgccacaggaagtgtgtacctccccactacaaggaagctgaactgtccaaaggcgagagcgtttgcctggatcggtgtgtgtccaagtacctcgacatacacgagaggatgggaaagaaacttaccgaactttccatgcaagatgaagaattgatgaaaagggtgcagcagtctagtggccctgcttag

SEQ ID NO: 138489 - DNA, 273 bp, Artificial Sequence
  Description of Artificial Sequence: Synthetic coding sequence
atggaccccctgcgcgcccagcaactcgcggccgagctggaggtcgaaatgatggctgacatgtataaccgaatgaccagcgcatgtcaccgtaagtgcgtgcccccccactataaggaggcggagctgagtaaaggggaatccgtatgtttggacaggtgcgtgagcaagtatttggacatccatgaaaggatggggaaaaagctcacagaattgtccatgcaggatgaggagctgatgaagcgcgttcaacaatctagcggccccgcgtag

SEQ ID NO: 138490 - DNA, 273 bp, Artificial Sequence
  Description of Artificial Sequence: Synthetic coding sequence
atggatcctttgagagcgcagcaattggccgcagaactggaggtggagatgatggctgatatgtacaatcgtatgacttcagcttgtcatcgcaagtgcgtgcctccccactacaaagaggccgagctgagcaagggagagagtgtgtgtttggatagatgcgtgtcaaagtatctcgatatccatgagcggatgggaaaaaaactcaccgaattgagtatgcaggatgaggaactgatgaagagagtccaacagtcatccgggcccgcctag

SEQ ID NO: 138491 - DNA, 927 bp, Artificial Sequence
  Description of Artificial Sequence: Synthetic coding sequence
atgaagcattatgaagtcgaaatactcgacgccaaaacacgggagaaactctgctttctcgacaaagtcgaaccgcatgccaccattgccgagattaagaacctgttcactaagacacacccacaatggtatccagcacgacagtctttgagattggaccccaaaggcaaaagccttaaagatgaagatgtgctgcagaagcttccggtgggcactactgcaaccctctattttcgcgacttgggagcccagatcagttgggtcaccgtgttcctaacagaatacgcgggtccactgttcatctacctgctgttctatttccgcgtgcccttcatatacgggcataagtatgatttcacttcatcacgccataccgtggtccatctggcgtgcatttgtcattcgttccactacattaaaagactgctggaaacgctgtttgtccaccgcttctctcacggcaccatgccgctgagaaatattttcaagaactgcacgtattactggggcttcgctgcttggatggcttattacatcaatcatcctctttatacccctccaacgtacggggcccaacaagtaaaacttgctttggcaatttttgtaatctgtcagcttggcaacttcagtattcatatggctctgcgagatctgcgcccagctggttccaaaactcgcaagatcccttatcccaccaagaatccatttacctggcttttcctgctagtaagttgccccaattacacctacgaagtgggaagttggatcggcttcgcaatcatgactcagtgtctgcctgtggcactcttcagcttggtggggttcacgcaaatgaccatttgggcaaaaggcaaacatagaagctacctgaaggagttcagagactaccctcccctcaggatgcctattatacctttcctactatag

SEQ ID NO: 138492 - DNA, 516 bp, Artificial Sequence
  Description of Artificial Sequence: Synthetic coding sequence
atggaagaatacgccagagaaccatgcccgtggagaatagtggatgactgtggcggtgctttcacaatgggtaccattggcggcggaatctttcaggccataaagggctttcgaaactccccagtcggggtgaaccacaggttgcgcggaagtctaacagccatcaagacacgggccccgcagctcggaggatcttttgcagtgtggggcggactgtttagtatgattgactgcagcatggtccaggtacgagggaaagaggacccatggaatagcataacctctggcgcccttacaggcgcaatattggctgcccgtaacggccccgtggccatggtgggcagtgcagctatgggcggcatcctgctggccctcatagagggtgctggcattctgcttactaggttcgcctccgcacagttcccaaacggtcctcagttcgcagaggaccctagtcaattgcccagtacccagctgccctcctctcctttcggtgactatagacagtaccaatag

SEQ ID NO: 138493 - DNA, 519 bp, Artificial Sequence
  Description of Artificial Sequence: Synthetic coding sequence
atggaagaatacgcccgcgagccgtgtccatggcgaattgtagatgactgcggtggagcatttaccatgggtgtaatcgggggaggcgtctttcaggctataaagggctttagaaacgcaccggtcggcatcaggcacagactgaggggctcagccaatgctgtgcggattagggcacctcagatcgggggatcattcgccgtgtgggggggcttgttttcaacaattgactgtggcttggtgcggctcagggggaaggaggatccgtggaacagtataacgagtggggctctgacaggggctgtcctggccgcacggagtggccccctcgccatggtcggatccgcaatgatgggcggaatcctgctggccctgattgagggcgtgggtattctgctgacacggtatacagcccagcagttccggaacgccccaccattcctggaggacccaagccaactgcctcctaaagacggtacccccgccccaggctatccatcctaccagcagtaccattag

SEQ ID NO: 138494 - DNA, 669 bp, Artificial Sequence
  Description of Artificial Sequence: Synthetic coding sequence
atggaagaatacgctcgcgaaccctgtccatggaggatcgtcgacgactgcggaggagcctttacgatgggagttattggggggggggtgttccaggcaatcaagggtttccggaacgcaccggtgtgtagactgctgtcagaagcccccctctttatctattcatgctctcgctcagtgtctcctaccgtcaatgtgagcagtgaaagggccgaaagtagacccacactattcatggccgtcagcctgcacatggcatggtgcctggcccacatcggtatcaggcatcgcctaagaggctccgcgaacgcagttaggattcgagccccccagataggcggcagcttcgctgtctggggcgggctgttctctacgatagactgcggcctggtgcgcctgcgcggcaaggaggatccatggaacagtatcacaagcggcgccctgaccggcgccgtgctcgccgcaaggtctggccccctggctatggtggggtccgctatgatgggcggtattcttctagcgctcatagagggggtcgggatcctgctaaccagatacaccgcacagcagtttaggaacgcccctccgttccttgaagacccttctcagctccccccgaaagatggcacacccgcccccggttatcccagttaccagcagtaccactag

SEQ ID NO: 138495 - DNA, 585 bp, Artificial Sequence
  Description of Artificial Sequence: Synthetic coding sequence
atggccgccgcagctcctaacgctgggggaagtgcgccagaaaccgcaggatccgcagaggcaccgctgcagtactctttactcctgcagtatctcgtgggggacaaaagacagccacggctcctggagcccggctctctgggcggcattccttcccccgccaagtcagaggagcagaaaatgattgagaaggcaatggaaagctgcgccttcaaggccgccttggcctgcgtgggtggcttcgtgctgggaggggcatttggggtgtttacagctggtatcgacaccaatgtgggtttcgatcccaaagatccttataggaccccaacagccaaggaggtgctgaaggatatggggcagcgcggaatgagttatgctaaaaactttgctatcgtgggagccatgttttcttgcacagagtgcctgattgaatcctacagaggcacctctgattggaagaattccgtaattagtgggtgtatcacagggggcgccatcgggttcagagctggactgaaggccggggcgattgggtgcggggggttcgctgctttctcagcggcaatcgactattatcttcgctag

SEQ ID NO: 138496 - DNA, 630 bp, Artificial Sequence
  Description of Artificial Sequence: Synthetic coding sequence
atggaaggcggtggcggcagcggcaataagactactgggggccttgccgggttctttggtgccggcggagctggctattctcacgcagacttagctggcgtgccactgaccggcatgaatccactttcgccctacttgaatgtagacccgagatatctggtccaggacacagatgaattcatcctgcctacaggcgccaacaaaacccgcggtcgctttgagctggccttttttaccattggcggatgctgcatgaccggagcagcctttggggctatgaacggtctgcggctggggctcaaggagacccagaatatggcctggtcaaagccacggaacgtccagattctcaatatggtcactcggcagggcgcgctctgggccaacactttgggttccttggcgcttctgtactcagcttttggtgtgatcattgagaagacacggggcgccgaagacgatttaaacacggtggcggcgggaacaatgacagggatgctatataaatgcacaggcggattgcggggcatcgcaagaggtggcctgacagggctgaccctcaccagcctgtacgccctctacaacaattgggagcacatgaaaggtagcctgctccagcagagcctatag

SEQ ID NO: 138497 - DNA, 486 bp, Artificial Sequence
  Description of Artificial Sequence: Synthetic coding sequence
atggaaggtggcggcggtagcgggaataagaccaccggcggtctggcgggctttttcggagctggaggagccggatattcacatgccgacctcgctggtgtgcccttgaccgggatgaacccactcagcccttatctgaacgtggatcctaggtacctggtccaggataccgacgagtttatcctcccgacaggcgccaacaagacccgcggtaggttcgagcttgcgtttttcaccatcggaggatgctgcatgactgccctcttgtattctgcttttggcgtgatcattgaaaaaacccgcggggccgaggatgacctgaatacagtcgccgctggaacgatgaccggcatgttgtacaaatgtacaggcggtttaagaggtatcgccagggggggcctgacggggctgactctcacctcactgtatgctctctacaataactgggaacacatgaagggcagcctgctgcagcagagcctgtag

SEQ ID NO: 138498 - DNA, 519 bp, Artificial Sequence
  Description of Artificial Sequence: Synthetic coding sequence
atggaaggcggagggggaagcggcaataaaacaactggtggtctcgccggcttctttggagccggtggtgcgggatattcccacgctgatctcgctggggtgcctcttaccggcatgaaccccttaagtccttatctcaatgtggatcctcggtacctggttcaagatacagatgagttcatcttgccaaccggagccaacaagaccagagggaggtttgaacttgcatttttcacaatcggggggtgttgcatgaccggggccctgtgggctaacaccttgggctcattagcactcctatacagcgcattcggcgtgatcatagaaaagacccgaggcgcagaagacgatctgaatacagttgccgctgggaccatgaccggcatgctgtacaaatgtactgggggattgagaggaatagcgcgaggcggactgactggcctgaccctaacgagcctctatgcgctgtataataattgggagcatatgaagggcagcctcttacagcagtctctctag

SEQ ID NO: 138499 - DNA, 381 bp, Artificial Sequence
  Description of Artificial Sequence: Synthetic coding sequence
atgacgggagccgcattcggcgccatgaacggcttacgcttgggcctgaaagagacacagaacatggcctggagcaaacctagaaatgtgcaaatcctgaatatggtgacgcggcagggagctctctgggcaaatacactcggcagccttgccctcctctattcagcattcggcgtgatcatagaaaaaaccaggggagcagaggacgatctcaataccgtcgccgcgggaacaatgaccggaatgctgtacaaatgtaccgcaagtgccagtcagtccgccaggatagccgacggcctgatttttaccgagttttgtagcgtcgcgaggctgcagggttccgggactattcttgcccattacaatctacatctcccgtag

SEQ ID NO: 138500 - DNA, 324 bp, Artificial Sequence
  Description of Artificial Sequence: Synthetic coding sequence
taaggaggtagtgggaataagacaacaggtggcctggccggatttttcggagctggtggagccggatatagccacgctgatctggcgggcgtgccccctctgctgtactcagctttcggtgtcattatcgagaaaacccggggggcagaggatgatctgaacaccgtagccgctggaactatgacgggcatgttatataagtgtacaggcggattgagagggatcgccagaggcggactcaccggcctaacattgaccagcctgtacgctctgtataacaactgggaacacatgaaaggaagtttactgcagcagtcgctctag

SEQ ID NO: 138501 - DNA, 1359 bp, Artificial Sequence
  Description of Artificial Sequence: Synthetic coding sequence
atggccgccgccgcattgcgcagcggttggtgcagatgtcctcgccggtgcctgggaagcggcatccagtttttgtcatcccataatttgccacatgggagtacgtaccagatgcgcagacccgggggcgagctgccgctttcaaagtcttactcaagcggaaaccgcaaggggttcctctctggtctgttggataacgttaagcaggagctggccaagaacaaggaaatgaaagaatcaattaagaagttcagagacgaagctcgtcgcctggaagagtctgatgtactccaggaggcccgcagaaagtacaaaactattgaatcagaaaccgtgcgcaccagcgaggttttgcggaagaagcttggggagttgactggcacggtgaaggagtcattacacgaggtttccaagtcagatctgggaagaaaaattaaggaaggggttgaggaagcagcaaagaccgccaagcaaagcgcagaatctgtgtccaagggcggcgaaaagcttggccgcacagcggccttccgagcactgtctcaaggcgttgagagcgtcaaaaaagagattgatgactccgtgctcgggcagaccggcccatatcgacgcccacagagattgagaaagcggactgagtttgcgggcgataaatttaaggaggaaaaagtgttcgaaccgaacgaggaagcccttggggttgtcctccacaaggactcaaagtggtaccagcaatggaaggatttcaaggagaacaacgtcgtgttcaacagattctttgagatgaaaatgaagtatgacgaatctgataatgctttcatccgcgcttcaagggcgttaacggataaagtgacggatttactcggtggtctcttcagtaaaaccgagatgtccgaggtgctgactgaaatcctgcgggtggaccccgcgtttgacaaggacagatttctgaaacagtgcgaaaatgacattatccccaacgtgctcgaggccatgatcagcggagaactggacatactgaaggactggtgttacgaggccacatattcccagctagcccatcctatccagcaggctaaggctctgggactgcagtttcatagcagaatcctcgacattgataatgtggacctggctatgggcaagatgatggagcaggggcctgtgttaatcatcacctttcaagctcagctagtcatggtggttcgtaatcccaaaggcgaagtggtggaaggagatccagacaaagtgttgagaatgctatacgtgtgggcactctgccgcgaccaagacgaacttaatccgtatgcagcatggcggctgctggatatatctgctagctccacagaacagatactctag

SEQ ID NO: 138502 - DNA, 294 bp, Artificial Sequence
  Description of Artificial Sequence: Synthetic coding sequence
atggacagctcctccagtagttctgcggccgggctgggagcagttgacccccagctgcagcactttatcgaggtagagactcagaagcagcggtttcagcagttagttcatcagatgaccgaattgtgttgggagaagtgtatggataagcctggccctaagctcgatagtagagcggaggcctgctttgtcaattgcgtcgaaaggttcatagatacgtcacagttcatactgaatagactggaacagacccaaaaatctaagcccgtattctctgagtctctaagtgattag

SEQ ID NO: 138503 - DNA, 270 bp, Artificial Sequence
  Description of Artificial Sequence: Synthetic coding sequence
atggcggcacagatcccagagtctgatcagatcaagcaattcaaggaatttttaggaacctacaacaagctgacggagacttgttttctggattgcgtgaaggacttcacaactcgggaagtcaaacccgaggagaccacatgcagcgagcactgtctccagaaatacctgaagatgacacaacgtatttctatgcgattccaagagtaccatattcagcagaatgaggctctagccgccaaggctggtcttctgggccagccccgctag

SEQ ID NO: 138504 - DNA, 270 bp, Artificial Sequence
  Description of Artificial Sequence: Synthetic coding sequence
atggcagcccagattcccgaatctgaccagatcaaacagttcaaggagttcctcgggacctacaataagttgactgaaacctgttttctggattgtgtaaaagacttcactacaagagaagtgaagcccgaggaaacaacttgctctgaacactgtctgcagaagtacttgaagatgacccaaagaataagtatgaggtttcaggagtatcatatccagcagaatgaagcgttggctgctaaagccggcctcctcggccaaccaagatag

SEQ ID NO: 138505 - DNA, 135 bp, Artificial Sequence
  Description of Artificial Sequence: Synthetic coding sequence
atggccgcccagatacccgaatcggaccaaataaagcagttcaaggagttcctgggaacttataacaagctgaccgaaacatgttttctggactgcgtcaaagacttcactacccgcgaagttaagcctgaatag

SEQ ID NO: 138506 - DNA, 270 bp, Artificial Sequence
  Description of Artificial Sequence: Synthetic coding sequence
atggcagcccagattcccgagtcggatcagataaagcagttcaaggaattcctgggcacttacaacaaacttaccgagacatgctttctagactgcgtcaaagacttcacgactagagaggtcaaacctgaagagaccacgtgctctgaacactgcctgcagaaatatctgaaaatgacacagcgtatcagcatgaggtttcaggaataccacattcaacagaatgaagccctggctgctaaagccggcttgctcgggcagccgcggtag

SEQ ID NO: 138507 - DNA, 270 bp, Artificial Sequence
  Description of Artificial Sequence: Synthetic coding sequence
atggcggcccagatacccgaaagcgaccagattaagcagtttaaggagtttctcggtacatacaacaaacttacagagacgtgttttctggactgtgtcaaggacttcacgacgagggaagtgaagcctgaggaaacaacctgctcagagcactgcttgcagaagtacttaaagatgactcaacggatcagcatgaggtttcaggagtaccatatacaacaaaatgaggcactggccgccaaagccggcctcttggggcagcctcgctag

SEQ ID NO: 138508 - DNA, 381 bp, Artificial Sequence
  Description of Artificial Sequence: Synthetic coding sequence
atgcctttctttggaaacacattctcgcccaagaagacgccaccacggaaaagcgcgtctctgtctaatcttcattcgttggatagatcaaccagggaggtagaattgggcctcgagtatggcagtcccacaatgaatctggccgggcaatccctcaagttcgagaacggtcagtggatcgctgagaccggggtttccgggggagtagatcggagagaagtgcaacggcttcggcggcgcaatcaacagttggaggaagaaaacaatctgcttcgcctgaaggttgacattctgctcgacatgctgtctgaatccaccgccgagtctcatttaatggaaaaagaactagacgaactaaggatttcccgaaagagaaaatag

SEQ ID NO: 138509 - DNA, 1086 bp, Artificial Sequence
  Description of Artificial Sequence: Synthetic coding sequence
atggggaacgtgttagccgcatcatctccacccgccggaccgccgcccccacccgcgcccgcgttggtaggcctgccaccaccgcctccgtccccccctggctttacactcccgccactggggggctctctgggtgccggcacctctacctcccggtcatccgaacgcacgcctggcgccgctacagcttcagcgtctggagccgccgaagatggcgcttgcggttgcctgcctaatcccggaacattcgaagagtgccaccgcaagtgcaaggagctgttccccattcagatggagggagtgaagctgactgtgaataaagggttaagtaaccactttcaggtgaatcacactgtggccctcagcacgataggagaaagtaactatcattttggagtcacctatgttggcaccaaacagctcagcccaacggaagccttccccgtgcttgtgggggatatggataattctgggtctctcaatgcgcaggtcatccaccagctcggccctggcctaagaagcaaaatggccatccagacccagcagtccaagttcgtgaattggcaggtagatggtgagtaccggggttccgactttaccgccgccgtcactctggggaacccagacgtcctcgtcggatctggcatcttggttgctcactatctgcagtcaataaccccttgcctggctcttgggggtgagctggtatatcaccggaggccaggtgaagagggaaccgtaatgagtctggccggcaaatacactctcaacaactggcttgccaccgtgacactaggacaagcagggatgcacgccacctactatcacaaagcaagtgaccagctccaggtcggggtcgagttcgaggcctcgacccggatgcaggacacatcagtgtcatttggatatcagctcgatctacctaaggctaatctgttatttaaaggaagcgttgacagcaactggatcgtcggagccactttagaaaagaaactaccacctcttcccctgaccctggcactaggagcatttctaaaccatagaaagaacaagttccagtgcgggttcgggctcacaatcggatag

SEQ ID NO: 138510 - DNA, 1086 bp, Artificial Sequence
  Description of Artificial Sequence: Synthetic coding sequence
atggggaacgttcttgcggcatcttccccaccagccggccctccacctcccccagccccagctcttgtgggcttaccacccccccctccctcccccccgggtttcacgctaccgcctctgggcggcagtctgggcgctggcacttccacttcgcgaagttctgaaagaacacccggggctgccacagccagtgccagtggcgcagctgaagatggtgcatgcggttgcctccccaacccgggaacctttgaagagtgccacaggaaatgcaaagagttattccccattcagatggaaggggttaagttgacagtcaacaaggggctgagtaatcattttcaggtcaaccacactgtagccttgtctacaataggcgaatctaactaccactttggtgtgacatacgttggcacaaagcagctgagtccaacggaggcctttcctgtgctcgtgggagacatggacaactccgggagtctgaatgcccaggtgatccaccagctcggtcctgggttacggagcaaaatggccatccaaacccagcagtccaaattcgtcaattggcaggtggacggggaatatagaggttccgacttcacagccgctgtcactttaggaaacccagacgtgcttgtcggcagcggcattctggttgctcattatctacagtctatcacaccttgccttgcgctgggcggtgaactggtataccacagaagacccggtgaggaaggtacagtcatgtccctagcagggaagtacactctaaacaactggctggctactgtgaccctcggacaagctggaatgcatgctacatattaccataaggcgtccgaccagctgcaagtaggcgtggaattcgaagccagtactaggatgcaggacactagtgtgtcatttggttaccagctggatctcccaaaggccaatctgttatttaagggcagcgtagactccaactggattgtgggagctaccctggaaaagaagttgcccccacttccgctgacccttgctctgggcgctttcctcaaccacaggaagaacaagtttcagtgcgggttcggtttaaccatcggatag

SEQ ID NO: 138511 - DNA, 1086 bp, Artificial Sequence
  Description of Artificial Sequence: Synthetic coding sequence
atgggaaatgtgctggcggcctcgtccccccccgcgggcccaccaccccccccagcgccagcgttggttggactccctccaccacccccctcaccacccgggttcaccctgccacctttgggcggaagcttgggggctggtacctcgacatccagatcttcagagcgcacccctggggccgctacagcctccgcctctggcgccgcagaggacggcgcctgtgggtgtctgccaaaccctgggactttcgaggaatgtcatcggaagtgcaaagagcttttccccatccagatggaaggcgtaaagcttaccgtcaataagggcctctctaatcacttccaagttaatcacacagtggcactcagcacaatcggggaatcaaactaccacttcggtgtgacttatgttggcactaagcagcttagtcccacagaggcgtttccagtcctcgtcggagatatggataattccggctccctcaacgcccaggtgatccatcagctgggaccaggactgaggtctaagatggcaattcagacacagcagtccaaattcgtgaattggcaggtggacggggagtacagagggagcgatttcacggcagccgttacgttggggaaccccgacgtcttggtgggttccgggatcctggtcgcccactacctgcagtcaattaccccctgcttggctctcggcggggagctggtttatcatcgcaggccaggcgaggaagggaccgtcatgagtttggctggcaaatacacccttaacaactggttggctaccgttacactggggcaagctgggatgcatgcaacgtattaccataaggctagcgaccaacttcaggtcggggtggagttcgaagccagtactcgcatgcaggatacctcagtatctttcggctaccagctggatttgcctaaggctaacctgctgttcaaaggtagcgtggacagtaattggatcgtaggggctactctagagaagaagctgcctcccctgcccctgactctcgccctcggcgcatttctcaatcatcggaaaaacaaatttcagtgtgggttcggactaacaatcgggtag

SEQ ID NO: 138512 - DNA, 453 bp, Artificial Sequence
  Description of Artificial Sequence: Synthetic coding sequence
atgccttcatcgggatcagtatcccggagtcgccagcgaggccggagcatggcctctcggggattcgatggtagtcggaggggatcactcagaagagccggagcgcgagaaccaccatcggaggtgattgaggctgccgctcaggccagcggatcgtgttggagtagtcccttctttagtgcatctactccctctgcagccgctacaggggtcccaggcccaactgacatggcagccgtcctacagcaagtgctcgaacgaaccgagctgaataaactaccgaaatctgtacaaaacaagcttgagaaatttctggccgatcagcaaagtgaaatcgatgggctgaagggccgtcatgaaaaatttaaagtggagagcgaacagcagtatttcgagattgagaagcgattatcccactcccaggagagattggttaatgagacccgcgaatag

SEQ ID NO: 138513 - DNA, 7092 bp, Artificial Sequence
  Description of Artificial Sequence: Synthetic coding sequence
atggccgctgtcttgcaacaggtattagaacggaccgaactgaacaaactgcctaaatccgttcagaataaactggaaaagttccttgccgatcagcagtccgagatcgacgggctgaagggccggcatgaaaagttcaaggttgagtccgagcagcaatactttgagatagaaaagagactgagccacagccaggaacgcctggtcaatgagaccagggaatgccaatcactgagactagagctcgagaagctgaacaatcaattgaaagcactgaccgagaagaacaaagaactggagatagcccaggacaggaacattgccatccagtcccagtttacaagaacaaaggaggagttggaagcagaaaaacgggacttgattaggacaaatgagcggctgtcccaagaactagaatacctcactgaagatgtgaagcgccttaatgagaagctcaaggagtctaacaccactaaaggcgagctgcaactgaagttagatgagttgcaggcctccgatgtgtctgtgaaataccgcgagaaaaggctcgagcaagagaaagagctgctgcactcacagaatacatggctcaataccgaactgaaaaccaagactgacgaactgctggccctagggcgggaaaaaggaaacgaaatactcgaactgaagtgcaaccttgagaacaagaaggaggaagtttctagactggaagagcagatgaacggccttaagacctcaaacgagcacctccaaaaacacgtggaggaccttttaactaaactgaaggaggccaaggagcagcaggcatcaatggaagagaagtttcataatgaactcaatgcacatatcaagctgtctaacttgtataaaagcgccgcagatgactcggaggcgaagtctaacgagctcactcgcgccgtcgaggaactccataaactgctgaaggaagccggggaagcaaacaaagccatccaagaccacttactggaagttgaacaatcaaaggaccagatggaaaaggaaatgctcgaaaagatcggtcggctggagaaggagctagaaaacgcaaacgacctgttgagcgcaactaagcgtaaaggggcaatcctctctgaggaggaattggctgccatgagccccacagccgcggccgtagcgaagatcgttaaacccggtatgaagcttaccgagttgtataacgcttacgtagagacccaagatcagctgctgttggagaagttagaaaataaaagaattaataagtacttggacgagatcgttaaggaggtggaggcaaaagccccaatcctgaagcgccagcgagaagagtatgaacgcgcacaaaaagccgtggccagcctgagcgttaagcttgagcaggcgatgaaggagatacagagattgcaggaagacacagataaggcaaataaacagagttctgtcctggaaagggataaccggagaatggagattcaggtgaaggatctgtcccaacagatacgagtgcttttaatggagctcgaggaggcccggggcaaccacgttattagggacgaggaggtgagtagtgccgatatctcttcctcatctgaggtaatttctcagcatctggtctcctaccggaacatcgaggagctgcagcagcagaatcaacgcctgctagtcgccctcagggaactcggagaaacccgggagcgggaagagcaggagaccacgtcctccaaaataaccgagcttcagctgaagctggagtcagcactgactgaacttgaacagctgcggaagtctcgacaacatcaaatgcagcttgtggatagtatcgtgcgccagagggacatgtacagaatcctgctgagtcaaacaactggggttgcaatcccacttcatgcatccagcctggatgatgtcagcctcgcaagcaccccaaagcggcctagtacttcacagacagtgagcacacctgcccctgtgccagtgatcgagagtaccgaggctatcgaagccaaggccgcactcaaacagcttcaggaaatatttgagaattataaaaaagagaaggctgagaatgagaaaatccaaaacgaacaattggagaaattgcaggaacaggtcacagatctccgctcccagaatacaaagattagcacccagctggacttcgcatcgaaaagatacgagatgttgcaggataacgttgagggttatagaagggagatcacatcactccacgaacggaatcagaaattgaccgccacaactcagaagcaggagcagataatcaacaccatgacacaggatctacgcggagcaaatgagaagctggcagtagccgaggtgcgagcagagaacctgaagaaggagaaggaaatgctcaagctgagtgaggttaggctatcccaacagagggagtctttgctggccgagcagcgtggccagaacctgcttctgacaaatctgcaaacaatccagggaatactcgagaggtctgagacggagaccaagcagaggctttccagccagattgagaagctggaacacgagattagccacctgaaaaagaagctggagaatgaagtggaacagagacacaccctaactagaaacttggacgttcagctgcttgacaccaaaagacagctggacaccgagaccaacctgcatcttaataccaaggaactgctcaagaatgcccagaaggagatcgcaactctgaaacagcacttaagcaatatggaagtgcaggtcgcgtctcaaagttctcagcgcaccggcaagggccagccatccaataaggaagatgtggatgatcttgtatcacagctgagacagacggaggagcaagtcaatgacctgaaggaacgattaaagacctcaacatctaacgtggagcagtatcaggctatggtcaccagcctcgaagagtcattaaacaaggagaaacaggtgactgaagaagtgagaaagaacatagaagtaagactgaaagagtcagccgagtttcaaacccagttagagaagaagctgatggaggtcgagaaggaaaagcaggaactccaagacgacaaaagaagagctatagagtccatggaacaacaactgtccgagctcaaaaagacactttccagcgtccagaatgaagtccaagaagcccttcagagggcatccaccgccctgtccaacgagcagcaggctcgcagagattgccaagaacaagcaaagatcgccgtggaggcccagaataagtatgagagggagctgatgcttcacgccgcagacgtcgaggcattgcaggctgctaaggagcaggtgagcaagatggcatcggtgcggcagcacctggaggagactacacaaaaggcagaatcacaactgctcgagtgcaaagcctcgtgggaggagcgtgaacggatgttaaaggatgaggtaagtaagtgtgtgtgtcgttgcgaggatcttgagaaacagaacagattactgcacgatcaaatcgagaagctgtcagataaagttgtggcctctgtcaaagaaggcgtccagggaccccttaacgtgtcactctctgaagaggggaagagccaggagcaaatcctcgaaatccttagattcattaggcgggaaaaggaaatcgcggagaccaggtttgaggtggctcaagttgaaagcctaaggtataggcaacgcgtggagctgctcgagagggagttgcaagaactgcaggacagcctaaacgccgagcgtgaaaaagttcaggtcacagcgaagaccatggcccaacacgaagagctcatgaagaaaacagaaacaatgaatgtggtaatggaaaccaataaaatgttgcgggaagagaaggagaggctggagcaggatctccagcagatgcaggccaaagtaaggaaactcgaactggatatactaccacttcaggaagccaacgccgagctgtctgagaaaagtgggatgctacaggccgaaaagaagctgcttgaagaggacgtcaagcgatggaaggctcgcaatcagcatttggtaagccagcaaaaagatcccgacactgaggaatatagaaagctgttatctgagaaggaagttcataccaagcgcattcagcaactcaccgaggagatcggccggctgaaggctgaaatcgcgaggtccaacgctagcctcaccaataatcagaacctgattcaatccctaaaggaggatctaaataaagtgaggaccgagaaagagacgattcaaaaagatctggatgccaaaattattgatattcaagagaaggtgaagactattacacaggtcaaaaaaattggtaggagatacaaaacacagtatgaggaactaaaggcgcaacaggacaaagtgatggagacgagtgcccagtctagtggcgatcaccaggagcaacacgtgtccgtgcaggagatgcaggagctcaaggagacccttaatcaggccgaaaccaaatcaaaatcccttgaatcacaggttgaaaacttgcaaaaaaccttgagcgagaaagaaaccgaggctagaaaccttcaggagcagacagtccagttacagtccgaattgagtagactgagacaggacctgcaggaccgcaccacacaggaagagcagttaagacagcaaatcacggaaaaagaggaaaaaactaggaaggcaatagtagcggctaaatcaaaaattgctcacctcgctggagtgaaggatcagctcacgaaagagaacgaggagttaaagcagaggaacggggccttggatcagcagaaggatgaactggatgttagaatcaccgcgctaaaatcacaatacgagggcagaatcagtcggctggagcgagagctgcgcgaacaccaggaaagacacttggaacagcgcgatgaacctcaggagcccagcaataaagtgcctgaacagcagcggcagattaccctaaagacaacgcccgcctcaggagagcgtggaatcgccagcaccagcgatccccctactgcaaacatcaaaccaactcctgtagtgagtacaccctcaaaagtaactgctgctgcaatggcaggcaacaagagcactccccgagccagtatcaggcccatggttacacccgctaccgtgaccaaccccaccactacacctacagcgacagtcatgccaactacacaggtggagtcccaagaggctatgcaatccgagggtcctgtcgaacacgtccccgttttcggcagtaccagtggttctgtaagatctacttcacccaacgtgcaaccctctattagccaaccaatcctcaccgtgcagcagcagacccaagccactgccttcgttcagcccacccagcaatctcatccccagattgaaccggcaaatcaggagttgtcctctaacattgtcgaagttgttcagtcatctcctgtggaaaggccaagcacgtccacagccgtcttcggaaccgttagtgctactccctcttcatctttgcctaagaggacaagagaggaggaggaggacagcaccatcgaagctagcgatcaggtcagcgatgacacagtcgagatgccattgcctaagaagctaaagtcggtaacccccgtgggaacagaggaggaggttatggcggaagagtccaccgacggagaagtagagactcaggtctataaccaggatagtcaggacagtatcggagaaggagttactcagggggattatacccccatggaggactccgaggagaccagccagagcctgcagatcgacctcgggcccttgcagtctgaccaacagaccactacatccagccaggatggacaggggaaaggggatgacgtcatcgtgattgacagtgatgacgaggaagaggacgatgatgagaacgacggggagcacgaagactacgaagaggatgaagaggacgatgacgatgatgaggacgacacgggcatgggggacgaaggagaggacagcaacgagggcacaggcagtgctgacggcaatgacggctacgaagctgatgacgcagaggggggcgacggtaccgatccaggtacagaaaccgaggaaagcatgggaggtggggagggcaatcatcgggctgccgattctcagaactccggagaaggcaacaccggggcagcggagtcatcgttttcccaggaagtctcccgggagcagcagcctagctctgcctctgagaggcaggcaccacgggcccctcagagtcccagacggccccctcaccccttgcctcctcgtttgacaatccatgcacctccgcaggagttgggaccacccgtccaaaggatccaaatgacccggcgacagtccgtgggccgcggcctgcagttgacacctggcatcggcggaatgcagcagcatttttttgacgatgaggaccggaccgtgccgtctactcccacactggtcgtgccccatcgaacagacggtttcgctgaagcgatccacagcccacaagtcgctggtgttccccggttcaggttcggaccgcccgaggatatgcctcaaacatcatcctctcactccgatctcggccagctcgcatcccagggcgggcttggtatgtacgagacaccactattcctcgcccacgaagaagagagtggcggccggtccgtccccacgacccctttgcaggtggctgcgccagtgaccgtttttactgagtcgaccactagtgacgccagcgaacatgccagccagagcgtccctatggtcaccactagtacgggaaccctcagcacaaccaatgaaaccgcgactggcgatgacggcgacgaggttttcgtcgaggctgaaagtgagggtataagtagcgaagctggactggaaatcgactcccagcaggaagaagaaccagtgcaagctagcgatgaatccgatcttccgagcacaagccaggatcctccttcttcctcatctgtcgatacaagctccagccagccaaagccctttcgacgggtcagactgcaaactacactgcgccaaggcgttcgcggaaggcagttcaaccgtcagagaggagtcagtcatgcaatgggtggccgtggtgggatcaaccggggcaatatcaactag

SEQ ID NO: 138514 - DNA, 453 bp, Artificial Sequence
  Description of Artificial Sequence: Synthetic coding sequence
atgccctcatctggctcagtgtctcgctctcgccaacggggcaggagcatggcatcccggggcttcgacgggtccagaagaggctctctgaggcgggctggggccagagaaccaccctccgaagtaatcgaagccgcggctcaggcctctggttcatgttggagcagcccatttttcagtgcctccacccccagcgcggccgcgactggcgtgcctggacccaccgacatggccgcagtgctccaacaggtgctggaacgaaccgagctgaacaaactgccgaagtcagtacagaacaaactcgaaaagttcctggctgatcaacaaagtgagattgatggacttaagggaagacacgagaaattcaaggtagagtctgagcagcagtacttcgagattgagaagcggttatctcacagtcaggagagattggtcaatgagactcgagaatag

SEQ ID NO: 138515 - DNA, 510 bp, Artificial Sequence
  Description of Artificial Sequence: Synthetic coding sequence
atggcccctccgtgggtgcctgccatgggattcactctggccccatcactgggatgcttcgtaggctcccgttttgtgcatggcgaaggattacgatggtacgctggactgcaaaaaccgtcatggcacccacctcactgggtgttgggccctgtttggggaacgctttactctgcgatgggctacgggtcctatcttgtctggaaggaactcggggggttcacagagaaggcagtggtgcccctgggactgtataccggtcagctggctctgaattgggcttggccgcctatcttttttggagctcgccagatgggctgggcccttgtagatctgcttctggtgagcggcgctgctgccgctaccaccgtcgcttggtaccaggtcagcccactggctgcacgcttgttgtatccatacctggcatggctagcctttaccaccactctgaattattgcgtgtggcgggacaaccacggatggcgtggtggcaggcggttgccagaatag

SEQ ID NO: 138516 - DNA, 510 bp, Artificial Sequence
  Description of Artificial Sequence: Synthetic coding sequence
atggcaccaccttgggtacccgctatgggtttcacccttgcgccttccttgggctgcttcgtggggtcccggtttgtacacggagaaggcctgcgatggtatgccggccttcagaagccatcctggcacccccctcactgggtcctcgggccggtttgggggactctctacagcgccatgggatatggatcgtatctcgtgtggaaggagctcggcgggttcactgagaaggccgtggttccgcttggcctctacaccggccaactcgccctgaattgggcgtggcctcccattttctttggggcaaggcagatgggctgggccctggtagacctgctacttgtgagtggcgccgcagcagccactactgtagcttggtatcaagtgtctccactggcggcaaggctgctatacccctatctcgcatggctggcctttacgactactctaaattattgcgtctggagggacaatcatggctggcgcgggggccggcggctgccggagtag

SEQ ID NO: 138517 - DNA, 309 bp, Artificial Sequence
  Description of Artificial Sequence: Synthetic coding sequence
atggctccccacctactctggtgtcccacgaatgggctggggcttggcggttctccagccggccagtggggcggcgggagccattacagaggcctggtccctggcgagcccgctggtaggccacccgccttaccattgcccggcctggcgggcctgcacgaccatactcagctcctccgcatggctggtcagccctggctggcatggggaactgcagccgcccgcgtgtctgcccgcccaaccagagattgtagttgcacgtcgcgttgccaccatgcctgtgacgtggtggcagtgaccctgagctag

SEQ ID NO: 138518 - DNA, 324 bp, Artificial Sequence
  Description of Artificial Sequence: Synthetic coding sequence
atggccccaccctgggtgcccgccatgggctttactctcgcccctagcctgggctgttttgtgggaagccgttttgtgcacggcgagggcctccggtggtatgcgggccttcagaaaccctcatggcatccaccccactgggtgcttgggcctgtatggggcactctgtactcagctatgggatacggtagttacctcgtatggaaggaactgggtggcttcacagagaaggcagtggtcccattaggactgtacacaggccagctcgccctgaactgggcttggcctccgatcttcttcggcgctcggcagatgggctggtag

SEQ ID NO: 138519 - DNA, 609 bp, Artificial Sequence
  Description of Artificial Sequence: Synthetic coding sequence
atgtgctatggaaagtgcgcacggtgcattggacactcgctagttggcctggccctgctgtgcattgcagcaaacatcctgttgtatttcccaaatggggaaactaagtatgcatcggaaaaccatctgtctcgttttgtgtggttttttagtggaatcgtcggtggaggtctcctgatgttgctgcctgcattcgtcttcattgggctcgagcaggatgactgttgtgggtgctgtggacacgagaattgcgggaaaaggtgcgccatgctctcgagcgtcttggccgcccttattgggatcgcgggctccggctattgcgtcattgtggccgccctcggtctggctgagggtcccttatgtttggactctctcggacagtggaattacacctttgccagtacagaagggcaataccttctggacacttctacctggtccgagtgcactgagcctaagcacatcgtagagtggaacgtgtctctgttcagcatactactggccctcgggggcatcgagtttatcctctgccttatacaggtgatcaatggagtgttaggcgggatatgcggtttttgttgctctcatcagcaacagtatgactgctag

SEQ ID NO: 138520 - DNA, 699 bp, Artificial Sequence
  Description of Artificial Sequence: Synthetic coding sequence
atgtgttatgggaaatgtgccaggtgcataggacattcactggtaggcctggcactgctctgtatcgccgccaacattcttctttatttccccaatggagagaccaagtatgcctccgaaaatcatctctccaggttcgtctggttctttagtggcatcgtgggcggcggattgctgatgctgctaccagcatttgtcttcattggactcgagcaggacgattgctgcggctgttgcggccatgaaaactgcggcaagagatgcgctatgctgtccagcgttctggctgcattaattgggatcgcggggtcgggatattgtgtgattgtcgcagcccttggtctcgccgaagggcccctgtgcctcgactcattaggccagtggaactacacctttgccagtacagaaggtcagtacctcctcgatacgtcaacttggagcgagtgtacggagcccaaacacatcgtcgaatggaatgtgtcgttatttagcattctgttagctctgggcggtatagagttcattctgtgtctcatccaggttattaatggtgtactgggcggaatttgcgggttctgttgctcgcaccagcagcaaatgacagcaaagcggaccaacccaggacaatcccacaacctgcccctatttcattgcaatctgtatataagtctcgtgttcatttgtaagacattgtattag

SEQ ID NO: 138521 - DNA, 609 bp, Artificial Sequence
  Description of Artificial Sequence: Synthetic coding sequence
atgtgtacaggcgggtgtgcacggtgcttgggagggacactcatccccctcgcttttttcggattcctggctaatattttgctgtttttccccggaggaaaagtgatcgatgataatgaccacttaagccaggagatttggttttttgggggcatactgggatcaggggtgttaatgatttttcccgcccttgtgttcctggggctgaaaaataatgattgttgtggctgttgtggtaatgaggggtgtggcaagagatttgcgatgttcacctctaccatctttgccgtcgtgggctttctgggcgccggatacagttttatcatcagcgcgatctccataaataaaggtccgaagtgcctgatggccaattcgacttgggggtatccatttcacgacggcgattacttgaatgacgaagccctttggaacaaatgcagagagcccctcaacgtcgtgccctggaatctcactctattctcaattttgctcgttgttggaggcatccagatggtcctgtgcgcaattcaagtggttaatggcctgctcgggaccctgtgtggtgattgtcagtgttgtggctgctgtgggggcgacggtcccgtgtag

SEQ ID NO: 138522 - DNA, 594 bp, Artificial Sequence
  Description of Artificial Sequence: Synthetic coding sequence
atgtgtaccggaaagtgcgcaaggtgcgtgggcctgagcctgataacgctgtgtctcgtttgtatcgtggcgaatgcactgctgttggtcccaaacggagaaacctcttggaccaacaccaaccacctgagcctgcaagtttggctgatgggcgggttcataggcggaggtttgatggtgctgtgtccagggatagcagccgttcgtgctggcgggaagggctgttgtggagcaggttgctgtggaaacaggtgcaggatgcttcgttccgtgttttcgagtgcctttggggttcttggcgctatttactgcttgagcgtctctggcgcggggctgcgtaatggtcccaggtgtctgatgaacggagagtggggctaccacttcgaagacacagcaggtgcatacctgctcaatagaaccctgtgggatcggtgcgaagccccaccccgagtcgttccttggaatgttactttgttttccttgcttgtggcggctagctgcctggaaattgtgctttgcggcattcagcttgtcaacgcgacaattggggtgttctgcggtgattgcaggaaaaaacaggacaccccacactag

SEQ ID NO: 138523 - DNA, 438 bp, Artificial Sequence
  Description of Artificial Sequence: Synthetic coding sequence
atgtcagcaagcgcagctaccggggtgttcgttctcagcctctccgctatccctgtcacctacgtctttaaccatcttgcggcacagcacgactcctggaccatcgtcggggtggcagccctgattctatttctagtggctcttttggctcgggttttggtaaagcgaaagccacctagggatccgctcttctatgtctatgcagtgttcgggttcacaagcgtggtaaacctgatcatagggctcgagcaggacggaataattgatggatttatgactcactatcttcgggagggagagccctatctgaacaccgcttacggccatatgatctgctattgggatggaagcgctcactaccttatgtacctggtcatggtggccgctatcgcatgggagtgctggcacatttgttctattctgttcctgaccctctag

SEQ ID NO: 138524 - DNA, 1113 bp, Artificial Sequence
  Description of Artificial Sequence: Synthetic coding sequence
atgtctgcatcagcggcaaccggggtgtttgttttatctctgtccgctattccagtgacctacgtttttaatcacttggcagctcagcacgatagctggactattgttggtgttgcagcactcattctttttctggttgccctgctggcccgggtgctcgtcaagagaaaaccacctcgggatccactgttctatgtgtacgcggtgtttggcttcaccagcgtagtcaatctcatcataggcctggagcaggatgggattatcgacggattcatgactcactatttgcgggaaggtgagccatacctaaatacggcatatggacatatgatctgttactgggacggatctgcccactatcttatgtatctcgtgatggtggcagccatcgcctgggaggagacctaccgaacaattggactctactgggttggcagtatcataatgagtgtggtggtgtttgttcccggcaacatagttgggaagtacggcacccgaatttgccctgcattcttcttgtctattccatatacgtgtctccctgtgtgggccggctttagaatctacaatcaacctagcgagaactataactacccaagcaaggtgatccaggaggcccaggccaaggacctgctgcggcgtcctttcgacctgatgctcgtcgtctgcctattgttggcaactggattttgcctcttccggggactcatagcacttgattgcccctccgagctctgtcggttgtatacgcagtttcaagaaccttacctcaaggaccctgccgcctatcccaagatccagatgctcgcctacatgttctacagtgtgccgtacttcgtcaccgccctgtacggtctagtcgtccctggatgctcttggatgcccgacatcactcttattcacgcaggaggtcttgcccaggctcaattctcccatataggcgcatccctgcacgcaagaacagcctacgtctaccgggtgcctgaggaagcgaagattctgttcttagcactaaacattgcatacggggtcttaccgcagttgctagcctacaggtgcatctataaaccggagttttttatcaagaccaaggccgaagaaaaggttgaatag

SEQ ID NO: 138525 - DNA, 1020 bp, Artificial Sequence
  Description of Artificial Sequence: Synthetic coding sequence
atgagtgctagcgcggctacgggggtgttcgtattgagcctgtctgcaatcccggtcacctacgttttcaatcacctggccgctcagcatgacagctggaccatcgtaggagtagcggcacttatcctctttttggtagccttgctggccagagtgctggttaagaggaagccccccagagaccctttattctacgtgtacgccgtgtttggtttcacctctgtggttaacctgatcataggactggagcaagacgggattatcgatgggttcatgactcattatctgcgcgagggggaaccttacctgaataccgcctatggacacatgatttgttactgggacggttccgcccattacttaatgtatctggttatggtcgctgccatcgcctgggaggaaacgtataggacaatcggactgtattgggtgggatcgattattatgagcgtcgtggtcttcgtccccgggaacattgtcggcaaatatgggacgcgtatttgtcccgccttttttctttccattccctacacctgtttgcccgtctgggcagggtttagaatttacaaccagccctccgaaaactacaactacccaagtaaggtcatccaggaggcccaggcaaaggatctcctcaggcgcccttttgatctgatgttggtcgtatgtctgctgctggccactggcttctgcttgttccgaggcctcatgctggcctatatgttttacagtgtcccctattttgtgacggccctgtatggattagtagttcctggttgttcctggatgcctgacatcactttaatacacgctggaggcctcgcccaggcccagttctcgcacatcggcgcatccctacatgctcgtacagcttatgtgtacagggtgccagaggaagcaaaaatcctttttcttgcactcaacatcgcatacggcgtcctgccacagttgttggcctacagatgtatctacaaaccagagtttttcattaagactaaggccgaagagaaagtcgaatag

SEQ ID NO: 138526 - DNA, 1122 bp, Artificial Sequence
  Description of Artificial Sequence: Synthetic coding sequence
atgagcgcctctgccgcaactggggtctttgttctgtcactgtccgccatccctgtgacatacgtcttcaaccatctagctgcacagcacgactcctggaccatcgtgggagtcgctgccttaattctttttttggtcgcacttctcgcacgagtgctcgttaaacggaaaccaccaagggaccccctgttttatgtctatgcagtcttcggctttacctcagtggtcaacttaataattggtcttgaacaggacgggatcatcgatggattcatgacacattatctgcgagagggcgagccctatctcaatacagcttacggccacatgatttgctactgggacggctccgcccactaccttatgtacctggtgatggtggcagctatcgcctgggattgctatagggaaacctacagaacaattgggctgtactgggtcgggagcattataatgagtgtggtcgtcttcgttcccgggaacatcatagggaaatatggcacgaggatttgtccggcattttttctttcaatcccttatacttgtttgcccgtctgggctgggttcagaatttacaatcagcctagtgagaactacaactatccctccaaggtgatccaggaggctcaggccaaagatctgctccgtcgcccattcgacctcatgctggtcgtttgtcttctgctggccaccggtttctgcctttttcgggggcttatcgccttggactgcccgtctgaactgtgtaggctgtacacacagttccaagagccctacctgaaggatccggccgcttatcctaagatccaaatgctggcctatatgttttactctgtgccatattttgtgacagcgctttacggccttgttgtccccggttgttcatggatgcctgatatcacactcatccacgccgggggcttggcacaggcccaatttagccacatcggagcaagcctgcacgcaagaaccgcatatgtgtacagagtcccggaggaggctaagattctgttccttgctctgaacattgcttatggtgtactgcctcagctcttggcttacaggtgcatttacaaaccagaattcttcataaaaacaaaggcagaggaaaaagtagagtag

SEQ ID NO: 138527 - DNA, 567 bp, Artificial Sequence
  Description of Artificial Sequence: Synthetic coding sequence
atgagcgcctctgccgctaccggggtctttgtcttgtcactgtctgccatacccgtgacttacgtctttaatcaccttgctgcacagcacgatagttggacgattgtgggcgttgctgcactcatcctttttctggtcgccctgctggcacgcgtactggtaaagcggaagccccctagggatccgctgttttatgtatacgcagtcttcgggtttaccagcgtggttaacctgataatcggcctcgagcaggacggcattatagacggtttcatgactcactacctccgagagggggaaccttatctcaatactgcatacggccatatgatatgctattgggatggttccgcgcattacctgatgtacctggtgatggttgccgctatcgcgtgggaggagacatatagaaccataggcctttactgggtcggctcaataatcatgagcgtcgtcgtttttgtgccaggcaatattgtcgatgcaggcatttatgtgttgttctgctctttactctgcgactgcaccgtctggctgtccggcagctggatgtttcttgatgcttag

SEQ ID NO: 138528 - DNA, 1020 bp, Artificial Sequence
  Description of Artificial Sequence: Synthetic coding sequence
atgagcgcatctgccgccactggggtgttcgtcttaagccttagtgccattcccgtgacatacgttttcaatcacctggctgcacagcacgatagctggaccattgtcggcgttgccgctttgatcttgtttttagtagcccttttagctagagtcctggtgaagcgcaagcccccgcgtgacccactcttctatgtgtatgctgtctttggatttacttctgtagtgaatctaatcatcggactggaacaggatgggattatcgatgggtttatgacccattacctacgcgagggggagccataccttaatacagcttacggccatatgatatgctactgggacggaagcgcccattacctgatgtacctcgtgatggttgctgccattgcatgggaggaaacatataggactattggcttgtattgggtggggtcaattatcatgagcgtggtggtgttcgtccccggcaacatcgtgggcaagtacggaaccaggatctgcccagccttttttctcagtattccttatacctgtctgcctgtttgggcggggtttcgaatttacaaccaaccgagcgagaactataactacccgagcaaagttatccaagaggctcaggccaaagatctcctgcgcaggccatttgatttgatgctggtagtgtgtcttctcttagccaccggattttgccttttcagaggtctaatgctagcttatatgttctactcagtgccatactttgtcactgccttatacggccttgttgttcctgggtgctcttggatgccagatatcaccctcatccacgcgggggggctcgctcaggcccagttctcccacatcggcgcctctctgcacgctcgcacagcttacgtatatcgggtgccagaggaggccaagatcctctttctggccctcaatatagcttatggggttctgcctcagctactggcctatagatgtatctataaaccggagttctttatcaagaccaaggctgaagaaaaggtggaatag

SEQ ID NO: 138529 - DNA, 1056 bp, Artificial Sequence
  Description of Artificial Sequence: Synthetic coding sequence
atggacataccccccctagccgggaaaattgcggcccttagcttgagcgccctccccgtctcgtatgcactcaaccacgtcagtgcactttcccatcccttgtgggtcgccctgatgagcgctcttattttgggcttactttttgtggccgtgtacagtctgtctcacggggaggtatcctatgatcccctgtacgccgtgtttgcggtgttcgccttcacgtcagtggtggatctcatcattgctctccaagaagattcctacgtagtgggctttatggaattttacacaaaggaaggcgaaccctacctgagaaccgcccatggggtctttatttgctactgggacggaactgtccactacctgctctaccttgcaatggcgggagccatctgccgccgcaaaagataccgaaacttcgggctgtattggctgggatcttttgcaatgtccattctcgtatttctgaccggcaacatcctagggaaatacagtagcgaaatccggcccgctttcttcctgaccattccctacctgctggtgccttgttgggcaggaatgaaagtgttttcccagccacgtgccctgaccagatgtacagccaatatggtacaggaagagcagcggaaaggtctgttgcagagaccagccgatttggccctggtcatctatctgatacttgctggcttctttaccctattcagaggtttggtggtccttgactgcccaaccgacgcttgcttcgtctacatataccaatacgagccatacctgcgcgatcccgtggcatatcccaaagtccaaatgctaatgtatatgttctacgtattacctttctgtggactggctgcctacgccctcacgttccccggctgcagttggctgccagattgggcactggttttcgcaggaggtataggacaggctcagttttcgcatatgggtgcctctatgcatctgcgtactcccttcacctaccgctgtctgcagtggcccgccttctttcaccagcccccccctagtgatccactggcactccacaaaaagcagcactag

SEQ ID NO: 138530 - DNA, 1134 bp, Artificial Sequence
  Description of Artificial Sequence: Synthetic coding sequence
atggacatcccgcccctcgcaggtaaaatcgctgccctgtcactgtctgctctgcccgtgtcttatgctttgaaccatgtgtcagcattgtcacacccgctctgggtcgcgcttatgagcgctctgatccttggtttgttatttgtggccgtgtattccttgtctcacggagaggtgtcgtatgacccactatacgccgtattcgcagtattcgcatttacatcagtagtggatcttataatcgcccttcaggaggactcctacgtcgtgggatttatggagttttataccaaagaaggggaaccatacctgcgcaccgcccacggagtgttcatttgctattgggacggaacagtgcattatctgctctatcttgccatggctggtgcaatatgtcgtagaaaaagatacaggaacttcgggctgtattggttaggcagtttcgccatgagcatattggtgttcctgaccgggaacatactcggaaagtacagttcagagatcagaccggccttttttctcactatcccctacctcctcgttccttgttgggccgggatgaaggtgttttcccagccccgggcactgacaaggtgtacagctaacatggtgcaggaagaacaacggaaaggcctattgcagcgcccagctgatctcgccttggtgatctatcttatcttggccggattcttcaccttgttccgtggtctggtggtgctggattgccctactgacgcttgttttgtgtacatctatcagtacgaaccttacctcagggacccagttgcttacccgaaagtccagatgttgatgtatatgttttatgtgctgccattctgtggcctggcagcctacgcattgacatttcctggatgcagttggcttcccgattgggctcttgtttttgccggaggaatcggccaggcccagttctcccatatgggtgcatccatgcacttacgcacacctttcacttatagggtgcctgaggacacttgggggtgtttcttcgtgtgcaacctcctctatgcgcttggaccccacttgctcgcttaccggtgtctccagtggcctgccttctttcatcaacctccaccatcggatccgctggctctccataaaaagcaacactag

SEQ ID NO: 138531 - DNA, 642 bp, Artificial Sequence
  Description of Artificial Sequence: Synthetic coding sequence
atggatatcccccccctggcaggaaagatcgcagccctgagcttgagtgccctcccagtttcatacgctcttaaccacgtgtctgctctgtcacacccactttgggtggccttgatgtctgctctcattttgggcttgctatttgttgctgtctactctctcagtcatggcgaggtctcttacgacccgctgtacgcggtgtttgcagtttttgcgttcacaagcgtggtagacttgataattgcccttcaagaggacagttatgttgtagggtttatggaattctataccaaggaagtgctggggggtaggccagggtctcctcttccgcactgcccatccgagtctccgacctgtcctcacagggaatcacacacctgtgcccagcggaccgagagctctagtgccaccgggatggccttgttcaccaccagttcgacctggccttggcctgccccttcggccgagggcgccggggggcgggagcgggtggcccctgaccctggcagggaggtcgcgtcatctgacggtgtccccggccaagggggagcccgaagcgtatgcagacgcaaccaggacgcatctctggggctgcaaccaggagtggcccggcgtcgttttcaggggacctcacaggtttag

SEQ ID NO: 138532 - DNA, 1257 bp, Artificial Sequence
  Description of Artificial Sequence: Synthetic coding sequence
atggcccccacccaaggcccgcgggcccctcttgaatttggcggtcccctgggcgccgctgccctgctgcttctcttaccggccactatgtttcacctcctgcttgccgcccggtcgggacctgcaagattattagggcctcccgcatcccttcccggcctagaggtgctgtggtcccctagagctctgctcttgtggctggcttggttgggcctacaggctgcactttatctgttacccgcaagaaaagtggctgagggccaagaactaaaagacaaatctaggttgcggtatcccatcaacggctttcaggccctggtactgactgccttgttagtgggccttggaatgagcgcgggcctacctttgggggcacttcccgagatgcttctccccctcgctttcgtggctacactgaccgcattcatcttcagcctgttcctctatatgaaagcccaagttgctcctgtgtctgcgctagcaccaggcggaaactctggaaaccctatatatgatttcttccttgggcgggaactgaatcctagaatatgcttcttcgacttcaagtatttctgtgagcttcgccccggactgattggctgggtactgattaatctggctctgcttatgaaggaagccgagcttcggggcagtccctctctcgctatgtggctggtcaacggttttcagctcctatatgtcggagacgcattatggcatgaagaggccgtgttaaccacaatggatatcacacacgacggattcggctttatgctggctttcggcgatatggcctgggttccttttacgtacagcctccaggcccaattcctgctccatcacccccagcctcttgggctcccaatggcatccgtcatctgccttattaacgctacaggttactacatctttcgaggcgcaaatagtcagaagaataccttcagaaagaacccctccgatccaagagtagcgggactcgaaactatctctaccgccacaggaaggaaactgctggtgtctggatggtggggaatggtgagacacccaaactatttgggcgacctgatcatggcgctggcgtggtccctcccgtgtggcgtctctcatttgttgccttacttttatctgctctacttcactgccctactagtccacagggaagctagggatgaacgccagtgtctgcagaagtatgggctggcctggcaggaatactgccgtcgggtcccttatagaattatgccttatatctattag

SEQ ID NO: 138533 - DNA, 1176 bp, Artificial Sequence
  Description of Artificial Sequence: Synthetic coding sequence
atggccccaactcagggaccaagggccccgctggagttcggcggtcctctcggcgcggccgcccttctccttctgttacctgccactatgtttcacctcctcttggccgctagaagcgggccagcccgcttgctgggtccccccgcaagcctccctggattggaggtgctgtggtcaccgcgcgcgctcctgctgtggctggcctggctgggcctgcaagccgccctgtatctactgcctgcccgaaaggtcgccgaaggccaggagttgaaagataaatcccggctgaggtatcccataaatggcttccaagccctggtgttgaccgccctgttggtgggcctgggtatgtctgctggcctcccacttggggcgctgcccgaaatgctgctccccttggccttcgtcgccaccctcaccgctttcatcttctccctcttcctctacatgaaggcacaggtagcccctgtgtcagcgctggcccccgggggcaattccgggaaccctatctacgactttttcctcgggcgcgagctcaatcccagaatctgcttcttcgatttcaagtatttttgcgagctcagacctggcctaattggctgggtgctgataaacctagctctactgatgaaggaggctgagctgcgaggcagcccctccctggccatgtggctcgttaacgggttccaactgctctacgtgggggatgcactgtggcacgaagaagccgtcctgactacaatggatatcactcacgatggcttcggtttcatgctggcctttggagacatggcttgggtgcctttcacctactcactccaggctcaatttcttctgcatcaccctcagccccttggccttcctatggcctccgtaatctgtcttattaatgggttggagacaatctctaccgccacgggtcgcaagcttctggtgtcaggttggtggggaatggtgagacaccccaattacttaggtgatctgattatggctcttgcgtggtccttaccatgcggtgtttctcacctcctcccatacttttatttgctgtactttactgccctgctcgtgcacagagaagccagagatgaacgccagtgtttgcaaaaatatgggcttgcatggcaggaatattgtaggagggtgccatacaggatcatgccatacatctattag

SEQ ID NO: 138534 - DNA, 909 bp, Artificial Sequence
  Description of Artificial Sequence: Synthetic coding sequence
atgtcggctgggctgcccctgggtgcactgcccgagatgctgctgccactcgcgtttgttgctactttaacggcttttatcttttccctgttcctgtatatgaaggcccaggtagcgcccgtctcggccctggcgccagggggcaactctggcaaccctatttatgacttctttctcggaagagagctgaacccacgtatttgcttcttcgacttcaagtacttttgcgaactcagacccggtcttatcggctgggtactgataaatttggccctgttaatgaaagaggctgagctccgcggctccccaagtttggccatgtggcttgtgaatggcttccagctcttatatgtgggcgacgctttgtggcacgaggaagccgtgctcacaacgatggacatcacgcacgacggcttcggcttcatgctcgcctttggggacatggcctgggtgccattcacttacagcttgcaggcccagttcctcctgcaccacccccagccactggggctgccgatggccagcgtgatttgtctgatcaatgctaccggctactacatttttaggggagcaaacagccagaagaatactttccggaaaaaccccagtgatcctcgtgtggccggtctcgagacaatctctacagctaccgggcggaaacttctggtgagcggatggtggggaatggtcaggcaccccaattacctgggtgatttgataatggccctggcctggagccttccctgcggagtgagccatctgttgccatacttttatttgctgtacttcaccgcactattggtacacagggaagcaagagatgagaggcagtgtctgcagaaatatggtttagcctggcaagaatattgcagaagggttccgtatcgtatcatgccgtatatatactag

SEQ ID NO: 138535 - DNA, 1713 bp, Artificial Sequence
  Description of Artificial Sequence: Synthetic coding sequence
atgggctttctacagctgctggtggtggcagtgctggccagtgaacacagagtcgcaggtgccgcagaagtctttgggaactcatctgagggcctgattgagttctccgtcggaaaattccgctacttcgaactgaatagaccctttcctgaagaggccatcctgcacgatatatcctccaatgtaacgtttctaatttttcagatacatagccaatatcagaatactactgtcagtttctccccaaccctcttgagcaacagttcggagacagggaccgccagtggccttgtgttcattctgcgaccagaacagtccacatgtacttggtacctgggtacatcaggaatccaacctgtgcaaaacatggccatactgttgtcatattcagaacgggatccagttccagggggctgcaacctggagtttgatcttgatatagaccccaacatctatctagagtacaattttttcgaaacaactatcaaatttgcaccggctaacttggggtacgccaggggcgtggaccctcctccttgcgatgccggaactgaccaggactcgcgatggaggctgcaatacgacgtgtatcaatatttcctgcctgaaaatgacttaaccgaagagatgctgctgaaacacctgcaacggatggtttccgtgccgcaggtgaaggctagcgctcttaaggtggtcaccttaaccgcaaacgataaaacctccgtcagcttctcttccttacctggacaaggggttatttataacgtgatcgtatgggacccgttcttaaatactagcgctgcttatatcccagcacacacgtatgcatgttcatttgaagctggcgagggatcatgtgcctccctaggccgagtgtctagcaaggtatttttcaccctttttgccctcctcgggttttttatctgtttttttgggcatcggttctggaagaccgagctgttcttcatcggatttatcataatgggattttttttttacatcctgatcacaaggctgaccccgataaagtacgacgtgaaccttatactcacagcggtaaccggatcagtcggcggcatgttcctcgtggccgtgtggtggcgctttgggatcctgtccatttgcatgttgtgcgtagggctggtacttggatttctgatttctagtgtgacttttttcacaccactgggcaatctgaaaatcttccatgacgacggcgtgttctgggtgaccttctcctgcatcgctattttgatcccagtggtgttcatgggctgtttgagaatcctcaacatcttgacatgcggggtcattgggagctacagcgtggtcttggccatcgactcttattggagcacatccctctcctatattacgctgaatgtccttaaaagggcactcaataaggactttcatagggcatttaccaatgttccgttccagaccaacgactttatcatactggcggtctggggcatgctggctgtctccggtatcacacttcagattcggagggaacgcggacggcctttttttccacctcacccgtataagctgtggaagcaagagcgcgaaagacgcgtcacaaacatactggacccaagctaccacataccacccctcagggagcgactgtatggtcggctcacccagattaaagggctcttccagaaagaacagccagccggtgagcggactcccctgctactttag

SEQ ID NO: 138536 - DNA, 351 bp, Artificial Sequence
  Description of Artificial Sequence: Synthetic coding sequence
atgggattcctgcagctcctggtcgtggctgtgttggcctccgaacaccgggtagctggggccgcagaagtctttgggaattcttctgaggtgtacctggtggtggggctgattgagttctctgtgggaaagtttcgatacttcgagttgaatagacccttccctgaggaagccatcttacatgatatctcttccaacgtcacttttctgatcttccagatccatagccagtaccaaaacaccaccgtttcattttctcccaccctactctcaaattcctctgaaactggtaccgccagcggacttgtgtttatactgagacccgagcagagtacctgtacatggtactag

SEQ ID NO: 138537 - DNA, 1413 bp, Artificial Sequence
  Description of Artificial Sequence: Synthetic coding sequence
atgggcatatggactagcgggacggatatattcctgagcctttgggagatctacgtgtccccccggagccctggatggatggattttattcagcatctcggtgtttgctgtctggtggcactgatcagcgtaggtctgctatccgtggccgcgtgctggtttttgccttcaataatagccgctgccgcctcatggattataacatgtgtgcttctttgttgctcaaagcacgctagatgctttatattactcgtttttctcagttgcggactgcgggaaggacggaatgctttgatcgctgcagggacgggaatcgtgatcctgggccacgtcgagaatatctttcataacttcaaagggcttctcgatggcatgacatgtaatctgcgcgctaagagcttctctattcacttccccttactgaaaaagtatattgaggcgattcagtggatttatgggctggctacccctctcagcgtatttgacgacttggtttcctggaaccagacactggcagtgtcactgttctcacccagtcacgtgctagaggcccagctaaacgattccaagggcgaagtcctgagcgtactgtatcagatggccaccacaactgaggtgcttagctcactgggacaaaagctccttgcctttgccgggctgtcactggtgctccttgggaccgggttgtttatgaaaaggttcttgggtccttgcgggtggaaatacgagaacatttatatcacccgccaatttgttcaattcgacgagcgggagcgacaccagcagaggccttgcgtgctccccctgaataaggaggagcggcggaaatacgtcattattcccaccttctggcctacacctaaggagagaaagaacctcggattgttctttctacctattctgatccacctgtgtatatgggtgctctttgcagccgtagattacctgctgtatcggctgatcttcagcgtttccaagcaattccagagcctaccaggattcgaggtccacctgaagcttcatggtgaaaaacagggcacacaggatattatccatgacagctcgttcaatatctcggtgttcgagccgaactgcattccaaagcccaaattcttgctgtcggaaacctgggtgccactcagcgtcattctgctgattctggtcatgctgggcctgctatcaagcatcctaatgcagctgaagattttggtgtcagccagtttttacccatctgtcgaacgtaagcgtatccagtatctccatgcaaaattgttaaagaagaggagcaaacagccacttggggaggtaaagcgtagattgagcctttatcttacgaagattcacttctggttacctgtgctgaagatgatcaggaaaaaacaaatggacatggcctcagccgataaatcttag

SEQ ID NO: 138538 - DNA, 567 bp, Artificial Sequence
  Description of Artificial Sequence: Synthetic coding sequence
atgtccacaatgttcgcagacaccctgctgatcgtctttatctcagtgtgtaccgcgctgctcgccgagggaataacctgggtgctggtgtatcggacagataagtacaagaggctgaaagccgaagttgagaagcagagcaaaaagctggagaaaaagaaggagaccattacagaaagcgcaggcaggcagcagaaaaagaaaatagagagacaagaagaaaaactgaaaaataataatcgagatttgagcatggtgcgcatgaagtcaatgttcgccattggtttctgtttcacggctctcatgggaatgttcaactctatctttgacggacgagtagtcgccaaactcccattcacccccctatcctacatccagggactgagccataggaacttgctgggcgacgacaccaccgattgctcatttatcttcctgtacattttgtgcacgatgagcattaggcaaaacatccagaaaattctcggcctggcccccagcagagctgccactaagcaggcgggagggtttctgggtccacctcccccgtctggtaagttttcctag

SEQ ID NO: 138539 - DNA, 510 bp, Artificial Sequence
  Description of Artificial Sequence: Synthetic coding sequence
atgtcaactatgttcgctgatacactgctcatagtatttatctccgtttgcacagccctgctggccgagggaatcacttgggttctggtgtaccgcacagacaagtataaaaggcttaaagcagaggttgaaaagcagagtaaaaagctggaaaagaaaaaggagactatcactgaatccgctggccggcaacagaaagtgagaatgaagtcaatgttcgctataggtttctgttttactgcccttatgggcatgtttaattccatttttgacggtcgggtagttgccaaacttccattcacgcctctaagctacatacagggtctgagtcaccggaatttgctgggagacgacaccaccgactgcagcttcatctttctgtatatcttgtgcactatgtcgatcaggcagaacatacaaaagattctcgggttggcccccagcagggccgcaacaaagcaggctggcggctttcttggcccgcccccaccttctgggaagttttcatag

SEQ ID NO: 138540 - DNA, 603 bp, Artificial Sequence
  Description of Artificial Sequence: Synthetic coding sequence
atgatgcactatgttgactactctatgatgtatcacctgatccggggacagagtgtgatcaaactctatatcatatacaacatgctagaagttgccgatagattgtttagctcttttggccaagatattctcgacgccctctattggactgctacagagcctaaagagaggaaacgcgcccatatcggatttgtcgagatcaagggcagcgttttcaagaagttcgaaaaaaataacctgtttcaaatgtccaatagcgacatcaaggagagatttacgaattatgtgctgctgctgattgtctgtctgaggaatatggagcagtttagctggaacccagatcacctttgggtgctgttcccggatgtctgcatggtgattgcttcagagatagccgtggatattgtcaagcatgcatttataacaaaattcaacgatattaccgctgacgtgtactcagagtacagggcttcccttgcgtttgacctcgtgtcttcacggcaaaaaaatgcatacactgactattctgactctgtggccagacggatggggtttattcctctccctttagcagtcctggtcgacatccccgaatccacgtag

SEQ ID NO: 138541 - DNA, 1371 bp, Artificial Sequence
  Description of Artificial Sequence: Synthetic coding sequence
atggtgttcggaatcttcttgtgcctcgacgcctttctgtacgtgtttacactgctgcctctgagggtgtttctcgccctgtttcgcctgttgaccctaccttgctacggactgcgcgaccggagactgctgcagccagcccaagtgtgtgacattctcaagggtgtaatcttggtcatttgctatttcatgatgcactatgtggactattctatgatgtatcatctgattcgagggcagtcggtgataaaattatacattatatacaatatgttagaggttgccgatagactcttctcgtcatttggtcaagatattctggacgctttgtactggaccgccaccgagccgaaggagagaaagagagcccatattggggttatcccacatttctttatggctgtcttgtacgttttcctgcatgcaattctgatcatggtgcaagcgacaaccctgaatgtggccttcaactcccacaataagagcttactcacgataatgatgagtaacaactttgtcgaaatcaagggatcagtgttcaaaaaattcgaaaagaataatctgtttcagatgagcaattcggacattaaggaaaggttcaccaattacgttctgctcttgatcgtttgcctgagaaatatggagcagttctcatggaatcccgaccatctttgggtgctgttcccggatgtgtgcatggttattgcgtccgaaatagcggtggacattgtaaaacacgcgttcattactaagttcaatgatatcactgctgatgtctactctgagtaccgggcgagcttggctttcgatcttgtttcttcaaggcagaaaaacgcctacactgactacagcgattcggtggcacgccggatgggattcattccattgccacttgcagtgctgctgatacgagtggtaacttcttccattaaggtgcaggggattcttagttatgcatgtgtgatcctgttttactttggtctgatttcactgaaggttctaaactccatcgtcctattagggaaatcttgccagtatgttaaagaagcaaagatggaagaaaaactgagtaatcctcctgccacatgcactcctggaaaaccatcctctaagagccagaataagtgcaagcccagccaaggcctcagtaccgaggagaacctctcagcaagcatcactaaacagcccatacatcagaaggaaaacattatccctttactcgtgactagcaactctgatcagttcctaactaccccagacggtgatgagaaggatatcacccaggataactcagagctgaagcaccgctccagcaagaaggacttgctcgaaatcgatcgtttcacaatctgtggtaatcgcatagactag

SEQ ID NO: 138542 - DNA, 1704 bp, Artificial Sequence
  Description of Artificial Sequence: Synthetic coding sequence
atggctggcgttggggatgcagcagcaccgggagagggcggtggcggtggcgtggacggcccacaacgggacggacgaggcgaggcagaacaacccggtgggagcggcggacagggacccccacctgccccccagctgacagagacgttaggtttttatgagtccgacagaaggcgggagcgtcgtcggggccgcacagaactgtctctgttgagatttctctcagctgagctcacacgcggatattttctcgaacataacgaagctaaatataccgagcgccgggagcgagtttacacatgccttcgcatacctcgggagctcgaaaagttgatggtttttggcatatttctctgtcttgacgcctttctgtacgtgttcaccctcttgccactgcgcgtattccttgcattgttccgcctcttaaccctgccgtgctacggcctgcgggaccgacggttacttcagcccgcacaggtctgcgacattttaaaaggcgttatcttggtcatttgttattttatgatgcactacgtcgactacagcatgatgtaccatcttatcagagggcagtccgtcattaagctgtatatcatctataatatgctcgaggtggcagatcgcctattctcatctttcggtcaagacatactggatgccttatattggactgccactgaacccaaggagaggaagcgggcccatattggcgtgatcccccatttttttatggctgttctctatgtcttcttgcatgctatcctcatcatggtgcaggcgaccaccttgaatgtggcgttcaattcccataataaaagtttactgacgataatgatgagcaacaacttcgtggagatcaaggggagcgtctttaagaaattcgagaagaacaacctttttcagatgtctaattcagatatcaaggaaaggttcactaattacgtcctgctgctgatcgtgtgtctcagaaacatggaacagttctcatggaatcctgaccacctttgggtgctgtttcctgatgtatgtatggtaatcgcttctgagatcgcagtagacatcgtgaaacatgcttttattaccaagttcaatgatatcacagcggatgtttatagcgaataccgggctagcctagcctttgatctggtcagctctcggcagaagaacgcgtacacagactactccgacagcgtcgcccgcagaatgggctttatcccgctgccattggccgtgctcttaatccgcgtggtgacgtcttctattaaggtgcagggaattctttcatatgcatgtgttatcctcttctactttggcctgatcagcctaaaggttctcaactccatcgtgctgctgggtaagtcctgccagtacgtgaaagaagccaaaatggaggaaaaattgagcaatcctcccgcaacatgcacaccaggaaaaccatctagtaagtcccaaaacaagtgtaagcctagtcagggcttgtcaacagaagaaaatttgtccgcctccatcactaaacagccaatccatcaaaaggaaaatatcatcccactgttggtaacctcaaattctgatcagtttctaacaacacccgacggagacgaaaaagacattactcaggacaacagcgagttgaaacatcgctcatccaaaaaagatctgctggaaatcgatagattcaccatttgcggaaacaggatcgattag

SEQ ID NO: 138543 - DNA, 1689 bp, Artificial Sequence
  Description of Artificial Sequence: Synthetic coding sequence
atggcgggagtgggcgatgcagctgccccgggtgaaggtggcggaggcggagtggacgggccccagcgggatggccgcggagaagctgagcaacccgggggctctgggggtcagggtccccctcccgcgccccagctgaccgagacactggggttctacgaatccgacaggcgccgagagcggcgccgtggccgcactgagctgtccttactgcggtttctatcagcagagctgacaaggggatacttcctggagcacaacgaagccaagtacacagagaggcgggagagagtttatacatgcctgcggattcctcgggaactcgagaagttgatggtattcgggattttcttgtgcttagatgcgttcctctacgtgtttaccttactgccgctccgagtcttcctcgcgctcttcaggcttctgaccctgccgtgttacgggctgagagatcggcggttgctgcagccagctcaggtttgcgacatcctcaagggcgtcattctggtcatatgctatttcatgatgcattacgttgactattcaatgatgtaccacttgattcgcggccagtcagtcatcaaactttacattatttataacatgctggaggtagcagatcggctgttcagttcatttggtcaggacattcttgatgcactctactggactgccacagaaccgaaagagcgaaaacgcgctcacattggtgtgataccccacttcttcatggccgtgttgtacgtgtttttacacgctatccttatcatggtccaggctaccacccttaatgtggccttcaactcacataataagtcattactgactataatgatgtctaacaactttgtggagattaaagggagtgtgtttaaaaagtttgaaaagaacaacttatttcaaatgagcaatagcgacattaaggagagattcaccaattatgtgctccttctgattgtctgtctgcggaatatggagcagttttcttggaacccagaccacttgtgggttctgtttcctgacgtttgcatggttattgcgtccgagattgccgtggacattgtcaaacacgccttcatcaccaagttcaatgacattacagccgatgtgtattctgagtatcgggctagccttgcctttgacttggtctccagtcggcaaaagaatgcatacacagattacagcgactcagttgcgcgccgtatggggttcatcccactgccccttgctgtcttgttaattagggtagtcacctcttccatcaaggtgcaggggatcctgtcttacgcttgtgtaatcctgttctacttcggacttatttctctaaaggtgctcaattccatcgtgctgttaggcaaatcctgccagtatgtgaaggaggctaagatggaagaaaaactatcaaatccccccgccacctgcacacccggcaaaccctcgagcaagtcccagaacaagtgcaagccttcacaggggctcagcaccgaggagaaccttagcgcctctattaccaaacaaccaattcaccagaaggagaatataatccccctactggttacatctaactcagaccaatttttaaccactcccgacggggatgagaaagacattacacaggataactcagaattaaaacatagaagcagcaagagcgtcctgttgtgccagagcggcctccccgagtgctag

SEQ ID NO: 138544 - DNA, 2283 bp, Artificial Sequence
  Description of Artificial Sequence: Synthetic coding sequence
atgtccccaaaaaaggtgcagatcaaggtggaggaaaaagaggatgagactgaagaatcaagcagcgaggaggaggaggaggtcgaagacaagctcccacggcgggaaagcctgcgtccgaaaagaaagcgaacaagagacgtgattaacgaagacgatcccgaacctgaacctgaggatgaggagacacgcaaggccagagagaaggagcgtaggcggcgacttaagagaggggctgaggaagaagaaatcgatgaagaggagctggagagacttaaagcggaactagatgagaaaagacagattatcgcgaccgttaaatgcaagccgtggaagatggagaagaaaatagaagttctcaaagaggcaaagaaattcgttagcgagaacgagggggccttaggcaaaggaaagggaaaacggtggttcgccttcaagatgatgatggccaagaaatgggctaaatttctcagggatttcgaaaattttaaagccgcttgtgttccctgggaaaacaaaataaaggctattgaaagccagttcggaagcagtgtggcctcttattttttattcctgcgatggatgtatggcgtcaacatggtgctgtttatactgactttttccctcatcatgctgccagagtatctttgggggctaccttatggttctctcccccgcaagaccgtgccgcgcgctgaggaagcaagtgccgcgaatttcggagtgctgtacgactttaatggtctggcgcagtactctgttttattttatggctactacgacaataaacgtacaattggatggatgaatttccggctgcccttgtcttactttttggtgggtatcatgtgtatcggctactcatttttggttgtgctgaaggcaatgaccaagaacatcggagatgatggtggaggcgatgacaacacctttaatttttcttggaaagtgtttactagctgggactacctgatcggaaatcccgagaccgcggacaacaaattcaatagcatcaccatgaatttcaaagaagcaataaccgaagaaaaagccgcacaggttgaagaaaatgtgcacttgatacgctttctcagatttttggccaacttctttgtcttcctgacacttggaggatccggctacttgattttctgggccgtgaaacggtcacaagagtttgctcaacaggaccctgacacattaggatggtgggaaaagaatgaaatgaacatggtgatgagcctgctcggaatgttctgccccaccctctttgatctgtttgccgaacttgaagactatcatccgctcattgctttgaaatggttactagggcgcatttttgccttgctgctcggcaacctttacgtgttcatcctggcactgatggacgaaatcaataataaaatagaggaggaaaagctggtcaaagctaatatcactttatgggaggctaacatgatcaaggcatacaacgctagtttctcggagaactcaaccggcccaccttttttcgtgcatcccgccgatgtgccccgagggccttgctgggagacaatggttgggcaggaattcgtgcgccttactgtttcagacgttctcactacatatgttacgatactgatcggtgatttccttagagcttgctttgtgcggttttgcaactactgctggtgttgggatttggagtacggatatccaagttacacagaattcgatatcagtgggaacgtgctcgccttgatcttcaaccagggaatgatctggatgggaagcttcttcgcccccagcctgcccgggataaacattttgagacttcatacaagcatgtatttccagtgctgggctgtaatgtgttgcaacgtgcctgaggctagggtcttcaaagcctcacggtctaacaatttctatcttggaatgcttctacttatcctgttcctgtccacgatgcccgtgctatatatgattgtctcactgccccctagctttgactgcggccctttcagtggaaagaatcggatgtttgaggttatcggcgaaaccttagagcacgacttccccagctggatggccaaaattctgcggcagttgtccaaccccggactggtgattgccgttattctggtgatggtcctcgctatctactatttgaatgcgaccgcgaaagggcagaaggcagcgaacctggatttaaagaaaaaaatgaaaatgcaggcactcgagaacaagatgagaaataaaaagatggcagcagccagagctgccgccgcagccggcaggcagtag

SEQ ID NO: 138545 - DNA, 2283 bp, Artificial Sequence
  Description of Artificial Sequence: Synthetic coding sequence
atgtctcccaaaaaggtgcaaattaaagtcgaggagaaggaggacgagacggaggaatcctctagtgaagaggaagaagaagtcgaagataaactgcctaggagggaatccctgaggcctaagaggaagcgaacgcgagacgtgatcaacgaggatgatcctgaacccgaacccgaggacgaggagactcgcaaggccagggaaaaagaacgaagaaggaggcttaaaaggggggcagaagaggaggaaatcgatgaggaggaactggagaggctcaaggcagagctcgatgaaaagagacagataatcgccactgtcaagtgtaagccttggaaaatggaaaagaaaatagaagtgctgaaagaagcgaagaagttcgtgtccgagaatgaaggggccctcggaaaagggaagggcaaaagatggttcgccttcaaaatgatgatggcaaagaagtgggccaagtttctccgagattttgaaaacttcaaagctgcgtgtgttccatgggaaaataagatcaaagccatcgagtcacaatttggctcaagcgtcgcttcttatttcctcttcctgaggtggatgtacggtgttaacatggtgctctttatcctgaccttcagcctgattatgctgcccgagtacctgtggggattgccgtacggatccctgccccggaaaaccgttcctagggctgaggaggcctctgcggctaattttggagttctctacgacttcaatggtctagcacaatactctgttttgttctacggatactatgataataagaggacaattggctggatgaatttcaggttgcccttgagttacttcttggtggggatcatgtgcatcggctactccttcctcgttgtgctgaaggcgatgactaaaaatatcggagacgacgggggaggggacgacaacacatttaatttcagttggaaagtctttacttcctgggactatctgattggcaacccggaaactgccgataataaatttaactccatcaccatgaattttaaggaggccataaccgaagagaaagccgctcaggtcgaagagaatgtacacctgatccggtttcttcgctttctggccaatttctttgtgtttctgacactgggggggtctggatacctcatcttttgggcagttaaacgtagtcaggagttcgcacagcaagaccccgatactctaggctggtgggagaagaacgagatgaatatggtgatgtcactgcttggtatgttctgtcctacgttatttgatcttttcgccgagctcgaggattatcacccgttaattgcactcaagtggctgctgggcagaatcttcgcgttgctgctcggcaatctgtacgtattcatactggcgctgatggacgaaattaataataaaattgaggaggagaaactggttaaagccaacattaccctctgggaggccaacatgatcaaggcgtataatgcatcattcagcgagaactctaccggcccccccttctttgtgcaccctgcagacgtccccaggggcccctgttgggagaccatggtcggtcaggaatttgtaaggctgactgttagcgatgtgctcaccacctatgtgactattctgattggcgattttcttcgagcatgttttgtccgattctgcaactattgttggtgttgggatctggaatatggttacccctcctacacagaatttgatataagtggaaacgtcttggccctgatcttcaaccagggcatgatctggatgggaagcttttttgctcctagcctgcccggtattaacatcttgaggcttcatacgtctatgtatttccagtgttgggcggttatgtgctgcaacgtgccggaggcccgcgtgttcaaggccagccgttccaacaatttctatctcggtatgcttctgctgatcctatttctctccaccatgccagtcctgtatatgatcgttagtctgccacccagctttgattgtggtcccttctcagggaagaatagaatgtttgaagtcataggagagactttagagcatgacttcccaagttggatggccaagattctacggcagcttagtaatccaggcctggttatcgctgtgatactcgttatggtgctcgccatttattacctcaatgccactgcaaagggacaaaaggctgcgaatttggatctgaagaagaagatgaagatgcaggccctggaaaataagatgcggaataaaaaaatggcagcggccagagcagctgctgcagcagggcgacaatag

SEQ ID NO: 138546 - DNA, 2223 bp, Artificial Sequence
  Description of Artificial Sequence: Synthetic coding sequence
gtagagtggtctggcgagtgtttaagaagctgtcgacgcgaggttcagatcaaagtcgaggaaaaggaagatgaaaccgaggagagctcttccgaggaggaagaggaggttgaggataagttaccacgacgagagagcctaagaccgaaaaggaagagaacgagagacgttattaacgaggacgatccggagcccgagcccgaagacgaggaaacgagaaaggcccgggagaaagagcggcggaggcgcctcaagcgaggcgcagaagccaagaaattcgtttccgagaatgagggggctctcggcaaagggaaaggtaagagatggttcgctttcaagatgatgatggcaaaaaagtgggcaaaattcctgagggactttgagaacttcaaagccgcatgtgtcccctgggaaaacaaaattaaagctatcgagagccagttcggtagttccgtagcctcttacttcctcttccttaggtggatgtatggtgtaaacatggttctcttcatcctcaccttctcactgatcatgctgccggagtacttgtggggcctgccctacgggagtctgccaaggaaaacagtcccgcgagcagaggaagcatcggcagccaacttcggagtcctgtacgattttaacggcttggcccagtactctgtgctgttctacggctattacgataataaacggacaatcggatggatgaactttagacttcctctgtcgtatttcctggtcgggatcatgtgcatcggatattcctttctggtggttttgaaggccatgactaaaaacatcggagatgatggaggcggcgacgataatacctttaatttcagctggaaagttttcacatcatgggattacctgatcggtaatcccgagacggccgataataaatttaatagcattactatgaacttcaaagaggcaatcaccgaagagaaggccgctcaggttgaggagaatgtccatctcatccggtttctacggttcctggctaacttcttcgtgtttctgaccctcggtggttctgggtatctgatcttttgggccgttaagaggtcccaagaatttgctcaacaagacccagacacactaggatggtgggaaaaaaatgaaatgaatatggtgatgtctcttctaggcatgttttgtcccaccttgtttgacctcttcgcagagctggaagactatcatcccctgatagcgctaaagtggctgctggggcggattttcgccctgctgttggggaacctgtatgtcttcatactggccctaatggatgagatcaataacaagattgaggaggagaagctcgtgaaggccaacattaccttatgggaggcgaatatgataaaagcatacaatgcctcgtttagcgaaaatagcacagggccgccttttttcgttcaccccgctgacgttcccagggggccatgctgggagacaatggtaggtcaagagttcgtccggctgacagtgagcgatgtgctgacgacgtacgtgaccatcctcattggggatttcctgagagcctgtttcgtccgtttctgcaattactgttggtgttgggatctcgaatacggttacccatcttacaccgaattcgatatctctggtaatgtgctggcactgatctttaaccaggggatgatctggatggggtcatttttcgctccttcactgcccggaattaacattctgcggctgcacacttccatgtacttccagtgttgggccgttatgtgttgcaacgttcctgaagcccgggtatttaaggctagcagatctaataatttctacttagggatgctgttacttatcttatttttatccaccatgcctgtcctttacatgattgtttcactcccgccttcgtttgattgcggacctttcagcggaaagaaccgaatgtttgaggtaataggcgaaacccttgagcacgactttccctcctggatggccaaaattctgaggcagctgagtaacccggggctcgttatagctgtgatcttagttatggtcctcgcaatatactatctcaacgcaacagccaaagggcaaaaggccgcgaaccttgatcttaagaagaaaatgaagatgctgcagctgctggtcgctagcaataaataccctgagagtccggaaaaggttcacttcgcactgctgtttaagtcaaacgcaatctgtgagcggcccgagaacaaacactgctag

SEQ ID NO: 138547 - DNA, 2283 bp, Artificial Sequence
  Description of Artificial Sequence: Synthetic coding sequence
atgagccccaaaaaggtacagatcaaggtcgaggagaaagaggatgaaacagaagaaagctcaagtgaagaggaggaggaagttgaggataagctgcccagaagagagtcattgagaccaaaacgaaagaggacacgggacgtaatcaacgaggacgaccccgaacctgaacccgaggacgaagagacaagaaaagcaagagagaaggaacggcggagaagattaaaaaggggagccgaagaagaggagattgacgaggaagagcttgagaggctcaaagcagagctcgacgagaagcggcagatcatcgctactgtcaagtgtaagccatggaagatggagaagaaaatcgaagtgctgaaggaagctaagaagtttgttagtgagaatgaaggggcactggggaagggaaaaggcaagcggtggtttgcttttaagatgatgatggcaaagaaatgggcaaagttccttcgcgatttcgaaaatttcaaggccgcgtgcgtcccatgggaaaataaaatcaaggccatcgagtcacagttcggctcctccgtagcctcctattttctattcctccggtggatgtacggggtcaacatggttcttttcatattaacgtttagtctcatcatgcttcccgaatacctgtggggcttgccctatggaagtcttcctcggaaaaccgttcctcgcgccgaagaggcttctgcagcgaacttcggcgttctgtacgactttaacggattggcacagtactctgtcttattttacggctattacgataataagaggaccattggttggatgaactttaggctgcccttgagctattttttagtcgggatcatgtgtattggttactcttttctggttgtacttaaggccatgacgaagaatataggagacgatggcggcggagacgacaacacctttaatttctcctggaaagtgttcaccagttgggattacctaatcggaaaccccgaaaccgccgacaacaagttcaattcaattacaatgaatttcaaagaggcaattactgaggaaaaagcggcgcaggtggaagagaatgtgcatctgataaggttccttaggttcttggcaaactttttcgtgtttctaaccttaggcggctccggttatctaatattctgggctgtgaaacgaagtcaggagttcgcacagcaggatcctgacaccctgggctggtgggagaagaacgagatgaatatggtcatgtcccttctcggaatgttctgtcctacactgttcgatttgtttgctgagttggaggattaccacccccttattgcactcaagtggttgctaggacgaatcttcgccttactgctgggcaatctatatgtcttcatcctggcgctgatggacgaaattaataataagatcgaagaagagaagctagtgaaagctaatattactctctgggaagctaatatgatcaaagcctacaacgcttcgtttagcgagaacagcacgggtccacccttttttgtgcatccagcagatgtcccacggggaccatgctgggaaacaatggtcggccaagagttcgtcaggctgaccgtttccgacgtactaactacatatgtcaccattctcataggcgatttcctgagggcgtgctttgtgcgcttctgtaactactgctggtgctgggacttggagtacgggtatccgagctacacggagtttgacatctccggaaacgttctagctctaatattcaaccagggaatgatctggatgggaagtttctttgcccccagtttgccaggaattaatatcctaaggcttcacacttccatgtacttccaatgctgggccgtgatgtgctgtaatgtgccagaggctagagtattcaaggctagcagatccaacaacttttacttgggaatgctgttattaatcctcttcctatccaccatgcctgtactctacatgattgtgtcccttcctccttccttcgactgtggccccttctcggggaaaaacagaatgttcgaagttattggtgagacgttggagcatgactttccaagctggatggccaagatactcagacagctcagcaacccaggactggtaattgctgtcatcttggtcatggtgttggctatctactacctgaacgctacggccaagggtcaaaaagcagccaacctggaccttaagaaaaagatgaagatgcaagccctagagaataagatgagaaacaagaaaatggctgcagcacgagccgcagcagccgccggacgacaatag

SEQ ID NO: 138548 - DNA, 2184 bp, Artificial Sequence
  Description of Artificial Sequence: Synthetic coding sequence
gtggaatggtctggggagtgcctgcgatcgtgcagaagagaagtgcagatcaaagtggaagaaaaggaggatgaaactgaggaatcctcaagcgaagaggaggaggaagttgaggataaactgcctaggagggaatcgctgagaccaaaacgcaagcgcacgcgggatgtcatcaatgaagatgatcccgaacccgagccagaagacgaagagacaaggaaagccagagagaaggagagaagacgacgtttaaaaaggggggccgaagctaaaaaatttgtatctgaaaatgagggggccctcgggaaaggcaaaggaaaaaggtggtttgccttcaagatgatgatggccaaaaagtgggcaaaattccttagagactttgagaatttcaaagccgcctgcgtgccatgggaaaataagattaaagcaatcgaatcacagttcggaagctctgtggcctcttatttcctgttcctgcggtggatgtacggagttaacatggtactctttattctgactttctcgttgatcatgctgccggagtacctgtgggggctaccatacgggtctctgccccgcaagacggttccgagggctgaggaggcgagcgcggccaacttcggagtgctgtatgacttcaatggtctcgcgcagtactcagtactgttttatggatattacgataataaaaggacaattgggtggatgaacttcaggcttcctttgtcgtacttcttggttggtatcatgtgtatcggatatagcttcctagtagtactgaaggccatgactaaaaacattggagacgatggaggtggggatgacaataccttcaatttttcttggaaggtcttcacttcctgggattaccttattgggaaccctgaaacagctgataacaagttcaacagcatcaccatgaattttaaagaggccattaccgaagagaaggccgcccaggttgaggagaacgtgcatttgattcgcttccttagatttctggcaaatttctttgtgttcttaaccctggggggatccgggtacctgatcttctgggccgtgaaaaggagtcaggagtttgcccagcaggacccggatacacttggttggtgggaaaaaaacgagatgaacatggtcatgtcactcttgggcatgttctgtcccactctgtttgacctgttcgccgagctggaggactaccacccgcttatcgccttgaagtggcttctcggcaggattttcgccctgctgctcggcaacctctatgtgttcatcctagcactgatggatgagattaataataagatagaagaggaaaagttagtgaaagctaacatcacgctttgggaggcgaacatgattaaagcatacaatgccagtttctccgagaacagcaccggcccaccgttttttgtacatcccgccgatgtgccacgaggcccgtgttgggagacaatggtgggacaggaatttgtccggctgacagtttccgacgttctgaccacgtacgtgaccatcctgattggggatttcctacgcgcctgctttgtcaggttctgtaactactgctggtgctgggacttggaatacggatacccgtcttatacagagtttgacatcagtggtaacgtgctcgcactcatttttaatcagggtatgatctggatgggttctttcttcgcacccagtttgcctggcattaatatcctgagactccatacatctatgtacttccaatgctgggcggtcatgtgctgtaatgtcccagaagcccgagtgttcaaggcgtctcgctcaaacaacttctatctcggcatgctgcttctcatcctcttcctttctacaatgcctgtcctttatatgatagtgagcctgcctccctccttcgattgcggtcctttttcagggaagaacagaatgtttgaagtaatcggcgagacacttgagcacgactttccttcttggatggccaagatccttcggcaactgtccaaccccgggttagtgatagctgtcattctggttatggtgctggccatttattaccttaacgcgacagcgaaaggccaaaaagccgctaacctggatttaaagaagaagatgaaaatgcaggccctggagaacaagatgagaaacaagaaaatggccgcggctagggccgccgcagctgcaggccggcagtag

SEQ ID NO: 138549 - DNA, 1665 bp, Artificial Sequence
  Description of Artificial Sequence: Synthetic coding sequence
gttgaatggagcggagagtgcctacgcagctgtcgacgcgaggttcagattaaagtggaagagaaggaggacgagactgaggaatcctcatccgaggaagaagaagaagtcgaggacaaactgcccaggcgggaaagcctcagaccgaaaagaaagcggactagagacgtgatcaatgaagacgaccccgaaccggagccagaggacgaggaaacacgcaaggctcgtgaaaaagagagaaggcggaggcttaagaggggcgctgaggctaaaaagttcgtgtctgagaacgagggcgccctgggcaaggggaagggcaaaaggtggttcgcttttaagatgatgatggctaaaaagtgggctaagtttctcagggacttcgagaactttaaggcagcgtgcgtgccgtgggaaaacaagattaaggctatcgagagtcaattcggttcctccgtagcctcttacttcctcttcctacggtggatgtatggtgtaaacatggtgctgttcatattgactttttctctgataatgctgccagagtacttatggggtctcccttatggctccctgccaagaaagacagtgcctcgggcagaggaggcttccgccgcgaactttggggtgctgtacgatttcaatggattagctcagtactctgtgctcttctacgggtactacgacaataagcgtacgatagggtggatgaactttcgactgccactcagttactttctggtgggtataatgtgtattggctatagtttcttggtagtgctcaaagccatgacaaaaaatatcggcgatgatggtggcggtgatgacaacacctttaacttcagctggaaggtgttcaccagctgggattacctgataggaaacccagaaacagccgacaacaagtttaactcgatcaccatgaattttaaagaggccataaccgaagagaaagctgctcaggtggaagagaacgtccacctgatccgctttttgcgcttcctagctaatttttttgtctttctaactctgggcggttcaggctatttgatcttttgggccgtgaaacgctctcaggagtttgctcagcaagaccctgacaccttgggctggtgggagaaaaacgagatgaacatggttatgagcctccttgggatgttttgtcccacactgttcgatctatttgccgaattggaagactaccacccccttatagccttgaaatggcttttggggagaatctttgcactcctgcttggaaatttatacgtatttatcctggcattgatggatgagataaataataagattgaggaagagaagctagtgaaagctaacatcacgctgtgggaggccaacatgatcaaggcctacaacgcctccttctcagaaaattctacaggaccccccttcttcgtgcacccagccgacgtccccagggggccctgttgggaaaccatggtggggcaggaattcgtgcgattaacagtgtcggacgtacttactacctatgtgaccatcctcatcggggattttcttcgcgcttgttttgtgcgtttttgcaactattgctggtgttgggacttagagtacggatacccctcttacacagaatttgatatttcagggaacgtactggccctaatcttcaaccagggaatgatctag

SEQ ID NO: 138550 - DNA, 2265 bp, Artificial Sequence
  Description of Artificial Sequence: Synthetic coding sequence
caaattaaggtggaggagaaggaagacgagactgaagaatcatcgtccgaagaggaggaggaagttgaggataaactgcccaggcgggagtctctcaggccgaaaaggaagcgcacccgcgacgtgatcaatgaagatgatcctgaacccgaacccgaggatgaggaaacaaggaaagcaagggagaaagagagacgaagacgcttgaaacgaggagcagaggaggaagagatcgacgaggaggagctcgagaggttaaaggcagaactggatgaaaagcgtcagattattgccaccgtgaaatgtaagccatggaaaatggaaaagaaaatagaggttctgaaagaagccaagaagttcgtgtctgagaatgagggggccctcggtaagggcaagggcaagcggtggtttgcgttcaaaatgatgatggccaagaagtgggccaagtttctccgagacttcgagaacttcaaagcagcctgtgtgccatgggagaacaaaattaaagccatcgagtcacaattcggctcgagcgttgcatcctacttcctgtttctgaggtggatgtacggtgttaatatggtgctatttatactcaccttttctttaataatgctgccagagtatctttggggtttaccctatggctcactgccaagaaagacggttccgcgagcagaagaggccagcgctgctaatttcggtgtcctgtacgatttcaacggccttgcgcagtactccgtcctgttctatggctattatgacaacaaacggacaatcggttggatgaacttccggctgccattgagttacttcctcgtgggcataatgtgcatcgggtactcttttctagtagtgcttaaggcaatgaccaagaatattggagacgacggtggaggtgacgataacacttttaactttagctggaaggtttttacatcatgggattacttaattgggaatcccgaaactgctgacaataagttcaatagtatcaccatgaacttcaaggaggccattacggaagaaaaggctgcgcaggtggaagagaatgtccatcttatcaggtttctccgcttcctggcaaatttttttgttttcctgaccctgggggggtcaggttaccttatcttttgggctgtcaagagatcacaggagttcgcacagcaggaccctgacactctcgggtggtgggaaaaaaatgaaatgaacatggtcatgagcctgcttggaatgttttgcccgactttattcgacttgttcgccgaacttgaagattaccaccccctgatcgccttaaagtggcttttgggccgcatcttcgcacttctgcttggtaatctctatgtgttcatcctggctcttatggatgagataaataataagattgaggaagaaaagctggtgaaggcaaacattactctttgggaagccaatatgatcaaggcttacaatgcaagtttttctgaaaacagcacgggacctcctttcttcgtgcaccctgcggacgtcccccgggggccttgctgggaaacaatggtcggacaagagtttgtgaggctgacagtgtctgacgtcttgacgacatacgtgaccatcctgatcggtgatttcctcagggcctgcttcgtgaggttttgtaattattgttggtgctgggatctcgagtatggctaccccagctacaccgaattcgacatcagcggaaacgtccttgctctgattttcaatcagggcatgatctggatgggtagctttttcgccccttccctccctggcatcaacattcttaggctgcacacttctatgtactttcagtgctgggccgtgatgtgctgcaatgtgccagaggccagagtgtttaaggcatcgaggagcaacaatttttatcttggtatgctgctgttgatcctatttttgagcactatgccagtcctgtacatgatcgtgagtctgccccctagcttcgattgcggtcccttcagcggaaagaaccgcatgttcgaggtaataggcgaaaccttagagcacgacttcccctcctggatggctaagatattgaggcagttgagtaaccctggattagtaatcgctgtcattttggttatggtgctcgccatctactaccttaatgctacagctaaggggcagaaagcagctaatctggatttgaagaaaaagatgaaaatgcaggcactcgagaacaagatgcgcaacaagaaaatggcagctgccagagctgacggggctgccggccgagcttag

SEQ ID NO: 138551 - DNA, 2721 bp, Artificial Sequence
  Description of Artificial Sequence: Synthetic coding sequence
atgagtcaccaggtgaaggggttaaaagaagaggctcggggaggggtgaaggggagagtgaagagcggttcaccgcacaccggcgacagactgggccgccggagtagctctaagagagcactaaaagcagaaggcactccagggcgcagaggcgcccaacgatcccagaaggagcgcgcgggtgggagtccaagtcctggctctccgcggcgcaagcagacaggtaggcggagacaccgggaagagctgggagagcaggagagaggagaagccgagcgcacctgcgagggtcgccggaagagggacgagagggcaagcttccaagagaggaccgccgcccccaagagagagaaggaaatcccccgtcgcgaagaaaaatctaagcggcaaaaaaaaccccgatcctctagcttggcctcctctgcttcagggggggagagcctctcagaggaagagcttgcccagatactggagcaggtggaagagaaaaagaaactcattgcaacaatgcggagcaaaccctggcctatggccaagaagctcacggaactgcgggaggcccaggaattcgtcgaaaagtacgagggagccctaggcaagggcaagggtaaacaactgtatgcttacaagatgcttatggctaaaaaatgggtcaagtttaagagggactttgacaactttaaaacacagtgcatcccttgggaaatgaagatcaaggatatcgagagccacttcggaagctcagtggccagctactttatcttcctgagatggatgtatggcgtcaatctggtcctgttcggattgattttcggactcgtcattatccctgaagtgttgatggggatgccctacggttctataccaaggaaaactgtgccccgcgcagaggaggagaaagctatggacttcagcgtactttgggactttgaaggctatattaaatatagtgctttattttatggctattacaacaaccagcgaaccattggctggctgcggtaccgactgcccatggcgtactttatggtcggcgtaagcgtattcggctatagcctgatcattgtaattcgatccatggcaagtaatacgcaggggtccacaggggagggggaatctgacaactttaccttcagttttaaaatgttcacttcttgggactatctcattggaaattccgaaaccgccgacaacaaatacgcgagcattacgacgtcgttcaaggagagtatcgtggatgaacaagaatcaaataaggaggagaacatccacctaacgagatttcttcgtgtccttgctaactttctgattatctgctgcctgtgtggcagtgggtacttgatttatttcgtggtgaagcgcagccaacaattctctaaaatgcagaacgtgtcatggtacgaaagaaacgaggtggaaattgtaatgtcattgctggggatgttctgtcccccactgttcgaaaccattgcggcactggagaattaccacccccggacaggactgaagtggcagctcggtcgcatcttcgctctattcctgggaaatctatatacatttctgttggccttgatggacgatgtacacctcaagctggcaaacgaggagaccattaagaacatcacccattggactctctttaattactataattctagcgggtggaatgagtccgtcccccgcccaccccttcatcccgctgatgtgccccgggggtcatgttgggagacggcagtcggaatcgaattcatgcggcttactgtgtctgacatgctcgtgacttatattaccatcctgctgggggacttcttgcgcgcctgttttgtgcgatttatgaactactgctggtgctgggacttggaagctggctttccgtcatacgctgagtttgacatcagcggaaacgtcttagggctgatatttaatcaggggatgatttggatgggctccttttacgctcctgggctggttgggatcaacgtgctacgactgctgaccagcatgtacttccagtgctgggccgtgatgtccagtaatgttccgcatgagagagtttttaaagcaagccgtagtaataacttttatatgggtctgttgcttctggtcttgtttttgtccctccttcccgtggcttacaccattatgagcctgccgccctcatttgattgcgggcctttctctgggaagaaccgtatgtacgacgtgcttcaggagaccattgaaaacgactttccgacctttctggggaagatctttgcttttttggccaacccgggattaattatcccggccattttgctcatgttcctcgccatatattatctgaacagcgtttcgaaatccctttcaagggccaacgcacagctgcgcaaaaagatccaggtgctgcgcgaagttgagaagtcccacaagtcggtgaaaggaaaggctacagcccgggattcagaagacacgcccaaaagttccagcaagaatgctacccagctgcaattgaccaaagaggaaaccacccctccttccgcaagccagagccaggccatggataagaaggcccagggcccaggcaccagcaattcggcgtcacgaactacgctgcctgcttcgggacacctgcctatctctcgcccgcccggcatcggtcctgacagtggccacgccccgtcccaaacccatccatggagaagcgctagtggcaagtccgctcagagaccccctcactag

SEQ ID NO: 138552 - DNA, 1365 bp, Artificial Sequence
  Description of Artificial Sequence: Synthetic coding sequence
atggcacagcccctcgctttcatcctcgatgtgcccgaaactcctggcgatcagggccaggggccttctccttatgatgagagtgaagtccacgactctttccagcaactgatacaggagcagtctcagtgcactgctcaggagggacttgagctgcagcagcgggagcgggaggtaacaggcagctcacagcaaactttgtggcgccccgaaggaacccagagcactgccacgcttcgcatcttggctagcatgccatcaagaacgatcgggcggtcgcggggcgcaatcatctctcaatattacaacagaacggtgcagcttcgctgccgatcttccaggcctttacttggcaatttcgttaggagcgcctggccttctctcagattgtatgatctcgaacttgatccgacagcactcgaggaagaagagaaacagagtctcctggttaaggagcttcagtccctggcagtcgcacagcgcgaccacatgctgcgaggaatgcctctttcactggcggagaagcgttcactcagagagaagagccggactccacgtgggaagtggagaggacaacccggatctggaggtgtgtgcagctgttgtggccggttgaggtatgcctgtgtgctggcactacactctctgggtctggctcttctcagcgctctccaagctcttatgccatggagatacgcgctaaaaagaattggcggccagttcgggtcttccgtcctctcatactttcttttcttaaaaacactgctagccttcaacgctttgttattactcctcctggtggcgtttatcatggggccccaggtggctttcccaccggcacttccaggacctgcacccgtttgcaccggactggagctgttaactggagccggttgcttcacacatacagtgatgtattacgggcactacagcaatgccacactgaatcaaccttgtggctcacctttagatggctcacagtgtactcctagagtgggtggcctgccctacaatatgcccttggcctatctgtctaccgtcggggtatccttctttatcacatgtatcacactggtgtacagcatggcacactccttcggcgagtcttatagagtcggctccacctccggcattcacgccattacagtgttttgctcatgggactacaaggtgacccagaaacgcgcttctaggctgcagcaggacaacatccggactcggttgaaaggggaggataagatctttcttattaataaactccactccatttacgagcgtaaagagcgagaggagcgctctagagtgggcacaaccgaggaggcggcggcacctcctgctttactgactgacgaacaagatgcctag

SEQ ID NO: 138553 - DNA, 2418 bp, Artificial Sequence
  Description of Artificial Sequence: Synthetic coding sequence
atggcgcagcccctagcctttatattggacgttccagagacaccaggagaccagggccagggaccctcaccatacgacgagagcgaagtgcacgattcctttcagcagttaatccaagaacagagtcagtgtacagcacaggaagggctggagctacagcagcgagaaagagaagtcacaggctctagccagcaaaccctctggcgtccggagggaacacaatccacagccactctcagaatactggctagcatgccttccaggaccattggcaggtcacgaggtgctatcatttcacagtattacaacagaacagtgcagctgaggtgtaggtcttcacgaccactgttgggcaatttcgtgcggtcagcctggccttcactgaggctgtacgatctggaactggaccctaccgctttagaagaggaggagaaacaatccctgctcgtcaaggagctacagtctctggcagttgctcagagagatcacatgctacgcggcatgcctttaagtttggcagagaagaggagcctcagggagaagagtcggacaccccgtgggaagtggaggggccaacctggctctggcggggtctgctcctgctgtggacggcttcggtatgcatgtgttttggccctgcattccctgggattggcactgctgtcggctctgcaagcactgatgccatggcgatatgccttgaaacggattggtgggcagttcggcagcagtgtcctcagttacttcttatttctgaagactctacttgctttcaacgcgctcctgttgttgctattggtggcttttatcatgggccctcaagtagcctttccacctgccctacccgggccggcacctgtgtgtaccggtttggaactgctgaccggcgcaggatgcttcacccataccgtaatgtactacgggcattattctaatgctaccctcaatcagccctgtggctctcccctggacggttcccagtgcactcccagagtgggcggtctgccatataatatgccactcgcctatttgagtaccgtgggagtgtctttttttatcacctgcattactttagtctacagcatggcacattcttttggagaaagctatcgcgtgggctccacgtccggcatccatgccataaccgtattttgctcatgggactataaggttactcaaaagagagcatctaggctccagcaggataatatccgaaccagattaaaggaactgttggccgagtggcagctgagacactctcccagatccgtctgtgggaggctgcggcaggctgccgtgctcggactcgtctggcttctgtgtctcggaacggccctcggatgcgccgtcgccgtgcatgtctttagtgaattcatgatccagtcacctgaagcggctgggcaagaagccgtccttctggtcctcccactggtggtgggcctgctgaaccttggggccccatatttgtgcagagtgctggccgccctggagcctcacgacagccccgtgctcgaggtttatgtagctatctgccggaatctgatcctgaagttggctatcctgggaaccttgtgttaccattggctgggcagacgcgtgggcgtccttcaggggcagtgttgggaagacttcgtggggcaggaactttacaggtttctggtgatggattttgtgctaatgctgctagatactttatttggcgaattggtgtggagaatcatcagtgaaaaaaaacttaagcgacgccggaagccagaatttgatatcgcgaggaacgtgctggagttaatttatggacagactctgacttggctcggggtcctattcagccccctgctgcctgccgtccagatcatcaaactgttgcttgtcttctacgtcaagaagacttctctccttgcaaactgccaggccccacggcgcccttggctggcctcccacatgtccaccgttttcctgaccctcctgtgctttccagcctttctgggggccgctgtatttctctgctatgccgtctggcaggttaagcctagttcaacctgcggtccattccgaactctggacactatgtatgaggcagggcgcgtgtgggtgagacatctggaagccgcaggcccgcgggtgagctggctgccctgggtccatcgctatttaatggagaacacctttttcgtctttctggtgagcgccctgctgttggcagtgatctatctgaatattcaggtggtgcgtggccagcgaaaggtcatatgcctgctaaaggagcagatcagtaacgagggagaggataagattttcctcattaacaagctgcatagtatttatgagcgtaaggagcgggaggagagatccagagtaggcactaccgaggaggccgccgcaccgccagcattactgaccgacgagcaggacgcctag

SEQ ID NO: 138554 - DNA, 1155 bp, Artificial Sequence
  Description of Artificial Sequence: Synthetic coding sequence
atggcgcattcattcggcgaatcttacagagtgggttcgacctcaggcattcatgcgattaccgttttctgctcatgggactataaggtgactcaaaaacgagctagtcggctccagcaggataacattagaactcggctgaaggagctgctcgccgaatggcagttgaggcattcccctaggagtgtatgtgggcgactgcgccaggccgcggtgctggggctagtttggctcctgtgcttgggaacggcactcggatgcgctgtggcggtgcatgtgttttcagaattcatgatccaatcccccgaggcggcaggtcaggaagcggtgttgctcgtcctcccattggtagttgggctgttaaatctgggagcaccctatttgtgtagagtccttgcagctctggagcctcacgacagtcccgtcttagaagtgtatgtggcgatctgtaggatcatcagcgagaagaagttaaagcggaggagaaaacctgagttcgatatcgccaggaacgtgttggagctgatatatggacagactctgacctggcttggggttctgttttctcctctcctgccagcggtacagattatcaagcttctcctggttttctacgtaaagaagacatcactcttggcaaattgccaggccccacgacgtccgtggttggcttcccacatgagcactgttttccttacactcctgtgctttcccgccttcttgggagctgccgtctttctctgttacgctgtctggcaggtgaaaccgagctccacatgtggtcccttcaggacgctggatacgatgtatgaggctggcagggtgtgggtgcggcacctggaggctgcggggcccagagtctcatggctgccttgggtgcaccggtacctgatggagaatactttcttcgtttttctggtgagcgccctgctgctggccgtgatttatctgaatatccaagttgttcgcgggcagaggaaagttatatgcctccttaaggagcagattagtaatgaaggcgaagataaaatctttttgataaataagctgcattcaatttatgaacgtaaggagcgagaagagaggagtcgagtggggaccaccgaggaagctgcggcccccccggccctgctcactgatgagcaagatgcctag

SEQ ID NO: 138555 - DNA, 417 bp, Artificial Sequence
  Description of Artificial Sequence: Synthetic coding sequence
caatgttgggaggatttcgtaggccaggaattgtatcgcttcctggtgatggacttcgtgctgatgctgctcgatactcttttcggcgagctcgagaatcgttttcagagcgacgttttctcaagccggatatgggcttggtggagaaaaccggagtttgatattgccagaaatgtgctcgagctgatctatggacaaacacttacctggctgggtgtgcttttttctccactgctacctgctgttcagattataaaactgctgctcgtcttctacgtgaagaaaacaagcctcctcgccaattgccaggcaccccgccgtccatggctcgcttcccatatgtcaactgtgttcctcacacttctgtgttttcctgcctttctgggcgctgctgtgttcttgtgctacgctgtatag

SEQ ID NO: 138556 - DNA, 2418 bp, Artificial Sequence
  Description of Artificial Sequence: Synthetic coding sequence
atggcccagcctttagcattcatcctagacgtaccggagaccccaggagatcagggccaggggccctcaccctatgacgagtctgaggtgcacgacagtttccagcagttaatccaagaacagagccagtgtacagcccaggagggcttagagctgcaacagcgggagcgcgaggtgactgggagctcccaacagacactatggaggccagaagggacccagtctaccgccacactccgcatactggcctccatgcctagcaggaccattggacggtccagaggagcaataatctcccagtactataataggaccgtgcaactccgttgccgttcatctcgaccccttttgggaaacttcgtccgctctgcatggccatctcttcggttatacgatttagaattagacccaaccgcgttagaggaggaagaaaagcagtcgctgctggtcaaggaactccaatccctggcagtggctcaacgtgatcacatgttgcggggtatgccgttgtctctcgccgaaaagagatctctccgggagaaaagtcgaacacccagaggaaaatggcgaggccaaccggggtccgggggggtgtgttcgtgctgcggaagactccgttatgcatgtgtcctagccctgcattcactgggcctcgcattgctgagcgctcttcaggccctgatgccttggcgatacgccttgaaaaggatcggaggacagttcggaagctcggtactttcatatttcctgtttctgaaaaccctgctggcttttaatgccttgctgctgcttctgctggtggctttcattatggggccccaagtagccttcccccccgccttgccggggcctgcccccgtatgtactgggctggagctactcacaggcgccggctgctttacacacactgtgatgtattacgggcactactcaaacgccacattgaatcaaccttgtggttcccccctggacggcagtcaatgtacccctagggttggcgggctgccctataacatgccactcgcctacctttctacggttggcgtgagctttttcattacatgtattactctggtgtatagcatggctcactcttttggggagtcttatcgcgtaggaagtactagtggcattcatgccattaccgtattctgcagctgggattataaggtgacacagaagcgggcttctaggctacagcaggataatatcaggacccgactgaaagaattacttgcggagtggcagttgagacactcccctaggtctgtctgtggtagattgagacaggccgccgttcttgggttagtgtggctgttgtgccttggaacagccttgggctgcgccgttgccgtgcacgtctttagcgagtttatgatccagagcccagaagcagcaggacaggaggctgtactgcttgtgctgcctttggtagtcggtttgctgaacctgggagccccctatttgtgcagggtcttggccgcgctggaacctcatgattcacccgtactggaagtctatgttgccatatgcaggaacttgatcctgaagttggccatcctgggcaccctgtgttaccactggttggggcgaagggtgggtgtgttgcaaggtcaatgttgggaggactttgtcggccaggagctatataggtttcttgtgatggactttgtgcttatgttgctggacacactctttggcgagctagtgtggcgaatcatctccgaaaagaaattgaagcggagaagaaaacctgagttcgatattgctcgaaatgtgttggagctgatttacggacagaccctgacgtggctgggggtgttatttagcccacttctgcccgccgtccagattattaagctcttgctcgtattctacgtgaagaagaccagtcttctcgcaaactgccaagcccctcgaaggccatggctggcctctcacatgagtacggtgttcctcacactcctttgtttccctgcatttctaggcgcggccgtcttcctgtgttatgcagtgtggcaggttaaaccatctagtacctgtggaccatttagaaccctagacacaatgtacgaggctggaagggtctgggtccgtcaccttgaagcagccggaccccgcgtgagctggctcccctgggtgcaccgctatttgatggagaacacctttttcgtgtttctcgtgagcgcactgctgcttgccgtgatctacctgaacatccaagtagtacgcggccaacgtaaggtgatttgcttactgaaagaacagatatctaacgagggcgaagacaagatctttttaatcaataagcttcatagtatctatgagaggaaggaacgtgaggaacggagccgcgtcggaacaacagaggaagctgcagcacctccagccctgctaaccgatgaacaggacgcttag

SEQ ID NO: 138557 - DNA, 1098 bp, Artificial Sequence
  Description of Artificial Sequence: Synthetic coding sequence
atgaatataatggattttaacgtgaagaaactcgcagccgatgctggtacattcctcagccgtgccgtgcagtttacagaagagaaacttgggcaggctgagaagactgagttggatgcccacttagagaacctgttgtcaaaagcagagtgcacaaaaatctggactgagaagataatgaaacagaccgaagtcctcttgcaacctaatccaaatgcccgtattgaggaatttgtttacgagaaactcgaccgaaaggccccctctcggattaataaccccgaactattgggccagtacatgatcgatgccggcacagagttcggtcccggaaccgcctacggtaacgccctgataaagtgtggcgaaacgcagaagcggatcggtaccgctgaccgcgaacttatccagacttccgcattaaatttcctgaccccactgaggaactttatcgagggggactataagacaatagccaaagagcgtaaactcctgcagaacaaacggctcgatttggatgctgcaaagactcgcctgaagaaagcgaaggcggctgagacccggaactccagcgagcaagaacttcgtataacccagtccgaatttgatagacaggctgaaataacacgtctcttgttggagggtattagcagtacccatgctcaccatctaagatgcctcaacgacttcgtggaagcccagatgacttactatgcgcagtgttatcagtacatgctcgacttacaaaaacagctggggagttttcccagtaactacctgtcaaataacaaccagacatctgtgactccagtgccaagcgtacttcccaacgctattggctctagtgccatggcatcaaccagcggactggtgattaccagtccaagcaacttatccgacttaaaagagtgctcaggaagtcgaaaagcccgggttttgtatgattatgacgcagccaatagcactgaactcagtttattggcagacgaagttatcactgtgttcagtgtggttggaatggactctgattggcttatgggggagcggggcaaccagaagggcaaggttccaatcacatatctagaactgctgaactag

SEQ ID NO: 138558 - DNA, 636 bp, Artificial Sequence
  Description of Artificial Sequence: Synthetic coding sequence
atggccggagtgggtgctgggccacttcgggcaatggggagacaagctctcctccttctggcattatgtgctactggcgctcagggactgtactttcacatcggcgaaaccgaaaaacgttgctttatcgaagaaatacccgatgaaacaatggtcatcggaaactacagaacccaagggatgcacgtagaagtcaaggacccagatggcaaggtcgtgctttccaggcagtatggatccgagggtcgattcacgttcactagccataccccaggagaccaccaaatctgtttgcactccaactctacaaggatggccctttttgccggaggtaagcttagggtccatctggacattcaggtgggtgagcatgcaaacaactaccccgagatagcggctaaagacaaactcacggaattgcagttgcgtgcccgtcagcttctagaccaggtagagcagattcaaaaggagcaggactatcagcggtatcgtgaagagagatttcgtctcacatctgaatcaaccaaccagagggtcctctggtggtcgatcgcacagacggtgatccttatcttgacaggaatttggcagatgcgccacctcaaaagtttctttgaggccaaaaaactcgtgtag

SEQ ID NO: 138559 - DNA, 684 bp, Artificial Sequence
  Description of Artificial Sequence: Synthetic coding sequence
atggctggagtgggtgcaggccctcttcgtgctatgggacgccaggctcttctgctgctggctctctgcgctacaggagcacagggtctgtattttcatatcggagagaccgagaaaaggtgtttcattgaagagatcccagacgaaactatggttataggcaattacaggacccagatgtgggataagcagaaagaagtgttcctgccctccaccccaggtcttggcatgcacgttgaagtgaaagatccggacggtaaagtcgtgctgagccgccagtatgggtcggaagggaggtttacttttaccagtcacacaccaggcgatcatcagatttgcctccactcgaatagtaccaggatggctctgttcgccggcggtaaactcagagtgcacttggacatacaggtgggtgagcacgcgaataattatcctgaaatcgctgcaaaggacaaacttacagagttacagctgcgggctcgccagctcctggaccaggtggagcagattcagaaagagcaggactatcagcggtaccgagaggagcgttttagactgacaagcgagagcacgaaccagcgggtgctgtggtggtcaatcgctcaaaccgtcatattgatcctgaccgggatatggcagatgcggcacttgaaaagcttctttgaggccaaaaagctcgtgtag

SEQ ID NO: 138560 - DNA, 660 bp, Artificial Sequence
  Description of Artificial Sequence: Synthetic coding sequence
atgtcaggactcagtggtccaccagccaggcgaggaccattcccactcgccctgctgctcttatttctgctgggccctcgcctcgtgctagccatatcctttcatctccccatcaactctagaaagtgcctccgcgaggaaatccataaggaccttctcgtgaccggcgcttatgagattagcgatcagagcgggggtgccggtggattacgcagtcatctgaagatcacagatagcgccggccatatcctttatagcaaagaggatgccactaagggaaagttcgccttcaccaccgaggactatgatatgtttgaggtatgttttgagtctaaagggaccggacgcattccggaccaactggtcattctggatatgaaacacggagtggaagcaaagaactacgaagagatcgccaaagttgaaaaactaaagccgctggaagttgagttaagaaggctcgaggacctgtctgagtcgatcgtgaacgatttcgcctacatgaagaagagagaagaagagatgagagacaccaatgaaagcacaaacacccgtgtgctgtacttttccatctttagtatgttctgtcttataggcctggcgacctggcaggttttctatttgcgcagatttttcaaggccaagaaactaatcgaatag

SEQ ID NO: 138561 - DNA, 471 bp, Artificial Sequence
  Description of Artificial Sequence: Synthetic coding sequence
atggctggctggcctggggcaggtcccctgtgtgttctcgggggagccgcgcttggtgtttgcctcgcgggagtcgcggggcagcttgtggagccaagcaccgcccctccaaaaccgaagccccccccactaactaaagagacagtagtcttttgggatatgagactctggcatgtggtaggcatcttctccctttttgtcctatctattatcatcactttgtgctgcgtgttcaattgcagagttcctcgcacccgcaaggagattgaagcccgctacctgcagaggaaggcagccaaaatgtacactgataagctggaaacagtaccacccctgaacgagttaactgaagttcctggagaagacaaaaagaaaaaaaagaagaagaagaaagactcggtagatacggtggccatcaaagtggaggaggatgaaaagaacgaagctaagaaaaagaaaggcgagaaatag

SEQ ID NO: 138562 - DNA, 1602 bp, Artificial Sequence
  Description of Artificial Sequence: Synthetic coding sequence
atgaatgaatcccctgaccccactgacctggctggggtgattattgagctcggtcccaatgattcccctcaaacttcagagttcaaaggagctaccgaggaagctcctgccaaagaatcagtacttgcacgcctgtctaaattcgaggtggaggatgcggagaatgtggccagctatgattctaagatcaagaaaattgtgcatagcattgtctcttccttcgccttcggtctgtttggcgttttcttggtgctgttggatgttaccctcatcctggcggatctgatcttcaccgactccaagctctacattcccctcgaatatcgctcaatttctctggccattgctctgtttttcctgatggacgttttgttgcgtgtgtttgtggagcgacggcagcagtatttcagcgatctcttcaatatacttgataccgccatcatcgtaatccttctgctcgttgacgttgtttacatattcttcgacatcaagctgctgaggaacattccgcggtggactcatctgctgagacttctccgacttatcatactcctgcggatcttccacctgtttcatcaaaaacgacaactggaaaaactcattcggcgccgtgtctcagaaaataagcgcagatatacccgggacggctttgatctggaccttacttacgttacagagcggattatcgcaatgagcttcccgagcagcggccgtcagtctttttacaggaatcctatcaaagaagttgttcggtttctggataaaaagcatcggaaccactaccgcgtatacaatctctgctccgagcgcgcatatgaccctaagcactttcataaccgcgtggtacgcatcatgatagatgaccacaacgttcctaccctacatcagatggtggtgtttacgaaggaagtgaacgaatggatggcccaggacttagagaacatcgttgcaatacactgcaagggtggcactgaccggacagggacgatggtgtgtgctttcctgatcgccagcgagatttgctctacagcgaaagagtccctctattatttcggagaaaggagaaccgataaaacgcatagcgaaaagtttcagggagttaagaccccctctcagaagcggtatgtggcctactttgctcaggtgaaacacctgtataattggaacctcccgccccgcagaattctgtttataaagcacttcatcatctacagtattccacgctatgtgagggatctgaaaatacagatcgagatggaaaagaaagtcgtcttctccactatcagcctggggaagtgctctgtcctggacaatataactaccgataaaatcttgatcgacgtctttgacgggcttcccctctacgatgatgtaaaggtacagtttttctatagcaacctgccgacctactacgataactgctccttctacttttggcttcatacgagcttcattgaaaacaaccggctttacctgccaaagaacgaactggataacttgcataaacaaaaggcgagaagaatctacccgagcgacttcgctgtcgagattttatttggcgagaagatgacttcaagcgatgtcgtggccgggagtgattag

SEQ ID NO: 138563 - DNA, 1542 bp, Artificial Sequence
  Description of Artificial Sequence: Synthetic coding sequence
atgaacgaaagccccgaccccaccgatcttgccggcgtcattattgaactgggaccaaacgactcaccccagacgtctgagttcaaaggggctacggaggaagccccagcaaaagaaagctcaaaaataaaaaagatcgtgcattctatcgtttccagtttcgccttcggcttattcggtgtctttctcgtgctcttggatgttacactcattctggcggacttgatttttacggactcaaagctgtacattcccctggagtaccgctctattagtctcgctattgccctgttctttttgatggatgtgctcctccgggtctttgtagagaggcggcaacagtatttttctgaccttttcaacatcctcgacactgctattatagtgatcctactgctggtcgatgttgtttatatcttctttgacatcaagttactgcgaaacattccccgctggactcacctgcttcgtcttcttagactgatcatcctgttacggattttccacctcttccatcaaaagaggcaactggagaagctgatccgccgcagggtgtcagagaacaaaaggcgctatactcgggatggatttgacctggatctgacttatgtcaccgaacggataatcgcaatgtccttcccatcatccggtaggcaaagcttctatcgcaaccctattaaagaggtcgttcgcttccttgataaaaagcataggaaccattaccgggtttacaatctgtgttcagaaagagcctacgacccgaaacactttcacaatcgtgtggtgagaatcatgattgatgaccataatgttcccacgctgcaccagatggttgtcttcactaaggaggtgaatgaatggatggcgcaggacttggaaaatatcgtcgccatacactgcaaaggaggtacagaccggacaggaaccatggtttgcgcttttcttatcgcttctgaaatttgttcaactgccaaggagagcctgtactattttggcgagcgccgcactgacaaaactcacagtgagaagttccaaggggtcaagactccttcgcagaagcgctatgttgcctattttgcacaggtgaagcatctgtataactggaacctgccaccaagaaggatcctttttattaaacacttcattatttacagcattcctcgctacgtgcgcgacttaaaaatccagattgagatggaaaagaaggtggtgttctcaaccatctcactggggaaatgcagtgtcctggacaacattactacggacaaaattcttatagatgtgtttgacggtctccccctgtacgacgacgtcaaggtgcagtttttctattcaaacttgcctacctattacgataattgctcattctatttttggttacacacaagcttcatcgaaaataaccgcctttacctgcctaagaacgagctagataacctgcacaaacagaaagcacggcgaatctatccaagcgacttcgccgttgagatcctctttggggaaaagatgaccagttcagacgtggtagcaggttccgactag

SEQ ID NO: 138564 - DNA, 1656 bp, Artificial Sequence
  Description of Artificial Sequence: Synthetic coding sequence
atgaatgagtcccccgacccaactgatctggctggcgtgattatcgagctgggaccaaatgatagccctcagacaagcgaatttaagggtgcaactgaagaagctccagccaaggagagtccacacacatccgagtttaaaggtgcagcaagagtgtcccctatttcagagtccgttctcgccagactgtccaagtttgaggtggaagatgccgaaaatgtggcttcgtacgactccaagataaaaaagattgtgcacagtatagtgtccagctttgcttttggcctgtttggcgtgtttctagttctcctggacgtgacactgatcttggctgacctcattttcaccgactctaaactgtacatacctctggaatacagatctatcagtttagccatcgcgctgttctttcttatggatgttctgctcagggtctttgtggagcgcaggcaacagtatttctcggacttatttaacatactggatactgctatcatagtgatactgctgcttgtggacgtggtgtatatatttttcgatattaagttactgagaaatattccaaggtggacacatctgctgaggctgctgcgcttaatcatcctccttcggatttttcatctattccatcagaaaagacagctcgaaaaattgatacgtcgacgcgtgtcagagaacaagaggagatacacaagagatggatttgatttggatctgacctacgtaacagagagaattatagctatgagctttccttcgtcggggcgacagtccttttatcgaaacccaataaaagaggtggttcgctttcttgacaagaaacatcgcaaccactacagggtgtacaatctgtgttccgaaagggcttacgatcctaagcattttcacaaccgggtggtgcgcattatgatagacgaccataatgtgccgactctccaccagatggtggtcttcactaaggaagtgaatgaatggatggctcaggacctggaaaacatcgtggccattcactgtaagggtggaactgacagaaccggaactatggtgtgcgccttcctgatcgcttccgaaatctgcagcacagccaaagaatctctgtattatttcggggagcgaaggacggacaaaacacacagcgagaaattccaaggtgttaagaccccttctcagaaacgatatgtggcctacttcgcccaagtcaaacacctgtacaattggaacttacctccccgtcggattcttttcatcaagcatttcatcatctacagcataccacggtatgtgcgggatcttaaaattcagatcgagatggagaagaaagtggtgttcagtacaattagtctcgggaagtgtagtgtgcttgataacattacaacagataaaatcctgatcgatgtctttgatggactaccgttgtatgacgacgtgaaagtacaattcttttattccaatttgccaacctattacgacaactgctccttctacttctggttacacactagctttattgaaaataatcggttgtatctccccaagaatgagttagataatctgcacaaacaaaaagctcgccgtatctacccatcagactttgccgtggagatcctattcggcgaaaagatgacctcttctgacgtggtggctgggtccgactag

SEQ ID NO: 138565 - DNA, 1692 bp, Artificial Sequence
  Description of Artificial Sequence: Synthetic coding sequence
atggagagggatagtcacgggaacgcttccccagcgaggacaccatctgcgggagctagccctgcacaggccagcccagccggcacgccccctggaagggccagcccggcccaggcttcccctgcccaggcgagtccggcgggtacaccgcctgggagagcgtcgccggctcaggcgtctcccgcaggcacacctcccgggagagcatcccctggacgggcctcacctgcacaggctagccccgctcaggcaagtcccgccagagcctcgccagccttagccagcttgagccgcagttccagcggtcggtcttcctctgccagaagcgctagcgtgactacatcacctactagggtctacctcgtccgcgctacaccagtgggagccgtgcccatccgatcgagccctgctaggtccgcgccagcgactagggcaactcgcgagtctcccggaacctctttgcctaagtttacttggcgagagggccaaaaacaactacccctgattggttgtgtgctcttgctgatcgccctcgtagttagtctgattatcctcttccagttttggcagggccacaccggtataagatataaagagcagcgggagagctgcccaaagcacgcagtgcggtgtgatggggtggtcgactgtaagctgaagtctgacgagctagggtgtgtgcgattcgactgggacaagtcgcttcttaaaatttattccggctcctcccatcaatggctccctatttgctcttctaattggaatgactcttattctgaaaaaacatgccaacagctcggcttcgaatccgcacaccgcactacagaggtggcgcatcgcgactttgccaactccttctctatcctaagatacaactcaaccatacaggagtctctccataggagtgaatgtccttcgcaaagatatatcagcctgcagtgttcgcactgtggcctcagggcgatgactggacggattgttggtggggcactagcctccgatagcaagtggccgtggcaggtctctctgcacttcggcacaacacacatatgcggtggcacgcttatcgatgctcaatgggtactcacagccgcacattgcttctttgttacgagagagaaggtgcttgagggctggaaagtgtatgcaggaaccagcaacctgcaccagctgcctgaggccgcttctatcgctgaaataataattaattcaaattacacagacgaggaagacgattacgacatagcactgatgagactatcaaagccactgacactcagcgcccatatccatcccgcctgtctgcccatgcatggccaaacgttttctcttaacgagacctgctggattacaggctttggaaagacacgggaaacagatgacaaaacaagcccctttctgagagaggtgcaggttaatctcatcgacttcaaaaagtgtaacgattatctcgtttatgattcttaccttacaccgcggatgatgtgcgccggagacctccgcgggggacgtgatagttgtcagggagacagcggcgggcctttggtctgcgagcagaacaacagatggtacttggccggcgtaacatcttggggcacgggttgcggacaaagaaacaaaccaggtgtgtacacaaaggtgactgaggtgctgccctggatttattctaagatggagtcttcagcagggtag

SEQ ID NO: 138566 - DNA, 1194 bp, Artificial Sequence
  Description of Artificial Sequence: Synthetic coding sequence
atggaccctgattcagaccagccacttaattcactcgtgaaggtgatattggataagtattactttctatgtggccagcccttacatttcattccccggaaacagctgtgcgatggcgagctggactgtcccctcggcgaggatgaggagcactgcgtgaaaagctttccagaaggacccgccgtcgcagtgcggctgtccaaggatcggagcacgcttcaggtcctggatagcgcaaccgggaactggttctcagcttgttttgataactttactgaggctcttgctgagacagcatgtcggcaaatgggctactctagcaaaccgaccttccgagccgtcgagatcggcccagatcaggaccttgacgtggtagagattacggaaaacagtcaggagctgcgtatgaggaacagcagcggaccttgtttaagtggcagtctcgtgtcacttcactgcctggcctgtggcaaatccctgaaaacgccccgcgtggtgggggtcgaggaggcctcagtagacagctggccgtggcaagtttccatccagtatgacaaacagcacgtttgcgggggaagtattctggatccacattgggtgctcacagccgcccactgctttcggaaacataccgatgtctttaattggaaggtccgcgccggctcagataaactcggatccttcccaagcctggccgtggccaaaatcataatcatcgaattcaatcctatgtaccctaaggacaacgacatcgccttaatgaagctgcagttccccttgaccttcagcgggaccgtacgccctatctgccttccattcttcgatgaggagcttacacccgcaaccccgctgtggatcatcgggtggggattcaccaaacaaaatggtggtaaaatgtcggatatactgctacaggctagcgttcaagttattgactcgaccaggtgcaatgctgacgatgcctaccagggtgaggttaccgagaagatgatgtgtgcaggcattcctgagggaggcgtggatacatgtcagggtgacagtggcgggcctctgatgtaccagagtgatcagtggcacgtcgtcggcattgtctcttggggatacggatgcggggggccttccactcctggtgtatataccaaagtgtccgcctaccttaactggatctataatgtttggaaagccgagctgtag

SEQ ID NO: 138567 - DNA, 1266 bp, Artificial Sequence
  Description of Artificial Sequence: Synthetic coding sequence
atgatgtaccggactgtgggattcgggacgagatctagaaacctcaagccttggatgatagctgtacttatcgtgctttcactgaccgtcgtagccgtgaccattggattgttggtgcacttcctcgtgtttgaccagaagaaggagtattatcacgggtcctttaaaattttggatccacaaatcaataataacttcgggcagtccaacacatatcagctcaaagacctccgagagactactgagaacctcgtgagccaggttgatgaaatcttcatcgattcagcttggaagaaaaattatattaagaaccaggtggttagattgacacctgaggaggacggtgtcaaggtcgatgtgattatggtgttccagtttcccagcacagagcagcgcgctgtcagggagaaaaagattcaatcaattttgaatcaaaagattcggaatctaagagccctccctatcaatgccagctccgttcaagtgaacgctatgtcgtccagtacgggagagctcaccgtccaggcctcctgtgggaaaagggtggtaccactaaatgtcaaccggatcgccagcggtgtgatcgcacctaaggctgcctggccttggcaggctagcctccagtacgataatatacaccagtgcggagcaacacttattagcaacacgtggcttgtcactgcagcccactgtttccaaaaatacaagaatccccaccagtggaccgttagcttcggcaccaaaattaatcccccattaatgaaaaggaatgtacggcgcttcatcatccacgagaaatatagaagtgccgctagggagtacgatatcgcagtagtacaagtcagctcccgggttaccttctcagatgacatccgccagatttgcctcccggaagcaagcgcgtctttccagcctaacctgactgtccacatcaccggcttcggcgcactgtattatggtggagagagccagaacgatcttagagaggcaagagtcaagatcatttctgatgatgtgtgtaagcagccacaagtgtacggaaatgatattaaacctggaatgttctgtgcgggctatatggagggcatctacgatgcttgcagaggcgacagcggaggaccattggtaactcgggacctgaaagatacatggtatctcatcggaattgtatcctggggggataactgcggacagaaggataaaccaggagtgtacacccaagtgacctactatagaaattggattgcgtcaaaaaccggcatctag

SEQ ID NO: 138568 - DNA, 1257 bp, Artificial Sequence
  Description of Artificial Sequence: Synthetic coding sequence
atgatgtaccggacggtgggattcggcacacggtcccgaaatttgaaaccttggatgatcgctgttctcatagtgctgagtctcacagtagtcgccgtcaccatcggactgttggtgcatttccttgtttttgatcagaagaaagaatattaccacggaagttttaagatactggatccccagattaacaataattttggtcaatcaaacacctaccagctaaaagatcttagagagaccacggagaacctggttgatgagatatttatcgacagcgcatggaaaaagaactatatcaaaaatcaggtcgtgcggctgacccccgaggaagatggagtaaaggtggatgtgatcatggtgttccagttcccgtccactgaacagagggccgtacgcgaaaaaaaaatacagtcgatcctcaaccagaagatacggaacctcagagcgttgcctatcaacgcaagctcagtgcaagtaaacgccatgtcttcatccacgggagagctgaccgtgcaggctagctgcgggaagcgcgtggtacccctcaacgtgaaccgcatcgccagtggggttattgcaccaaaagccgcttggccctggcaggcttccttgcagtacgacaacattcatcagtgcggcgctactctgatctccaacacgtggctcgttaccgctgctcactgctttcagaaatacaagaatccacaccaatggacagtcagttttggcacaaaaatcaatcccccattaatgaagcgaaatgtaaggaggttcatcattcacgagaagtacaggtctgctgcccgcgaatatgacatcgcagtggtgcaagtgtcaagcagagttacgttctcagatgatattcgccagatatgcttaccagaggctagcgcttcttttcagccgaatctcactgtgcatattaccggattcggggccctgtactacgggggagagagccagaatgatctgcgggaggctagggtcaaaattatatccgacgatgtatgcaaacagccccaggtttacggaaacgatattaaacctggtatgttttgcgcgggttacatggaaggaatctatgatgcctgtaggggtgattcaggcgggcccctggtgacccgcgacctgaaggatacatggtacttgataggtatagtgtcctggggagacaactgtggccagaaagataagccaggcgtgtacactcaggtgacctactaccggaattggattgcttccaagacaggaatctag

SEQ ID NO: 138569 - DNA, 1254 bp, Artificial Sequence
  Description of Artificial Sequence: Synthetic coding sequence
atgtacaggaccgttggctttgggacccgctcaagaaacttgaaaccatggatgatcgcggtgttgatcgtgttgagtctcaccgtcgtcgccgttactattggtcttctcgtacactttctggtgtttgatcagaagaaggagtattaccacgggtccttcaagattctggacccccagattaataataattttggccagtcaaacacttatcagctgaaggacttaagggagactaccgagaacttagtagacgagatctttatcgatagtgcctggaagaaaaattacataaagaaccaggtcgtcagacttacccctgaggaagacggggtaaaagtggatgtaattatggtgtttcaatttccctcgactgagcagagagcagtgagagaaaagaagatccaatcgatcctcaaccagaaaattcggaacctacgggccctgccaattaacgcctcttcagtgcaggttaacgctatgagctcatccactggtgagcttacagttcaagcgtcctgtggcaagagggtcgtgcctctcaatgttaatcggattgcgagcggggtaatcgcccccaaagccgcctggccctggcaggccagtttgcagtatgacaacatccaccagtgtggagcaaccctaatctctaatacttggttagtgacagccgcccactgctttcaaaagtataagaacccccatcaatggacggtttctttcggaaccaaaatcaaccccccacttatgaagcgtaacgtgcgaagattcatcatccatgaaaaatatcgatccgctgcccgggaatacgatattgccgtggttcaggtgtcctcgagagtcaccttcagtgacgacatccgccagatttgcctccccgaagcctctgcatctttccagcctaacttaactgtacacataactggatttggagccctgtattacggaggtgaatcacagaatgacctgcgggaagcacgggttaaaattattagcgatgatgtgtgcaaacagccacaggtctacggaaacgacatcaagcccggtatgttctgtgccggatatatggaaggcatttatgacgcttgccgaggcgacagtggtggcccactagtgacacgcgacctaaaagacacttggtacttgatcggaattgtctcatggggcgacaactgcggacagaaggacaaaccaggagtgtatacacaggtgacgtattataggaattggatcgcatctaagactggcatttag

SEQ ID NO: 138570 - DNA, 1689 bp, Artificial Sequence
  Description of Artificial Sequence: Synthetic coding sequence
atggagcgggattctcacgggaacgcctcacctgccagaaccccaagtgccggagctagtccagcccaggccagccctgccggcacccctccaggaagggcatcccccgcccaggctagcccggcccaggcctccccagcagggacccccccaggtcgcgcatctccagcacaagcgtcacccgctggcacccctccaggcagagcctcccccggcagggctagcccccttcaagccagtccagcccgcgcgagccctgccttggcttcactttcccgaagctcttccggtcgcagtagttcagcaaggagcgcatcagtcacaacttcccctactcgggtttacctggtgcgggccacaccagttggggccgtccccattagatccagtcctgcacggagcgctcccgctacaagggcaacacgggagtctcctggcaccagtctccctaagttcacatggagggaaggtcagaaacagctgccactgatcggatgtgtgcttttactgatcgccttggtcgtgtcactgatcattctcttccaattctggcagggccataccggaataaggtataaagagcagagagaatcatgccccaagcatgcggtgcggtgtgacggcgttgttgattgtaaactgaagagcgatgaactcgggtgtgtgcggtttgattgggacaagtccctgctgaagatctattcaggatccagccaccagtggttgcctatatgtagttctaattggaacgattcttactcagaaaagacgtgccaacagctgggctttgaaagtgcacataggactaccgaagtagcacacagggacttcgcaaacagtttttctattctgaggtacaacagtaccatccaggaatcgttgcaccgatccgaatgcccgtcccagcgctacatttcactgcagtgctcacactgcgggcttcgggcaatgacaggtaggatcgtcgggggcgcactggctagtgacagtaagtggccatggcaggtgagtctgcacttcgggactacgcacatctgcggcggaacacttatcgatgcgcagtgggtgttgaccgcggctcattgtttctttgtgacacgggagaaagtgctcgaaggttggaaagtgtacgccggaactagtaatctccaccagttgccagaggctgcctccatagcagaaataattattaacagtaactacaccgatgaggaagatgattacgatatcgctcttatgcgcctgtccaagcctctgaccctgagcgcccacattcaccctgcatgtctgcctatgcacggacagaccttttcactgaacgagacctgttggataactggcttcggaaaaaccagagaaacggacgataagacaagcccttttctgcgcgaggtgcaggtaaatctgatcgatttcaaaaagtgtaatgattacttagtctatgattcatacctgacacccagaatgatgtgcgccggtgaccttagaggtggcagagattcctgtcagggagactccggagggcctctcgtgtgcgagcagaataaccgctggtacctcgccggagtgacatcgtggggaaccgggtgcggccagagaaataaaccaggcgtgtataccaaagttaccgaggtcctgccatggatctactcgaaaatggaatccgaagtgcgatttcggaaatcttag

SEQ ID NO: 138571 - DNA, 1761 bp, Artificial Sequence
  Description of Artificial Sequence: Synthetic coding sequence
atggagcgtgactctcatggaaatgcgtcccccgcgcgaactccctccgcgggagcttcacctgcacaggccagtccagcagggaccccacctggcagagcctctccagcacaggcttccccggcacaggcaagcccagcaggaacccctccaggtagggcttctccagcgcaggccagtccggctgggacaccaccggggcgtgccagcccgggacgggcgtctcctgctcaggcgtcgccagctcaggcctctcccgcccgtgctagcccagcccttgcttccctgtcccggtcatcttcagggcggagcagcagcgccaggtctgcatcagtaaccacttcccccaccagagtgtatcttgttcgggcaacaccagtgggcgcggtccctattcggtcctcgccagcgaggtccgctccagccactcgagcgacaagggaaagccccggcacctctctccccaagtttacttggcgagagggtcagaaacaactgccgttgattgggtgcgtcctcctgttaatcgcactggtggtttcactcatcatattgtttcagttctggcagggccacaccggcattagatacaaagagcagcgggagtcctgtcctaaacacgctgtgaggtgtgatggagttgttgattgtaaattgaagagtgacgagctcggatgtgtgcgcttcgattgggataagagtctgcttaaaatttactccgggtcctctcaccaatggctacctatctgctcaagtaattggaatgactcgtatagtgagaagacatgtcagcagcttggattcgagtctgctcatcgaaccacagaggtcgcacaccgggatttcgccaatagcttcagtattcttagatataatagcactattcaggagagtctacaccggagcgagtgcccatctcaacgatatatttccctccagtgctctcactgtggcctgcgtgctatgaccgggagaatagtgggaggtgcgctggccagtgactctaaatggccatggcaagtaagtctacacttcggaacgacgcacatatgcgggggaacgttgattgacgctcaatgggtcttgacagcagcccactgcttttttgtgactagggaaaaagtgctcgaggggtggaaggtctatgcaggcacttctaatctgcatcagcttccggaagccgcatctatcgccgaaatcattattaattccaattataccgacgaggaggatgactatgatatcgcgctgatgcggctctccaagcctttgaccctgtccgcacatatccacccagcttgcctacctatgcatggccagacattctctcttaatgaaacctgctggattacaggcttcggtaagacgcgggaaacggatgataaaacatcgcccttccttcgcgaagtgcaagtcaatctcatagattttaagaagtgcaacgattacctagtctacgacagttacttgaccccgaggatgatgtgcgccggagacctaaggggagggcgcgattcttgtcagggagattctggcggcccattggtctgtgagcagaacaaccggtggtatcttgcgggtgtcactagctggggcactggatgcggacagaggaacaaacctggagtgtacactaaggtgacggaagtgctgccgtggatctacagtaaaatggaagtcaggagtctgcagcaggacaccgccccctcaaggttgggaaccagctcggggggggaccctgggggcgccccaagactgtag

SEQ ID NO: 138572 - DNA, 1704 bp, Artificial Sequence
  Description of Artificial Sequence: Synthetic coding sequence
atggaacgcgattctcatggtaatgcatctccagcaaggaccccttctgccggcgctagcccagcgcaggctagtcctgctggtaccccaccaggtagagcgtcccctgctcaagccagtccagcccaggccagccccgccggcacaccccccggcagagcttcccccgcacaagctagccctgcgggaacaccgccaggccgtgcttcccctgggagggcctcccccgcacaggcatctcctgctcaagcctctcccgcgcgcgcttcaccagctttagcatctctgagtcggtccagctcggggaggagtagctctgcaagatctgcctccgtaaccacctctccaactagagtttatctagtccgcgccacccccgtgggggccgtccctatcaggtccagtcccgcaaggtccgcccccgccacccgcgcaaccagagagtcacctggcacttcattacctaagtttacctggcgcgagggccagaagcagctgcccttgattgggtgcgtgctgctgctgatcgctttagtggtcagcctcatcatcctgttccaattttggcagggccacaccggcatcagatataaagagcagcgggaatcatgtcccaaacacgcggtgcgatgtgatggtgtagtcgattgcaaactcaagagtgatgaactggggtgcgtgcgattcgattgggataagtccctgttgaaaatctactctggcagttctcatcagtggctgcctatctgttcttccaactggaacgattcttactccgaaaaaacatgtcagcagcttggcttcgagagcgctcatagaactactgaggtggcacatagggacttcgccaactctttttccattttacgctataatagcacaattcaagagtccctgcatcgtagtgagtgtcctagccaacgatatatctccctccagtgttcgcattgcgggctgcgcgctatgactggacgaatcgttggtggggcactggcatctgattccaaatggccttggcaagtatcccttcactttggaaccacccatatctgtggtggaactttgatcgacgcacagtgggtactgacagctgcccattgtttttttgtcaccagggaaaaggtgctcgagggctggaaggtgtacgcaggaaccagcaatctgcaccagctgccagaagccgcctctatcgccgagatcattatcaatagcaactatacggacgaggaggatgattacgatatagcactcatgaggttgagcaaacccttaacattgtctgctcatatccatccggcttgtctgcccatgcatggccagaccttctcactgaatgagacatgctggattacaggtttcgggaaaacaagggaaaccgacgacaagacctccccctttctgcgcgaggtgcaggttaacttgatcgactttaaaaaatgcaacgattaccttgtgtacgacagctatttgaccccgaggatgatgtgtgccggagatctgcggggaggccgggacagttgccaaggcgattcaggtgggccactggtctgtgagcagaataaccgatggtatctggccggagttaccagctggggcaccgggtgtggtcagaggaacaagcccggcgtttacacaaaggtgacagaagtcttgccttggatctactcaaagatggaaagtgaggtgcgctttaggaagagttag

SEQ ID NO: 138573 - DNA, 1476 bp, Artificial Sequence
  Description of Artificial Sequence: Synthetic coding sequence
atggagcgtgactcccacgggaatgcatcacctgcccgcacgccttccgctggtgcttctcccgcccaggcatccccagctgggacccccccgggccgggccagcccagcccaggctagtcctgcccaagcttcgcccgctggcaccccgccaggtagagcctcccctgcgcaggctagccctgccggaactcctcccggtcgagctagccccgggcgggccagtcccgctcaagcgtcgccggctcaagcctcacctgctcgcgctagcccggccctggcttccttgagtagatcctcgagcggaagatcttcctccgcacggtccgcttcagtgaccacaagtccaacccgcgtgtatcttgtgcgggccaccccggtgggagcagttccgattcgaagctccccagcccggagcgcaccagccacccgagctacccgggagtcacctggaaccagtcttccgaagtttacttggcgagaagggcaaaaacaattacctctgatcggctgtgtcctgttgctaatagctctcgtagtgagcctgatcatcctcttccaattctggcagggacacaccgggatccgctacaaagaacagcgggaaagctgcccgaaacacgccgtgcgttgcgacggcgtggtggattgtaagttaaagtcagacgagcttggctgcgtgcgcttcgattgggataaatcactgctgaagatctattcaggcagttcacatcagtggctccccatttgttcgtctaactggaatgattcctattcagagaaaacttgccagcagctgggatttgaatcagctcaccggacgaccgaagtggcgcacagagattttgccaattcgttcagcatcctcaggtacaactctaccattcaggaaagcttacatcggtccgagtgtccctcacaacgctacatttctctgcagtgcagtcattgtggactccgggctatgactgggcgcatagtcggtggagcactggcctctgattctaaatggccctggcaagtttccctgcacttcgggacaacacacatctgtggcggtaccttaatagacgcacagtgggtccttacagccgcacactgtttttttgttacccgcgagaaggttttggagggatggaaggtgtacgcgggtactagcaatttgcatcagctgcctgaagccgctagtatcgctgagataatcatcaactcaaactatactgacgaagaggacgactacgacatcgcactgatgagactcagcaaacccctaaccctgagtggcgaaggtatttgtacacccagatctcccgctccccagccccagcatccccttcaaccttcacacctcagtgcctctgtcaatagctatcctggcccaaaagcctctgccggtcagaagtctaagacactgaaggacccctatatggaacacttttgcttcattatacgagagaccgaagcccagggactttag

SEQ ID NO: 138574 - DNA, 1599 bp, Artificial Sequence
  Description of Artificial Sequence: Synthetic coding sequence
atggaacgggacagtcatggcaatgcaagccccgcccggactccatccgccggagcatctccagctcaggcgtcacccgcgggcacaccgccgggacgagcgtcccccgcacaggccagcccagcccaggctagccccgctgggactcctcctgggcgggcgtccccagcccaagcgtccccggcaggcactcctcctgggcgcgcaagtcctggcagagcctcccccgcccaagcttctccggcgcaagcttctccggcacgcgcatctcctgctctcgctagtctctcgagatccagtagtggcaggtcctccagcgcccgatctgcctctgttaccacatctccgacacgcgtgtatctcgtgagagccacaccagtgggagccgtccccattcgcagctcacctgcgcgctccgccccggcaaccagagcaacccgggagtctcccgtacagttctggcaaggacacaccgggatccgctataaggagcagagagagtcctgtcccaagcatgccgttcggtgtgatggtgtagtagactgtaagctcaagtcggatgaactgggttgtgtcagattcgactgggataagtccctgttgaagatctatagcggctcgagccaccagtggctcccaatttgcagctccaattggaacgatagttactctgagaaaacttgccagcagctggggttcgaatcggctcatcgaacgactgaagtcgcccatcgcgactttgccaactctttctctattcttaggtacaacagtactattcaggaatccctgcaccgcagcgagtgcccctcccagcgctacatcagtctgcagtgctcccactgcggcctgcgcgctatgacagggagaatcgtaggtggcgctctagcatccgacagtaagtggccatggcaggtgagtcttcattttggcacaacccacatctgcggaggcacgctgatagatgcacaatgggtgttaaccgccgctcactgcttcttcgttacaagagagaaagttctagaaggttggaaggtctacgccggaacctcaaacctccaccagctgcctgaagcagcctccatcgctgaaataatcatcaattcgaattacaccgacgaggaggatgactacgacattgcattgatgagactgtcgaaacccctgactctttccgcccatattcatcctgcatgcttacccatgcatggacagaccttcagcctgaatgagacctgttggatcaccggctttggaaagactagagagactgacgacaaaacgagtccattcctcagagaagttcaagtcaacttaattgacttcaagaaatgtaacgattatttggtctacgacagttatcttaccccgagaatgatgtgtgcaggggacctccgcggcggacgcgatagttgccagggcgacagcggcggcccgttggtctgtgagcagaataataggtggtacctagcaggtgtaacatcctggggcacagggtgcggccagcgcaacaagcccggtgtatacacaaaggttacagaggtgctcccatggatttattcaaagatggagtcagaggtaaggttccgcaagtcttag

SEQ ID NO: 138575 - DNA, 1365 bp, Artificial Sequence
  Description of Artificial Sequence: Synthetic coding sequence
atgggcgagaatgatcccccagctgttgaagctcccttcagcttcagaagcctgtttggcttagacgatttgaagatttcccctgtggcccccgatgctgatgcagttgcagcccagatattgagccttctgcccctgaaattcttcccgattatcgtaatcggaatcattgctttgatcctcgcactagccataggtctgggtattcacttcgattgttccggaaaatatcgttgccgcagctcctttaaatgtatcgagctaattgcaaggtgcgacggggtgtctgattgtaaggatggggaagacgaataccgttgcgttcgcgtcggtggccagaacgcagtactgcaggtttttaccgccgcgtcctggaaaactatgtgtagcgacgactggaaagggcactatgcgaatgtcgcctgtgcccaactgggttttccatcatacgtatcctctgataatctgcgggtcagtagtctggagggccaattccgggaggaattcgtttccatcgatcatctcctcccagacgacaaggttaccgccttgcaccattccgtttacgtccgtgaggggtgtgcatcaggacacgttgtgaccttgcagtgtactgcttgcggtcacaggaggggctacagctctcgcatcgtgggtgggaacatgtccttactgtcgcagtggccctggcaggcctctctgcagttccaaggttaccacctgtgcggcggatcagtcattacacctctgtggatcattactgctgcccactgtgtgtacgatctgtaccttcccaagtcatggactattcaggttggcttggtgagcctgctggataacccagcacctagtcaccttgttgagaagattgtgtaccatagcaagtacaaaccaaagcgattaggaaatgatattgcgctcatgaagttagctggcccgctcacttttaatgaaatgatccagccagtctgtttgcccaatagtgaggagaattttcctgacgggaaggtgtgctggacaagcggctggggagctacagaagatggtgccggagatgccagccctgtgctaaatcatgctgcagtgccactgatatccaacaagatctgcaatcatagggatgtgtatggtggcattatcagtcctagtatgctgtgtgccggatatttaacagggggagtggactcatgccagggggactcggggggacctctggtatgtcaggagcgcaggttgtggaaactcgtgggagccacctctttcgggatcgggtgtgctgaggtcaacaagccaggcgtttacacccgagttacctctttcttggattggattcacgaacagatggaaagagacctgaaaacgtag

SEQ ID NO: 138576 - DNA, 1617 bp, Artificial Sequence
  Description of Artificial Sequence: Synthetic coding sequence
atgcaggcagtggggccgaagccactgcccacccttctctgcggcggaaggacagggcacagaaccgctcgtgtgctctccttcctcatccggtcctgcccctgcgaacccgggaaaggctgtgtctacggcaagccggtcaccctgtggcccactatctccagtgtggtaccgtcgacttttcttggtctgggaaactacgaagtggaggttgaggcagaacctgacgtaaggggtcccgagatcgtgacaatgggcgagaacgatccccctgctgtagaggcccctttcagcttccggtccctctttggcctggacgatctgaagatcagtcccgtggcccctgatgctgacgcagtggctgcacaaatcctgtctcttctgcctctgaagttctttcctataattgtcatcggtatcatagcccttatacttgccctcgcaataggactggggattcacttcgattgctctggaaaatatagatgtcgctcatcctttaaatgtatcgaactgatagctcgatgcgacggcgtgtccgattgcaaagacggcgaggatgagtatcgatgtgtcagagtcggtggccagaatgccgtcctgcaagtatttaccgccgccagctggaaaactatgtgctctgacgattggaaggggcattatgctaacgtcgcttgcgcccagctgggttttccgtcatacgttagcagcgacaacctaagagtgagttctttagagggtcaatttagagaggagttcgtaagtattgaccacctgttacccgacgataaagttacagccttgcaccactcagtgtatgtgagagagggttgtgcctcaggccacgttgtgaccctgcaatgcaccgcttgcgggcataggcggggctacagcagccgaatagtgggtggaaatatgtccctattaagccagtggccttggcaggcctctttgcagtttcagggataccatctatgtggcggatcagtcatcacaccactgtggatcattacagccgcccattgtgtgtacgatttgtatttgccgaaaagctggaccatccaggtcggcctcgtgagccttctcgacaaccccgccccatctcacctcgttgaaaagattgtctatcacagcaagtacaagcccaagcgcctgggtaatgatattgctttaatgaagttggccgggcctctcacctttaacgagatgattcagcctgtgtgccttcctaacagtgaggaaaacttcccagacggaaaagtatgctggactagtggctggggtgccaccgaggatggggccggtgacgccagtccagtgctaaatcatgccgctgtgccgctcatctccaacaagatctgcaatcatcgggacgtgtacggggggattattagcccatctatgttgtgcgcggggtacctgactgggggggtggactcctgccagggggactccggggggccattggtctgccaggagcggaggctttggaagcttgtgggcgctacctcgttcggcattgggtgtgcagaggtgaataagccaggagtatatacaagagttacgtcctttttggattggattcatgaacagatggagcgcgacctgaagacttag

SEQ ID NO: 138577 - DNA, 1035 bp, Artificial Sequence
  Description of Artificial Sequence: Synthetic coding sequence
atgggcgagaatgatccccctgctgtcgaagcacctttctcattccgctcgctcttcgggctcgacgatttaaaaatatctccagtcgctcccgatgcagatgcagttgcagcccaaatactaagtctgctgccactcaagttttttccaatcattgtgatcggaatcatcgcactgatcctggccctggcaattggcttgggcatacacttcgattgttctggaaagtatcggtgccgttcatcattcaaatgtatagaacttatcgccagatgcgacggtgtaagtgactgtaaggacggcgaggacgagtaccgctgtgtgagggtcggcgggcagaacgccgtgctacaggtgttcacagctgcctcttggaagaccatgtgttccgacgattggaaaggccattacgccaacgttgcatgcgctcagcttggcttcccttcatatgtttccagtgacaatctgagagtgtccagcctcgaggggcagttccgtgaggagttcgtgtcaattgatcatctcctgcccgatgacaaggtgacagccttgcaccactccgtttacgtaagagaagggtgtgcttcagggcacgtcgtaacgcttcagtgtacggcctgtgggcaccgaaggggatacagtagccggatagttgggggtaatatgagccttttgagccagtggccctggcaagcctccttgcagttccagggctatcacttatgcgggggcagtgtgattacccccctctggattattacagccgcccactgtgtttacgacctttatctgcctaagtcctggacaattcaagtgggcctggtgtcattgctagacaatcccgccccaagccatctggtagaaaagatcgtgtaccatagtaagtacaagcccaaaaggctgggcaacgatatcgctctgatgaaactcgctgggccattgactttcaatggcacctctgggagcctgtgcgggagcgctgccctacccttgtttcaagaggacttgcagttactgatcgaggccttcctttag

SEQ ID NO: 138578 - DNA, 1362 bp, Artificial Sequence
  Description of Artificial Sequence: Synthetic coding sequence
atgggagaaaacgatccgcctgccgtggaggctccttttagctttagatccttattcggacttgatgatctcaaaatatctcccgtggcccctgacgccgacgctgttgccgcccagatcctctcgctcctacctctgaaattcttcccaatcatcgtaatcggcatcatcgccctgatactcgctctcgccatcggcctgggcattcacttcgactgctcggggaagtatagatgcagatcatcctttaaatgcattgagctcatcgctcgctgtgatggcgtgtccgactgtaaagatggcgaagatgagtacagatgtgtgcgggtgggggggcagaatgctgttctccaagtctttaccgctgcttcctggaagacaatgtgctctgatgactggaaagggcactacgccaacgtggcgtgtgcacaactcggattcccatcatatgtgtctagcgacaacttgcgggtgtccagtttagaggggcaattcagggaggaatttgtatctattgaccacctgctgcctgatgataaagtgaccgctctgcatcactcagtgtatgtgcgcgaaggttgtgccagtggtcacgtggtgacactccaatgcaccgcctgtggccatagacgcgggtacagcagcagaattgtgggaggcaacatgtcccttctatcgcagtggccctggcaggcatcactgcagtttcagggctaccatctgtgcggcggaagcgtgatcacacccctatggattatcactgctgcccactgtgtatatgatctgtacctccccaaaagttggacaattcaggtggggttggtaagcttactggacaaccctgccccctcccacctggtggagaagatcgtgtaccattccaagtataagcccaagcgcttggggaacgacatcgccctcatgaagctggcagggccccttacatttaacgaaatgatacaaccagtatgcctgccaaatagcgaggagaattttcctgacgggaaggtgtgttggacatctggctggggggctaccgaggacgggggcgatgcgtctccagttctgaatcacgctgccgttcccctcatcagcaataagatatgcaatcaccgggacgtctatggcgggataatttctccatcaatgctgtgcgcaggataccttaccgggggagttgactcttgccaaggtgactcaggaggacccttggtgtgccaggagcgcagactgtggaaactggtgggggctacatcgttcggcattggttgtgccgaagtgaacaagcctggtgtgtacacacgggtcacaagttttcttgactggatccatgagcagatggagcgggacttaaaaacttag

SEQ ID NO: 138579 - DNA, 1314 bp, Artificial Sequence
  Description of Artificial Sequence: Synthetic coding sequence
atgctgcaggatcctgactctgaccaaccactgaactctctggatgtcaagcccttacggaagcctcggatccccatggagacgtttagaaaagtgggaatacctattatcatcgcgttattgagtcttgcatccataatcattgtggttgtgctgattaaggtcatcctggacaagtactatttcctctgtgggcaaccgctgcacttcatcccaaggaagcagctgtgtgacggtgagctcgactgcccccttggagaggatgaggaacactgtgtgaaatcctttccagagggccccgcggtggcagtgcgactttccaaggacagatccaccctgcaagtgctggactccgcaactggcaattggttctccgcctgcttcgacaatttcacagaggcactggcagagaccgcctgtcggcagatgggctactcttctaaaccaacgtttcgtgctgtggagatcggaccggatcaggacctcgacgttgtagaaataactgagaattcacaggagctccgcatgcgaaactcatcaggtccctgcttatctggcagcctcgtgtccttgcactgtttggcctgtggcaagtcactgaaaaccccccgagtggtgggagtggaggaggcttctgttgactcgtggccatggcaagtcagtattcagtacgataaacaacatgtgtgcggggggagcattctggaccctcactgggtgttaaccgccgcacactgcttcagaaaacacaccgatgtattcaactggaaggtgagagccggctcagataagctcggatcttttcctagtttggcggtggctaagatcatcatcatagaattcaatccaatgtatcctaaagataatgatattgcactgatgaagcttcagtttccactgactttcagcgggacggtcaggccaatctgtttaccattctttgacgaggagttgacccccgcgactcctctgtggatcatcggctgggggttcaccaagcagaatggaggaaaaatgagcgatatccttttgcaagcttccgtgcaggtgattgacagcacaaggtgtaacgccgacgacgcttaccagggggaagtgaccgaaaaaatgatgtgtgccggcattcctgagggcggtgtcgatacatgtcaaggggactcaggcgggcctctcatgtaccagtcagaccagtggcacgtggtcggtattgtaagctggggctatgggtgtggaggacccagtaccccaggggtctacacgaaggtctccgcctacctgaattggatatacaatgtatggaaagccgagctgtag

SEQ ID NO: 138580 - DNA, 1299 bp, Artificial Sequence
  Description of Artificial Sequence: Synthetic coding sequence
atgctgcaggacccagattctgaccagccactgaatagcctcgatgtgaagccccttagaaaaccacggatcccaatggagacattcagaaaggttggaatacccattataattgcactgctcagcctggccagtattatcatagtcgtggttttgattaaagttattctggataagtactatttcctgtgcggacagccccttcacttcatccctcgcaaacagctttgcgatggtgagctggactgccctttgggcgaggacgaagaacattgcgtgaaaagcttcccagaaggacctgccgttgctgtcagactatccaaggatcgctccacactccaagtcttggattccgcaactggcaactggttcagtgcatgcttcgacaactttaccgaagccttagccgagaccgcctgtcgccagatgggctactcccgggctgtcgagatagggcccgatcaggacctagacgtcgtggaaattactgagaacagccaggagctgcgcatgcggaattcgagtggcccttgtctctcaggatctctcgtgagtctgcactgcctggcatgcggcaagtccctaaagacacccagggtggtcggagtggaagaagcctccgtagactcctggccatggcaggtctctattcaatatgacaaacagcacgtctgcgggggatcaatcttggatccacattgggtgctgaccgccgctcactgcttcaggaagcatactgacgtattcaattggaaggtccgagccggaagtgacaaactcgggagtttccccagtctggctgtagcaaaaattatcatcattgagtttaacccaatgtaccctaaagacaatgacatcgctttgatgaagttgcagttcccactcactttttccggaacagtgcgaccaatttgcctgcctttctttgatgaagaactgacgccagcaacgccgctctggatcatcggatggggattcacaaagcagaacggcggtaaaatgtctgacattctgctacaggcttccgttcaggtgatagattctactcgctgcaacgcggacgatgcttaccagggggaagtcacggagaagatgatgtgtgctggaatcccagaagggggggtcgacacctgccagggcgactcggggggccccttaatgtaccagtctgaccagtggcatgtcgtgggtatcgtgtcatgggggtacgggtgcggaggacccagcactcctggcgtgtatacaaaggtgtcggcatatttgaattggatctacaacgtgtggaaggccgagctttag

SEQ ID NO: 138581 - DNA, 1308 bp, Artificial Sequence
  Description of Artificial Sequence: Synthetic coding sequence
atggaccctgattccgatcaaccactgaatagcctggatgtgaaaccccttcggaagccccgtatccctatggagacattccgcaaagtcggaatccccatcattatcgctttactatccctagctagcattattatagtggtggtactgataaaggtaatcctcgataaatactactttctttgtggacagccccttcactttatcccccgtaagcagctgtgcgacggggagttagactgtccactaggggaggatgaagagcactgcgtaaagagtttccccgaggggcctgccgtggcggttcggttgtcaaaagatcggagcaccctccaagtgctggactccgcgacaggcaattggtttagcgcctgttttgacaacttcactgaagccctggccgagacggcctgccgccagatgggctatagctctaaacctactttccgggctgtcgagattggccctgaccaggacctggatgttgtggagattaccgaaaactcccaggagctcaggatgaggaactcatctgggccatgcctgagcggcagcctggtatctctccactgtctggcatgtggcaagtcccttaagacccccagggtcgtaggtgtggaggaagccagtgtcgattcctggccgtggcaagttagtatccagtatgataagcagcacgtatgcggggggagcattcttgacccacactgggtcctgactgccgcccactgctttcgcaagcataccgatgtgtttaactggaaggtccgcgcagggagcgacaaattgggttcgtttccgagcctcgcagttgctaagattatcattatcgagttcaacccaatgtaccccaaggacaacgacatcgcacttatgaaactacagtttcctctgacctttagtggcactgtccggcccatatgtctgcccttttttgacgaggaactcacccctgccaccccgctgtggatcataggctgggggttcactaagcaaaacggcggcaaaatgagtgacattttactccaggctagcgttcaggtcattgacagcacccgctgcaacgctgatgacgcatatcagggagaagttaccgaaaagatgatgtgtgccggaatccccgaaggtggagttgatacctgtcagggggacagtggaggaccactgatgtatcaatccgaccagtggcacgtcgttgggattgttagctggggctatggttgtgggggtccttccaccccgggagtatacactaaagtctccgcctatcttaattggatatataacgtatggaaagcagagctgtag

SEQ ID NO: 138582 - DNA, 1374 bp, Artificial Sequence
  Description of Artificial Sequence: Synthetic coding sequence
atgagtttgatgctggacgatcagcctcctatggaagctcagtacgccgaagaaggacccggacccggaatcttccgggccgaacccggtgatcagcagcacccgatctcacaggccgtctgttggcgcagtatgcgtaggggctgtgccgtgctgggcgctttaggccttctggccggggccggagtcgggtcttggctgctggtgctgtacttgtgtcctgctgcatcacagccgatcagtggaactttgcaggatgaggagatcacactgagctgttctgaggcgagtgccgaagaggccctgttaccagcgcttccaaagacagtcagcttcaggataaactctgaggacttcctcctagaagcccaggtgcgcgatcagcccagatggctattagtttgccacgaggggtggtccccagccctgggactgcaaatctgctggtccctcgggcatcttagactcactcatcataagggcgtgaatttaactgatattaagctaaactcttcccaggagtttgcacagctgtcaccacggttgggcggtttcctggaagaggcctggcaaccaagaaacaattgtacaagcggccaagtggtgtccctgcgatgctccgagtgcggagcaagaccccttgcgtcacgcatcgtcggtggtcagagcgttgcccccgggaggtggccatggcaggctagcgttgctctaggattcaggcacacgtgtggcggctccgtactggctccacgatgggtcgttaccgcagcccactgcatgcattcatttcgcctggccagactgtcttcatggcgcgtgcacgcggggcttgtttctcacagtgcagtgcgtccgcatcagggtgctctagttgagagaatcattccacacccgctgtactctgctcaaaaccacgactacgatgtggctctcttgcgccttcagaccgccctgaatttttcagacaccgtgggtgccgtgtgcctgccagctaaagaacagcactttcccaaaggctccaggtgctgggtctcaggttggggccatacacatccctcccacacatatagctcagatatgctgcaggataccgtggtgccactgttcagtacgcaactgtgcaacagcagctgtgtttattccggggccttgacccctcgtatgctctgcgcaggatacctggacggccgcgcagacgcgtgccagggggactctggtggtcccctagtttgcccagacggggacacgtggcggctcgtgggagtggtgtcatggggaaggggatgtgccgaaccgaatcacccgggcgtgtacgccaaagtagccgagttcctcgattggatccacgacacggcacaggactccctgctgtag

SEQ ID NO: 138583 - DNA, 2436 bp, Artificial Sequence
  Description of Artificial Sequence: Synthetic coding sequence
atgctgctgctctttcattccaagaggatgcctgtcgccgaggcgccacaggtggccggtggccagggtgacggtggtgacggggaggaagccgagcccgaaggaatgtttaaggcctgcgaggattccaagaggaaagctcggggctatttacgattggtgccactctttgttctcctcgcactcttagtgttagcatcggctggggtgttgctgtggtatttcctaggttataaagcggaggtcatggtgtcacaggtatactcaggtagccttcgagttctgaaccgccactttagccaggatctgaccaggcgcgaaagttccgcgttcagaagtgaaaccgcaaaggcgcagaagatgcttaaggagctgatcacttccactcggctgggcacctactacaatagcagctcagtctattcatttggagaagggcccctgacatgctttttttggttcatactgcagattcccgagcaccggaggctcatgctgagtcctgaagtagttcaggccttgctcgtggaagaactcctgtccacagtcaacagcagcgccgccgtgccatacagggccgagtacgaggtcgatcctgaaggcctggtgatcttggaagcctccgtgaaagacatcgccgcactcaacagtactctggggtgttacaggtactcttatgtgggacaggggcaggtgctccgactgaaaggcccagatcaccttgcaagctcctgtttatggcacctacagggacctaaggatctgatgctcaagctcaggctcgaatggacacttgctgaatgtagggatagactggccatgtacgacgtcgcaggccctttggagaagcgcctgattacctcagtgtacgggtgttcgcgccaggaaccagtggtggaggtgcttgcatccggcgccattatggcagtggtttggaaaaagggcttacatagctattatgaccctttcgtgctctctgtacaaccagtggtcttccaggcttgcgaggttaacctgacactggacaaccggctggattcgcagggggtactgagcacgccttactttccaagctactactcacctcagacgcactgtagctggcacttaaccgtaccgtcattggactatggcctggccttatggttcgatgcatacgccttgcggagacagaaatacgaccttccttgcacccagggccagtggaccatccagaatcggagactttgcggcctgagaatacttcagccatacgcagagcgcatcccagtcgtcgccacagctggcattaccattaattttaccagtcagatttccctgacaggacctggagtccgcgtccactacggtttgtataaccaatccgacccgtgtccgggtgagttcctgtgttccgtgaatgggctttgcgtacctgcctgcgatggggtgaaagactgcccgaatggcctagatgagcgtaactgcgtgtgccgcgccactttccagtgtaaggaggattcaacttgcatctccctacctaaagtctgtgatggtcagccagactgcctgaacgggtctgatgaggaacagtgtcaggaaggcgtgccatgcggcacttttacattccaatgtgaggacagatcttgcgttaagaaaccaaatccccaatgcgatggacgtcctgattgccgcgacggtagcgacgaggaacattgtgactgtgggctacagggacctagctcaaggatcgtcggtggtgccgtgtctagcgaaggtgaatggccatggcaggcgtctctccaggttagaggccggcacatttgcggcggtgcactcatcgccgatcgttgggtcataacggctgcacactgcttccaagaggattccatggcctcaacagtcctgtggaccgtgttcttggggaaggtgtggcagaattcaagatggcccggtgaagttagcttcaaagtttctcgattgttactccacccttatcatgaggaggatagccacgattacgatgtggcgctcttgcagttggaccatcccgtggtccgctcagcggccgtcagacctgtgtgcctgcccgctcgaagccatttcttcgagcccggtttgcactgttggataaccgggtggggcgccctgcgggaaggaggacccattagcaatgcccttcaaaaggttgacgtgcagcttatacctcaggacttgtgttctgaggtgtatcgataccaagttactcccagaatgttatgcgctgggtacagaaaaggaaagaaagatgcctgtcagggggacagcggggggccgcttgtttgtaaagccctctcagggcggtggtttcttgctgggcttgtgtcttgggggctgggctgcgggaggccaaactatttcggcgtttacaccagaatcaccggtgtcatttcatggatacagcaggttgtgacctag

SEQ ID NO: 138584 - DNA, 2475 bp, Artificial Sequence
  Description of Artificial Sequence: Synthetic coding sequence
atgcccgtagccgaggcgccacaagtcgccggagggcagggcgatggcggcgatggagaggaagccgagcctgagggtatgttcaaggcttgtgaggactcgaagcgcaaggcccgcggatatttgcgtttggttcccttgttcgttcttctggcgcttttggtgctggctagtgctggagttcttctctggtatttcctgggttataaagccgaagtcatggtctcgcaggtgtatagcggaagcctgcgcgtgttgaaccggcactttagccaggatcttactaggagggagagttcggcatttcgctctgaaacggccaaagctcagaaaatgctaaaggaactgatcacttctacacgactcggcacctactacaactccagctcagtgtactctttcggagaggggccactcacttgtttcttttggttcattctgcagatccccgaacacaggcgccttatgctctcaccagaggtggtgcaagcactccttgtggaagagctcttgtctacagtgaatagttccgctgcagttccatatcgggccgagtacgaggtggaccccgaggggttggtaatcctcgaggcttctgtgaaagatattgccgccctgaactcaacactggggtgctacagatacagttatgtcggacaggggcaggtgctgcgactgaagggccccgaccaccttgccagctcttgtttatggcatctgcaaggtcctaaggatctcatgctgaagctccgcttggagtggactttagcggagtgtagagaccggctcgcaatgtacgacgtagccggacccttggagaaacgtctcataaccagcgtgtacggatgtagtcgacaggaaccggtggtagaggtgctggcttccggtgcgatcatggcagtggtctggaaaaaaggcttgcattcatattacgacccatttgtgctgagcgtgcagccagtagtattccaggcatgtgaggttaatctgacacttgataacaggttggatagtcagggggtcctgagcacgccttatttcccaagctactattcaccacagacgcactgtagttggcacctgaccgtcccgagtctggactatgggctggccctctggtttgacgcttatgctctccggcgccaaaaatatgatctgccgtgtactcagggccagtggacaatccagaataggcggttgtgcggcctacgaatactccagccatatgcagagcggatcccagtcgtcgctacagccggcattaccataaatttcaccagccagatctccctaaccggccccggtgtcagagtacactacggactgtataaccaatccgatccgtgcccaggagagttcttgtgctcggtgaacggcctctgtgtccctgcctgcgacggagtgaaggactgtccgaatgggctggatgaacgcaattgcgtgtgccgcgcgacattccagtgcaaagaggattcaacctgcattagcctgccaaaagtgtgtgacgggcagccggactgcctgaatgggagtgatgaggagcagtgtcaggagggagtaccttgtgggacattcaccttccagtgcgaagacaggtcgtgcgtaaaaaaacccaacccacaatgtgacggtcgccccgactgtcgggacgggtcagacgaggagcattgcgactgtggactgcagggtccttcatcacgtatcgtgggaggggccgtttcatccgagggcgagtggccttggcaggcaagcctgcaggtgagaggacgtcacatttgtggaggtgcactcatcgcagatcgatgggtaataaccgcggctcactgctttcaggaggattcaatggccagtacagttctgtggaccgtatttctcggcaaagtgtggcaaaattcccggtggccaggtgaggtatcttttaaggtgtctcgattactgctccacccctaccacgaggaggactctcatgattatgatgttgctctcctccagttagaccacccagttgtgcgctcagctgccgtcagacctgtttgtctgcctgctcggagtcacttctttgaacccgggctccactgttggataacaggttggggagccctacgcgagggtgccctgagagctgacgcagtggccctcttctacgggtggaggaaccagggatctgagacttgctgctgtcccatctccaatgccttgcagaaagttgacgttcagctaatccctcaagatttgtgctccgaggtgtataggtatcaagttacacccagaatgctgtgcgccggttatcgcaaggggaaaaaggacgcgtgccagggagactccggtggccctcttgtgtgtaaggcattgtccggacgttggttcctggcaggtcttgtgtcatggggcctggggtgtggcagaccaaactatttcggggtatacactcggatcaccggagtcatttcgtggatacagcaggtggtaacgtag

SEQ ID NO: 138585 - DNA, 2409 bp, Artificial Sequence
  Description of Artificial Sequence: Synthetic coding sequence
atgcctgtggctgaggccccccaggttgcaggagggcagggagatggaggtgatggcgaggaagccgaaccagaaggcatgttcaaggcctgtgaagacagcaagcgaaaggctaggggatacctccgactggttcccttattcgttcttctggctctactcgtgctagcgtctgcaggcgtcctgctttggtactttttagggtataaagctgaggtgatggtgagtcaggtgtactctgggagtttgagagtgttgaataggcacttttcgcaagatctcacacggcgcgaatcctcagcttttagatccgaaaccgcgaaggcccagaagatgctcaaggaattgatcaccagcacccggctgggcacctattataactcttcatccgtctattcatttggcgaggggcccctcacctgtttcttctggttcattctgcagattccagagcatcgacggctcatgctttcgccggaagttgtgcaggccttgcttgttgaggagttattaagcaccgtaaacagttccgcagcggtgccttaccgggccgagtacgaggtcgacccagaaggactcgtcatcttggaagcctctgtcaaggacattgcagccctgaactccacgctgggatgttatcggtactcttacgtgggacaaggccaggtgctgaggctaaagggtccagatcatctggctagctcctgtctttggcacttgcagggacccaaggaccttatgctgaagctgcgcctggagtggacgcttgcagagtgccgggatagactggctatgtacgacgtcgctggtcctctagagaagaggctgatcacctcagtgtacggatgtagtagacaggagcctgtcgtggaggtgctggcatccggcgcaattatggcagttgtgtggaaaaaaggactgcatagctattatgatccatttgtgctgtccgtccagcccgtagtgttccaggcttgtgaagtcaatctgacattggataatcgcctggacagccagggcgtgctgtctaccccatatttcccttcttattactccccacaaactcactgctcctggcacctcacagtaccttccttagattatggtttggcactgtggttcgatgcttatgccttaagacgacaaaagtacgacttgccatgcacacagggacaatggaccatccagaacaggcgattgtgcggcctccggatcctgcagccatatgccgaacgtatcccggtggttgcaaccgctgggatcaccattaattttacttcgcagatctccttgacgggacccggagtgagggtccattacgggctctataatcagtccgacccttgtcctggagagttcctctgttcagtgaacggtttgtgcgtgccggcatgtgatggcgtgaaggattgtcccaacggactggatgaacgcaactgtgtctgtagagccactttccagtgcaaggaagacagcacttgcatcagtctgccaaaagtgtgtgacgggcagcctgattgcctgaatgggtcagacgaggagcaatgccaggaaggcgtgccctgtggtaccttcaccttccagtgtgaggatagatcctgcgtgaagaagcccaacccccaatgtgacgggcgtcccgactgcagggatggatcggatgaggagcattgtgattgcgggctacaggggcctagttcccgcatcgttgggggcgcggtctcttcggaaggggagtggccttggcaggcaagcctccaagttcgcggacggcacatttgcggcggcgcactcattgcagacaggtgggtcataacagcggcccactgttttcaggaggatagtatggcttccactgtgctgtggaccgtgtttctgggtaaagtgtggcaaaactccaggtggcccggcgaggtttcattcaaggtatctaggctgctcctgcatccgtatcatgaagaggattcccatgactacgatgtggccctgctgcagttggaccatccagtggtgagaagcgctgctgtaagaccagtctgtctgcctgcacggtctcattttttcgagcccggactgcattgctggattacgggatggggagccctgcgcgaaggggggccgattagcaacgcactccaaaaggtagacgtgcagcttatcccccaagatttatgctccgaagtgtatcggtatcaagtgacccctcgcatgctgtgcgctggctatcggaaaggcaaaaaggatgcttgtcagggcgattcgggggggccactcgtgtgtaaggctttgtctggcaggtggttcttggccggtctcgtgagctgggggcttggctgtggacggccaaactattttggtgtttatactcgaatcacaggcgtgatatcgtggatccagcaggtggtgacctag

SEQ ID NO: 138586 - DNA, 2475 bp, Artificial Sequence
  Description of Artificial Sequence: Synthetic coding sequence
atgcctgtggccgaggcaccacaggttgcaggcggccagggggacgggggggacggggaagaggccgaaccggaaggtatgtttaaagcctgcgaagattcaaaacgaaaggcccgcggctatttacgcctcgtacctctgttcgttctgttggctctacttgtcctggcaagtgccggcgtcttactgtggtacttcctgggttataaagccgaggtgatggtgagccaggtgtacagtggctctctccgcgtgctgaatcgacacttcagccaagacctaaccaggagggagtctagtgcatttcgctccgagacagccaaagctcagaagatgctgaaggagctgatcaccagcacacggctcggtacgtactacaactcgagttctgtatatagcttcggagagggaccgttgacctgttttttctggttcatcctccagattccagaacatcggcggcttatgctcagcccggaagtagtccaggccctgctggtggaggaactgctgtcaacggtgaatagttcggcagctgtgccatatcgagcggagtatgaagttgatcccgagggtttggtgattctcgaggcctccgttaaagatatcgcagccctgaactctactctgggatgctatagatacagttacgtgggacaaggccaggtgttacgcttgaaagggcccgaccatctggcatcgagttgtctttggcatctgcaagggcccaaagacttgatgctgaaattacgattggaatggactctcgctgaatgccgcgatcgcctcgccatgtacgacgtagcaggtcctttagagaagagattgatcacatccgtgtacgggtgtagccgccaggagccagtggtggaggttttagccagcggcgctatcatggcagtggtgtggaaaaaaggcctgcactcttactacgatccgtttgttttatccgtgcagcctgttgtttttcaggcttgcgaggttaatctcaccctagataaccggctggattcccagggcgtattgtctaccccttattttccgagctattatagtccacagactcattgctcctggcacctcaccgtgccctccctggattatggcttagccttatggtttgatgcatatgcactgcggaggcaaaaatacgaccttccctgcacacaaggtcaatggaccatccaaaataggagattgtgcggtctgcgcatccttcagccatacgccgaacgaattccggtggtcgcaacagcaggtattaccatcaatttcacatcccagatatcgctgaccggacctggcgtgagagttcattacggactgtacaatcagtcagatccatgccctggtgaattcctgtgttccgtgaacggtctgtgtgtgccggcttgtgatggcgtaaaagactgccccaatggcctggacgaaaggaactgcgtctgccgggcaaccttccagtgtaaagaggatagcacctgtattagcctcccgaaagtctgtgatggacaacccgactgtctcaatggatcagacgaggaacaatgtcaggaaggagtgccctgcggaactttcacgtttcagtgtgaagatagaagctgtgtcaagaaaccaaatcctcaatgtgacggaaggccggattgccgggatggatcagacgaagagcattgtgactgcggcctccaaggccccagcagccgaatcgtcggcggcgccgtatccagcgaaggggagtggccttggcaagcctccctgcaagtcagaggccggcacatctgcggtggcgctctgatcgcagaccgatgggttatcacagccgctcactgtttccaagaagactctatggcctcaaccgtcctttggactgtgtttctggggaaagtctggcaaaatagccggtggcccggggaagtgagctttaaggtttccagactcctcctgcatccttatcatgaggaggatagccacgactacgacgtagcactgctacagctggatcatcccgtggtgcggagtgccgccgtgcggccagtgtgcctgcccgcacggagtcatttctttgagcccggactgcactgctggattacagggtggggcgcactgagagagggagccttgagagctgacgccgtggccctcttctatgggtggcgcaaccaaggatccgagacatgctgctgtcctatcagcaatgctttgcagaaagttgatgtccagctcatccctcaggacctctgctccgaagtctataggtaccaagtcaccccaaggatgctttgtgcagggtacaggaagggaaaaaaggatgcctgccagggtgacagcgggggccctttagtctgtaaagccttgtccggccgttggttccttgccggattggtaagttgggggctcgggtgcgggcggccaaactattttggagtctatacccgcatcaccggggtcatcagctggatccagcaggttgtgacatag

SEQ ID NO: 138587 - DNA, 426 bp, Artificial Sequence
  Description of Artificial Sequence: Synthetic coding sequence
atgccagtagccgaagcaccacaggtggctggagggcagggcgatggaggtgatggcgaggaggcagaacccgaaggcatgtttaaggcgtgtgaggattccaagcgaaaggctagaggctaccttaggctcgttccccttttcgtgctgttggctcttcttgtacttgcgtccgccggagtccttctgtggtacttcctcggttataaggctgaggttatggtgtcacaggtttactccggttcactgagggttctgaaccggcacttttcacaagatctgacacggcgggaatcatccgcctttagaagcgaaactgccaaggcccagaagatgctcaaggagttgataacctccacacgcctggggacctactacaacagtagtagtgtgtattcgttcggcgaggggcccctgacttgttag

SEQ ID NO: 138588 - DNA, 1386 bp, Artificial Sequence
  Description of Artificial Sequence: Synthetic coding sequence
atgctcctgctgttccacagcaaaagaatgccggtggctgaagccccacaggtcgccggtgggcagggtgacgggggcgatggcgaggaggcagagcccgagggcatgttcaaggcgtgcgaggactccaagcgcaaagcaaggggttatctcaggctggttccactgttcgtgttactcgccctattggtgctggcatcagcaggagtgcttctctggtattttttgggttataaggccgaggtcatggtttcccaggtctatagcggcagtctgcgagtcctgaacaggcatttctcgcaggacttgacacgtcgcgagtcctccgcctttagaagcgagacagctaaagctcagaaaatgctgaaggaattgatcacttcgaccagactcggcacttattataattcgagctccgtgtactcgttcggtgaaggccctcttacttgttttttttggttcatattacagatcccagagcatcgacggctgatgctatcacctgaagtggtgcaagccctgttagtggaagagttgctatctacagttaattcctcggcagccgtaccgtaccgcgctgaatatgaggttgatcccgaaggcctggtgattttagaggcttcagtcaaagacatagctgccctaaactccactctaggctgttatagatacagctacgtaggtcaagggcaagtgctaagactcaaaggtcctgaccacctggctagctcgtgcctctggcacttgcagggtccaaaggatctgatgttgaagctgagactggagtggaccttagccgagtgcagggacagattagcgatgtacgatgtggctgggcccctcgagaagagattaatcacatcagtctacggatgcagcaggcaggagccagtggtggaagtccttgcatcaggggcgattatggcagtggtgtggaaaaaggggttgcattcgtattacgatccttttgtcctgtcagtgcaacctgtggtgtttcaggcttgcgaagttaatctgactcttgacaatcgtttagattcacagggagtactcagcaccccgtattttccttcatattactctccacagactcattgctcctggcatcttaccgtgccttcccttgactacggcctcgctctgtggttcgacgcgtacgctttgaggaggcagaagtacgacctgccctgtactcaggggcagtggactattcagaatcgccggtaccactttcttagcagtctttggttacccttccttcccccaccgccttcgcttccctcaagcatcgtgactccgtcactcgaggcacaggttccaaatctccggggggctgctcgtggcgcctctagaggctggggttggtgtcaggcttgctgcccatag

SEQ ID NO: 138589 - DNA, 1527 bp, Artificial Sequence
  Description of Artificial Sequence: Synthetic coding sequence
atggccagtgcggtgtggggttccgcgccttggtggggcccaccgccaccggccccggctagacctctgaccgacattgatttttgctctggagcccagctgcaagaattgacccagttaatacaggaactgggcgtgcaggagagctggagcgatggcccaaaaccaggcgctgacctgctgcgcgccaaagacttcgtgttctccctgttgggcctagttcacagaagggatccgaggttcccccctcaagctgagctgctgttgctaagggggggtatccgggagggatctctggacttgggtcacgcaccccttggaccttacgcccgggggccacattatgacgcaggctttaccttgttagtccccatgttttcactcgacgggaccgagctccagctggacctagagtcttgttacgcccaagtttgtttacccgaaatggtgtgcgggaccccaatcagggagatgtggcaggattgtctgggtccaccagtccccggggccagagattccattcatagaactgagagcgaggagtcctcaaaggactggcaatcgtctgttgatcagcctcactcttatgttactgaacacgaggcacctgtgtcccttgagaagagcccgagcgacgtttcagcctccgaatctccccaacatgacgtggttgacctggggtcgaccgcgccgctaaaaactatgtcaagtgacgtgacgaaggccgctgtcgagtccccggtcccaaaaccaagcgaggccagggaagcatggcccacattatgcagtgctcaggttgcagcttggttttttgcaaccctggcggctgtggcagagtcacttatccctgtgcccggggcccccagacttgtccatgccgcacgccatgccggctttaccactgtactgcttgccacaccagagccaccacgccgactactgctttttgatctaatccccgtcgtgagcgtggccgggtggccagagggggctcgttctcattcttgggctggacctctagcatctgagtccgcctccttttatctggtccctggagggggaacagagagaccatgcgccagtgcttggcagctgtgctttgcccgtcaggaactcgccttgaaggctagaatccccgctcctctcctgcaggcacacgctgccgcacaggctctccttaggcctctcgtcgcagggactagagccgccgctccttatctgcttagaacgttgctgtactgggcgtgcgagcgattgcctgccttgtatcttgcccggcctgagaatgccggagcttgttgcctgggtttactggatgagctggggcgcgtactcgaagccgggaccttgccccattattttctgaacggccgacagctccggactggagatgactctgccgctcttttaggcgaactggcacggctgagaggggatccagcacgggctctccgggctgctgtggaggaggcaaaagtcgcccggaagggagggggacttgccggggttggcgggggagcacactag

SEQ ID NO: 138590 - DNA, 1527 bp, Artificial Sequence
  Description of Artificial Sequence: Synthetic coding sequence
atggcaagtgcggtgtggggatcagctccatggtggggaccccctccccctgctcctgcaaggccactgacagacatcgacttttgctcaggcgcccagctgcaagagctcacccaactgattcaggaattgggcgtgcaagaatcctggagtgatgggcctaagcctggggctgatctactgcgagccaaagattttgtgttttccctgctcggcctggttcatcgacgcgacccgcgctttccgccacaagcagaactcctgcttctcagaggaggtattcgggagggctctctcgatctcgggcatgccccactgggcccttatgctaggggtccacactacgatgccggcttcaccctcctggtacctatgttctcactcgacggcactgaactgcagctggacctggagagttgctacgcgcaggtatgcctgcccgagatggtttgtggcacacccataagggagatgtggcaggactgtttggggcctcctgtgccaggagcccgggatagtatacaccgtaccgagtccgaagagtcttctaaagactggcagagctctgttgatcagcctcatagttatgtgactgaacacgaagccccagtgagtctggagaaaagcccatccgatgtcagcgcaagtgaatctccgcagcacgacgtggtggacctaggctctacggccccactgaagacaatgtcaagtgatgtcacgaaagctgccgtggagagtcccgtgccaaaacccagcgaggcgagagaagcctggccaaccctttgtagcgcccaggttgctgcttggtttttcgccacactggccgccgtcgctgaatccctgattcccgtcccaggggcgcctcggctggttcacgcagcccgacacgctggatttaccaccgtgctgttagcaacacccgaacctcccagacggctcttactcttcgatctcatacctgttgtctccgtcgccggttggcccgaaggagcccggtctcacagctgggccggacccctagcatctgaaagcgcaagcttctatctcgtgcccggtgggggaacagaacggccatgtgcgtcagcctggcagctatgctttgctcggcaggagctggccctgaaggccagaattccggcccccctattgcaagcccacgctgccgctcaggccctgctaaggccactcgtggcaggaaccagggctgcagcaccttatctactgcgcactctgttatattgggcttgtgaaaggcttccggccctgtatctagctcgccccgagaatgcaggagcgtgctgcttggggctgctcgatgagttaggaagagtgctagaggccggcacactgcctcactattttctcaatgggcgccagctgagaaccggcgacgacagtgcagcactgctgggtgagctcgccaggctacgtggagaccctgctagagctttacgcgcagccgtggaggaagccaaagttgctcggaaagggggcggcctggccggggtgggaggtggcgcacattag

SEQ ID NO: 138591 - DNA, 825 bp, Artificial Sequence
  Description of Artificial Sequence: Synthetic coding sequence
atgggaaaatcactgtcccatctgcctctgcattcctccaaggaagatgcatatgacggcgtgacctccgagaacatgaggaatggcctcgtgaattctgaggtccacaacgaggatggacgaaatggcgatgtttctcagtttccttacgtggagttcacaggccgcgactctgtgacttgccctacgtgtcaaggtacaggcagaatcccacgcggccaggagaatcagcttgtggcactgattccgtactcagaccagagactgcggccccggcgcactaagctatatgtgatggctagcgttttcgtttgtctattgctcagcggtcttgcagtcttttttctcttcccacggagtattgatgtgaagtatatcggcgtgaaatccgcatatgtcagctatgacgttcagaagcggacaatctacctgaatattactaacactctgaacattacaaacaataactattacagtgttgaagtggagaatatcactgcacaagttcagttcagcaagaccgtgatcggaaaggcccggttaaataatatcacgataataggccctctggatatgaagcagattgattatacggtgcccacagttattgcagaggaaatgtcctacatgtatgacttctgtactctcatctcgatcaaagtccacaatatcgtcctgatgatgcaggtcacagtcaccaccacatacttcggacactcagagcagatcagtcaggaacgttaccaatacgtggactgcgggcgcaatacaacatatcaactaggacaaagcgaatatctgaatgtgctccagccgcagcaatag

SEQ ID NO: 138592 - DNA, 825 bp, Artificial Sequence
  Description of Artificial Sequence: Synthetic coding sequence
atgggcaagagcctgagtcatctgccactgcattcttctaaagaagacgcctatgatggagtgacttctgagaatatgaggaacggcctggtgaacagtgaggttcacaatgaggacggcaggaacggagatgtcagccagtttccctacgtggagttcactggtcgcgatagcgtgacatgccctacatgccaggggaccggcagaatcccccggggtcaggagaaccaattggtagccctgataccgtacagcgatcaaaggctacggccacgaaggaccaaactgtatgttatggcatctgtgttcgtgtgtctgcttctcagcggcctggctgtcttctttctgttccctcgaagcatcgatgtgaaatacatcggcgtgaagagcgcctatgtttcttacgatgtgcagaaaagaaccatttacttgaatattacaaacacactgaacataaccaataataattattactcagtggaggtggagaacatcactgcacaggtgcagttcagtaagacagtaattggcaaagctcgcctcaacaatatcacgatcattggcccccttgatatgaaacaaattgactacacagtccctactgtcatagctgaagagatgtcgtatatgtacgacttttgcactttgattagtatcaaagtgcacaacattgttctcatgatgcaagtcactgtcactacgacttactttggacatagcgagcaaatcagtcaggagagatatcagtatgtggattgtggccggaacaccacataccagctgggacaaagcgagtacttgaatgtccttcaaccccagcagtag

SEQ ID NO: 138593 - DNA, 78 bp, Artificial Sequence
  Description of Artificial Sequence: Synthetic coding sequence
atggggaagagcctcagtcatttgcctttgcattccagtaaggaagacgcatatgatggagtcacaagtgagaactag

SEQ ID NO: 138594 - DNA, 333 bp, Artificial Sequence
  Description of Artificial Sequence: Synthetic coding sequence
atgggaaagagcttgtcccatctcccattgcacagctctaaagaagacgcctatgatggcgtgacctccgagaatatgcgcaatggcttagtgaatagcgaagtccataacgaagatggtaggaacggcgacgtgagccagtttccgtacgttgagtttacggggcgcgattctgtcacttgccctacgtgccagggaacaggcagaataccccggggacaggagaaccaactggttgcccttataccctacagcgaccagagattgagacctaggcgtactaaactttacgtgatggccagtgtgttcgtgtgcttgctgctgtccgggtag

SEQ ID NO: 138595 - DNA, 369 bp, Artificial Sequence
  Description of Artificial Sequence: Synthetic coding sequence
atgcacgggaccttcgtgatattactcccgctgtcactgattctgatggtcttcggaggcatgacaggattcctgtcattccttctgcaagcttacctccttcttttgctgacaggcattctgttcttattcggcgcaatggttaccctggcgggaatatctgtatacatagcttactcagcagccgcctttcgggaggccctatgtctgttggaagagaaagccttactggaccaagtggacatctcttttggatggtccctggccctgggatggatcagctttattgccgagctgttaacgggggctgccttcctggctgccgcacgggaactcagcttacggaggcgccaggaccaggcaatctag

SEQ ID NO: 138596 - DNA, 570 bp, Artificial Sequence
  Description of Artificial Sequence: Synthetic coding sequence
atgggccttggagcgaggggcgcctgggctgcgttgctgctgggcacgctccaggtgctggcactgctaggtgctgcccatgagagtgccgcaatggccgaaaccttgcagcatgtcccgtcagaccacaccaacgagaccagcaatagtacagtgaagcccccaacctctgtagcctcagactcttccaacactacagtgaccacaatgaagccaaccgcagccagcaacacaaccacacccgggatggtttccactaatatgacaagcactacactcaaatctacccccaagactacctccgtcagccaaaacacttcacaaatcagtacgagcacaatgaccgtcactcacaatagtagtgttacttcggccgccagtagcgtcaccattaccacaactatgcacagtgaggccaagaaaggcagtaagttcgacaccggatcattcgttgggggcatcgtcctgacacttggtgtcctgtctattctgtatatcggctgcaagatgtattacagcagaagaggcatccggtatcggacgatcgacgaacacgatgctataatctag

SEQ ID NO: 138597 - DNA, 627 bp, Artificial Sequence
  Description of Artificial Sequence: Synthetic coding sequence
atgggcttgggggctaggggagcctgggcagctctcctgctaggcaccctccaggttctggcgctgctcggggctgcacacgagagtgctgccatggccgcctccgcgaacatagagaacagcgggcttccccacaattcctctgctaactctactgagacattacagcatgtgccctctgatcataccaatgagacttccaactcaaccgttaagcctccgacatctgtcgcgagtgattcgagcaacaccacggtaaccactatgaagcccacggccgccagcaataccactactcccggcatggtcagcaccaacatgacaagcactactcttaaaagcaccccaaagacaacttcggtgtcccaaaacacttcacagataagcacctctactatgactgtgacccataactcttctgtaacttctgccgcctcctcagttacgatcaccacaactatgcactcagaggcaaaaaagggttccaagtttgacaccggttcttttgtcggcggaatcgtcctcacgttaggagtcctcagcatcttgtatatcgggtgtaagatgtattatagtcgccgggggatcaggtataggacaatcgacgagcatgacgccatcatttag

SEQ ID NO: 138598 - DNA, 588 bp, Artificial Sequence
  Description of Artificial Sequence: Synthetic coding sequence
atggaaaatcataagagtaacaataaagaaaatatcaccattgttgatatcagtaggaaaattaatcagctgcccgaggccgaacgcaacctgctcgaaaacggatcggtgtacgtgggactgaatgctgctctttgcggtctcatagccaacagtttattccgcaggatactgaacgtcacaaaggctcgtatcgctgctgggcttcccatggctggcatccccttccttactacagaccttacctacaggtgcttcgtgtctttcccccttaacacgggcgacttagactgtgagacctgcacgatcactagatctggactcacaggcctcgtgatcggagggctgtaccccgtctttctagcgattccagtgaacggagggctggcagcccgctatcagtccgctttactccctcataagggcaatatccttagctactggatcaggacctcaaagcctgtatttcggaagatgctgttccccatcttgctgcaaaccatgtttagcgcctatttaggttccgagcagtataagttgctgataaaagcgctgcagttatctgagccagggaaagagattcactag

SEQ ID NO: 138599 - DNA, 378 bp, Artificial Sequence
  Description of Artificial Sequence: Synthetic coding sequence
atggccgggattcctttcttaactacagacttgacatacaggtgttttgtgagctttccactcaacacaggtgatctggattgtgagacctgcacgatcaccagatctgggctgaccgggctggttattgggggcctgtatccagtcttccttgccatccccgttaacgggggcctcgcagcccggtaccagtccgccctgctgccacacaagggtaacattcttagctactggattaggacttccaaacctgttttccgaaagatgttgttccctatcttgctacaaaccatgttctcagcgtatctcgggagcgagcaatacaagctgctgattaaagcgcttcagctgtccgagccaggcaaggaaatccactag

SEQ ID NO: 138600 - DNA, 489 bp, Artificial Sequence
  Description of Artificial Sequence: Synthetic coding sequence
atgctgcagacctctaattattctctagtcctctctctgcagtttctcctgctgtcctacgatctctttgttaattccttttccgaactgctgcagaaaactcctgtgatccagcttgtactcttcatcattcaagacattgccgtgctgttcaacattattatcatatttctgatgtttttcaatacgttcgtgttccaggctggcctcgtgaatctcctctttcataaattcaaagggacgatcatcctaaccgctgtgtacttcgctctaagcataagcctgcacgtttgggttatgaacttgcgctggaagaatagcaattctttcatatggaccgacggacttcagatgctgttcgtgtttcagcggctggcagctgttctgtattgctacttttacaaaagaaccgctgtccgcttaggtgatccccacttctatcaggactcgctgtggctacgcaaagagttcatgcaggtgagaaggtag

SEQ ID NO: 138601 - DNA, 318 bp, Artificial Sequence
  Description of Artificial Sequence: Synthetic coding sequence
atgctgcaaacgtctaactactctctcgtcctgagcctccagtttttgttactgagttatgatctgtttgtgaattcctttagcgagttactccaaaaaactccagtgattcagctggtgctcttcatcatacaagacatcgctgtgttgttcaatatcattatcatcttcttgatgttctttaatacctttgtgtttcaagccggtctggttaatctgctgtttcacaagttcaaaggtacaattattctcacagcagtttattttgctctttcaatttcactgcatgtatgggtgatggtgagagtagctgtatag

SEQ ID NO: 138602 - DNA, 1140 bp, Artificial Sequence
  Description of Artificial Sequence: Synthetic coding sequence
atgccgcacagctccctgcatccatcaattccgtgcccaagaggacacggcgcccaaaaggctgcactagtattgctttccgcatgtctggttaccctatgggggctgggcgagccacccgaacacacgctgagatatctggttttacacctggcttccctgcagctggggctgctgcttaatggagtatgctcattggcagaggaactgcgccatattcatagcagatatcgcgggtcctactggaggacagtccgcgcgtgtcttgggtgtccgctgaggcgtggagctttactgcttctctccatttatttttattactcattgcccaacgccgtggggccaccctttacctggatgctggccctcctggggctcagccaggcactgaacatcctactgggtctcaagggcctggccccggccgagattagtgccgtgtgcgaaaagggaaattttaatgtggcacacgggctagcctggagctattatattggatacttgcgactgatcctcccagagctgcaagcccggatcagaacctacaatcagcattacaacaatttgctgagaggggccgtttcccagagattgtacatccttctcccactagactgtggagtcccagataacctgagcatggcagatccaaacatccggttcttagataagctgccccagcaaaccggcgaccacgctggtatcaaggatcgggtctatagtaactctatctatgagctgctggagaacggccagcgggccggtacttgtgtcctggaatatgcgacacccctccagaccttgtttgccatgagccagtatagccaagcaggattctctagggaagacagactggaacaggctaagctgttttgccgcaccctggaagatatacttgccgatgccccagaaagccagaacaattgtagattaatagcttaccaggaacccgcagacgatagttcattctcgttgtcccaagaagttctccggcaccttcggcaggaagaaaaagaagaagttaccgtggggagccttaagacatccgctgtgccaagcactagtaccatgtcccaggagccggagcttctgatcagcggcatggagaagccactcccactgagaaccgacttcagctag

SEQ ID NO: 138603 - DNA, 762 bp, Artificial Sequence
  Description of Artificial Sequence: Synthetic coding sequence
atgccccactcttccttgcacccttcaatcccttgccctagggggcacggcgcacagaaggccgccctggtcttgttaagcgcatgtctggtgacactttggggattgggcgagccacccgagcacactctgagatatttggttctccacctggcctcactccaactgggccttctgctcaatggggtatgcagcctcgcagaggaactcaggcacattcactcgcggtacaggggatcctactggagaactgtacgcgcatgcctggggtgccccctccggaggggagccctgctcctcctgagcatatacttttattattcgcttcccaatgcagtgggcccaccttttacatggatgctggccttactggggctgtcacaagccctcaacattctcctaggactaaaggggttggctccagccgagatttccgccgtttgcgagaaaggcaattttaatgtggcccacggtctggcctggtcttattacattgggtacctgagactaatcctccccgagctccaggctcggatcagaacttacaaccaacactacaacaatctgcttcggggcgccgtctcccagcggctgtatatactcctgccgctggattgtggggtgccagacaatctgtctatggccgaccccaacatccggttcctggacaagctcccccagcagaccggcgaccatgcaggcatcaaggatcgggtgtacagtaactcaatttatgaactgctggagaatggacagcggtag

SEQ ID NO: 138604 - DNA, 423 bp, Artificial Sequence
  Description of Artificial Sequence: Synthetic coding sequence
atgccctccgctttctctgtctctagcttccctgtgtctatccctgctgtgctgactcaaaccgattggacagagccctggctaatgggcctcgctacttttcacgccctgtgcgtgctgcttacatgtttatccagtagatcttaccggctgcagatcggacactttctgtgcctggtcatcctggtttattgcgcagaatatatcaatgaagccgccgcaatgaattggagattgttttccaaataccagtatttcgattcaagaggcatgttcatctccatcgtgttcagtgccccattactcgtcaacgcaatgatcatcgtcgtgatgtgggtctggaagaccctaaatgttatgacagacttgaaaaatgcgcaagagcggcggaaggagaagaaacggcgtcggaaggaggactag

SEQ ID NO: 138605 - DNA, 384 bp, Artificial Sequence
  Description of Artificial Sequence: Synthetic coding sequence
atgctgtcagggtatctacaaaccgattggaccgaaccatggctcatgggcctggctacatttcacgccctctgcgtgctgctcacatgcttatcttctaggagctataggctacagatcgggcatttcctgtgcttggtgatcctggtgtattgcgccgagtatattaacgaggcagcggccatgaactggcgcttgttttcaaaataccagtactttgattccaggggcatgtttatatccattgtgttttctgcccccctgctggtcaacgctatgattattgtggtcatgtgggtatggaagactctcaacgtcatgactgatctgaaaaatgcccaggagcgccgcaaagagaagaaacggcgccggaaagaggactag

SEQ ID NO: 138606 - DNA, 1560 bp, Artificial Sequence
  Description of Artificial Sequence: Synthetic coding sequence
ggacccgctcaacgtgcatcttcccccattccatctgcaggacggcgagagggggctcaggccgctacccagagggtagagcggcgggacagagatccgggaggctgtgccgcctggactccatccactttgccactctctccaagatcagcagcctcatccagcacttgtgcagggggctgcggcaagcgcacggcctcatctagaaggacaagccggccatccagaatgactgccacaaccgggcctaaggtgatccagacaagcgctgcaaatttcagcctcaataactctaagaagctgaagcccatccagatactatccaatccattgtcgacatataatcagcagctgtggctgacgtgtgtagttgagcttgaccagtcaaaagaaacttcaataaaaacaagcttccctatgacggttaaggttgacggagtggcccaagatggcaccacaatgtacatccacaataaagtccacaaccgcacaaggacactaacctgtgccggcaaatgcgcagaaattattgtggcacacttagggtatctgaattatacccaatataccgtgatcgtcggcttcgaacacctcaagctgcccatcaagggcatgaacttcacatggaagacatataatccagcattttcacgcctggaaatctggttccgctttttcttcgttgtattgactttcattgtgacctgtctattcgcccactctttgaggaagttcagcatgagagactgggggattgaacaaaagtggatgtcggttctgctgcctctgctgctactgtacaacgatcccttcttccctttgagcttcctggttaatagttggctccctggcatgcttgatgatcttttccagtctatgttcctgtgcgccctgttgctgttctggctatgtgtctatcacggcatccgagtgcagggagagcgcaagtgtctaacgttttacctgcccaagttctttatcgtcggattattgtggctggcttcggtgaccctgggcatttggcaaactgtaaatgagcttcatgaccctatgtatcagtatcgggtagatacagggaattttcagggcatgaaagtcttttttatggtggtcgccgccgtgtacattttgtatctgctatttctcatcgtgagggcctgctccgaactccgtcacatgccttatgtggacctgcggctgaagttcctaaccgctttgacgtttgttgtgcttgtgatcagtatcgccatcctgtacctccgcttcggggcccaagtgcttcaggacaatttcgttgcagagctgagcacccactaccaaaaacccgccgagtttcttagcttctacggcctgctaaatttctacttgtacacccttgcttttgtgtactcgccctcaaaaaacgcgctgtatgaaagccaactgaaagataatcccgcgttctctatgctgaatgatagcgacgacgacgtaatctacggttcagactatgaggagatgccactccaaaatggtcaggcaattcgcgccaaatacaaggaagagtctgatagtgattag

SEQ ID NO: 138607 - DNA, 1839 bp, Artificial Sequence
  Description of Artificial Sequence: Synthetic coding sequence
atgggagccgcaccgagtcccacgcaggcttcttctcgcggggggggtcctggacccccagctcccacccgcgctgtaagttcaagttctcgcgcccggggcggagcattgtctgcattgggccccagtcccgcgcgccctctcaccacttcacctgctcccgcccccccccccagatctaggcccgctcggcaacaacctgatccccagtgctgggagaaacggggaggcgccggcggtgataccaaggggggtgccgccgggccggggcccggtcgcctccgagggatggatgccgagtatccagccttcgagccacctttatgctcagaattgaaacatctctgtcggagattgagagaggcctacagggagcttaaagaagacttgactccctttaaagacgatcgatattatcgtttggcccctatgaggctgtacacactgagtaaacgacactttgtgctagtattcgtcgtcttctttatctgtttcgggctgaccatcttcgtcggaattcggggtcctaaggtgatacagaccagcgctgccaatttctctcttaacaattctaagaagctgaaaccgattcagatcctttcaaaccctttgagcacgtacaatcagcaactatggctgacgtgcgtggtcgagctggatcagtcaaaagaaacttccatcaaaacttcctttcctatgaccgtaaaggtggacggtgtagcccaggacggcactaccatgtatattcataacaaggtgcataatcgtactcggactcttacttgtgccggcaaatgcgccgagattattgtcgcccatcttgggtatctgaattacactcagtacaccgtgatcgtaggctttgagcatctaaaactgcccatcaaaggaatgaactttacttggaaaacctacaatcccgcgttcagccggttagagatatggttcagattcttcttcgttgtgttaacattcattgttacatgtctgtttgcccactccctgcgcaagttcagcatgcgggattggggcatcgagcagaaatggatgtccgtcctgcttccactgctactcctgtataacgaccccttttttcccttgtcctttctagtcaatagttggttgcccggcatgctcgatgacctgtttcagtcaatgtttctttgcgccctcctacttttctggctgtgtgtctatcatggcatcagagtgcagggcgagaggaagtgtctcacattttacttaccaaaattctttatcgtcggcttgctatggctggcttcagttaccctggggatctggcagactgttaacgaactgcatgaccccatgtaccaatatcgggtggatactggcaacttccaaggcatgaaggtgttcttcatggtggtggctgcagtatacatcctgtatctgctgttcctgatcgttcgggcctgcagcgaattgcgccacatgccctacgtcgatttgagactcaaatttctgaccgcccttacctttgtagtgttagttattagtatcgctatcctctacttgaggttcggagcccaggtgttgcaggataactttgtcgccgagctcagcacacactaccagaactcagctgaatttctgtcattctacgggttgttgaatttttacttatataccttggctttcgtgtactccccaagcaaaaatgcgctgtatgaatcccagctgaaagacaaccccgctttctctatgctgaatgactccgatgacgacgtgatttacggaagtgactatgaggaaatgcctctgcagaatggccaggcaatcagggcaaagtacaaagaggagagcgattctgattag

SEQ ID NO: 138608 - DNA, 1317 bp, Artificial Sequence
  Description of Artificial Sequence: Synthetic coding sequence
atgccctgtacctgcacttggcgcaactggcgccagtggatacggcctcttgtggcagtgatctatttggtgtccatcgtggtggccgtgccgctctgtgtgtgggagctccaaaaactggaggtgggcattcataccaaggcatggttcatcgcaggcattttcttgctgttgaccatccccatctcactgtgggtgatcctccaacacctggttcattatacacaacctgaactccaaaagcctatcatcaggatactctggatggtgccaatctactctttagattcatggattgcgttaaaatacccggggattgctatctatgtggacacttgtcgagaatgctacgaggcttatgttatttacaatttcatgggcttcctcaccaactacctgaccaacaggtacccaaacctggtcctcatcctggaggccaaggatcagcagaagcactttccccccttgtgctgctgccctccatgggccatgggcgaagtgctgctgttcagatgcaaactgggggtgcttcaatataccgtggtgcggcccttcacaacaatagtggctctaatctgcgagctgctgggtatctatgacgagggcaacttctcattctcgaacgcctggacatatctggtgattataaataacatgagccagttatttgccatgtactgtctgttactgttctataaagtactgaaggaggagctctctccaatccaaccagtggggaaatttctgtgtgttaagctagtcgtcttcgttagcttttggcaggcagtggtcatcgcactgctggtgaaagtgggtgtcattagcgagaagcatacgtgggagtggcagactgtggaggctgtggcgacaggactgcaagattttattatctgcatagagatgttcttagctgcaatcgctcaccactatacttttagctataagccctacgtgcaggaggctgaggagggttcgtgttttgattcctttctagccatgtgggacgtgtccgatatcagggatgacatcagtgagcaggtccggcatgtggggcgaaccgtgcgcggacatccccggaagaaactgtttcctgaggaccaggatcagaatgaacatacttcgctactcagctcctctagccaggacgcgatttctattgcttcctctatgcctccttcacctatggggcattaccagggcttcggacacactgttacaccccagacaacgcctacgaccgccaaaatttctgatgagatcctaagcgataccatcggtgagaagaaagagccatcagataagagcgtcgacagctag

SEQ ID NO: 138609 - DNA, 4152 bp, Artificial Sequence
  Description of Artificial Sequence: Synthetic coding sequence
atgtatgccacggatagccggggacactcaccagcctttttgcagccacaaaatgggaatagtagacatcccagcggttacgtaccaggcaaagtggtgcctttacgaccaccacctcctcccaaatcacaggcctccgcaaagttcacatcaattcgccgggaagacagggcaactttcgcattctccccggaggagcagcaggcccagagggagtctcagaagcagaagaggcacaagaacacatttatttgtttcgctatcacatcattcagcttctttatcgcactggccattatcctgggcatctcctctaagtacgctcccgacgaaaattgtcccgaccagaatccaagactgcgtaattgggaccctggccaggatagtgcaaaacaggtggtgattaaagaaggggatatgttgcggctgacttctgatgccacggtgcattctatagtgattcaagacgggggtctgttagtgttcggcgacaacaaggatggaagtcggaatatcactctgaggacgcattacatactgattcaagacggcggcgctctgcacattggagccgagaaatgcaggtataaatccaaggctaccatcacactctatgggaaatcggatgagggtgaatccatgcccacttttggcaagaagttcatcggcgtagaggccgggggtacgcttgagctccacggtgcacgaaaggcctcttggacgctgctcgctagaaccttgaattccagtggtctgccatttggctcttacacttttgagaaagactttagcagaggcctcaacgttagggtgatcgatcaggatactgcgaagattctcgaaagcgagcggttcgatacacatgagtatcgcaatgagtccagacggctccaggagttcttacggtttcaggacccgggccggatcgtggccattgctgtcggagattccgccgccaagagcctcctgcagggaaccatacagatgatccaagagcggctaggatctgagctgattcagggacttgggtaccgacaggcatgggcccttgttggcgtgattgacgggggttcgacatcttgcaacgagagcgtgcggaattacgaaaatcattcttctggcggaaaggccctggcgcaaagagaattctatacagtcgacggacagaagttctctgtgacagcttatagcgagtggatagagggggtgagcttgtccggattccgagtggaggttgtggatggagtcaaactgaatctcctcgacgacgtctcctcgtggaagcccggagaccaaatcgtggtggcctccactgactactccatgtaccaggccgaggagttcacccttctgccctgtagtgagtgttcacattttcaggtgaaggtgaaggagacgccacagtttttgcatatgggggagattatcgatggggtggatatgagggcagaagtcggaattctgactcggaatattgtcatccagggcgaggtcgaagacagctgctacgcggaaaaccagtgccaattttttgattacgacacttttgggggacatatcatgataatgaagaactttacctccgtgcacttatcatacgtggaactaaaacatatgggtcagcagcaaatgggaaggtacccagttcacttccacctgtgtggggatgtcgactataaagggggctacaggcacgccaccttcgtggacggtctgagcatccatcactcattcagccggtgtataaccgtacatggcaccaacggcctgctcatcaaggacacgatcgggtttgacacactgggacactgtttcttcttggaggacggcatagagcagcgaaacacactgttccacaacctgggcttgctcacaaagcctgggacgctgcttccaaccgacaggaacaattctatgtgcaccaccatgcgcgacaaggtctttggaaactacattccagtgccagccactgactgcatggcagtgtctaccttctggatagcacacccaaacaacaatctgatcaacaatgccgctgctggaagccaggacgccggtatatggtacttatttcataaggagccgacaggggaaagctccggactgcaattgctcgcgaaacccgagttgactcccttaggtatcttttacaataaccgagttcactccaactttaaagcagggctgttcattgacaagggcgttaaaaccaccaattctagcgccgcagaccccagggagtatttgtgtctcgacaactcggctaggttcaggcctcaccaggatgccaatcccgaaaaacctagggtggccgcccttattgatcggctcattgcctttaaaaataatgacaacggtgcctgggtcaggggcggggatataatcgtgcagaactctgcgtttgccgacaacggtatcggtcttacattcgcgtctgacggtagcttcccgagcgatgagggctctagccaggaagtgtctgaatccctgttcgtgggagaaagccgcaactacggttttcagggcggacagaataagtacgttgggaccgggggtatcgatcagaagcctcgcaccctcccacgaaacaggaccttcccaatcagaggcttccagatttatgacggccccattcatctgaccaggtcaacttttaagaagtatgtacctacaccagatagatactccagcgcgataggcttcctgatgaagaattcatggcagattactcccaggaacaacatcagtcttgtgaagttcgggccacacgtttccctgaacgtcttctttggaaagcctggcccatggttcgaggactgcgagatggatggggacaagaacagcatcttccatgacattgacgggtctgtgacgggctataaagacgcctatgtcgggagaatggacaattacctgattcggcatccctcatgcgtcaacgtgtccaaatggaacgccgtgatctgctctggtacttatgcgcaggtgtacgtgcagacatggtctacccagaacctgagcatgacgattactagggatgaatatcccagtaatcctatggtacttcgcggaattaaccagaaagccgcttttcctcagtatcaacccgtcgtaatgctagagaaaggttataccatacattggaatggaccagccccacgcactacctttttatacctcgtgaacttcaataagaatgactggattagagtgggactatgttacccctctaacacttcatttcaggtgacatttggctacttgcagaggcagaatggctcactatcgaaaatcgaagagtacgaaccagtccatagcttagaggagctccagagaaaacagtctgagcgcaaattttacttcgattctagcactggactgctgtttctctacctgaaggccaagtctcaccggcatggccatagttactgctcttcacaagggtgtgagagagtgaaaatccaagccgctacggacagtaaagacatcagcaactgcatggctaaagcataccctcaatactacagaaagccttccgttgttaaacgaatgccagccatgttaactggactgtgccaaggctgtggtactaggcaggtggtcttcacctcagaccctcacaaaagctatcttcctgtgcagttccagtctcccgataaagccgagactcagcggggagatcctagcgtaatctcagtcaatggcacggacttcacattccgaagcgccggtgttctgttactcgttgtggacccttgtagcgttccgtttcggcttacagagaagactgtgtttccactagcagatgtgagccgcatcgaggaatacctcaagacaggaattccacctcgatccatcgtcctcttgtctactcgcggggaaatcaagcagttgaacatcagtcacttactggtccctcttggtctcgccaagccagcccatttgtatgacaagggttctactatctttctcggatttagcggtaacttcaagccctcttggactaagctcttcaccagtcctgcaggccagggcctcggagtcctggagcagttcatacccttacagttggacgagtatggctgtccgcgcgctacaaccgtgaggcgccgggatttggagttgctgaaacaggccagcaaagcccactag

SEQ ID NO: 138610 - DNA, 3963 bp, Artificial Sequence
  Description of Artificial Sequence: Synthetic coding sequence
atgtatgctactgacagccgggggcacagccccgcctttctgcagccccaaaatgggaattcaagacacccctccgggtacgtgccggggaaagtggttccgctgcggccgccgccgcctccaaagtcacaggctagtgccaagttcacttcaattagacgagaagatcgcgcaacgtttgcattctctcccgaggagcagcaagctcagcgtgaaagccagaagcagaaaagacacaaaaacacgttcatctgtttcgccataaccagcttttccttcttcatcgcgttggcaataatactcggcatcagctcaaagtacgcacctgacgaaaactgtccagaccagaaccccagactgaggaattgggacccagggcaggactcagctaaacaagttgttatcaaagaaggggatatgctccgtcttacgagtgatgcaaccgttcactccattgtgatccaagacggcggtcttctcgtcttcggggataataaggacggaagtagaaatatcactctaagaacacactacatcctgatccaggacggaggagcactccatatcggagctgaaaagtgtcgatataagtcaaaagctactatcaccctctatgggaaaagcgatgagggggagtccatgcctacgtttggcaagaagttcatcggagtagaagctgggggtaccctggagctccacggagctcgcaaggcgtcgtggactttgctcgccagaactctgaattcaagcggtctgccatttggttcgtatacatttgagaaagacttcagccgggggttgaacgtgcgggtgatcgaccaagatacagccaagattctagagtccgagaggttcgatactcacgagtataggaacgagtcccggaggttacaggagttcttaagattccaggaccccggacgtatcgtggctatcgcggtgggcgattctgctgcaaaaagtctgttgcagggaacgatacagatgatccaggagcgactcggttcagaactgatccaaggcctcggatataggcaggcttgggcactagtgggcgttatcgacgggggaagcacctcatgcaacgaatctgtgaggaactatgaaaaccattcatcagggggcaaagccctcgctcaacgcgaattttacactgtggatgggcagaaattcagtgtcaccgcgtactccgagtggatcgaggagacccctcagtttctccacatgggcgaaatcattgatggagtcgacatgagagcagaagtcgggatcctgacgcggaatattgtcatccaaggagaagtggaagattcttgctacgccgagaaccagtgccagttcttcgactatgataccttcggcggccacattatgatcatgaagaatttcactagtgtccacttgtcatatgtggaactgaagcacatgggtcaacagcagatgggcaggtacccagtgcatttccacctctgtggcgatgttgattataagggggggtaccgacacgctacatttgtggacggactttctattcaccacagcttcagcagatgcataaccgtgcatggaacgaatggcctactgattaaggacaccatcggattcgatactctggggcactgtttctttcttgaagatggaattgagcaacgcaacacattattccacaatcttggattgctcactaagccggggacactccttcccactgatagaaataattcgatgtgtacgactatgcgggataaggtgtttgggaattatataccagtccctgccactgactgtatggcagtgtctacgttctggattgcccatccaaacaacaacctaattaacaacgccgcggctgggagccaggacgcagggatttggtacctgtttcacaaggagcctacaggcgagtcaagtgggcttcaattattggcaaagcctgagctgacgccgctggggattttctacaataaccgggtacacagcaatttcaaggccggcctgttcattgacaagggagttaagaccactaactcctccgctgccgatcctagagagtatctgtgcttagacaacagtgcccggtttcgcccccaccaggatgcgaaccctgagaagccccgggtcgcagctctcatcgatcgcctaattgccttcaagaataatgacaacggcgcctgggtccgaggcggcgacatcatagtgcagaacagtgcattcgcggataacgggatcggcctgacattcgcctccgatggctccttccctagcgatgagggctctagtcaagaggtttccgagagcttattcgttggggaaagccgtaattacggatttcagggaggacaaaacaagtacgtcggcactggcggaattgatcagaagccccggactctgcctcgcaatcggacctttccaattagaggtttccaaatctatgacggccccatccacttaacacgatctactttcaagaagtatgtaccaacccccgacagatattcctctgctattggatttcttatgaaaaactcttggcagattactcctagaaacaatataagtttagtcaagttcggaccacacgtgagtctgaatgtgtttttcggaaagcccggaccatggtttgaggactgcgaaatggatggcgataaaaactccatttttcatgatatcgatggaagtgtgaccggctacaaagacgcctatgtaggaaggatggacaattatctaatccgccacccctcatgcgtgaacgtctcgaagtggaatgccgtcatctgttccgggacatacgctcaagtgtatgtacagacatggtctactcagaacctgtcgatgactatcacgcgagacgaataccctagtaaccccatggtgcttaggggcatcaaccagaaggccgccttcccccagtaccagccggtggtgatgcttgagaagggatacacgatccactggaacggaccggcacctcggactaccttcctgtatctcgttaattttaataagaatgactggatcagggttggactctgttatccctccaatacttcatttcaggtgaccttcggataccttcagcggcaaaacggtagcttatccaagattgaggagtatgaaccagtgcacagccttgaagagcttcagaggaaacagtccgagaggaaattctattttgactcttcaacaggactcctgttcctttatcttaaagcgaagtcacatcggcacggtcactcctactgctcttcacagggatgcgagcgcgtcaagatacaggcagccacggattccaaagacattagtaactgcatggccaaggcctatccacagtactaccgcaagcccagtgtggtgaaaaggatgccagccatgctaaccggattatgccaggggtgcggcacacgccaggtcgtgtttactagcgaccctcacaagtcatacttgcccgttcagtttcagtcgcccgacaaagctgaaacacaaaggggggacccttccgtcatctccgtgaatggaactgattttactttcagatctgccggggtgctgctgttagtcgtggacccttgttctgtaccctttcgactaacagagaagaccgtgttccccttggctgacgtcagccggattgaagaatacctgaagacgggcatccctccacggtctatcgttctgctgagtaccagaggagaaatcaagcaactcaatatctcgcatctgctcgtgcccttaggcctggcgaagcccgcacatctatatgacaaggggagtactatctttctgggctttagcgggaatttcaaacctagctggacaaaattgtttacatcccctgctggtcaagggttgggggtcctagagcagttcatacccctgcagctggatgaatacggctgtcctcgcgcaactaccgtcaggcgccgcgatctagagctgcttaagcaagccagcaaggctcattag

SEQ ID NO: 138611 - DNA, 1131 bp, Artificial Sequence
  Description of Artificial Sequence: Synthetic coding sequence
atgacaataactcgggatgaatacccttccaatcccatggttctgagaggaatcaaccagaaggccgcattccctcagtaccaaccagtcgtgatgctggagaaaggatataccattcactggaatggccccgcccctcgaacaaccttcctttatttggttaattttaataagaatgactggatccgcgtggggttatgctacccctccaacacatcttttcaggtaaccttcggatacctccagaggcagaacggctccctctcaaagatcgaggaatacgaaccagtccacagtctggaggaacttcagaggaagcagagcgagcgcaagttctatttcgactcttctaccggcctcctgttcctgtatctgaaagcgaagtcgcatagacacggccactcctattgctccagtcaaggctgcgaacgggtgaaaatacaagccgctacagactcgaaggacatttcgaactgcatggcaaaggcttatccacagtactaccgcaagcccagcgtcgtaaagcgcatgcccgcaatgctaacaggcctttgtcagggatgtggtacacggcaggtcgttttcacaagtgatccgcataaaagctatctgccagtccaatttcagtctcccgacaaggccgagacacaacggggtgatccctccgtgattagcgtgaatgggacagacttcacctttagatccgctggagttcttctgctcgtcgtggacccatgctcagtgccttttcgtttaaccgaaaaaaccgtattcccgctggccgacgtctcgcgcatcgaggaatatctgaagacaggtatccccccgaggagcatcgtgctgttatcaactcgcggcgagatcaagcagcttaacatctcgcatcttctggtccctctggggctggcaaagccagctcacctctacgacaagggatctacaatctttctcggattttcaggcaactttaagccgtcgtggacaaagctttttacttcaccggccggccagggccttggggtgctggaacagttcatccccttgcaacttgatgaatatggatgcccgcgagcaacgacagtacggcgtcgcgacctggagctcctaaaacaggcgtcaaaggcacattag

SEQ ID NO: 138612 - DNA, 57 bp, Artificial Sequence
  Description of Artificial Sequence: Synthetic coding sequence
atgtatgccactgattctagaggccattcccccgcatttctgcaacctcaaaactag

SEQ ID NO: 138613 - DNA, 570 bp, Artificial Sequence
  Description of Artificial Sequence: Synthetic coding sequence
atggaggagggcggaaacctcggcggacttatcaagatggtccacctattagtcctctcgggagcctggggcatgcaaatgtgggtgacctttgtgagcggttttctcttgttcaggtccctgccgcggcacacattcggcctggttcagtcaaagctgttccctttctacttccatatttctatgggctgcgctttcataaacctgtgcattctcgcatcacagcacgcatgggcccagctcactttctgggaagcgagtcagctttacctactgtttctttctctaactctcgccacagtgaatgcccgatggctcgagccaagaaccactgccgccatgtgggccctccagactgtggaaaaagagagggggttgggaggagaagtgccaggtagtcaccagggcccggacccgtatagacagcttagggagaaagaccctaaatacagtgccttgcgccaaaatttctttaggtatcacgggttgtcctcactgtgcaacttaggttgcgttctgagcaatggactttgcctggcagggctggccctggagattcggagcctatag

SEQ ID NO: 138614 - DNA, 570 bp, Artificial Sequence
  Description of Artificial Sequence: Synthetic coding sequence
atggaagaaggcggaaaccttggcgggctgataaaaatggtccatctcctggtgctgagtggcgcttggggcatgcagatgtgggtgacgtttgtgagcggtttcctcctgtttcgttcactccctcgacacacttttggactggttcagtccaagttgtttccgttctatttccatattagtatgggctgtgctttcattaacctgtgtatccttgctagtcaacatgcatgggcccagttgactttttgggaggcatcgcagttatatctgctctttctcagcttgaccctcgcaacagtgaatgcccgctggcttgaaccacgtactactgcagccatgtgggccctgcagaccgtcgaaaaagagcgggggctcggcggtgaagtaccaggcagtcaccagggtccggacccttaccgccaactgcgggagaaagacccgaaatactctgccctgcgacagaatttcttcaggtaccacgggctgagctccttatgtaaccttggatgcgtgttgagtaatggactgtgcctggccggtctggccttggagattaggtctctttag

SEQ ID NO: 138615 - DNA, 570 bp, Artificial Sequence
  Description of Artificial Sequence: Synthetic coding sequence
atggaagagggtgggaacttgggaggactgattaaaatggtgcatctgctggtactcagtggggcgtggggcatgcaaatgtgggttacattcgtgagcggatttctactgtttagaagtctgcctcggcacacatttgggcttgtacagtccaagctgtttccgttctactttcatatcagtatgggctgcgcatttatcaacttgtgtatcctcgccagtcaacacgcctgggctcagctgactttctgggaagcctctcaactgtacctgttgtttctgtctcttacactggcgacggtgaatgcgcggtggctggagccaaggaccacagctgcaatgtgggcactgcagacagtggaaaaggaacggggcctcggtggagaggtgcctggtagtcaccagggccccgacccctatcgccagctgcgcgaaaaagatcctaagtattctgctctgagacagaattttttcaggtatcacgggttaagctctctgtgcaacctgggctgtgttctcagtaatgggctctgtctagcaggactggccctagaaattcgctcactgtag

SEQ ID NO: 138616 - DNA, 447 bp, Artificial Sequence
  Description of Artificial Sequence: Synthetic coding sequence
atgttgccacggggcctgaagatggctccccgcggcaaacgactctctagcaccccgctggagattttgtttttccttaatggatggtacaatgccacttattttctcttggaactgttcatcttcctgtataagggggtcctgttaccatatcctacagctaatctggtgctggatgtcgtgatgcttctgctgtacctcggcattgaagtcattaggctgtttttcggcactaaaggaaacttgtgtcagaggaaaatgccactgtcgatatcagtggctctcacatttccgtccgccatgatggctagctattacctgctcctgcagacctatgtgctgaggttggaagccataatgaatggaatcctgttgttcttctgcgggagtgaattgctgctggaggttcttacactggctgccttcagttcaatggaccgcatctag

SEQ ID NO: 138617 - DNA, 438 bp, Artificial Sequence
  Description of Artificial Sequence: Synthetic coding sequence
atgctccctcgcggcctcaagatggctccgaggggaaagagactctccagtactccactggagatcctgttctttcttaacggctggtataacgcaacctacttcctgctggagctatttattttcctgtataagggggtcttgttaccataccctaccgccaatctggttctggacgtggtgatgttgttgttgtatctggggattgaggtcatcagactcttctttggaactaaaggaaacctctgtcagagaaagatgccactcagcatttccgtggcgttgacgttccctagcgccatgatggctagctactaccttctgctacaaacctacgtgctaagactcgaagccatcatgaatggcattttactgtttttctgtggcagtgagttgctcctggaagtgctaacactcgctgccttctccaggatctag

SEQ ID NO: 138618 - DNA, 942 bp, Artificial Sequence
  Description of Artificial Sequence: Synthetic coding sequence
atgcggacggattctggcgcccggctcgaggaaggccatctacggccccctagagccctccctccagtcccatcaattgatgatattccactatccaggcctaaaaaaaaaaagacacagcctgctgagctgcagtacgccaatgagctgggggtggaggacgaggatatcataacggacgagcaaaccaccgtggaacagcagtctgtttttaccgctcccaccggaatttcacagccagtggggaaagtttttgttgagaaatcccgcagattccaggccgcggaccgctctgagctgattaagaccacagagaacatcgacgtaagtatggacgtgaagccatcctggacgacaagggatgtggcgttgacagtgcaccgggccttcaggatgatcggactgttctcgcacggattcctggccggctgcgctgtctggaatatcgtagttatatatgtgcttgctggtgatcagttgtcaaatcttagtaacttgctgcagcagtacaaaaccctcgcgtaccctttccagagcctgctctatctcctcctggccttgtctactatcagcgcctttgataggatcgactttgcgaagatatcggtggccatccgaaattttttggctctcgacccgacggcccttgcttccttcctatacttcaccgcccttattctgtcattaagccaacagatgaccagtgacagaatacacctttacaccccttcaagcgtcaacgggagcctatgggaagcaggcattgaagagcagattctccagccttggattgttgtcaacctcgtagtcgccttgcttgtcggtctctcctggttgttcttgtcgtatcggccaggcatggatctgtcggaagagctaatgttctcctcggaggtcgaagaataccctgataaagagaaagagatcaaggcctcttcttag

SEQ ID NO: 138619 - DNA, 1203 bp, Artificial Sequence
  Description of Artificial Sequence: Synthetic coding sequence
atgggcaagaatcccgtgaggccacctcgcgctcttccgccagttccctcgcaggatgacatcccattgagcagaccaaagaagaagaaacccagaactaagaataccccagcatccgcttccctcgaaggtctggcccaaacagctggccgtagacccagcgaaggcaatgaaccttctacgaaagagctgaaagagcaccctgaggcccccgtgcagaggcgtcaaaagaagacccggctgcctctcgaactcgagacttcatccacacagaagaaatcaagttccagctcgcttttgcgcaacgaaaatggtattgatgcggagccagcagaggaagccgtgattcagaagcctcgccgcaagacaaagaaaactcagccggcagagctccagtacgccaatgaacttggggtggaggacgaagacattatcactgatgagcagacaactgttgaacaacaaagtgtgttcacggctccaactggcatctcccaacccgtaggcaaggtctttgtcgaaaaatcaaggaggtttcaagcagccgaccgctcagaattgataaaaaccaccgagaatatcgacgtaagcatggacgtgaagccttcctggactacaagagatgtggctctcacggtacatagagcgttccgaatgattggtctgttttctcacgggtttttggctgggtgcgcagtctggaacatcgtggtaatctacgtattggcgggagatcagctgtcaaatctgtccaatttgctgcagcaatacaagaccctcgcctatccttttcagagtctgctctacctgttactagccttgagcactatttctgcatttgatcggatagatttcgcaaagatcagtgtcgctattcgaaattttcttgcacttgatcccaccgccttagcgagttttctgtacttcacagctctcatcctctcactctcacagcagatgacctccgacaggatccatctgtatactccatcctcagtcaacggttccctctgggaagccggcatcgaagaacaaattctgcagccgtggattgtggttaacttggttgtggctttacttgtcgggttgtcttggctgtttctctcctataggcctgggatggatctttctgaggagctcatgtttagtagcgaggtggaagaataccccgataaggaaaaggagatcaaagccagcagctag

SEQ ID NO: 138620 - DNA, 1227 bp, Artificial Sequence
  Description of Artificial Sequence: Synthetic coding sequence
atgaggacggattccggcgccagactggaggaagggcacctgcggcctcctagggcactccctcccgtaccaagccaggatgacattcccctgtctcggcccaaaaagaaaaagcctcgcacaaagaacacaccagcgtccgcctccctggagggcctggcacagactgcagggcggcgcccttctgagggtaatgagccatcgacaaaagaactcaaggagcacccggaggcgccagtgcagcgcaggcaaaaaaaaactcgtctgccgttggagttggaaacatcgagtacgcagaaaaagagctcaagctcatcccttttaaggaatgaaaacggtattgacgcagaaccagccgaggaggcagtgatccagaaacccagaaggaagacaaagaagactcagcctgctgagcttcagtatgccaacgagcttggcgtcgaggatgaagatatcattactgacgagcaaactacggtggaacagcaatctgtttttacagcaccaactggcatttcgcagcctgtgggcaaggtgtttgtagagaaaagcagacgctttcaggctgccgacagaagtgaactgatcaagaccacagaaaatatagacgtgtccatggacgtaaagccttcttggaccaccagagatgtcgccttaaccgttcacagagcttttcgaatgatcggccttttctcccatggattcctcgccggatgtgccgtttggaacatcgtagtcatctatgttctggccggagatcagctgtccaacctgagcaacctcctgcagcagtataaaacccttgcctatccgttccagagtctcctttacctcttgcttgcgctcagcacaatatcagcctttgaccggatcgacttcgctaagatctccgtggccattagaaattttttggctcttgatccgaccgctttggcctcctttctttacttcacagcactcattttgtcactttcccagcagatgacctccgatcggatacatctgtacactccctcttctgtcaacggatctctctgggaagcgggcattgaagaacagatcctccagccctggatcgtagtgaacctagtcgtcgctttactcgtgggcctcagctggctgttcttgagctatcgccccggaatggatctgagcgaggagcttatgttctcctcagaagtggaagaatacccagacaaagaaaaggaaattaaggcctcttcctag

SEQ ID NO: 138621 - DNA, 1293 bp, Artificial Sequence
  Description of Artificial Sequence: Synthetic coding sequence
atgacccactgtgcatgcgctagggatagacgagagggctggggtgcccgctgtctgggaaggaggccacctaggccggctaagagacggatgggtaagaaccccgtgcgtccacctagggcgctcccacctgtgccttcaatcgacgatatacccctgagcagacctaagaagaagaaacccaggacgaagaacaccccagccagtgcctcactggagggcctggcacagacagccggccggcggccttccgaaggcaatgaaccctcaacaaaggagctgaaggaacatcccgaggcacccgtgcagaggcgccagaaaaagacccgactgccactcgagctggagacgagctccacccagaaaaagtcgtcctcatctagtttgctgcgcaatgagaacggcatagatgctgagcctgctgaagaagctgtcatccaaaagccccggcgcaagaccaagaagacacagcccgccgaactgcagtacgccaatgagctaggagtagaggatgaagacatcattactgatgaacagaccacagttgagcagcagtccgtattcactgcccctacaggcataagccagcctgtcgggaaggtgtttgttgagaaatctcgtagatttcaggccgccgataggtcagaattgattaagacaaccgagaatatcgacgtaagcatggacgtgaagccctcctggactacacgtgatgtagccctgacagtacaccgggcattccgtatgataggacttttctcccacgggtttctggctggttgtgccgtttggaacattgtggtcatctatgtcttggccggggatcaattatccaacctgagtaatctgctgcagcagtacaaaaccctggcctatcccttccaaagccttctgtacctcctgcttgccttgtccaccatttccgcgtttgaccgtattgacttcgctaaaattagtgtggccattcgcaattttctggcccttgaccccactgccctggccagctttttatactttaccgcattaatactgagcttaagccagcagatgacctctgataggattcacctctacacgcctagttcagttaacgggagtctgtgggaagcgggcattgaggagcagatcctccagccttggatcgtggtgaacttagtcgtggctctgcttgtaggtctgagttggctgttcctgtcatacagaccaggaatggatctgagcgaggaactgatgttctcttccgaggtggaagagtacccagataaagagaaagagatcaaggcgagctcatag

SEQ ID NO: 138622 - DNA, 1227 bp, Artificial Sequence
  Description of Artificial Sequence: Synthetic coding sequence
atgaggacggactcaggggccaggctcgaggagggtcacttgcgtcctcccagggcactgccccctgtacccagtatcgatgatattccgctttcacggccaaagaaaaagaaaccacgcactaaaaacacgcccgcatcggctagcctggaagggttggcacagacagcagggcgtcgcccaagcgaggggaacgagccaagcactaaagagctaaaagagcatcctgaggcaccagtgcagcgtcgccaaaagaagactcggctgcctttagagcttgaaacctcttcaacccagaagaagagcagcagcagcagtctgctgaggaatgagaacgggatcgacgccgagcccgccgaagaggcggtgatccagaaacccaggaggaagactaaaaaaactcaaccagcggagttgcagtacgccaacgagctcggcgttgaggacgaggacatcatcaccgacgagcaaacaactgttgaacagcagtcagtctttaccgcacccacaggcatcagtcaacccgtgggaaaggtgttcgttgagaagtctcggaggttccaggctgccgatcgcagcgaattgattaagacgacagagaacattgatgttagcatggatgtcaaacctagctggaccacccgcgacgtcgcactcactgtacaccgtgccttccgaatgattggattatttagtcatggttttctagctgggtgcgccgtgtggaacatagtggtcatttacgttttagccggcgatcaacttagtaatctcagtaacctgctgcagcaatataaaaccctggcctacccctttcaatcactgttgtacttactcctggccctaagcacaatctccgcctttgaccggattgactttgccaagatttctgtagccattcgcaactttctggcactcgacccgaccgcacttgcgagttttctctactttaccgcccttatcctctcactttcccaacagatgactagcgatcgaatacacctttacacaccatctagcgtgaatggttcactctgggaggctggtattgaagaacagattctgcagccatggattgtggtgaatctcgtggtagcgctcttggtcgggctgtcatggctattcctgtcttatcgtcccggcatggatctgagtgaggagttaatgtttagctctgaggtggaggagtatcccgacaaggaaaaagagattaaggcttcttcatag

SEQ ID NO: 138623 - DNA, 1101 bp, Artificial Sequence
  Description of Artificial Sequence: Synthetic coding sequence
atggctttgccgccaggacccgccgctctgcgccatacactgctactgctgcccgctcttctgtctagcgggtggggtgaactggaaccccagattgatggtcaaacatgggccgaacgcgccttgcgcgaaaacgagcgacatgccttcacgtgtcgggtagccggaggccctggaacaccacgtctggcctggtacctcgacggacagctgcaggaggcgtcaacttctaggctgctatcggtgggcggggaggcctttagcgggggaacttcaacctttactgtgacagcccacagagcacaacatgaactcaattgcagcttacaggaccctagatcaggcaggagcgcgaacgccagtgtaatactcaatgtccagtttaagccagaaatagcccaagttggggctaaataccaggaagcacagggtcctggtcttcttgtcgtgcttttcgccctagttcgggctaatccccctgcaaacgtgacttggattgatcaggacgggcctgtcaccgtgaacacctcagacttcctggttctcgatgctcagaactatccatggttaacaaaccatactgtgcagttgcagcttcgcagtttagctcataacctctctgtcgtagccaccaatgatgtgggcgttacaagtgcatccttgccagctccgggcttgctggctaccagagtggaggtgccactcctaggcattgtggtggccgccggccttgcactggggacgctagtgggtttttccacactggtggcgtgtcttgtatgtaggaaagagaagaaaactaagggtccaagtagacatccgtctctgatttcctccgacagcaataatctcaagctgaataatgtgcgcctgcctagagaaaatatgtccctaccttctaaccttcaactgaacgacctgactccagactcacgtgccgtgaagcccgcggatcggcagatggcccagaacaactctcgaccagagctgctggaccctgaacctggcgggctacttacatcccaggggtttattcgtctgcctgttctcggatacatataccgtgtgagttctgtctctagtgacgagatttggttgtag

SEQ ID NO: 138624 - DNA, 657 bp, Artificial Sequence
  Description of Artificial Sequence: Synthetic coding sequence
atggccttgcctccggggccggccgcactgcgtcatacacttttattgctgcctgcgttgctgtccagcgttaaacctgagatcgcacaggtgggcgccaagtatcaagaagctcagggcccaggcctgcttgtggtgctcttcgctctagtccgagcaaaccccccggccaacgtgacatggattgatcaggacgggccagttaccgtaaacacttctgattttttggttcttgatgctcagaactatccttggctcaccaatcatacagttcagttgcaactgcggtctcttgcacataacctgagcgtggtggccacaaacgacgtgggcgtcacctctgctagcctgcccgccccgggcccatcacgtcatccatccctcatcagttctgattcaaacaatctgaagctgaataacgtgagacttccccgcgaaaatatgagcctaccgtctaatttacagctcaatgatcttacccctgattctagagcggtgaagccggctgacagacaaatggctcaaaacaactcacgcccagaattgctagatcccgagccggggggtttgttgactagtcagggatttattaggctgcctgtcttggggtatatatatcgcgtgagttctgtcagcagcgatgagatctggctgtag

SEQ ID NO: 138625 - DNA, 1056 bp, Artificial Sequence
  Description of Artificial Sequence: Synthetic coding sequence
atggccctgcccccagggcccgccgccttgagacacactcttctgctgcttcctgccctcctttcttctgggtggggggagctcgagcctcagattgatggccagacctgggcggagagagctctccgggaaaacgaaaggcacgcctttacatgccgggtggccggcggacctggaaccccccgcctcgcatggtatctggatggccagctccaggaagcctccacttccaggctgctttcagtcggcggagaagcattctcaggtggcacctctactttcacggttacagctcaccgagctcaacacgaactcaattgtagtctccaggatccgcgaagcgggcgcagtgctaacgccagtgtgatattgaacgttcagtttaagcctgaaatagcacaggtcggcgcgaaatatcaagaagcccaaggaccagggctgctggttgtcctgtttgctctggtgagggccaatccaccagccaacgtcacatggatagatcaggacggcccagtgaccgtgaacacaagcgatttcttggtcctggacgcccagaactacccatggttgacaaaccacacagtgcaactgcagctccggtccctggcgcataatctgtccgtggtggccactaacgatgtaggagttacttctgccagtctcccggctccaggccttctcgccacgagggtagaggttcccttgctaggaatagtagtggccgccggtcttgcgctgggcacgctcgtcgggttctctactctcgtcgcctgccttgtctgtcgcaaggaaaagaaaacaaaaggcccttccagacacccatccttgatctcctccgattcgaacaacctgaagcttaacaatgtgcgacttccaagagagaatatgagtttacccagcaacttacagctgaatgacctcacccccgactcccgcgccgtaaaaccagctgaccgacagatggctcaaaacaactcacgcccggaactgctggaccctgagccaggtggactgctgacctcgcaaggtcgcaggaaccaggacaaggatgcctag

SEQ ID NO: 138626 - DNA, 969 bp, Artificial Sequence
  Description of Artificial Sequence: Synthetic coding sequence
atggcgctgccaccagggcccgcagccttgaggcacactctgctattactgcctgcactcctctcgtcaggttggggggagctggaaccgcaaatagacgggcagacctgggccgagcgggctctgcgggagaatgagcgacatgcattcacatgccgcgttgctggtggccccggcacgcccaggttggcctggtatttagacgggcagctgcaggaggcatcaaccagtcggctattgtcagtgggtggcgaagcttttagcggtgggaccagcacattcacggttactgctcatagggcacaacatgagctgaattgcagtctgcaggaccctaggtcaggccgctccgctaatgcatctgtgattctgaacgtgcagtttaaacccgaaatcgctcaggtgggggccaagtatcaggaagcacaaggacccgggctgctggtggtgctgttcgcactggtaagagccaatcctccggctaatgttacctggatagaccaggacggcccagtcacggttaataccagtgactttttggtactggacgctcagaattatccatggctcacaaaccacactgttcagctccaactgcggtccctcgctcacaacctgtccgtcgtggccaccaatgacgtgggagtgacttccgcctctcttcccgcgcccggtcccagtcgtcacccatctctgattagttcagacagcaacaatcttaagttgaacaacgtccgtctcccccgtgaaaacatgtcactgccgagtaaccttcagttgaatgatctcacaccggatagtagggcagttaagccagccgacagacagatggcccagaataactctaggccggagttgctggatcccgaacccggcgggctgctgacttctcagggattcattcggctccctgttctgggttatatttatcgggtttcctcagtgtcttccgacgaaatctggctctag

SEQ ID NO: 138627 - DNA, 969 bp, Artificial Sequence
  Description of Artificial Sequence: Synthetic coding sequence
atggccttgccccctggtccggccgccttacgccatactttactgctgctgccggccctgctcagctccgggtggggggagctggagccacagattgatggccagacctgggccgagcgggctcttcgcgagaatgagcgccatgcatttacttgcagggtggccggcggacccggcacaccccgtctggcgtggtatctggacggtcagctgcaggaggcttccacttcccgactgctgtcagttgggggcgaggcctttagtggcgggacgagcacattcacagtgaccgctcaccgggcgcagcatgaactcaactgctccttgcaggacccccgctcgggaagatccgctaatgcatcggtcatcctcaatgttcaatttaagccagaaatcgcacaggttggagcaaaataccaggaagcccagggccctggactgctcgtggtgctgttcgcacttgtccgagccaatcctcctgccaacgtgacatggatcgaccaggatggacctgtgacagtgaacacgtctgactttctggttctagacgctcagaattacccatggctcactaatcacacagtgcagctgcagctcaggagtctcgcccacaacttatccgtggttgcaaccaatgatgtgggagttacgtccgcttccctgccggcaccgggacctagtcgccacccgagcctcatcagcagtgactccaataatttgaagctcaataacgttcgtctccctcgcgagaatatgtcactcccctcaaatctccagctgaacgatttgacacctgattcgcgcgccgtaaagccagccgacagacaaatggcccaaaataattcgcggccggagcttctggaccccgagcccggaggactgctgacctcccagggatttatcagattgcccgtcctggggtatatctaccgggtgagcagcgtgtcgtctgacgaaatctggttgtag

SEQ ID NO: 138628 - DNA, 921 bp, Artificial Sequence
  Description of Artificial Sequence: Synthetic coding sequence
atggcccttcccccaggccccgccgctctgcgtcataccctgctgctgctccctgctctgttgtcaagcggatggggggagttggaaccccagatcgatggccagacctgggccgaacgcgccctgagggaaaatgagaggcacgcttttacctgccgggtggcaggcggccccggcaccccaaggttagcctggtacctcgacggccagctccaggaggcttctactagtcgactcttgtctgtcggtggagaggcgttctccggtggcacatctacttttacagttactgctcacagagcccagcacgagcttaactgcagtctgcaagaccctcgctctgggcggtctgctaatgcctcagttatactgaatgtgcagtttaagccggaaattgcgcaggtgggagcaaagtatcaagaggcacagggccccggtctcctcgtcgtgctgtttgctttggttcgagcgaacccccctgctaacgtgacttggatcgaccaagacggcccagtgacagttaatacgagcgactttctcgtcctggatgcacagaactatccgtggctgacaaaccacaccgtgcagcttcaactgaggagcctggcccataatctgagcgtggtggccacaaatgacgtgggggtgacttctgcatcacttcccgcgcctggtcctagtaggcatccgagcctgatcagctcagactcaaacaatctaaagctgaataatgtcaggttacctagagaaaacatgtctttgcctagcaatctgcagctgaacgatcttacaccggacagtcgtgtgaaacccgcagaccgacagatggcgcaaaacaattcgagaccagagttactggaccctgagccgggcgggctgttaacgtcccagggcaggcgtaatcaagataaagacgcttag

SEQ ID NO: 138629 - DNA, 1146 bp, Artificial Sequence
  Description of Artificial Sequence: Synthetic coding sequence
atggctttacctccgggccccgcagctctcaggcatactctattactcttgccagctctgctgtcttctggctggggcgagttggagcctcagatagatgggcagacatgggcagagagagctctgcgggagaatgagaggcatgccttcacctgtcgagtggctggtggacctgggacgccgcgcctggcgtggtatttggacggacaacttcaggaagcttctacttctcggctgctgtcagtgggtggcgaagcattttcagggggcactagcacattcactgtaactgctcacagagcacagcacgagctaaactgctccctgcaggacccccggagtggcagatcagctaatgccagcgtcatcctcaacgtccagtttaagcctgagatcgcccaggtgggcgccaagtatcaggaggcacagggccccgggctactcgttgtgctattcgctctggtgagggctaacccccctgcaaacgtgacttggattgatcaggacggccctgtgactgtaaataccagtgactttctggtgttagatgcacagaactatccctggctgaccaatcacaccgttcagctgcagctgcggtcattagcacataatctgtctgttgtagccactaatgatgtaggggtcacctctgcaagcctgcctgcacccggccttctcgcgacaagagttgaggtgccactgctgggcattgtcgtggccgctgggctggctctgggcaccctagtcgggtttagcactcttgtagcatgcctcgtctgtcgcaaggagaagaaaaccaaagggcccagccgccacccaagccttatcagcagcgactccaacaacctcaaacttaataacgtacgactgccaagggaaaatatgagcttaccatccaatctacagcttaatgatctaacccctgattctcgggttaagcctgccgaccgtcagatggcccagaacaattctaggcccgagctgctggatccagaaccggggggtctgcttaccagccaggcttgcctgctgcatcacgggacccctgcgctgacgaacccctggctaccgcaccagcaggagggcgccctgccgggagggtggtccccccaggcccataactctactgtatggaaactctag

SEQ ID NO: 138630 - DNA, 810 bp, Artificial Sequence
  Description of Artificial Sequence: Synthetic coding sequence
atggctctgccacccggcccagctgccctgagacacacactgctgctcctgccagccctgctgtcaagcgggtggggggaactagaaccacaaattgacgggcagacatgggccgagagggcgcttagagagaatgagagacatgcctttacctgtcgagtagctgggggtcccggaactccgaggctggcctggtaccttgatggccagctgcaagaggcttcgacatcccgcttgttgtcagtgggcggggaggctttcagcggagggaccagcacattcacagtcacagcccaccgtgcgcaacatgagctcaattgttctctgcaggatccacgatccgggaggtctgccaacgcctcagttatcctcaacgtccagtggcttttggccacccgtgtggaagtgccactgctgggtatagtcgtcgcagccggcctggccttgggaaccctggtgggattcagtacgctcgtggcatgtctcgtttgccgcaaagaaaagaagactaaaggtcccagtcgtcatccctcacttataagctccgactcaaacaatctcaaactcaacaatgtccgcttacccagagaaaacatgtcccttccgagcaatttacaactcaacgacttgacccctgacagccgcgccgtgaaacccgcggacagacagatggcacagaacaactctcgacccgagttgttagacccagagccaggaggattacttacatctcaggggttcattcgattgcccgttcttggctacatttacagggtgtcgagcgtctcttcagacgagatttggctctag

SEQ ID NO: 138631 - DNA, 669 bp, Artificial Sequence
  Description of Artificial Sequence: Synthetic coding sequence
atgctctggctcctgttttttctagttaccgctatacacgcggagctctgccagccaggtgccgaaaacgccttcaaggtgcggctgtccattcgtacagcgctgggcgacaaggcctacgcctgggacaccaacgaggagtacctgtttaaggcgatggtcgccttctcaatgagaaaggttccaaaccgcgaagcaaccgaaatctcccatgtgctcctgtgcaacgtgacacagcgagtcagcttctggtttgtagtgactgacccatctaagaatcatacacttcctgccgtggaagtccagtctgccatcagaatgaataagaacagaattaacaatgcttttttcctaaatgaccagacactcgaattcctgaaaattccctccactctggcaccccctatggacccctccgtgcccatctggataatcattttcggagttatcttctgtattatcatcgtggccattgccctgttgattctgtccggcatctggcagcggagacgcaaaaacaaggagccaagcgaggtcgatgatgctgaggacaaatgtgaaaacatgattactatcgagaatggcatcccttccgatcctttggacatgaagggaggccacattaatgacgcattcatgactgaggatgaacggctgacccccttatag

SEQ ID NO: 138632 - DNA, 252 bp, Artificial Sequence
  Description of Artificial Sequence: Synthetic coding sequence
atgttgaggaatctactggctttgcgccagataggacagcgaactatttctactgcctctcgccgccatttcaaaaataaggtgcccgaaaagcagaaactgttccaggaggatgatgaaatcccactttacctgaaaggaggggtcgccgacgcactgctgtacagagcgacgatgatcctgaccgtaggcggtactgcctatgcaatttacgagctcgccgtcgctagtttccctaagaagcaggagtag

SEQ ID NO: 138633 - DNA, 729 bp, Artificial Sequence
  Description of Artificial Sequence: Synthetic coding sequence
atgtactacggactgtctaatttctaccagaaccaccgccgctacgtgaaaagtcgtgacgacagtcagctcaacggtgactcctctgctctgctgaacccctctaaggaatgtgagccataccggagaaatgaggacaagccaatcgcaccttgtggagctattgctaactccatgtttaacgacaccctggagctgtttctcataggaaatgatagttatcccattccgattgcactcaaaaagaaggggatcgcgtggtggacagacaaaaatgtaaagtttcgaaaccccccaggcggggacaacttggaggaaagattcaaagggaccacaaaacccgtcaactggctgaagcccgtatatatgcttgactcagaccctgacaataacggattcattaacgaagatttcatcgtatggatgcgcacagctgccctgccgacgtttcgaaagctttacagactgatcgagcgcaagtccgatctgcatccgacactgccggccgggcggtactccctgaatgtcacctataattatccggtgcactacttcgatgggcgtaagcgtatgatcctcagcacaatcagctggatggggggaaaaaacccgttcttgggtatcgcctacattgccgtgggcagtataagtttcctgctgggagtcgttctgctagttatcaaccataaatacagaaattcctcaaacactgccgatatcactatctag

SEQ ID NO: 138634 - DNA, 978 bp, Artificial Sequence
  Description of Artificial Sequence: Synthetic coding sequence
atggccatgaactacaacgcaaaggatgaagtggatggagggccaccatgcgctccaggcggaactgctaagacccgtcgcccggataataccgccttcaagcagcagaggctcccagcttggcagcccatcttaacagctggaaccgtgctgcctattttcttcataataggactgatttttatacccatcggcattggtatattcgtgacctctaataatatcagagagatcgaaggaaacgtgttcatgtattacggcctctccaatttctaccagaatcacaggcggtacgtgaagtctcgggatgatagccagcttaatggcgattccagcgccttgttgaaccctagcaaggaatgcgagccctaccgccggaacgaggataaacccatcgcgccatgtggcgcgatagccaattctatgtttaacgacaccctggaattgttcctgatcggcaacgactcctacccaatccccatcgccctaaagaagaaagggattgcatggtggacagacaaaaacgtgaagttcagaaacccccccggaggcgacaacctggaggaacggtttaagggtaccaccaaacctgtgaattggctgaagccggtatatatgctggactccgatcctgacaacaatgggtttattaacgaggactttattgtctggatgaggacggccgccttaccgacctttcggaagttgtacaggctcatagaacggaagagcgatctacatccgactcttccggctggtcggtatagtctcaacgtaacctataactatcccgtgcattattttgacggacgaaagcgtatgattttgagtaccataagctggatgggtgggaaaaatccttttctgggcattgcctacattgcagttggctccatcagcttcctgctcggagtcgtgttgctggtcattaaccataagtaccgcaacagcagcaacaccgccgacatcaccatctag

SEQ ID NO: 138635 - DNA, 234 bp, Artificial Sequence
  Description of Artificial Sequence: Synthetic coding sequence
atgtactacgggttatctaacttttaccagaaccaccgccggtacgtcaagtcccgcgacgacagccaattaaatggagactcgagtgccctcctgaatccgtctaaagagtgtgaaccctacaggcgtaacgaagacaagccgattgcaccatgcggggccatcgcgaatagcatgttcaacgacacactggagctgtttttaatcggtaacgactcttaccctattccatag

SEQ ID NO: 138636 - DNA, 1038 bp, Artificial Sequence
  Description of Artificial Sequence: Synthetic coding sequence
atggccatgaattacactgccaagacgcgtcgtcccgataatactgctttcaagcaacagaggctgccagcttggcagccaattctgacggcaggcacagtgctacctatcttttttatcattggcctcatcttcatccctatcggcatcgggatatttgtcacttcaaacaatatccgggaaatcgaaattgattacaccggcaccgagccatcgtcaccgtgtaataaatgtctgagccccgacgtgacaccatgtttttgcaccattaactttaccctggagaaaagcttcgagggtaatgtcttcatgtactatgggttgagcaatttttaccaaaaccatcgccgatacgtcaagtccagagatgatagccagcttaatggtgattctagcgctctgctgaacccgagcaaggaatgcgagccctataggcgtaacgaggacaaacctatcgccccatgcggagctattgcgaacagcatgtttaatgacacactggagctcttcctgataggtaatgattcctatccaatacccatagccctcaagaaaaaggggatcgcgtggtggacagataagaacgtgaagttccgcaaccctcccggcggggataatctcgaagagcgctttaagggcacaaccaaaccggtcaattggctgaagcctgtgtacatgcttgattccgaccccgacaacaatgggttcattaacgaagacttcatcgtatggatgcgcactgctgctctgcctaccttcaggaaattatacaggttgatcgaaaggaagtccgacttgcaccccactctccctgcagggaggtactcactgaacgtgacctacaactatccagtacactactttgatggcagaaagcggatgatactttccaccatctcctggatgggtggcaagaacccgtttctgggaatcgcctacatcgctgttggatccataagtttcctgctcggcgtcgtccttctagtgattaatcataaatatcggaattcttctaacaccgcagacattacaatttag

SEQ ID NO: 138637 - DNA, 1056 bp, Artificial Sequence
  Description of Artificial Sequence: Synthetic coding sequence
atgacctggagcgcgactgcccggggagcccaccagccggacaacacagctttcacacagcagagactgcccgcatggcaacccctcttaagtgcatctatagcactgccccttttcttttgtgccggactggcattcattggcctcggtctaggactatattacagtagcaacggaatcaaggagctggaatacgattacactggtgacccagggaccgggaattgttctgtatgcgctgctgcaggacagggaagggctctgccacccccctgttcctgcgcatggtatttctccctccccgaattatttcagggtcccgtgtatctttattatgaacttactaacttctaccagaataaccggcgctatggcgtgtcccgcgatgatgcccaactgagtggacttccctctgccttgaggcatcctgtgaatgaatgcgccccctaccagagatccgcagctggcttgcctattgcaccgtgcggagctatagccaacagtttgtttaacgacagctttagtctgtggcatcaaaggcagccgggcggtccttacgtggaggttcccctggacagatccggtatcgcatggtggacagactaccacgtaaaattccggaatccgcctttggtcaacgggtccctcgcactcgccttccagggcactgccccgcccccgaattggcggaggccggtgtacgaactatcccctgacccaaataacaccggcttcattaatcaggacttcgtcgtgtggatgaggacagctgccttgcccacttttcgcaagctctatgcccgcatccgccaaggaaattactcagctgggctgccacggggggcctatcgcgttaacatcacctacaattaccccgtcagggcctttggaggccataaactgctgatcttttcaagcataagctggatgggtggcaagaacccattcttggggattgcatatctggtcgttggctctctctgcattttaacaggattcgtgatgctggtggtttacattaggtaccaggaccaagacgacgacgacgaggaatag

SEQ ID NO: 138638 - DNA, 1056 bp, Artificial Sequence
  Description of Artificial Sequence: Synthetic coding sequence
atgacctggtctgcaacggccaggggagcccaccagccagacaataccgcctttacccagcagcggttgcccgcttggcagcccctgctgtccgctagcattgcgctgccccttttcttctgcgcaggactggcattcatcggccttgggctaggactttactactctagcaacggtataaaggagctggagtatgactatacaggtgaccccgggactggtaactgctccgtctgcgctgccgctggtcagggccgagctctgccaccaccctgtagctgtgcatggtatttctctctccctgagctgtttcaggggccagtatacttatattacgagcttacaaatttttaccagaataaccgtcgatacggcgtgtctcgggacgacgcccaactgagtgggttgcccagtgccttgcggcatccggtgaatgagtgcgcaccttaccaaaggtctgccgccggccttcctattgctccttgtggcgctatcgccaatagtttgtttaatgactctttctccctctggcaccagaggcagcccggagggccttacgtagaagttcccctcgataggtccggcattgcctggtggacggattatcacgtgaagttccggaaccctccactcgtcaacggatcgttggctctggcattccagggcacggcaccccctcccaactggaggcgacctgtatatgagctcagtcccgaccctaacaacaccggcttcatcaaccaagacttcgtagtttggatgcgaacggcggctctccccaccttccgaaagctctacgccaggattcggcagggtaattatagcgccggccttcctcgaggcgcgtacagggtaaacatcacctataactaccctgtaagggccttcggaggtcataaacttctgatcttctcatccatttcatggatgggcgggaagaacccttttcttgggattgcctacctcgtcgtgggttcactgtgcatcctgacgggattcgtaatgttggtggtctatatcagataccaggatcaggatgatgatgacgaagagtag

SEQ ID NO: 138639 - DNA, 342 bp, Artificial Sequence
  Description of Artificial Sequence: Synthetic coding sequence
atggaggaaagggcgcagcactgcctttcgcgcctattggataatagcgccctgaaacagcaggagttgccaatccatcgcctgtatttcacggcacgtagagtactcttcgtctttttcgccactggcatcttctgtctctgcatgggcattatcttgatcctgtctgctcgctctacacaagaaattgagatcaattacacacggatctgtgcaaactgtgcaaagctccgcgagaatgcatctaactttgataaggaatgtacttgttccattcctttttacttaagcggtaagatgatggtgggagaaatccaagagacgcggctcactctccactag

SEQ ID NO: 138640 - DNA, 207 bp, Artificial Sequence
  Description of Artificial Sequence: Synthetic coding sequence
taattatgcatgggaattatcctaatactcagcgcccggtctacgcaagaaatagagatcaactatacgaggatttgtgcgaactgcgctaagctgagagagaatgcaagtaacttcgataaggagtgcacttgttcaatccccttctatctgtccgggaaaatgatggtcggggaaatccaggagacaaggctgacgttgcattag

SEQ ID NO: 138641 - DNA, 1203 bp, Artificial Sequence
  Description of Artificial Sequence: Synthetic coding sequence
atggccgctaactattcctcaacaagcaccagaagagagcacgttaaagtcaagacaagcagtcagcctggcttcctggaaagactgagtgagacaagcggaggaatgtttgttggtctcatggctttcctcttgtcattttacctcatcttcactaacgaaggacgggctctgaaaacagccacaagtctagcagagggactgagccttgtggtctctccagatagcatccatagtgtggccccagaaaatgagggcagactggtgcatataatcggggctctcagaacgagcaagctactgagcgatccaaactacggcgttcatctgccagccgtgaaactgagacgtcatgtggaaatgtatcagtgggtcgaaactgaggaaagtcgtgagtataccgaagatggccaggtgaagaaagaaacacggtattcttacaataccgagtggcgctctgagatcataaatagtaagaattttgacagagagatcgggcacaaaaaccccagtgcgatggccgtggaatcattcatggcgaccgcacccttcgtgcagatcggaaggtttttccttagttcagggctcatcgacaaggtagataacttcaaaagcctaagtctcagtaaattggaggatccgcacgtggacatcatccgtcgaggagacttcttttaccactcggagaatcctaagtatccggaggtcggcgatttaagagtctccttcagctacgcgggtctgtcgggggatgatcccgatctaggccctgcacacgtggtaacagtcatagctcgacaacggggggaccagctcgtgcctttctctaccaagtccggggacacgctcttactgctgcatcatggagatttctcggccgaagaggttttccatagagagcttagatccaactctatgaaaacctgggggcttagagcagcaggatggatggctatgttcatggggctgaacctgatgacacgcattctttataccctcgtggattggttcccagtctttcgcgatttagtgaatattgggttgaaggccttcgctttttgcgtggcaactagccttacacttcttacagtggcagctgggtggctattctataggcccctctgggctcttctgattgcagggctcgccctcgtgcccattctggtcgcaaggacccgggtccccgccaaaaagttggaatag

SEQ ID NO: 138642 - DNA, 546 bp, Artificial Sequence
  Description of Artificial Sequence: Synthetic coding sequence
atggcctctgctggatctggtatggaggaggtgcgggtctcagtgttgaccccgcttaaactggtgggtttggtgtgcatcttcttggccttatgcctggacctgggcgcagttctcagcccagcctgggtgactgctgaccaccagtattatcttagcttatgggagagctgtagaaaacccgcttcgctcgacatttggcactgcgagtccacattaagcagcgactggcaaattgcaaccttggctctgttgctaggcggggccgccattatcctcatcgcattcctcgtgggcctgatttcaatttgcgttggctcacgacggagattctatcgcccagtggccgtgatgctgtttgcagctgtcgttctccaggtatgctctctggtgctctatcccatcaaattcattgagacagtgtccctgaagatctatcacgagttcaactggggctacggactggcatggggcgcgacaatcttctcctttgggggagctatcttgtattgcttaaaccccaagaattatgaggattattactag

SEQ ID NO: 138643 - DNA, 2745 bp, Artificial Sequence
  Description of Artificial Sequence: Synthetic coding sequence
atgggccctttcaagagctcagtattcattctgattctgcatctcttggaaggagctctgtccaactccttgatacaactgaataataacggttatgagggcatcgtggtggctattgatcccaacgtacccgaagacgaaactttaattcagcagatcaaggacatggtgacacaagctagtctatacctcctcgaggctactggaaagagattttacttcaagaacgttgctatcttgattcccgagacttggaagaccaaagcggactatgtacgccctaagctggaaacttataagaacgctgatgtgctggtcgctgagtctactcctcccggaaatgatgagccatacactgagcagatgggtaactgtggggagaaaggagagaggattcacctgactcctgatttcattgccgggaagaagcttgccgaatacgggcctcagggcagggcttttgtccatgaatgggctcacctccgctggggggtgttcgacgagtataacaacgatgaaaagttttacttaagcaatggcagaattcaggcagttagatgctccgcaggtattaccggaacaaacgtggtgaagaaatgtcagggaggaagttgttacacaaaaagatgtaccttcaacaaggttaccggactttatgagaaaggctgcgagtttgttctccagagtcgacagacagagaaggcttcgatcatgtttgctcaacatgtggactcgatcgtagagttttgtacggaacagaatcacaataaggaggcaccaaacaaacagaaccagaagtgtaacctgagatctacctgggaagtgatacgcgacagcgaagatttcaaaaagacaacacccatgactacccagcctcccaatcccaccttcagcctgctccagatcggtcagcgcattgtctgtttggtcttagataaaagcggcagcatggcaacaggtaacagactgaacaggctgaatcaagccggtcagttgttcctgttacagacggtggaactaggcagctgggttggcatggtgacattcgactctgccgcccacgttcagaacgagttgatccaaattaactcaggctccgatcgggacacgttagcgaaaaggctccccgcagcagcttccggcggtacttcaatctgttctggactcagatctgccttcacggtaattcgtaagaagtaccccaccgacggatccgagatcgtacttctgacagatggtgaggacaatacaatcagtggctgcttcaatgaagtgaagcagagcggagctatcattcacacggtggcccttggcccgtcagctgctcaggaattagaggaactttctaagatgacgggtgggctgcaaacatacgcctcagaccaggtccagaacaatggcctgattgacgccttcggcgcactatctagcggcaacggagcggtctcccagagaagtatccaactggaatcaaaaggcctgacacttcagaatagccaatggatgaatgggacagttatcgtggactcaacggtgggcaaagatactctgtttttgataacttggactatgcaacccccccagattctgttgtgggacccgtccggtcagaaacagggcggattcgtcgtggataaaaacacaaagatggcctacctgcagatcccaggaattgcaaaggtggggacctggaagtacagcctgcaagcctcttcccaaaccttaactctaactgtcacgtctagggcttccaatgctacattgccgccgatcacagtcacaagcaaaacgaataaagataccagcaagtttccaagtcctctcgtggtctacgccaacattagacagggggcaagccccattctcagggcaagtgtgacagcccttatcgaaagtgtgaacggaaagacagtcaccctggaactactagacaacggggccggtgcagacgcaacaaaggacgacggggtctacagccgctattttacaacctatgatacgaacgggcgctactcggttaaggtccgagcactcggcggggttaacgctgctcgccgaagagtaatcccccagcagtctggagctctttatatcccagggtggattgagaacgatgaaatccaatggaacccacctcgcccagaaatcaacaaggacgacgtacagcacaagcaggtgtgctttagcagaaccagttcaggtggttctttcgtcgctagcgatgtccctaatgctcctatccctgatctgttccctccaggccaaatcactgacctgaaggctgaaatacacgggggctcgttaatcaatcttacctggactgcaccaggagacgactatgatcatggtacggcacacaagtacatcattcgcatatctacaagcattctcgatctgcgcgataaattcaatgagtcccttcaagtcaataccactgcactgatacccaaggaggccaatagcgaagaggtgttcttgtttaagcccgaaaatataacatttgagaacggcactgacctcttcatcgctatacaggcggtcgacaaggtagacctgaagtccgagatctctaacatcgcacgggtcagtcttttcatccccccacagactccaccagaaactccatctcccgacgagacgtcagccccgtgtcccaatatccatattaacagcactatccccggtatacacatcctgaagatcatgtggaaatggatcggagaactgcagctctctatcgcttag

SEQ ID NO: 138644 - DNA, 1674 bp, Artificial Sequence
  Description of Artificial Sequence: Synthetic coding sequence
atggccactgctgtctcccgcccttgcgcagggaggagccgcgatattctgtggagagtgcttgggtggagaatcgtggcctctatcgtttggagcgttttgtttcttcccatttgcaccaccgtttttatcatcttttctcgcatcgacttattccacccgatacagtggcttagtgacagttttagcgacctttacagctcttacgtgattttctacttcctattgctctcagtcgtaatcattattatttcaatttttaacgtggagttttatgcagtggtaccgagtattccatgttcacgactggccctcatcggaaaaattattcatccccagcagctgatgcattcatttatccatgcagccatgggaatggttatggcttggtgtgccgctgtgatcacgcagggtcagtatagcttcctcgtcgtgccctgtaccggcactaattccttcgggtctcccgcagcccagacgtgcctaaatgagtaccacttgtttttcctgctcacaggcgccttcatgggttattcctacagcctgctctactttgtgaataatatgaactatctgccgttcccaataattcaacagtacaaatttttacgctttcgaagaagcctcctgctgcttgtgaaacatagttgcgtggaaagcctgtttctggttagaaacttctgtattctgtactatttcctgggctacatacctaaagcatggatctccaccgccatgaatcttcacattgatgagcaggtgcaccgtccccttgatacagtctcgggcctcctgaacttgagcttgctgtatcacgtttggctgtgcggggtttttcttctcacaacctggtacgtgagctggattctcttcaagatatacgccactgaagcacacgtcttcccagtgcagccacccttcgccgagggatccgacgagtgcctgccgaaggtgctaaatagcaaccctccaccaatcatcaaatatctcgctcttcaggaccttatgctgttgtcacaatattctccttcaagacgacaggaagtgttttccctgagccagcctggcggtcacccacataactggaccgcaatctcccgtgagtgcctaaacttgcttaacgagatgactgagttcagtaatccctcaccaagtacaagcatatccgccgagggcaagaccatgagacagccctcagtcatatattcctggatccaaaacaagagggagcagatcaagaactttctctctaagagggtccttatcatgtacttctttagtaaacaccccgaggcctcaattcaagccgtgttttctgatgcccagatgcatatctgggccctggaaggtcttagccaccttgtggcagctagcttcacggaagaccgtttcggagttgtgcagaccacattgcccgctattctgaacactctcctcacactccaggaggccgtggacaaatacttcaagctccctcacgcatcatcaaaacctccacggatatctggaagcctcgtcgacacaagctacaaaacacttcgctttgcgtttcgggcctcactaaaaaccgccatttatcgaattacaacaaccttcggagaacacctcaatgcagtgcaggctagcgccgagcaccagaagcggctgcaacaatttctggagtttaaagagtag

SEQ ID NO: 138645 - DNA, 2025 bp, Artificial Sequence
  Description of Artificial Sequence: Synthetic coding sequence
atggctacggctgtgtcacggccttgcgcaggcaggagtagagacattttgtggagggtgctcggctggaggatcgtcgcatcaatagtctggtcagtgttatttctgcccatttgcaccacggtgttcatcattttctcgagaattgatctttttcaccccatccaatggctcagcgactcattcagcgatctgtactcgtcctatgtgatcttttacttcctgcttctgagtgtcgttatcataatcatcagcatctttaacgtggaattttatgccgtggtaccgagtatcccctgttcacgcctggctctgataggcaagatcatccacccccagcagctcatgcatagttttattcacgccgcgatggggatggttatggcctggtgtgcagcggtgatcactcaaggtcaatattcatttctcgtggtgccctgtactggaacaaattccttcgggtctccggccgcccagacatgccttaacgagtaccacttatttttcctcctgaccggcgccttcatgggctattcgtattccctgttgtactttgtgaacaacatgaattatctaccattcccaataattcaacaatacaagtttttaagattcagacgatcattactgctgttagtgaagcacagttgtgtcgagagcctgtttcttgtaagaaacttttgtatactgtattactttctaggctatatcccaaaagcctggataagtactgcaatgaaccttcacattgatgagcaggtgcatcgcccgctagacaccgtatccggtctccttaacctttcactgctttatcacgtgtggctgtgcggtgtttttctgctaaccacatggtacgtctcttggattctgttcaaaatttacgccacagaagcccacgtgtttcccgtgcagccaccctttgcagaaggctcagacgagtgcctgcccaaggtgttgaactcaaaccctccccctatcattaaatacctagctctccaggacctgatgcttttgtctcaatactctcccagtagacgtcaggaggtattcagcctgagccagcccggcggccatcctcacaattggacagccatcagcagggaatgtctaaatctactaaacggaatgactcagaagctgatactttaccaagaagccgcggcaaccaatggccgcgtttcttcctcctatcccgtcgaacccaagaagctgaactcgccggaagaaacagcttttcagacccccaagtctagtcaaatgccaaggccgagcgttccaccacttgtaaaaacatccctgttttcgtctaagctatctactccggacgttgtttccccttttgggacaccattcggcagttcagttatgaatcggatggctggcatatttgatgtcaatacatgttacgggtccccacagtccccccagctgattcgccgcggcccccgattgtggacgtccgcaagtgaccaacagatgacagaattcagcaacccgagcccatccaccagcattagtgctgaggggaagactatgcgacagccatctgtgatctattcctggattcagaacaagcgggagcagataaaaaactttctttcaaaaagggttttaattatgtacttcttctctaaacaccccgaggccagcatccaagctgtgttttccgacgcgcaaatgcatatttgggcgctcgaaggactgtcccacctcgtcgccgccagctttaccgaagatagattcggggtcgtgcagacaacactgcctgccatcttgaataccctactgacacttcaggaggccgtggacaagtacttcaagctgccgcatgcttcttccaaaccaccacgtattagcggctcactggtggacactagctataagacacttagattcgccttcagggcttctctgaaaacagctatatataggatcactaccacatttggagagcacctcaatgccgtccaggcctctgcagaacaccagaagcggttgcagcagttcttggagttcaaggagtag

SEQ ID NO: 138646 - DNA, 1020 bp, Artificial Sequence
  Description of Artificial Sequence: Synthetic coding sequence
atgctgctgtcccagtatagcccttctaggcgtcaggaggtgttttctctctcccagcctggggggcatccccacaactggacagccatctccagagaatgtctcaacctgctaaatgggatgacacagaagctgattctctatcaggaggccgccgccacaaatgggcgagtgtcatcaagctaccctgtggagcccaaaaaactgaactcaccggaggagacagcctttcagactcccaagagcagccagatgcctcggccctcagtcccccccctggtgaaaacaagccttttttccagcaagttaagcaccccggatgtcgtgtcaccgtttgggaccccattcgggtccagtgtgatgaaccgtatggccgggattttcgatgtaaacacttgttacgggagtccacaatcccctcagcttatccggcgtggccctcgactgtggacttctgcttccgatcagcagatgaccgagttttctaacccatctccgtccacctctatctctgcagaaggcaagactatgaggcagccttctgtaatctactcctggatacagaataagagggagcagataaagaatttcctgagcaaaagagtgctgattatgtacttcttctctaagcaccccgaagcttcaatccaagctgtgttctccgacgcccagatgcatatctgggccctggaaggcctttcccatttggtggccgcttctttcaccgaggaccgcttcggagttgttcagacaactctgccggcgatcttaaacaccctgctgaccctgcaggaggctgtcgataagtacttcaagctgcctcatgcctcatctaaaccaccccgaatctctggatccttggtggatacatcctataaaacgttgcgctttgcttttcgcgcttccctgaagaccgcaatataccggatcactacgaccttcggtgagcacctcaatgccgtgcaggcgagcgctgaacaccagaagaggttgcagcaattcctggagttcaaagaatag

SEQ ID NO: 138647 - DNA, 1629 bp, Artificial Sequence
  Description of Artificial Sequence: Synthetic coding sequence
atggctaccgcggtgtcccgaccctgcgccggccgctctcgtgacatcctttggcgagtcctcggctggcgaatagtggcgagcatagtgtggtctgttctgtttttgccgatttgcaccaccgtgtttatcatttttagtaggatcgatctttttcaccccatccagtggctgtcagattcattcagtgacctgtattcttcctacgttatattctactttttattgctctcagtggtcattattatcatctctatttttaacgtggagttctacgctgtcgtaccatctattccatgctccaggctggccctgatcggcaaaatcatccacccgcagcagttgatgcactcattcatccacgcagctatgggcatggtaatggcctggtgtgccgccgtcataacacagggtcagtacagttttctggtagtcccttgcaccggtaccaatagtttcgggtcccccgccgcccagacttgcttgaacgaatatcatctgttctttttgctgacaggggcctttatgggctactcatatagcctgctttattttgttaacaacatgaactacctcccatttccgattatccaacagtataaatttcttagattccggcgttcactgctccttctggtcaaacatagttgcgtggaatctcttttccttgtgcgcaatttctgtatcctgtattattttcttgggtatattcccaaagcttggatctccaccgcgatgaacctgcacatagacgagcaggttcaccgtccgctggatactgtgtctggtctcctgaacctgtctttactctaccatgtgtggttgtgtggcgtgtttctccttacgacttggtatgtctcctggatcctgtttaaaatttacgccaccgaggctcacgtgtttcccgtgcagcccccttttgcggaaggtagtgacgagtgtctgccaaaggtcctgaactctaacccaccacctataattaaataccttgccctgcaggacctgatgctgctgagccagtatagtccgtctcggagacaagaggtgttctccttgtcacagccaggtggccacccacataactggaccgcaatctcccgcgaatgcctaaatctgttaaatgggatgactcagaaactaattctatatcaggaagctgcggctaccaacggtagggtcagttcatcctatcctgtcgaacccaagaagctgaacagcccagaggaaactgccttccagactccaaagagcagtcagatgccaaggccaagcgtgccccctctggttaagactagtctcttctcctccaaactaagtaccccggacgtggtcagccctttcggtactccatttggaagctcagtaatgaacagaatggctggaatcttcgacgtgaacacctgttacgggagtccccagtcaccacagttgatcagacggggtcctaggctttggaccagtgcatcagatcaacaaatgacagaatttagtaacccttctccgagcactagcataagcgcagaagcaccacggggcctgcattccggatgtttttttagatgtcccaatgcgtacctgggaatcaggcggtccgtggcactttcttcaagcatcatctacagaggatag

SEQ ID NO: 138648 - DNA, 1332 bp, Artificial Sequence
  Description of Artificial Sequence: Synthetic coding sequence
atgaggctcacacgcaaacgactgtgttcgttcctcattgctctgtattgcttgttctcactctatgccgcatatcatgtgttcttcgggcggcggcgccaggccccagccgggtcccccaggggcctgagaaagggtgcagcaccggcacgcgagagacgtgggagggagcagtccactctggaatctgaagaatggaatccgtgggagggcgatgaaaaaaatgagcagcaacaccggttcaaaaccagtctgcagatcctagacaaatctaccaaagggaaaacggacttatctgtacagatttggggaaaggccgccattggcttgtacctgtgggagcacatcttcgaaggactgctggatccctccgatgtgaccgcgcagtggagagaaggtaagtctattgtcggacggacccagtattcttttatcacagggccggccgtaattcctggttatttttccgtggacgtgaataatgtcgtgctgattctgaatggacgtgagaaggccaagatcttctatgctacccaatggctcttgtatgcccagaatctggtccagattcagaagctgcagcatctcgcggttgttttactcggtaatgagcactgcgataatgagtggatcaatcctttcctgaaacggaatggaggttttgtggaattactttttatcatatacgactccccctggatcaatgacgtggatgtgttccaatggcccctgggtgtggctacctaccgaaactttcccgttgtggaggccagttggagtatgttgcacgacgaaagaccctatttgtgtaacttcttggggaccatttacgagaatagttccaggcaagccctaatgaacatactgaagaaagatggcaatgataagctgtgctgggtgagtgcacgcgaacactggcagccccaggagactaacgagtccctgaagaactaccaggacgctctgctacagtcagacttgaccctttgccctgtcggcgttaatactgagtgttacagaatttatgaagcgtgctcctatggaagcattcccgtggttgaggacgtgatgactgccggtaactgtggcaacacctcagtgcaccatggcgccccgttacaactgctaaagtctatgggagccccatttatattcatcaaaaactggaaagagctgcccgctgtgctcgagaaagaaaaaaccataatactgcaagagaagattgaaagaaggaagatgctgctccagtggtatcagcattttaagacagaactcaagatgaaatttactaacatcctcgaaagctccttcttgatgaacaataagagttag

SEQ ID NO: 138649 - DNA, 774 bp, Artificial Sequence
  Description of Artificial Sequence: Synthetic coding sequence
atggctgccgatggagtggatgagaggagccccctcctgagcgcctcccactccggtaacgtgacccccacggcgcctccctatctccaagagagctcacctagggcggagttaccgcctccctatacagccattgcctctccggatgccagcggtattccggtgatcaattgccgtgtgtgtcagtctcttataaatcttgacggtaaactacatcagcatgtcgtcaaatgtactgtgtgcaacgaggcgactccaattaagaacccaccgaccggaaagaaatatgttagatgcccctgtaactgtctgctcatttgcaaggacacctcaagacggatcggatgtccaagaccaaactgccgacgcatcatcaacttaggaccagtgatgcttatttctgaagagcagccagcccagcccgccttgcccatccagcccgaaggaacccgggtggtttgcggccattgcggtaatactttcttatggatggaactgcgttttaataccctggcaaagtgtccacattgcaagaaaatctcttccgtcgggtccgccctccctcgtcgacggtgctgtgcctacattacaattggcatgatatgtatattcatcggtgtcgggcttacggtgggcactcccgactttgctcggcgttttcgcgctacatatgtcagttgggctattgcctatctgctcgggctgatctgcctgatcagagcttgttactggggggcaatccgagtgtcataccctgagcattcctttgcatag

SEQ ID NO: 138650 - DNA, 2745 bp, Artificial Sequence
  Description of Artificial Sequence: Synthetic coding sequence
atgtctctttcacactggccatacttccggctggtgttgaatttccggccccaagtcatttgcttgccccaacctcccaaagtcctcggctataggctggaacctccccatctgactcttgcctgcacccttgaggggatgtacaacattatcgaggagatattggaaagagacatcaatggcactctcctgtctcaagcgacctgtgagttatgcgacgggaatgaaaatagttttatggtcgtaaatgctcttggtgaccgctgcgtgagatgcgaaccgaccttcgtgaatacttcacggtcctgtgcgtgctcagaacccaatatccttaccggcggcctctgcttctccagtacaggaaattttcctctccgccggatctcagccgctcgatatggagaggtgggtatgtcactgacctccgaatggtttgccaaatacctccagagttcagcggccgcctgctgggtctatgccaatttaacctcctgtcaggcgctaggcaacatgtgcgtcatgaatatgaattcctacgactttgcaacgttcgacgcctgtgggctgtttcagttcatttttgagaatactgccgggctgagcacagtccattctatttccttctggcggcagaatctaccctggctgttttacggtgaccaactcgggctggcccctcaggtacttagttctaccagcctccctacaaactttagctttaaaggcgagaaccagaatactaagctcaagttcgtggctgcaagctacgacattagggggaatttcctgaagtggcagacactggagggtggtgtgttgcagctgtgccccgacaccgaaaccagactcaatgctgcctacagcttcgggactacataccaacagaactgcgagattccaataagcaagatcctaattgatttccctactcccatcttctatgacgtgtacctggagtatacagacgaaaatcaacaccagtatatcctcgctgttccagtcttgaaccttaatctccagcacaacaagattttcgtgaatcaggacagcaacagtggcaaatggctactgaccaggaggattttcctggtcgatgcagtctctggacgcgagaatgatctgggaacccaaccccgagtcattcgggtggctacccaaatctctctgagcgtccacctggttcccaacactatcaacggaaatatatatcctccattgatcactatcgcgtactccgacattgatataaaggacgccaacagtcagagtgtcaaagtgtcttttagcgtgacttatgagatggaccacggcgaggcacacgtccagactgacattgctctcggtgtgctgggcgggctggctgttttggcaagcctactgaagacggcggggtggaaaagacgtatcggaagtcctatgattgatctgcagacagttgtgaagttcctcgtctattacgctggcgatttagccaacgtgttctttatcatcaccgttggcacgggactatactggctgatttttttcaaagctcagaagtccgtctctgtgttgctgcctatgcctattcaggaagagcgctttgtaacctatgtgggttgcgcattcgccctgaaggctttgcagttcctacataagctcatctctcagataaccatagacgtattcttcatagattgggaaagaccaaaaggcaaggtgcttaaagccgttgagggagaaggcggagtgaggtcagccacagttccagtgtcaatctggaggacctactttgtcgccaacgaatggaacgaaatccagaccgtgagaaaaatcaactccttatttcaggtcctcactgtactgttcttcctcgaggtggtaggtttcaagaatttggccctaatggatagcagctctagcctgtcccgcaacccgccttcatacatcgctccctatagctgcatcctgcgctatgcggtgtccgccgccttgtggcttgcgatagggattattcaggtggtgtttttcgccgtgttctacgaacggtttatcgaggataaaatacggcaatttgtcgacctctgcagtatgagcaatatctcagtatttcttctgagtcacaaatgtttcggttattatatccacggccgatccgtgcacgggcacgcggataccaacatggaagaaatgaatatgaacctgaagagggaggccgagaacctgtgctcccaacgcggcttggtgccaaacactgatggccaaacattcgagattgctatttctaaccagatgagacagcactacgataggatccacgagaccctaattaggaaaaacgggcctgcccggctgctgagttcctccgccagcaccttcgaacagtccatcaaagcataccacatgatgaacaaatttctgggctcatttatcgaccatgtgcataaggagatggactattttatcaaggataagctccttctcgagagaatcctgggaatggaatttatggaaccgatggagaagtctattttttacaatgatgaggggtatagctttagctccgtattatactacggtaacgaggcaactttgctgattttcgacctactgtttttctgtgtggttgatttagcctgccagaactttatccttgcatccttcctcacttacctacagcaagagatcttcaggtacatcagaaacaccgtcgggcaaaagaacttggccagcaagaccttggtcgaccagcgtttcctcatctag

SEQ ID NO: 138651 - DNA, 2988 bp, Artificial Sequence
  Description of Artificial Sequence: Synthetic coding sequence
atggcaactcggggaggcgccggcgttgctatggcggtctggtcattactgtctgcccgcgcagtgaccgctttcctgcttctgtttctgccgcggtttctccaggcccagactttcagttttccattccagcagcccgaaaagtgtgataacaaccagtacttcgacatctccgcactctcctgtgtgccttgcggcgctaaccagcggcaggacgccagaggcacaagttgcgtatgtctgccaggattccaaatgatcagtaataacggcggtcccgccattatctgtaagaagtgcccagaaaatatgaagggagtcacggaagatggctggaattgcataagttgtccatctgaccttacagcggaagggaagtgtcactgcccaatcgggcatatcctagtggagagggacatcaatggcaccttactcagtcaggccacctgcgagctgtgtgatggtaacgagaattcctttatggtcgtaaatgctctgggcgatagatgtgtgcgatgtgaacccacctttgtgaatacatctcggtcgtgcgcgtgttctgaacccaatatcctgactggggggctgtgcttttccagtacgggcaactttccacttagaaggatctcagctgcaaggtatggtgaggtcggcatgtctctaactagtgaatggtttgcgaaatatctgcagagtagcgctgccgcctgttgggtgtatgcgaacttaacctcttgccaggctctcggcaatatgtgcgtcatgaacatgaatagttacgacttcgcaacctttgacgcttgtgggctgtttcaattcatcttcgagaacaccgccggcctgagcaccgtgcactctatctctttttggaggcagaaccttccttggcttttctacggggatcaactcggattggccccccaggtactgtctagcacttccctcccaaccaacttttctttcaaaggtgagaatcagaataccaaactcaaatttgtcgccgcatcttacgacatccgaggaaacttcctgaagtggcagacgctggaaggaggcgtccttcagttatgccccgacacagaaaccagactgaatgcagcatactcctttggaacaacttaccagcagaattgtgaaatccctatctctaaaattctgatcgattttccgactcctattttctacgacgtttatttggaatacaccgatgagaatcagcaccagtatatccttgcggtgcctgtgctgaatttaaacttgcaacacaataaaatttttgtgaatcaggattccaatagcggtaagtggttgctcacaaggcgcatctttttggtggacgcagtctcaggtagggagaatgatctcggtacccagccacgcgtcatccgagtcgcaacacaaattagtttgagtgtccacctggtgcccaatacaattaacggaaacatctacccacctcttatcacgatcgcctactcggacatcgatatcaaagacgccaatagccaatcagtgaaggtttctttctccgtaacatatgagatggaccacggcgaggcacacgtgcagacagacatcgcactcggagttttaggaggactagccgtgctcgctagcctcctgaagaccgccgggtggaagcggcgcatcggctctcccatgattgatctccagacagtggtgaagtttctagtgtattatgccggggaccttgcgaatgtcttctttataattacggtgggcactggactgtactggctgattttcttcaaagcacagaaaagcgtttccgtactgttgccaatgcccattcaggaggagcgctttgttacatacgtagggtgtgcattcgcactgaaggccctgcagtttctgcataaactgatctcacagataaccatagatgtgttcttcatagactgggaacgacccaaggggaaggtgctgaaagccgtggagggggaggggggtgttaggagcgccactgtccctgtttcaatctggaggacatatttcgtggccaacgaatggaatgagatccagaccgtgcgcaaaatcaactctctcttccaggtgttgaccgtcctgttcttccttgaagttgtggggtttaagaatctagccttaatggattctagtagctccttaagtagaaatcctccaagctatatcgctccatactcgtgcatattgcggtatgccgtcagcgccgcgctgtggctggccatcggcatcatccaagtcgtgttttttgccgttttttacgagaggttcatagaggataagatacgccagttcgtggacctgtgcagtatgtcaaacatctccgtatttctgctgtctcataagtgctttggatattacatccacggacggagcgttcacggccatgcagataccaatatggaagagatgaatatgaatctgaaacgcgaggccgagaatctctgcagccagcggggtcttgtgccgaacactgacggccaaacatttgagatcgccattagcaaccagatgcggcagcattatgatcgcatccatgagacccttatccggaaaaacggacccgctagactcctgagctcatctgcaagcacctttgagcaaagcatcaaggcgtatcatatgatgaacaaatttctgggcagctttatcgatcacgttcacaaggagatggattactttatcaaggataagctcctgttagagaggatcctgggtatggagttcatggagccaatggaaaagtccatattttataacgatgagggttactctttctccagcgtcttgtactacggaaatgaggccacactgctgattttcgacctgctgttcttttgtgtggtcgacttagcttgtcagaacttcatcctggccagctttctgacgtatctgcagcaagaaatttttcggtatatccgaaacactgtgggtcagaaaaatctggcatccaagactctcgtcgaccagcgctttttgatctag

SEQ ID NO: 138652 - DNA, 783 bp, Artificial Sequence
  Description of Artificial Sequence: Synthetic coding sequence
atgttattcttggcattgggcagtccttgggctgtcgaactgcccttgtgcggccggcgcactgctctttgcgctgcggccgctctacgggggccccgtgcctccgtaagcagagctagcagctcttccggcccgagtggccccgtcgccggttggagtaccgggcctagtggtgcagccagacttctgcgcagacctgggcgcgcacagatcccagtttattgggaaggatacgtcagattcctcaataccccgtcagacaaatccgaagacgggcggctcatctatactgggaacatggctcgcgcagtgttcggcgtcaaatgcttttcatactccaccagcctgatcggcctcacttttcttccatatatatttacacaaaataatgccattagcgagagcgtcccactgcctattcagatcatcttttatgggattatggggtcattcacagtgataacaccagtgctgcttcactttatcaccaaaggctatgtgatcaggctgtaccatgaggccaccacagacacttataaagccatcacctacaacgccatgctggccgaaaccagcaccgttttccaccagaacgacgtgaagattccagatgcaaagcatgtatttacaacgttttacgcgaaaaccaaatcactgctcgttaatccggtgctgttcccgaaccgggaggactatattcatctcatgggctatgacaaggaggaattcatcctatacatggaggagacaagcgaggagaaacggcacaaggatgacaagtag

SEQ ID NO: 138653 - DNA, 324 bp, Artificial Sequence
  Description of Artificial Sequence: Synthetic coding sequence
atgctcttcctcgccctggggagcccctgggccgtggagcttccattatgcggccggcgaaccgctttatgtgcggccgccgccctgaggggaccaagagctagcgtctcacgggcctcttctagtagtggcccctctggcccagtggccggctggtccacaggaccatccggggctgcaagattgctgcgcagacctgggcgggctcagattccggtttactgggagggctacgttcgctttctaaacactccatccgataaatccgaggacggaaggcttatttatacaggcaacatggcacgagccgtgttcggcaaatag

SEQ ID NO: 138654 - DNA, 918 bp, Artificial Sequence
  Description of Artificial Sequence: Synthetic coding sequence
atggaattacactacctcgccaaaaaaagcaaccaggccgatttgtgtgacgcacgcgattggtcctcccgagggctgcccggcgaccaggcagacaccgctgcaaccagagcagctttgtgctgtcaaaagcaatgtgcttctacccctcgcgctacggaaatggagggatcaaagttgtcctcctccccagcctcaccctcgtcaagtttgcagaactctaccttgcagcccgacgcgttccctcccggtctgcttcattcaggcaataaccagattaccgcggagagaaaggtttgcaattgctgctcccaagagcttgaaacaagctttacatacgtggacaagaacattaacctggagcaaagaaatagaagctcaccttctgcaaagggacataaccatcctggtgagttaggatgggagaaccccaatgaatggagtcaagaggctgcaatttctttaatttcagaagaagaagacgacaccagtagcgaagccacctcctcaggcaaaagcattgactacggattcatctcagctattctttttcttgttacagggattttattggtaatcattagctacattgtgcctcgcgaggtgacggtagacccaaacaccgtggccgcacgggagatggagcggctagaaaaagagtctgcccgcctcggtgctcatctcgatcgatgtgtgatcgctgggttgtgcctgcttacattgggcggtgttattctgtcctgtttgcttatgatgtcaatgtggaaaggagaactatacagaaggaaccgcttcgcttccagtaaagagtcagcgaagctttatgggagtttcaatttcagaatgaaaacatccacaaatgagaacacccttgaactatccctggtggaggaggatgccctggccgtgcagtcctag

SEQ ID NO: 138655 - DNA, 951 bp, Artificial Sequence
  Description of Artificial Sequence: Synthetic coding sequence
atgtccggagacacctgtctctgtcccgctagtggggcgaagcctaagctctcaggctttaagggcgggggactgggcaacaaatacgtgcagctcaatgtcggcggcagtctttactacaccaccgttagagcactaactcgacacgacaccatgctcaaagcaatgttcagtgggaggatggaggtgctcactgacaaagaggggtggattctgatcgacaggtgtggaaagcactttggtaccatcctgaattaccttcgtgacgacactattaccttaccgcagaatcgccaagagattaaagaacttatggccgaggccaagtattacctgatccagggcctggtaaacatgtgtcagtctgccctgcaggataagaaggattcctaccagcccgtttgtaatattcctattatcacctctctgaaggaggaggaacggttgatagagtcctctaccaaaccagtggtgaagctcttgtacaaccgaagtaacaataaatactcctataccagcaactctgacgaccatcttttgaagaacatagagctgtttgataaactgtcactccggttcaacgggcgtgttctgttcattaaggatgtgattggggacgaaatctgctgttggtccttttatgggcaaggacgcaagctggctgaagtttgttgcactagcattgtgtacgctacagagaaaaagcagacaaaagtggagttcccggaggctcgaatctacgaggaaactctgaacgttcttctttatgaaaccccaagggtccccgataacagtctgttagaggcaacttctcgatctagatctcaagcttctccttccgaggacgaagagacctttgaactgagggaccgggttcgcagaatccatgtcaagagatattcgacctatgacgacaggcagcttggccatcagagtacgcatagggattag

SEQ ID NO: 138656 - DNA, 210 bp, Artificial Sequence
  Description of Artificial Sequence: Synthetic coding sequence
atgactactcttatacctattctgtcaacattcctgtttgaggacttctctaaagccagtggttttaagggacagcggcctgaaaccctgcatgaaaggctaactctggtctccgtgtacgccccgtacttattaataccgttcattctcttaatttttatgctgcggtctccgtattataagtatgaggagaagaggaagaagaagtag

SEQ ID NO: 138657 - DNA, 1125 bp, Artificial Sequence
  Description of Artificial Sequence: Synthetic coding sequence
atggtgctttgggaatccccgagacagtgttcctcctggaccctctgcgaggggttctgctggctcctgctccttcccgtgatgctcctgatcgtggcgcggccagttaagctggcggctttccctacctcgcttagtgactgccagacacccacgggttggaattgtagcggttatgacgatagagaaaatgacctgttcctttgtgacactaacacctgcaaatttgacggcgaatgccttcgaattggggacacagtaacatgcgtgtgtcagttcaaatgcaacaatgactacgtgccggtgtgtgggagcaatggggagtcctaccaaaatgaatgttacttgcgccaagcggcgtgtaaacaacagtctgagattctggtcgtatccgagggcagctgtgccaccgatgccggctcaggttcaggcgatggagttcacgagggcagcggcgagacttctcagaaagagacgtcaacctgcgacatttgccagttcggcgcagagtgtgatgaggatgcagaggacgtctggtgtgtgtgcaatattgattgcagtcagactaattttaaccccctgtgtgcctctgatggcaagtcttatgataatgcctgtcagattaaagaggcctcctgccagaaacaagaaaagattgaggtgatgtcactcggcaggtgccaggacaacaccaccactactaccaagtccgaggatgggcattacgcccgtacagactatgcagaaaacgcgaataagttagaggagagcgcccgcgaacaccacattccgtgcccagaacactacaacggcttttgtatgcacgggaaatgcgagcatagtatcaacatgcaggagccctcgtgtcggtgtgacgcaggctacacagggcagcactgcgagaaaaaagattattccgtgctatacgtagtgccgggccccgtaagatttcagtatgttctgattgcggcagttattgggaccattcagattgccgtcatatgcgtcgtggtcttatgcataaccagaaagtgccccaggtctaacaggatacaccgccagaaacagaataccgggcactattcatcggataacacaacaagagcgtccacgcggctaatctag

SEQ ID NO: 138658 - DNA, 528 bp, Artificial Sequence
  Description of Artificial Sequence: Synthetic coding sequence
atggtcctatgggagtcccccagacaatgttcaagttggacattatgtgaaggcttctgttggctccttctgctgcctgtaatgttgcttatcgtcgcgcggcccgtcaaactggcggctttccccacttcattaagtgactgccagactcctactggctggaattgctcaggatacgacgatagggagaacgacctatttttgtgtgacactaatacttgtaagttcgatggagagtgtttgagaataggggatacagtgacttgtgtgtgccagtttaaatgtaacaatgactatgtaccagtgtgcggttccaacggggaaagctatcagaatgagtgctacctgaggcaagcggcatgcaagcagcagagtgaaatacttgtagttagtgagggaagttgcgccacagacgcgggctccggcagcggggacggcgggaggtcctgtctgttcacttatctcaagatttattggtggatcctgctctgcatttttacgtatgtttgctctatttccgatatctag

SEQ ID NO: 138659 - DNA, 2427 bp, Artificial Sequence
  Description of Artificial Sequence: Synthetic coding sequence
atggctgaactgctggcaagcgccggtagcgcgtgtagctgggactttcctagagccccaccatccttcccaccaccagccgcctcgcggggaggcctggggggtacaaggtcattccggccacacagaggagccgagtcccctcgtcctggtagagaccgcgatggggtccgtgtgcctatggcttcatcacggtgtccagccccacgcggctgcagatgcctccccggtgccagtcttgcctggctgggcacagtactgctgctgttggctgactgggtcctgctccgtacagcgctaccacggattttttctctcctggtccccactgccctgccactgctgcgtgtctgggctgtcggattaagccgctgggctgtcctgtggcttggggcctgcggcgtcctgagagcaacagttggctccaagagcgaaaacgccggagcacagggttggctggctgcccttaaacccctcgctgctgcacttgggttggctctgcccggtctggctctcttcagggagttaatttcatggggggcccctggctcagccgatagcacccgcctgctgcactgggggtcccaccctacagccttcgtggtgagttatgccgccgccctccccgccgctgccctgtggcacaagttggggtcactttgggtccctggcgggcagggtggctcaggtaatcctgtgcggcgcctgcttggatgcctgggaagcgaaacccgacgcctgtctttgtttttggtgcttgtggtgctgtcttccctcggggagatggcaattccgttctttacaggacggctcactgactggattctgcaggacggcagcgctgacacttttactagaaacttaacgctgatgagtattcttacaatcgccagtgctgtactggagttcgttggagatggaatctataacaacacaatgggacacgttcactcccatctgcagggtgaggtcttcggcgcagtgctgagacaggagactgaattctttcagcagaatcagacgggtaacattatgtcgcgggtcactgaggacacttccactctgtctgactcactttctgaaaaccttagtttatttctttggtatctggtgcgtggcctctgcctgctcggcataatgttatgggggtcagtgagcctgacaatggttaccctgatcaccttaccgctgttgttcctcttacccaaaaaggtaggaaagtggtatcagctgttggaagtgcaggttcgcgagtccctggctaaatccagtcaggttgctattgaagccctatcggccatgccaactgtgcgaagctttgccaatgaagagggcgaagctcagaaatttcgtgaaaagctgcaggagatcaagacactgaaccaaaaggaagcagtagcctacgctgtgaacagttggacgacttctattagcggcatgctcctaaaggtcggcatcctctatataggaggtcagctggttacctccggggctgtgtctagcggaaacctggtgacatttgttctgtatcagatgcagttcacacaggctgttgaggtgctcctttccatttatccacgagtgcaaaaggcagttggaagttccgagaagatttttgagtacctggacagaactccccgctgcccgccgtccgggttgctaacgcctctacatctggaaggcctcgtgcaattccaagacgtgtcattcgcttatcctaatagaccagatgtgttagtgcttcaagggctcacctttacactgcgtccaggggaggtgacggcattggtgggacccaatggctccggcaaatccacggtggccgccttacttcagaacctctaccagcctacagggggacagctcttgttagatgggaagcccctgccccagtatgagcataggtatctccacagacaagtggctgccgtcggtcaggaacctcaggtgttcggaaggtctctgcaggaaaacatcgcctacggcttaactcaaaaaccaaccatggaagaaattacagcagctgccgttaagtccggtgcccatagctttatttccggattaccccagggatacgacacagaagtcgatgaagcaggtagtcagctctcaggcgggcaaaggcaagctgtggctctggcacgggctctgattcgaaagccatgtgtcctcatcctggacgacgcaacttcggcactggacgctaattcgcagttacaagtggagcagcttttgtatgagtccccagagagatattcacgttctgtcctcctcattacccagcatttgagtctggtggagcaggcagatcacattttgttccttgagggaggtgccatcagagaaggaggtacccatcaacagctgatggagaagaaagggtgttactgggcaatggtacaggcacccgctgatgcaccagagtag

SEQ ID NO: 138660 - DNA, 2427 bp, Artificial Sequence
  Description of Artificial Sequence: Synthetic coding sequence
atggctgagctgcttgcttcggcaggatctgcatgttcctgggatttccctcgggccccgccatcttttcctccccccgcagcttccagaggaggcctgggaggaacccggagttttcggcctcaccgcggagccgaaagcccgcgcccaggccgggatcgcgacggcgtgagagtgcccatggcatcctctaggtgtccagcaccccggggatgtcgctgtctcccaggcgcctctcttgcttggctcgggacggttctgctcttgttggccgattgggtgctgctgaggaccgcattgccacgcatcttttctctactagtgccaacggccttgcctctgttaagggtgtgggctgtgggtctttcacgttgggcagtgttatggctgggggcttgcggagtgcttcgtgcaacggtgggctccaaaagcgagaacgcaggggctcagggttggctggcggctctaaaaccgcttgccgcagcactggggctggctttgccgggcctcgccctctttagggagctgatttcttggggagccccaggtagcgctgacagcacccggttactccactggggaagccatccaacagcatttgttgtgtcctatgcggctgcccttccggcagctgccctgtggcacaaactcggttccttgtgggtgccaggaggccagggaggtagcggaaaccccgtgcgacgcttacttggttgtctaggaagcgagacccgcaggctctctctgtttctggtgttggtcgtcctttcttctctgggcgaaatggcgatcccgttttttaccggacgactgaccgactggatcctacaggacggctcggctgatacctttactagaaacctcaccttaatgagcatactcaccatcgccagtgctgtgctagagtttgtaggagacggtatctacaataatacaatgggacatgtgcactcgcacctgcagggagaggtgttcggggcagttctgaggcaggagacagagtttttccagcagaaccaaacaggcaacattatgtcccgtgtgaccgaagacacgtcgactttatccgattcactctcggagaacctcagcctttttttgtggtatctcgtaagagggctgtgtctgcttggcatcatgctttggggtagcgtgagcctcaccatggtgaccctcatcaccctgccactcctcttcttgctgcccaagaaagtgggaaaatggtaccagctactagaagtgcaagtgcgcgaatctctggcaaagagttcacaggtcgccattgaagctctaagtgccatgcctaccgtaaggtcttttgccaacgaagagggtgaagcccagaaatttagagagaagctgcaagagatcaaaacactcaaccagaaggaggcagtcgcctatgctgtaaattcatggaccacatcaatttccggaatgcttctcaaggtgggaattttgtatatcggggggcagttggttacatctggtgcggtatccagtggaaatctagtgacttttgtgctgtaccaaatgcagtttactcaagctgtggaggtcctactgtcgatctacccccgcgtgcagaaggcggtcggatccagcgaaaaaatattcgagtatttggatagaactcctcgttgccccccttcaggcctgctgacacctctgcatctggaaggcctggtgcagtttcaggatgtctcattcgcataccccaaccggccagacgttttagttttacagggactgacatttactctgcgcccaggcgaggtgaccgcacttgtagggccaaacgggagcggcaagagtaccgtagccgcccttctgcagaacctgtatcaaccaacggggggtcagctcctcttagacgggaaaccacttccccaatatgagcaccgttatctacataggcaagttgctgcggtggggcaggagcctcaggtatttggccgttcccttcaggagaatatcgcatacggactcacccagaagccaacgatggaggagatcacagcagccgctgtaaaaagcggtgcacattccttcatcagcggcctcccacagggatacgataccgaagtcgatgaggcggggtcacaactaagcgggggccagcgccaagcggtcgctctcgctcgggcgctcatacgcaagccctgcgtactgatcctggatgacgccacttcggctctcgacgcaaactcccagctccaagtagagcagttgctatatgaaagtccggagcgatattctcggagcgtcctccttattactcagcatctgtctctggtcgagcaggctgaccatattctgttcttagaaggcggcgctatcagggaaggaggaacacatcaacagctgatggaaaaaaagggctgttattgggctatggtgcaagctcccgccgacgccccagagtag

SEQ ID NO: 138661 - DNA, 2427 bp, Artificial Sequence
  Description of Artificial Sequence: Synthetic coding sequence
atggctgagctgctcgcttctgctggcagcgcctgttcctgggactttcctcgggcacctccctcatttcctcccccagcagcatcacgtggtgggctgggcggaacaagatctttcaggccacaccgtggcgccgagtctcccagacccggtcgggaccgggacggcgtgcgggttcccatggcgtcatccaggtgtccggcccctcgagggtgcaggtgcctccctggcgcgagtctcgcctggttggggactgtactcttgttgctggctgactgggtgctcctccgcaccgcactccctaggatcttcagcctacttgtgcctacggcactccccctgctcagagtgtgggcagtgggtcttagccgatgggctgtgctgtggttgggggcctgcggggtactacgagccactgtgggaagtaaaagcgaaaatgccggagctcaaggatggctggctgccctcaaacctttggccgccgcactggggctggctctcccgggcttagccctctttcgagagcttatctcatggggggctcccggctcggccgatagtacccggctgctgcattggggttcccacccgaccgcttttgtagtgagttatgccgcagccctgcctgctgccgccctgtggcataaactcggcagtctgtgggtccccggaggtcagggtggatctggtaatcctgttcgccgcctgttggggtgcctcgggtcagagactagacggcttagcttgttcctcgtcctcgtggtactatccagtctgggtgagatggctattccattctttacagggagactaacagactggattctacaggacggcagcgcagatactttcacacggaatctgactctcatgtccattctcaccatcgcgagcgcagttctggaatttgttggagacggtatttacaacaataccatgggccatgtgcacagccatctgcaaggcgaggtcttcggggctgtcctcaggcaagagactgaattcttccaacagaaccagacagggaatataatgtctcgcgtcactgaagacactagcactttatcagattctctgtccgagaacctgtcactctttctgtggtacctggtcagaggactgtgcctgctcggaataatgctgtgggggagcgtgtcattaactatggtaacactcattaccctgcctctgctctttctgctccccaagaaggtagggaaatggtatcagcttcttgaagtgcaggtgcgtgagtcccttgcaaagtcttcacaggtagctatcgaagccctgtcagctatgcccaccgtgcggtccttcgcaaacgaagagggcgaggctcaaaagttccgtgagaaacttcaggaaatcaagaccctaaaccaaaaggaggcagtcgcctacgccgttaattcctggacaaccagcatctccgggatgcttcttaaagtgggcatcttatatatcggaggccagcttgtgacctccggtgccgtgtcctccggtaatctcgtcacttttgtgctgtaccagatgcagtttacgcaggcggtagaggtattacttagcatatacccacgggtgcagaaagctgtagggtcatctgaaaaaatcttcgagtacctggaccgcaccccacgctgccctccaagcgggcttctcaccccgctacacctggagggactggtccagttccaggatgtctcttttgcctacccaaatcgccccgacgtgttggtgttacaaggcctgacttttaccctccgccccggagaagtgaccgccctcgttggcccaaacgggtcaggaaagagtacagtcgctgcacttctgcagaatctgtaccaacccacggggggtcagttactgttggacgggaagccactgcctcaatacgaacatagatacctccatcgccaagttgccgctgttgggcaggagccgcaggtgtttggacgctcgcttcaagagaatattgcttacgggttaacccagaagcctacaatggaggaaataaccgctgccgcggtcaagtctggcgcgcatagcttcatcagcggcctgccccaaggatacgacacggaggtcgatgaggctggcagtcaactgtcaggaggacagcgacaggccgtcgctttggcacgcgcgctgattaggaaaccttgtgttctgatcttggatgatgcaaccagtgcacttgatgcaaacagccagctacaagtggaacaactgctgtacgaatcccccgagagatatagcagaagcgtgctcctgattacacagcatctatccctcgtcgagcaggccgaccacatcttgttcttagagggcggggctatccgagagggggggacccaccaacagctaatggagaagaagggttgctactgggccatggtacaggcccctgcggacgcacctgaatag

SEQ ID NO: 138662 - DNA, 2427 bp, Artificial Sequence
  Description of Artificial Sequence: Synthetic coding sequence
atggctgaactgctcgcatctgcgggctccgcctgtagctgggactttccacgggccccgccgtcctttcctccacccgcggcgagcagaggcgggctggggggaacccgctcatttcggcctcatcggggcgccgaatcccccaggcctggtcgagatagggatggggtccgggttcctatggcttctagtcgctgtcctgcgccacggggatgtaggtgtttgcctggggccagcctcgcctggctgggcaccgtattgcttttgctggccgattgggtcttgcttcgaaccgccctcccccgcatcttcagcctgttagtgcctacagccctccccctgctgcgtgtgtgggctgtgggactgagtcgatgggctgtgttgtggctgggagcatgtggagtgctcagggcaacagtcggatctaaatccgaaaatgctggggcacagggttggctggcggcactgaaaccactcgctgcagccctcggcctggctctcccaggcctggcccttttcagggagctgatctcttggggcgcaccaggctctgctgatagcacacgcctgctacattggggttcccaccccacggcctttgtggtgtcttacgcagcagctttgcccgcagccgccctctggcacaagctgggctctctctgggtgcccggaggacagggaggaagtgggaacccggtgcgccgacttttggggtgtctagggtccgagactagaaggctgtcgctgtttctggtcttggtggtcctcagttctcttggtgagatggcgataccctttttcacgggacggctgaccgactggatcctgcaggatggttctgccgataccttcactagaaacctgacccttatgagcatattgaccatagccagcgccgtactggagtttgttggcgacggcatatacaacaatacgatgggtcacgtccattctcacctccagggggaagttttcggcgccgtcctgaggcaggagacagaattcttccagcagaaccagaccggcaatatcatgtctcgggttaccgaggacacctcgactctttcggactctttgagcgaaaatcttagcttgttcctgtggtacctagtgcggggcctgtgtctgctgggcattatgttgtggggatcggtgtcactaacaatggtaactctcattacgctgcctctcttgttcctgcttcccaagaaggtcgggaagtggtatcagcttcttgaagtccaggtgcgagagtcactagcaaaatcatcacaggtagctattgaggccctatccgcaatgcccactgtgcggagttttgcgaacgaggaaggggaggcacaaaagttcagggaaaagttgcaggaaataaagacactgaaccagaaagaggctgtagcctatgccgtgaacagctggaccaccagcatctcaggaatgttgttaaaggtggggattctgtatatcgggggccagcttgtgacatctggagccgtttcaagtggtaacctggtcaccttcgtgctctatcagatgcagttcacacaggccgttgaggtattgctcagcatatatcccagggttcaaaaggctgtgggaagctcagagaagatctttgagtatctggatcgtacaccgaggtgcccacccagcggcctactcacacctctgcatctggagggactggtgcaatttcaggacgtatcttttgcatatcccaatcgacccgatgtcctggtgctccagggcctcacttttaccctgaggccaggagaggtgaccgcattggtgggcccaaacggttcggggaagtccactgtggcagccctgctgcagaacttgtaccagcccaccggagggcagctgcttttagatggaaaacccctgccacagtacgagcacagatatttgcacaggcaagtggccgctgtgggacaggaaccccaggtcttcggcaggagcttgcaggaaaatattgcttatgggctgacacaaaaacctacaatggaagagattaccgcagcggccgtgaagtccggagcccacagcttcatctccggactgccacagggttacgacacagaggttgatgaggctggctcgcagctttccgggggacaacggcaggctgttgctcttgcccgggctctcattaggaagccttgcgtattaattttggacgacgccacttcagctctggacgctaattcccagctgcaagtcgagcagctgctgtatgaatcccccgaaaggtattcccggagcgtgcttctcataactcagcatctttctctggtggagcaggctgaccacatcctcttcctagaaggaggtgctatacgggagggtggaactcaccagcagctcatggaaaaaaaggggtgttattgggccatggtgcaagctccggccgatgcaccagaatag

SEQ ID NO: 138663 - DNA, 2427 bp, Artificial Sequence
  Description of Artificial Sequence: Synthetic coding sequence
atggctgagcttctcgcctcggcaggttccgcctgcagctgggactttcccagagcaccaccatcattccccccacccgcagcgtctcggggagggctgggcgggacaaggtcatttcgaccacataggggcgctgaatcgcctagaccaggtcgcgacagagatggtgtgcgtgtccctatggcctcaagtcgctgtcccgcacccagagggtgccgttgtctgcctggggcgtctctagcctggttggggacggtgctgctgctgcttgcagattgggtgctgctacgtacagccctccctcgcatcttctcattgttagtgcccactgcattgccactgttgcgcgtctgggctgtgggactgagccggtgggctgtgttgtggctgggtgcttgcggtgtgctgcgtgcgactgtcggatccaaaagcgagaacgccggtgcccagggttggctggccgccttgaagccattggctgcggctcttggccttgctctgccgggcttagctttgttcagagaattaatcagttggggagccccaggcagcgccgactcaacccgactgctgcattggggaagtcaccccacagcctttgtagtgtcctacgccgctgccttacctgccgcagccctgtggcacaagctgggctctctgtgggtgccaggaggccagggtggcagtggcaacccagttaggaggcttctaggatgcctagggtccgaaaccagaagattgagcctatttcttgtattggtggtcctctcgagcctgggcgaaatggcgatacccttctttacggggaggctgaccgattggatcctacaggatggctccgctgacacctttactagaaatctgacgctgatgagcatcctgactatcgcttccgccgtgctcgaattcgttggggacgggatttacaacaatacaatggggcatgtacattctcaccttcagggggaagtctttggggccgtgttgaggcaggagaccgagttctttcagcagaatcagacgggcaacatcatgagtcgggtcacagaggacactagcactctgagcgactcgttgtctgaaaatctgtccctgttcctgtggtatttagtgcgcggattgtgcttgttgggaatcatgctctggggcagcgtgagtttgacgatggtgaccctgatcacattacctctgttgttcctgctgcccaaaaaagttggtaagtggtaccagttactcgaggtccaggtgcgggagagtttggccaagagttcccaggtagctatcgaggccctgtcggccatgccaactgtccggtcatttgccaacgaggaaggggaggcccagaagtttcgagaaaaattgcaagagatcaagactttgaaccaaaaggaggcagttgcatatgcagtgaactcctggacgaccagtataagcggcatgctcctcaaagtggggattctgtacattggcgggcagctggtcactagcggagcggtgagcagtgggaaccttgtcacattcgtactgtaccagatgcagttcacccaggccgtagaagtactgctctcaatttatccacgggtacagaaggcggttggcagcagtgaaaagatctttgaatacttagacaggaccccccgatgtccaccttctggcttgctcacccctctgcacctggaagggctggtacagtttcaggacgtgagtttcgcataccctaacaggcctgacgtgctcgtgctgcaaggattaacttttactctcaggcccggagaagtgacagctctcgtcggccctaatggatccggcaagtccaccgtcgcggcccttctacaaaacctttatcagccaacaggcgggcagctcttgctcgacggcaaacccttgccccagtatgagcacagatatctgcaccgtcaggtagccgcggtaggacaggagcctcaggttttcgggaggtctcttcaggagaacatagcctacgggttgacacagaagcccactatggaggaaattactgcagcagccgtgaagagcggtgcgcatagtttcattagcggactacctcagggctacgacactgaggtggacgaggcggggtctcagctcagcggtggccaaagacaagcggtggccttggcccgcgctctgattaggaaaccctgtgtgctcattctggacgacgccaccagcgccctcgacgcgaactcacagctgcaggtcgaacagctcctctatgaatctccagaaaggtattctaggtctgtcctgttaattacacagcacctgtctctggtcgagcaggctgaccacattctgttcctggagggaggcgcaataagggaaggaggcactcatcagcagctcatggaaaaaaaggggtgttattgggcgatggtgcaagcccccgctgatgccccggagtag

SEQ ID NO: 138664 - DNA, 1644 bp, Artificial Sequence
  Description of Artificial Sequence: Synthetic coding sequence
atggccattccgttcttcaccggaagactgaccgattggatcctccaagatggatctgccgatacgtttacaaggaatttaaccttaatgtccattcttactatagcaagtgccgtgctcgagtttgtcggcgatggcatctataacaataccatgggacatgtgcatagccatctgcagggggaagtgtttggtgccgtgctccgccaagagacagaattctttcaacagaatcagaccggcaacataatgtccagggtgaccgaggatactagcacattgtctgacagtctttcagagaatctcagccttttcttgtggtacttggttaggggcctgtgtctcttgggcattatgctgtggggatctgttagcctgacgatggtaactcttataacgttgccgctgttgttccttctcccaaagaaagtggggaaatggtatcagttactggaggtccaggtgagggaatctctagccaagtccagccaagtggcgatcgaagccctgtctgccatgccaacagttagatcatttgcgaacgaggagggcgaagctcaaaaattcagagagaaactgcaggagattaagaccctaaaccagaaggaagctgtggcctacgccgtaaatagctggacaacctccatctcgggtatgttactgaaggtcggtatcctttacatcggtggacaactggtgacctcaggggccgtgtcctccgggaacctggtaacatttgtactgtaccagatgcagtttactcaagccgtggaagttctgttgtccatatatcctcgagtccagaaggcagtgggctcaagcgagaagatatttgaatatctcgacagaacacccagatgccccccatctggattgttaaccccgttgcatttggaagggcttgtacagttccaagatgtttcattcgcctatccgaataggcctgatgtgttggtgttacagggactcacctttacactgcgccctggagaggtaactgcccttgtgggcccaaacgggtccggcaagtcaactgtggcggccctgctgcagaatctttaccagcccacgggcggtcagctcctgctcgacggaaagccattaccacagtatgagcatcgatacctgcaccggcaggtagctgccgtgggccaagagccccaggtattcggacgctctctccaagagaatatcgcctacggactcacccagaagcccacaatggaagagatcaccgcagccgcagtgaaaagcggagcccattcttttataagtggacttccgcaaggttacgacaccgaggtcgacgaagcagggtctcaattatccgggggccagcggcaagccgtggcactagctagagccttgatccggaagccgtgcgtcctaatcctggatgacgctactagcgccttggatgccaacagtcagctgcaggtggagcaactgctctatgagtctccagaacgctactctcgctccgtcttgttgatcacccaacatctcagtcttgtggaacaagccgatcacatcctcttcctggagggcggtgccattcgcgagggaggcacgcaccaacagctcatggagaagaagggatgctattgggccatggtgcaggcacccgctgatgctcctgagtag

SEQ ID NO: 138665 - DNA, 2427 bp, Artificial Sequence
  Description of Artificial Sequence: Synthetic coding sequence
atggccgaactcttagctagtgccggctctgcctgtagttgggactttccaagggccccgccttcctttccccctccagctgcttcacgtggtggccttggcgggacccgcagctttcgcccccatcggggcgctgagtcacccaggcctggacgggatagagacggcgtgagggtgcctatggcctcttcacgctgtccagctcctagaggctgtcgctgtctgcccggcgcctcccttgcctggcttggtaccgtgcttctgttgttagccgactgggtgttgctcagaactgccttaccacgaatattttcactcctggttcccactgctctgccactgttgcgagtttgggcagtgggactgagtcgctgggctgtgttatggctcggagcgtgcggagtgcttagagcaacaggtggaagcaaatctgagaacgccggtgctcaggggtggctggccgcacttaagccactcgctgccgcactaggcttggccctgccggggttagctctttttcgagaactgatctcctggggcgccccaggaagcgccgactccacaagactgctgcactggggaagtcatcccacagcctttgtggtgtcctatgctgctgcacttccagccgcagctctctggcacaagttaggctcactgtgggttccgggtggtcagggagggagcggtaatcctgtgaggcggctcctgggttgcctcggtagcgagactcgcaggctgtcccttttcctggtgcttgtggtgcttagttctctgggagagatggctattccgttttttacaggccggctcacggattggatcctgcaggacggatccgcagacacatttactcgcaacctgactttgatgagcatcttaactatcgccagtgcagtcctggagtttgtgggcgatggaatttacaacaacaccatgggccatgttcacagccatctccaaggcgaggtcttcggggctgtcctgcgccaggaaaccgaattcttccagcagaaccagactgggaatattatgagccgcgttaccgaggatacaagtactctgtccgactccctgtctgaaaatctcagcctgtttctctggtatctggttcgggggctgtgcttgttaggcattatgctgtggggcagtgtgtcactgacgatggtgaccctcatcacgctccctctcctcttcctcctcccaaagaaggtaggaaagtggtaccagctgctggaggtgcaggtgcgggagagtctggccaagagctctcaagtggccatagaggccctcagcgcgatgccgactgtaaggtccttcgcaaatgaggaaggtgaagcccagaagtttagagagaaactgcaggaaatcaagaccctcaaccagaaggaggccgtggcgtatgccgtcaattcttggaccacaagcatttctggaatgctcttgaaggtcggaatactgtacataggagggcagttagttacgtcaggggcagtgtcgagtgggaacctggtgacctttgtgctttaccagatgcagtttacacaggcagtcgaagtgttactgtccatctatccacgcgtgcagaaggcagtcggctcctcagagaagatttttgagtacttggacagaacacccaggtgtcctccatcgggacttctcacacccttacacctggagggtctggtacaatttcaggatgtgtccttcgcttaccccaacaggcctgatgtactcgttttacaagggctgactttcacactgagaccaggggaggtgacggccttggtgggccctaatggaagcggtaaaagtaccgtcgcagctctgttacaaaacctttatcagcctaccggggggcagctcctgcttgatggtaagccgttacctcaatacgagcatagatacctgcatcgtcaggtcgcggccgttggccaggagccacaggtgttcggacgatctctgcaggaaaacatagcttacggtctgactcagaagcctaccatggaggaaattactgccgctgcggtgaagagtggtgcacactcatttatctcaggcctgcctcaggggtacgacaccgaagttgacgaggccggaagccaactctccggtggacagaggcaagccgtcgcactggcaagggccttaataagaaagccctgtgtgttgatactcgatgatgctacatctgctctggatgcgaattcccagctacaggtggagcaactcttgtacgaatccccagagcgatattcgcgcagtgtcttgctaattactcagcacctgtctttagtggagcaggccgaccacatcctctttctcgagggcggagccatccgggaaggcggcacccaccaacagctgatggagaagaaggggtgttactgggcaatggtccaggctcctgctgatgcgcctgagtag

SEQ ID NO: 138666 - DNA, 2427 bp, Artificial Sequence
  Description of Artificial Sequence: Synthetic coding sequence
atggccgaacttttggccagtgccggctccgcttgctcatgggatttccctcgggcgccacccagcttccctccacccgccgctagcagaggcggactgggcggcacgcggagcttccggccacatcgcggcgcggaatcaccgcgcccaggcagggatcgagacggcgtgagagttcctatggctagctcccgatgccccgcacctaggggctgtcggtgtctccccggcgcttcactggcttggctggggacggtactgctcctcctggcggactgggtgttgctgaggaccgccctcccgcgaatctttagcctcctcgtgcccaccgcgctacctctgttgcgggtttgggctgtcggtttatctagatgggcggtgctgtggttgggtgcatgtggggtgctgcgtgccactgtgggatcaaagtcagaaaacgcaggtgcccagggctggctggcggcccttaaacctttagcggccgctctgggcctggccctgccagggttggctctattccgtgagctgatctcctggggggctccagggtccgctgacagcactaggcttctccattggggatcccacccaaccgcgtttgtggtgagctacgccgccgcactgcccgccgccgcactgtggcacaagcttgggtccctgtgggtgcccggaggtcagggcggctctgggaatccagtgcgccgcctgttaggctgtcttggaagcgaaacccgccgtctttcactgtttttagtactcgtggttctcagcagcctcggcgagatggccatcccgttcttcacgggtagactcacagactggatcctgcaggatggctctgccgatactttcaccaggaaccttacactcatgtcgatcctgaccattgcttctgccgtcctggaattcgtcggagacggcatttataataacactatgggacacgtccactcacaccttcagggcgaggtgtttggcgcagttttaagacaggagacagagttctttcagcagaatcagacgggcaatatcatgagtagggttacagaagacacatccactctgtcagacagcctatccgagaacctgagtcttttcctctggtatctcgtgcgcggcctctgcctgctcggaatcatgctgtggggatctgtgtcactgaccatggttacgctcatcaccctgcccctcctctttctgctgcctaagaaggtggggaaatggtatcagctgctggaagtgcaggtacgggagagcttagccaagagctcccaagtggcaattgaggctctttcggcaatgcctactgtgcggtctttcgctaatgaggagggtgaagcacagaagtttcgggagaaacttcaggagattaaaactctcaaccaaaaggaggccgtggcctatgcagtaaatagctggacgacatcaatctctggaatgcttctgaaggtgggcattctgtatattggagggcagctggttacctctggggcagtatctagtgggaatctggtcacgtttgttctgtaccagatgcagtttacccaggctgtggaagtgctactgagcatctacccgagggtccagaaggccgttggttctagcgagaaaatctttgagtacctggataggactcccagatgtcctccgagtggattactgaccccacttcacctggagggcctcgtccagttccaagatgtgagtttcgcctaccccaataggccagatgtgcttgttctacaggggctgacctttactttacggcctggggaggtaaccgcattagtgggtccaaatggtagcggtaaatctaccgtggccgccctgctgcagaacctctaccaacccaccgggggacagctgctcctcgatggcaagccactgcctcagtatgagcatcgctatcttcacagacaggtggcagccgtaggccaggaaccgcaggtgttcgggcgcagcctccaggaaaacattgcgtatggattgacacagaaaccaacgatggaggaaattaccgccgcagctgtgaaatctggcgcccacagctttatctcaggattaccccaggggtatgatacggaggtggacgaggctggttcccaactgtcaggcggccaacggcaagcagtcgcgttggcacgagccctcatccgcaagccctgtgtgttaatactcgacgacgctacttcggccctcgatgcgaactctcagttgcaggtagaacagctgctgtatgaatcccctgaaaggtattcccggtccgtcttactcatcacccaacatctaagcttggtggaacaagccgaccatatcctgtttctggaaggtggagcgattcgcgagggaggtacacaccagcagcttatggagaagaaaggttgttattgggctatggtacaggcccccgcggacgcccctgagtag

SEQ ID NO: 138667 - DNA, 2427 bp, Artificial Sequence
  Description of Artificial Sequence: Synthetic coding sequence
atggccgaattacttgcttctgcgggcagcgcctgtagctgggattttcctagagccccaccatcttttccaccccccgccgccagtcggggcggcttgggtgggactaggtcatttcggcctcatcgcggggccgagtctcctcggccaggtagggatcgcgacggcgtccgcgtgccaatggcctcgtctcgctgtcctgcccctagaggatgtcgttgcctaccaggggccagcttggcttggctgggaacggtgttattgctacttgcagattgggtgctcttacgcacagctctgccgagaatcttctccctgctcgtgcccaccgccctgccgctgttaagggtttgggctgtgggtcttagccggtgggctgttttgtggttaggagcctgtggcgtgttaagggcaacggtgggttctaagtcggaaaacgccggcgcccaaggctggctcgccgcattgaaacctttagccgccgctctcggcctggccctccccgggctggcgttgttccgtgagctcattagttggggtgccccgggtagtgccgattccactagactcctgcactggggttcccaccctacagcctttgtggtgtcctatgccgcagctctcccggcagctgccctatggcacaaactggggtcactgtgggttcctggaggccaggggggttccgggaacccagtccggaggcttctcggctgcctgggtagtgagaccaggcggctctcactcttcctggtcctggtggtcttgtcgtctcttggggagatggccattccgtttttcactggaagattgacagactggattctccaggatggctcagctgacacatttacacggaatcttaccctgatgtcgatcctgaccatcgcctctgccgtcctcgagttcgtgggcgatggtatttacaacaataccatgggccacgtccattctcatctccagggcgaggtgttcggagccgtgttgcgtcaagaaacagaattttttcagcagaaccagactggtaatatcatgagccgggtgacggaagatacctcgacactctcggactctctgagtgaaaatctgtccctcttcctgtggtacttggtgcggggcctgtgtttgctgggaatcatgctgtggggttctgttagcttgactatggtcacattgattactttgcctctgctcttcctgctaccaaagaaagtagggaagtggtaccagctcctcgaggtccaggtgcgtgaaagtttagcaaagtcctcgcaggtggccatcgaggcattaagtgcaatgccaacagtgcgaagctttgctaacgaggaaggagaagctcagaaattccgggaaaagctgcaggaaatcaagacgttaaaccaaaaagaggctgtggcatatgctgttaacagctggaccactagtatttccggcatgctgctgaaggtgggtatactatatatcggggggcaactcgtcaccagtggagccgtgtccagcgggaatctagtgaccttcgtgctttaccagatgcagttcacgcaggctgtggaagtcctgctgtccatctaccctagagtccagaaagctgtggggtcatctgaaaaaatctttgagtacttggaccgaaccccacgctgtcctcccagcggactgctcacccctctccatctagaaggcctggtgcagttccaggatgtatccttcgcatacccaaataggcccgatgttctggtgctccagggcctgacgtttacactgagacctggcgaagttactgctttagttgggcctaatggcagcggaaaatctacagtcgccgccctgctccagaatctgtaccaaccaacgggaggccagctgctcttagacggaaaacctctaccccagtatgagcacaggtatcttcatcgacaggttgccgctgtcggtcaggagccacaggtgtttggaaggtctctgcaggaaaacatcgcctatggattgacacagaagcccactatggaggagattacagccgccgctgtcaaatctggtgctcatagttttatttctggtctacctcaaggatacgacacagaagttgatgaggcggggagccagctgtccgggggccagaggcaggcggtggcactagctagggctctgattcggaaaccatgcgttctgatcctggacgacgccacaagtgcactggatgctaactcccaactgcaggtggagcaactcctgtatgagagtcccgagcggtactcacggtctgtcctgcttatcacacagcacttgtcactggttgagcaagcagaccatattcttttcctcgaaggcggggccatcagagaaggaggaactcatcagcagctcatggagaaaaagggatgctactgggccatggtgcaggctcctgctgacgctccagagtag

SEQ ID NO: 138668 - DNA, 1644 bp, Artificial Sequence
  Description of Artificial Sequence: Synthetic coding sequence
atggccatacccttttttaccgggcgtctgactgattggatccttcaagacggtagtgcagacacattcacaagaaatctcactttgatgtccattctgactattgcaagtgctgtgttagagttcgtcggcgatggcatctacaacaataccatgggacacgtccacagccacttgcagggcgaagtctttggggccgtgctccgccaggagaccgagttcttccagcagaatcagaccggtaatattatgtcccgcgtcactgaggacacttctacgctaagcgacagcctcagcgagaacctgagcctcttcctctggtacttagtgcgcggcctgtgtttgctcggaataatgctgtgggggagcgtgtctctaactatggttacccttatcactctccccctgctgtttttgctcccaaagaaagtggggaagtggtaccaactgctcgaggtgcaggtgagggagagcctggccaaatcaagtcaggtggcgatcgaagctctttcagcaatgcccacagtgagatcctttgcgaacgaggagggggaggcccaaaagtttcgggaaaaactgcaggagataaagacactgaaccagaaagaagcagtggcttacgccgtaaactcatggacaacctcaatttctggaatgctgttgaaggtgggaatcctgtacataggaggccagctcgtgacctcaggagccgtctccagcggaaacctggtcactttcgtcctctaccagatgcagttcacccaggctgtggaggtgctcctttccatttacccgcgcgtgcaaaaggctgtaggttctagcgagaaaattttcgagtacctcgaccgaacaccacgctgtcccccaagcgggctgttgacacctctccaccttgagggactggtgcaattccaagatgtgagcttcgcttaccctaacagaccagacgtcttagtgctgcagggactgacattcacactacggccgggagaggtcaccgccttggtaggacctaacggttctgggaaatcaactgtggctgcactcctgcagaacttgtaccagcccaccggcggtcaactgctattggatggcaagccattgccacagtatgaacaccgctacctgcatcgacaggttgccgcagtgggacaggagcctcaggttttcggtagaagtctgcaggaaaacatagcctacggtctgacccagaagcccaccatggaagagatcacagcagctgcagtgaagagcggggctcatagcttcataagtgggttaccacagggttatgatactgaggtcgatgaggccggatcacagctgtctggcgggcagcgccaggctgtggccctcgccagggcccttattcgtaaaccatgtgtcctgatcctggatgatgccacctccgccttggacgcaaacagtcagctacaggtcgaacagctgctgtatgagagccccgagcgctattccagaagcgtgcttctgatcacgcaacacctgtccctggtggagcaagctgatcatatactgttcttggaaggcggtgcaattcgcgaaggcggcacccatcagcagctgatggagaagaaaggctgttattgggccatggttcaggcccctgccgatgcccccgagtag

SEQ ID NO: 138669 - DNA, 1644 bp, Artificial Sequence
  Description of Artificial Sequence: Synthetic coding sequence
atggctatcccctttttcacaggtcgtctcaccgactggattctccaggatggctcagccgatacatttaccaggaatctgactctcatgtcaatcctgaccatcgcctccgctgtactggagtttgtcggtgacgggatctacaacaacaccatgggtcacgtgcactcacatcttcaaggggaggtgttcggtgccgtgctgcgccaagaaacggaattctttcagcagaatcaaaccgggaatatcatgtccagggtgacggaggatacatccactctctctgacagtctcagcgagaacctctctctcttcctctggtatctggtcaggggactctgcctcctcggtattatgctgtggggatctgtgagtttaacaatggtgaccctgattaccctgcccctcctgttcctactgccaaagaaagttggcaagtggtaccagctcctggaggttcaggtcagagagtctctcgccaaaagctctcaggttgctattgaagccctctcagctatgcctaccgtgaggtcattcgctaatgaggagggagaggcccagaagttccgtgagaaattgcaggaaataaaaaccctaaaccagaaggaagccgtcgcttacgccgtgaactcttggactacctctatttctggtatgctccttaaggtgggcatactgtacataggagggcagctggttacgtccggcgcagtctcatccggaaacctggtcacttttgtactgtatcagatgcagtttacccaggccgtcgaagtcctgcttagcatttatcctcgtgttcagaaagcagtgggaagtagtgaaaagatctttgagtatttggatcggactcccagatgtccaccgtccgggctgctcaccccactgcaccttgagggcctcgttcagtttcaagacgtaagcttcgcttatccaaatcgccccgatgtcctggtcctgcaggggctgacttttaccctacggcccggagaggtaaccgccctggtaggacctaacggtagcggcaagtctactgtcgccgcgctgctccagaacttgtaccagccgaccggtggccagctattgctcgatggcaagccccttcctcagtacgagcatcgctacttgcatcgtcaggtggccgccgtgggacaggagcctcaagtttttggacgttcgctgcaggagaatatcgcttacggcttgacccagaagcctactatggaagaaatcactgctgcggctgttaagagtggggctcacagtttcattagtgggttgccacagggttacgacaccgaagtggacgaggcaggctctcagctgagcggtggccagagacaggctgtagctctggccagggccctgatcaggaagccctgcgtcttaatattggacgatgccacgtctgccctcgacgccaactctcagctgcaagtagaacagctgctgtatgagtctcctgagcgctactccaggtccgttctcctcatcacacagcatctgagcctggtggaacaggccgatcacattctgttcctggagggtggcgcgattagggaaggtggaacccaccaacagctgatggagaagaagggctgttattgggccatggtgcaggcgcctgctgatgcaccggagtag

SEQ ID NO: 138670 - DNA, 1644 bp, Artificial Sequence
  Description of Artificial Sequence: Synthetic coding sequence
atggccatacctttttttacgggacgcttgaccgattggatcctccaggatgggtcggctgatacctttacccggaatttgaccctcatgtctatcctgaccattgcatccgcggttttagagtttgtaggtgacgggatatacaacaataccatgggacacgtgcactcccacttgcagggagaagtctttggtgccgtgctgcggcaagagacggagttttttcagcagaaccagaccgggaacattatgtccagggtaaccgaggacaccagtaccctgtctgactcattgagcgaaaatcttagcctgtttttgtggtacctggtgaggggcctctgccttctaggcatcatgctgtgggggtccgtgtcactgaccatggtgactttgatcacgctgccactcctgttcttgctccctaagaaagttggcaagtggtaccagttgctcgaggtgcaagtgcgagagagcttggcaaaatcaagtcaggtggccatcgaagcactttctgccatgcctaccgtaaggtcattcgccaacgaagagggtgaggcccaaaagttcagagaaaaactgcaggagatcaaaacacttaatcaaaaggaggccgttgcctacgcagtcaactcatggacaactagtatttcggggatgctgctgaaggtagggattctgtacataggagggcagcttgttacatctggagcagtttcgtctggtaatttagtcactttcgtcctgtatcaaatgcaattcacacaggccgtggaagtacttctgagtatatacccgagagtccagaaggcagtggggtcctcggagaagatctttgaatatctcgataggacccctcgatgccctccctccggattgttgacaccactacacctcgagggtctggttcagttccaagatgtcagtttcgcatatcctaatagaccagacgtgctggtgctgcaaggcctcaccttcaccctgagacctggtgaggtgactgctctggttggcccaaacggatctgggaagagtacggtggcagcactgctgcagaacctgtatcagccaaccggcggccaactgctgctggacggaaaaccattgccgcagtacgaacaccggtacttgcaccgccaagtggctgcggtgggccaagagccccaggtttttgggcgcagccttcaggagaatattgcctacggacttacacagaagcctaccatggaagagataactgccgcagccgttaagagcggggcccattccttcatcagtgggctcccccaggggtacgacacagaggtcgacgaggccggtagtcagctgagtggagggcagaggcaggctgtcgcgctggctcgggccctgatcagaaaaccctgcgtgttgatcctggatgatgccacaagcgccctggatgccaactcccagttacaggtagagcagttactctatgaaagcccagagagatattcacggagcgtcctgctgatcacccagcacctgtctcttgtggagcaggctgatcatattctgtttctggaggggggcgctatcagggaaggcggtacacaccagcagctgatggaaaaaaaagggtgttactgggctatggtacaagcacctgcagacgcacccgagtag

SEQ ID NO: 138671 - DNA, 1644 bp, Artificial Sequence
  Description of Artificial Sequence: Synthetic coding sequence
atggctattcctttctttacaggtcggttgacagattggattttgcaagacggaagcgctgacacgttcacccgaaatttaacactgatgtcgatcttgactatcgcgtccgccgtgctggaattcgtgggagacggtatctacaataatacaatgggccacgtccatagccatcttcaaggagaagttttcggggcagtcctccgacaagagacggagttttttcagcagaatcagaccggtaatatcatgagcagagtaacggaggacaccagcacacttagcgattccctaagcgaaaacctgagtctctttttgtggtatcttgttcggggtttatgtcttctgggaattatgttatgggggagcgttagcctgaccatggtcacattgatcacactgcctctcctgttcctattgcccaagaaagttggaaaatggtaccagttacttgaagtgcaggtgagagagagcctggctaagagttcccaggtggcaatcgaggctctgtcagccatgcccactgtcagaagttttgcaaatgaggagggagaagcacagaagtttagggagaagctccaggagattaagactctaaaccagaaggaggcagtggcctacgctgtgaactcttggacaaccagcattagtggcatgctccttaaggtgggcatactgtacatcggtggacagcttgttacttcaggcgccgtttcttccggcaacctcgttactttcgtgctctatcagatgcagttcacacaggccgtggaagttttgctgagcatatatccaagagtgcagaaagctgtgggctcctccgaaaaaattttcgaatacctggacagaacacccagatgtcctcccagcgggctccttacccccctgcacttggaaggcttagtacagttccaggatgttagttttgcctacccgaaccgtcccgacgtgctggtgctccaaggtctgacttttacactgcgtcctggcgaggtcactgccctcgtgggtccaaacggatcaggaaaatccacagtggctgccttactccagaacctctaccaacccaccggaggacaattgctcctggacggtaagcctctcccccagtacgagcacagatacctgcacagacaggtggcggcggtcggtcaggagccacaagtgtttgggcgttctttgcaggagaatatcgcatacggcctgacacaaaaaccaacaatggaggagatcactgccgccgcagtgaaaagcggagcccatagctttatttcgggattgccccaaggctacgacacggaggttgatgaggctggctcccagctgagtggggggcagaggcaagccgtggccctggccagggcacttatccgaaagccctgcgtcctcattctcgacgatgccacctcagctctagatgccaattcacagctgcaggtggagcagttgctgtatgaaagcccagagagatactcacggtccgtccttcttattacccaacatctttcgctggttgagcaggccgaccacattctgtttcttgagggcggagcaatcagagaggggggtacccatcagcaactgatggaaaagaagggctgttattgggctatggtccaggcccccgcagacgcgcccgagtag

SEQ ID NO: 138672 - DNA, 1644 bp, Artificial Sequence
  Description of Artificial Sequence: Synthetic coding sequence
atggccatccctttcttcaccggccgcctgaccgattggattctgcaggacggtagcgccgacacattcacaagaaatttgaccctgatgtcaatcctgactatcgcctctgctgtgctggaatttgtcggtgacggtatctacaacaacactatgggccacgtgcattcccatctgcagggcgaagtgttcggggctgtccttaggcaagagacagaatttttccaacagaatcagaccgggaatatcatgagcagggtcaccgaggacacatccaccctgagtgactctctgtcagaaaatctatcgctgttcctgtggtatctggtgaggggactgtgtttgttagggattatgttgtgggggtcagttagtttgacaatggtgactctcatcacattacctctcctgttcttgctcccgaaaaaggtcgggaaatggtaccagttgctagaagtacaagtccgcgaaagcctggccaagagctctcaagtggcaattgaggctctcagcgcaatgcccacagtgcggagctttgcaaatgaagaaggagaggcccagaagttccgggaaaaactgcaggaaattaagacactgaatcagaaagaggctgtcgcatatgcggtaaactcatggaccactagcattagtggcatgcttctgaaagtgggcatattatatattggcggacagctagtcaccagtggtgctgtgagttcgggaaacctggtgactttcgtactgtaccaaatgcagttcacacaagcagtggaggtgctgctgagcatctatcctagggtgcagaaagcagttgggagcagcgagaaaatcttcgagtacttggatcggacaccccggtgtcctccttctggtttgctgacgccattacatctggagggcctggtgcagtttcaggatgtttcttttgcttatcccaaccgacccgatgtactcgtgctgcagggcctgacgtttacactgagacctggtgaagtaacggccctggtagggcctaatgggtcaggaaagtccaccgtggccgcacttctgcagaatctgtaccagcccaccggcggacaacttttgctcgatggcaagcctctgcctcagtacgaacatcggtacctgcaccgccaggtggccgcagtgggacaggagcctcaggtgttcggacggtcccttcaggagaacatagcctatggcctaactcagaagccaacaatggaggaaattactgccgccgctgtcaagagcggcgcccacagcttcatcagcggtctgcctcaggggtacgatacagaggtggatgaagctggctctcagctcagtggtggacagagacaggcagttgcactggctagagccttgatcaggaagccctgcgtcctgattttggacgacgctacgagcgccctggacgccaactctcagctacaggtggagcagctgctgtacgaaagcccagagaggtactccagatcagtgttgctaattactcagcacttgagtctcgtggaacaggccgaccatatcctcttcctggaaggcggtgctattagggagggtgggacacaccagcagcttatggagaaaaaagggtgttattgggccatggtgcaggcccctgccgacgctccagaatag

SEQ ID NO: 138673 - DNA, 1644 bp, Artificial Sequence
  Description of Artificial Sequence: Synthetic coding sequence
atggccattccttttttcaccggtagactgaccgactggatccttcaagatggcagtgccgacacattcactcggaacctcacactgatgtccatactgactatcgcgtcggcagttttagagttcgtgggagatgggatatataacaacacaatgggtcacgtccactcccacctccagggcgaggtgttcggggcggtgctgagacaggagacagagttcttccaacagaatcaaaccggcaacattatgtctagagtaacagaagacacaagtactctgagcgactctttatcagagaacttaagtctcttcctgtggtatctagtgcgtggcctctgtctgctggggatcatgctatgggggagtgtgtcactcactatggtgacgcttataaccctcccccttctattcttgcttcccaagaaggtgggaaagtggtatcagctgctggaggttcaggttcgggagtccctcgctaagtccagccaggtggctatagaggctctttcggctatgcccaccgtgagaagcttcgccaacgaggagggggaggctcagaagttcagggagaaacttcaagaaattaagactctgaaccagaaggaggcggtcgcatatgcagtgaattcttggacaaccagcatatccggtatgttgctgaaagtgggaatcctttacatcgggggccaactggtaacttcgggagccgtgtcatccggaaaccttgttacttttgtcctgtaccagatgcaattcacccaggccgttgaagtgctgctcagcatctatcctagggtacaaaaagcggtcggttcatcagagaaaatatttgaatacttggatcgcacaccaaggtgccccccttctggcctgttaacgccccttcacctggaggggctggtccagttccaggatgtatccttcgcatacccgaatagacctgatgtactcgttctccagggccttacttttacgctgcggccaggcgaagtgacagcccttgtgggtcctaatggcagcggcaagagcactgtcgctgccctcttgcagaatctgtatcaaccgaccggcggacagttactcctggacgggaagccccttccacagtacgaacatcggtatctgcacagacaggttgctgcggtcggacaggagcctcaggtgttcggaaggtcactgcaggaaaacattgcttatggtctgacccagaaacccactatggaggaaatcaccgccgccgccgtcaagtccggcgctcactcattcatcagcggactgccccaggggtatgataccgaggttgatgaagccggatctcagctgagtgggggtcaacgccaggcggttgcactcgcccgggctctcattagaaagccttgtgtactgatcttggatgacgccacgtctgctttggatgccaattcacaattgcaggtggaacaactcctttacgagtcccctgaaaggtactcaaggtctgtgttgctgatcacccagcacctcagcctggtcgagcaggcagaccatattctatttctggaaggcggggctatcagagagggcggcacacaccagcaacttatggaaaagaagggctgttattgggccatggtacaggccccggccgatgcaccggaatag

SEQ ID NO: 138674 - DNA, 1644 bp, Artificial Sequence
  Description of Artificial Sequence: Synthetic coding sequence
atggctattcccttctttaccgggaggctgactgactggatcctgcaggatggcagtgctgatacatttacgagaaatctcactctgatgtctattctaacaattgcgagtgctgtgctggaattcgtcggggatggaatatacaataatacaatgggacacgtccactctcacctgcaaggcgaggttttcggtgctgtcctccgacaggaaacggaattctttcagcaaaaccagactggtaacataatgtcaagggtgacggaagacacctctactctctccgatagtctgtctgagaacctgtccctcttcctgtggtatctagttcggggcctgtgtctccttggcattatgttatggggctctgtgagtctgacaatggtgactctcatcacattgccgctgttgtttcttctaccgaagaaggtcgggaagtggtaccaactcctcgaagttcaagtgagagagtctctggccaaaagctctcaggtagcaatcgaggccctgtccgcaatgcccaccgtgaggtcctttgccaacgaagagggcgaggcccagaagtttagagaaaaattgcaggagattaaaacgctcaaccagaaggaagcagtagcctacgccgtcaattcttggacaaccagcatttctggcatgctgctcaaggtcggtatcctctacatcggcgggcagctagtgaccagtggtgcggtttcttccggaaatttagtgacctttgttctctatcaaatgcagtttacacaggcggtggaggttctgctttcaatctacccgcgagtccagaaggcagtgggctcaagcgaaaagatatttgaatatttggacaggactccgcgatgtcccccgagtgggctgctgactcccctccacctagaaggactcgtccagttccaggacgtgagctttgcttatccaaatcgacccgacgtactggtactgcagggtctcacgttcacactgcgaccaggagaagttactgcattagttgggcccaacggctcaggaaaatctacagtggcagccctcttgcagaacttataccaaccaaccggcggccagcttctattagacggcaagcccctgccgcaatacgagcacaggtacctgcaccgacaggtggctgccgttgggcaagagccacaggtattcggccgctctttgcaagaaaacatagcttacggtcttacccaaaagccaaccatggaggagattaccgcagcagcggtcaaatccggggcacattcatttatatccgggctcccgcaaggctacgatactgaggttgatgaagccggttctcaactttccggcgggcagaggcaggccgtcgccctggcccgggctctcattaggaaaccatgtgtgctcatcctggatgacgcaacaagcgccctggatgctaacagtcagctacaagtggagcaactgctgtacgaatcgccggagcgctatagtcgctccgtgctcctcattacacagcacctgagccttgtggagcaggccgatcatattctgtttttagagggaggcgctattagggagggtgggacacatcaacagctcatggaaaagaaggggtgttattgggcaatggttcaggctcccgccgatgcgcccgagtag

SEQ ID NO: 138675 - DNA, 2061 bp, Artificial Sequence
  Description of Artificial Sequence: Synthetic coding sequence
atgaggctgccagacctaaggccttggacttctctgctgctggtcgatgcagcgttgctgtggctgctgcagggccctcttggcaccctcctaccgcagggactgccgggactgtggctggagggtaccctgcgactcgggggactgtggggcttgctgaagttgagaggcctgctgggttttgtgggcactttgctgctgcctctgtgcctggctactccactaaccgtgtcacttcgagcccttgtcgctggggccagccgggcacctccagctcgcgtggctagcgccccctggtcatggctgctagtgggttatggcgcggccggcctgtcctggagcctatgggccgtgttgtctcccccgggcgcacaagagaaagaacaagaccaggtgaacaacaaagtgctgatgtggcggttgctgaaactatctagaccggacctcccactcttggtcgctgcatttttctttctggtcctcgccgtgttaggggagacgctaatccctcattactcgggccgcgtcattgacattttgggaggggacttcgaccctcacgctttcgcctcggccatctttttcatgtgtctgtttagcttcggcagttcattatcagctgggtgtcgtggtgggtgttttacttatacaatgagcagaattaacctccggatcagggaacaactattttcttccctgcttcggcaagacttaggttttttccaggagactaagacaggggagctgaattcaagactttctagcgacacgactttgatgtccaattggcttcctctaaacgcaaacgtactgttaaggtcattggtgaaagtagtagggctgtatggttttatgctttccatttcgcccaggttgactctgttatctctgctgcacatgccattcacgatcgccgccgagaaggtatataacacacgccaccaggaggtgttgcgggagatccaagacgcagtggccagagccggccaggtggtccgcgaggcggtgggcggcctgcagacagtgagatccttcggggcagaggaacatgaagtatgccgctacaaggaagcgctggagcaatgccgccaactatattggaggagggatctcgaacgggccctgtacctgctcgtgcggcgtgttctgcatctgggggtacagatgctcatgctctcctgcggcctgcagcagatgcaagatggtgaactcacccagggctccctcctgagctttatgatatatcaggagtctgttggcagctatgttcaaacattggtctatatctacggagatatgctctcaaacgtcggcgctgcagagaaagtcttctcttatatggataggcagcccaatttgccctctccgggcacgctcgcccctaccacccttcagggcgtcgtcaagtttcaagatgtgtccttcgcctaccccaacaggcccgatcggcccgtcctcaaagggcttaccttcactctccgccccggggaggtgacagcactagtcggccccaacgggtctggcaaaagcacagtggccgccctacttcaaaatctctaccaaccgacaggtggccaggtcttactcgacgaaaagccaatatcacaatatgaacattgctacttgcatagtcaggtcgtgtcagtgggacaggagccagtgctgttctccggttctgtacgcaacaacattgcctacggattacagtcatgtgaggatgataaggtgatggcggcagcacaggccgcacatgccgatgattttattcaggagatggagcatgggatctatacagacgtcggcgaaaaaggctctcaactggctgccgggcagaaacagaggctggccattgcgcgggccctagtcagggaccccagagtactcatcctggatgaagctacatcagcactggacgtgcaatgcgagcaggccctccaggactggaacagccgcggagacagaactgtcttggtgattgctcaccgattgcagaccgtccagcgggcccaccaaatactggtgctccaagaaggcaaattacagaaactggcccagctctag

SEQ ID NO: 138676 - DNA, 1962 bp, Artificial Sequence
  Description of Artificial Sequence: Synthetic coding sequence
atgcgcttgcctgacctgcgaccttggacatccttacttctggtggatgctgcactactctggctcctgcagggcccattgggcaccctattgccacaggggctcccgggcctctggttagagggaacccttaggctaggagggctctggggactgctgaaactccgaggactgctggggtttgttggcactttgttgttgccactgtgcctggcaacaccattaaccgtgtccctcagagcattagttgcaggcgcttctagggccccccctgcacgggtagccagtgccccatggagctggttgctggtagggtacggcgccgcaggactttcctggtccctctgggctgttctcagtcctccaggggcccaggaaaaagagcaggaccaggtaaacaacaaggtactgatgtggcggcttctcaagctgtctcggcccgatttgcctctcctcgtcgcggcctttttctttctggtattggctgtcctcggcgagacacttataccacactactccggccgggtcatcgacatcctcgggggggatttcgacccccacgcctttgcctctgccatcttttttatgtgtttgttcagcttcggaagctccctttctgcggggtgtaggggaggctgttttacctacaccatgtccagaatcaatctgaggatccgggagcagctgttcagtagtctcctgcgacaggacctgggcttcttccaggagaccaaaaccggagagttgaatagcagactgagctcagatacaacgttgatgtctaattggttgccccttaacgccaacgtgctgctgcgctctctagtgaaggtggtaggcctgtatggattcatgctgtctattagccctcgactcactttgctctctttgcttcacatgccctttaccatcgctgccgagaaagtgtacaatactcggcaccaggaggttctccgtgaaatccaggatgctgtcgccagagccggccaggtagtgcgggaagccgttggcggcctacagactgtgagatcttttggagccgaagaacatgaggtctgccgatacaaggaggcactcgagcaatgcaggcagctatattggcgcagagatctagagcgggctctgtatctccttgtaagaagagtactccatctgggggtgcagatgttgatgttgtcctgtggtctgcaacaaatgcaggacggtgaactgacgcaagggtcactgctgtccttcatgatctatcaggagtccgtgggcagttacgtgcagacgctggtgtatatttacggagatatgctgtctaacgtaggtgctgccgaaaaggtgtttagctatatggacagacaacccaatctcccaagcccgggtacccttgccccgaccaccctccagggagtggtcaagtttcaggatgtgagctttgcctatcccaaccgccccgatcgccctgtgctaaaagggcttacctttaccctgaggccaggcgaggtaaccgcgcttgtcggacccaacgggagtggcaaatccaccgtagccgctctgctccagaatctctaccagcccaccggcggccaagtattgctggacgaaaaacctatttcccagtatgagcactgttacctgcacagccaggtcgtttctgtcggccaagaacctgtgctgtttagcgggtccgtgaggaataatattgcttacggtctgcaatcctgcgaagacgacaaggtgatggcggcagctcaagccgctcatgccgacgattttatacaagagatggaacacggcatttataccgatgtaggagaaaagggaagtcagcttgcagctggacagaagcagaggttggcgatcgcccgtgccttagtgcgggaccctcgcgtactgatactcgacgaggcaacctctgcccttgacgtccagtgcgagcaggccaagactctgtggaaattcatgatattttag

SEQ ID NO: 138677 - DNA, 2061 bp, Artificial Sequence
  Description of Artificial Sequence: Synthetic coding sequence
atgcgtctgccagatctcaggccatggacctccctgctcctggtggatgctgcccttctgtggttacttcagggtcctcttggcacactgctgccgcagggtctccccgggctctggctggaaggcactctgagactgggcggactctggggcctcttgaagcttcggggcctgctcgggtttgtgggcacactgctgcttcctttgtgcctggcgacacctctgacagtgtccctccgcgctctcgtggcgggcgcctctagggcgcctcccgccagagttgcatccgcaccctggagttggctgctggtggggtatggcgcagcaggattaagctggtctttgtgggctgtcctcagtcctccaggggcccaggagaaggagcaggatcaagttaacaataaagttttaatgtggcggctgcttaaactgtcacggccagatctgccactcttggtggcagctttttttttccttgttcttgcggtgctaggcgagactctgatcccacattattctgggcgagtgatcgatatacttggcggagacttcgacccccatgctttcgccagcgcaatattcttcatgtgtttgttttcatttggttcttctctatccgcagggtgccgaggagggtgcttcacttacacgatgtcaagaatcaaccttaggatccgagaacagctgttctctagcttgctccgacaggatctgggcttcttccaggagacaaaaaccggagaactaaattcaaggctgtcaagcgacacaactctgatgtcaaattggctccctctcaatgccaacgtgctgctgagatcccttgtaaaggtcgtaggcctctacggcttcatgctgtcaatctccccacgactgaccttgctgtccctactacacatgcccttcacaattgccgccgagaaggtctataatacacgacaccaagaggtactgcgagagatccaggacgctgtcgcccgtgcgggccaggtagtacgagaggccgttggaggactgcagaccgttcgaagtttcggcgcagaggaacacgaggtctgtagatataaggaagctcttgaacagtgcagacagctctattggcggagagatctggaacgcgccttgtacctgctggtgcggcgcgtacttcatctgggcgtgcagatgcttatgctatcatgtggactccagcaaatgcaggacggagaacttacacagggtagtcttctgtcctttatgatttaccaggagagcgttggaagctatgtgcagaccttggtgtacatttacggagacatgctgtctaacgttggagccgctgaaaaagtcttctcttacatggaccgccagcccaacttaccctcacccgggactctggctcccacaaccctccaaggggtagttaagtttcaggacgtcagcttcgcctatccaaatcggccggatcgccccgtgctgaagggtcttaccttcacattacggcctggggaagtcacagcactggtggggccgaatggttccggaaagagtactgttgccgccctgctccagaatctttaccaacctaccgggggacaggttctactggatgagaagccaatttcccagtacgagcattgctatttgcacagccaggtggtctccgtgggacaagagccagtactgttctcgggtagtgtacgaaacaacatcgcctacggcctgcagtcctgcgaagacgacaaggtcatggcagcagcccaggctgcccatgccgatgacttcattcaggaaatggaacatggtatatacactgatgtaggggagaaaggttcccagttggcagccggccaaaagcaaaggttagccatagcacgggcactcgtgcgagaccctcgcgtgttaatccttgatgaagccaccagtgctcttgacgtgcagtgcgaacaagcacttcaagactggaactcccggggagatagaaccgtgttagttatagctcacaggcttcagaccgtccagcgcgcgcaccagattctggtgctgcaggagggtaagctgcagaagcttgcccagctttag

SEQ ID NO: 138678 - DNA, 1962 bp, Artificial Sequence
  Description of Artificial Sequence: Synthetic coding sequence
atgaggctcccagacttacgaccgtggaccagtctcctgctcgtggacgccgccctattgtggctcctgcagggcccactcggaacattgctgccacaggggctccccggcctttggctcgaaggaaccttgcggctgggaggcctgtggggactgcttaaactgcgagggctgctggggtttgtgggaacgctgctgctccctttgtgtttggccacgccactcacagtgagcctgcgcgcgttagtcgctggcgcttcccgtgccccgcctgcccgtgtagcatctgcaccttggtcctggctcctggttggttacggtgccgctggtctcagctggagcctgtgggcggtgctgagcccgcccggagctcaggagaaagagcaggatcaagttaacaataaagtgctcatgtggaggctgctgaagctgtctaggccagatctccccctgctcgtggcagcctttttctttcttgtactggctgtgttaggcgagactctgattccccactactctgggcgggtgatcgacatcctcgggggtgatttcgacccgcatgcattcgcttctgccatcttcttcatgtgtctgttctcattcggcagttcgttgtccgcaggttgtcgcggaggctgtttcacatataccatgtcacgcatcaacctgagaatccgggaacagctgtttagcagcctgttgcggcaggatctcggcttctttcaggaaaccaaaactggtgagcttaattctagactgagtagtgataccactcttatgtccaattggctccctctaaatgcgaacgtgctgctccggtccttagtgaaagtagtggggctctatggattcatgctttctatttctccacgcctcactctgctttccttgcttcatatgccttttaccattgcggctgagaaagtctataatacccgtcatcaggaggtgctgagagagattcaggacgctgtggctcgcgccggccaggtcgttagggaagccgtagggggtctgcagacagttcggtcctttggagccgaggaacatgaagtctgccgatacaaagaagccttggagcagtgccgccagttgtattggcggagagacctggaaagagccttatacttactggtccgccgggtcctccacctgggggtgcagatgcttatgttgagctgtggcctgcagcaaatgcaggacggagagcttacgcagggtagtcttctttcttttatgatctaccaggagtccgttggttcatacgtgcaaacgttggtgtacatttacggagacatgctatctaacgtgggggcggccgaaaaagtcttctcttacatggatagacagcccaacctccccagcccaggcaccctggctcccaccacattgcagggtgtcgttaaattccaggatgtgagtttcgcctacccaaatcgccccgacaggcccgtgctgaaggggctcaccttcacccttaggccgggggaagtcaccgctcttgtgggccctaacggctcgggcaaatcgactgtcgccgccctcttacaaaacttataccagcctaccggtgggcaagtgctcctggatgaaaagccaatctcccagtatgaacactgctatttgcatagccaggtggtctccgtcgggcaggagccggtcttgtttagtgggtctgtccgtaataacattgcatacggcctccagagttgtgaagatgataaggtgatggctgcagctcaggcagcccacgcggacgacttcatccaagagatggagcacggcatttacactgacgtgggcgaaaagggttcccagttagcggctgggcagaagcagaggctggccattgctagggcccttgtgcgagatcccagagtcttgatattggacgaagctacatcagccctggacgtacaatgcgagcaggccaagacactctggaagttcatgattttctag

SEQ ID NO: 138679 - DNA, 2061 bp, Artificial Sequence
  Description of Artificial Sequence: Synthetic coding sequence
atgaggctgccagatttgagaccgtggacctcgctcctgttagtggacgccgccctgctgtggcttctccaggggccactgggcacgttgctgccgcaggggctgcccgggctgtggttagagggcactctgaggcttggggggctgtggggactcttaaagctgcggggcctgctgggttttgttggcactttactcctgcccctctgcttggccactccgctcaccgtctctctcagggcgctcgtagccggtgcttcacgggccccacccgccagagtcgcctccgccccttggagctggctgctggtcgggtacggtgcggctggccttagttggtccctttgggccgtcttgagcccccccggtgcccaggaaaaggagcaagaccaagttaataataaagtattgatgtggaggctcctcaagctgtccaggcctgatctccctctcctggtcgccgcctttttttttctggtgctcgctgtgcttggggagactctcattccccattacagcggtagggtcattgacatcctaggtggagattttgacccccacgcctttgccagcgccatcttctttatgtgcctctttagtttcggctcctctctgtcagctggctgcagggggggctgcttcacctacactatgtcacgtattaatcttagaattagagagcagctgtttagctccctcctgcggcaggacctggggttttttcaggagaccaagactggggaattgaacagcagactcagctccgacacaaccctgatgtccaactggctgcccttgaacgccaacgtccttctccggtccctggtgaaagtggtgggcttgtatggtttcatgctttccatctccccccgactgacccttctgtcattgcttcacatgccatttacaattgccgcagagaaggtctataacactcgccatcaagaagtcctccgcgagatccaggatgccgttgcacgggctggccaagtcgttagagaggctgtggggggtttgcaaacggtgcgatcttttggcgccgaggagcacgaagtgtgtcgatacaaggaggcccttgagcagtgtcggcagctttactggcgtcgagacctggagcgggccctctatctgttagtgcgccgggttcttcacctcggcgtacagatgctgatgctgagctgtgggctccagcagatgcaggatggcgaactcacacagggatccctcctgtcattcatgatctaccaagagagcgtgggatcctacgtccagaccctggtgtatatctatggcgacatgctgtcgaacgtgggtgcagctgaaaaggtgttctcatatatggacagacagccaaacctgccaagtcctggtaccctcgcacccacaaccttacagggcgtcgtcaaatttcaggacgtatcttttgcctacccaaacaggcctgataggcctgtgctgaaaggtctcacattcaccttgcgccccggcgaggtaacagcacttgttgggcccaacggcagcggtaaaagtaccgtggccgcgttgctacagaacctctaccagccaacaggaggtcaagtactgctggacgagaaacccattagccagtatgaacattgttacctccactcccaggtggtaagcgtcgggcaggaacccgtgctgttcagcggctctgttagaaataatattgcttacggacttcagagttgcgaggatgataaagtgatggctgcggcacaagcagcccacgcagatgatttcatccaggaaatggaacatgggatttacacagatgtcggggaaaagggctcccaacttgccgcgggtcagaagcaacgcctcgcaatcgccagagccttagtccgggaccctcgggtgttgattctggacgaagccaccagtgcacttgatgtgcagtgtgaacaggcactgcaggattggaactcacgtggcgacagaaccgtactggtgatcgctcacagattgcagaccgtccagcgcgcgcatcaaattctggtgctccaggaaggaaaattgcagaaacttgcacaactctag

SEQ ID NO: 138680 - DNA, 1962 bp, Artificial Sequence
  Description of Artificial Sequence: Synthetic coding sequence
atgcggctcccagacctgcgcccatggacctccctgttgcttgttgacgcagcgctgttgtggctgttgcagggcccactgggtacgttgctccctcaaggactccctgggctctggcttgaggggaccttaagactgggggggttgtggggcctgctcaagctgcgtggactcttaggattcgtcgggacactgttgctccccctctgcttagcgacacccctcacagtgtccctgcgggctctcgtggccggggcttcccgggctcctcccgcccgcgtggccagcgcaccatggagctggctgctggtcggatacggcgcagccggcctctcatggtctctgtgggcagtattgtcaccaccaggtgcacaagagaaagagcaggaccaggtcaacaacaaggtactgatgtggagattgcttaagctttcccgacccgatttaccattgctggttgccgccttctttttccttgtgttggcagttctgggggaaacattgatccctcactactcaggacgagtaatcgacatccttggaggcgattttgatccacacgccttcgcaagtgccatctttttcatgtgtctgttttcattcggcagttcgctgagtgccggctgccggggtgggtgcttcacctacacaatgtctcgtataaacctgcgtatcagggagcaactgttcagcagcctgctgcgccaggatctgggcttttttcaggagacaaagaccggcgagctgaattccagactaagttccgataccactcttatgtccaattggctgcctctgaatgctaatgtcctcctgcggagccttgtaaaggtcgtggggctgtacggttttatgttatctatctcccctcgcctcaccctgttatcactcttgcatatgcccttcaccatagcagcagagaaggtctataacacccggcaccaggaagtcctgagggagattcaggatgcagtggcccgggcaggccaggtggtgcgcgaagccgtgggagggcttcagactgttcgaagttttggagccgaggaacatgaggtgtgtcggtacaaggaggctctggagcagtgccggcagctttattggcgacgggacctagaacgggctttatacctgctggtacgccgtgtgttgcaccttggcgtgcagatgctaatgctttcttgtggccttcagcagatgcaagacggagagctgacccagggctccctgttatcctttatgatttaccaggaaagcgtcggctcctatgtgcaaaccctggtgtatatttatggtgacatgctgagcaacgtgggagctgcggaaaaggtattcagctacatggacagacaaccaaatctgccatcaccaggaaccctcgcccccaccacactgcaaggcgtagtgaaatttcaagatgtttcctttgcctatcccaacaggccagaccgccccgtgctcaagggcttaacgtttaccctcagaccgggcgaagtcacagccctagtgggacccaacggatctggcaagagtacagtagcagccctgctccaaaatttataccagcctaccggtgggcaggtgttactggatgagaaacctatcagtcagtacgaacactgttatctgcattcgcaggtcgtgtctgtgggccaggaacccgtcctttttagcggcagtgtgaggaacaacattgcttacggcttgcagagctgtgaggatgataaggttatggcagctgctcaagcagcgcatgccgatgattttatccaggagatggagcacggcatatacaccgatgtgggggagaaaggctcccagttggctgcaggtcagaaacagaggctggcaattgcacgcgcactggtgagggatcctagggttctgatcctggacgaagccacatctgcccttgacgttcagtgcgagcaggccaagacactgtggaagtttatgattttttag

SEQ ID NO: 138681 - DNA, 1962 bp, Artificial Sequence
  Description of Artificial Sequence: Synthetic coding sequence
atgcggttacctgatttgcggccttggacatctcttctgctggtcgatgccgctctgctctggttactccagggacctttaggcacgctgctccctcaggggttgccaggcctgtggctagaagggactcttcggctcgggggcttgtggggcctgctgaagctgaggggcctactggggttcgtgggcaccctgctgcttccactgtgcttagccacacccctgacagtgtccctgagggctctcgttgccggcgctagccgcgcaccacccgctcgggtcgcgtccgccccctggtcttggctgttagtgggatacggagcggcagggctgagttggtccctctgggctgtcctgagtcctccaggcgcccaggaaaaggagcaagaccaggtcaataacaaggtcttaatgtggcggctattaaagctctctaggcccgacttacctctcttggtggctgcatttttctttctcgtgctggccgtgctgggcgagacactgattccccactattccgggcgggtgatcgatattctcggcggtgatttcgatccccatgcgttcgcctctgctattttttttatgtgtctcttctcctttggatccagcctttcagcaggctgcagagggggctgttttacatacaccatgtcccggataaatctgagaatcagagaacagctcttctcttccctgcttcgccaagatctcggtttctttcaagagaccaaaaccggggaactcaactccagattgagcagtgatacaacactaatgtccaactggctccccctcaatgcaaatgtgttattgcggagcctcgtgaaagtcgtgggcctgtacggctttatgttaagcatatcgccacggttgacattactgagcttgctccatatgcccttcacgatagccgctgagaaggtgtacaatacacgccaccaggaggtgctcagggagatccaggatgctgtggcgcgtgcaggccaggtcgtcagagaagcagtgggcggactccagacagtacgaagctttggggctgaagaacacgaggtatgcaggtacaaggaagctctagagcagtgcagacagctgtactggcgtcgggacttagagagagctctctacctgctggtgagacgcgtgctccatctgggggtgcagatgctgatgctctcttgcggattgcagcagatgcaggatggtgagctgacgcagggtagcctgttgagcttcatgatctatcaagaatccgttggaagttatgtccaaacattagtatatatttacggagacatgttgagcaatgtaggcgccgcggagaaagtcttctcgtacatggaccgccaacccaatctcccatcacccgggacgctcgcaccaaccaccctacagggtgttgtcaaattccaagacgtgagtttcgcatatcccaatagaccggaccgcccggtactgaaggggctgacgttcaccctcaggccaggcgaggtgaccgcgctggtaggtcccaatggaagcggtaaatccaccgtggctgcacttctccagaacctgtaccagcctaccggtggtcaggtgctcttggacgagaagccaatcagccagtatgagcattgttacctgcattcacaagtggtctctgtaggacaggaacccgtgctgttcagcggctctgtgcggaataatattgcctacggcctgcagtcgtgtgaggacgacaaagtaatggctgccgcacaggctgcacacgctgacgacttcatccaggagatggagcatggaatatataccgacgtcggggaaaagggatcccaactggccgcgggtcagaagcagcgactggcaattgcccgagctttggtccgcgatccgagagtactaatcttggatgaggcaacaagcgcgctcgacgtccaatgtgagcaggccaaaaccctgtggaagttcatgatcttctag

SEQ ID NO: 138682 - DNA, 2061 bp, Artificial Sequence
  Description of Artificial Sequence: Synthetic coding sequence
atgaggctccctgacctgcgcccatggacatcactgctgctggtggacgccgcactcctctggctcctccaaggtcccttgggcacccttctgccccaggggttgcctgggctgtggctcgaaggaacccttagactggggggactctggggcttacttaaattgcggggactcctcgggttcgttgggacactgctgctccccttgtgcctagccacacctttgactgtttctctcagagcgcttgtcgccggtgctagtcgagcgcccccagcgcgcgttgcaagtgctccttggagttggttgcttgtgggctacggagccgctggcctgagttggagcttgtgggccgtgctgagcccccccggcgcccaggaaaaggagcaggatcaagtcaacaacaaagtgttaatgtggagactgctgaaattgagtaggccagatctgccactccttgtagctgctttcttttttctcgttctggcggtgctgggcgaaacacttatcccacactattccggaagggtgattgacattttaggtggtgacttcgacccccatgcttttgcttctgcaatcttcttcatgtgcctgttttccttcggttctagcctgagcgctggctgtagagggggatgcttcacttataccatgagcagaattaacttgcggatccgcgaacagttgttcagctcactgctgaggcaggatctggggttctttcaggaaacgaaaaccggggaattgaactctcgtctcagctccgacaccaccctcatgagtaactggctgcccttgaacgctaacgtgctgctcagatcacttgtgaaagtggtcggtctgtatggcttcatgctgtctatcagtccacggctcaccctcctttcgctcctgcacatgccattcactatcgctgccgaaaaggtgtacaacactcgccatcaagaggtgttgagagaaattcaggacgcagtggcacgagcggggcaagtggttcgggaggctgtaggcggtctgcaaaccgtccggtcttttggggcagaagagcatgaggtctgtaggtacaaggaggctcttgaacagtgcaggcagctttactggaggagggacctggagagagccctttacctgttgatccgtcgggtcttacaccttggcgtgcagatgctgatgctcagctgcggactccaacagatgcaggatggagagctcactcagggatccctcttgagcttcatgatttatcaggagtccgtcgggagttacgtgcaaaccctagtgtatatatatggggatatgttaagcaacgtgggggcggccgaaaaggttttctcatatatggacaggcagcccaacctgccaagtccaggtaccctggcccccaccacactccagggcgtggttaagtttcaagatgttagctttgcataccccaaccggccggatcgcccagtcctgaagggcctgacctttacactgaggcccggggaagttacggcgctggtgggacccaacggcagcggcaagtccacagtggcagccctgctacagaatctatatcagcccacaggcggccaggtgttactcgacgagaagccaatcagccagtatgaacactgttacctccattcccaagtagtgtcagttgggcaagagcctgtactatttagcggctccgtaaggaacaatattacctatggtctgcagtcatgcgaggacgacaaagtgatggctgccgcccaggcagcccacgctgacgacttcatccaggagatggagcacggcatttacactgacgttggggaaaagggctctcaactggctgctggacaaaagcagagactggccattgcaagagcactcgttcgcgacccgcgtgtgctcattctagatgaggcgacttccgctctggacgtccagtgcgagcaagcccttcaggattggaactcccggggagaccggactgtgctcgtgattgcccaccgactacagacagtgcagagagctcaccaaatcttggttctccaagaggggaaactgcagaaacttgcccagctttag

SEQ ID NO: 138683 - DNA, 1962 bp, Artificial Sequence
  Description of Artificial Sequence: Synthetic coding sequence
atgcgactgcccgatctgcggccatggactagccttctgctggttgacgcagccctgttgtggttgcttcagggtcctcttgggaccctgctgccccagggcctcccaggcctgtggctggagggtacacttcggttgggtggactttggggcttacttaagctgcgcggattgcttggcttcgttggcaccctgctcctccccctttgtcttgctaccccgctgacagtgagcttgcgggctctggtggctggtgccagccgggccccgcccgccagagtggcctcagcaccctggagctggctacttgtaggctacggcgcagctggtctttcgtggtccttgtgggcagtcctcagcccacccggtgcacaagagaaggaacaggaccaagtgaacaataaagtgctcatgtggcgtctgttgaagttaagtagaccggacttacccctgctggttgctgcattctttttcctggtcctcgccgtgcttggagagaccctcattccccattactcgggacgggtcatagatatcctaggcggtgacttcgacccccacgcatttgcctccgcaattttttttatgtgtctcttttcattcggatcgagcttgtcagccggctgtaggggggggtgctttacgtatacgatgagtcgtataaacctacgcattcgagagcaactgtttagctctttgttacgtcaagacctcgggtttttccaggagacgaagaccggtgaactcaattccaggctgtctagcgataccacgcttatgagtaactggctgccgctgaacgcaaatgtgttgcttagaagcctggtgaaggtggttggcctttacggttttatgctgtctatcagccctcggttgactctgttgagtctgctccatatgcctttcacaatagctgccgagaaggtgtataacacacggcaccaggaagttctaagagagattcaggacgccgtcgcccgtgcgggacaggtcgttcgagaggctgtgggaggtctgcaaacggtgcgcagctttggcgctgaagaacacgaagtatgcaggtataaggaagcgctggagcagtgcaggcagctctattggcgccgggatttggagcgggcactgtatttgctggtgcgccgcgtcctccatctgggagttcagatgttgatgctaagttgtggcctgcagcagatgcaggacggcgagctcacccagggatcacttcttagcttcatgatctaccaggaaagcgtcggttcctatgtgcaaacattggtgtacatctacggtgacatgctatcgaatgttggcgcagccgagaaagtgttttcctatatggacaggcagccaaatctcccttcccccggaaccctcgctcccaccacactccagggcgtcgtaaagtttcaggatgtgtctttcgcctaccccaatcggccagaccgacctgttcttaagggtttgaccttcacactacgcccgggtgaagtcaccgctctggtaggacctaacggctctggtaaatctacagtggctgctcttctccagaacttatatcagccaactggggggcaggtccttcttgatgagaaacccatttcccaatatgagcattgctatctccattcccaggtggtgagtgttggccaggagccggttctattcagcggctctgtgcgcaataacatcgcctatgggttacaatcatgcgaggatgataaggtaatggcagccgctcaggcagcccacgctgacgattttatccaggaaatggaacacggtatttataccgatgtcggcgagaaggggagccagctggccgccggccagaaacagcgcctagccattgcccgggctttggtaagggaccctcgtgtgctgatactcgacgaagctacatcagcgctggacgttcagtgtgagcaggccaaaacactgtggaagttcatgattttctag

SEQ ID NO: 138684 - DNA, 1962 bp, Artificial Sequence
  Description of Artificial Sequence: Synthetic coding sequence
atgaggcttcccgacctccggccatggactagtttactgctggtggacgcggctcttctgtggctgttgcaaggtcctctgggcaccctgttaccccagggcttgcctggactttggctggagggtaccctgaggcttggtggcctttggggcctgctcaagctgagagggctcctagggtttgtggggacactccttctccctctctgcctggctacccccctgactgtttccctccgcgccctggtggcaggcgcttctagagccccccctgcccgagttgcatctgccccttggagctggctccttgtaggatacggagccgcaggcttgtcttggagcctctgggcagttttaagccccccgggcgcgcaggagaaagagcaggatcaggtaaacaacaaagtgttaatgtggcgactactcaagttgagtagacccgatctgccactgctggtagcagctttcttctttctggtcctggctgttttgggtgagacacttatcccgcactattcagggagagtgattgacatcctcggcggagattttgacccccacgcatttgcatcagcaatttttttcatgtgcctgttctcctttggatctagcctttccgcaggctgccggggcgggtgctttacttacacaatgagccggattaacctgaggattcgcgaacaacttttctcaagcttgcttagacaggatttgggcttcttccaggaaaccaaaacgggggagcttaacagtcggctcagctctgatacaactctcatgtcaaactggctccccttgaatgctaacgtcctgcttagaagtcttgtgaaggtggtgggactttacggcttcatgctatctatatccccaaggctcaccctccttagcctgctccacatgcctttcactattgccgctgaaaaagtgtacaacacccgtcaccaggaggttttacgagagatacaggatgctgtggcaagggccggacaggtggtcagggaagccgtcggtggcctgcagaccgttagaagcttcggggcagaggaacacgaagtttgtcgctacaaagaagctctagaacagtgtcgccagctgtattggcgcagagacctggagcgcgccctgtacctattggtgcggcgcgttctgcatcttggcgtgcagatgctgatgttatcatgcgggctacagcagatgcaggacggagagctcacccaagggagcctcctcagctttatgatttatcaagaatccgtgggctcttatgtgcaaacacttgtgtacatttatggtgacatgctgtctaatgttggtgcagccgaaaaggtattctcatacatggaccgacagcccaaccttccctctcccggcaccttagcgccaaccaccctccagggagttgttaagtttcaggatgtttcctttgcttatcccaatcggcctgaccggccggtgttaaagggactgacattcaccctgcggcccggagaagttacagcgctcgtgggaccaaacgggtcgggcaagagcaccgtcgccgccctcctccaaaacctttaccaacccaccgggggtcaggtgcttcttgacgagaagcccatttctcagtatgaacattgttacctgcattctcaggttgtgagcgtcggccaggaaccggtgctgttctccggttcagtgaggaacaacatcgcatacggtttgcaatcttgtgaggacgacaaggtcatggccgcagcccaagcagcacatgcagacgacttcattcaggagatggagcacggaatttacaccgatgtgggcgagaagggctcacagctcgcggccgggcaaaagcaacgccttgccattgctagagcattggtcagggaccctcgagtgttgattctcgacgaggcaacatctgctctggacgttcagtgtgagcaggctaaaacattatggaaattcatgattttctag

SEQ ID NO: 138685 - DNA, 2061 bp, Artificial Sequence
  Description of Artificial Sequence: Synthetic coding sequence
atgaggttgccggatctgagaccgtggacttcccttctgcttgtagacgccgctctgctctggctgttacaagggcccctcggcaccttgctgccacaggggctccccggtctctggctggaggggactctgcgcctcggaggattgtggggactgctgaaactgcggggacttctgggctttgttggcaccctactcctgccactgtgtttggccacacccctgaccgtatccctcagagctctggtggctggcgcttcccgggcacccccggccagagtagcttcagctccatggagttggctgctcgtgggctacggtgcggcaggactttcgtggagtctgtgggctgtgctttccccccctggggcccaagagaaggaacaggaccaggtcaacaacaaggtgctcatgtggaggctgcttaagctgtccagacctgatctaccattgctggtggccgcattctttttccttgtgctcgccgtcctaggagagaccctaataccccactattccggaagggttattgacattctgggaggcgactttgatccacacgcttttgcatccgcaatattttttatgtgtctgttttcattcggcagcagcttgtctgccggctgtaggggcggatgttttacatacacgatgagtcgcatcaacttaagaattcgggagcagctattttcctccctgcttaggcaggacttggggttctttcaggaaactaagacaggggaactgaatagcaggctgtcgagcgataccactctcatgagtaactggttgcccttgaacgccaacgttctgctgaggagcttggtgaaagtggtgggactgtatggttttatgttgtccattagccctcggctgaccttgttatccttacttcatatgccctttactatcgccgcagagaaggtctataacactcgtcatcaagaagtgctccgtgagattcaggatgctgtggccagagccgggcaagtggtacgggaagccgtcggcggcctacagacggtaaggagcttcggtgccgaggaacatgaagtgtgccggtacaaggaggcgttggagcagtgtaggcagctctactggcgccgcgacctagagcgagccctgtacttgcttgtgcggcgggtgctgcacctcggagtgcaaatgcttatgttatcctgtggcttgcagcagatgcaggacggcgagttaacccagggctctctgctgagcttcatgatctatcaagagtcagtcggttcatacgtacaaacactagtgtacatttacggcgatatgctgagcaacgtaggcgctgcagagaaggttttcagttatatggatagacagcctaatcttcccagccccggcacccttgcacccacaacattgcagggggtggtaaagttccaggacgtcagctttgcatatccaaataggccagacagacctgtgctcaaagggctgaccttcaccctcaggcctggagaagtgacagccctggtgggccctaacgggtctggcaagtctactgtagccgctctgctgcaaaatttgtaccagccaacgggtggtcaggtgctgctggatgagaagccaatctctcagtatgaacactgttatctgcactcccaggtggtgagtgtcggtcaggagcccgtccttttttctgggtcagtgcgcaataacatagcttatggcctgcagagttgcgaagatgacaaagtgatggcggcggcacaggccgctcacgcagatgacttcatccaggaaatggagcacggcatatataccgatgtgggagagaaaggttcacagctggccgcgggtcaaaaacagcggcttgccattgctcgtgcacttgtgcgagacccccgtgtacttatcctggacgaggcaacatccgccctcgacgtccagtgtgagcaggccttacaggactggaacagccgtggcgatagaaccgtactggtgatcgcacacagacttcagactgtgcagcgagctcatcagatcctggtcctccaggagggtaagcttcaaaaattagcacaattatag

SEQ ID NO: 138686 - DNA, 1962 bp, Artificial Sequence
  Description of Artificial Sequence: Synthetic coding sequence
atgaggctgcccgatctgaggccctggacatcactgctcttggtggacgccgcacttctgtggctccttcagggccccttagggaccttgcttcctcaaggcttgccagggctgtggctggagggcactctgagactgggggggttatggggcctcttaaaactgcgcgggctgcttggattcgtgggtaccctgctgttgcctttgtgtctggctaccccactgacagtgtcgctgagggcccttgtggctggcgcttctagggcgccaccagcacgcgtagcatccgccccctggtcctggctgctggtggggtacggggccgcaggtctctcttggagtttgtgggccgtcctaagcccgcccggtgctcaggagaaagaacaagaccaagtgaataataaagttttgatgtggcgcctgctgaaactcagtcggcccgatctccccctgctggtcgccgcctttttttttcttgtgctggccgttctcggcgagactttgatcccgcactattcaggcagagtgatagacattttgggcggcgattttgatccccatgcattcgcatccgccattttcttcatgtgcttgtttagctttggcagctcactgtccgccggttgtcgcggggggtgcttcacatatacgatgagccgcataaatctccgaatccgggagcagctgttctcaagtctgctgagacaagatctgggcttcttccaggaaaccaaaacgggagaactgaattccaggctctcgtccgataccacactgatgtctaattggttaccactgaacgcaaatgtgctgctaagaagcttagtgaaggtggtggggctgtacgggttcatgcttagtataagcccgcgtttgactttgctgagcctgcttcatatgccgttcacaatcgctgccgagaaggtctacaacacgcgccaccaggaagttctgcgggaaatccaggacgcggtcgcgcgagctggacaggttgttagagaggctgttgggggcctgcagaccgtgcgcagttttggagccgaagagcacgaggtttgtcggtacaaagaggccctggaacagtgcagacagctgtactggcgcagagacctcgaacgtgctctatacctattgatcaggcgcgtgctgcacctcggggtccagatgctgatgctgagctgtggactccagcagatgcaagacggggaacttacccagggaagccttttgagttttatgatttaccaggaaagtgtggggtcctacgtccagaccctggtctacatctacggcgacatgctaagtaacgtgggtgccgctgagaaggtcttcagttacatggatcgacaaccaaacttaccctctcctgggacattagcaccaactactctccagggagtggtgaaatttcaggatgttagctttgcctatcccaatagaccggatagacccgtgttgaagggcctcacatttacactgcggccaggggaagtgaccgcactggtggggccgaacggatctggcaaatctacagtggcagctctcttacaaaacttgtatcagcccacaggcggccaggtgctgctcgacgaaaaacccatctcacaatatgagcattgttatcttcacagccaggtagtgtccgtcggtcaggagcccgtcctgttctcagggtctgtgcggaataatattacatatggtcttcagtcatgcgaagacgataaagtgatggccgccgcgcaggctgctcatgccgacgacttcatacaggagatggagcatgggatttacacagacgttggcgaaaagggttctcagctggctgctggtcagaagcagaggttagccatagcaagagccttagtgagagatccgcgggtgctcatactggacgaagcaactagtgctttagatgtccagtgtgagcaagccaagacactctggaaattcatgatcttctag

SEQ ID NO: 138687 - DNA, 1962 bp, Artificial Sequence
  Description of Artificial Sequence: Synthetic coding sequence
atgagattgcccgatttacgtccctggaccagcctgctgctggtggatgctgccctgctttggctgttgcaggggcccttaggaactcttctacctcagggcctgcctggattatggttggagggcacacttaggctgggaggcctttggggccttctgaagctccggggactcctggggttcgtcggaaccctgttactgcctctatgtctggcgacaccacttacagtctctctgagagccctggttgcaggggcaagccgcgccccgcccgctagagtcgcatccgcgccctggtcctggctcctcgttggatacggggccgccgggctgtcttggtcactttgggccgtattatctccacctggggcccaagaaaaagagcaggaccaggtgaacaataaagtcctgatgtggagactgctaaagctcagccgacccgatctgccactgctggtcgctgcatttttttttttggtgctggccgtcttaggagagaccctgatcccacactatagcggtcgggtcattgatattctgggaggcgactttgacccccacgcttttgcatcagccatcttctttatgtgtttgttttcttttggcagttctctttccgccggctgcagagggggctgtttcacgtatactatgagtcgcatcaatctgcgaatccgagaacaacttttcagcagtctgctaagacaagatcttgggttctttcaggaaaccaagactggggagctgaactctcgcctctcgtctgatactaccctcatgagtaactggctgcccctgaacgcaaacgtgttgctgaggtcattggtaaaagtggtcgggctttacggttttatgctctcgatttccccgcgcctgacgctcttgtcactgcttcatatgccattcacaattgcagctgaaaaggtctacaatacgaggcaccaggaggtgctgagagagatccaggacgccgtggcgagggctggccaggttgtgcgggaggctgtcggtggcctgcagactgtccgaagttttggcgccgaggaacacgaggtttgcaggtataaggaagctctcgagcagtgtaggcagctctactggcgacgcgacctagaacgcgcactgtatctcctggtgaggagggtgctgcacctaggtgttcagatgctgatgctgtcctgcggactccagcagatgcaggacggagaactcacccagggctctctgctgagctttatgatctatcaggagtccgtgggaagttacgtgcagacgctggtgtacatctacggggatatgctctctaatgtcggcgctgcagagaaagtgttctcctatatggaccgccaacctaatctgccctcacccggcaccctggctcctactactctgcaaggcgtcgtgaagttccaggacgttagcttcgcttatcctaataggcccgaccgcccggtactgaagggattaacattcaccctgagacccggcgaggtgacagctctggtgggaccgaatggctccggtaaatccaccgttgcagctttactgcagaacttatatcagccaactggtggccaggtgctgctcgatgaaaagcctattagtcaatacgaacattgttacttacactcccaagtggttagtgtggggcaggagcctgtgttattcagtggctccgtcagaaacaatatagcttacggtctgcaaagttgcgaggacgacaaagttatggccgccgcgcaggcagcccatgccgacgactttatccaggaaatggagcacggtatctatacagacgtgggggagaaaggatctcagctggccgccgggcaaaagcaacgtctggctatagccagagccctggttcgtgatccgcgcgttctgatcctagatgaggcgacgtctgcactggacgtgcaatgcgaacaggccaagaccctttggaagttcatgatattttag

SEQ ID NO: 138688 - DNA, 2112 bp, Artificial Sequence
  Description of Artificial Sequence: Synthetic coding sequence
atgagacttccggaccttcggccttggaccagtctgcttctagtggatgccgcgcttctgtggcttttgcagggtcccctggggactctgctgccccaaggactcccaggactgtggctcgaaggcacactgaggcttggcgggctctggggccttctgaaactgaggggcctcctcgggtttgtcgggacactactgctgccactgtgtctggccacacccctgacggtttccctgagggccctggttgccggcgcctcaagggctcccccagccagagtggcgtccgccccatggtcttggctgcttgtggggtacggcgctgcaggcctgtcttggagcttatgggctgtgttatcacctccgggggcccaggaaaaagaacaggatcaagttaacaacaaagttctaatgtggagactgctgaagctttcacgacctgatttacccctgttggtggcagcctttttctttctggtgcttgccgtgctgggcgagactctgatcccacactatagcggtcgggtcattgatatcttgggaggtgattttgatccccatgcttttgcctccgccatcttctttatgtgcctcttttcgtttggatcgtctctgagcgccggatgtcgcggaggctgtttcacatacactatgtccaggataaacctgcgcattcgcgagcaattatttagttctctgctgcgccaagatctcggcttcttccaggagacgaaaaccggcgagttgaattctaggctatcgagcgacacaaccctcatgtccaattggttacctctcaacgctaacgtcctgcttcggagtcttgtcaaggtggtggggctttacggcttcatgttgtcaatcagccccagactcaccttgctgtcactccttcacatgccgttcacaatcgcggctgagaaagtatataacacacggcatcaggaagtcctgcgtgagatccaggacgccgtagcaagagctggccaagttgtgcgggaagcagtgggggggttgcagactgtcagaagcttcggcgcggaagaacacgaggtgtgtcggtacaaagaagcgttggagcaatgccggcagttgtattggcgcagggacctcgagcgcgcactctacctgcttgtgaggcgagtgctccacctaggtgtgcagatgcttatgcttagctgcgggttgcaacagatgcaagacggagaactcacgcagggatctctactctcttttatgatctatcaggagtccgtcggctcctacgtgcagactctggtgtatatctatggcgatatgctgtctaacgtgggtgccgcagaaaaggtattctcttacatggaccggcaaccaaatctgcctagcccggggaccttagccccaaccactctgcagggagtggtgaaatttcaggacgtgagttttgcataccccaaccggcctgatcggcctgtgctgaagggactcacctttactctgcgccctggtgaggtgacagcactggtggggccaaatggctcaggtaagtccaccgtagcggcgcttcttcagaatctgtatcagcccactgggggacaagtcctgctcgatgaaaaacccatttcccaatacgagcattgttacttgcacagtcaagttgtatccgtcggtcaggagcccgtgttgttttccgggtcggtgaggaataacatcgcttatggattacagagctgcgaggacgacaaagtcatggccgctgcccaggcggcgcacgcagatgactttattcaggaaatggaacacggtatttataccgatgtcggagaaaaaggttcacaactcgccgccggccagaaacagcgcctcgcaatcgctcgagctctggtccgagaccctcgcgtgctcatcctggatgaggcaacatccgctcttgatgtacagtgtgagcaggccctgcaagattggaatagcaggggcgatcgcacagtattagttatcgcccaccgcctgcaggccgttcagagggcacaccagatcctcgtgttacaggaagggaagctgcagaagctggctcagctccaagagggccaagacctgtattctcgactggtgcagcagaggctgatggactag

SEQ ID NO: 138689 - DNA, 2112 bp, Artificial Sequence
  Description of Artificial Sequence: Synthetic coding sequence
atgagactcccagacctccgcccatggacatcacttttgcttgtcgacgcagccctactgtggctgctgcagggccctctcggtacactgttacctcaaggattgccgggattgtggctggagggaactctgaggctgggaggactttgggggctgctaaagctgcgaggtctcctgggattcgtggggactttgttgctcccactgtgtttggcaactccactgaccgtctcacttagggcactggttgcaggcgccagtcgtgcgccccctgctcgcgtggcctctgccccatggtcctggctgcttgtaggctatggcgcagcaggacttagctggagcctttgggcagtgctgtctccacctggagcacaggagaaggaacaggatcaggtgaacaacaaggtcttaatgtggaggttgctgaagctgagcaggcctgatttaccactgctggttgctgcctttttcttcctggtgctggcagtgctgggggagaccctgatcccacactactccgggcgtgtgatcgatattctgggtggggacttcgatcctcacgctttcgcttcagctatcttcttcatgtgcctcttcagcttcgggagctccctttccgctggatgtcggggtgggtgcttcacatataccatgtcacggatcaacctgcgcatacgagagcagcttttttcttccctgcttcgtcaagacctcggatttttccaggaaacaaaaactggcgagctcaatagtcggcttagcagcgacacaaccctcatgtctaactggctcccgctgaacgctaacgtactcctgcgaagtctggtaaaggttgtgggcctttacgggttcatgctctcgatttcaccccgtctgactctgctctcgctgctgcatatgccgttcaccattgcggccgaaaaggtgtacaatactaggcaccaagaagtcctgcgagaaatacaggacgccgtggcacgggcagggcaggtcgtgagagaggcagttgggggcctccagaccgtgcggagttttggggccgaggaacatgaggtgtgccggtataaagaagccctggaacagtgccggcagctgtactggaggcgagatctggagagagctctgtatcttctggtgagacgggtgttacaccttggtgtgcagatgctgatgctgtcctgcggactgcaacagatgcaggacggcgagcttacccagggttccctgctctcatttatgatctaccaagagagcgtgggatcttacgtacagaccctagtgtatatttacggggacatgttatccaacgtgggggctgcagaaaaggtgttcagctatatggaccgtcagcctaacctgccaagccccggaaccctcgctccaactacccttcagggagtggtgaaattccaagacgtgtcttttgcctatcctaatcgccctgacaggcccgtcctgaaaggtctcactttcacgcttaggcctggagaggtcaccgccctggtggggcctaatgggtcaggcaaatcaacggttgcagccctgcttcaaaacctatatcagcctaccggagggcaagtcctccttgacgaaaaacccatatcacaatacgagcattgctacctgcactcacaggtagtctccgtcggccaagagcccgtgcttttcagcggaagtgttcggaacaatattgcctatggactgcagtcgtgtgaggatgataaagtgatggcagccgcacaagccgcccacgccgatgactttatacaggagatggagcacgggatctacaccgatgtaggggagaaagggagccagctggcagccggacagaaacagcgccttgccattgcccgcgccctggtgcgggaccccagggttctcatcctggacgaagcgactagcgcgctggacgtgcaatgtgagcaggccctacaggattggaattctagaggggatagaaccgtgctcgtgatcgcgcatcgcttgcaggccgtgcagcgggctcatcaaatactggtcctccaagaaggcaaactgcaaaagcttgcccagctgcaggaaggccaggacttatacagtcgtctcgtccagcaacgtctgatggactag

SEQ ID NO: 138690 - DNA, 2112 bp, Artificial Sequence
  Description of Artificial Sequence: Synthetic coding sequence
atgagattgcccgacctacgtccctggacctctcttctgttggtggatgctgccttactgtggttacttcagggaccactaggcaccttgctgccgcaggggctgccagggctgtggcttgaaggaacgcttcggttgggtggactgtggggattactgaaactgcgaggtctgcttggatttgtggggaccctcctgctcccgttgtgcctcgcgaccccgctaacggtgagccttcgggcccttgttgccggagcctcgcgggcgccccctgcccgggtggcctctgcaccctggagctggctgctcgtgggttacggcgccgctggactctcctggtctctgtgggcagtacttagcccgcctggagctcaggagaaggagcaagaccaggtcaataacaaagtgcttatgtggcgcctcctgaaactgtcccgacctgatctcccactactcgtggcggcgttcttcttcctggtgttggccgtactgggagaaaccttgatacctcactatagcggccgcgtcattgacatccttggaggcgattttgatcctcatgcctttgcctctgcaatattttttatgtgcctcttcagctttggatcgagcctgagtgctggatgcaggggcggatgcttcacatatactatgagtaggatcaatctccgaatcagagagcagctttttagctctttattacgccaagatctgggcttctttcaggagacaaaaacaggggaactgaactcacgattgtcttccgatactaccctaatgtccaactggctccctctcaacgccaatgtgctgctgcgcagtctcgttaaggtggtggggctgtatgggttcatgttgtctatctcgccccggctcaccctcctgtctcttctccacatgccattcactattgctgccgagaaggtgtacaatacccgacatcaggaagttctgcgcgagatacaggacgctgtggctagggctggtcaggtagttcgagaagcggtgggtggcctccagacggtgcgcagctttggggctgaggagcatgaagtgtgtaggtacaaagaagctctggaacaatgcagacagttatactggagacgggacctggagcgtgcattgtacttacttgtcagaagggtgctgcatctgggagtgcaaatgctgatgctgtcctgcggccttcaacagatgcaggatggggaacttacacagggttctctccttagcttcatgatttaccaggagagcgtcggtagctatgtccaaacgctcgtttatatctatggtgacatgctctctaacgtgggtgcggccgagaaagtcttctcctatatggaccggcagcctaaccttccatcgccaggcacgctggcacccacaaccttgcagggagtcgttaagttccaagacgtaagctttgcttacccgaatcggcccgacaggcccgtgttaaagggcttaacttttaccctgagacccggggaggttacagcccttgtgggtcccaacggaagcggaaaaagtacagttgcagccctcctgcagaatttgtaccaaccgactggggggcaagtcttactggatgaaaagccaatttctcagtacgaacactgctatttacactcacaggtcgtctcggtgggacaggaaccagtgttgttctcaggtagtgtcaggaataatatagcttatgggctgcagtcttgtgaagatgacaaagtgatggccgccgctcaggccgcacacgccgatgatttcatccaagagatggaacatggtatctacaccgatgtgggcgagaagggctcacagttggccgccgggcagaaacagcggctcgcaattgcaagggccctcgtcagggatcctcgggtgctaattctcgatgaggcaacaagtgccctggacgtgcaatgtgaacaggcacttcaagactggaactctcgaggcgatcgtacggttctggtcatcgcacaccgcctccaagcagtgcagcgcgcacaccaaatcctggtgttgcaagagggaaagttacagaagttagcccaactgcaggagggtcaggacttgtactccagactggtccaacaacggctcatggactag

SEQ ID NO: 138691 - DNA, 2310 bp, Artificial Sequence
  Description of Artificial Sequence: Synthetic coding sequence
atgagactaccggatctgcgcccctggactagcctgttactggtggacgctgccctactgtggctgttgcaaggcccattgggaaccctgcttccccagggtctgcctggcctttggttggagggcaccctgcgcctcggtggtctgtggggacttcttaagctgaggggcctccttggctttgtaggtaccctgctgcttcctctgtgcctggctactccacttacagtgtcattgcgcgcacttgtcgctggtgcctcgcgcgccccacctgcccgagtggcctccgccccatggagctggctgcttgtgggatacggagctgctggtttgtcttggagcctatgggccgtgttgtctccccctggtgctcaggaaaaagaacaggatcaggtgaataacaaggtgctgatgtggcgcctgctgaagctgagccgcccagacctccccctactggtggcagcctttttttttctcgtcctcgccgtactcggggagactttaatccctcactactccgggcgtgtcattgatattctgggtggggactttgatccacacgcctttgcctcagcaatcttcttcatgtgtctctttagctttggatcatctctgagcgcgggctgccgaggcggatgttttacatacactatgagccggattaacctgaggatacgggagcagttattctcctcgctactccggcaggacctgggattctttcaagagactaagactggcgaactaaactcgagactgagctcagacactactctgatgtctaactggctccccttaaatgcaaacgtactgctccggagcctggtgaaggtcgtaggcttgtatggatttatgctgtctatcagtccccgactcacactgctgtcactgttgcatatgccattcacgatagctgcagaaaaagtctataatacgagacaccaggaggtgctgcgagaaatccaggatgctgttgcccgtgcagggcaggtggtgcgtgaggctgtaggtggcctgcagacagtcagaagctttggggccgaagagcatgaggtctgtcggtacaaggaggccctcgaacagtgtcggcagttgtactggcgtagagacctggaacgagccctatatctgttagtgcggcgcgtgttgcacttgggagtacaaatgctaatgctctcatgcggtctgcagcagatgcaggatggcgaattgacccagggttcacttcttagcttcatgatttatcaagaaagcgttggatcatacgtgcagacgctggtttacatctatggagatatgctcagcaatgtgggagcggccgagaaggtcttttcctacatggatcgccagccaaatttgcccagccccggcacactagcccccacaacgctgcaaggtgtggtgaagtttcaggacgtgagcttcgcatatcccaaccggcccgaccgaccagtgctgaaaggcctgacattcacgttgaggcccggcgaagtcactgcactcgtagggcccaatggctcagggaagtctactgtggccgccctgcttcagaatctgtatcagcccactgggggtcaggtactgctcgatgaaaagccaataagccagtacgaacattgttatttacattctcaggtggtctctgttggccaggaaccagtcctgttcagcggcagtgtgaggaacaatattgcgtatggactgcagtcatgcgaagatgacaaggtaatggctgctgcacaagccgctcacgccgacgacttcattcaggaaatggagcatgggatttacacggacgtaggcgagaaggggtctcaactcgccgccggacagaagcaaagactcgctattgccagagctctggttagggaccccagggtgcttatcctggacgaggctactagcgccctggatgttcagtgcgagcaggcgaatggcttctgggttgggccactcggcggcggctcagctagtgagtccgatccaacagggtttttgcatgacagccgacatcggctctcttctgatgttggaatgttcgttgctctcacaaaattgggccagcctgatgcggaacaatggaactcacgcctggatttactcgagagaagcagacaggcagtggatggcgtgtgtcggcacaattaccgtctgggcgcaccattcaccgtgggcagaaaggttcagccagaggtcactgtctaccccgagagaactccactgctccaccagcacaatctactgcactgctctgtcaccggattctaccccggcgatatcaagattaagtggttccttaatggccagtag

SEQ ID NO: 138692 - DNA, 2310 bp, Artificial Sequence
  Description of Artificial Sequence: Synthetic coding sequence
atgcgactccccgacctgagaccctggacctctctgttgttagttgacgcggccttactttggttattgcaggggccactgggtaccctgctacctcaggggcttccagggctctggctcgaagggaccctacgcttgggaggtctttggggtctgttgaaactgagaggcctgctgggctttgtcggaaccttgctcctgccgctatgtttagccacacccctaactgtgtccctcagagctctggttgccggcgcgtctagagctcccccagctcgtgtggcgtcagcaccctggagctggctcctcgtcggctatggggccgccggactctcttggtctctgtgggccgtcctgagtcctccaggcgcccaggagaaagagcaggaccaggtaaacaacaaggtcctgatgtggagattgctcaagttgtcaagaccagatctgcctctgctggtagccgcctttttctttctcgtgttagcagtactcggcgaaacactaataccacactattccgggcgggtaattgacatcctcggcggcgactttgacccgcacgcatttgcttccgcaatcttctttatgtgtctgttcagcttcggatcatctctgagcgcgggatgtcgcggtggatgttttacctataccatgtctagaatcaacttaaggatcagggagcagctgtttagtagtctgctgcggcaggacttgggcttttttcaggagacaaagaccggcgaactcaattcccggctgtctagtgatacgacattgatgagcaactggctaccattaaatgcaaacgtcctactgagatcgttggtgaaggtggtcggactttacggctttatgctgagcatctctcccagacttactctgctgagtctgctgcatatgccattcaccatcgccgccgagaaggtgtataatactcggcatcaggaggtcctaagagagattcaggatgccgtggcccgtgcaggacaggtcgtacgggaggcagtgggagggttacagacggtcaggtctttcggggctgaagagcacgaagtgtgtagatataaggaagccctggagcaatgccgccagctttactggagacgggatctcgagagagccctctacctgctcgtccgacgggtgctacaccttggagttcagatgcttatgctcagttgtggactgcagcagatgcaggacggcgaattgacccagggctcactactgagctttatgatttaccaggagagtgtgggtagctacgtccagactttagtttacatctacggagatatgctgtcaaacgtaggagccgccgagaaggtcttctcctacatggaccgccaacctaacctgccttccccaggaaccttagcacccaccacactgcaaggggtggtaaagttccaagatgtgagctttgcctacccaaacaggcctgataggcccgtattgaagggtctaacctttactcttagaccaggcgaggttaccgctctggtgggaccaaacgggtcaggtaagagtaccgtggcggccctccttcagaatctgtaccagccaactggaggccaggttctcctcgatgagaagccaatttcacagtacgaacactgctatctccactcccaggtggtgagtgtgggccaggagccggtgctgttcagcggcagtgttaggaataatattgcttacgggctgcagtcatgcgaagatgataaggtaatggctgcagcccaggcagcgcatgccgatgacttcatccaggaaatggaacacggtatctataccgatgttggcgagaagggaagccagttagctgccgggcagaagcagcgcctcgccattgcgcgtgctcttgtccgggatccccgcgtgctgattctagatgaagcgacctctgccttggacgtacagtgcgagcaggctaatggtttctgggttgggcccttaggtggcggcagcgcctcggagtcagaccccaccggatttttacatgatagtcgccaccgactgtcttcggatgtggggatgttcgtcgccttgaccaaattgggccagcccgacgccgaacagtggaatagccgccttgacctgctggaacgctcccgtcaagccgtggatggggtatgccgccataattatcgcttaggggcacccttcaccgtaggccgcaaggtgcagcctgaggttacagtttatccagaacgcacccctctgctacaccagcacaatcttctgcattgttctgtgacgggtttttaccctggagatatcaagattaaatggttccttaatggacagtag

SEQ ID NO: 138693 - DNA, 2310 bp, Artificial Sequence
  Description of Artificial Sequence: Synthetic coding sequence
atgagacttccagatctgagaccatggacctccttgctccttgtcgatgcagcacttctttggctactgcagggaccgctcggcactctgttgccacaggggctgcccggcctgtggctggaaggcacactgaggttgggtggcttgtggggccttttaaagctgagagggctgttgggattcgtcggaaccctcctcctgccgctttgtttagccacgccactcacagtgagtctccgcgctctcgtggctggcgcaagtcgagctccaccagctcgtgtagctagcgcaccatggagttggttgctggtaggttacggagcagcagggttgtcctggtcactctgggctgtcctcagccctcccggggcccaagagaaggagcaggaccaggtcaataataaagttttgatgtggcgcctgctgaagctcagccgtccagacctgcctttactcgtggctgccttttttttcctagttttggccgtccttggcgagacattgattccacattactctggcagggtgattgatatactcggcggggatttcgacccacatgcattcgcaagcgccattttcttcatgtgtttgttctctttcggcagctcactgtcagccggatgtagggggggatgctttacgtatacaatgagccgcattaatttaaggattagagagcaactgttttcatcactcctgcgacaagacctcggcttcttccaagagactaaaacaggggagctgaacagtcgactctcctctgataccaccctgatgagtaattggcttcccttgaacgccaacgtgctcctccgctcactcgtaaaggtcgtgggtctgtacggcttcatgttgtcgatctccccacggctgactttgctgagtcttcttcacatgcctttcacaatcgctgcagaaaaagtttataatacacgccaccaagaagtcttacgggagatccaagatgccgtggcaagagccggccaagttgtcagagaggccgtcgggggcctgcagaccgtcaggtcttttggtgcggaggagcatgaggtatgtcggtacaaggaagctcttgagcaatgcagacagctctattggaggagggatctggagcgtgccctatacttgctggtgagaagggttctgcatctcggcgtccagatgctcatgctctcgtgtgggctgcagcagatgcaggatggggagttgacgcagggctctttactcagcttcatgatttaccaagagtccgtcggatcttacgtacagaccctggtctacatctatggcgatatgctgagtaatgtgggagcagctgagaaagtgttttcttacatggatcggcagccgaacctcccttcacccgggacactggcaccaaccactctgcagggtgttgtaaagtttcaggacgtatcattcgcctaccccaatcgcccagacaggcccgtgctgaagggactgaccttcacattacgcccaggagaggtgacagccctggtggggcccaatgggagcgggaaatcgacagttgccgcactgttacagaatctttaccagcctacaggggggcaggtgctcctggacgagaagcccatttcgcagtacgaacattgttatctgcacagccaagttgtatctgtagggcaggaacccgtgctctttagtggaagtgttcggaacaacatcgcatacggactgcagtcttgcgaagacgataaggtcatggccgctgcgcaagcggctcatgccgatgactttatccaggagatggagcatggaatatacacagatgtgggggaaaaggggtcgcagctggcagccggacaaaagcagcgattggccatagctagggccctcgtgagggacccccgtgtgcttatactcgatgaggctaccagtgcactggacgtgcagtgcgagcaggctaatggattctgggtcgggcccctgggaggtggctccgctagcgaaagtgaccccaccgggtttttgcacgattctcgtcatcgactgtcttcagatgtcggcatgtttgtcgccctgactaaacttggacagcctgatgcagaacagtggaactcaagactggacctcctggagcggtccaggcaagccgttgacggcgtttgccgccacaactaccggctgggtgccccattcaccgtcggaaggaaagtacagcccgaggtcaccgtctatccagagaggactcctttgttacaccagcacaacctgctgcactgcagtgttacaggcttctatcccggtgacattaaaatcaagtggtttctgaatgggcagtag

SEQ ID NO: 138694 - DNA, 2310 bp, Artificial Sequence
  Description of Artificial Sequence: Synthetic coding sequence
atgagactccctgatctgcgcccttggaccagcttactcctggtcgatgcagccctgctgtggctgcttcagggaccactcgggacattattgccccagggactgccagggctgtggctggagggaaccctgaggctgggcggcctctggggtttgctcaagctgcgcggcctgttgggcttcgtagggaccctgctgctgccactgtgcctagccacccccctgaccgtgtctcttcgcgctctcgtggccggcgcgtctagagcccctcctgcacgggttgcgtcagctccctggagttggctgctggtcggatacggtgccgccggcctatcttggtcgctgtgggctgtcctttcaccccctggagctcaggagaaggaacaggaccaggtcaataataaagtcctgatgtggcgtctgctgaagttgtctcgccccgatctgccgctgctggttgccgccttctttttcctggttctggccgttctcggggaaaccctgataccgcactattctgggcgagttatcgacatcctgggaggagatttcgacccccacgctttcgccagtgccattttttttatgtgtctgttctcattcggctcaagcctgtctgcaggatgccggggaggctgttttacatacaccatgagcagaatcaacttaagaatcagagagcagttgttctccagcctgttgaggcaggatcttgggttctttcaggagaccaagaccggcgaacttaatagcagactgtcatccgacaccacattgatgtctaattggctgcctcttaatgcgaacgtactgctgcggtcgttagtgaaggtcgtcggtctctacggattcatgctttctatctccccaaggctcacactcctgtctctactgcatatgcctttcaccattgccgccgagaaggtgtacaatactcggcaccaggaggttctgagagaaattcaagatgccgtcgcacgtgctgggcaggtcgtccgcgaggccgtagggggccttcaaaccgtccgcagctttggggctgaagaacacgaggtgtgtcgatataaggaagctcttgagcagtgccgtcagctgtactggaggagggaccttgaacgggcgctttacctgcttattcgacgggtgctgcaccttggcgtgcagatgcttatgctgagttgtgggcttcagcagatgcaggatggcgaactcacccaaggctcactgctgagctttatgatttatcaagagagtgtgggctcttatgtgcagactctcgtttatatttatggcgacatgttgagcaacgtcggagccgctgagaaggtgtttagttatatggaccgacagcccaacctcccttcccccggtaccctggcaccgaccaccctgcagggcgtggtcaaattccaggacgtatccttcgcctacccaaaccggcccgaccgccctgtcttgaagggtctgaccttcaccttgcgaccaggcgaggttacagcactggtgggccccaacggctctggcaaaagcactgttgcggcgctacttcagaatctgtatcaaccaacaggcggccaggtcctcctggatgagaaaccaatcagccagtacgagcattgctatttacacagtcaggtagtctccgtgggccaagagccagtactgttttcagggtctgtgcgcaataacattacctatggattgcagtcgtgtgaagacgataaagtgatggctgcagctcaagctgctcacgcagatgatttcatccaggaaatggaacatggtatatataccgatgtcggagagaagggttcacagctcgcagccggccagaaacagcgtctcgctattgctcgagccttagtgcgagatcctagagtgctgatcttagatgaagccacttcagccctcgatgttcagtgtgagcaggctaacggtttttgggtcggtcctcttggcggcggcagcgctagtgagagcgaccctaccggattcctccatgacagcagacataggctttcctctgacgtgggtatgttcgtcgcactgaccaagcttgggcagccagacgcggagcaatggaactcaagactggacctcctggagcggtcccggcaggccgtcgatggagtgtgtaggcacaactacagattgggcgcacccttcacggtgggccgtaaggtccagccggaggtgacagtctaccccgagagaacgcctctattgcaccagcataatttgttacactgttccgtgactggcttctatccaggtgatattaaaataaaatggttcctgaacggacagtag

SEQ ID NO: 138695 - DNA, 2310 bp, Artificial Sequence
  Description of Artificial Sequence: Synthetic coding sequence
atgaggctccccgacctgagaccttggacatctttattgctggttgatgcggcattgctctggctgctgcagggtccactgggtacactgctacctcaggggctgcccggattgtggcttgaagggaccctcagactgggcggtttgtggggcctgctgaagctgaggggcctgctcggcttcgtcgggaccctgctcttacccctctgcttagccacccccctaactgtgtccctaagagccctggttgccggcgcaagtcgcgccccccccgcccgtgtggcctccgccccttggtcttggctgctcgtggggtatggcgccgctggattatcatggagcttgtgggcggttttgtctccaccaggcgcgcaagagaaagaacaggatcaggtgaacaacaaagtgctcatgtggcgcctcctaaagctgtctagaccagatctacccctcctggtggcagcgtttttctttctggtacttgcagttttaggggagacgctcatccctcattattctggacgcgtgattgacatactagggggcgacttcgacccgcacgccttcgccagcgccatcttctttatgtgtctcttttcgttcggcagctctttgtccgccggatgtcggggaggctgttttacctatacaatgagtagaatcaacctccgaatccgggagcagctgttctcttctctgctgagacaggatctcggcttcttccaggaaactaaaactggggagctaaatagccgcctgtccagtgatactaccctgatgagcaactggctgcccctaaacgcaaacgtcctgcttagaagtctggtcaaggtagtcgggctgtacggattcatgctgagcatttcccccaggctcactctcttgagtcttctgcatatgccctttacgattgcagcggaaaaggtgtataacacgcgccaccaggaagtactgcgggagattcaggatgccgtagccagagcgggacaggtagtgagagaggccgtgggcgggctccagacagtgcgctcctttggggcagaagagcatgaggtatgcaggtataaagaagcacttgagcagtgccgccagctgtactggcgcagggacctggaaagggctctgtacctgctggtgcgcagggtcctgcatttgggggtgcagatgctgatgctctcatgcggcctgcagcagatgcaagacggcgagttgactcaaggatctctactgtcattcatgatctatcaggaatcggtgggctcctacgtgcagaccctggtgtatatatacggggacatgctctctaatgtcggggcggctgaaaaggtgttctcatatatggaccgccagccaaatctcccaagccctgggacactcgcccccacaacactacaaggggttgtgaagtttcaagacgtgtctttcgcgtatccaaatagaccggataggcccgtcctcaaaggtctgacctttacactgcgcccaggcgaagtgaccgcgctggtggggcccaacggctcagggaagagtacggtagcggccctcctgcaaaacctataccagccaacaggaggtcaggtactactggatgaaaagccgatatcccagtatgaacactgctatctacacagtcaagtcgtatcagtgggacaggagcctgtattattttcagggtctgttcgcaataacatagcctatggtctgcagtcctgcgaggatgataaagttatggcagccgcccaggcagcccatgctgacgatttcatacaggaaatggaacatggaatttacacggatgttggtgaaaagggttctcaactcgcagccggccagaagcaaaggctcgcaatcgccagagcgctagtcagagatcctcgcgtgctaatcttggatgaagccacttcagctctggatgtgcagtgcgaacaggcaaatggcttttgggtcggcccccttggaggcggtagcgcatctgagtcagaccccacaggctttttgcatgattctagacatagactgtcttctgatgtcggcatgttcgttgctctgacaaaactgggtcagcctgacgccgaacagtggaacagccgacttgacttgcttgaacgcagccgccaagcagtggatggagtatgtaggcacaattacaggctgggcgcgccgtttacagtgggtcggaaagtgcagcctgaggttaccgtctatccagagaggacaccactgctccatcagcacaacctgctgcattgtagcgtgaccgggttctaccctggggacatcaagatcaaatggtttctgaacggacagtag

SEQ ID NO: 138696 - DNA, 2310 bp, Artificial Sequence
  Description of Artificial Sequence: Synthetic coding sequence
atgcgcctccctgacttgaggccgtggaccagcctcctgctcgtggacgctgcattactctggctgctgcagggccccctggggacgctccttcctcagggtctgcctggactctggttggaggggacattaagactcggaggcctgtgggggctgctaaagctgcgaggcctgcttggttttgtcggtactctcctgttacctctctgcttagcaactccattgactgttagtttgcgcgcactcgtggccggagccagccgggctcccccagcaagagtggcaagcgccccttggagctggctgctggtgggctatggggccgccgggctgtcttggtccctctgggcagtgctctctccacctggcgcgcaggaaaaggagcaagaccaagttaacaataaggtgctgatgtggagactcctaaagctgagccgacctgacctaccactcttggtggctgcatttttctttctagtgctcgcggttctcggcgaaacccttatcccacactacagcggtagggttatcgatatactgggcggagactttgatcctcacgcttttgcaagcgccatcttcttcatgtgtcttttctcatttggctcttcactgtctgcgggttgtagaggaggctgcttcacatacacaatgagccggatcaatctccggatacgtgagcagttgtttagctccctcctgcggcaagatctaggatttttccaggaaactaaaaccggagaactgaacagcaggctgtcgagcgacaccacactgatgtcaaactggttgcctctcaatgcaaacgtgctcctgcgatccttagtgaaagtcgtgggcttgtacgggtttatgctcagcatctccccgcgtctcacactgttgtccctcttgcacatgccattcaccatcgcggcagaaaaagtgtacaatacaagacaccaagaagtgttgcgggaaattcaggatgccgtggcacgagccgggcaagtggttcgtgaagccgtgggagggctgcaaacggtaaggtcctttggagcggaggagcatgaagtctgtcgatacaaggaagcccttgaacagtgcaggcaactatactggaggcgagacctggaaagggcgctttacctgctggtcaggagagtgctgcatctaggggtgcagatgctcatgttaagctgtgggctccaacaaatgcaggatggggagctcacccagggcagcctcctatcctttatgatttatcaagaatccgtggggtcatacgtgcagacgcttgtttatatctacggggacatgctgagtaacgtgggcgcagcagagaaggtcttttcttacatggataggcagccaaatttgccctcccctggtacactcgcccccaccaccctacagggagtggtgaagttccaggatgttagcttcgcttaccctaacaggcctgacagacctgtgttgaagggcctcaccttcactttgcggccaggtgaggttacagccctcgtgggccctaacggaagtggaaaaagcactgttgctgcattgctgcagaatctctaccagccaactgggggacaagtgctactcgatgagaaacccatctcccaatatgagcattgttatttgcacagtcaggtggtcagtgtcggccaagagcccgtcttgttcagtggctctgtcaggaacaacatcgcctatggcttgcaatcttgcgaggatgacaaggtgatggccgccgcccaggccgcccacgctgatgacttcattcaagaaatggaacacggcatctatacagacgtgggcgaaaagggctcacagttggccgctggacaaaagcagaggctcgccattgcgagagctctggtgagagatcccagagtgttgattttggacgaggctacgtctgctctcgacgtgcaatgcgaacaggctaatggattctgggtcggccccttgggcgggggcagcgcctcagagtccgatcccaccggattcctgcacgactctaggcatagactgtcttctgacgtgggcatgttcgttgctctaaccaagctcggccagccggatgccgagcaatggaattcccggttagacctgctggaacgaagtcgtcaagcggtggacggagtgtgccggcataactatcgtctgggggcaccctttacagtggggagaaaggtacaacctgaggtcacagtctaccccgagagaaccccacttctgcatcaacacaacctgctgcattgttccgttaccggtttctaccctggtgacatcaaaatcaagtggttcctgaacggacagtag

SEQ ID NO: 138697 - DNA, 2697 bp, Artificial Sequence
  Description of Artificial Sequence: Synthetic coding sequence
atggtgtgggatcggcagactaagatggagtacgagtggaagccggatgagcaaggacttcagcagattcttcaactgcttaaggagtctcagtccccagacactacaatacagagaacagtacagcagaagttagaacagctgaaccaataccctgacttcaacaactacctaatctttgtactgacaaaacttaaaagcgaggacgagccgaccaggagcctaagcggattgatcctcaaaaataacgtgaaagcacacttccagaactttcccaacggtgtgacagactttatcaagtccgagtgcctaaataatatcggcgatagtagccccctgattagagctacagtcggcatcttaatcactactatcgctagtaagggcgagcttcaaaactggccagacctgcttcctaaactttgctcccttctggactccgaggattacaacacatgcgaaggcgctttcggcgcgctgcagaaaatctgcgaagactcagcagaaattctcgactctgacgttttggaccggcctctgaatatcatgattcctaagttcttgcagttcttcaagcactcctcccctaagattagaagccacgcagtggcctgtgttaatcaatttatcatctcgcgcacccaggccctcatgctgcatatcgacagtttcatagaaaatttgtttgctctggcaggcgacgaggaaccggaggtgagaaagaatgtttgtcgcgccctggtgatgttactggaggttcggatggaccggctgttgccccacatgcataatatagtggagtacatgctgcaaagaacacaagatcaagatgaaaacgtggcactagaggcttgtgagttctggctcaccctggctgagcaacccatttgtaaagacgtactggttcgccatttacccaagctgataccagtgctcgtcaacggaatgaagtactctgatatagatatcatcttgctgaaaggcgacgtagaagaggatgaaactatacctgactccgaacaggacattcgcccaagattccaccgcagcaggacggtcgcacagcagcacgatgaagacggtatagaggaggaggacgacgacgacgacgaaatagatgatgacgacactatcagtgattggaatctcagaaagtgcagtgcggcagccctggacgtgctggccaacgtctatcgcgatgagttactgcctcacattcttccgcttctcaaggagttactattccatcatgagtgggtcgtcaaggaatcagggatcttagtccttggagcgattgctgaaggttgcatgcaggggatgattccttacctacctgagctaatcccccatctcatacagtgcctgtccgacaagaaggcactcgtgcgaagtattacatgttggaccctttcacgttatgcgcactgggtggtttcccagccaccagatacctatctcaagccgttgatgaccgagctgctcaagagaattctggatagcaacaaacgagttcaagaagctgcgtgtagcgcatttgctacattggaagaggaggcctgtacagagctcgtgccctacctggcctacatattagatacgctggttttcgcgttctccaagtatcagcacaagaacctactcattttgtatgacgccattgggaccctggccgatagtgtgggccaccacctgaataagccagaatacatacagatgctaatgccacccctgattcaaaaatggaacatgctgaaagacgaggataaagacctcttccccctgctggagtgtctttccagcgtggccactgccttgcagagcggctttctgccttactgcgagcctgtgtaccagcgttgtgtcaatctcgtgcagaagactcttgcccaggccatgctgaacaacgcgcaaccagatcaatacgaagcccctgataaagatttcatgattgtggccctagacctcctgagcggattggcagagggcctcggaggcaacatcgagcaactggtggcaagaagtaatattctgacacttatgtaccagtgtatgcaagataagatgccggaggtgcgccaatcatcattcgccctgctgggggacctcaccaaggcttgttttcagcacgtcaaaccctgcattgctgacttcatgcccatcctgggcacgaatctgaaccccgagttcatctcagtgtgcaataatgctacttgggctatcggagaaatctcaattcaaatgggtattgaaatgcagccgtatatccctatggtgctgcatcagctggtagaaataatcaaccgtcccaatactcctaaaacgctgctcgaaaacacggccattaccattggacgactaggatacgtgtgtccccaggaggtcgccccgatgctgcagcaattcataaggccttggtgcacctccctgcgtaacattagggacaatgaagaaaaggattccgccttccgggggatctgcacaatgatatctgtgaaccccagcggggtcattcaggatttcatcttcttttgcgacgcggtcgcctcttggatcaaccccaaagacgacctgagagacatgttctgcaaaatactgcacggatttaagaatcaggtcggggacgaaaattggcgccggttctccgatcaatttcctttgccactcaaagagcgactcgccgcattttatggtgtgtag

SEQ ID NO: 138698 - DNA, 387 bp, Artificial Sequence
  Description of Artificial Sequence: Synthetic coding sequence
atggagtatgagtggaagccagacgaacagggtctgcagcagattctccagctgctcaaggagtcgcagtctcctgacaccactattcagaggaccgtccaacagaagctggaacagctgaaccagtatcccgattttaataattacctgattttcgtgctgacaaagctgaagagcgaggatgaacctaccagatccctttctggcctgatccttaagaacaatgtcaaggcccacttccagaactttcctaatggggtgacagacttcataaagtctgaatgtctgaataatattggagatagcagtcctctgatcagagccactgttgggctgacccttttacatgtctcaataagtctgtccagtgtgggccttaagctgtag

SEQ ID NO: 138699 - DNA, 2547 bp, Artificial Sequence
  Description of Artificial Sequence: Synthetic coding sequence
atggtctgggaccggcagacaaagatggagtacgaatggaagccagacgaacaaggcctccagcagatactccaactgcttaaggaaagtcagtcgcccgacactaccatacagcggaccgtccagcagaagttggagcagctgaaccagtatccggacttcaataactacctgatctttgtcctcaccaagctgaagtccgaaggtatcctcattaccactatagcctccaagggagaattacagaattggcccgatctgctccccaaattatgctccctgctggacagtgaagactataatacttgcgaaggtgcttttggcgcgcttcagaaaatttgcgaagacagcgctgagatactcgactcggatgtcctggaccgcccccttaatattatgattcctaagttcctccaattttttaagcattctagcccaaagatccggtcgcacgctgtcgcttgcgttaatcagtttattatttcccggacacaagccctaatgctgcatatcgactccttcattgagaatcttttcgcccttgctggggatgaagaacccgaagtgcgaaagaatgtttgtcgggccctggtcatgctgttagaagtccgcatggataggctcctgccccatatgcacaatatcgttgagtacatgttgcaacggacccaggaccaggacgaaaatgtggcactggaagcatgtgaattctggctgacccttgccgagcagcccatctgcaaagacgtactcgtgcgccacttgccgaaattgataccggtcctggtgaacggaatgaagtactccgatatcgacatcatcctcctgaaaggagacgttgaagaagacgaaaccattccagactccgagcaggatattcggcctcgctttcaccgatcgagaacggtagcacagcagcatgacgaagatggaatcgaggaagaggatgacgacgacgatgagatagatgacgatgacacgatatccgattggaatttgcgcaagtgttctgccgcggccctagatgtgctggctaacgtgtaccgcgacgagctattgccccacatcctgcctttgctcaaggaactgctcttccatcacgagtgggtggtgaaagagtctggcatcttggtcctgggcgctattgccgagggttgtatgcagggcatgataccatacctgcctgagctgattcctcacttgattcaatgtctctccgacaaaaaagccctggtgcggtcgattacatgctggaccctatctcgctatgcccattgggtagtctctcaacctccagatacatacttaaagcctctgatgactgagttactcaagcggatattggactctaataaaagggtgcaggaagcggcgtgtagcgcctttgcaacacttgaggaagaggcatgcactgaattggtcccctacctggcttacatcctcgacaccctggttttcgcatttagtaaatatcagcataagaatctgctgatcctgtacgacgccattggcactttggctgactcagtgggccatcatttgaacaagcctgaatacatccaaatgctaatgcctcccctgatccaaaagtggaacatgcttaaggacgaagacaaagatttgtttccactgctggagtgtctctcctccgtcgctacggccttacagagtggattccttccatactgtgagccagtgtaccagagatgcgtgaacctggtacagaagacacttgcacaagcgatgctgaacaacgcccagcctgatcagtatgaggccccagataaggatttcatgattgtggccttggatctactctcaggtctagccgaagggctgggcgggaacatcgagcaactggtggcccgtagcaacattctgacactgatgtatcagtgcatgcaggataaaatgcctgaggtaaggcaatctagttttgcattgctcggcgatttgacaaaggcctgcttccaacacgtgaagccttgtatagctgatttcatgcccatcttaggaactaacctgaacccggagtttatctccgtgtgtaataatgctacctgggccatcggggagattagcatacagatggggatcgagatgcagccctacattcccatggtgctgcatcagctcgtcgagatcataaacaggcctaacaccccaaagactctgctggagaacaccgccatcaccattgggagattgggctacgtgtgtccacaggaggtcgccccgatgttacaacagtttatccggccttggtgcacaagtttaagaaatattcgagataacgaagaaaaggactccgccttccgcggaatttgcaccatgatctctgtgaacccaagtggggtgatccaggattttattttcttttgtgatgccgttgcctcttggattaaccccaaggatgatttgcgtgacatgttctgtaaaattctccacggattcaaaaaccaggtaggcgacgagaattggcggcggttcagcgatcagttccccttgcctcttaaagaacgcctggccgcgttttatggagtgtag

SEQ ID NO: 138700 - DNA, 2673 bp, Artificial Sequence
  Description of Artificial Sequence: Synthetic coding sequence
atggagtacgaatggaaacccgacgagcaggggcttcagcagatactgcagctgctaaaggagtcccagagtccagataccacaatccagaggacagttcagcagaaacttgagcagcttaaccaatatccagacttcaataactacttgatatttgtgctaacaaagctgaagagcgaggatgagccaactcgctccctgtccggacttatcctcaagaacaatgtgaaagctcacttccagaattttcctaacggcgtgacggattttatcaagtccgagtgtttgaacaacataggtgatagttcgcctttgataagggcaactgtgggtatcctgatcaccactatcgcatccaaaggtgagctacagaactggcctgatcttctgcctaaattgtgttccctacttgatagtgaagattacaacacctgtgaaggagcctttggagctcttcaaaagatctgcgaagacagcgcagagatcctcgattccgatgttctcgatagaccactcaatataatgatccctaaattcctgcagtttttcaaacactcctccccaaaaataaggtcacacgcggtcgcatgcgtcaaccagtttattatatctcgcacccaggccctcatgcttcacattgactcttttatcgagaatctgtttgccctcgcgggggatgaggaacctgaggtcaggaagaacgtgtgcagagcgctggtgatgcttctggaagtccggatggataggctcttaccccacatgcacaatatcgtggagtacatgctgcagcgaacacaggaccaagacgaaaacgtcgcccttgaggcgtgtgagttttggcttaccctggctgagcagccaatttgcaaagacgtacttgtaaggcacctgccgaaactgataccagtcctggttaacggaatgaaatatagcgatattgacatcattctgctcaagggggatgttgaggaggacgaaacgatccctgattcggaacaggacatcagacccagattccatagaagccgtactgttgcccaacaacacgatgaggatgggatcgaggaggaagacgacgacgatgacgagatcgatgatgacgacacgatctccgattggaatctacgaaagtgctctgccgctgcactggacgtacttgctaatgtctacagagacgaactgctgccccacattttgccccttctgaaggaattgctgtttcatcacgagtgggtagtcaaggagtctgggatacttgttctcggcgctatcgccgaggggtgtatgcaaggcatgattccttacttgcccgagctgataccccatctgatccagtgtctatctgacaagaaggctctcgtgcggagtatcacttgttggacgttgtcaagatacgcgcactgggtcgtgagccagccacctgatacttaccttaagcctctgatgaccgaactgcttaagcggattctcgatagtaacaaacgggttcaggaggccgcctgttctgcttttgctacccttgaagaggaggcctgtaccgagctggtgccttatttggcctatatcctggatacactggtgttcgcttttagcaaataccagcacaagaacctactcatcttgtacgacgcgatcggaactcttgcggactccgtcggacatcatctcaataagcctgagtacatccaaatgctcatgcctcccttgatccagaagtggaacatgctgaaggatgaggacaaagatctgttccccttgctagagtgcctcagttccgtggccacggccctacagtccggttttttgccctactgcgagcctgtttatcagcgatgtgttaatctggtacagaaaactctcgcacaggcaatgctcaacaacgctcagcccgatcagtatgaagctcccgataaagactttatgatcgtggctctcgacttgctgagtggtttagcggaaggcttaggagggaacatcgagcagctggtcgctcgatcaaacattctgaccctcatgtaccagtgcatgcaggacaaaatgccggaggtgagacagagctcatttgccctgctgggagacctcacaaaggcttgctttcaacatgtaaagccttgcattgctgatttcatgcccatcttgggcacaaacctgaatccagagtttatctccgtgtgcaataatgcgacgtgggccatcggtgaaatcagtattcagatgggaatcgagatgcagccttacattcccatggtgcttcaccagctagtggagattataaaccgccctaacacgcccaaaacgctcctggagaacactgccatcacgattggaaggctcgggtatgtgtgtccgcaggaggtggcaccaatgctccagcagtttattaggccatggtgtacctcgttaagaaacattcgggacaacgaagaaaaggacagtgcctttaggggcatttgcactatgatcagtgtcaatccctctggggtcattcaggattttatcttcttctgcgatgcagtggcctcctggatcaatcccaaggacgatttacgcgacatgttttgtaagatcctccacgggttcaaaaaccaggtaggggatgaaaattggcggaggttctcagaccagtttcctctgcccctcaaggagaggctggccgcattttatggagtctag

SEQ ID NO: 138701 - DNA, 2664 bp, Artificial Sequence
  Description of Artificial Sequence: Synthetic coding sequence
atggactggcagccggatgagcagggcctgcaacaggtgctccagctgcttaaagacagccagtcgcctaacaccgctactcagagaatcgtacaggacaagttaaagcaactgaatcaatttccagacttcaataactacctgatcttcgtgctaacccgtctgaaaagcgaagatgaaccaacaaggtctcttagtggcctgattcttaagaataatgtgaaagcccactaccagtctttccccccacccgtagctgacttcatcaaacaggagtgcctgaataatatcggcgatgcttcctccctgattcgcgctactatcggaatcttaattaccaccatagcttctaagggggagctgcagatgtggccagagctattacctcagctgtgcaacttgcttaatagtgaagactataacacttgcgagggggcgttcggcgctcttcaaaagatatgcgaggattcttccgaactgctcgattcagacgcgcttaatcggcccctgaacattatgattcccaagttcctgcagttcttcaagcactgctctcccaagatccgtagccacgccatcgcttgcgtgaaccagttcatcatggatagggcccaagcgctgatggataacatcgataccttcatcgagcatctgtttgcgttggcggttgacgatgatcccgaggtgaggaaaaacgtgtgccgcgcattggtcatgttattggaggtaagaatcgatcgcctcattccacacatgcactcgataatccagtacatgctgcagaggacccaggatcatgatgagaacgtggccttggaagcctgcgagttctggctgactctagccgaacagcccatttgcaaagaggtgctcgctagccacttggttcagcttatccccatcctggtaaatggtatgaaatactccgaaattgatatcatccttctgaaaggagacgtggaagaagatgaagcggttcctgacagtgaacaggacataaaacccaggtttcacaagtcacgtaccgtgactctcccccatgaagccgagcgccccgatggatcagaagacgcagaggatgacgatgatgacgatgctctaagtgattggaacttacgtaagtgctcggccgccgccctcgacgtgctggcaaacgttttccgggaggagctgcttccccatctgctaccgttactgaaaggacttctcttccatccagagtgggtcgttaaagagagtgggattctggtcctgggtgccatagccgagggttgtatgcagggaatggtgccgtacctgcctgaactgatccctcatctgatccagtgcctttcggacaagaaagctctagtgagaagcatagcttgttggaccctgtcaaggtacgcacattgggtggttagccagcccccagacatgcatctaaaacctctgatgaccgagctcttaaagcgcattttagatggcaacaagcgggttcaggaagctgcctgttcagcatttgccacgttagaagaggaggcctgcacagaattggtcccttatctgagttacattctagacaccctagtctttgcctttggaaaatatcagcacaaaaacctcctgattctctacgacgccattggcactctcgctgactccgtcggacatcacctaaaccagcccgagtacatccagaagctgatgcctccactcattcagaaatggaatgaactcaaggatgaggacaaggatctgtttcccctgcttgagtgcctgtcatcagtggcaacagccctccagagcggttttcttccctattgtgaacccgtttatcaaaggtgtgtgacactggttcagaaaactctcgcccaagcaatgatgtatacacagcaccccgagcagtacgaggctcccgataaggacttcatgatcgtggccctggacttactttctggacttgccgagggcttgggagggcatgtagagcagctggtcgctcgctcgaacatcatgacactgctgtttcagtgcatgcaggatagtatgcctgaagtgcggcaaagctcattcgcactgctcggcgacctgacaaaagcgtgctttatacacgtgaagccttgtatcgccgagtttatgcccattctcggcactaatctgaaccccgaatttatctccgtgtgcaacaacgccacctgggctattggagagatatgcatgcaaatgggcgctgaaatgcagccatacgtgcaaatggtcctgaacaacctggtggagatcatcaataggcctaacacaccaaagacactcctagaaaataccgcaataacgatcgggaggttaggctacgtatgtcctcaggaagtcgcccccatgctgcagcagttcattcgcccttggtgcacaagcttgaggaacattcgagacaacgaggaaaaggacagcgcatttcgcggcatctgcatgatgataggagtgaacccaggaggcgtagttcaagacttcatattcttctgtgacgcagtagcaagctgggtttccccaaaggacgacctccgcgatatgttttacaagattcttcatggcttcaaggaccaagtcggagaagataattggcaacaattctctgaacagtttcctcctctattaaaagagagactcgcagcattttacggggtgtag

SEQ ID NO: 138702 - DNA, 2100 bp, Artificial Sequence
  Description of Artificial Sequence: Synthetic coding sequence
atggactggcagcccgacgaacaggggctacagcaggtgttgcaactactcaaggacagtcagtctccgaataccgccacacaaagaattgtccaggataaactcaagcagttgaaccagtttccagactttaacaactacttgatatttgtcctgacacgcttgaaatctgaggacgaacccacccgcagtctaagcggattgattcttaaaaacaatgtcaaggctcactaccagagcttccccccgccagtggccgacttcataaaacaggagtgtcttaacaatattggcgatgcttccagccttatccgcgcaacaattgggattctcatcaccactatagcctccaagggtgagctccagatgtggcctgagctgctgccccagctctgcaacttactcaactctgaagactacaacacatgtgaaggggccttcggcgctctccagaagatctgtgaggattcctctgagttgttggattcagacgccctgaataggcctctgaacattatgatcccaaagtttttgcagtttttcaaacattgcagtccaaaaatcagatcacacgcgattgcctgcgtgaaccagtttattatggatagggcccaggcgcttatggacaacattgacacgttcattgagcatctgtttgcattggcggtggacgatgacccagaagtgagaaaaaacgtctgtcgagcacttgtgatgctactggaagtccgcatagatcggttaattccccatatgcattcaattatccagtacatgctgcagcggacccaggaccacgatgaaaacgtggcactcgaagcttgcgagttttggctgaccctcgcagagcagcccatttgtaaggaggtgctcgcaagtcacctagttcaactgatcccaattttggtcaatggcatgaagtacagcgagatcgatattatcctacttaaaggtgatgttgaagaagacgaagcagtcccggactccgagcaagacatcaagccccgctttcacaaaagcaggaccgtgacattaccccatgaggcggagaggccagacggatcagaggacgccgaagatgacgatgatgacgacgccctctccgattggaacttacgcaagtgtagcgctgctgcgctggatgtcttggccaatgttttcagggaagaactgcttccacacctgctccccctgctgaaaggtctccttttccaccctgaatgggtcgtcaaagagtccggaattctggtactcggggctattgctgagggctgcatgcagggcatggtgccctacttgccggaactgatccctcatctaattcagtgcctctcagacaaaaaggcgctagtccgctccattgcctgctggactttgagcagatacgctcattgggtggtcagtcaaccccctgatatgcacctgaagccactgatgaccgaactgctgaagcgcatccttgacggcaataagcgggtccaggaagcagcttgttcagcctttgctactttagaagaggaggcctgcacggaactcgttccttatctgtcttacattctggacacactggtgtttgcgttcggcaagtaccagcataagaacctgctgatcctatacgacgccattggaactctggcggactccgtgggtcatcaccttaatcagccagagtacattcaaaagctcatgcctccgctgatacaaaaatggaacgagctcaaggatgaagacaaggaccttttcccgctcctcgaatgcctctccagtgtagccactgccctccaaagtggttttcttccatattgcgaacctgtgtaccagaggtgcgtcactctcgtgcaaaaaactttagctcaagccatgatgtacacccagcatccagagcagtatgaggccccagacaaggatttcatgatcgtagcattagacttattaagcggtcttgccgaagggctagggggccacgtggagcagctcgtagcccacagcccttcattccctccccaccctctccccccagcgggcagcagagtctgtccttttgtgactgttctgtgttggggattggctcctcggtggcgcgagattcccttagtttag

SEQ ID NO: 138703 - DNA, 2694 bp, Artificial Sequence
  Description of Artificial Sequence: Synthetic coding sequence
atggactggcaaccggatgagcaaggcctccagcaagtgctgcaactgctgaaagactcccagtctcctaacacagccacacagaggatcgttcaggacaagcttaagcagctgaatcaatttcccgatttcaataattatctgattttcgtgcttacgaggctaaagtctgaagacgagccaacacgatccctcagcggactgatcttgaagaataatgtgaaggcacactaccagagtttcccaccccccgtggccgatttcatcaaacaagagtgcctcaataatatcggagacgccagctcactgatcagggcaacgattggcattctgattactacaatcgcgtccaaaggcgaattgcagatgtggcccgagctgctcccccaactctgtaatcttttgaacagcgaagactacaatacctgcgaaggcgccttcggcgccctgcagaaaatctgcgaagactcgagcgagctcttagacagtgacgctttgaatcggccgctgaatatcatgataccgaaattcctgcaattttttaagcactgcagtcccaagatcaggtcgcacgcaatagcttgcgtgaatcagttcataatggacagagcccaggcactgatggataacatcgacacttttatagagcacctcttcgcccttgctgttgacgatgaccccgaagtcaggaagaatgtgtgcagggcactggtgatgctgctagaggtgcgaattgatcgattgattccccatatgcactcaattatccaatacatgctccagcgaactcaggaccacgatgagaacgtagctctcgaagcatgtgagttctggctgaccttggccgaacaacctatttgtaaggaagtacttgcgagccacctggtgcagcttattcccatcctggttaatggaatgaaatacagcgagattgacataatcctgctgaagggcgatgtggaagaggacgaggctgtgccagattcagagcaggacatcaaaccccgattccataaaagcaggactgtaaccttaccgcacgaggccgagaggcctgacgggagtgaggacgctgaagacgacgacgacgatgacgccctgtccgattggaatctgaggaagtgctctgccgctgctctggacgttcttgcgaacgtgtttcgcgaggagctgttgccccacctcctgcccctcttaaaaggactgctgttccatccagagtgggtcgtgaaggaatcaggaatcttggtacttggcgccattgccgagggttgtatgcaagggatggttccttacctgcctgaacttattccacacctgatccagtgcctgagtgacaagaaagcgctggttcggagtatcgcctgttggactctttccaggtatgcacactgggtggtgagccagccacccgatatgcacttaaaacccctgatgactgagctgctgaaaagaatactggatggcaataagcgggtgcaggaagcagcctgttcagcatttgctaccttggaagaggaggcctgcaccgagttagtcccatacttatcatacatcctcgataccctggtttttgcgtttgggaaataccagcataaaaatttattgatcctctacgatgctatcggcaccctggccgactctgtcggacatcacttgaaccaaccggaatacatccagaaattgatgcccccactgatccagaagtggaacgaacttaaagacgaagataaagacctattcccgcttcttgagtgtttgagctcagtggccacggcactgcagagtgggtttctaccttactgtgagcctgtttaccagcgctgcgttacgttggtgcaaaaaacacttgctcaggccatgatgtacacccagcatcctgaacagtatgaggcacctgataaggacttcatgattgtggccttagatctgctctctggactggccgagggcctcggcggccatgttgagcagcttgtggcgaggtccaacatcatgacgctgctgttccagtgtatgcaggactccatgccagaggtccggcagtcctcctttgcacttctgggggaccttaccaaggcctgttttatccatgtgaaaccttgcatcgccgaatttatgcccattctcggtaccaacctcaaccctgagttcatctctgtctgtaacaatgccacgtgggctatcggtgagatctgtatgcagatgggcgccgagatgcagccctacgttcagatggtcctcaataatctcgtagagatcatcaacagacctaacacgccaaaaaccctattagaaaacacgggccgtctcacaagtccatctgccatccccgccatcacaattggacgactgggttacgtgtgccctcaggaggtcgcccctatgctacagcagttcattaggccttggtgtacttcgcttcgcaatattcgcgacaatgaggagaaagactctgctttcaggggtatatgcatgatgatcggcgtgaatccaggaggtgtggtgcaggatttcatcttcttctgcgacgctgtggccagttgggtgagccccaaagacgacctacgcgatatgttttataagatattgcacggattcaaggatcaggtcggcgaggacaactggcagcagttctcggaacagttccctcctctactgaaagaaagactggcagcgttctatggagtctag

SEQ ID NO: 138704 - DNA, 2664 bp, Artificial Sequence
  Description of Artificial Sequence: Synthetic coding sequence
atggattggcaacctgacgagcaggggttgcaacaggtgctacaactcttaaaagattcccagtctccaaacacagcaacacaacggatcgtgcaagataaactgaaacaattaaatcaatttcccgacttcaataactatctcatcttcgtgctaaccagacttaaatccgaagatgagcctacaaggagcctgagcggcctcatcctaaaaaataacgtgaaggcccattatcagtcgttcccccctcccgtagctgacttcattaaacaggagtgtctcaacaatatcggtgacgccagctcgcttattcgcgcgactattgggatcttgatcacgactattgcctcaaaaggggaactgcagatgtggccagagcttttgccacagttatgcaatctcctcaacagtgaagactacaacacatgcgagggtgcctttggcgcactgcaaaaaatctgtgaagactcttctgaactgttagactcagatgcactgaataggccactgaacattatgataccaaagttcttgcagtttttcaaacattgttctccaaagatcagaagccacgcaattgcatgtgtgaatcaattcataatggatcgagcccaggccctgatggacaacatcgataccttcatcgagcatctctttgccttggctgtggacgatgacccagaagtgagaaaaaatgtctgcagagccctggtcatgctgctggaagttcgtatcgacagactcatccctcacatgcattctataattcagtatatgttgcagaggactcaggaccatgacgaaaatgtcgccctcgaggcgtgtgagttttggctgaccttggccgagcagcctatttgcaaggaagtgctggcctctcacctggtgcagttaatacccatcctcgtgaatggaatgaagtattcagaaatcgacatcatactgctgaagggtgacgtggaggaggatgaagccgtccccgattctgaacaggacatcaaacccaggttccacaagtctcgcactgtgaccttaccacacgaggctgaaaggcctgacgggagtgaagacgccgaggacgacgacgacgatgatgccctatcagattggaatctgagaaagtgctccgccgccgccctggacgtgctcgctaacgtctttagagaggagctcttgcctcacctgctgcccctgctgaagggtcttttgtttcatcctgagtgggtggtcaaggagagtggcatcctcgtgctaggggctattgctgaagggtgtatgcagggcatggtgccttatctgccagagctaatacctcatctgatacagtgtcttagtgacaaaaaagccctggttcgatccatcgcctgctggacgctgagcagatacgcacattgggtggtctcccaaccacccgatatgcatctgaagccactcatgactgaactactgaaacggattctggatggaaacaagcgggttcaggaagccgcctgtagtgccttcgccaccctggaggaagaggcctgcaccgagctggtcccctacctgagctatattcttgatactttggtgtttgcttttggtaagtaccaacacaagaacctgctcatattatacgacgcaatcggaaccctggccgactctgtaggacaccatctgaaccagcctgaatacatccagaaattgatgccgccactgattcaaaagtggaatgaactgaaggacgaagataaggatctgtttccattgctggaatgtctgagtagtgtcgcaaccgccctccagagcgggtttctgccttattgtgagccggtttatcagcggtgtgttaccctggttcagaagacattggctcaagccatgatgtatacacagcaccccgagcagtatgaggctcccgataaagactttatgatcgttgctttagatctactctctggcctggctgaagggcttggcggacatgttgaacagcttgtggcacgctccaatattatgactctactatttcagtgcatgcaagactcaatgcctgaggtgcgccaaagcagtttcgctcttctgggcgacctaacaaaggcatgtttcatacacgttaagccatgtatcgccgaatttatgcctatcctgggcactaaccttaatccagagtttatttctgtgtgtaataacgcgacatgggcaatcggggaaatttgtatgcagatgggtgctgagatgcagccctacgttcagatggtcctgaacaatctggtggaaatcatcaatcgccccaacacacccaagactctgttagaaaacactgctatcaccatcggccgactggggtacgtctgcccccaagaagtcgccccaatgctgcagcaatttattaggccgtggtgtacctctctccgcaatatacgtgacaacgaagagaaggactccgccttccgcggaatatgtatgatgatcggggtcaatcccgggggtgtcgtgcaagattttatcttcttctgcgacgccgtggcatcttgggtgagccccaaggatgatttaagggacatgttctataagatactgcatggcttcaaagaccaggtcggcgaggataactggcagcagttttccgagcagttcccccccctacttaaagagagactcgcggcgttttacggcgtgtag

SEQ ID NO: 138705 - DNA, 2694 bp, Artificial Sequence
  Description of Artificial Sequence: Synthetic coding sequence
atggattggcagccagacgaacagggactccagcaggtcttgcagctgctcaaggatagtcagagtccaaatactgctactcaacgcattgttcaggacaagctgaagcaacttaatcagtttccagacttcaataactatctgatcttcgtactcacccggctcaagtctgaggatgagcctacccggagtctgtctgggctcattcttaagaacaacgtgaaggcccattaccagtcctttcctccacccgtcgctgattttatcaagcaggagtgcctcaataatatcggagatgcttcttctctcattcgcgccaccatcggcatcctcatcacaacaatcgcaagcaagggggagctccagatgtggccagagctgttaccccagctgtgcaaccttctgaactcagaggattacaacacctgcgagggtgcctttggtgccttgcagaagatttgcgaggatagcagtgaattgttagactccgacgcgctaaaccggccactcaatattatgatcccaaagtttcttcagttcttcaaacactgttccccgaaaataaggagtcacgccatcgcatgcgtgaatcagtttataatggatcgggcccaagcacttatggacaacattgatacttttatcgaacacttattcgccttagccgtggatgatgacccagaagtgaggaagaacgtgtgtcgagctctcgtgatgttactcgaagtgagaatagaccgcctgattcctcatatgcattctattattcaatacatgttacaaaggacacaggaccatgatgaaaacgttgcgctggaagcttgtgagttctggctcaccctcgcagaacagccgatatgtaaggaggtgctggccagccacctcgtacagctgattccgattcttgtgaatggtatgaagtactctgagatcgacattatcctgctgaaaggagatgttgaagaggacgaagctgtgcctgactccgaacaagacataaaaccccgattccataaatcccgaaccgttacgcttccccacgaagccgagcggcctgatggttctgaagacgcagaagacgatgatgacgacgacgcgctgtccgattggaacctgcggaaatgttcagcagcagccttggacgtgctggccaacgtgtttagagaggagttgctgccacacctgttgccgttattgaaaggactgctgttccacccagagtgggttgtgaaagagagcggaattttggtcctcggtgctatcgccgaaggatgtatgcagggcatggtcccatacctgcctgagttaattccccacctaatccagtgcctctctgataaaaaagcactggtgcgtagcatcgcctgttggacactttcccgatacgcgcactgggtggtgagccagccacctgacatgcatctcaagcctttgatgaccgagctgctaaagcggatcctggatggcaataaaagagtgcaagaggccgcgtgcagtgcttttgcaactctcgaggaggaagcatgtacggagctcgtgccgtatttgagctacatccttgataccctagtgtttgccttcggtaagtatcagcataaaaaccttctgattctgtatgacgccattggcacactggctgactctgttggccatcatctcaatcaaccagaatatatccagaaactcatgcccccactgatccagaaatggaacgaactgaaggacgaagacaaagacctgttccccttgttggaatgcctctccagcgtagctaccgctttgcagtctggctttttgccctattgtgagcccgtgtatcagagatgcgtcacacttgtccagaagactttggcccaagcaatgatgtatacgcaacaccccgagcaatacgaggctccagataaggatttcatgatcgtagcacttgatctactcagtggcctggcagaggggctcggtggccatgtggagcagcttgtggctaggagcaacatcatgaccttactgttccagtgtatgcaagacagcatgcctgaagtgaggcagtcatccttcgcactgttaggagatctcaccaaggcatgtttcatccacgtcaagccatgcatagccgagttcatgcctatattaggaaccaacctcaatcctgagtttatatcagtctgcaacaatgccacctgggctattggagagatctgtatgcagatgggagcagaaatgcagccctacgtccaaatggtgcttaacaatttagtggagattattaacaggccaaatacaccaaagaccctcctggagaatactggtaggttgacctcaccgtcagccattcctgctatcacaattggccgtcttggatacgtgtgcccacaggaagttgcacctatgctgcagcagtttatcaggccttggtgcacctctctacgtaatattcgagacaatgaggagaaagattccgcattcagggggatctgcatgatgattggagtgaacccaggaggcgttgttcaagattttatctttttttgcgacgccgttgcaagctgggtgtcacctaaggacgatctgcgagatatgttctataagatcctccatggtttcaaggaccaggtgggcgaggacaattggcagcagtttagcgaacagttcccccctctgcttaaagagcggctcgctgctttctatggggtgtag

SEQ ID NO: 138706 - DNA, 3156 bp, Artificial Sequence
  Description of Artificial Sequence: Synthetic coding sequence
ggacagtctgtcggtggccgaggacttttccgcgactgtgcttgcatcgaggagacgacgggtgcgggcgctctctcacgaagtggggcaggtccgctggacgttgaggcagctgggccatctccttcgcgctgcgaaggtggtggctcacttagagccagaagtcgcggtcagaggcatgggccgccatgggacgagggttcgtcactcggaccaatgcgcatccggcgggctcctccgcctcctccagtggcccgattccatattccccctcctgccctgccttcccccagactgagaggccggggctggcggtcttggagaggaccacgaacatgggcgggggttgatcgccggcctccgcctgtgcgccgcgggaggtctagacggcatgctgcgactgccgcctctggcgcgccccctggttcccatactgagcctcagcgcccatctgctgatccaggcccttacttgcgtagcctgccttgtgctatggattggcagccagacgaacagggtctgcagcaagttctgcaacttctcaaagatagccagagtccaaacacagcaacgcagagaatcgtccaggacaagctgaagcagttgaaccaattcccagatttcaacaattacctgatcttcgtcctgaccagactgaagtctgaagatgagcccacacgttcgctgtccggtctcatactgaaaaataacgtgaaagctcattatcaatctttcccaccaccagtggcagacttcattaagcaggagtgcctcaataacataggagacgccagcagtttaatccgagccactataggcatactaataacgacaatcgcgtccaagggcgagttgcaaatgtggcctgagctgcttccgcagctgtgtaatctgctgaactcagaagattataacacctgtgagggtgcgttcggcgccctgcaaaaaatctgcgaagatagttccgaactgctagattccgatgcccttaatcggcctctgaatataatgattcccaagtttctacaattttttaagcactgtagtcccaagatacgaagccacgctatcgcatgtgtcaaccagttcataatggatcgagctcaggctttaatggataacatcgacacgttcatcgaacatttgttcgctctggcagtggatgatgacccagaagtccggaagaacgtttgtcgcgccctggttatgctgctcgaggtgcgcatagaccgcctcattcctcatatgcactctattattcagtacatgctccagaggacacaggatcacgacgaaaacgtggcactcgaggcctgcgagttttggcttacccttgcggaacaaccaatttgtaaagaggtgctggcttcacacctggtacagcttatccccatattggtcaatggcatgaagtacagcgaaatagatataatactgcttaaaggagacgtggaggaggacgaagctgtgcctgattctgaacaggacatcaaaccacggttccacaaatctcggacggtcacgctgcctcatgaggctgagcgcccagacgggtcagaagacgcggaggatgacgatgacgatgacgctctgtccgactggaacctccgtaagtgttcagcagcggctttagacgtactcgccaatgtttttcgggaggagttacttccccacctgctgccactgctgaaagggctgttgtttcatccagagtgggtagtcaaagagtctggcattctggtcttaggtgccatcgcagaagggtgcatgcaaggcatggtcccgtacctgcctgagttgattcctcatttgatccagtgtctgagcgacaaaaaggcgctcgtcagatccatcgcttgttggactttgtcaagatacgctcattgggtcgttagtcagcctcctgacatgcaccttaagcctctcatgaccgagctcctgaagcggatcctagatggtaacaaacgcgtccaggaagcagcctgtagcgcatttgcaacattggaggaagaagcctgtacagaacttgtgccttatctgtcttacattttggacacgctcgtctttgctttcggcaagtaccagcacaagaatctgcttattttgtacgatgctatcggaaccctggccgatagcgtggggcaccacctcaatcagcccgaatatatccagaagctcatgccgcccttgattcagaaatggaacgagctgaaagacgaagacaaggacctcttccccctgctcgagtgtctttcctcagtggccaccgctcttcagagcggattccttccatactgtgagcccgtgtaccagcgatgcgtaactcttgttcagaagaccttggctcaagccatgatgtacacacagcaccccgaacaatacgaagctcccgacaaggactttatgatcgttgctctggatctgctgtcgggtctggctgagggtctcggcggacatgtcgagcagctggtggccaggtccaacatcatgaccctgctgtttcagtgcatgcaagactctatgccagaggtgagacaatccagttttgccctgcttggggatctgacaaaggcctgcttcattcatgtgaaaccctgcatagctgagtttatgcctatcctcggcactaatttgaacccagagttcatcagcgtttgtaataacgctacctgggccattggcgaaatctgcatgcaaatgggagctgaaatgcagccatacgtccagatggttctaaacaatctcgtcgagatcatcaatagacctaacacccccaaaaccttgttggagaatactgcaatcacaattggacggttgggttacgtttgtccccaggaggtcgcccccatgcttcagcagtttattcgaccctggtgcacctccctcagaaatattagagacaacgaagaaaaagactccgcttttagaggcatttgtatgatgattggcgttaaccccggcggagtggtacaagacttcatttttttttgcgatgcagttgccagctgggtgagccctaaggacgacctcagggacatgttttacaagatcctgcacgggtttaaggaccaggttggagaagacaactggcagcagttctccgagcagttccccccgcttttgaaggagagattggcagcattctatggcgtttag

SEQ ID NO: 138707 - DNA, 2316 bp, Artificial Sequence
  Description of Artificial Sequence: Synthetic coding sequence
atggattggcagccagatgagcaggggctccaacaggttcttcagctgctgaaagatagtcagagccctaatacggccacacagaggatagttcaggacaaacttaagcagctaaatcaatttcctgatttcaacaattacctcattttcgtcttgacacgcctcaagtccgaagacgagcccacccggtccttgtctggactgattctcaaaaacaacgtgaaagcacactatcagtcttttccaccaccggtggccgacttcatcaagcaagagtgtctgaataacatcggcgacgcttcgagcctgatacgggccaccattggaattcttataaccaccattgcttctaagggggagctgcaaatgtggcccgagctgcttccacagctgtgcaacctgttgaattctgaagactacaacacttgcgagggtgcctttggggccctgcaaaagatttgtgaggattcttctgaactcctcgactccgacgctcttaatcgtccattgaacatcatgattcctaaattcctccaattttttaagcattgttctccaaagattcggtcccatgctattgcctgcgtgaatcagttcatcatggaccgagcacaggcattgatggataacattgacacgttcatagaacacttgtttgctcttgccgtcgatgatgatcccgaggtccggaaaaatgtctgccgagctctcgtcatgcttctggaggttcgcattgatagattgatcccacacatgcacagcattatccagtacatgctccagcgaacgcaggatcatgacgaaaatgtggcactcgaggcgtgtgaattctggctgacactagccgaacagccgatctgcaaggaagttctggcaagccacctggtccagctcatccccatccttgttaacggtatgaagtacagcgagatcgatatcattttacttaagggggacgtggaggaggacgaggctgtacccgattcagagcaagatatcaagccgagatttcacaagtctcgcaccgtcactctgcctcatgaggcagaacggccagacggctcagaagatgcagaggatgacgatgatgacgatgccctgagtgattggaatctgagaaagtgctcggctgctgcgttggacgttttggcaaacgtcttcagggaagagctgctgccccacctactccctcttctgaaagggctcctttttcaccccgagtgggttgtgaaagaatcaggcattcttgtgcttggagccatagcagagggttgtatgcaaggaatggtaccatatctgccagagctaatcccacacctgatccagtgcctgtccgataaaaaagcgctggtccgctccattgcctgttggacactctccaggtacgcccattgggtagtgtctcagcctcctgatatgcatctgaagccactgatgaccgagctgctcaaaaggatactggacgggaacaaacgagtgcaggaagccgcttgttcagcatttgcaactttggaggaagaagcctgtaccgagctcgttccatatctgagctacatactggatacactggttttcgctttcgggaaatatcaacacaagaacctcctcatactgtatgatgcaatcggaacgcttgccgactcagtgggtcaccacttgaaccagccagagtacatccaaaagcttatgcccccattgatccagaagtggaacgagcttaaggatgaggacaaggacctctttcctctcttagagtgtctgtcctctgtggctacggctctgcagtccgggttcctgccctactgcgagcctgtgtaccagagatgtgtcacgctggtgcaaaagactcttgcccaggccatgatgtatacccagcatcccgaacagtacgaggcccctgacaaggatttcatgatcgttgccctggacctgctctccgggcttgcagaggggctgggcgggcacgtagagcagctggtcgcccggtcaaatatcatgactttgctgttccagtgcatgcaggattctatgccagaagtccggcagtcttcgtttgccctgctgggagaccttactaaggcatgcttcatccatgtgaagccatgcatcgccgagttcatgcctatattaggaaccaatctgaatcccgagttcatttctgtctgtaacaacgctacctgggcaattggggagatatgtatgcagatgggcgctgaaatgcagccatacgtgcaaatggtactgaacaacttggtggaaattattaaccgtcctacgccgtctcagaaacagaataagactaagaagaacaagtag

SEQ ID NO: 138708 - DNA, 2772 bp, Artificial Sequence
  Description of Artificial Sequence: Synthetic coding sequence
atggagggtgccaagcctactttacagctggtgtatcaagcagtgcaagcactgtaccacgatccagaccctagcggaaaggaaagggcctctttctggttgggtgagctccagagaagtgttcacgcctgggaaatcagcgaccagctcctacagatccggcaagatgtcgagtcctgctacttcgccgcccaaacaatgaagatgaaaattcagacctcattttacgagttacccacagactcccatgcttcacttagggattcactgctgacccatatccagaacctcaaggatctgagccctgtaatcgtaacacagttagcactcgccatcgcggatctcgcactgcagatgccatcatggaaaggatgcgtacagaccctcgtcgaaaaatattctaacgatgtcactagcctgcccttcctgctggagatcctgactgtgctgcccgaggaggtgcacagcaggtccctaaggattggtgccaatcgcagaacagaaattattgaggatctcgcattttactcaagcactgtcgtgagcttacttatgacttgtgtggagaaggccggtactgacgagaaaatgttgatgaaggtctttcgatgccttggatcttggtttaacctcggcgtgctggacagcaacttcatggccaataacaaacttttggctttgttgttcgaggtcctgcagcaggataagacctccagtaaccttcatgaggctgctagcgactgcgtctgttccgcgttatatgccatcgagaacgtggagaccaaccttcccttagccatgcagctttttcagggcgtgcttacgctcgagaccgcttaccacatggcggtggctcgcgaagacttggataaggtgctcaattactgcagaattttcacggagttatgtgagaccttcttagagaaaatcgtttgtactccaggccaaggactgggcgatttgcggacactagaactgctgctgatttgtgcaggacatccacagtatgaggttgtagagatatcattcaacttttggtatagactcggcgaacatttgtataagacgaacgacgaggtgatccacggcattttcaaggcttatatccagcggctactccacgcattggcccgtcattgtcaactcgagcctgaccatgagggggtgcccgaagagaccgatgatttcggtgaattccgcatgagagtatcggatttggtcaaagacctgatcttccttatcggctccatggagtgctttgcccagctgtacagtacgcttaaggaaggcaatccaccttgggaggtgaccgaggccgttttatttatcatggctgccatcgcgaagtctgtggaccccgaaaacaatccaactctcgtggaagtgctggaaggagtcgtgcggctgcctgaaaccgtccacacggccgtgagatacactagtatcgagctggtgggcgagatgtccgaagtggtggaccgaaatccccagttcctcgatcccgtcctggggtatctcatgaaaggtctgtgtgagaaaccactggcctcggccgcggccaaggccatacacaacatttgtagtgtctgcagggaccacatggcacaacactttaacggcctgctggaaattgctcggtccctggacagctttttactaagtcctgaagctgcagtgggcctgctgaaagggacagcactagtcttagcccgtctgcccttggacaaaattacagaatgcctatcagaattgtgttctgtgcaggtgatggccctgaagaagctgttgtcacaagagccgagcaacggcatctcatccgacccaaccgtgttcctggacagactggctgtgatcttcaggcatactaaccctatagtagaaaatggacagacgcatccctgtcagaaggtgattcaggagatctggccagttctgtctgagacacttaacaaacatcgtgcagataatcggattgtagagcggtgctgtcgttgcctgcgctttgctgtccgttgcgttggtaaggggtccgcagctctcctgcaacctttagtcacccagatggtcaacgtttatcacgtgcaccagcatagttgcttcctgtacctggggtccattctggtggatgagtatggtatggaggagggctgtagacagggccttctagacatgctgcaggcattgtgcattcctacctttcaacttctggagcaacagaatgggctgcagaaccacccagacactgtcgatgacctgttccgtttggctaccagattcatacagaggtctccagtgacactactgaggagtcaggtggtcatccctatcctccagtgggccatcgctagtactaccctcgatcacagagatgccaactgctccgtgatgcgctttctgagggacctgatccacacaggagtcgcgaatgatcatgaagaggatttcgagctgaggaaagaactcattggacaggtcatgaaccagctcggccagcagctagtatctcagctccttcacacgtgctgcttctgtctgccaccttatactcttcctgacgtcgcggaggtcctgtgggaaatcatgcaggttgatcgtcctaccttttgcagatggctcgagaactccctgaaggggctccccaaggagacaacggtgggggccgtgaccgtgacgcacaaacagctgactgattttcataagcaggtcacctcagcggaggagtgtaaacaggtgtgctgggcacttcgagactttacacgactgttccgctag

SEQ ID NO: 138709 - DNA, 2874 bp, Artificial Sequence
  Description of Artificial Sequence: Synthetic coding sequence
atggagggggccaagcctacactccagcttgtgtaccaggcagtgcaagccctttatcatgatccagacccatctggtaaggaaagagcaagcttttggctgggagagttacaacggagcgtgcacgcttgggagatctccgaccagttgctgcagatccgtcaagatgtggagagttgctacttcgcggcccagactatgaagatgaaaattcagacctcattctacgaattacctactgactctcatgcaagcttgcgggactcccttttgactcatatacagaacctaaaagacctcagcccagtgatcgtgacacagctagcactcgcaatcgcagacctagccctgcagatgccatcttggaagggatgcgtccagaccctggtggagaaatacagtaacgatgtgaccagtctacccttcctcctggaaattcttaccgtgcttcccgaggaagtgcattctaggtccctgcgaattggggctaacaggaggacggagattatcgaagacctcgcattttattcgtcaacagtcgtctcactgcttatgacttgtgtggagaaggccggcacagatgagaagatgctgatgaaggtgtttagatgtctggggtcctggttcaatctcggcgtcctagattctaattttatggctaataacaagctcctggctttactgtttgaagttttgcagcaggataaaacttctagtaatctgcatgaagccgcttcggattgtgtgtgcagtgcgctgtacgcgatcgaaaacgtggagacaaacctgcccctggcgatgcaacttttccagggagtgcttacattggagactgcttatcacatggcagtcgcaagagaggacttggacaaagtgctgaactactgccggatattcaccgaactttgtgaaactttcctcgagaagatcgtgtgtaccccagggcaaggtctgggcgacctgcgtactctcgagcttctgctaatttgcgcagggcacccacagtacgaggtggtggaaatcagttttaatttttggtacaggttaggggaacatttgtacaaaactaatgatgaggtaatccatggcatatttaaggcgtatatacagcgactgttgcacgcccttgcgagacattgccagctcgagccagaccatgaaggggtccccgaggagacagatgactttggggaattcaggatgcgtgtgtccgatttggtgaaggacctcatctttcttatcgggagtatggagtgtttcgcgcaattgtattccaccctcaaggaaggaaatccaccatgggaggttaccgaggctgtgttgttcatcatggccgccatcgccaaatcagtggaccccaagaaaccattctcgaatgcggtgtgtcggcacagcttgctgttcgggcaaaatatcacctctgagatatcaaactgtgagtatttgcctccagtactgcgagaaaataaccccaccctggtcgaggtgctagaaggagtcgtcagactccctgagacagtgcacaccgctgtgaggtatacaagtatcgagctggtgggtgaaatgagcgaagtcgtcgacagaaacccacagtttcttgatcccgtcctaggatatctaatgaaggggctttgtgagaagcctctcgccagtgccgcagcgaaggctatccacaatatctgcagtgtgtgtcgcgatcatatggctcagcacttcaacgggctccttgagatcgcccgctctctggattcatttctgctgagtcctgaagcggcggtggggctattgaagggcacagccctggtgctcgctaggctgcccctggacaagataaccgaatgcctgtccgagctgtgtagcgtccaggttatggcccttaagaagctcctaagccaggagcccagtaatggtatcagcagtgatccaactgtgtttctggaccggttagctgtcatttttcgacacacaaatcctattgttgagaacggccaaacacacccctgtcaaaaagtcatccaagaaatctggccagtcctctctgagacactcaataaacaccgcgctgacaacagaatcgtggagagatgctgtcgctgcctgaggttcgccgtgagatgtgtgggcaaggggagcgctgctcttcttcagcctttagtgactcagatggtcaacgtgtaccatgtacaccaacacagctgcttcctgtacctgggaagtatcctggtcgacgaatatgggatggaggagggatgcagacagggcctgctcgacatgctccaggccctctgtattcccacatttcaattacttgagcagcaaaacggcctgcagaatcacccagacacagtggacgacctgtttaggctggcaaccagattcatccagagatcacctgtgacactgcttcggtcccaggtggtcatacctatcctgcagtgggcaattgcttcaacaacactcgatcatcgggatgcaaattgttccgtcatgcgttttctgagagacctaatccacactggggtggccaatgaccatgaagaagacttcgaactgcgaaaagagttaataggacaggtgatgaaccagctgggccaacagttggtgtctcagctgttacatacatgctgcttctgcctccccccctatactctgccagacgtggcggaggtgctgtgggagataatgcaggtcgacagacccaccttttgtagatggctcgaaaattctctgaaggggctgcccaaggaaactacagtgggggcggtgacagtgactcacaagcagctcaccgattttcacaaacaggttacatccgccgaagaatgcaagcaggtgtgctgggcactacgggacttcactcggttgttccggtag

SEQ ID NO: 138710 - DNA, 2874 bp, Artificial Sequence
  Description of Artificial Sequence: Synthetic coding sequence
atggaaggcgctaagcctacattgcagctggtgtatcaggccgtgcaggccctgtatcacgaccctgacccctctggcaaggaacgcgcgtccttttggcttggtgagctccagcgctctgtacatgcctgggagataagcgaccagttgttacagatcagacaagatgtggaatcttgttacttcgctgcacagaccatgaaaatgaagattcagacatccttttacgagttgcccaccgattcacacgcctccctcagagacagtctgctaacacacattcagaatttgaaagatctgtccccagtgattgttacccagttagccctggcgatcgccgacttagctcttcagatgccgtcttggaagggatgtgtgcagactttggttgaaaagtactccaatgatgttacctcactaccattcctcttggaaatcctgacagtactgcctgaagaagtacactccagatccttgcgcatcggggctaaccgccggacggagatcattgaagacctggcattctattctagcaccgtagtgtctttgttgatgacatgcgttgagaaagctggaacagatgagaagatgttgatgaaagtattccggtgtttgggttcgtggttcaatctgggggtactggattctaactttatggccaacaataaattattggctctgctttttgaggtgctgcagcaggataagacatctagtaacttacatgaagcagcaagcgattgcgtctgtagtgccctctacgcaatcgagaacgttgagaccaacttacctctggctatgcagctttttcagggcgtgttaaccctagaaacagcttaccacatggctgtagctagagaggatctggacaaagtgctgaactactgtcggatttttaccgagctctgcgaaaccttcttagagaagatcgtgtgtaccccaggtcaaggactgggtgacctgaggactttggagctcctgctgatctgcgccggtcacccccaatatgaagtggtggaaatctcttttaacttttggtatcgcctaggggaacacctgtataaaactaatgatgaagtaattcacggcatcttcaaggcatacattcagagattactgcacgccctggcgcgacactgccagcttgagcctgatcatgaaggcgtacctgaagagaccgatgacttcggagagtttcgtatgcgcgtgtctgatctggtgaaggatctcatctttttgatcggatccatggagtgttttgctcagttatactcaacccttaaagaaggcaaccctccttgggaagtaaccgaagccgtactgtttatcatggccgctattgccaaatctgtcgacccgaaaaagcctttctccaatgcggtgtgtaggcattccctgctgtttggccaaaacattacaagcgagatcagcaactgtgagtatctgccccccgtccttagggaaaacaaccccacattggtggaggtgctagagggcgttgtgaggctcccagagacggttcacaccgcagtacgatatactagcattgagctggttggagagatgtccgaagtggtggaccgaaatcctcaatttctcgacccggtacttggatacctaatgaagggactttgcgaaaagcccctcgcatctgcggctgctaaagccatccataacatctgcagcgtatgccgggaccatatggcacagcacttcaacgggcttcttgaaattgccagatctctggactcctttcttcttagcccggaggctgctgtgggtttgctcaaaggcactgcactggtgctcgcacggttacctttggataagattacagaatgtctgtcggagctatgttcagtgcaggtgatggctctcaagaagcttctgagccaggaacccagcaacgggatcagttctgaccctactgtctttttagataggcttgcggtgattttccgacacacgaaccccattgttgagaatggccaaacccatccttgtcaaaaagtcattcaggagatatggcctgtgctctccgagaccttgaataaacacagggctgacaacagaatcgttgaacggtgctgccggtgcctgaggttcgccgtgagatgcgtggggaaaggcagcgctgctttactgcagcccctcgtcacacaaatggtgaacgtctatcacgtgcaccagcattcttgctttctctatttaggttccatcctggtcgatgaatacggtatggaagaaggctgtcgtcagggtcttctggatatgctgcaggctttgtgcattccaaccttccagctcttagagcagcaaaacggcttacaaaaccaccccgacaccgtggacgacctgtttagactggccacccggttcattcagcggtctcctgtgacccttttacggtctcaggttgtcattcccatcctgcagtgggccattgctagtacaaccctggaccacagagacgcgaactgttcagttatgcggttccttcgagacctgatccacaccggggtggctaatgaccatgaagaagacttcgaactgcggaaagaactcattggccaagtcatgaaccagttgggccaacagcttgtaagccagcttctgcacacctgttgcttttgcctaccaccctatacacttccagacgtggctgaggtattgtgggaaatcatgcaagttgataggcccactttttgccggtggctcgagaatagtctgaaaggtttgcctaaggagaccacggtgggcgcagtgactgtgactcataaacagctcacggactttcacaaacaggtcacatctgcagaggagtgcaagcaggtctgctgggcacttcgggattttactaggctttttagatag

SEQ ID NO: 138711 - DNA, 2580 bp, Artificial Sequence
  Description of Artificial Sequence: Synthetic coding sequence
atggaaggtgctaagccaactttacagctggtctaccaagcagtgcaggccctgtaccatgatcctgaccccagcggcaaggagcgagctagcttttggctcggtgagctgcagagatccgtgcacgcctgggaaatctctgatcagctcctccaaatcagacaggacgtcgagtcttgttacttcgccgcacagacaatgaaaatgaagatccaaacttcattctatgagctcccgactgattcccacgcaagcctaagggactctctgttgacccatatccagaatctcaaggacttatcaccagttatcgttactcagctcgccctcgcaatcgcggatctggctctccaaatgcccagctggaaggggtgcgtccaaacactcgtggagaagtactctaacgatgtgacaagcctcccctttctcctggaaattctgacagtgttaccagaagaggtgcactccagatcactaagaatcggggcaaatcgccggactgagataattgaggacctcgccttctacagctcaacagtagtttcgctgctgatgacttgcgtcgaaaaggcaggcaccgacgaaaagatgctcatgaaagtgtttcggtgtctgggatcttggttcaatctgggtgtgctcgacagtaatttcatggcgaacaataaattattagcgctactttttgaggtgttgcaacaagacaaaacctcctctaacctacacgaggccgcctcggactgcgtgtgcagcgcactctacgcgattgagaacgttgaaaccaatctgcccttagccatgcagttattccagggcgtgctaaccctcgagaccgcttatcatatggccgtggcccgggaagacctcgacaaagtgcttaattattgtagaatttttaccgagctctgcgagaccttcctcgaaaaaatagtgtgcacacctggccaggggctgggagatttgcggacactggaattgcttctgatctgtgccggccacccacaatatgaagttgtcgaaatcagctttaacttctggtaccgactcggggaacacctgtataagaccaacgatgaggtcatccatgggattttcaaagcctacattcagagacttctgcatgcactggcccgtcactgtcaactggagcctgatcacgagggggtcccggaagaaacagacgacttcggagaatttcggatgagggtgtctgacctggtcaaggacctgatattcctgatcggctccatggagtgttttgcccagctgtatagcactcttaaagaaggaaacccgccctgggaagtcactgaggcagtgcttttcatcatggcagccattgcaaaatccgtggacccggaaaacaacccaacactcgtcgaggttcttgagggcgtagttcggcttcccgagaccgtgcacacggccgtgcgctatactagcatcgagttagttggggagatgtcagaagtggttgatagaaaccctcaatttctgggcaccgctctcgtcctggcgagactcccacttgataagattacagagtgcttatccgagctctgctccgtccaggtgatggcactcaaaaaactgctgtctcaagaaccctcaaatgggatctcttcggatcctacagtgttccttgatagacttgcggtgatatttaggcacactaacccaattgtggaaaacgggcagacccatccctgccaaaaagtgatccaggagatctggcctgtgttatccgagactctgaacaaacatagagccgacaacagaatcgtggagcgctgctgcaggtgcctgcggtttgccgtgcgctgtgtgggaaagggctctgccgcactgttacagccactggtgacccagatggtaaacgtgtatcatgtgcaccagcatagttgtttcctctacctcggatccattctggtggatgagtacgggatggaggaaggctgtagacaaggactactggatatgctgcaggcattatgtatcccgacctttcagctactggaacaacagaacggccttcaaaatcaccctgacactgtcgacgacctcttccgtcttgccacaaggttcattcagcgaagtccagtgactcttctcaggagtcaggtggtgatcccgatcctccagtgggcaattgcctctaccaccctggaccacagggatgcgaattgcagcgtcatgaggtttctgcgcgaccttatccacactggggttgccaatgaccatgaagaggattttgagcttcgtaaagagctgatcggccaggtgatgaaccagctgggacagcaactggtgagccagctgttgcacacttgttgcttctgcctacctccgtacacgctgccggatgtggctgaggtgctctgggaaataatgcaggtagataggcctaccttttgtaggtggcttgaaaattccttaaaaggccttccaaaggaaactacggtgggcgctgttactgtgacccataagcaacttactgactttcacaaacaggtgacgagcgctgaagagtgtaagcaggtttgttgggcactccgcgactttacccgcctgttcagatag

SEQ ID NO: 138712 - DNA, 4236 bp, Artificial Sequence
  Description of Artificial Sequence: Synthetic coding sequence
atggccgaggccaggaaaaggagagagcttttgccactaatttatcatcacctgctcagggcaggatatgtgcgagctgctcgtgaggttaaggaacagagtggccagaaatgtttcttggcacagcccgtcacccttctggacatctacacccactggcagcagacgtctgaactgggccggaaacgcaaagctgaggaggatgcagcgcttcaggctaaaaaaacgagggtgtccgatcctatctcgacatccgaatcctcagaggaagaggaagaggctgaggcagaaacagccaaagccactcccaggcttgcaagcacaaatagctcagtgttaggggcggacctccctagttcaatgaaagagaaggctaaagcagaaacagagaaagcagggaagacgggtaattccatgccccaccccgctacaggcaagaccgtagcgaatctgctgtccgggaagtccccaagaaaatccgccgaaccttccgcaaatactaccctcgtgtctgaaaccgaggaggagggttccgtgccggctttcggagcagccgctaaacctgggatggtgtcagctggtcaggctgattcttctagcgaagatacatctagcagctctgacgagacagacgtagaagttaaggcttccgagaaaattctgcaggtgcgggccgcatccgcgcccgctaaggggacccctggaaagggtgcgacaccagcccctcccggaaaggccggagcagtggcttcccagactaaagccggcaagcccgaggaagactctgaatcatcttccgaggaaagcagcgatagtgaggaagaaacaccagctgcaaaggcgcttctccaagctaaagcgtcaggcaagacctcccaagtgggtgccgcctctgctccagccaaggagtctccgagaaagggtgctgcgccggcacctccaggaaagaccgggcctgccgtcgcaaaagctcaggccggaaagagagaggaggactcacagtccagcagtgaagaatccgacagtgaagaagaggctccagctcaagctaaaccgtcagggaaggccccacaggttcgcgccgcttccgccccggcgaaagagtctcctcgtaaaggagctgcaccggcaccacctcgcaaaacaggtcccgcagccgctcaagtgcaggttggaaaacaggaggaggatagcagatcttcttccgaggagagtgatagcgatcgagaggccttggcagctatgaacgctgcacaggttaagcccctgggaaaatctccccaagtcaaaccagcatctacaatgggaatgggcccacttggtaagggggctgggcccgtaccgccggggaaggtcggccccgccacacctagcgctcaggtcggcaaatgggaagaggatagcgagtcctcgtccgaagaaagtagcgatagctctgatggtgaagtgcctacggccgtggcccccgcgcaggagaagtccttagggaatatcctgcaggctaagcccacctcctcaccagccaaggggcctccgcagaaagctggaccagttgctgtccaggttaaggccgagaaaccaatggacaacagcgaaagttctgaggaaagttccgactccgcggactctgaagaggcgccagccgcaatgacagctgcacaagctaagccggcgctcaaaattccgcagactaaagcctgtcccaagaagaccaataccaccgcaagtgctaaggttgctcccgtacgtgttggtacccaggcccccaggaaggccggaaccgccacttcccccgccgggtcaagccccgcagtggccggggggacacagcggcctgcagaggactcatcttcatcggaagagagcgactctgaagaggaaaagacagggctcgctgtaactgtcggccaggctaagtcagtgggtaagggcctccaggttaaagccgcctccgtgcccgtaaaagggtctcttggccagggcacggcacctgtcctgcccggtaaaactggcccgactgtcacccaggtcaaagctgagaaacaggaagacagcgaatcttccgaagaggaaagtgacagcgaggaggccgctgcgtccccagcccaagtcaaaacttcggtgaagaagacccaagccaaggcaaatccagccgcggcccgcgctcccagtgccaaaggcacaatatccgcacccggtaaggtggttaccgctgccgcccaagctaaacagagatccccctctaaggtgaagccccccgtccggaacccccaaaatagtacagttctggctcgcggcccggcatccgttccatcagtgggaaaagctgtcgcgacagccgcacaggctcaaaccggaccggaggaagattccggaagttcagaggaagaaagcgactcggaagaagaggccgaaacattggcgcaggtcaagccatcggggaaaactcaccagattagggccgccctggcacccgctaaggaatcacccagaaagggtgctgcacccacacctcctggcaagaccggaccgtctgctgcacaggccggaaagcaagacgacagtgggtcatcatcagaagagtcggacagtgacggggaggctcccgctgccgtaacttccgcccaagtgattaaaccccctctcattttcgttgaccccaaccgctccccagcaggacctgctgcaactcctgcccaagcacaagccgccagcacccccagaaaggctcgggcctcagaaagcactgcccggtcatcctcatccgagtctgaagacgaggatgtaattccagcaactcaatgcttaacaccaggcatacggaccaacgtcgtgacaatgcccactgcccaccctcgcatcgcaccaaaagctagcatggctggcgcgtcaagcagtaaagagagtagccggattagtgacggcaagaaacaggaagggcccgctacacaggtgagcaaaaagaaccccgccagtcttcctttgactcaggcagcactgaaggtgttggcacagaaggccagcgaggcgcagcccccggtggcccgcacacagccgagtagtggcgtggattccgccgtcgggacccttccagctaccagcccacagtcaaccagtgtccaggcgaaaggtaccaacaagttgcgaaagcctaagctgcccgaggtccagcaagcaactaaggcaccagagagtagtgacgactcagaagacagcagcgatagcagctccggcagtgaggaagacggcgagggtccccagggtgctaagtccgcccacaccctgggccccactccctcccgcaccgagaccctggttgaggaaactgctgccgaaagttcagaggacgacgttgtggctcccagccagtcccttctctccgggtatatgacacccgggctgacgcctgcgaacagtcaagcctccaaggccacacctaaactggactcctcccctagtgtgagcagcactctcgctgccaaagatgacccagatggaaaacaggaagccaaaccccagcaggccgctggcatgttaagcccgaagacagggggtaaggaggcggccagcggaacaacaccccaaaagtctaggaaaccaaagaaaggggctgggaaccctcaggcttccacactggcactgcagtcaaatattacgcaatgcctgctgggccagccatggccactgaacgaggcccaggttcaggcttctgtggtaaaggtgctcaccgaactgcttgagcaggaacgcaaaaaggtggtggacaccaccaaagaaagctccagaaagggttgggaatcccggaagaggaaattgagcggcgatcaacccgcggccaggacccccagatccaaaaagaagaaaaaactgggcgctggtgaaggcggcgaagcttcagtgtcccctgaaaagacaagcactactagtaagggcaaagcaaaacgcgacaaggctagcggtgatgtcaaagagaagaagggcaagggcagtcttggatcccaaggcgccaaggatgaacctgaggaagaactccagaagggtatgggaaccgtcgaggggggagaccagagcaacccgaaaagtaagaaggaaaaaaagaagtccgacaaacgtaagaaggacaaggaaaagaaggagaagaaaaaaaaggctaagaaggccagtacaaaagacagcgagagccctagtcagaagaagaagaagaaaaaaaagaaaactgcagagcaaacagtctag

SEQ ID NO: 138713 - DNA, 4470 bp, Artificial Sequence
  Description of Artificial Sequence: Synthetic coding sequence
atggcagaggccaggaaacggcgcgaactgctccccctcatttatcaccacctgctgcgcgctggctacgtgcgggccgccagggaagtgaaggaacagtcaggccagaaatgttttctggcccagcccgtcaccctcctcgatatatacactcactggcagcaaacaagcgagctgggccggaagaggaaagctgaagaagatgccgccctgcaggctaagaagacccgagtcagtgatcctatttccaccagtgagagcagcgaagaggaggaggaagccgaagctgagactgcaaaggccactcctcggctcgcctctaccaactcctcagtgctaggcgctgacttgccttctagtatgaaagaaaaggcgaaggcggagacagaaaaagcaggaaagaccgggaattctatgccccacccggcaactggaaagaccgtggccaatctactgtctggcaaatctcctcgaaagtctgcagaaccttccgctaacacaactctagtatccgaaactgaagaggaagggtccgtgcctgcgtttggcgccgccgccaaacccggcatggtctccgccgggcaagcagactcctcaagcgaagataccagttcctcctccgatgaaaccgacgtggaaggaaagcctagtgtgaaaccagcccaagtgaaagccagttctgtttcaaccaaggagtccccagccaggaaggcggctcccgcacccggcaaagtgggtgatgtgactcctcaggtaaaggggggggcattacccccggcaaaacgggccaagaagcctgaggaagagtcagagtcctctgaggaggggtctgagtccgaggaagaggcgcccgcaggtacccgcagccaagtcaaggcttctgagaaaattttgcaggtgagggccgcttccgcgcccgccaaagggacaccaggcaaaggtgccaccccggctccgccaggcaaggctggtgcagtagccagtcagaccaaggccggtaaaccagaggaggactcagaatcctcatccgaggaaagctccgactcagaagaggaaaccccagcagccaaggcacttctgcaagccaaagcctccggtaaaacatcccaggtgggcgccgcatcggccccagcaaaagaatcaccaaggaagggggcggcacctgcccctccaggcaaaacaggacctgccgtggctaaggcccaggctggtaaaagggaagaagatagccaatcctcaagcgaggagagcgacagcgaggaggaagccccagcccaggcaaagcctagcgggaaagcacctcaggttcgcgctgcaagcgcacctgctaaggaatcaccaagaaagggggccgcccctgctccacctcggaagactggtccagctgctgcccaggtgcaggtgggaaaacaagaggaagacagtagaagctcctctgaagagtcagactcagatagagaggctctggccgcgatgaacgccgctcaagtgaaaccacttgggaagtcaccccaagtcaagcctgccagtaccatggggatggggcccctgggcaagggtgcgggccctgtcccaccgggtaaggttggccccgctactccctctgctcaggtggggaagtgggaggaagatagcgagtccagtagtgaagagagttccgacagtagcgatggcgaggtgcctaccgcagtagcaccagcacaagaaaagagcttggggaacatccttcaggcgaagccaacaagctcccccgccaagggccctcctcagaaggctggtcctgtggccgtacaagtaaaggctgaaaaacctatggacaactccgagtcaagtgaggaaagctccgattccgctgactcggaggaggcccctgccgccatgacagccgcacaagctaaacccgcattgaagataccacaaaccaaggcctgcccgaagaagacaaatacaactgcatctgctaaagtggcccctgtacgcgttggaacccaggctccacgcaaagcagggacggctacttctcccgccggtagttcacccgccgtggccggcggcacacagcgccccgccgaagacagttcatcttccgaggaatcagattcggaagaggaaaagaccgggcttgctgtaacagtgggccaggcgaagagcgtgggcaagggtctccaggtgaaggctgcttcagtacccgtgaaaggcagccttggacagggcacggcacctgtactgcctggtaagaccggaccgaccgtgacccaggtgaaggctgagaagcaggaggactctgagagttcagaagaggagagtgactccgaggaagcggccgcttccccagcccaggtgaaaacctccgtgaaaaagacacaggcaaaggctaatcccgccgcagcgcgggccccaagcgctaagggcacaatttctgccccaggtaaagtggtgactgctgcagcccaggcgaaacaacggtctccttcaaaggtcaaacctcctgttcgcaacccacagaatagtacagtgcttgcccggggtccagcctccgtaccctccgttgggaaggctgtggccaccgccgcacaagcccagactgggcctgaggaagactctgggtcatcagaggaggagagcgatagtgaagaggaagctgaaacattggcgcaggtaaagcctagtgggaaaacacaccagattagagctgccttggcacccgctaaggagagtcctcgcaaaggcgcagctcctacccctcccgggaaaacgggcccctcggctgcccaggcaggcaagcaagacgacagtgggagttcttcagaagaatctgacagcgacggcgaagcccctgctgcggtcacatcagcccaagtgatcaagcctcccctgatattcgtggacccaaatcgtagcccagcaggccccgccgcaactccagcccaggcccaggcagctagcacgccgcgcaaagcgagggcctcggagtctactgctcgcagttcaagcagtgagagtgaggatgaggacgtgattcctgctactcaatgtttaacaccagggatacgaaccaatgtggtcacgatgcctactgctcaccccaggatcgctcctaaggctagcatggcgggcgcttcaagttctaaagagagctctaggatctccgacggcaagaaacaggaggggcctgcgacgcaggtctctaaaaaaaatccagccagcctgcctttgacccaagccgctttgaaggtgctcgctcaaaaggccagcgaggctcaacctccagtggcaaggacacagccatccagcggtgtggattctgccgtgggaaccttgcccgccaccagcccccaatctacgagcgtgcaggccaagggaactaataaactacggaagccaaagttgcctgaggtccaacaagctactaaggcacctgagtcctccgatgacagtgaggattccagcgactcctcctctggatctgaggaagacggcgaaggtccacagggagccaaaagcgctcacacactcgtgggcccaaccccatcccgaacagaaacccttgtcgaagagaccgccgctgagtcctcagaagacgacgtggttgcccctagccagtccttgctttccggctacatgacccctggcctgactcccgccaattctcaggcatctaaggccacacccaaactggacagttccccatccgtgtcatccaccctcgccgcgaaggatgaccctgacggaaaacaggaggctaaaccccaacaggctgctggcatgctgtccccaaagacaggcgggaaggaagccgccagtggtactactcctcaaaagtcaaggaaacccaagaaaggagcgggaaaccctcaggcttccactctcgcgctccagagtaacataacccagtgtttgctggggcagccctggccactgaacgaggctcaagttcaggcctctgtggttaaggtgttgaccgagttgctcgaacaagagcgcaagaaggtcgttgataccaccaaggagagctcaaggaaaggatgggagtcccgcaagcgcaaattatccggggatcagcccgccgcacgtacaccccgcagcaaaaaaaagaagaagctaggagccggcgaaggcggcgaagctagtgtgtctcccgagaaaaccagtaccactagcaagggaaaagccaagcgggataaggcgagcggagacgtgaaggaaaaaaagggcaaaggctcactgggatcccaaggcgcgaaagacgagcctgaagaggagctgcagaaaggaatgggcaccgtggaaggcggtgaccagtccaatcctaaatccaaaaaggagaagaagaagtcggataaaagaaagaaggataaagagaagaaagaaaagaagaagaaggcgaagaaggcgagtactaaggactccgagagtccttcacaaaaaaagaagaagaagaagaagaaaactgccgagcagactgtttag

SEQ ID NO: 138714 - DNA, 2877 bp, Artificial Sequence
  Description of Artificial Sequence: Synthetic coding sequence
atggcagaggcgagaaagagacgagagttactgccactgatttatcaccacctgctccgcgccgggtacgttcgagctgcccgcgaagtgaaagagcagtctggacaaaagtgcttcctggcccagccagtgacacttctggacatatacacccactggcaacagacctcggagttgggtcggaaaagaaaggcggaagaggatgccgcgctgcaggctaaaaaaaccagggtgtcggacccgatcagcactagcgagtcttcggaggaggaggaagaggccgaagcagagacagcgaaagcaaccccccggctggcatccaccaacagcagtgtactaggggccgatctgcctagttccatgaaggagaaggcaaaagccgagaccgagaaagccggcaagaccggtaacagcatgcctcaccctgcaactggaaaaaccgtcgctaacctgttgtccgggaagagtcctagaaagagcgctgaaccttctgccaatacaacacttgtaagcgagactgaggaggagggatctgtgcctgccttcggcgccgctgccaaaccggggatggttagtgcaggccaggccgattcaagctcagaggacacatcctcttcttccgacgagaccgacgttgagggcaagccgtcagtgaaacctgcccaggttaaagcatcaagcgtgtccacaaaagaatcccccgcacgcaaagccgctccggcccctgggaaggtcggtgacgtcactcctcaggttaagggtggcgccctgccacctgccaaacgtgctaagaaaccggaagaggagtccgaaagctctgaagaaggatccgaatctgaggaggaagctccagcgggaacccgtagccaggtaaaagctagcgaaaagatattgcaagtgagagcagccagcgctcccgcaaagggaacccctggaaagggagctactccagcacctccgggaaaagccggggctgtggcatcccagacgaaagcagggaagcctgaggaagactctgagagttccagcgaggagagctccgatagtgaagaagagactcccgctgctaaagctttgctgcaggctaaggcttccgggaagacatcccaagttggcgccgcttcagctcctgctaaagaatcaccccggaaaggcgccgccccagcacctccaggtaaaacaggacctgcagttgctaaggctcaggccggaaaacgcgaggaagacagtcaatcaagctccgaagaatctgatagtgaggaagaggctccggcacaggcgaaaccatctgggaaggccccacaagtgagagcagcctcagcccctgcaaaggagtcccctcgtaagggcgccgctccagccccgcctcgaaagaccggtccggctgccgcccaagtgcaggtgggtaagcaggaagaagactcaaggtcgtcctcggaagaatccgacagcgacagggaggccttggcggcaatgaatgcagctcaggtgaagcccctcggaaagagtccacaggtaaagccagcatcaacaatgggtatgggccctctgggtaaaggcgctggccctgtgccacctggaaaggtgggtcctgccactccctcagctcaggtgggcaagtgggaagaagattccgagtcaagctctgaagagtcttcggacagctctgatggtgaggtcccgactgccgtggctccagcacaggaaaaatcccttggaaacattctgcaggccaaacctacaagctctcctgccaaggggcccccgcagaaggcgggacctgtagccgttcaagttaaagctgaaaaacccatggataactccgagagctcagaggagagttctgatagcgcagatagcgaagaagccccagccgcaatgactgctgcacaagccaaacccgccttaaagattccccagacaaaggcttgtcccaaaaagacgaacacaacagcctcagcaaaggtcgctcccgtgcgtgtgggaactcaagcccctcgaaaggccggaaccgctacaagtcccgctgggtcgagcccggccgtggccggcgggactcagcgccccgccgaggactcatcgagctcagaggaatctgatagcgaggaggagaaaactggcctggccgtaactgttggacaagcgaagagcgtgggcaaaggactgcaggttaaggccgcttctgttcccgttaaggggtccctgggtcagggcactgccccggtgcttccaggtaagacgggaccaacagtaacgcaggtgaaagccgagaagcaagaggatagcgaaagtagtgaggaagagtcggactcagaagaggctgctgcttctccagcacaggtaaaaacttcagtcaagaagacgcaggcaaaagcaaaccccgctgctgcccgagcaccaagcgctaaggggacaatctcggccccggggaaagtcgttactgccgctgcccaggcaaagcaacgatctccctccaaggtgaagccccccgtgagaaacccacagaattccaccgtgctggcaaggggtcccgcatccgtgccaagcgtaggcaaggctgtagccacagccgcccaggcccagaccggccccgaggaggactccggatccagcgaagaggaatcagacagcgaagaggaggcagagaccttggcccaggtgaaaccgagtggaaagactcaccagattcgggccgccctggcccccgcaaaagaatcgccaaggaagggcgccgcacctacgcccccaggtaagacagggccaagtgccgcccaggccggcaagcaggacgattctggaagcagctcagaagagtccgattctgacggtgaggcccccgctgcggtcacctccgcacaggatcaggagagcagttag

SEQ ID NO: 138715 - DNA, 4245 bp, Artificial Sequence
  Description of Artificial Sequence: Synthetic coding sequence
atggccgaagcgaggaagcgaagggagctcctgccgctgatttaccaccatttactaagggccggctacgtgagggcagctagagaagtcaaggagcaaagcggccagaagtgcttcctcgcccagccagtcactctcctagacatctacacacactggcagcagacttcagaactggggcgcaaaaggaaggctgaagaggacgctgcactgcaggccaagaaaactagggtatccgaccctatctcaaccagcgaaagttcagaggaggaggaagaagctgaggctgaaacagcgaaagccactccacggctggcatccaccaatagtagcgtcttgggagccgacttgccttccagcatgaaagagaaggccaaagctgagacggagaaggcaggaaagactggcaattcaatgccccacccagcaactggcaaaaccgtggccaatctcctgtcaggtaagagcccccgcaagtccgctgagccctccgccaacacgactttggtcagcgagaccgaggaagaggggtcagtgcccgcgtttggagctgccgcgaagcccggtatggtgagtgctggacaggcagatagcagctctgaggataccagctcgagttctgatgaaacagatgtcgaggggaagccaagcgtgaaacccgctcaagtgaaagcatcctctgtatccaccaaagagagccctgcaagaaaggctgctccggcccctgggaaggtaggagatgttactccacaagtgaaagggggcgccctcccgcctgctaagagagctaagaaacccgaagaagagtctgagagttccgaggaggggtctgaatccgaggaagaggctcccgccgggactaggtcccaggtgaaggccagtgagaaaatcctgcaggtccgcgctgcatctgcaccagccaaaggcacacctggaaagggagcaactccagccccgcccgggaaggccggtgcagtcgcctctcaaacgaaggcagggaagccagaagaggactcagagtcatcatctgaagaaagcagcgatagtgaagaggaaactccggccgccaaggctctgctccaggctaaggcctccgggaagacgtctcaggtgggcgccgctagtgcccctgccaaggaatccccccgcaaaggagcagccccagctccgcccggaaaaacagggcctgcggtggcaaaggctcaggcagggaaacgcgaagaagacagtcaatcttcttctgaagagtccgattccgaagaggaggcgccggctcaggcaaagccttccgggaaggctcctcaggtgcgtgccgccagcgcacctgccaaagaatcccctcggaagggggccgcccctgcacctccacgaaaaaccgggccagccgcagcacaggtgcaggtcgggaaacaggaggaggattcccgttcctcctccgaggaatccgactcagatcgggaagccttagccgctatgaatgccgcccaggtcaagccactgggtaaatctccacaggtcaaacctgctagcactatgggcatgggacccctgggcaaaggtgctgggcccgtccctcccgggaaagtgggtcccgctacaccctcggcgcaagtgggaaagtgggaggaagatagtgagtcttcaagcgaggagagtagcgactcatctgatggcgaggtgcccacagctgtggcaccagctcaggagaaatcccttggaaatatcttacaggccaaacctacgagtagcccagccaagggacctccgcagaaagccggaccagtggcagttcaggtcaaggctgagaaacccatggataattccgagtctagtgaggagtctagtgatagcgctgattctgaggaggctccagcggcaatgacagccgcgcaggccaaacccgcactgaaaattcctcagactaaagcctgtccaaagaagaccaatactacagcctcagccaaagttgcgcctgtgcgggtcggcacacaggcccccaggaaggcaggcaccgccacatctcccgcggggtcaagtccggctgtcgcaggaggtactcagcgccctgcagaggattcttcttcctcagaggaatcagattctgaggaagaaaagactggcctggctgtgaccgtcgggcaggccaagtccgtaggaaagggtctccaggtaaaggccgcaagcgtccccgtcaaaggtagtctgggtcagggcacagctccagttcttcctggtaaaaccggaccgacagtgacacaggtgaaggcagagaaacaggaggacagcgaaagctcagaagaggagtctgactcagaggaagcagccgcgagtcccgctcaggtgaagacctctgttaaaaaaacccaggccaaggctaatcccgccgcggcccgcgccccctcagccaagggtacgatttccgccccaggaaaagtggtcacagccgcagctcaggccaaacaaaggagcccgagtaaggtgaagcctccagtgagaaatcctcagaacagcactgtcctcgccaggggacctgcttctgtccccagcgtcggcaaagcggtagcaactgctgctcaggctcagactgggcccgaggaagatagcggaagctctgaagaagaatccgattccgaagaggaggcggaaactctggcccaggtaaagcccagcggcaagacccaccagatccgagctgctctggcgccagccaaggaatcccctaggaaaggtgccgcgcccactcccccgggcaaaaccggacccagcgctgcacaggctgggaaacaggacgattctggctctagcagcgaggagtctgattcagacggtgaagctcccgccgcagtcacctctgcccaagtaatcaagccgcccttaatctttgtagatcccaataggagcccagcggggcctgccgccactcccgctcaggcacaggccgcgtccacccccaggaaggcccgagctagtgaaagcacagcacggtcttcgtcctccgagtccgaggacgaggacgtaattccagctacccagtgtcttacccccgggattcggaccaatgttgtgacaatgcctaccgctcacccccgcatcgcacctaaagccagcatggccggtgcatctagcagtaaagagtcctccaggatctccgacggaaaaaagcaggaagggcctgccactcaggtggatagcgctgtcggaacactgcctgccacctcgccgcaaagtacatccgtccaggccaaaggtaccaataaactgcggaaacctaagctgccggaagtgcagcaggccactaaagcccccgagtcttccgatgacagcgaggactcctcagatagtagctctgggtccgaagaagacggagagggcccacagggagctaaatcggcccacaccctcggccccactccctctcgtaccgagacattggtcgaagaaactgccgctgagtcctccgaagatgatgtcgtggccccgtcccagagcctgttatccggctacatgactcccgggcttaccccagccaacagtcaggcttctaaagctacacctaaactcgacagttcccccagcgttagtagtaccttagccgccaaggatgatccggacggcaaacaagaggccaagcctcagcaggccgctggaatgctcagccccaaaaccggaggcaaggaggcagccagcggcaccacgcctcagaaatcccgcaagccaaaaaagggcgctgggaacccacaggcttccacactggcattgcagagtaacatcactcaatgcctgttgggccaaccctggcctctgaatgaggcacaagtccaggcctccgtggtcaaggtcctaactgagctcctggagcaggagcgtaaaaaggtggtggacaccacaaaggagtctagccgaaaaggatgggaaagccggaagcggaagctgagcggcgaccagcctgccgcccgaactccccgaagtaagaaaaagaagaaattgggcgctggagaaggcggagaagcttcagtgtctcccgagaaaacctcaacaacctctaaggggaaagccaaacgtgataaagcctctggagacgtgaaagaaaagaagggtaaaggaagcctgggcagccaaggcgccaaagacgaacccgaggaggaattgcaaaaaggcatggggaccgtcgaagggggggaccagtctaacccgaagtccaaaaaagaaaagaagaaaagcgacaagcgaaagaaggacaaatag

SEQ ID NO: 138716 - DNA, 4356 bp, Artificial Sequence
  Description of Artificial Sequence: Synthetic coding sequence
atggccgaggcccgcaagcggagggaactgttgccattgatttatcatcatctgctccgtgccggatatgtgagggcggcacgggaagttaaggagcagtccggccagaagtgttttttggcccagccagtcacactactcgacatctatactcactggcaacaaacttctgaactgggccgaaaacggaaagccgaagaggacgctgccctgcaggctaagaagaccagagttagcgatccaatcagcacaagcgagtcctcagaagaagaggaagaggctgaggccgagacagctaaggctacccccagactggcctccactaattcaagtgtacttggggcggatctgccttctagtatgaaggaaaaagccaaggcagagactgagaaagcagggaaaactgggaatagcatgccccatccagcaaccggcaagacagtggccaatctactgagtggcaaatcgccaagaaaatcagcagagccaagtgcaaataccacccttgtgtcggagacagaggaagaggggtctgtgcccgccttcggagccgcggcaaaacctggaatggtcagcgccgggcaagcagacagttcctccgaagacacatcatctagctctgacgagacagacgttgaaggcaaacctagcgtgaagccggcccaggtgaaagcgtcttcggtttccacaaaggagtctccggccagaaaagccgcccctgctcctggcaaggttggggacgtcacaccccaggtgaaggggggtgcactgcccccagccaagagagctaaaaagcccgaagaggaatctgaatcttcggaagagggtagtgaatctgaagaggaagcccctgcagggaccagaagccaggttaaggcttcagagaagattctgcaggtgcgggccgcctctgctccggccaagggtacccccgggaagggcgctaccccggccccccctgggaaggcaggtgccgtcgcttcacagacgaaggctggtaagcctgaagaggacagtgaaagttcttctgaggaaagctctgattccgaggaggagacccctgctgccaaggccttgctgcaggcgaaggcctccggaaagaccagccaggttggcgcagcgagcgcccccgcaaaagagagcccccgcaagggggccgcaccagcccctccaggaaagactggacctgctgtggctaaggcccaggctgggaagagagaagaagattcccaaagcagcagtgaggaaagtgatagtgaggaagaagctccggcccaggccaaaccctccggcaaggccccccaagttagagctgcgtccgcccctgccaaggaatcccctcggaagggcgccgctcccgcccctccacgtaaaacagggcctgccgccgcacaagtgcaggtggggaagcaggaagaggacagccggtcctctagcgaggagtccgactcagaccgagaagccttggcagctatgaacgctgcccaagtcaaaccattgggcaaaagcccacaggtgaagcccgcgagtaccatgggtatgggccccctgggcaaaggagcaggaccagttccgcccgggaaggtaggacctgccacaccctcagcccaagtgggtaaatgggaagaagattccgaatcctcttccgaggaaagctccgattcatcagacggcgaagtgcctaccgcagtggctcccgctcaggagaagtctctcgggaatatcctacaagccaagccgacatcctctcctgctaaagggcctccacagaaggctggcccagttgctgtgcaggtgaaagctgagaagcctatggacaatagtgagtcaagtgaagaatcttcagactctgccgactctgaggaggcacctgcggccatgactgctgcccaggccaagccagctttgaaaattccccagacgaaggcctgtcctaaaaagactaacaccaccgcatccgctaaagtggcccccgtccgcgtgggtacccaggccccgcgaaaagccggtacagcgactagtccagcaggttcttcccccgccgtcgccggcggcactcagaggcccgcggaagactcctcctctagcgaggaatccgacagcgaagaagagaagactggactggctgtgaccgtcggacaggccaagtcagtgggtaaaggcctacaggtgaaagctgcaagtgtccccgttaaagggagtcttggacaaggcacagcccctgtgcttcctggtaaaaccggacctacggtcacccaagtcaaggccgagaaacaggaagattcagagagtagtgaggaggaatccgacagtgaggaagccgcagcctcacccgcacaggtcaagacgtccgttaaaaagactcaggccaaggccaatccggcagctgctagggccccaagtgccaaagggactatatcagccccaggaaaagttgtgactgccgctgcacaggcgaaacaacggtcaccatccaaggttaagccaccggtgcgtaacccccagaatagcaccgtgctggcccgagggcctgctagcgtccccagtgtgggaaaagccgttgctactgcagctcaggctcaaaccgggcctgaagaggactcaggcagcagcgaagaagagtctgattccgaggaggaagccgagactctggcacaggtcaagccatccggaaaaacgcatcagatacgagcagccctggcccccgccaaagaatcccctcgcaagggcgccgccccaactccccctggaaagactggccccagcgccgcccaggcaggaaaacaggatgactccggctcgtcgtccgaggagtcagattctgacggcgaagcgcctgcggctgtgacttctgcccaagtgatcaagccacctctgattttcgtcgatccaaatcggtctcctgcgggccccgccgccaccccggcccaagcccaggccgcaagtaccccaagaaaggcccgagcgtctgagtcgactgctcgaagctcctcgagtgagtcagaagacgaggatgtgatcccagcaacacagtgtttgacacccgggatacggaccaacgtggtgacaatgcccactgctcacccccgaatcgcccctaaggcaagtatggcgggtgccagcagctccaaggaatcgtcccgtatctccgacggcaagaagcaggagggaccagcgacacaggttgacagcgctgtgggaacgctgcccgccacatcccctcagagtactagcgtccaggctaaggggaccaacaagctgagaaaacccaaactcccagaggttcagcaggcaactaaggccccagagtccagcgatgattctgaagattcttccgacagttcatcagggtccgaggaggacggcgagggaccacagggggcaaagtcggcacacacacttgtcggtccaaccccatcccggaccgaaaccctggtagaggaaactgccgccgaaagcagcgaggatgacgtcgtcgccccatcgcagtccctgctttcaggatatatgactcctggtttgactccagccaacagccaggcgagtaaagcaacccctaagctagactcgtccccgagcgtgagtagcaccctggccgcaaaagacgatccggatgggaagcaggaggccaagccccagcaggcagctggcatgctaagccccaaaacaggaggcaaagaagcagcctctggaaccacaccgcagaagtcacggaaacctaaaaaaggtgcgggaaaccctcaggcgtctacattggctctgcagagcaacattacccagtgtttattgggccagccctggccactgaacgaggcccaagtgcaagccagcgtggtgaaggtactcaccgagttgctggaacaggagcggaagaaggtcgtggatactaccaaggagtcatctcgcaaaggctgggagagtcggaaaagaaagctgtccggagaccagcccgcggctcgcacccctagatccaagaaaaaaaagaaactgggagctggggagggcggcgaagcctctgtaagccccgaaaagaccagcacaacttcaaaaggtaaggcaaaacgggataaggcttccggcgatgtgaaagagaagaaagggaagggttcattgggatctcagggcgctaaggacgagccggaggaggagttgcagaagggaatggggaccgttgaggggggtgatcagtcaaatcctaagtctaaaaaggagaagaagaaatcggataaacggaaaaaggacaaggagaaaaaagaaaaaaagaagaaggcaaaaaaagcttccaccaaagattccgagagtcccagccagaaaaaaaagaaaaaaaaaaagaaaacggccgagcagaccgtgtag

SEQ ID NO: 138717 - DNA, 4239 bp, Artificial Sequence
  Description of Artificial Sequence: Synthetic coding sequence
atggctgaggcgcgtaaaagacgggagctgctccctttgatctaccatcacctcttaagggccgggtatgtgagggcagcccgcgaggtcaaggagcagtcaggacagaagtgttttctggcacagccagttaccctattggatatctacacccattggcagcagacatccgaactgggacgcaagagaaaggcagaggaggatgccgcccttcaggccaaaaagacacgtgtttcggatccaatttcgactagcgagtcctcagaggaggaggaagaagccgaggccgaaacggccaaagcaacacctcgcctggcttcgaccaattcaagtgtgctcggagctgacctcccctcctccatgaaggaaaaggccaaagcagaaactgagaaggctggaaaaacaggcaactccatgccccatccagcgacaggaaagaccgtggccaatcttctctcgggtaaatccccacgaaaatctgctgagccctccgcaaataccacgcttgtgtccgagacagaggaagaaggctccgtaccagcattcggtgctgccgcaaaacccggtatggtttccgcagggcaggccgactcctcgtccgaagatacgagctcttcctccgacgagactgacgtcgaggtgaaagcctccgagaaaatcctgcaggtgcgtgcagcctcagctcctgccaaaggaactccagggaagggggcgaccccggccccgccgggtaaagctggcgcagtggcttcccaaactaaagccggaaaaccagaagaggacagcgaatcctctagtgaggaaagttcagactctgaggaagagaccccagccgctaaggccttgctgcaggccaaggcatcgggaaaaacatctcaggttggtgccgcatcagcccctgccaaagaaagcccgcgtaagggcgccgcaccagcccccccgggcaaaacaggccctgccgttgctaaagcgcaggcaggaaagagagaggaggacagccagtcctcgagtgaggaatcggatagcgaagaagaagcccctgcccaagcaaaaccatccggcaaggcgccccaggttagggctgcatcagcgcccgccaaagagagcccccgcaaaggagccgccccagccccgcctcgcaaaactgggccggccgccgcgcaggtacaggtcggcaaacaggaagaagacagccggtcttcttcggaagaaagcgatagcgatagggaggctctcgccgctatgaacgctgcccaggtcaaacccctgggcaaatcaccgcaggtgaaaccagcttcgacgatggggatgggcccgttggggaaaggcgcgggccctgttcctcccggcaaagtgggtcccgccaccccatccgcccaggtgggtaagtgggaggaagactccgaaagctctagcgaagagtctagtgacagctctgatggagaggtacctacagctgtggcccctgcccaagagaaatccctgggtaacatcttacaggccaagcccacctctagcccagccaagggccccccccagaaggccggaccagtagccgtgcaggttaaggcggagaaacccatggataacagtgagagttctgaagagtccagcgattctgcggattccgaagaggccccagctgctatgactgccgctcaagccaagccagccttgaaaattccccagaccaaggcctgtcctaaaaagaccaatacaaccgccagcgctaaggttgcccccgttcgtgtggggactcaggctcctagaaaggctggcactgcaactagccctgcagggtcctcgcctgccgtggctggaggaacccagagacctgctgaggattcttcatcatccgaggaatccgactccgaagaggaaaaaaccggattagcagtgaccgtgggtcaagcgaagagcgttggaaagggattgcaagtgaaggcggccagcgtgccagtgaaagggtccctggggcaagggacagccccggttctacctggaaagactggccctacagtgacacaagtgaaggccgaaaagcaggaagactcagaatcttcggaggaggagtctgactctgaggaagctgccgcttcgcctgcacaggtcaagacatcggtgaagaagactcaagcaaaagccaacccggcagctgctagagccccgtccgccaagggtacaataagcgcacctgggaaagtggtcaccgcggccgcacaggctaaacagcgctcacctagcaaggtgaaaccacccgtgcggaatcctcagaatagtaccgtgttagcgagggggccggcaagcgtaccttccgtgggcaaagccgtggcgactgcagctcaggcacaaaccggccctgaagaggactccggcagtagcgaagaggagtcagattcagaggaggaggccgaaacattggcacaggtgaagccatcaggcaagacgcaccagattcgagccgctctggctccagccaaggaaagtccacgcaaaggggcagcccctaccccccctggcaaaaccggcccctccgctgctcaagcagggaagcaggacgactcgggatccagctctgaggaatcggactctgatggggaagcccccgccgctgtgactagcgctcaagtgatcaagccccctctgatcttcgtagatccaaaccggagcccagcgggcccagcagctactcctgcccaggcccaggcggcctcaacccctagaaaagcaagggccagtgagtccactgctcggtcatcctcaagcgagagtgaggatgaagatgtgataccggccacccagtgcttgacacccggcattcgcaccaatgtggtgacaatgccaaccgcccacccacggatcgcccccaaagcctcaatggccggagcatcatcaagcaaggaatctagccggatctccgatggaaagaaacaggaaggcccagctacacaggtgagcaagaagaaccccgcgagcctgcccctgactcaggctgccctaaaggtgcttgctcaaaaagcttctgaagcgcagcctcccgtcgcgcggacacagccaagttctggagtggattccgctgtgggtaccctgcctgcaacttctcctcaaagcacaagcgtgcaagccaagggaacaaacaagctcagaaagcccaaactgcctgaggttcaacaggctacgaaagcccccgaatcctccgacgactcggaagactcctctgacagctcttccggcagtgaagaggacggtgagggcccacagggggctaaaagtgcccacacactggttggtcctacgccttccagaactgaaaccctggtggaagaaaccgcagcagaatcatctgaggacgacgtggttgcaccgagtcaatccttgctgagcggatacatgaccccagggttaactccagctaatagccaggcaagcaaggcaactcctaagctggatagctccccgtccgtcagcagtactctcgccgccaaggatgatcctgacggtaagcaggaggctaagccacaacaggccgccggaatgctgagtcccaaaactggcggaaaggaagctgcttcaggcacaaccccccagaagtctcggaagcccaaaaaaggtgctggcaatccccaagcttctacattggcgcttcagagcaatattacccaatgccttctcggacagccgtggcctttaaatgaagctcaagtgcaagcgtcagtagtgaaagtgctgacggagttactagaacaggagaggaaaaaggttgtagataccacgaaagagtcaagcaggaagggttgggaatctagaaagcggaaactttccggcgaccagcccgccgcacgcacaccaagatcgaaaaaaaagaaaaagctgggtgccggtgaagggggtgaggcctccgtaagccccgagaaaacatcgacaacaagtaagggtaaggcaaaacgggataaggctagcggcgacgtaaaggaaaaaaagggcaaagggtccctagggagccagggcgccaaggatgaacctgaggaggaacttcagaaaggcatgggcaccgttgaggggggcgaccaatctaatcccaagagcaaaaaagaaaaaaagaaatctgataagcggaagaaggataaggagaagaaagagaaaaagaaaaaggctaaaaaggcaagtactaaagactcagagtctccctcgcaaaagaagaagaagaagaagaaaaaaaccgcagagcagactgtctag

SEQ ID NO: 138718 - DNA, 4578 bp, Artificial Sequence
  Description of Artificial Sequence: Synthetic coding sequence
atggcagaggctcgcaagcgcagggaactactgcctctgatctatcatcatctgctgcgtgctggatacgtgcgagctgcaagagaagtaaaggagcagagcgggcagaaatgcttcttagcacagccggtcacccttctggacatctatactcattggcagcaaacctctgaactcggacggaaaagaaaagccgaggaggatgccgctttacaggctaagaagactcgcgtatccgatcctatttccacctccgaatcatcagaggaagaggaggaggccgaggctgagaccgcgaaagcgacaccaaggctggctagcactaactcgtctgtcctcggggctgatttgccttcgtccatgaaggaaaaggccaaggcggaaactgagaaggccggtaagacaggtaattctatgccccatcccgccactggcaaaacggtggccaacctgctgagtgggaagagccctagaaagtccgcagaaccgagcgcaaatactacactcgtcagcgagacggaggaggagggtagcgtgccagccttcggggcagcggcgaagcccggtatggttagcgctggacaggctgattccagctccgaagacacatccagttcatctgatgagaccgacgtggaaggaaagccgtctgtgaagcctgcgcaggtaaaggcttcatccgtatctaccaaagaaagccccgcccggaaagcagctccagctccaggtaaagtcggagacgtgacgccccaggtgaagggaggggctttacccccagctaagagggcaaaaaagccagaagaggaaagcgagtcctctgaggaaggatccgagtcagaagaggaggcgccagcaggaaccaggagccaagtcaaggcttccgaaaagatactccaggtgcgtgccgcctcggccccagcgaagggaactccaggcaaaggagccacaccagccccccctggtaaggcaggtgctgtcgcatctcagactaaggccggtaagccggaagaagatagtgagtcatcatccgaagaaagttcagacagtgaagaggaaacccccgcggcaaaagcccttctgcaggccaaagcaagcggcaagaccagccaggttggagcagcatccgcgcctgctaaagaatctccccgcaagggcgccgcacctgctcccccaggtaagacaggaccagcagtggccaaggcccaagccggcaagcgcgaagaagattctcagtcctcttcagaagaaagtgactccgaggaagaggcccctgcacaggctaaaccatcaggcaaagcaccccaagtaagggctgctagtgcacccgccaaggaatcacccagaaaaggtgcggcccctgctcccccaagaaaaactgggccagctgccgcacaagtacaggtcggcaagcaagaagaagacagcaggagttcatccgaggagtccgacagcgaccgtgaggctctggctgccatgaatgccgcccaggtcaagcccttgggcaagtccccacaggtgaagcccgccagcaccatggggatgggcccgcttgggaagggggccgggcccgtgccccccgggaaggtgggtcctgccactccaagtgctcaggttggaaaatgggaggaggatagcgagtctagctcggaagagtcaagcgacagttccgacggagaggtgcccaccgcagttgctcccgcccaagaaaaatctctggggaacattctccaggctaagcctacatcgagccctgctaaaggtccaccccagaaagctggtccagtggcagttcaggtgaaggcagagaagcctatggataattctgagtcaagcgaggagtcttccgactccgctgacagtgaggaggctccagcggctatgaccgctgcccaggccaaacccgcattaaaaatcccacaaacaaaggcctgccctaagaagacaaacaccactgcatccgccaaagtcgctcccgtccgagtcgggacacaggctcccaggaaagctggaaccgctacctcacctgctggttccagtccggcggttgctggtggtacccagagacccgccgaggatagttccagctccgaggaatctgacagcgaggaagagaagaccggactggcagttacagtgggccaggcaaaaagcgtaggcaagggtcttcaagtcaaagccgccagcgtgcccgtgaaggggtccctagggcagggaactgctccagttctgcctgggaaaacaggtcccactgtcacacaagtgaaagccgaaaaacaggaagactcagaaagctctgaggaggaatccgattcggaggaggccgcagcctcaccggctcaggttaaaactagtgttaaaaagacacaggctaaggccaaccccgctgcagcaagggctccttcagctaaagggacaatttccgccccgggtaaggtggtcacagcagctgcccaagctaaacagcgatcaccctcgaaagttaaaccccctgtgaggaatccgcagaacagcactgtccttgcgagagggcctgcctctgtgccatctgtgggtaaggctgtggctactgcggcccaagctcagaccggccctgaggaagacagtggcagctcagaagaggagagtgacagtgaggaggaggccgagaccctagctcaggtcaagccctccggaaaaacacatcagatcagagcagcgttggcccctgccaaagagagcccccggaagggagcagctcctacgcccccaggaaaaaccggtccaagcgccgctcaagccggaaaacaagatgactccggctcaagctcagaagagagcgatagcgacggggaagctcctgcagcagtcacaagcgcacagaaagatagtaacagtaaaccagctaggagcaaaactcttgcaccagcacctcccgaaagaaatacggaaggttcctccgaatcttcagaggaggaactgcccctgacccaggtaataaagccacccctcattttcgtcgatcctaatcgcagtcctgcaggccccgcggcaactcccgcccaggctcaggcagcaagcaccccaaggaaagctcgggccagcgaaagcacagctaggagctcctcctctgaatccgaggatgaagacgtaatacctgctacacagtgcctcaccccaggcatccgaacaaacgttgtcacaatgcctaccgcacatcccagaatagcgcctaaggcttcaatggctggcgcatcaagtagtaaagaaagcagtcgcatttccgacggcaaaaaacaggaagggccggcaacacaggtcagcaagaaaaaccccgccagtctgccactgactcaggctgcattaaaagtcctcgcccagaaagcctcagaggcacagcctcccgttgcacggactcagcccagtagtggtgtagactctgctgttggaactctgccagccaccagcccacagtctacaagcgtgcaagccaagggcacaaacaagctccgaaaaccaaagctacccgaagtgcagcaggccaccaaagcacctgaaagcagtgatgatagtgaggactcttcggactctagcagtggctcagaagaagatggcgagggaccacagggcgcgaagtctgcgcatacgctcggtccgactccatctagaactgagacgctggtggaagaaactgcagccgaaagtagtgaagatgacgtggtggctccctcccagagtttgctcagcggctacatgacgcccgggctgactcctgccaattcccaggcgagcaaggccaccccaaagttagactcctccccttcggtttcctcaacccttgccgctaaagacgatcctgatggcaagcaagaggccaagccacaacaggctgccgggatgttgtcccccaagaccggcggcaaagaggccgcctctggcaccaccccccagaaaagtcgcaaaccaaaaaaaggcgccgggaacccgcaggcatccacactcgcacttcaatctaacattactcaatgtctgttaggacagccatggccgttaaacgaagcccaggtgcaggcctcagttgtcaaggtgctcaccgagctgttggagcaggaacggaagaaggtagtggacactaccaaagagtcttctcggaaagggtgggaaagcagaaagcgtaaactcagcggagaccagccggctgccagaacaccaaggtcaaaaaagaagaaaaaattgggagccggagagggcggcgaggcctcagtgagccctgagaagaccagtactacgtccaaggggaaagcaaagcgcgataaggccagtggcgacgtgaaagaaaagaaaggaaaggggagtctcggtagccagggtgctaaagatgagcctgaagaggagttacagaaaggaatgggtacggttgagggaggggatcagtccaatccaaaaagtaaaaaggaaaaaaagaagtcggataagcgaaaaaaggacaaggaaaaaaaggagaagaaaaaaaaagcgaagaaagcctcaactaaggatagcgagagcccttctcagaaaaagaagaaaaaaaagaagaagaccgctgagcaaaccgtgtag

SEQ ID NO: 138719 - DNA, 4467 bp, Artificial Sequence
  Description of Artificial Sequence: Synthetic coding sequence
atggccgaggcgcgaaagcggcgggagttgcttcctcttatataccatcaccttctccgggcaggatatgtgcgggccgcgcgggaagtgaaggaacaaagtggtcagaaatgctttctggcgcagccagtgacactcctggatatctatacccattggcaacagacgtcagaacttggcagaaaaaggaaagcagaggaggatgccgctctgcaggcaaagaagactcgggtcagcgacccaatttcaacctctgaatcctctgaggaagaggaagaagcggaggccgaaaccgccaaagctactccccgactcgcaagcactaacagtagcgttctcggagccgatctgccctccagtatgaaagaaaaggcaaaagccgaaaccgaaaaagccggaaagacaggtaacagcatgcctcacccggccaccggaaagacagtagcgaacctcctttccggcaaatccccaagaaagagcgccgagccttccgccaacactactctggtgagtgagacagaggaggagggctcagtccccgcctttggcgccgcagccaaaccaggtatggtctccgctggacaggctgattcatcctccgaggatactagctcttcatccgacgaaactgatgtcgagggtaagccctccgtgaagccagcacaggtaaaggcgagctcagtttctaccaaggaatctccggctcgaaaagcggctcccgctcctggcaaagtcggggacgtgacccctcaggtgaagggtggcgcattaccaccagccaagcgggcaaagaagcccgaagaagaatccgaatcgagtgaggaaggctctgaaagcgaggaagaagcacccgccggaacacgcagtcaggtgaaggcttcagagaaaattctgcaggtgcgtgcggcttccgctccggccaaaggaactccaggtaagggcgccaccccggcccctcctggcaaggcgggagcggtggctagtcagaccaaggccggaaagcctgaggaggactcagaatcatcttctgaagagtcctcagatagcgaggaagagacacccgctgctaaagctttactgcaggccaaggcaagcggcaaaaccagtcaggtgggcgccgccagcgcgccagccaaggagtcgccgagaaagggtgctgcaccggcccctcccgggaagaccggaccggcagtcgctaaggcccaggctggaaaacgagaggaggattcacagtcaagttcagaggaatcagattcagaggaggaagccccagcacaggccaaaccctcgggcaaggctccacaggtgcgagccgcatctgctcccgctaaggagtctccgagaaagggcgcggcacccgccccccctcggaaaactggaccagccgctgctcaagtccaggtcggaaaacaggaggaggactcccgatctagctcagaggaatcagattccgatcgggaggctctggccgctatgaatgctgcacaggtgaaaccactgggcaaaagcccccaggtcaagccagcctctaccatggggatggggcccctgggcaagggtgccgggcccgtgccacctgggaaagtcggcccggccacaccttcagcccaagtgggcaaatgggaggaagacagcgagtctagttccgaagaatcttccgactcaagcgacggcgaggtccctacggctgtagcccccgcacaggaaaagtctttagggaacatacttcaggccaagcccaccagctcccccgctaaaggccctccccaaaaggcaggccccgtggctgtccaggtgaaggctgagaaacctatggacaatagcgagtcctccgaagagagcagtgatagcgcagacagcgaggaagctcccgctgctatgaccgcagcgcaggcaaagcctgcccttaaaatacctcagactaaggcctgcccaaagaagacgaacacaacagcgagtgctaaagtagctcccgtcagagtaggtactcaagcacccaggaaagctggaaccgctaccagtccagccgggagttcccctgccgttgccggtggcacccagaggcctgcggaggacagcagtagttctgaggaatccgacagcgaggaagagaaaacaggacttgccgtgaccgttggacaggctaagtccgtaggaaaggggttacaggtaaaagccgccagtgtacctgtgaaaggtagtttagggcagggtacagcacctgtgcttccaggcaagacaggccctactgtaacccaggtgaaggcggagaaacaagaagatagcgagtcctccgaagaagaatccgatagtgaggaagcagccgcatcacctgcccaggtcaagacgtccgtcaaaaaaacacaggccaaggctaatccagcagccgcgcgcgcaccctcagcaaagggcactattagtgccccaggaaaggtagtaaccgccgcggcacaagccaagcaaaggagcccaagtaaagtcaaaccgccagttcgaaacccccaaaattctactgttttggctaggggaccggcctcagttccaagcgtcggtaaagcagtggcaaccgccgcacaagcacagaccggaccggaggaggattccggatcaagtgaagaagaaagcgattctgaggaggaagcagaaacccttgcccaggtcaagccatccggtaagacacaccaaatccgggctgccttagcccccgctaaagagagccctaggaagggagccgctccaacccccccagggaagacagggccgtcggcggcgcaggcggggaaacaagatgattccggctctagttcagaagagtcagatagtgacggggaggcccccgccgcagtgactagtgcccaggtcatcaagccacccctgatttttgtcgaccctaatcgctcccctgcgggccctgcagctactccagctcaggctcaggcggcctccacgcccaggaaggccagggctagcgagagcacagctaggtccagcagctccgagtctgaggacgaagacgtcatccctgcaacccagtgtctcacccctggcatacgaaccaacgtggtgacaatgcccacagcacatcccaggatcgcccccaaggcaagcatggccggagcttcttccagtaaggagtctagccgaatcagcgatggaaaaaaacaagagggtcctgccacacaagtcagtaagaagaatcccgccagcctcccactcacacaggctgccctaaaagtacttgctcagaaggcctccgaggcacagccgccggtcgcccgaactcagccatcctccggtgtggactccgccgtaggaacactgcccgcaacctcgccccaatctacctctgtccaggctaaaggtactaacaagctccgcaagcccaaactccccgaggtgcaacaggcaactaaggccccagaaagcagcgacgacagcgaggacagcagtgactccagttccggttctgaggaggacggcgaaggtcctcagggagcaaaatccgctcacacattgggcccaactccgagcaggacagaaactctcgttgaagaaacggccgccgaaagctcagaggacgatgtggtggccccaagtcagtccctgcttagtggctatatgactccgggcctgaccccagcaaacagccaagctagcaaggcaactccaaaactcgactctagcccttcggtgagtagtacacttgcggccaaggacgatccagacgggaagcaggaggccaagcctcagcaggctgctggaatgctcagccctaaaacaggcgggaaagaagctgcctccggtaccacaccccaaaagtctagaaagccaaaaaagggagccggtaacccacaggccagtaccttagcactgcagagcaacatcactcagtgtctcctaggccagccttggcctctgaatgaagcccaagttcaagcaagcgtcgtgaaggtgctgacagaactgctcgaacaagaaagaaagaaagtcgtggacacaaccaaagagtcctctcggaagggttgggagagtcgcaagcgtaaattatcaggagaccagccggccgccagaacccctagatccaaaaaaaaaaaaaagctgggcgcgggtgagggtggcgaggcatctgtaagccctgagaaaacgtccacgaccagtaagggaaaggcaaaacgggacaaagcctcaggagatgtcaaggagaaaaaaggaaagggtagtctcggttcacaaggcgctaaggacgaacccgaggaagagctacagaagggcatgggtacagttgaaggtggagatcaatccaaccccaaaagcaagaaggaaaagaagaagagcgataagcggaagaaagacaaagagaagaaagaaaagaagaaaaaggctaaaaaagcctccacgaaggacagcgagtccccatctcagaaaaagaagaaaaagaagaaaaaaactgcagagcagaccgtgtag

SEQ ID NO: 138720 - DNA, 255 bp, Artificial Sequence
  Description of Artificial Sequence: Synthetic coding sequence
atggccaccatggaaaataaagtgatttgcgcgttggtccttgtgagtatgctggctcttggaacactggcggaagctcagactgagacgtgtactgtggcaccaagggagagacagaactgtggcttcccaggagtcacccccagccagtgtgccaacaaggggtgctgttttgacgatactgtccgaggagtgccttggtgcttttaccccaacactatagatgtccctcctgaggaagagtgcgagttttag

SEQ ID NO: 138721 - DNA, 390 bp, Artificial Sequence
  Description of Artificial Sequence: Synthetic coding sequence
atgggcagacgggacgcccagctgctggccgcgctgcttgtgttggggctctgtgcacttgcaggctcagaaaaaccatcgccatgccagtgctcgcgactatctccccacaacagaacaaactgcgggtttcccggtataacttctgatcagtgtttcgacaatggctgctgcttcgactcctctgtaaccggcgtgccatggtgcttccatcctctgcctaaacaagaatccgaccaatgtgtcatggaagtgtccgataggcgcaattgcggctatcccggcatttctccagaagaatgcgcttctaggaagtgctgctttagcaatttcattttcgaggtcccttggtgcttttttcccaagagtgtggaggactgccattactag

SEQ ID NO: 138722 - DNA, 1749 bp, Artificial Sequence
  Description of Artificial Sequence: Synthetic coding sequence
atgccaggccgcacctgggaactgtgcctacttcttttgctgggcctgggcctgggatcacaagaggccctgcccccaccatgcgagtcagagatttattgccatggagaactcctgaatcaggtgcaaatggccaaactctaccaggacgacaagcagttcgtggatatgcctttatccattgccccagaacaggttctgcagactttcacagaactcagccgggatcataaccactctatccccagggagcaattgcaggcctttgtgcatgaacatttccaagcaaaggggcaggaactgcaaccatggacccctgccgactggaaggactcaccccagtttcttcaaaaaatctccgacgcgaaactgcgcgcctgggccggtcagctgcatcagctgtggaaaaaactcggcaagaagatgaagcccgaagtgcttagccatccagaaaggttctccttaatctacagtgagcaccctttcatcgtgcccggtgggcggttcgtggagttttattattgggactcctactgggtgatggagggtctattgctcagtgagatggcggagactgtcaaggggatgcttcaaaactttcttgacctggtcaagacctacggccatgtgccaaacggtgggcgggtgtattacttgcagaggtcgcagccacctctgttgacactgatgatggattgttacctgactcatactaatgacaccgccttcctgcaagaaaacatcgagaccctggctctggagctagacttctggaccaagaatcgaactgtgtcagtctcactggaaggaaagaattatctcctgaaccgttactacgtaccatacgggggtccgcggcccgagtcttattcgaaggacgttgagctggcagatacattgcccgagggggaccgcgaggccctctgggctgagctgaaagccggggccgaatccggctgggatttttcaagtcggtggctgataggggggccaaatcctaattctttgagtggaatccgtacaagcaaacttgtgcctgtggatctcaacgcttttttatgccaggctgaagagctgatgtccaacttttatagccgcctgggcaacgacagccaggccacaaagtacagaattctgcggtcacagaggctggctgccttgaacactgtgctgtgggatgaacaaacgggagcgtggttcgactatgacctggaaaagaagaagaagaatagagaattttatcctagcaacctgacacccctttgggctggatgtttttccgaccccggggtcgctgataaagcactgaagtaccttgaggataataggattctcacttaccaatacggtatacctacctctctgcagaagacagggcagcagtgggacttccctaatgcctgggctcccctccaggacctggttatacgcggattagccaaagcccccctacggagggcacaagaggtcgcattccagcttgcccagaactggatccgcacaaacttcgatgtttactcccaaaaaagcgcaatgtatgaaaaatatgacgtgagcaatggcggtcagccaggcggcggaggagagtacgaagtgcaagaaggtttcggatggacaaacggagtcgtgttgatgctgttggatagatacggcgaccgccttacctctggcccgaaattaccgttccttgaacctcactgccttgcaacccttttgccatctctcctgctgtcactgctcccttggtag

SEQ ID NO: 138723 - DNA, 1656 bp, Artificial Sequence
  Description of Artificial Sequence: Synthetic coding sequence
atgccgggtcgaacttgggagttgtgtctcctcctgttgcttggattgggcttaggcagtcaggaagcactcccccccccttgtgaaagcgagatctattgtcacggcgaacttctcaaccaagtacagatggccaagctctaccaagatgacaaacagtttgtcgatatgcctctaagtatagcccctgagcaggtgctgcaaacatttaccgaactctcccgcgaccacaatcattctatcccacgggaacagttgcaggctttcgttcatgagcattttcaggccaaaggacaggaattacaaccctggactccagcagactggaaggattctccccagtttctgcagaagatctccgacgctaaactaagggcgtgggcggggcagctgcatcagctatggaagaaactgggcaaaaagatgaagccagaggtgctgagtcatcccgagcgttttagcctgatctacagtgagcaccccttcatcgtgcccggcgggcggttcgtggagttctattattgttacggacatgtgcccaacggaggtagagtgtactacttgcagcggagccagcctcctttactaaccctgatgatggattgctatctcacccataccaacgacaccgcttttctccaggagaatattgaaacactcgcgctggaactagacttttggacgaagaatcggactgtgtctgtgtctctggagggcaaaaactatcttctcaaccgctactatgttccttacggaggaccccggcccgagtcttacagtaaggatgtggagttagcggacacactcccagagggggatcgggaagccctttgggccgagctcaaggctggtgctgaatcagggtgggatttttctagcaggtggttaattggggggccgaaccctaactcacttagcggcatacgcacatccaagttagtacccgttgatcttaacgcattcttatgccaggccgaggagctgatgtccaacttctatagccgtctgggcaatgactcccaggctacaaaataccggatcctgagaagccagagactggcagccctgaataccgtgctgtgggatgaacagaccggagcctggttcgattatgaccttgaaaagaagaaaaagaaccgggagttttacccatccaatcttacacccttatgggctggctgctttagcgatccgggcgtcgctgacaaagccttgaagtacctggaagataacagaatcttaacttatcagtatggcatccccacttccctgcagaagacaggacagcagtgggacttccctaatgcttgggcccctttacaagacctggtcatccgaggcttggctaaagctcctcttcgacgcgctcaagaggtggccttccagcttgcacaaaattggataagaacaaatttcgatgtctattctcagaagtctgctatgtacgaaaaatacgacgtgtcaaacggtggacagcctggcggcggcggagagtatgaggtccaggaggggttcggctggaccaacggcgtggtgctgatgcttctggacagatacggggaccgtctgacctcggggccaaagctcccgttcctggaaccgcactgcctcgccacgcttctaccgagtctgctgctctcccttttgccgtggtag

SEQ ID NO: 138724 - DNA, 1380 bp, Artificial Sequence
  Description of Artificial Sequence: Synthetic coding sequence
atgcctaactgcgtccccggccagggaagttgcatttccagcgggagaagctggggcagacgctatcagcgcccaggtccagcacagggattgaccaagggcacagaggagcgcaacgtcccaggcgcccacagcgttttcggtgcgcaaattcgagatagttattgggttatggaaggcctcttgctgagcgagatggcagagactgtcaaaggcatgctccagaatttcctcgatttggtcaagacatatggacacgtacctaacggcggaagagtgtactacctgcagcggagccagcctcctctgctcaccctgatgatggactgctacttaacgcacacaaatgatacagcattcctgcaggagaacattgagaccctggccctggagctggacttctggacaaagaatcgaactgtctctgtaagcttagaaggaaaaaactacttgttgaacaggtactacgtcccttacggcggcccaagacctgagagctactcaaaggacgtggagctcgccgatacactgccagagggggaccgcgaggcactgtgggcagaactgaaagcaggggccgagagcggttgggacttcagttcgaggtggttaattggcggccccaacccaaattcactctcaggcatacggaccagcaaactcgtgccagtggatctgaatgccttcttatgtcaagccgaagaactcatgtccaatttctactcacgcctcggcaacgactcacaggcgaccaaatatcggattctacgctcacagcgattggccgccctaaatactgtgttgtgggatgagcagaccggtgcatggttcgactacgatctcgaaaagaagaaaaagaaccgagagttttacccctccaacctcacgcctttgtgggctgggtgtttctctgacccaggtgtcgccgataaagcccttaagtatcttgaagacaaccggatcttgacctaccaatatgggatccccacatccttgcagaaaacggggcagcagtgggattttccgaacgcctgggccccattgcaagaccttgtcattcgaggactggcaaaagcacccctgcgaagggcccaagaggtggcattccaactggctcaaaattggatcaggactaacttcgacgtgtactctcagaagtctgccatgtacgagaaatatgacgttagtaatgggggccagcccggtggaggaggggaatatgaagtacaagagggcttcggctggacaaacggagtggtgctcatgctactggataggtacggggaccgacttacgagtggtcctaagttgccattcctggagccccactgtctggctactttgctgcccagcctactcctgtcacttctcccctggtag

SEQ ID NO: 138725 - DNA, 1641 bp, Artificial Sequence
  Description of Artificial Sequence: Synthetic coding sequence
atgcccggacggacttgggaactttgtcttttgctcctgctcggtctcggactgggcagccaggaggcgctcccacctccctgtgagagcgagatctactgtcacggcgaacttctgaatcaagtgcaaatggccaagctgtaccaggatgataagcaattcgtggacatgccactctcaatcgctcccgagcaggtcctgcagacctttaccgagctgtcacgtgaccacaaccactccatcccaagagagcaactccaggcctttgtgcatgaacattttcaagccaaaggccaagaactgcagccttggacacccgccgactggaaggattcacctcaatttctccaaaagatttcagatgcaaaactgcgagcatgggctggccagttgcatcagctgtggaaaaagcttgggaagaagatgaagcctgaggtcctgtcacatccggagcggttcagtcttatctactctgaacatccattcatagtgcctggcgggagattcgtggagttctactactgctacgggcatgtgcctaatggggggcgcgtgtattacctgcagaggtctcagccccccctcctgacgctcatgatggactgctacctcacacacacaaacgacaccgcttttttacaggagaacatcgagaccctggcgctggaacttgatttttggaccaagaaccggaccgtgagcgtatcactggaagggaagaactacctattgaatcgttactacgtgccctacggcgggcctaggcctgagtcttatagcaaggatgtcgagctggccgatacactaccagagggcgatcgtgaggccctgtgggctgaattgaaagctggcgccgagagcgggtgggatttctcatctaggtggctgatcggaggtccaaatcccaattcactttctggcattaggacctctaagctcgttcctgtggacctgaatgctttcctgtgccaagcagaggaactcatgtcgaacttctatagccgcctcgggaatgattctcaggccaccaagtaccgcatcctgcgctctcagcggttagcggccctgaatacagtgctctgggatgaacagacaggggcttggttcgactacgacctggaaaagaagaagaagaaccgcgagttttatccaagcaacctcacacctctgtgggcaggctgtttttcagacccaggtgttgctgacaaagccctgaaatacctggaagataatcgcatactgacctaccaatatgggatccctacatcactgcagaaaactgggcagcagtgggactttcctaacgcctgggcccctcttcaagatttagttattcgcgggcttgccaaagcacccctgcgaagagcacaagaggtcgcctttcagctggcacagaactggatccgaaccaactttgatgtctactcacagaagagcgccatgtacgaaaagtacgatgtgagtaatggcgggcaacccggcggcgggggcgaatacgaggtgcaggagggcttcggctggactaacggggttgtgttgatgctactggacaggtacggcgaccggctcactagtggacctaaactgccattcctggagccccattgcctgggaccccctttctgcccagcatcctgctag

SEQ ID NO: 138726 - DNA, 1734 bp, Artificial Sequence
  Description of Artificial Sequence: Synthetic coding sequence
atgcctggacgaacctgggaactgtgcttactacttctcctgggccttgggctaggtagccaggaagcactgccacctccttgcgaatccgagatatactgccatggcgagctactcaatcaggttcagatggccaagctgtaccaggacgacaaacaatttgttgatatgccgttaagcattgctccagaacaggtcctccagacattcaccgaactgtctcgtgaccacaaccactcaatcccaagagaacagctccaggcttttgttcatgaacactttcaggccaagggccaggagttgcagccctggacaccagcagattggaaggattccccccagtttctccagaaaatttctgacgcaaagctgagagcttgggctgggcagctccaccagctctggaagaagctggggaaaaagatgaagccagaggtcctttcccatcctgaacgattttctttaatttatagcgagcaccccttcattgtgccaggtgggcgcttcgttgagttctattactgggatagctattgggtcatggagggacttttattatctgaaatggccgaaaccgtgaaagggatgctgcagaacttcctcgacctggtgaagacgtacggccacgtccctaacggtgggcgggtgtactacctacagaggtctcagccaccattgcttaccctaatgatggactgctacctgacacatactaacgatacggcattcctccaggagaacattgagactctggcactggagctggatttctggacaaagaaccgaacagtgtccgtgtcactcgagggaaagaattacctgctgaatcgatactacgttccctatggcggtcctagacccgagtcctattcgaaagacgtggagctggctgacacgctcccggagggcgaccgcgaggccctctgggccgagctgaaagcaggggctgaatcgggctgggatttctcttctcggtggttaattggcggccctaatcctaattctttgtccggcatcaggacgtcaaagctcgtgccagttgacctgaacgccttcctctgccaagccgaggaactgatgagcaacttctatagccggttgggcaacgactcccaggccaccaagtaccggatccttagaagtcaacgtctagcggccttgaacacagttctatgggacgagcagacaggcgcttggtttgattacgacctcgaaaagaagaagaagaaccgggagttttatccctcaaacctgacgcctctatgggcgggctgcttcagtgatccaggcgtggcagacaaagcgcttaagtatctagaggataacagaattttgacgtaccaatacgggattccaacatctctgcagaagacgggtcagcagtgggatttcccaaacgcgtgggctcccctgcaggatcttgttatccgcgggttagcaaaagctcctcttagacgagcccaggaggtggcatttcagcttgctcaaaattggattcgcacgaacttcgacgtgtatagtcagaagtccgccatgtacgaaaagtacgacgtttcgaacgggggccagccaggcgggggcggggagtacgaagtgcaagaaggcttcggctggaccaacggagtggttctcatgctgctagaccggtatggcgaccgcctgacgagtggaccgaagttaccttttctagaaccacattgtctcgggcccccgttttgccctgcgagttgttag

SEQ ID NO: 138727 - DNA, 273 bp, Artificial Sequence
  Description of Artificial Sequence: Synthetic coding sequence
atggaggagactaccgattggatctacggcttctttagtctattgtctgatatcatatctagcgaagacgaagaggacgatgacggcgacgaagacacagacaaaggcgagatcgatgaaccaccactgaggaagaaagagattcacaaggataaaacagaaaagcaggagaagcctgaacggaagattcagacaaaggattggtctgcaaactcctccaccatcagaacactcaagctgactcagctgaaaccgatttacatttgcacttag

SEQ ID NO: 138728 - DNA, 654 bp, Artificial Sequence
  Description of Artificial Sequence: Synthetic coding sequence
atggaggaaaccacagactggatctatggatttttcagcctgctgtccgacatcatatcctcagaagatgaagaggatgatgatggagatgaggacaccgacaagggcgagattgacgagccccccctgcggaaaaaggaaatccacaaagataagaccgagaagcaggagaaacccgaaagaaagatacagactaaggtcacacacaaggaaaaggagaaaggtaaggaaaaggttagggagaaggaaaagcccgagaagaaagcgacgcataaggagaagatcgagaaaaaagagaagcccgagacaaaaacactcgcgaaggaacagaaaaaggcaaagactgcagaaaagagcgaggagaaaactaaaaaggaggtgaaagggggaaagcaggagaaggtgaaacaaacggcagctaaagtgaaggaagtgcagaaaacaccgtcaaaaccaaaggagaaagaagataaagaaaaagccgcagtctctaaacacgaacagaaagggttccccgggccgggcatccgcaattcctcatactattgccagtatattaagggccaaatcaatgcttggaacgatctgcgcactagtcttctccccattccctatctcagctgtggaaagatgtgctctaatttcaataattag

SEQ ID NO: 138729 - DNA, 2166 bp, Artificial Sequence
  Description of Artificial Sequence: Synthetic coding sequence
atgaccgagatcacggcagaaggcaatgccagcaccaccaccacagtaatcgattctaagaacggctctgttcccaagtcacctggtaaggtgttgaaaagaaccgtaacggaagatattgtgacaactttcagcagccctgcagcctggctactggtcattgccctgataattacctggtccgccgtggctatcgtgatgttcgatctggtggactacaagaactttagcgcatcatccattgccaagataggtagcgatccactgaaactggtgcgcgacgcaatggaggagaccacggattggatatatggcttcttctccttactttccgacatcattagctccgaggacgaagaagacgatgacggcgacgaggacactgataagggggaaattgacgagcctccattgcggaaaaaggaaatccacaaggataagactgagaagcaggaaaagcctgaacgaaagatccagacgaaagttactcataaggaaaaggaaaaaggtaaggagaaggttagggagaaggaaaaaccagagaaaaaagccacacacaaggagaaaatcgagaaaaaagagaaaccagaaacaaaaaccctggcaaaagaacagaagaaagctaagacggccgagaaatcagaggaaaagacaaaaaaggaagtcaaaggaggaaaacaggagaaagtcaaacaaactgctgccaaggtcaaagaggtccagaaaactccatcaaagcccaaagagaaggaggataaagaaaaggctgccgtgtctaagcatgagcagaaggaccagtacgctttttgtcggtacatgatagatattttcgtacatggcgatctcaagcctggccagtctccggcgatccccccacctctcccgacggagcaggcttcacgcccgacccccgccagtcccgcacttgaagagaaagagggtgagaaaaagaaggcagaaaaaaaagttacctctgagaccaaaaaaaaggaaaaagaggatatcaagaagaagagtgagaaggaaacagccatcgatgtggagaaaaaggagccaggcaaagcctccgaaactaagcagggcactgttaagattgcggctcaggcggccgctaaaaaggatgagaaaaaggaggactcaaaaaagacgaaaaagcccgctgaagtcgagcagccaaaaggtaaaaaacaggaaaagaaggagaagcacgttgagcctgcaaaaagccctaaaaaggagcatagcgtacccagtgataagcaggtgaaggccaagacagagagagccaaagaggaaattggggctgtgtcaataaaaaaagccgttcccggcaagaaggaggagaaaacaacgaagacagtggaacaagagattcgaaaggagaagagcggtaaaacgagtagtatcctgaaagacaaggaaccaattaaaggaaaggaggaaaaggttcccgcctcactaaaagagaaggagcccgagaccaaaaaagatgaaaagatgagcaaagccggcaaagaggtgaagccaaagcctccccagctacagggaaagaaggaagagaagcccgaaccacagattaaaaaagaggctaaacctgcaatctccgagaaagtgcaaatccacaaacaggatatagtgaaacctgagaagacagtcagccacgggaagcctgaggaaaaagtgctgaaacaggttaaggccgttaccatcgaaaagactgccaaaccaaaacctaccaagaaggcggagcaccgcgagcgggagcctccatccattaagaccgataagcccaagccgaccccaaaaggtacctcagaggtgaccgagtcaggaaaaaaaaagaccgagatctctgagaaagagtccaaggaaaaggccgatatgaagcaccttagggaggaaaaggtcagcactcgaaaagaatccttgcagcttcacaacgtgacgaaggaggatgtagaggatgtgcccgcatccaagaaagcaaaggagggaacagaggatgtgtcacccacaaaacagaaaagccctatatctttctttcaatgcgtctatctagacggttataatggatacggatttcagttcccctttacacccgctgatcggccaggtgaaagtagtggccaggccaattctcctggacagaagcagcaagggcagtag

SEQ ID NO: 138730 - DNA, 81 bp, Artificial Sequence
  Description of Artificial Sequence: Synthetic coding sequence
taaatccacaaggacaagacggaaaagcaggagaaaccggagcgtaagatacagaccaaagaggtgggccacagttcctag

SEQ ID NO: 138731 - DNA, 456 bp, Artificial Sequence
  Description of Artificial Sequence: Synthetic coding sequence
tgaactcataaagaaaaagaaaaaggaaaagagaaagtgagagagaaagagaagccagagaaaaaggcgacacacaaagaaaagatcgagaagaaagagaaacccgaaactaagactctggctaaggaacagaaaaaagccaagaccgcagaaaagagcgaggaaaaaacaaaaaaggaggtaaaaggtggcaaacaagaaaaagtgaaacagaccgcggcaaaggttaaagaagtgcagaaaactcctagcaagcctaaggaaaaggaagacaaggagaaggccgctgttagcaagcacgagcagaaaggcttcccaggcccgggaatcaggaacagcagctactactgtcaatacatcaaggggcagatcaacgcctggaacgatctgaggacgagcctcctgccaattccttaccttagctgtgggaaaatgtgttccaattttaataattag

SEQ ID NO: 138732 - DNA, 2196 bp, Artificial Sequence
  Description of Artificial Sequence: Synthetic coding sequence
atcgtagaaatctaccctcaaggaaacgctagcactacaaccacagtcatagattctaagaatgggtctgtacccaagagccccgggaaggttttaaaaaggacggtgaccgaggatattgtgactacattttcatccccagctgcctggcttttggttatcgcccttataattacctggtccgcagtcgcgatagttatgttcgacttggttgattacaaaaattttagtgcctcgagcatagccaagatcggaagcgaccccctgaagctggtgcgagatgccatggaggagaccacagactggatttacgggttcttttccctgctgagtgatatcatctcttctgaggatgaggaagacgatgatggagatgaggacaccgataagggcgaaatcgatgaaccaccactgcgcaaaaaggaaatccataaagataagaccgaaaagcaggaaaagcctgagcggaagatccaaacgaaagtcacgcacaaagagaaagaaaaaggaaaagaaaaagtgcgtgagaaagagaaaccggaaaaaaaagctacgcacaaagaaaagatcgagaagaaagagaaaccagagaccaagaccctggctaaggagcagaaaaaggcaaaaaccgccgagaaaagtgaggaaaagacaaagaaagaggttaaggggggcaagcaagaaaaggtaaagcagacagccgctaaggtaaaggaggtgcagaaaacaccatccaaacccaaggaaaaagaagacaaggaaaaggccgccgtgagcaagcacgagcaaaaggaccaatatgctttctgcagatacatgattgacatctttgtacatggagacttaaagcctgggcagagtccagccattccaccacctctccctacagagcaggcctctaggcctaccccggcttcgccggcactggaggaaaaggaaggagaaaaaaagaaggccgagaaaaaggtgacctctgaaaccaagaaaaaagagaaggaggacatcaaaaagaaatctgagaaagagaccgctatagatgtggagaaaaaagtgcaggagcctggtaaagctagcgagactaagcagggcacagtgaagatcgccgcgcaggctgcggctaaaaaagatgaaaaaaaggaagattcgaaaaagacaaagaaaccagcggaagtggaacaacccaaagggaaaaagcaggaaaagaaagagaagcacgtcgagcccgccaaatcaccgaagaaagaacatagcgtgccctcggacaaacaagttaaagccaaaacagagcgcgctaaagaggagattggcgctgtgagtatcaagaaggctgtaccaggaaaaaaggaagaaaaaacaaccaagactgtcgagcaggagatcagaaaagaaaagtccgggaaaacttctagcatacttaaagataaagaaccgatcaagggaaaggaagagaaggttcctgcgtccctgaaggaaaaagaaccagagactaagaaggatgagaaaatgtccaaggccgggaaagaggttaagccaaagccgcctcagttgcagggcaaaaaggaggagaagcctgagcctcagattaagaaagaggctaaacccgcaataagcgaaaaggtgcagatccacaagcaggatatcgtaaaacccgaaaagacagtctctcacggaaagccggaagagaaggtgctgaaacaagtgaaagcggtgaccatcgagaaaacagctaagcccaagcccacaaagaaggcagagcatagggagagagaacccccctccattaagaccgataagcctaagcccaccccaaaagggacgtccgaggtgactgaatccggcaagaagaagacagaaatttctgagaaggaatctaaggaaaaagctgacatgaaacaccttcgtgaggagaaagtatccacgaggaaggagtctctgcaactgcacaacgtgacaaaagccgaagaggtagactccaccctggaagacgtggaagacgttccggcctctaagaaggctaaggagggaaccgaagacgtgtcaccgaccaaacagaagtcccctataagttttttccagtgcgtgtacttggatggttataacggctacgggtttcaattcccgtttacacctgctgaccgccccggcgagtcatcaggacaggccaattccccaggacagaagcaacagggacagtag

SEQ ID NO: 138733 - DNA, 2190 bp, Artificial Sequence
  Description of Artificial Sequence: Synthetic coding sequence
atgacagagatcacagctgagggaaacgcctccacaaccacgaccgtcatcgatagcaagaatgggtccgtgcctaaatccccagggaaggtgctgaagcgcaccgttaccgaggatatcgtaaccacattttctagcccagcagcttggctactggtgattgcactgatcattacctggtccgcagttgctatcgtcatgtttgacttggtggactacaaaaatttcagcgccagtagcatagctaaaataggctccgacccactaaaactcgtcagagacgcgatggaagagacaactgattggatctatgggtttttctctcttctgtccgacattatcagctcagaagatgaggaagatgatgacggcgatgaggatactgataagggagagatcgacgagcctcccctccgcaagaaagaaattcataaagacaagaccgagaaacaggagaaaccagagcggaaaatccaaacaaaagtgactcacaaagagaaggaaaaggggaaagagaaggtgcgggagaaggaaaaacctgaaaagaaagccacccacaaagaaaagattgagaagaaggaaaaacccgagaccaaaactctcgctaaggaacaaaaaaaggccaagacagccgaaaagtccgaagaaaagaccaagaaagaagtcaaaggaggtaagcaggaaaaagttaaacagaccgctgccaaggtgaaagaggtgcaaaaaaccccatccaaacctaaggagaaagaagataaagaaaaagccgccgtgtctaagcatgagcagaaagaccagtatgcgttttgccggtacatgatcgacatcttcgtgcatggtgacctaaaacctggtcagagtcccgccatacctccccccctacccaccgagcaggccagtcgaccaacccccgcctcacctgccttggaagaaaaggagggcgagaagaagaaagccgagaagaaggtaacctccgaaacgaagaaaaaggaaaaagaggacatcaagaagaaatcagagaaggagaccgcaattgacgttgagaagaaagagcccgggaaggcatctgaaacgaagcaggggacggttaaaatagcggcccaagcagccgcaaagaaggacgagaaaaaagaagacagcaaaaaaacaaagaagccagcggaggttgagcagccaaagggaaaaaaacaggaaaaaaaagaaaaacacgtggaacctgccaagagccccaaaaaggaacactccgtgccttccgataagcaggtcaaggccaagactgagcgcgcaaaagaagaaatcggagccgtcagcataaaaaaggcagtcccaggaaaaaaggaggaaaaaaccaccaagactgtggaacaagagattagaaaggagaaaagcggcaaaaccagttcaattctgaaggacaaagaaccaataaaagggaaggaggaaaaagtccctgctagcctcaaggaaaaggaacctgagactaagaaggatgaaaaaatgagcaaggctgggaaggaggtaaagccaaaaccgcctcaacttcagggcaaaaaagaggaaaaacctgaacctcaaatcaaaaaggaggcgaagccagcgattagcgagaaggttcagattcacaaacaagacattgtgaagcccgaaaaaacagtgagccatggcaagccagaggaaaaagttcttaagcaggtcaaggcggtaacgatcgagaagaccgccaagcccaaaccaactaaaaaagcagagcacagggaaagggaacccccaagtattaaaacggataagcccaagcccacacctaagggaacctccgaggttactgaatccggtaagaaaaaaactgagatcagcgaaaaagagtccaaagagaaagctgacatgaagcacctgagggaagaaaaagtctcaaccaggaaagagtcacttcagcttcataatgtgactaaagccgagaagccggcccgggtttcgaaggacgtggaagacgtgcccgccagcaagaaagccaaagaaggcactgaagacgtaagccccactaagcagaagagcccaatcagtttcttccagtgcgtgtatcttgacggatacaatggatacggcttccaatttcccttcactcctgccgatcggcccggggagagtagcgggcaggccaatagccccgggcagaaacaacaagggcagtag

SEQ ID NO: 138734 - DNA, 135 bp, Artificial Sequence
  Description of Artificial Sequence: Synthetic coding sequence
tgaatccacaaagacaagactgagaagcaggaaaaacccgagcgcaaaatacagacaaaggactggtccgctaatagttctacgatcaggaccctgaagctaactcagctcaaaccaatttatatctgtacttag

SEQ ID NO: 138735 - DNA, 1038 bp, Artificial Sequence
  Description of Artificial Sequence: Synthetic coding sequence
atcgtagaaatatacccacagggaaatgcgtctacaaccacgacagtgatcgactccaaaaatggctcggtgccgaaaagccctggaaaggtattgaaaagaaccgtgaccgaagatatagtaaccacgttctcatcccctgccgcatggctcctggtcatcgctctgattatcacgtggagcgcagtggccatcgtcatgttcgatctggttgactataaaaatttcagcgcatcctcaatagctaagattggcagcgatcccctgaaactagtcagagatgccatggaagagacaaccgattggatctacggattctttagcctcctgtccgatatcatcagctcagaggatgaagaggatgacgatggcgatgaagacacagacaagggggaaatcgacgagccccccctgcgcaagaaagaaatccataaggataagacggagaaacaggaaaagccagaaaggaaaatccaaactaaggtcactcacaaagaaaaggagaaggggaaagaaaaagtaagggaaaaggaaaagcccgaaaagaaagccacccacaaggaaaagatcgagaagaaggagaaacccgagactaaaactttagcaaaggaacagaaaaaagctaaaacagccgagaaaagcgaagagaaaacaaaaaaagaagtgaaaggagggaagcaggaaaaggtgaagcagactgctgcaaaagtgaaagaagtgcagaaaaccccttcaaagccaaaagagaaggaggataaggagaaggccgcagtctccaagcatgagcaaaaagatcagtatgccttctgcagatacatgatagacatatttgtacacggcgatctgaagcctgggcaatcacccgccattccacctccccttcctaccgaacaggcatcccgcccaactccagcgtcccctgcactagaggagaaggagggtgaaaagaaaaaggcagagaaaaaggtgactagcgaaactaagaaaaaagaaaaggaagatattaaaaaaaagaaaaaaaaaaaaaaaaaaaagtag

SEQ ID NO: 138736 - DNA, 504 bp, Artificial Sequence
  Description of Artificial Sequence: Synthetic coding sequence
atgaccgaaatcaccgctgagggcaatgcctcaaccacaaccaccgttatagactctaaaaacggctcggtccccaagtcgcctggaaaggtgttgaaacgaacggtcactgaggacattgttacaacgttttcatctccagccgcatggctgctggtgatcgctctgattatcacctggagcgctgtggcaattgtcatgttcgacttggtggactacaagaactttagcgcaagtagtatcgcaaaaattggaagtgatccattgaagttggtcagggacgcgatggaggaaacaaccgactggatatatggattcttttccctcctgtccgacatcatctccagcgaggacgaggaagacgacgacggggacgaggacacggacaaaggagagatagatgagccacccctccgcaaaaaagagattcataaggataagactgaaaaacaggaaaagcccgagcgtaaaatccaaaccaaggaggtcggacactcatcgtag

SEQ ID NO: 138737 - DNA, 987 bp, Artificial Sequence
  Description of Artificial Sequence: Synthetic coding sequence
atgactgagattacagccgagggaaacgcatcaaccaccactacagtcatcgacagtaaaaatgggtctgtgcccaagtcgccggggaaggttttaaaacggacagtgaccgaggatattgttacgacgttcagctctcccgctgcttggctcttagtcatcgccctgatcattacctggtctgccgtcgcaatcgtgatgttcgacctcgtggactacaagaatttttccgcctcctccattgcaaagattggtagtgatcctcttaagttggtccgcgacgcgatggaagaaaccacagattggatatacggtttcttttctttgctgagtgacatcatttccagcgaggacgaagaggacgacgacggtgatgaggataccgacaagggggaaatcgacgagcctccactgcggaagaaggaaattcacaaggacaagactgagaagcaagagaaacccgagaggaaaatacaaacaaaagttacccacaaggagaaagagaaaggaaaggaaaaagttcgggaaaaggagaaacccgaaaaaaaggcgactcataaagaaaagatcgagaagaaagagaaacccgagacgaagacgctggctaaggaacaaaaaaaggcaaaaacagctgagaagtcagaagaaaagactaaaaaggaagtgaagggcggaaagcaagaaaaagtcaagcaaactgcggctaaagtcaaggaagttcagaagaccccgagtaagccaaaggagaaagaggataaagagaaggcagctgttagcaagcacgagcagaaggaccagtacgctttctgcaggtacatgatcgatatttttgtacacggagacttgaaacccggtcagtcacctgcaatcccgccacccttacccactgagcaagcctcgaggccgactcctgccagcccagccctggagggagataaagcgtctaaggagaagaaaaggaaaatgaaaaggatgtccgaaaaatag

SEQ ID NO: 138738 - DNA, 894 bp, Artificial Sequence
  Description of Artificial Sequence: Synthetic coding sequence
atgaccgaaattaccgcagagggtaacgcgagcactaccacgactgtcatcgactctaagaatgggtcagtaccaaagtctcctgggaaagtgctcaaacgaacagtcaccgaagatatagtcactaccttcagctcaccagccgcttggctactggtgatcgctctcatcattacatggtctgcggtcgctatcgtgatgtttgaccttgttgactacaagaacttcagcgcctcctcaattgccaagatcgggtcggatccattgaagctggtccgggacgccatggaggaaacgaccgattggatctatggctttttctcactcctaagcgacatcattagcagtgaggatgaagaagatgacgacggggatgaagacaccgataagggagaaatcgatgagcctccactgcggaagaaggagattcacaaggacaagaccgagaagcaggaaaagccggagaggaagatccaaacaaaagtgacccataaagagaaagaaaaaggtaaggagaaagtgcgtgaaaaggagaaacccgagaaaaaggcaacgcataaagagaaaatagaaaagaaggagaagcccgaaaccaagaccttggccaaggaacagaaaaaagcgaagaccgccgagaaaagcgaggagaagacaaaaaaagaggtgaagggagggaagcaggaaaaagtgaagcagaccgccgcgaaagttaaggaagtccaaaagactccatctaaacccaaggaaaaggaggacaaagagaaggccgcagtctctaaacacgaacagaagggtcaatctcctgcgattcccccacctctgccgactgagcaggcgagtagacccacacctgccagccccgcactggaggggaagtacttcttcttttcgtag

SEQ ID NO: 138739 - DNA, 5832 bp, Artificial Sequence
  Description of Artificial Sequence: Synthetic coding sequence
atgagccccctcttgcgcagtatttgcgacatcactgagatcttcaaccagtatgtgagtcacgattgtgatggagccgcactgactaagaaagatctcaaaaatctcctggagcgcgagttcggtgctgtattgcgaaggccacacgaccctaaaaccgtagatctgattttggaactgcttgacttagacagcaacggacgcgtcgacttcaacgagttcctcctgttcatctttaaggtggcgcaggcgtgctactatgccctgggtcaggcgaccgggttggatgaggagaaaagagctcgttgcgatggtaaagagagcctgctgcaggaccggcggcaggaagaagatcagcgtagattcgaaccaagagacagacagttagaggaggagcccggtcagaggaggcgccagaagcggcaagagcaggaaagggagctggcagagggggaggagcaatcagagaaacaggagaggctggagcagcgggataggcaacgtagggacgaagaactgtggagacagcgccaggagtggcaggaaagggaggagcgacgggccgaggaagaacaactgcagtcctgcaagggccatgagacggaggaatttccggacgaggagcagctgcggaggagagaactgctggagctgcggcgcaaaggaagggaagaaaagcagcagcagagaagggagcggcaggatagagttttccaggaggaggaggaaaaggaatggcggaagcgcgaaaccgtgctccggaaggaggaagagaagcttcaggaggaagagccacagcggcagcgtgaactccaagaggaggaggagcagctaagaaaattagaacggcaagagctgcgccgagagaggcaagaggaggaacaacagcagcagcgactccggcgagaacagcagttaagacggaagcaggaggaggaaaggagagagcagcaagaggagcggcgtgagcagcaggaacggagagaacagcaggaggagaggagagagcagcagctgcggagagagcaggaagaaaggcgggaacaacagctgaggcgggaacaggaagaggagcgcagggagcagcagctgaggagagaacaagaggaggagagaagggagcagcagctgagacgcgagcaacagctccgcagagagcagcagctacggcgcgaacagcaactgagacgtgagcagcagttgaggagggaacaacaactcagacgcgagcagcagctcagacgcgaacagcagctaagacgtgaacaacagctgaggagggaacaggaggaagagcgacacgagcagaagcatgaacaggagcgtcgcgaacaacgtttaaagagggaacaagaagaaagaagagactggctcaaaagagaagaggagacagaaaggcacgaacaagaaagacgcaaacagcaacttaagagggaccaggaagaggaacgaagggaaagatggctcaagttggaagaagaggagagaagagagcaacaagagcggcgggaacagcagctccgacgtgaacaggaagagcggagggaacagcgtctaaagcgacaggaagaagaagaacggctccagcagcgattgcgctcagaacagcaactgagaagagagcaagaggagcggcgggagcagctcctgaagcgggaggaggaaaaaagacttgaacaagagcgccgggaacagcggttaaaacgggaacaggaggaacgtagagaccagctcctgaaacgggaagaggagcggagacagcagaggttaaagcgagaacaggaggagagacttgagcagaggttaaagcgcgaggaggtcgaaaggttggaacaggaagaacgtagggagcaacggcttaaaagagaagagcctgaggaggaaagaaggcagcagctgctgaagagcgaggagcaggaggagagaaggcagcaacaattgcgcagggaacaacaagaacgccgtgagcagaggctgaaacgtgaggaggaagaggagagactagagcagaggctgaaacgcgaacatgaggaggaacgaagggagcaggagcttgcagaggaagaacaggagcaggcaagggagcgcattaagtcacgtatccccaagtggcagtggcagttggaaagcgaggctgatgctcgtcagagcaaagtttactctagaccgaggaagcaggaaggccagcgacgccgccaagaacaggaggagaagagaaggcgacgggaaagcgaattgcagtggcaggaggaggaacgggctcaccgacagcaacaggaggaagagcaaagaagggatttcacttggcagtggcaggccgaagaaaaaagcgaacgaggtcggcaaagactctccgcgagacccccactgcgcgaacagagggagcggcagctacgggctgaggagcgccagcagagagagcagcgcttcctgcccgaggaagaagagaaggaacagcggagacgacagcgaagggagagagaaaaggagctgcagtttctcgaggaggaagagcaactgcaacgtagagagagagcccagcaactacaggaggaggaggatgggctgcaggaagaccaggagagacggaggtcccaggagcagagacgcgaccagaaatggcggtggcagttggaagaagaaagaaagcggaggagacacacactttatgccaaacccgcactgcaagaacaactgcggaaggaacagcaactgctgcaggaggaggaggaggagctccagagggaagagcgtgagaaacgtaggcgacaggaacaggaacgacaatatcgggaagaagagcaattgcagcaggaggaggagcagcttctgagggaagagcgagagaaacgccgaagacaagagcgagagcgtcagtacaggaaggacaaaaagctgcagcagaaggaggagcagctactcggcgaggagcctgagaagaggcgcagacaagagagggagaagaagtacagagaggaagaagaacttcagcaggaggaagagcagttgctgcgggaagagagggaaaaacgtcggaggcaggaatgggagaggcaatacaggaaaaaagatgagttacagcaagaggaggagcagctcctacgagaggagcgtgagaaacggcggttacaggaaagagaacgtcaataccgagaagaggaagaattacagcaggaagaggagcagctgttgggtgaggagcgcgaaactcggcgtcggcaggagctggaacgccagtaccgcaaggaggaggagttgcaacaggaggaggaacagttgttaagggaggagccagagaagcgacgcaggcaggagcgcgaaagacagtgcagggaagaggaagagttgcagcaagaggaagagcagctgctcagggaagagagagaaaagcgaaggaggcaggaacttgagcgccagtacagggaggaagaggaggtacagcaggaggaggaacaactcttaagggaagagccagagaagcggcgcaggcaggaactcgaaagacaatatagggaagaggaagaactccagcaagaggaggaacagttgttgcgcgaggaacaagagaaaagacgacaagagcgcgagcgacagtacagggaagaagaggaactccagcgtcaaaagcggaaacaaagataccgggacgaagatcaaagaagtgatctgaagtggcagtgggagcccgagaaagagaatgctgtccgcgataataaggtctattgtaagggacgcgagaacgagcagttccggcagctggaggactcccagctgcgagaccgccagagtcagcaggacctgcaacacctactgggcgagcagcaggaacgtgaccgtgaacaggagcggaggcgctggcagcagagggacaggcacttccccgaggaggaacagctcgagcgtgaggagcaaaaggaagccaagcggcgcgatcggaagtctcaagaagagaagcagctgctgcgtgaggagcgtgaggaaaaacgtcgtcggcaggagacagaccgtaaatttcgcgaggaggaacaacttctgcaggaaagagaagagcagcccctgcggcgacaagaaagagaccgaaaatttagagaagaagagttgcgccaccaggaacaagggagaaagttccttgaagaggaacagcgcctgcgccggcaggagcgggagcggaagttcctcaaggaggaacaacagctgaggtgccaggaacgggaacagcagttgcggcaggaccgggaccgcaagtttcgcgaggaagagcagcaattaagccgtcaggagcgcgacagaaagttccgtgaggaggagcagcaagtgcgaaggcaggagcgggagcgtaaattcctcgaagaggagcagcaactgagacaggaaaggcaccgtaaatttcgcgaggaggagcagttgctccaggagcgggaagaacaacagctccataggcaagagcgggatagaaagttcctggaagaggagcagcagttgcgccggcaggagcgagaccgtaaattcagagaacaggagctgcggtctcaggagccagagcgcaaatttctagaagaggagcaacaattgcaccggcaacagagacagcgaaagttcctccaggaagagcagcaattgaggcgccaggagagagggcagcagcgcagacaggatcgagaccggaagtttagggaagaagagcaactgagacaggagagagaggaacagcagctgtccaggcaggaacgcgatcgaaaatttagactcgaagaacaaaaggtaagacgacaggagcaggagagaaagtttatggaagatgaacagcagctgcgacgtcaggaaggacagcaacagttgagacaggagcgggaccgcaagttccgcgaggacgagcagttactgcaggagagagaggagcagcaactccaccgccaggagcgtgaccggaaatttttggaagaggaaccccagttgagacgccaggaaagggaacaacagttgcggcacgacagagatagaaagtttcgggaggaagaacagctgctgcaggagggggaagaacagcagctgcggagacaggagcgtgaccggaagtttagagaggaggaacagcaacttcgcagacaggagagggaaaggaagtttttgcaggaggagcagcagctgaggaggcaagagctagagcgcaagttccgggaagaggaacagctgcgacaggaaacggagcaggagcagctccggaggcaagagaggtaccggaagatattagaggaagagcagctgcgacccgagcgggaggagcagcaactgaggaggcaggagcgggaccgtaagtttagggaagaggaacaattgcggcaagagagggaagaacagcagcttcgctctcaggagagtgacagaaagttcagggaggaggagcagctccgacaggagcgggaggagcagcagttgcggccccagcagagagacggtaaataccgctgggaagaggaacagttgcaacttgaggaacaggagcaacggctcagacaagaaagggatagacagtatcgagcagaggagcaattcgctacacaggaaaaatccagacgggaggagcaggagctgtggcaagaggaagaacagaagcgaagacaggaacgggaaagaaaactccgggaagagcatatcagacgccaacaaaaggaggaacagcgacacagacaggtcggagagatcaagagtcaggaaggcaaaggccacggcaggctgctcgagcctggcacccatcagtttgcgagcgtgccagtgagatcttcccccctttatgaatacatccaggagcagcggagccagtaccgaccatag

SEQ ID NO: 138740 - DNA, 540 bp, Artificial Sequence
  Description of Artificial Sequence: Synthetic coding sequence
atggctaagacagcgatggcctataaagagaagatgaaggaactttctatgctaagcctgatatgtagctgtttttatcctgaacccaggaacatcaacatatacacctatgatgatatggaggttaaacagattaacaagcgagcttcgggtcaagcattcgaactgatcttaaagccgccctctccaatatccgaggcaccacgaacactggctagtcccaagaagaaagatttgtccctcgaggaaatccagaagaagctggaagctgccgaagaacgccggaagagccaagaagcccaggttctgaaacaactcgccgaaaaacgcgagcacgaacgcgaggtgttacagaaggctctggaggagaataataacttcagcaaaatggcggaagagaagctgattctgaagatggaacagatcaaggaaaacagggaggctaacctcgcagcaattatagaacgcctccaggaaaaagagcgccatgcagccgaggtgcgtcggaataaagagcttcaagtggagctatctggatag

SEQ ID NO: 138741 - DNA, 3885 bp, Artificial Sequence
  Description of Artificial Sequence: Synthetic coding sequence
atgccatacgaggttaatgctggctatgatttcacaaacatggttagaaagaaaaaccctcctcttcggaatgtggctagcgagggggaggggcagattttggagcctataggcaccgagagcaaggtttctggaaaaaataaggaattctcagccgaccagatgtcagagaataccgaccaatcagatgcagcagaactgaaccataaagaggaacacagcctgcacgtccaagaccctagctccagctccaaaaaggatctcaaaagtgccgtgctgagcgagaaagccggtttcaactatgagtccccctccaaaggggggaacttccctagttttcctcacgacgaagtcaccgatcgcaacatgctggccttctcctcgccagcagctgggggtgtttgtgaacctctgaagtcacctcagagagcagaggccgatgatcctcaggatatggcttgcacgccgagcggcgattctctggagacgaaggaggaccagaaaatgtcacccaaggccaccgaagagaccggccaggcccaatccggacaggcaaattgtcagggtctgagtcccgtctcagtagctagcaaaaatccccaggtgccatctgacggcggagtaagattaaataaatccaaaactgacctgctggtgaacgataaccctgacccagcccctctgtcacctgaacttcaggatttcaagtgcaatatttgtggatatgggtattatggcaacgacccgactgacctgattaagcatttccgcaagtaccacctgggtctgcataataggaccagacaggacgcagagcttgattcaaagattttggctctgcataacatggtgcaattttctcatagcaaggatttccagaaagtgaatagaagcgtcttctctggcgtcctccaggatattaacagctccaggcccgttttgctgaacggaacttacgacgtgcaggtcacgtcaggtggaacgttcataggcatcgggcgtaagactccggattgtcagggaaatacaaagtacttccgatgcaaattctgtaattttacatatatgggaaattcgagcactgagctagaacagcatttccttcagacgcacccgaacaaaattaaagccagtttgcccagctctgaagtcgctaaaccttccgagaagaatagtaataaatcaatacctgctctccaatcctctgattcaggggacttaggtaagtggcaggataagattaccgtgaaggcaggagatgacacacccgtcgggtactccgtcccaataaaacctctcgattctagtcgacagaatggtacagaagctactagctattattggtgcaagttttgttctttttcctgcgagtcgtcatctagtttgaagctacttgagcactacggcaaacagcacggtgccgttcagtccggaggtctcaatccagaactgaatgacaaacttagtagaggctctgtgataaatcagaacgatcttgctaagtcgagtgagggagagacgatgacaaagacggacaagtcctcaagcggagcaaaaaagaaagattttagcagcaagggggcagaggacaatatggtgacatcctacaattgccagttttgtgactttcggtatagcaagagccacggacccgacgtaatcgtggtaggtccacttcttcgacattatcagcagctccacaatatccacaagtgtacgataaaacattgccctttttgtcctcgcggactgtgttctccagaaaagcacctgggggagatcacctaccccttcgcctgtcgcaaatccaattgttctcactgcgccttgttgctgctgcacctcagccccggggccgcaggaagcagtagagtgaagcaccagtgtcatcaatgcagttttaccacacctgatgtggacgtgctactatttcattacgagtccgtccatgagagtcaggcatctgacgtgaagcaagaagctaaccatctgcagggcagtgacgggcagcagagtgtcaaggagtcaaaggagcactcatgtaccaaatgtgacttcatcacacaggtggaagaggaaattagtcgccactataggcgggcccacagctgttacaagtgtagacaatgttccttcacagccgcagatacccagagccttctggagcactttaatacagtgcattgccaggaacaggatatcacaactgccaacggagaggaggatgggcacgccatttcaacgattaaggaagagcctaagattgactttcgggtatacaatctgctgactcccgattcaaaaatgggagagcccgtctctgagagcgtagtgaagcgggaaaaactcgaagagaaagacggcctcaaggagaaagtttggactgagagcagtagcgacgacttgcgtaacgtgacatggcggggagcagacattcttcgtggttccccttcctacacacaggccagtttagggctgctgaccccagtctctggcacccaagaacaaaccaaaacactgcgcgattctcctaatgtagaggccgcccacctcgcacggcctatttacgggctcgccgttgaaaccaagggctttcttcagggcgccccggcaggcggagagaagtcgggcgccctccctcaacaatatccagcatccggagaaaataagtctaaggatgagtcccagtccctgctgaggcgacgtagggggagtggagttttttgcgcaaactgcctaaccacaaaaacctccttgtggcgcaagaacgccaacggcgggtatgtctgcaacgcatgcggtctctaccagaagcttcattctaccccacgcccacttaacattattaagcagaacaacggggaacagatcattcgccggcggactaggaaaagactgaaccctgaagcactgcaggccgaacaactgaataagcaacaaaggggttctaacgaagagcaggtcaacgggtctccactggagcgccgatccgaggatcacctgaccgagtcccatcagagggaaatccctttgccttccctctccaaatatgaagcccagggctccttaactaaaagccactctgcacagcagcccgtgctggtgtcacagaccctagacatccacaaacgcatgcaacccctgcatatccaaataaagagtccccaggaaagcacgggggatcctggtaactcatctagcgtctccgaggggaaggggagctctgagcgcggatcaccgattgagaagtacatgcgccctgctaaacaccccaattacagtccccccggatcccccatcgagaaatatcaatatcccttgtttggattgcctttcgtccataatgattttcagtcagaggccgattggcttcgattttggtcaaaatacaagttgtcagtgccagggaatccccactacttgtctcatgtcccggggctgcctaacccttgccaaaactacgtgccgtacccgaccttcaacctgccgccacatttcagcgcagtggggagtgacaatgatatcccactggacctggccataaagcacagcaggcctggaccaacagccaatggcgcctctaaggagaaaacaaaggctccccctaatgtgaagaatgagggaccacttaatgtggttaagacggaaaaggtggaccgttccacacaggacgaactgagcaccaagtgtgtgcattgtggcatcgtgtttctggacgaggttatgtatgctctacacatgagctgccatggggactctggacccttccaatgctccatttgccagcacttatgcacagataaatacgatttcacaacccatattcaaagagggctgcatagaaacaacgcgcaggttgaaaagaacgggaaaccaaaggagtag

SEQ ID NO: 138742 - DNA, 3858 bp, Artificial Sequence
  Description of Artificial Sequence: Synthetic coding sequence
atgcagtctaacatggtgcgaaagaagaatcccccattaagaaacgtggcctcagagggtgagggtcagatcttggagcccatcggtaccgagtccaaggtgtcgggcaagaataaggagttttctgctgaccaaatgagcgagaacacagaccagagcgatgccgccgaacttaatcataaggaagagcattctctgcatgtccaggaccctagttccagtagtaagaaagacctcaaaagtgcagtgctaagtgagaaagccggcttcaactatgaatctccatcgaaagggggaaactttccgtctttcccacatgatgaagtgaccgataggaatatgttggcgttttcgagccccgctgctggaggcgtgtgtgaaccccttaagagcccacagagggccgaggcagatgacccccaggatatggcctgcaccccatccggagatagtttggaaactaaggaggaccaaaagatgagcccaaaggcaacagaggagacaggacaagcccagagtggacaagctaattgtcagggcctaagtcccgtgtctgtggctagcaaaaacccacaggtaccttcagatgggggagtccgcctcaacaagtcaaagaccgacctgttagtaaacgataatcctgatcccgccccactgagccctgagttgcaggacttcaagtgcaatatctgcggttacggttattatggcaatgaccctactgacctgataaagcacttccgaaagtatcacctcgggctacacaacaggactcgacaagacgctgaactcgatagtaaaatcctggccttacacaacatggtccagttttctcatagtaaggacttccagaaggtaaataggagcgtgtttagcggcgtgctgcaagacatcaactccagcagaccggtgttgcttaatggaacatacgacgtgcaggtgacttcaggtgggacgtttatcggcatcggccgcaaaacccccgattgccaggggaacaccaaatatttcaggtgtaagttttgtaactttacttacatgggtaacagcagtaccgagctggaacagcacttcctgcagacccatcccaataagatcaaagcctccttaccatcctctgaggttgccaagccttccgagaagaactctaacaaatctatacccgcgttgcaaagtagcgactctggcgatctgggtaagtggcaggacaagattaccgtgaaggccggagatgatactcctgtcggctattctgttcctatcaagcccctcgactccagtaggcagaacggtacagaggccacctcatactactggtgcaaattctgtagtttcagctgtgaaagcagcagctccctaaagttgctggaacactatggaaaacaacatggggccgtccagagcggagggctgaatccggaactcaatgacaaactctctaggggatcagtcattaaccagaatgatctggctaagtcctctgagggcgagacgatgacaaagactgataagtcctcgagcggcgctaagaagaaagacttctccagcaaaggcgcagaagataacatggtgactagctataactgccagttctgcgatttccgatattcaaaaagccatggacccgacgttattgttgtcggaccccttctgcgccactatcagcagcttcacaatatccacaaatgcacaatcaagcattgccccttctgccctagaggtctttgttcccccgaaaaacatctgggtgagatcacctatccctttgcatgtcgaaaatccaattgctctcactgcgctctgctactcttgcacctcagcccaggtgcggcggggagctccagagtgaagcatcagtgtcaccagtgttcctttaccacacctgacgtggatgtgctgttgttccactacgagtctgtgcacgagagtcaagcctccgacgtaaagcaggaagcaaaccatttgcagggcagcgacggccaacagtctgttaaagagagtaaggagcacagctgtactaaatgcgattttatcacccaggtcgaggaagaaatcagtcgacactataggagggcccattcatgttataaatgtagacaatgtagcttcacggccgctgacactcagtcccttttggagcactttaatacggtacattgccaggagcaggacattaccacggccaatggtgaggaggacggccacgctatatccacaattaaggaggaaccaaaaatcgattttagagtgtacaacttgcttacaccagacagtaaaatgggcgaacccgtaagtgaaagtgtcgttaagagagagaaattagaagaaaaagacggcctgaaggagaaagtgtggaccgaatcatccagtgatgacctgcgaaacgtaacttggcggggtgcagacattctgcgggggtcaccgtcatacacgcaggcgagtcttgggcttctgactcctgtgtcgggaactcaagaacaaacaaaaacacttagagacagcccaaacgtcgaggccgctcacctggcccgacccatctatggcttggcagtggagactaagggatttttgcagggagcccccgcaggtggagagaagagtggggctctgcctcagcagtatcccgcctccggagaaaataaatctaaggatgaatcacagtctctgctgcgtaggaggcgtggatccggagtgttttgtgcaaattgcttaactaccaaaacatctctttggaggaagaacgctaatggagggtacgtgtgtaacgcatgtggactgtatcagaaactgcatagcaccccgagacccttgaatatcattaaacagaacaacggagagcagataattaggcggcgcactaggaagcgcctcaatcccgaggcactgcaggcagagcagctgaacaagcaacagcgagggtccaatgaagaacaggttaacgggtctcccctagagcgtcggtccgaagaccatctcactgagtcacatcagcgggaaataccgctcccaagtctcagcaagtacgaggctcagggttcactgacaaaatcccattccgctcaacaacccgtgctcgtgtcccagacactggatattcacaaacgcatgcagccccttcacattcagattaaatccccacaggagtcaaccggcgatccaggcaatagctcaagcgtgtccgaagggaagggaagtagcgaacggggctcaccaatcgagaaatatatgcggcccgcaaagcaccccaactatagcccacccggcagtcccattgaaaaatatcagtaccccctatttggtcttccttttgtgcataatgacttccagagcgaggccgactggctgaggttctggtctaaatacaaactgagcgtccctgggaatccacactatttaagtcatgtcccaggactgccaaatccctgccagaattatgtcccttaccccacctttaatcttcccccccatttctcagctgttgggagcgataatgacatccccctggacttagctatcaagcactctagacccggcccgactgccaacggcgcatctaaggagaaaacgaaagctcctccaaacgtcaagaacgagggccctttaaatgtggtaaagaccgaaaaagtcgatcgctccacacaggatgagctgagtactaaatgcgtgcattgcggcatagtctttctagacgaagtgatgtacgccctgcatatgagctgtcatggcgacagcggacctttccagtgttctatctgtcaacacctgtgcacggacaaatacgatttcactacccatatccagagggggctccaccgtaataacgcacaggtggagaagaatggaaagccgaaggaatag

SEQ ID NO: 138743 - DNA, 705 bp, Artificial Sequence
  Description of Artificial Sequence: Synthetic coding sequence
atgcgcaagactagactgtggggccttttgtggatgctgtttgtgtcagagctgcgagccgcaactaaattgaccgaggaaaagtacgaactcaaggaggggcaaacgctcgacgttaaatgcgattatacgcttgagaagtttgctagcagccagaaagcgtggcagatcattagggatggcgaaatgcctaaaaccttggcctgtaccgaacgacccagtaagaattcacatcccgttcaggtgggccgcataatcctggaggattaccacgatcatgggctcctaagagtgagaatggttaacctgcaagtcgaggatagtggcctttatcaatgtgtaatctatcagccaccaaaggagccgcacatgctatttgatcgaattcgccttgttgtaactaaaggattttcagggactcccggttctaacgaaaacagtacccagaacgtctataaaatccctcctactaccaccaaggcattatgtcccctatatacctctccaagaacagtcactcaggctccccccaagagcaccgctgacgtgagcacccccgactccgaaattaacctcactaacgtcaccgatataatcagagtgcccgtgtttaacattgtgatcttgttagcagggggctttctcagtaagtccctggtgttctcggtgctgttcgctgtaacactgcgctccttcgtgccctag

SEQ ID NO: 138744 - DNA, 453 bp, Artificial Sequence
  Description of Artificial Sequence: Synthetic coding sequence
atgcggaagaccagattatggggtctgttgtggatgctgtttgtatctgaattgcgggcagccaccaagctgaccgaggaaaaatacgaactgaaggagggccagaccctggacgtcaaatgtgactacaccctcgaaaagttcgcatctagccagaaggcttggcagatcatccgggacggtgagatgccaaaaaccctcgcctgcactgagcgtccatctaagaattcgcaccctgtccaagttggtcgaattattctggaagattatcacgaccatggactccttagagtacggatggtcaatctccaggtggaggattctggcttgtaccaatgcgtcatataccagccccccaaagagccgcatatgctatttgaccgtatccggttggttgttactaagggttttaggtgttcgactctgtcattttcttggctggtggattcgtag

SEQ ID NO: 138745 - DNA, 678 bp, Artificial Sequence
  Description of Artificial Sequence: Synthetic coding sequence
atgaggaagacacggctatgggggctgttatggatgttgtttgtgtccgagctgcgcgcagctacaaaactcacagaggaaaagtacgaactaaaagagggccagactttggacgtaaaatgcgactacacactggaaaaatttgcctcctcacaaaaggcttggcaaatcataagagacggcgaaatgcccaaaaccctggcttgtaccgaaagaccatctaagaacagtcaccctgtgcaggtcgggaggataatccttgaggactatcacgatcatggcctactgcgcgtccgcatggttaatctccaagtggaggattccggcctctatcagtgcgtgatataccaaccgcctaaagagccccacatgctcttcgatcgcattcgcctggtagtcacaaagggcttcagtggcacacccgggtccaacgagaattcgacccagaacgtgtataagatcccgcccactactacaaaggccttgtgccctctgtacacttcacccaggaccgttactcaggcgccgcccaagtccactgccgatgtatccacaccagacagcgagattaatctcacaaacgtaactgacattatcaggtactcgtttcaggtccctggcccattggtttggactctgagtcccttatttccatccctgtgtgccgaacggatgtag

SEQ ID NO: 138746 - DNA, 501 bp, Artificial Sequence
  Description of Artificial Sequence: Synthetic coding sequence
atggagcctttaagactactcatcctcttattcgtaacagagttaagcggggcgcacaacaccactgtctttcaaggggtggctggccaatctctgcaggtgagctgtccatatgattctatgaagcactggggcagaagaaaggcctggtgcaggcagctgggggagaaaggcccgtgccaacgtgtagtgtctactcacaacctgtggctgctgtcctttttgcgccggtggaacggctcaacggctatcacggacgacactctcggcggcaccctgacaatcacgctacgcaacttgcagcctcacgacgcaggcctgtaccagtgccaatctctgcatggaagcgaagctgatacactccgcaaggtgctggtagaagtcctggcagatcccctggaccacagagacgcaggagatctgtggttccctggggaatccgaaagtttcgaagatgctcacgtggagcattcaatcagtcgggcagagaggcacgtttag

SEQ ID NO: 138747 - DNA, 693 bp, Artificial Sequence
  Description of Artificial Sequence: Synthetic coding sequence
atggagccattgagattactcatactgttattcgtgaccgagctgagcggggcccacaacacgactgtatttcagggggtggcgggacagtctttgcaggtgagctgcccctacgattccatgaagcattggggcaggaggaaagcttggtgtcgtcaattaggagaaaaaggcccttgccagagggtagttagcacacacaatctgtggctgctgagctttcttagaaggtggaatgggtctacagctattaccgatgataccctagggggaacacttaccataactctgcggaatcttcagccccacgatgccggcttgtatcaatgccagtcactgcatggttctgaggctgatacccttcggaaagtacttgtggaggtgctggcagaccccctggaccaccgcgacgcaggcgacctctggttccccggggagtccgaatctttcgaggatgcccatgtagaacactcaatctctcggtcgctgctcgagggcgagatcccattccctcctacctcaatcctgctcttgctggcgtgtatcttcttgatcaagattctcgcagcttcagctctctgggccgcagcctggcacggccaaaagcctggaacgcacccaccctcagaactagattgtggacatgatccagggtatcagctccaaacactcccgggtcttcgggatacctag

SEQ ID NO: 138748 - DNA, 660 bp, Artificial Sequence
  Description of Artificial Sequence: Synthetic coding sequence
atggagcctttaagactccttatacttctcttcgtgacagaactgtccggggcccataacaccacagttttccagggagtagcaggccagagtctccaggtgagctgtccttacgattcgatgaaacactggggccggagaaaagcctggtgcaggcagctcggggagaaaggaccttgccagcgggtcgtctcaacccacaatctgtggcttttatcgttcttacgtcgttggaacggctcaaccgcaatcaccgatgatacgctggggggtactctcaccatcacattacgcaacctccaacctcatgatgcaggcctctaccagtgtcagtctctgcacggaagtgaggctgacacgttacgcaaagtcttggtggaggtacttgctgatccgctcgaccatcgcgacgccggagatttatggttccccggagaatctgagtcctttgaggacgcccacgtggagcatagtatcagccgagccgaaaggcacgtcaaggaagatgatggcaggaaaagccccggggaagttcccccaggaacaagcccagcatgcatactggcgacctggccaccaggccttctcgttctgctttggcaagagaccacgttaccggagcactgtttttcttggacacttgaggctggcaccgggtag

SEQ ID NO: 138749 - DNA, 936 bp, Artificial Sequence
  Description of Artificial Sequence: Synthetic coding sequence
atgggtctgacattactgcttctgctgctcctcgggcttgaaggtcagggcatagtgggctcactgcctgaggtgttacaggcaccagtcgggagctcaatcctggtccagtgccactaccgcttgcaggatgtcaaagctcagaaggtgtggtgccgattcttgcctgaaggctgccaacccttggtgtccagcgccgtagacagacgcgcaccggcaggccggaggacatttctcactgatctcggcggtggcctcctgcaagttgagatggtaacactacaagaggaggatgctggtgagtatggttgcatggtcgacggagctaggggccctcaaatcttacaccgcgtgagcctgaacattcttcctccagaggaggaagaggaaacgcataagattgggtccttggccgaaaacgccttctccgaccctgccggctccgccaatcccctcgagccttcacaagacgagaagagtatcccactgatttggggcgcggtgctgctggtcggccttctggtcgcagccgtggttctttttgccgttatggccaagaggaagcagggtaacaggttgggggtgtgcggcaggttcctgtcaagcagggtgtccgggatgaacccgtcttctgtcgtgcaccatgtgtcagacagtggtccagctgctgaactgcccttagatgtgccccacatccgacttgacagcccgccttctttcgacaacaccacatatactagcctgcctcttgacagtccctcgggaaaaccatcgttgcctgcaccatcctccctgccccccctgccacccaaggttctcgtgtgtagtaagcctgtgacgtacgcaactgtgatctttcccggcggcaacaagggagggggaaccagctgcggcccagctcagaatcccccaaataaccagaccccctcctcctag

SEQ ID NO: 138750 - DNA, 600 bp, Artificial Sequence
  Description of Artificial Sequence: Synthetic coding sequence
atggggttgaccctgctgctgctcttactgctggggctagaaggccagggaatcgtaggttccctaccagaagtcctccaggccccagtcgggtcctccattcttgtccaatgccactaccgcctgcaggatgtgaaagcccagaaggtatggtgccgctttctgccagagggctgccagcctttagtaagttcagcggtcgatcgtagggctcctgctggcagacgcactttcctgacagatctgggaggtggactcctgcaggttgagatggtgactctccaggaggaggatgccggtgagtatggatgtatggtcgacggggccaggggcccacaaatcctgcatagggtgtccctcaacattctgccaccagaggaggaggaagagactcataaaattggctctctagctgagaacgccttctcagatcctgcgggaagcgccaacccactggagccctcccaggatgagaaatcaatcccgctcatctggggcgccgtactcctggtgggtttgctggtagcagcggtggtcctatttgcggtcatggccaaacgcaagcaggagtctctgcttagtggcccaccacggcaatag

SEQ ID NO: 138751 - DNA, 603 bp, Artificial Sequence
  Description of Artificial Sequence: Synthetic coding sequence
atggggctcacattattgctcctcttactgctgggactggaggaggaggaagaggaaactcacaagatcggaagcctcgccgagaatgccttctccgatcccgccggatctgcaaaccccctagagccttcccaggacgagaaaagcattccgctaatctggggtgccgtactgctggtgggactgttggttgctgcggtggtgctcttcgccgtcatggccaagagaaaacaggggaaccgcctgggagtgtgcgggcgcttcctgtcgtcgcgggtatctggcatgaatcccagcagtgtcgttcaccacgtttcagactcggggccagcagccgaactacccctggacgttccacatatacgcctggacagcccaccatcttttgataacaccacttacaccagcctccccttggattctcccagcgggaaacccagtctccccgccccaagctccctaccccccttaccgccgaaagtgcttgtttgttcgaaacctgttacatacgccacagtgatttttcccggcggtaataagggcggcggtacatcatgtggtcccgcacagaacccacccaacaaccagacaccgagctcctag

SEQ ID NO: 138752 - DNA, 966 bp, Artificial Sequence
  Description of Artificial Sequence: Synthetic coding sequence
atggcccctgcatttctcctgctgttgctgttgtggccccagggatgtgtgagtgggccctctgccgactcagtttacacgaaagtgcgcctgctcgagggggaaactctctcggtgcagtgttcttataagggatacaagaacagggtggagggcaaggtctggtgcaagatccggaaaaaaaaatgcgagcccgggttcgccagagtctgggtgaaagggccaagatacctgttacaggatgacgcgcaggccaaagttgtgaatatcaccatggtagccttaaagctgcaggactccggaagatattggtgcatgagaaatacatctggtatactctatcctctcatgggattccagctcgatgttagtcccgcacctcagactgagcgaaacatccccttcacccacctcgacaatattttgaagtctgggactgtgactacaggtcaggcacccacatcaggcccagatgcccctttcactaccggtgtcatggtgttcacgcctggactgattactctcccaagactcctggcctctaccaggcccgcctccaaaaccggctacagcttcacagcaacaagcacgacttctcaaggcccgaggcgtacaatgggttcacagacagtgacagcatccccctctaatgccagggattcttccgccgggcccgaatcaatatcgaccaaatctggagatctgtctacgcggagccctactactggcttatgcctgacatcccgttcactgttgaaccgcctgccatcgatgcctagcatcagacatcaagatgtgtactcgaccgtcctcggcgtcgtgctgaccctcctggttcttatgctgatcatggtgtatggcttctggaaaaaaaggcatatggcttcttactccatgtgcagcgacccgagtacccgagacccacctggccgccctgagccttacgtggaagtgtatctcatctag

SEQ ID NO: 138753 - DNA, 2562 bp, Artificial Sequence
  Description of Artificial Sequence: Synthetic coding sequence
atgtgctgcgaaaaatggagtcgggtggccgagatgttcttatttatagaggagcgggaggattgtaagatcctgtgtctgtgttcacgggccttcgttgaagacaggaaactgtataatctgggattaaaggggtactacattcgcgattcgggaaataattctggggaccaagcaacagaggaagaagaagggggctactcatgcggaacagccgagagtcatgacagcaaaggcattggtctggacgagtcggaactcgactctgaagctgagcttatgcggtctatgggtctccctttgcagttcgggaggattacagcccacaaggattttgaggtgagcatgaatactcgtaacaaggttaaaattaaaaaaaaaaaacaccaaaaaaagtatttggacgagatcgttcaggagagctggagaaaggagtatgaggaggacgacatcttggcttccgacgatcctagctcgatcgagcagtatgagaacacccgcacatacgaactgcagtccaagaaagacactgagaccgaaaacccaccagtggagaatactctgtcacccaagttggaaattacagaaaagtgggagaagtattggaatgaatacgggggcggcttgttgtggcagtcatggcaggaaaagcatcccggccaagcccttagctccgagccgtggaattttcccgacactaaggaagagtgggaacaacactacagtcagctatattggtattatctcgagcagttccaatattgggaggcacagggctggaccttcgacgcctctcagtcttgcgatactgacacctacaccagtaaaacggaggcagacgataagaatgatgaaaaatgcatgaaggtcgacctggtttccttcccgagcagccctatcatggtagacaatgactcctctgggacgtccgataaggaccattccgaaattctcgatggtataagcaacataaaattgaattctgaagaagtgactcagagccagctcgactcctgcaccagtcacgatggccatcagcaattgtctgaggtgtcttcaaagcgcgaatgtccagcatcggggcagtctgaaccccgcaacggaggtaccaacgaagaatctaattcctcaggcaatactaatactgacccacccgcagaggactcacagaagagcagcggggccaatacgtccaaagatcgccctcacgcctctggtactgatggggacgaaagcgaggaagatccgcctgaacataagcccagcaagttgaagcggagccatgagctggacatcgatgaaaacccggctagcgattttgacgatagcggcagtcttctcggtttcaagtacggttccggccagaagtacggtggaatccctaacttctcccaccggcaggtgcggtatctcgagaaaaacgtgaaactcaaaagcaagtatctagacatgagaaggcaaataaagatgaaaaacaaacacatcttcttcaccaaggagtccgagaaacctttcttcaaaaaatctaaaatcctgtctaaagtggagaaatttctgacgtgggtgaataagccgatggatgaagaagcgtcccaggaatcctcgtctcacgacaacgtgcatgatgcctctacaagcagcgatagcgaggagcaggatatgagcgtaaagaaaggggatgaccttctggaaactaataatccagaacctgaaaagtgccagagtgtgtcaagcgctggagagctggagacagaaaactatgaacgagactcactgctggcgacagtgcctgatgaacaagactgtgtgacccaggaagtcccggattcacgccaggctgaaacagaagccgaagtgaagaagaagaagaacaagaagaaaaacaagaaagttaatggactcccacccgagatagctgcggtccccgagttagctaaatactgggcccaacggtaccgcttgttctctcggtttgacgatggtatcaaactggatcgtgagggctggttttctgtgacccctgagaaaattgctgagcatatagccggccgggtgagccagtcgtttaagtgcgacgtggtagtggacgctttctgcggggtgggaggcaacactatccaattcgctctaacaggcatgcgagtgatcgctatcgacatagatcccgtgaagattgctctcgcacgtaacaacgctgaggtgtatggtattgctgataagattgaatttatctgtggcgattttttgttacttgccagcttcttgaaggctgatgtggtgttcttgtctcctccttggggaggacccgattatgctactgctgagactttcgatatccggacgatgatgagtccagacggattcgagatcttccggctgagcaagaagattaccaataacatagtgtatttcctgcctcgcaatgctgatatcgatcaggtagcctcccttgcagggcctgggggccaggttgaaattgagcagaacttccttaataataagttgaagacaattaccgcgtacttcggcgatttgattagacggcctgcgagcgagacgtag

SEQ ID NO: 138754 - DNA, 1266 bp, Artificial Sequence
  Description of Artificial Sequence: Synthetic coding sequence
atgtggtaccatcgactgagtcacctgcatagtcggttgcaagatctgctgaaaggcggcgttatctaccccgccctgccccagccaaattttaagagcctgctgccgttagccgtacattggcatcatacagcctcaaagtcattgacctgcgcgtggcagcagcatgaggatcactttgagctgaaatacgccaatactgtgatgcgctttgactatgtctggttgcgcgaccactgccgctctgcatcctgttacaactcaaaaactcatcagcgatccctcgacactgcctcagtggatctctgcattaagcccaagacaatccgtctcgatgagaccaccctcttcttcacttggcctgacggccacgtcaccaaatatgatctgaactggctggttaagaactcctacgagggccagaagcaaaaagtgatccagccccggattttgtggaacgcggaaatatatcagcaagcccaagtgccgtccgttgattgccagagctttctagagaccaatgagggcctgaaaaaatttctacagaacttcctgctgtatggcatcgcgtttgtggaaaatgtgccaccaactcaagagcacacagaaaagcttgccgaacgcatctccttgatccgcgagacgatttatggacgaatgtggtattttacaagcgactttagtcggggcgataccgcatacactaaattggctctggatcgccacaccgatactacctatttccaggaaccttgtggaatccaagttttccactgcctcaaacacgagggaacgggcggcaggaccctgctggtggatggattttatgcggcggagcaggtgctgcaaaaagctcctgaggaatttgaactgctgtctaaggtcccgctgaaacatgaatacatagaagacgtaggggaatgccacaatcacatgattgggatcggcccagttcttaacatttatccatggaacaaagaactctacctaattagatacaacaactacgaccgcgctgtcattaacacagtgccatatgatgtagttcaccgctggtatacagcacatcggactctgaccattgagctgagacgaccagagaacgaattctgggtgaaactgaaacccggacgtgtcctcttcatcgacaactggcgtgttctgcatggccgggaatgtttcaccgggtatcgtcagctgtgcggatgctacctgacccgggatgacgtattaaacacagcccgcctgctgggactccaggcgtag

SEQ ID NO: 138755 - DNA, 1131 bp, Artificial Sequence
  Description of Artificial Sequence: Synthetic coding sequence
atgtggtatcacagactttctcatctgcattcccggctgcaggatttactcaaggggggagtaatctatcctgcccttccccaaccaaactttaagtctcttctaccccttgccgtgcattggcaccacaccgcttctaagagtttaacttgcgcgtggcaacagcacgaagatcacttcgagctgaagtacgccaacacagtcatgaggttcgactacgtttggctgagagaccactgccgctccgcttcctgctacaattctaaaactcatcagcgttccttggacaccgccagcgtcgatctttgtatcaaacctaagactatacgcttggatgaaactacactgtttttcacctggccggacggacacgtaactaaatatgacttgaattggctggtgaaaaacagttatgaaggacagaaacagaaagtgatccagccacgaatcttatggaatgccgagatctaccagcaagcccaagtgccctctgtggattgtcagtcatttttggagactaatgagggactcaagaaatttctgcagaattttttgttatatggtattgcctttgttgagaatgtccccccgactcaggagcacaccgagaaattagcagagcggatttccctcatcagagaaaccatttacgggcggatgtggtactttactagtgatttctcaagaggagacactgcatacaccaaactcgcgttggatcggcacacggacacaacctatttccaggaaccttgcggtattcaggtattccattgtctgaagcacgagggaactggaggtaggacccttctcgtggatggcttttacgccgccgagcaggtgctgcagaaggccccagaagaattcgagcttctcagtaaggtgcctcttaagcacgagtacatagaggacgtcggcgaatgtcataaccacatgattggcattggaccagtgcttaacatctatccttggaataaagagctgtatctgatacgcctctttaaggaaaagcagaacaccgtaaacagacagtggaactcctcactacaatgtgacatcccagaacgcatcctaacttatcggcactttgtcagcggcaccagtatcgaacaccgggggagtctgatctag

SEQ ID NO: 138756 - DNA, 5889 bp, Artificial Sequence
  Description of Artificial Sequence: Synthetic coding sequence
atgagggagctggaggctaaggctacgaaagatgtcgaacggaacttgagcagagacctggtgcaggaggaggaacagctcatggaagagaaaaaaaaaaagaaagacgataagaagaagaaagaagctgcccagaaaaaagcaactgagcagaaaatcaaggtgccagaacaaatcaaacccagtgtatcacagcctcagcccgctaatagcaataatggcacctcaactgctacttcgacaaacaataacgcaaagcgagccactgctaataatcaacaacctcagcagcaacagcaacagcaacaacctcaacagcaacagccccagcagcaaccccaacctcaaccacagcaacaacagcctcagcaacagccacaggcactcccccgctaccctcgggaggtccctccaaggtttagacatcaggagcataagcagctcctaaaacgaggacagcacttccctgtaatcgccgccaatcttggcagcgccgtcaaggtgctgaattcgcaatcagaatccagcgcactgacaaatcagcagccacagaataacggagaagtgcagaacagtaaaaaccagtctgatattaaccattcgacctctggttctcattatgagaactctcagagggggcctgtaagctctacaagtgactccagtacgaactgtaagaatgccgttgtgagcgacctgagtgagaaggaagcctggcccagtgcccccgggagtgaccccgagctcgcttccgagtgcatggacgcagactccgccagtagcagcgagtcagaacgtaacattacaattatggccagtggaaatactggaggagagaaggacggacttaggaactctaccggcctgggatctcagaacaagttcgtggtggggagctcatcaaataatgtggggcacggcagctcaaccgggccttggggttttagtcatggcgctattatctccacatgtcaggtttctgttgatgcacctgaaagcaagtccgaatcttccaacaatcgcatgaatgcttggggaaccgtgagctcaagcagtaacgggggacttaatccttccacccttaatagtgcctccaatcacggtgcatggccagtgcttgaaaacaatgggttggccctgaaaggtcctgttggctcaggaagctctggaattaacattcagtgttccacgatcgggcaaatgcccaacaatcagagtatcaattcaaaagtatcgggtgggagcacccacgggacttggggcagcttacaggagacatgtgaaagcgaagtttccgggacccagaaggtcagttttagcggtcagcctcaaaacatcactacagagatgaccggccccaataataccacgaactttatgacttcatccctacctaactcaggctccgtccaaaacaatgagctgccgtccagcaacaccggggcctggagggtatccaccatgaaccatccccaaatgcaggctccatctgggatgaacggtacctctctgtctcacttaagcaatggagaatctaaaagcggcgggagttatggcacaacctggggcgcctatggttctaactacagtggcgacaagtgttcagggccaaatgggcaggccaatggtgatacagtgaatgcaaccctcatgcagcccggcgtcaacggcccaatgggcaccaatttccaggtgaatacgaataagggcggcggcgtttgggagtccggggccgccaatagccagtccacctcatggggtagcggcaatggggccaatagcggtggttctcgacggggctggggaacacctgctcaaaacacaggcaccaacctgccttccgtggaatggaacaaactcccttccaaccaacattctaacgattcagctaatggcaacggaaagacgtttacaaacggttggaaatcaaccgaggaggaggatcaaggctcggcaacttctcagactaacgaacagtctagcgtatgggctaagactggtgggactgtcgagagcgatgggtcaactgaaagcacaggcaggctggaggagaagggaaccggcgaaagccagtcccgagatcgccgcaaaatcgaccagcacaccttgctgcagtccatcgttaacagaacggatcttgacccaagggtactgtccaatagcggttggggccagacccccatcaagcagaacacggcgtgggacacagagacatctccgcgcggggagcgtaagacggataatgggaccgaagcctgggggagcagcgctacacaaacattcaactctggggcgtgtatcgacaagacttctccaaatggcaacgacacatcgtctgtgtctggctggggagaccccaagcctgcgctgcggtggggtgactctaagggctctaattgtcagggcggttgggaggatgactccgcagcaactggcatggtgaagtccaatcagtggggaaattgcaaagaagaaaaagctgcatggaatgatagtcaaaaaaataaacagggctggggcgatggacaaaaaagctctcagggatggtctgtatccgcctctgacaattggggcgagactagtaggaacaaccattggggagaggcgaataaaaagagcagctcaggcggaagcgactctgatcgttctgtttccgggtggaatgaactggggaagaccagctcttttacctggggcaataacattaaccctaacaattcaagcggctgggacgaatcaagcaaaccaaccccgtcgcagggatggggggatcctcccaagtccaaccagtccctgggatggggcgattctagcaagccagtcagttccccagattggaacaaacagcaagacattgttggctcctgggggatccctcctgcaacgggaaaaccacctggaaccgggtggctcggtggtcccatccccgctccggcgaaagaggaggagccaacagggtgggaggagcccagtccagagtctattagacgcaaaatggaaatagatgacggaacttctgcctggggagatccatcaaagtacaactacaagaatgttaatatgtggaacaagaatgtgcccaatggtaacagtcggagtgaccagcaagcgcaggtccaccagttgttgacgcccgcctcagcaatcagcaataaggaggccagctccggtagtgggtggggcgagccgtggggagaaccctcaacacccgcaacaacggtggacaacggcacatccgcatggggcaaaccaatcgactcaggaccttcttggggcgagcctattgcagccgcatcaagcactagtacttggggctctagttcagtcgggccccaagctctgtccaagagcggcccaaaatctatgcaggatggctggtgcggggacgacatgcctctgccaggcaatagacctacgggctgggaggaggaggaggacgtcgaaatcggtatgtggaattccaatagttcacaagagctcaattcaagcctgaattggcccccatatactaaaaaaatgagtagtaagggcctttcgggtaagaaacgcaggcgcgaacgcggcatgatgaaagggggcaacaagcaagaagaagcctggattaacccattcgtgaagcagttttccaatattagcttctcaagggactctcccgaagagaacgttcagtctaataaaatggacctcagcggcggaatgctgcaggataaacgtatggaaatcgataaacatagcctgaatatcggcgattataataggacagtaggaaagggccccggttctcgaccccaaatcagcaaagagtcttctatggaacggaacccgtactttgacaaggacggcatagtcgctgatgagagccaaaatatgcaatttatgagcagccagtctatgaaattaccacccagcaattccgccttgcccaatcaggcacttggcagcatagcaggcctggggatgcagaacctcaattctgtgcgccagaacggtaatccatctatgtttggggtgggcaacacagccgcgcaaccaagaggcatgcaacaacctcctgcccaacctttgtctagctcccagcccaatctgcgtgctcaagtgccaccacccttactctcaccccaagttccagtctccttactcaagtacgccccgaataatggtggcttgaacccgctctttggcccccaacaggtggctatgctgaatcagctgagccagcttaatcagctgtctcagattagtcagttgcaaaggctgttggcacagcagcagagggcgcagtcacagcggagcgtgcccagcggaaataggccgcagcaggaccaacagggtcgccccctttccgtccagcaacagatgatgcaacaatcccgccaactcgacccgaacctgttggtgaagcagcagacgccaccaagtcaacagcaacccctccaccagccagctatgaagtcatttctggacaacgtgatgcctcataccacgcccgagctgcagaaaggtcccagccccattaatgctttttcaaactttcccattggactgaatagcaatctgaacgtgaacatggacatgaactctatcaaggagccacagtcccgtctgaggaagtggaccacggtggactctatttccgttaacaccagccttgaccagaattccagcaagcacggcgcaatatcttctggttttcgcttagaagagtcaccctttgtgccctatgatttcatgaactctagcacaagtcctgcaagccccccaggttctatcggggacggttggccccgtgcaaagagtccgaatggcagctcctccgtgaattggccgcccgaattcagacctggcgagccatggaagggctacccaaacatcgacccagagaccgatccatatgtgacgcctgggtccgttattaataatctgtctatcaacactgtgcgggaggtagatcacctacgagatcgcaacagcggctcaagctctagcttgaataccactctcccttcgacctcagcctggagttctatccgagcaagtaattacaacgtacccctaagtagtactgcccagtccacctctgcacggaatagcgactctaagttgacctggtcccccggcagtgtaactaacacatcactggcacatgagctctggaaagtccccctgccacccaaaaatataactgccccatcgcgcccgccacctggcttgaccggacaaaaacctccactgagcacctgggacaattccccgctgaggattggtggagggtggggcaacagcgacgcccggtacacacccggctccagttggggcgaaagttccagcgggcggatcactaactggctggttctcaagaatctgactccacaaattgacggaagcaccctcaggaccctctgtatgcagcatggcccactgattactttccatttaaatctgccgcacggcaacgccctggtcaggtacagttctaaggaagaggtagtgaaggcacagaagtcactgcatatgtgtgtacttgggaatactactatcctcgctgagttcgcatcagaggaggaaatttcaagattcttcgcccagtcgcagtctctcacgccaagccccggttggcagagcctgggctcctcacagtcaagattaggtagtctggattgttcccacagcttcagcagccggaccgatttaaaccattggaacggggctggtttgtcaggaaccaattgtggcgacttgcacgggacaagtctgtgggggacgccccactacagtacaagtctgtggggtcctccctcctcttctgaccctagaggaatcagctctccatcaccaatcaatgcatttctgtcagtggaccacctgggtggcggaggtgaaagcatgtag

SEQ ID NO: 138757 - DNA, 1323 bp, Artificial Sequence
  Description of Artificial Sequence: Synthetic coding sequence
atggacatgaactccatcaaagagccccagtccagactcaggaaatggaccaccgttgacagcatctcggtgaataccagccttgaccaaaactctagcaagcacggtgcgatctcaagtggtttcaggctggaagagagtcctttcgtcccatatgactttatgaattcgagcacttctccggcctcaccaccaggttccataggggatggctggcctcgcgccaaatcgccaaacggttcttccagcgtgaattggcctcctgagtttcggcccggtgagccttggaaaggctacccaaatatcgaccctgagaccgacccgtatgtgaccccagggtccgttattaataatctgtccattaataccgtgcgcgaagtggatcacctcagggacaggaactcaggcagctcatcatcacttaacactaccctccccagcacctctgcttggtcgagcattcgagcaagtaattacaatgtacctctttcaagtaccgcccagagcacttctgccaggaatagcgattctaaacttacatggtcacccggctctgtgacaaacacttcacttgcccatgagctgtggaaggtccctctgcctccgaagaacatcaccgccccctcacggccccctcctggtctgactggtcagaaaccacccctgtccacttgggataatagccccctcagaataggcggtggctggggcaacagtgatgcccgatacacgcccggcagcagctggggtgaatcttctagcggaagaattacaaattggctcgtcttgaagaatcttacccctcaaattgacggctccacattgcggactctatgcatgcagcatggccctttgattaccttccatctgaaccttccccacggtaatgccttggtgagatactcctcgaaggaggaggttgtcaaggcacagaagagtctgcacatgtgcgtgctggggaacacaacaattctggccgagttcgcttcagaggaagagatttctaggttcttcgcacaatcacagagcctcacaccatctccaggatggcaatctctgggtagctctcagtctcgccttgggtccctcgattgctcacactctttctctagtaggacggatctgaatcactggaatggcgccggtttatctggaacaaactgcggggatctgcatgggacctcgttatggggaacaccccattacagcacctcactttggggcccacccagttctagtgacccacggggcatctcatctccctctcccattaatgcattcttgtccgtcgatcatttgggggggggcggtgaatctatgtag

SEQ ID NO: 138758 - DNA, 5073 bp, Artificial Sequence
  Description of Artificial Sequence: Synthetic coding sequence
atggcaactggttccgcacaaggcaatttcactggccacacaaagaagacaaatggcaataacgggaccaacggagccttagtgcaatcaccctccaaccagagcgcgctgggcgccggcggcgcaaatagtaatggatctgccgcccgcgtgtggggcgtggccactgggtcatcatctgggcttgctcattgcagcgtgagtgggggagacgggaagatggatacaatgatcggcgacggccgcagccagaattgctggggcgccagcaacagcaacgcagggatcaatctcaacctgaaccccaatgcaaatcccgctgcgtggcctgtcttggggcatgaggggaccgtggcgaccggaaatccctcctcaatttgttcccctgtgagcgcaattggccagaatatgggtaatcagaacgggaaccctactggtacactgggagcctgggggaatctgctgccccaagagagcacagagcctcagacttcaaccagccagaatgtcagcttctctgctcagccacagaacctgaataccgacggccccaataacacaaaccccatgaattctagcccgaatccaatcaacgccatgcagaccaacggcctgccaaattgggggatggccgtcgggatgggagctataatccctccacatctgcaaggtctaccgggcgccaatggctcatccgtatcacaggtctccggaggatccgcggaaggcatctctaatagcgtatggggcttgtctcccggaaatcccgccaccggcaacagcaacagtggattctcacagggaaatggggacacagtgaatagcgcgctgagcgctaaacagaacggttcttcaagcgctgtacagaaagaaggcagtgggggcaatgcttgggattccgggccccccgctggccccggtattctcgcctgggggcgcgggtctgggaacaatggagtggggaacatccactccggggcatgggggcatcccagccgctcaaccagcaatggcgttaacggggaatggggaaagccaccaaatcaacactcgaattctgatattaatggcaagggctcaacagggtgggagtccccctcggtcacctcccagaaccctactgtgcagccgggcggggagcatatgaattcctgggccaaagccgctagcagtggcacaaccgctagtgaaggaagttctgacggatctggcaatcacaacgagggaagtaccgggcgtgagggtacaggcgagggacgcagacgcgataaaggtatcatcgaccaggggcacatccagctacctcggaacgacctggacccacgagtgctttccaatacaggatgggggcagacgccagtgaaacagaacacggcttgggagttcgaggagagccccagatccgagcggaaaaacgacaacgggactgaggcttgggggtgcgcggccacccaggctagcaactcaggcgggaagaatgacgggtccatcatgaacagtaccaatacatcaagtgtgtctgggtgggttaacgcacccccagcagctgtcccggccaacacgggctggggggactctaacaacaaggctccttccgggccaggtgtgtggggggatagtattagctcaaccgccgtgtctacggctgccgcagctaaatccggacacgcctggagcggggccgccaatcaggaggataaatcccccacctggggagagccgcccaaacccaagagccagcactggggcgatggacagcgtagcaatcccgcttggagcgcgggggggggcgactgggcagactccagtagtgtgcttggacatctgggagacggcaaaaaaaacggttccggctgggacgcagactcaaaccgcagtgggtcgggctggaacgacacaactcgatctgggaactccggttggggtaattctaccaacacgaaagccaacccagggacaaactggggagagacgctcaagcctggaccgcagcaaaactgggcttcaaagcctcaggacaacaatgtgtcaaactggggcggtgctgcatccgtaaagcaaacgggaaccggttggatcgggggaccagtgcctgtcaagcagaaagactccagcgaagccacaggttgggaggagccatctccaccttcgataagacggaaaatggagatcgacgatggcacctcagcctggggagaccctagtaattataataataaaacggtgaacatgtgggaccgcaacaaccccgtgatacagtcgtcaaccaccacaaacactaccacaaccaccactaccactacatccaacaccacacatcgtgtagagacaccacccccccaccaggcaggcacacagttaaacaggagccccctgctcgggccagggcgcaaagtgtcctctggttggggagagatgcccaacgtacacagtaagacagaaaacagctggggcgagccttccagtccatccactttggtggataacggcacagctgcatggggtaagcctccctccagcggctctggctggggagatcatcccgctgagcctcccgtggcatttggccgggccggtgctcctgtagccgcatctgctctatgcaaaccagcgtctaaatcaatgcaagaaggatggggatcgggcggagatgaaatgaacctcagcacctcccagtgggaagacgaagaaggtgacgtttggaacaacgccgcttcacaggagtcaaccagctcctgcagttcctgggggaatgcgcccaagaaaggcctgcagaagggaatgaagacctcaggaaagcaggatgaagcctggatcatgtctagacttattaaacagctgacagacatgggctttccaagagagcccgcagaagaggcattgaaatcaaataatatgaatctcgaccaggcaatgagcgctttgctcgagaaaaaggtggacgtcgataagcggggtcttggggtgaccgaccataacggaatggccgcaaagcccctgggctgccgacctccgattagcaaggagagttccgtggataggccaaccttccttgacaaagacgggggtctggtagaggagccaacccccagtcctttcctccccagtccctcattgaaacttccattgagccatagtgcacttccttcccaggctctcggaggcatcgccagcgggctgggaatgcagaatctgaatagttcacggcagattccatccggcaatctcggtatgttcggcaactcgggagctgctcaggctcgcacaatgcagcagccgccacagcccccagtgcagccactgaattcttctcagcccagcttgcgggcccaggtgccacagtttctgtctccgcaggtgcaggctcagctcctccagttcgcggctaagaatatcggcctcaacccagccctgttaaccagcccaatcaatccgcagcatatgacgatgcttaatcaactgtaccagctccaacttgcctaccagcggctacaaattcagcagcagatgctccaggcgcaacgtaacgtgagtggaagcatgcgtcagcaggaacaacaagtagcacgcactattaccaatctacagcagcagatccagcaacaccaacgccagttggcccaagccttacttgtgaaacagcctcccccacctccacccccgcctcatctgtccctgcatccttctgccggcaaaagcgctatggattcctttccttctcacccacaaacgcctggattgcccgaccttcagactaaagagcaacaaagcagtccaaacaccttcgctccatacccacttgctggccttaacccgaacatgaacgtgaatagcatggatatgactggcgggctttcagttaaagatccgtcgcagagtcagtcccgactgccacaatggactcacccaaattcaatggacaacctacctagtgcagcatctccgttggaacaaaatccaagtaagcacggtgcaatacctgggggtctctccattggccctccaggtaagagcagcatagatgatagctatgggaggtatgacctcatccagaatagtgagtcccccgcctcacccccggtggccgtcccccactcctggagtcgagccaaatcggattcagataaaatttctaatggctcctcaatcaattggccgcccgagtttcacccgggggttccttggaaaggactgcaaaatatcgacccggagaacgacccagatgtgacaccagggtcggtcccaaccgggcccactatcaacacgactatacaagatgtcaaccggtaccttctgaaatctggaggcaagcttagcgatattaagtctacatggtcttctggcccaacatcacatacccaggccagcctgagccatgagctctggaaagtcccgagaaattcaactgcacccacccggccaccccccggactcacaaacccaaagccgtctagcacttggggggcgtcccccttaggctggacctccagctactcatcagggagcgcctggtctacggataccagcggccggacctcctcgtggctggtcctgcgcaatctgacacctcaaatcgatggcagcacactgagaaccctgtgcttgcaacatgggccactgatcacctttcatctgaatctgacccaaggcaatgctgtcgtgaggtactcttcaaaggaggaggccgcgaaggcccagaagtctttacacatgtgtgtgctcggcaatactaccattttagctgaatttgccggtgaggaggaagttaatagattcctggcccagggacaggccctacccccaaccagctcatggcaaagctctagtgcttctagtcagccccgtctttccgcggcgggaagctcccacgggctggtgcgatccgatgctgggcattggaacgctccctgcttggggggaaagggatctagcgagcttctttggggaggcgtgccacagtactcatcatccctctggggccccccttcggcagatgacagccgggtcattggaagtcccacccccctcactactctgctccccggcgacctactgtccggggagtctctgtag

SEQ ID NO: 138759 - DNA, 5181 bp, Artificial Sequence
  Description of Artificial Sequence: Synthetic coding sequence
atggccactggctctgcacagggtaatttcacgggacacactaagaagacaaacggcaacaacggcacgaacggggccctggttcagtcgccatctaaccaatccgcccttggcgctggcggtgccaactccaacggaagcgcggctagggtgtggggggtggctactggctctagcagcgggctagcccattgctcagtgtcaggcggggacgggaagatggacacaatgattggagatggccgatcacagaattgttggggagcttctaattccaacgctggcatcaatctcaacctgaatcccaacgcgaacccagctgcatggcccgtgctgggtcacgagggaactgtggcaacagggaacccgtcctccatctgttcaccagttagtgcgattggacagaatatgggaaaccagaatgggaatcccaccggcacactgggagcctgggggaacctgctgcctcaagagtctaccgagccccaaacctccacttcgcagaacgtctcattcagtgcacagccccaaaatctgaataccgacggtcccaacaacactaaccccatgaactctagcccaaatcctattaacgctatgcagaccaatgggctgcctaattggggtatggccgtcgggatgggcgccattattcccccccatctccagggcctgcccggggccaatggatccagtgtgagccaagtctcaggtgggagtgccgaaggcatttcaaattccgtatggggcctttctcctggcaaccctgcgacgggaaactccaactccggtttctcccagggcaacggagataccgtgaattcagccttatctgcaaaacagaacggatcttcaagcgccgtccaaaaggaagggtctggcggcaatgcttgggacagtgggccccctgctggccccgggatcttggcctgggggaggggctccggcaacaatggtgtcggcaatattcactctggtgcctggggccaccctagcaggtctaccagtaatggcgtgaacggcgaatggggaaagcccccaaatcaacatagcaattctgacattaacggcaaaggaagcacaggttgggagagtccgtccgtgaccagccaaaatcccactgttcagccaggcggagaacacatgaacagttgggctaaagccgctagttcaggtactacagcttcagaaggctcctctgatggaagtggaaatcacaatgaagggtctactgggcgggaagggaccggcgaaggcaggaggcgagataagggaataatcgatcaagggcatatccagttgccccgcaacgaccttgacccccgcgtgctttctaatacgggctgggggcagacccctgtgaaacagaacacggcttgggagttcgaagaatcaccccggtccgagcgtaaaaacgacaacggtactgaggcctgggggtgtgctgctacgcaagctagcaattcaggtggaaaaaacgacggctctatcatgaactcaacaaacactagttccgtaagcggttgggtcaatgcacccccagctgccgtgcccgcaaatactggatggggtgatagtaataacaaagcacccagcggaccaggtgtctggggtgattccatttctagtacagcagtttcaaccgcagccgctgctaagagtgggcatgcttggtctggcgctgccaaccaggaagataaatctcccacatggggtgaaccccccaaaccgaaaagccaacactggggagacggccagaggtcaaacccagcttggtcggcaggaggcggtgattgggctgactcttcttctgtgctcggtcatctgggcgacggaaaaaagaacggctcgggttgggatgctgactctaaccggtcaggctccggatggaatgatacaactcggagcggaaactcaggatggggcaacagtaccaacaccaaggccaaccctggcacgaactggggcgaaacactcaagcctggaccccagcagaactgggcatccaaaccacaggataataatgtgtccaattggggcggtgcagcatccgtaaagcaaaccggcaccggctggatcggtgggcccgttccagtcaaacagaaggattcatctgaggccactggctgggaagaaccttcaccaccaagtattcggaggaaaatggagattgacgacgggacctcagcttggggagacccatccaattataataataagaccgttaatatgtgggacagaaacaacccagtgatccagtcatccactaccaccaatactaccacaaccaccaccactactacgagtaacactactcatcgagtcgagactccccccccccatcaggccggaacacagttgaaccgtagccctctgcttgggcccgtgagctccgggtggggggagatgcccaacgtccacagcaagaccgagaactcatggggcgagccatcaagtccttccaccttagtggacaatggaactgcagcgtggggaaagcctccgagtagtggcagcggatggggggatcaccctgctgaaccacctgtggccttcggccgagccggagccccggtagcagctagtgctttatgtaagcccgcttctaagtcaatgcaggaggggtgggggtccggcggagacgaaatgaatctgtccacatcccagtgggaagatgaggagggtgatgtgtggaataacgcagcctctcaggagtcaacttcatcttgcagtagctggggcaatgccccaaagaaaggcttacagaagggaatgaagactagtggcaaacaagacgaggcctggattatgagccgcctgatcaaacagctcacagacatgggtttcccgcgtgagcccgcggaagaggctttgaagtccaacaatatgaacttagaccaagccatgtctgcccttctggagaagaaggtcgacgtggataaacggggcctcggggtgacagatcacaacggcatggcagccaaacctcttgggtgccggccgcctatcagcaaagagtcgagcgtggaccgacctaccttcctagacaaggacggtggcctggttgaggaacccacaccatcaccgttcctgccttccccaagtcttaaacttccactgagtcacagcgctttgccttctcaggccctgggcgggatagcttcgggcctgggtatgcagaacctcaatagctcgagacagatacctagtgggaatttgggaatgtttggaaattcaggtgcagcccaagctcgcaccatgcaacagccgccgcaaccacccgtacagccactgaacagttcccaaccttccctccgagcacaggtgccccagttcctcagcccacaggtgcaagcacagttactccagttcgcagccaagaacatcgggctcaaccccgcccttctgacatcacccattaatccccagcatatgactatgttaaatcagttgtaccagcttcagctcgcctaccagaggctgcagatccagcagcagatgctgcaggctcaaaggaatgtctccgggtccatgcggcagcaagagcagcaagtggctaggaccataaccaatctgcagcagcagattcagcagcaccagcgacagctcgcacaggcgttgcttgtcaagcagccacctccccctcccccgcccccccacctatcgctacatcccagtgctggaaaatccgcaatggattccttccccagccatccccagacccctggactccccgatttgcagacgaaagagcagcagtcatcgcctaatacctttgcaccttaccccctggccggcctgaaccccaacatgaacgtcaacagtatggatatgaccggcgggcttagcgtcaaggacccctcccaatcccagtccaggctcccgcaatggacccacccaaactcaatggacaacctcccgtctgccgcctctccgcttgaacaaaatccctctaaacatggcgctatacccggaggattgtctatcggcccccctgggaagtctagcatagatgactcctacgggagatacgatctcattcagaattcagagtcccctgcctctccacccgtcgcagtgcctcactcctggtcaagagccaagtcggatagcgacaaaatttctaacggaagcagcattaactggcctcccgaattccatccgggcgtgccttggaagggtctgcagaacattgaccctgagaacgaccccgatgtgacacctggttccgtccccaccgggcctaccatcaacacaaccatccaagacgtgaaccgatacctccttaaatccggcggctcttcaccaccttcgtcccagaatgccactctgccctcctcctcggcctggcccctgagtgcctccggttacagctcgtcttttagcagcatagctagcgcaccatccgtcgctgggaaactgagtgacatcaagtccacgtggtccagtgggcccaccagtcacacacaggcctccctaagccacgagttgtggaaagtaccaaggaactccactgctccaacccggccccctcccggccttaccaaccccaagccctctagcacgtggggggcttccccactgggttggacaagctcctatagttctggctcagcctggtccactgatacttcaggcagaacaagctcatggttggtgctgagaaatctgacgccacagatcgatggctctacactgagaacactttgtctgcagcacggaccgctgatcacatttcacctgaatctgacccagggcaacgctgtggttcggtattccagcaaagaagaggccgcgaaggcgcagaagtctttgcacatgtgtgtacttgggaacaccaccatcttggccgagttcgccggagaagaggaggtcaatagattcctcgcacagggccaagccctgccccccacatcaagttggcagtctagtagtgcgtccagccaacctcgcctctcagctgctggctcctcccatggtttggtgaggtcagatgctggacactggaacgctccttgcctgggaggcaaggggtcctccgagctgctgtggggtggggtcccccagtatagtagttccctgtgggggccacctagcgctgacgacagtagagttattggatcaccaactccccttacaactctgctacctggcgacctgctcagcggggaatcattgtag

SEQ ID NO: 138760 - DNA, 5181 bp, Artificial Sequence
  Description of Artificial Sequence: Synthetic coding sequence
atggctactgggagcgcacaggggaattttactggtcacaccaagaaaactaacggcaataatggcacaaacggcgcactagtccagagcccttctaaccagagcgctctgggtgctggaggggccaatagcaatggatctgcggctcgtgtgtggggcgtcgccactggtagctcatcagggctggcacactgttctgttagcggcggcgacggcaagatggacactatgatcggcgatggcagaagccagaattgctggggagcaagcaacagcaacgcaggaatcaatctcaacctcaatccaaacgctaatccagctgcttggcccgtgcttgggcatgaagggactgtggcgaccggaaacccctccagtatttgctcgccagtgtccgctattggacagaatatgggtaaccaaaatggcaaccccaccgggaccttaggcgcatggggtaatttgttaccccaagaatcaacggagccccagacctcaacctcgcagaacgttagtttctctgctcagccacaaaatctgaataccgacggaccgaataatacgaatcctatgaatagttctccaaatcccatcaacgctatgcagaccaacggccttcccaattggggaatggcagtcggcatgggagcaattatcccgcctcacctgcaggggcttccgggagccaatggctccagtgttagtcaagtgagcggggggagtgccgaaggcatcagcaacagcgtttggggactgtccccggggaaccccgccacggggaattctaacagcgggttctctcagggcaacggcgatacagtcaattctgccctgtcagcgaagcaaaacggctcatctagtgccgttcagaaagaagggtccggcggtaatgcttgggattcaggcccccccgccggccccggaatcctcgcctggggccggggcagcggcaacaatggggtaggcaacattcatagcggggcctggggccacccaagcagaagtacgtccaatggggtgaacggagagtgggggaagccccctaatcaacattctaattcagatatcaacggaaaggggtcaaccggctgggagtccccatcagtgacttcacagaatcctacagttcagccaggcggagagcatatgaacagctgggcgaaagctgcctcctctggaacgaccgcgagtgaaggctcatcagacggctctggaaaccacaatgaaggatctaccgggcgcgaagggacaggggagggacggcgacgcgacaagggaataatcgaccagggccacatccagctcccgaggaatgacctcgacccgagggttctgagtaacacaggttggggccagaccccagtgaaacagaacactgcttgggagttcgaggagtctccaaggagtgagagaaaaaatgacaacggtaccgaagcgtggggttgtgccgcaacacaggcatcaaatagcgggggcaagaacgacgggagcatcatgaattcaacaaatacatcttctgtgtcagggtgggtcaatgcgccccctgctgccgttccggctaatactggctggggggactccaacaataaagccccttcgggccccggtgtgtggggtgatagcatttcctcaaccgctgtctccacagctgcggcagctaagtccggccatgcttggtctggagctgccaatcaggaagacaagtcacctacatggggtgagcccccaaaaccaaagtctcaacattggggagacggtcagcggtcgaacccagcttggtctgccgggggtggcgactgggctgattcctcatctgttcttggtcacctgggagatggaaaaaaaaacggctcgggatgggacgctgatagcaacaggtccggtagtggctggaacgacaccaccaggtcaggtaatagcggatggggcaatagtactaatactaaggcgaaccctggtaccaattggggcgagactctcaagcctggcccacagcagaattgggcgtcaaaaccacaggataacaatgtgtcaaactggggaggcgcagcttccgtgaaacaaactggcaccgggtggatcggaggtccagtgccagtgaagcaaaaagactcaagtgaagcaactggatgggaagaaccctcccccccctccatcaggcggaagatggaaattgacgacggtacatctgcctggggtgatccatctaattataacaataaaacagtgaatatgtgggaccgcaataatcctgtaattcaaagcagtaccaccacaaacaccactactaccacaactacaacaacatccaataccacccaccgcgtagagaccccccccccccaccaggccggaacacagctaaatcgctcccccctgctgggtcctgtgtcctcgggctggggcgagatgcccaatgttcactctaaaaccgaaaactcatggggggaaccatcttctccaagcactcttgttgataatggcacagctgcatgggggaaacccccatcttcggggtctggctggggagaccatcctgccgaacctccagtggctttcgggcgagctggcgcccccgttgcagcttccgcattatgcaaaccggcttccaagtccatgcaagagggctggggatccgggggagacgagatgaacctgagcacctctcaatgggaggacgaggagggcgacgtgtggaataacgccgcctcccaggaaagcactagctcgtgttcctcatggggtaacgcacccaagaaaggactgcaaaaagggatgaaaacctctggaaaacaggatgaggcgtggatcatgtcccggttgatcaagcagctgactgatatgggctttccaagagaacccgccgaggaagcactgaagtccaacaacatgaatttggaccaagcaatgagcgctctacttgaaaaaaaagtcgatgttgacaaaagaggccttggcgtaacagatcacaacggaatggccgccaaacctctgggatgccgaccccctatttccaaggaatcctctgtggaccgacctacatttctggataaggacggcggtctggtcgaagaaccaacgccttcaccctttctgccctcaccaagcttaaagctgccactgtctcattcagctctaccatcccaggccctcggcggaatagccagcgggctgggtatgcaaaatcttaattcatctcgccaaatcccgtccgggaatttagggatgtttggcaacagtggtgcagcgcaggcccgtacaatgcagcaaccaccccagcccccagtgcagcccctgaattcctcacagcccagtcttagagcccaggttccacaattcttgtctccacaggtgcaggcgcaacttctacagtttgcagccaagaatataggtcttaacccagctttgcttacttcccccattaatcctcagcacatgaccatgctaaatcaactgtatcagcttcagttagcatatcaaagactgcagattcaacaacagatgctgcaggcccagcgaaatgtgtctggctcgatgcggcaacaagagcagcaagttgcgagaacaatcacgaatttacagcaacagattcaacagcaccaaagacagctcgcacaggccctgctcgtgaagcagccacccccacctcctcctcccccccatctgagcctccatccgagcgcgggtaagtctgctatggactccttcccatcccacccacagacgcctggcttaccagatctccagacgaaggaacagcagagttcacccaataccttcgcaccctatcccctagcaggcctgaaccctaatatgaatgtgaactcaatggatatgacaggtggcctgagcgtcaaagatccttcgcagagtcagagccgactgccccagtggacccatcctaattccatggacaatctcccttccgccgcgagtcctcttgagcagaacccaagcaagcacggcgctatccctggaggcctgtcgattggccctcccggaaagtcatctatcgatgactcatatggacggtacgatctcatccagaactcagaatcaccagcttctccccccgtggccgttccccacagctggtccagagccaaatccgactctgacaagattagcaatgggagctccatcaattggccccctgaatttcatccaggcgtgccgtggaagggcctgcagaacattgaccccgagaacgatcccgacgttaccccgggatccgttcctaccggtcccactataaacacaacgatccaggacgttaaccgttatctgctaaagtcgggagggtccagtcccccgtccagtcaaaatgcgacccttccatccagcagcgcctggccactcagtgcatccggctacagttcgagtttctcctccatcgctagcgcgcctagcgtcgccggtaaactgagcgatataaaatccacttggagttccgggccgacctcgcatacacaggcttccctctcccacgagctctggaaagtgccacgcaattctacggccccgaccagaccgcccccaggccttactaaccctaaaccttcgtctacctggggtgccagcccgcttggatggacctcttcctattcgtctggctcagcatggtcgactgatacctccggtaggacgagtagttggcttgtgctgcggaaccttacaccccagatagacggtagcacactgagaacgctgtgtttgcagcatggccccctgatcacctttcacctgaacttgacacaggggaacgccgtggtgagatattccagtaaggaagaggctgccaaggcgcagaagtccttgcacatgtgcgtgcttgggaatacaacgatcctggccgagttcgccggagaggaggaggtgaaccggttcctagcacaggggcaggccctccctcctactagttcgtggcagtcttctagcgcttccagccagccccggctgtcggccgccggctcttcccacggattggtccggtccgacgccggccattggaatgccccgtgcctgggcggaaaagggagctcagaactcttatggggcggagtccctcaatattcttcatcactgtggggacctccctcagctgacgatagtagggttataggatcccccaccccccttaccactcttctgcctggagacttgctgtccggagagagcctctag

SEQ ID NO: 138761 - DNA, 5073 bp, Artificial Sequence
  Description of Artificial Sequence: Synthetic coding sequence
atggcaaccggatcagcgcaaggcaactttacagggcatacaaagaagacaaatggcaataacggtactaacggcgccttggtgcaatccccttctaaccaatctgccctgggggccggcggcgctaacagcaatggcagtgcggcccgtgtgtggggtgttgccaccggcagtagttctggactcgcgcactgctccgtcagcggcggggacggaaagatggataccatgattggtgatggacggtcccagaactgctggggtgcctcgaattcaaacgctgggatcaatctgaatctgaaccctaatgccaatccggcagcttggcctgttcttggccacgaggggaccgtggcaacaggaaacccttcctcaatttgttcccccgtgtcagctatcggacaaaatatggggaatcagaatggcaatcccacgggcaccctgggcgcatggggcaatctgctgccccaggagtcaacggagccacagactagcaccagccaaaacgtgtccttttccgcccagccccagaacctgaacaccgacgggccaaacaatacaaaccctatgaattcatcccccaatccaataaacgccatgcagactaacggcctgccgaattggggaatggcagtgggcatgggcgcaataatccctccccacctccagggcctcccaggagccaatgggtcctctgtctcccaggtgtccggaggatctgcagagggaattagtaactcagtctgggggttgtcaccgggaaaccctgcgaccgggaactctaacagtggatttagccaggggaatggggataccgttaactcagcattgtccgccaaacagaacggatcatcaagtgctgtccagaaggaaggttccggagggaatgcatgggacagcggtccgccggctggccctgggatcttggcttggggacggggctccggcaacaacggggttggtaatattcatagcggagcctgggggcatccatcacgatcaacgtctaatggggtgaacggggaatggggcaaaccccccaatcagcacagtaacagcgatattaatggcaaagggagcaccggatgggagtccccctcagtcacttcccagaatcctactgttcagccggggggagagcatatgaattcctgggcaaaagccgcctcctcaggtaccaccgcctctgagggctctagtgacggtagtggaaaccacaacgagggaagtactggacgggagggaaccggggagggccgacggagggacaaagggatcatcgatcaggggcacatccaactgccccgaaatgatctggacccaagggtgctgtcaaatacgggctggggccagacacccgtgaaacagaacactgcgtgggagtttgaggagtctccacgctctgagagaaagaacgacaatgggaccgaagcctgggggtgtgcagcgactcaggccagcaacagcggcggaaagaatgatgggagcatcatgaattcaactaacaccagctccgttagcggttgggtgaacgcccctcctgctgccgtgcctgccaacacaggctggggcgattctaacaataaggccccctccggtcccggagtttggggagacagtattagctctactgccgtgtctacagccgcagcggccaaaagcggtcatgcctggtctggagcggcaaaccaggaggacaagagccccacgtggggcgagcccccgaagcccaagagtcaacactggggagatggccagagaagtaatcccgcgtggtccgcaggcgggggagactgggctgatagcagcagcgtgctgggtcacctgggagacggtaagaaaaatgggtccggctgggacgctgattctaacaggagcggtagcggttggaacgacacaacgcgaagcggaaattccggttggggcaatagtaccaatactaaggccaatcctgggacgaactggggggaaacattgaaaccaggtccccagcagaactgggcaagcaagccgcaggacaacaacgtgtccaactggggaggggcagcatccgtcaagcagacaggcactggttggataggcggcccagtgcctgtcaaacaaaaggatagttccgaggctaccggctgggaggagccctcacctccctctattaggcgaaagatggaaattgatgacgggacctctgcttggggagatccatctaactacaacaataaaacagtgaatatgtgggacaggaataatcccgtcattcagtcatccacaactactaataccaccacaaccactaccacaactacctccaatactacgcacagagttgagactcctccccctcatcaggctgggacgcaactgaatcggtcgcctctcctgggtcctgggcgcaaagtatcctctggatggggggaaatgccgaatgtgcactcaaagacagagaacagctggggtgagccctcgtctccatcaactctggtagacaatggaactgctgcctggggaaagccaccatcctccggttccgggtggggcgaccaccccgctgaaccaccagtggctttcgggcgggccggggccccggtcgccgcttcggccctttgcaagcccgcgagtaagtcaatgcaggaaggatggggctccggtggcgacgaaatgaatctgagtacttcacagtgggaagacgaggagggtgatgtctggaacaatgccgcttcacaggaatcgacctccagctgtagctcttggggcaacgcccctaagaaaggactccagaaaggaatgaagacgtcagggaagcaggatgaagcttggataatgtctcggttgattaaacagttgacagatatgggctttccccgagaacctgccgaagaagccttaaagagtaacaacatgaatctggaccaagcaatgagcgccctgctggagaagaaggtggatgttgacaaaagaggtctgggcgtgaccgaccacaacggcatggccgctaaaccactgggatgtcgcccaccgataagcaaggagagtagcgtggatagacctaccttcctggataaagatgggggcctggttgaggagcccaccccaagcccctttctaccgtcccccagtcttaaactacctttgtctcactccgccctgccatctcaggcccttggtggtattgcaagcgggctcggaatgcaaaatctcaactcttcacggcagatccctagcggcaatctaggtatgttcggcaatagcggggctgcacaagcaagaaccatgcagcaacccccacagccccctgtgcaacctctgaacagttcacaaccctcacttcgagcccaggtgcctcagttcctgtcgccccaggtgcaggcgcagcttctgcaattcgccgccaagaatatcgggctgaatccagcgttgctcacatctcccataaatccacagcacatgaccatgttaaaccagctttaccaactccaactcgcctatcagaggcttcaaattcagcagcagatgcttcaagctcagaggaacgtttcaggctctatgagacagcaagaacagcaagtcgctaggaccattacaaaccttcaacagcagatccaacagcaccagcgccagcttgcacaggcgctcctggtgaaacagccaccacctcccccccccccaccccatctatcactgcacccctctgcaggcaaatctgccatggacagttttcccagccatccccagacgcccggtttgcccgatctgcagaccaaagagcaacagtcttcgccaaataccttcgccccttatccgttggccggcctgaatcccaatatgaacgtgaactccatggatatgaccggtggtctgagcgttaaagatccctcccagagccagagtagattaccacagtggacacatcccaatagcatggacaacctgcctagcgctgcctctccactggagcagaaccctagcaaacacggagctattcctggcgggttgtctattggccctcctggcaagtcttccatagacgactcttatggtaggtacgatctcatccagaattccgagagcccagcctcaccccccgtggcagtaccccactcatggtcaagagctaagtcagacagtgacaagatttccaacgggtcctccattaactggccgcctgagttccatccaggcgtcccatggaaaggtctgcagaacattgatcctgaaaacgaccccgatgtgacacccggaagcgtacccaccgggccgaccataaatacaaccatacaggatgtgaaccgctatcttcttaaatccgggggcaaactgtccgacatcaagtcaacatggagcagcgggcctacatcccacacccaggcctccctgtcgcatgagctctggaaggttcctagaaattcaaccgctccaacaagacccccccccggcttaacaaatccgaagcccagctccacatggggggccagtccacttgggtggacatcatcctactctagtgggtcggcgtggtctaccgatacaagcgggaggacctcatcttggctcgtgctgagaaacctgactcctcagatcgacggttccaccttgcggacactctgtctgcagcacggacccctgattacgtttcacctgaaccttactcagggaaatgcggttgtcagatattcctccaaggaggaagccgccaaggcacagaaaagcttgcatatgtgcgtcctggggaataccaccatccttgcggaattcgccggggaagaagaagtgaaccggttcctcgctcagggacaagcattgcctcccacctcctcatggcagtcctcctccgcttcttcccagccacgtctgtcagcggctggaagttcccatggactcgtccgcagtgacgcggggcactggaacgccccttgcctgggagggaaagggtcttccgagcttttgtggggaggggtgccgcagtacagcagttctctttgggggccaccttctgcagacgactcccgggtgatcggatctccaactcctctgactactcttctaccaggggacttgctctccggtgaaagcctgtag

SEQ ID NO: 138762 - DNA, 5073 bp, Artificial Sequence
  Description of Artificial Sequence: Synthetic coding sequence
atggccaccggcagtgcacaaggtaactttacgggtcacacaaaaaaaaccaatggcaacaacgggacaaatggtgcgctggtccagtctccatcaaatcagtctgctctcggggccggtggcgcaaacagcaacggatctgcagcacgagtctggggtgtggccactggctcttccagtggcttggcacactgttcggtttccggtggagatggaaaaatggacaccatgatcggcgatggaagatctcagaattgctggggggccagtaacagtaacgcagggattaatcttaatctcaatccaaacgccaatcccgccgcatggccagtgctcgggcatgaaggcacggtggctactggtaatccatccagcatatgctcgcccgtgtccgctatcggccagaatatgggaaaccagaatggcaacccgaccggaaccctcggagcatggggtaatctgctgcctcaggaatctactgagccccagacctctaccagtcaaaacgtgagcttctccgcacagccgcagaaccttaatacagatggaccaaacaatacaaatcctatgaatagctccccaaacccaattaacgctatgcagactaatggactgcccaactgggggatggcagtcggaatgggggccatcatccccccacatctccagggcctgcctggggcaaatggctcgtccgtaagccaggtgagcggagggtctgccgaggggatcagcaatagtgtgtggggattgagtcccggcaaccccgctacgggaaattcaaacagcgggttttcacaaggaaatggcgacactgtgaactctgccctctcagccaagcagaacggttcgtcttccgcagtccagaaggaaggttctggcggtaacgcctgggattccgggccgccagcgggacccggtatcttggcgtggggccgcgggtctgggaacaacggggtgggtaacattcactctggggcctggggacacccctcccgaagcacaagtaacggcgtgaacggagagtggggtaagccacctaaccagcattcgaattctgatatcaacggaaagggctcaaccgggtgggagtctccgtctgtaactagccagaatcctacagtccaaccgggtggggaacacatgaatagctgggccaaggccgcttcatcgggaactactgcctcggaagggtctagtgatggatcgggcaaccacaatgaagggtcaacgggcagagaagggactggggagggaaggagacgggataaggggatcatcgatcagggccacattcagctgccacgcaatgatctggaccctcgagtactcagcaataccggttggggtcagacgccggtcaaacagaacacagcttgggaatttgaggaatctcccagatctgagaggaagaatgataacggtaccgaagcatggggttgcgccgctacacaagcaagtaacagtgggggcaaaaatgacggcagcatcatgaacagcactaacacttccagtgttagcggctgggttaatgccccgccggcagcagttcctgctaatacagggtggggtgattctaacaataaggcaccttcgggccccggggtgtggggggacagcatttcctccacggctgtgtccaccgcagcagccgcaaagtcaggccatgcctggtctggcgctgctaatcaagaagataagtccccaacctggggagaaccacctaagcccaagagccagcactggggcgatgggcagaggtcaaatcctgcatggagtgccggagggggcgactgggccgactcctccagcgtcctgggtcacctcggcgacggcaagaaaaatggctcgggctgggacgctgactccaaccgatccggctccggctggaatgatactacgcggtcggggaatagtggctggggcaattcaaccaacaccaaggccaaccccggcacaaattggggggagactttaaagccgggaccccagcagaattgggcgtcaaaaccgcaggacaacaatgttagcaactggggcggagccgctagcgtcaagcaaaccgggaccggttggattggtggccctgttcccgtgaagcagaaagattccagcgaagccacgggttgggaagaacccagccctccttctattcgaagaaagatggagatcgacgacgggacctctgcctggggcgacccgtcaaactacaacaataagactgtgaacatgtgggaccgaaataatcccgtgattcagtcaagcacaacaacaaataccacaactacaacaacaacaacaacctccaataccacccatcgagttgaaaccccaccaccccatcaggccggcacgcaattaaaccgcagccctctcctcggaccggggagaaaagtgagcagtgggtggggcgagatgcctaatgtgcattcaaaaaccgaaaattcctggggggagccctccagcccatccacactggtggacaatggaacagcagcgtggggcaaacccccttctagtgggtcgggctggggtgatcacccggcggaaccccccgtagcttttggccgagccggtgcccccgttgctgcgtctgccctgtgcaagcctgcttccaaatccatgcaggagggatgggggtccggcggagatgaaatgaatctcagcacctcccagtgggaagacgaggaaggagatgtttggaacaacgcggcatctcaggagtctactagcagctgtagtagttggggtaacgcccctaaaaagggtttgcagaaaggaatgaagacgagtggaaaacaagatgaggcttggatcatgagtcggctgatcaaacagctaactgacatgggctttccacgggagcccgcagaagaagctcttaagtctaacaacatgaacttggaccaggccatgtctgctctgcttgaaaaaaaagtggatgtggataaacgtggccttggcgttacagatcacaacgggatggcagcaaagcctctgggctgcaggcctcccattagtaaggaatcaagcgtggatcgccctacgtttcttgacaaagatggtgggctggtggaagagccgacacctagcccattcctgccatctccatcactgaagctgcctctctcccattctgcacttcctagccaggcattgggtggcatcgcgagtgggcttggaatgcaaaatcttaatagttcaagacagattcccagcgggaaccttggaatgttcggaaacagcggcgccgcacaggctaggactatgcagcagcccccacagccacctgtgcaacccttaaatagcagtcagccgagcttgcgcgcccaagttcctcagttccttagccctcaggtgcaagctcagctgctgcagttcgcagcaaagaatatcggccttaatcccgcactgctgacttcacctatcaacccccagcacatgactatgcttaatcagttgtaccagttacagttggcttatcagcgactacaaatccagcagcagatgctgcaggcacaacggaacgtgagtggaagcatgaggcaacaggaacagcaggtcgctcgcacaattaccaatctacaacagcagattcagcagcaccaaagacagctcgcacaggccctcctggtaaagcaaccccccccaccccccccaccccctcacttgtctctgcacccaagcgccggcaagagtgccatggatagcttccccagtcatccccagacccctgggctgccggatcttcaaaccaaagaacaacagtccagcccgaatactttcgctccctatcccctcgccgggctgaatcctaacatgaatgtaaatagtatggacatgaccggcggtctttccgtcaaagatccttctcagtcacagtcccggttgccccagtggactcatccgaattctatggacaacctacctagcgcagcctcgcccctggagcaaaacccatctaaacatggcgccatacctgggggtctgagcatcggcccacctggcaaatcctctattgatgatagctacggaagatatgatctgattcagaatagcgaatcgcctgcttctcctccagtggctgtgccccactcttggagtcgggccaagagcgacagcgataaaataagtaatggctccagcattaactggccacccgaatttcaccctggcgtgccgtggaaaggactgcaaaacatagatcctgagaacgaccccgatgtgacacccggaagcgtcccgacagggcccaccatcaacacaaccattcaagatgtgaaccgctatctgctgaaatcagggggaaaactctcagatataaagtccacttggtcctctgggccgacaagtcacacccaggcgagcctctctcatgaactgtggaaagtgcctaggaatagcaccgcacctacacgacccccccccggtctgactaaccctaagccctctagtacatggggggcctctccgcttggctggacctcctcctattcttccggaagtgcatggagcactgatacctccggaaggacgtcaagctggctggtgctccgcaacctcactccgcagatcgacggctcgacacttagaaccctttgcctgcagcacggcccgctgataacgttccacctgaacctaacacaggggaacgccgtcgtgcgctactcttccaaagaggaggcggcaaaggctcaaaaaagcctgcatatgtgcgttttaggtaatactacaatccttgctgagttcgccggggaagaggaagtgaatcggtttctggcccagggacaggcattgccacccactagtagctggcagagcagctcagctagctctcagcccaggctgtctgctgcaggatcctcccatggactagtgagatctgatgccggtcactggaacgctccctgtctcgggggcaagggttcctcagagctgttgtgggggggcgtcccacaatacagctctagtctatggggacctccatctgctgacgactctagagttattgggagtcctaccccactcactaccctgctccctggcgacctgttgagtggcgaatcactgtag

SEQ ID NO: 138763 - DNA, 5181 bp, Artificial Sequence
  Description of Artificial Sequence: Synthetic coding sequence
atggccacgggctctgctcagggtaatttcactgggcatacaaaaaaaaccaacgggaacaacggaacaaatggggccctagtccagagtccatccaatcagtccgcgctcggagccggcggcgccaattcaaatggcagtgcagcccgcgtgtggggcgtggccacagggtcctcttccgggctggcacattgcagcgtgtctgggggcgacgggaagatggatactatgatcggggatggtagaagccagaactgttggggtgccagcaacagcaacgctggcatcaatctgaatctgaatccaaatgccaatccagccgcctggccagtgttaggccacgaaggcaccgtagccactgggaatcctagcagtatttgctcaccagttagcgccattgggcagaacatggggaatcaaaatggaaacccaacaggcacgttgggagcgtggggtaacctattgccccaggaaagcacagaacctcagaccagcacctctcagaacgtgtctttttctgcccagccgcagaatctcaataccgacggccccaacaacacaaaccccatgaactcctcgcctaaccccatcaacgccatgcagactaacggtctgcctaattggggcatggctgtggggatgggcgcaattataccgccgcacctccagggactgccaggggctaatggatcatcagtgagccaagtctcaggaggttcagcagagggtatttccaactccgtgtgggggctcagcccgggtaacccggctactgggaactccaatagcggatttagtcaaggaaacggtgatactgtgaatagcgccctgagtgcgaagcagaatggaagtagcagcgcggtgcaaaaagagggatctggaggcaacgcctgggactctgggccgcccgccgggcccggcatcctagcctggggacgaggttccggaaataatggtgtcggcaatatccatagcggggcttggggacacccctcacggagcacatccaacggggtgaatggggagtggggtaagcctccaaaccagcattccaactcagacattaatggcaaagggtctactggttgggaatctccctccgttaccagccaaaatccgacagttcaacctggcggtgagcacatgaattcttgggccaaggccgccagcagcggcaccactgccagcgaagggtcttccgacggctcgggcaatcataatgagggatctacagggcgtgaggggactggcgagggtaggcgccgggataaaggcatcatcgatcagggccacatccagttgccgcggaatgacttagaccctagagtgctcagcaacacagggtggggacagacgcctgttaaacagaatacagcctgggaatttgaggaatctccacgatcagaaaggaaaaacgacaacggcactgaggcttggggatgtgccgctacccaagcatctaatagcggaggcaaaaacgacggtagcataatgaactcaactaatacctcctcggtgtctgggtgggtgaatgccccgcctgccgctgtccctgctaatacgggttggggcgacagcaacaacaaggccccctctggtcccggcgtttggggcgacagcataagtagtaccgccgtctctactgccgcagccgccaaaagtggccatgcctggtccggtgctgcgaaccaggaagacaaaagccctacctggggcgagccacctaagccaaagtcacaacactggggagacggtcagcggagtaacccggcttggtctgccggggggggggattgggctgactcatcatccgttttgggccacctaggagacggcaaaaagaacggcagtgggtgggatgcggatagtaacaggtctggcagtggatggaacgataccacccgcagcggtaacagcggctggggtaattctaccaacactaaagccaacccaggcacaaactggggtgaaactctgaaacctggacctcaacagaactgggcctctaagccacaggacaataacgtttccaactggggtggagccgctagcgtgaagcagaccggtactgggtggatcggcggacccgtcccagtgaagcaaaaagacagctcagaagctacaggctgggaagaaccctccccccccagcatccgccggaagatggagatagacgacggcacttcagcctggggggatccctccaactataataataagacagtcaatatgtgggacaggaacaatccggttatacagtcatctacaactaccaatacgaccacaactacgacgacaaccacatcaaatacgacccatcgcgtcgagacccctcctccccaccaggccggcacccaattaaaccgatctccactgctcggacccgtctcgtcaggatggggcgaaatgccgaatgtgcacagcaagactgagaacagttggggagaaccctcgagcccctctaccctagttgacaatggcaccgccgcctggggcaaaccacccagctccggctccggctggggagaccatcctgccgagcccccagttgccttcgggcgagccggagcccctgtcgccgcctcggcgctgtgcaagcccgcttccaaatctatgcaggagggatgggggtcaggaggagacgaaatgaacctgagcaccagtcaatgggaggacgaggagggagacgtgtggaacaacgcagccagtcaagaaagtacatcatcatgctcaagctggggaaatgcgcctaaaaagggcctgcagaaaggtatgaagacatctggcaaacaggacgaggcttggatcatgtcgcggctaatcaagcagttgacagacatgggattccctcgagaacctgccgaggaggccctcaagtctaataacatgaatttagaccaggccatgagcgcgctgttagaaaagaaagtggacgtggacaaaagagggctcggcgtaactgatcataacgggatggcagcgaaaccgctgggatgtagaccccccatcagcaaagagagttcagtcgaccggcctacttttctcgataaggatggcggactggtggaggagcctactccatcccccttcctcccctcaccttctctgaaactgcctctttctcattctgctctcccatcccaggctctgggcggaatcgcatccggacttgggatgcagaaccttaattcttcaaggcagattccgtccggcaatctgggaatgtttgggaattcaggcgctgctcaggcccgcaccatgcagcaaccaccccagcccccagttcagccattaaacagctcacagccctcattgagagcccaggtgccgcaatttctatcgccccaagttcaggctcagctcctacagttcgccgccaaaaacatcggtcttaatcccgccttgctcaccagtcccatcaacccccagcatatgaccatgctgaatcagctttatcaactgcagcttgcataccaacgcttacagatacagcagcagatgctgcaggcccagaggaatgtctccggaagcatgcgccaacaagagcagcaagtagctaggacaatcaccaacctccagcagcaaattcagcagcaccagaggcagctcgcccaagcacttctggtgaagcaaccaccacctccccctcccccacctcacctttcactgcatccatccgcagggaaaagcgcaatggacagcttcccatcgcatcctcaaacccccggcctgcctgacctacaaaccaaagaacagcagtcatctcctaacacgttcgcaccgtaccccctggctgggctcaatcctaacatgaatgtaaattcaatggatatgactggaggcctgagtgtgaaagacccttctcagtcacaatcacggcttccccaatggacccacccaaacagcatggacaatctgccgagcgctgcaagtccccttgagcaaaacccctctaaacatggcgccataccgggcggcctgtccatcggccctccggggaagtctagcatcgatgattcgtatggtagatatgacttgattcagaattctgaaagcccagccagccctcctgtcgctgtacctcacagctggtctagagctaagagcgactcggacaagatttccaacggatcttcaatcaattggccaccagagttccacccaggcgtcccatggaagggactgcagaatatcgatcctgaaaatgaccccgacgtgactcccggcagcgtaccgaccggacccactataaacaccacaattcaggacgttaaccgttacttgctgaaaagcggaggctccagcccaccctcatctcagaatgctactcttccctccagcagcgcatggcccctgagtgcttccggttactcttcttccttttcttccatagcttccgcacctagcgtggcaggtaagcttagcgatatcaagtcaacttggtcttcaggccctacatcacatacccaggcctctctatcacacgagctgtggaaggtccctcggaactctacagctcccactcggcctcccccagggctgaccaatccgaagccttcttccacatggggagcctcacccctgggatggacgtcttcctactcttccggatccgcctggagtaccgacaccagcggtcgcacatcctcctggcttgttttgaggaacctcacccctcagattgatggtagcacgctaagaaccctgtgtctccagcacggacccctcatcacttttcatctgaatttaacacaaggcaatgcagtggtccgctatagctccaaggaggaagcagccaaagcccaaaagtctctgcacatgtgtgttctgggaaacacaactattctagcagagttcgcaggcgaggaggaggtgaacagatttttagcccagggccaggctctgcctcctacctcatcctggcagtcatcctctgcctcaagccagccccgtctaagtgcagctggatcttctcacggattggtgcggagcgatgccggccattggaatgctccatgtctgggcgggaaaggcagtagtgagttgctttggggtggggtcccccagtattcttctagcctttggggacccccatccgccgatgattcaagggttataggatccccaactcccctgaccactttgttgcctggcgacttactgtcaggggagtcgctttag

SEQ ID NO: 138764 - DNA, 1959 bp, Artificial Sequence
  Description of Artificial Sequence: Synthetic coding sequence
atgggaggatggaaagggcccgggcaacggcgcgggaaagagggacccgaagctcgccgacgcgctgctgagagaggcggcgggggaggcggcgggggggtgcccgctcccaggtcacctgcccgagaacccagacctcgctcatgcctcctgctgccaccaccctggggcgccgccatgacgcccgacctcctcaactttaagaaaggttggatgagtatcctcgatgaaccaggggaacccccatctccctctctgaccaccacctccacctctcagtggaagaaacactggttcgtgctgacagatagctctctcaaatattaccgcgattccaccgctgaggaagctgacgagttggacggtgagatagacttgcgttcttgcactgacgtgacagagtacgcagtgcagaggaactatggatttcagatacacacaaaggatgccgtgtatacgctttccgccatgacaagcggaatccgcaggaactggattgaagcgctgaggaagacagtcaggcctacgtctgctcctgacgtgactaaactgagcgatagcaataaggagaacgctctgcattcctactctacccagaagggcccgttgaaagcaggcgagcaacgggccggcagtgaagtcatttccagagggggacccaggaaagccgatgggcaaagacaagcgctcgactacgtggaactgtcccccctgacccaggctagcccacaaagagcccgcacacccgcgaggaccccagatcggcttgccaagcaagaggagctggaaagagacctggcacagcgatctgaagagagacggaaatggtttgaagctacagattcccgcacccctgaagttcctgctggtgaaggacctaggagggggcttggagccccactgaccgaagaccaacagaatagactgtctgaggaaattgaaaaaaagtggcaggagctggagaaactgccactccgggaaaataagcgcgtgcctttaactgccctcctcaaccagagccgcggggagcggcgcggacctccgtctgatgggcatgaagctctggagaaagaagtccaggctttgcgcgcccagctggaggcctggcgcttgcaaggggaggctccccagtcggcccttcgctcacaggaggatggacacatcccccccgggtatatttcccaggaggcttgtgagcggagtctggccgaaatggagtcctcccaccagcaggtaatggaagagctgcagaggcatcacgaacgagagctgcagagactgcaacaagagaaggaatggctgttagctgaagaaaccgcagccaccgcctcagccatcgaagccatgaaaaaggcctatcaggaagagcttagcagagagctctcgaaaacaaggtcattgcaacaaggcccggacggactccgaaaacagcaccaatccgacgtcgaggcattgaaacgcgagcttcaggtgctcagcgaacagtacagtcagaagtgtcttgagatcggcgcgctgatgaggcaagccgaggagcgcgagcacactctcaggaggtgtcagcaagagggtcaggaactgctacgccacaatcaggagttacatgggcgtctgtcagaggagattgatcaactcagagggtttatcgcgtcgcagggtatgggtaacggttgtggtcgctcaaatgaacgctcctcttgcgagctggaagtccttttgcgagttaaggagaatgaactacaatacctgaaaaaggaggtgcagtgtcttagggatgaactccagatgatgcaaaaggataagaggtttacttctgggaagtatcaggatgtctacgtagagctgagtcatatcaagacgcggtcagagcgcgagatagagcaactcaaagagcatttgcggctggcgatggctgctctgcaggagaaagagtctatgcgaaacagtctagccgaatag

SEQ ID NO: 138765 - DNA, 7098 bp, Artificial Sequence
  Description of Artificial Sequence: Synthetic coding sequence
atggaggaagtgcccggggatgctctgtgcgaacacttcgaagccaacattctgacacaaaatagatgtcagaattgctttcacccagaggaagcacacggagcccgttaccaggagttgcgcagtccatccggagcagaagtgccctactgtgatctgcctaggtgtccacctgcccctgaggaccccctgtctgcctcaaccagcgggtgccaatcagtagtggaccccggcctgcgccccggacccaagcgggggcctagcccctccgccggcctgcctgaggaggggcctaccgcagctcccaggtctcgatccagagagttagaggctgtcccctatctggagggcctaacaacctctctgtgcggttcctgcaacgaagaccccggctcagacccgactagctcaccagatagtgcaaccccagatgacacatcaaattctagctctgtcgattgggataccgtcgaaagacaggaggaggaagcgcccagttgggacgagctggcagtgatgattccccggaggcctagagaagggccgagagccgatagctcccagcgtgcgccatccctgttgaccaggagtccggtcggcggagatgcagccggacagaaaaaagaggacaccggaggtgggggccgtagcgcaggccagcattgggcacgcctgcgaggcgagtccggcttgtcgcttgagcgccatcggagcacactcacacaggcgagttcaatgacaccacacagcgggccccggtctacaacttcccaagccagtccggcccagcgcgataccgcccaggccgcctctacacgcgagatcccccgagccagctctccccacaggatcacgcaaagagacacatcaagagccagctccacccagcaagagatctcccgggcttcttcaacacaacaggaaacatcccgggcctctagcacccaagaggacacccctagggcatcaagcactcaggaggatacccccagagctagttccacccaatggaacactccgcgagcgtcctctcccagtcggtctacacaactcgacaaccctcggacctcatccactcaacaagacaatcctcaaacaagtttccctacatgtacacctcagagggagaatccaagaacaccttgtgtccagcaggacgacccgcgggcctcaagccctaatcggacaacccagagggagaactctcggacttcgtgtgctcagcgagataatccaaaggcttcccggacaagctctcctaaccgcgctacaagagataacccaagaactagttgcgcccagcgggacaaccctagggccagtagcccgagcagggcgaccagggataacccaaccacgtcttgcgctcagagggacaatcctagggcaagccgcacaagcagcccgaatagggccacccgcgataacccgaggacatcttgcgcccagagagataatcctcgggcctcgagtcccagcagggccaccagagataacccaacaacatcatgcgcccagagagacaaccccagagcctcaaggaccagctccccaaaccgagcaacgagggacaacccccgaacatcctgcgcacagagagacaaccctcgtgcatcaagcccaaacagagccgctcgcgataaccccaccacaagctgcgcccagagagacaacccacgggcatcaagaacgtcgtcacctaacagagcgactagagacaacccacgaacgtcttgtgcgcaacgagataacccgcgagctagctctcctaatagggcaaccagagacaacccaacaacaagctgtgctcagagggataacccccgcgcaagccgcactagttcccccaatagagcaacccgcgacaacccacgcactagctgtgcccagcgcgataacccgagagcttcctctcccaacaggactacacagcaggacagtccaagaacttcatgtgcgcgacgggacgatcccagagcctcttcacccaaccggacgatccagcaggaaaatccgaggactagctgtgcccttagggataatcccagagcaagttcacctagcagaactatacaacaagaaaatccacgcacgagttgtgctcaaagggatgacccccgggcatcctcccctaatcgcacgacgcaacaggagaaccctaggacatcctgtgcacggcgcgataaccctcgtgcaagcagtagaaataggactatacagcgcgacaaccccaggacaagctgtgcgcagcgtgacaatcccagggccagttcacctaatcgcacaattcagcaagagaacctgaggacctcctgcaccagacaggataatcctaggacaagctcacccaatcgggccactcgcgataatcccagaaccagttgtgcgcaaagggacaacctgagagcgagctctcccatacgagcaacgcagcaagataacccgcgcacctgtattcagcaaaatatacctcgctcatcttccacccagcaagacaatccaaaaacatcatgcacaaagcgcgacaacctccggccaacctgcacgcagcgagaccggacacagagtttctcatttcagcgggacaacccaggtaccagcagctcccagtgctgtacacaaaaagagaatttgcgcccttcttcaccccacagaagtactcagtggaacaatcctcggaactcatcgccgcatcgcactaacaaagatattccttgggcatcctttccgctgaggccaactcaatcggatggccctaggaccagctcaccaagccgctcaaagcaaagcgaagtgccatgggccagcatcgctctccggcccacacagggggatcggccacagacgagtagccccagccgccctgcccagcacgaccctccgcaatcttcgttcggccctacccagtacaatcttccgtcacgcgccacgtcgtcttctcacaatcccggacatcaaagcacatcccggacctcctcaccagtctaccccgctgcctacggtgcacctctcacgtcccccgagccatcccaacctccctgtgcagtgtgcatcggacacagagacgcccctcgggcctcaagccctccccggtatctgcagcacgacccattcccatttttccctgagcccagagcacccgagtcagagccgccacaccatgaacccccgtacattccacccgccgtctgcattggtcatcgcgatgcgccaagagcttcaagccctcctagacacacacagtttgacccttttccttttctgcccgatacctcagatgctgagcaccaatgccagtccccccagcacgaaccactgcaactgcctgcccccgtgtgcataggctacagagatgcacctcgcgcttctagcccccctcggcaggcccctgagcctagtcttctcttccaagacctgcccagagcaagcacagagtctctggtgccatctatggattccctgcatgaatgccctcatatccctaccccggtttgcatcgggcaccgggacgccccatccttctcaagtccaccccgccaggcccctgagccttcccttttcttccaagatccgcctggcacgtccatggaatccttggcgcccagcaccgacagtctacatggctcacccgtactcatcccacaggtgtgcatcggccatcgggacgctccacgcgcgtcctcccctccccggcatccgccatcagatctcgcattcctcgctccatcaccgtctcccgggtcatccggtggatcccgtggaagtgcgccacccggggaaacacgtcacaaccttgaaagggaggagtatactgtgctggctgatttgcccccgccccgcaggttggcacagcgacaaccggggccacaggcccagtgctcaagcggcggcagaactcacagtcctggccgtgctgaggtggaacgtctcttcgggcaggaacggcgcaagagcgaggctgccggtgcattccaggcccaggatgagggcaggtcacagcagccctcacaaggccagagccaactgctgcggcgccagtcctctcccgctccgagcagacaggttacaatgctcccggcaaagcaagccgagttaacccgcaggagtcaggcagaacctccgcatccatggtcaccagagaaacgccctgagggtgaccgacagctgcagggctcacccctgccccctcggaccagcgctcgcacgcctgaacgtgaactgaggacccagagaccactggagagtgggcaagccggcccacgacagccgctaggcgtgtggcaaagccaggaagagcctcctggatcccagggcccgcaccgccatttggaaagatcttggtcctcccaggagggggggctaggtcccggaggctggtggggctgtggagagcccagcttgggcgcagccaaggccccagagggggcatggggtggcacgtcccgggagtataaggagagctggggtcagccggaagcttgggaggaaaagccgacccacgaactcccaagggagctgggtaagcgtagtccacttacctcacccccggaaaattggggaggaccagcagaaagcagccaatcatggcacagcgggactcctaccgcagttggttggggtgcggagggagcctgtccctaccctcgaggatcggagcggagaccagaactggattggagagatctgcttgggctgctgcgcgccccgggtgagggtgtttgggctcgcgtgccttccctggattgggaagggctcctcgagctcttgcaggcaagacttcccaggaaagaccctgcaggacatcgcgatgatttagcccgagctcttggtccagaactcggacccccaggaactaatgatgttcctgaacaggagtcccacagccaacctgaaggctgggcagaagcgactcccgttaacgggcactcccccgcgcttcaatcacagagtcccgttcagctcccttcacccgcatgtacatctacgcagtggccaaagattaaggttacccggggtcccgcaaccgccactcttgccggcctggaacagactggccctctcggaagtagatcgaccgcaaaagggcccagcctcccggagctgcagttccagcccgaagagcccgaagaaagtgaacctagcaggggccaggatcctctgacggaccagaagcaggcagattccgccgataaacgccctgccgaggggaaggcggggagcccactgaaaggcagactggtgacttcttggcggatgccaggcgatagacccacactgttcaatcctttcctgcttagcctcggcgtcctgaggtggcgcaggccagaccttctgaactttaagaaggggtggatgtctattctcgatgagcccggcgagcccccctctcctagcctaactacgacttctacttcacagtggaaaaagcactggttcgtgcttacggattcaagcctgaagtactatcgtgatagcaccgcagaagaggcagacgaactggacggggaaatcgatctgcgctcctgcaccgatgtgacagagtatgcagtgcagcgcaattatggattccagattcacactaaggacgctgtgtatactctttccgccatgacttctggcattcgcaggaactggatcgaagcattgcggaagaccgtgcggcccacatccgccccggacgtgaccaagctgtcagatagtaacaaagaaaacgcgctacacagttacagcacccagaaggggcccttgaaggctggcgagcagagggcagggtccgaagtaatcagtcggggcggacccagaaaggctgacgggcagagacaggctcttgactatgtagagctgtctcctcttacccaagcatccccacagcgcgcccggaccccagccagaactcccgaccgactggccaaacaggaagagctggagagggacctggcccagcggagcgaagaacgcaggaagtggttcgaggcgaccgactctaggacccctgaggtcccagccggggaggggccaagacgaggactcggcgcccccttgactgaagaccagcagaaccgcctgagtgaggagatcgaaaagaaatggcaggaacttgaaaagctgcccttacgcgaaaacaaacgcgtgcctctgactgcactcctcaatcagagtagaggagagcggcggggtccaccttcagacgggcacgaagccctggagaaagaggtgcaggccctcagggctcaactggaagcatggagactacagggtgaggccccccagtccgcactgcggagtcaagaggacggacacattccccccggttacattagccaagaagcatgtgaaagatccttagctgaaatggagtccagtcatcagcaggttatggaggaattacagcgtcaccacgagcgggagttgcaaaggctccagcaggagaaggaatggcttctggctgaggagaccgccgcgactgcctcggctatcgaggccatgaaaaaggcataccaggaggagctttcacgagaactgagtaagaccagatctctgcagcagggtcccgacgggctccggaagcagcaccagtctgacgtggaagccctcaagcgggaactgcaggtgctctctgagcagtactcacagaagtgtttagaaattggggctctcatgagacaggctgaagagcgcgagcatacgctgagacgctgtcagcaagaaggccaggaactcctgaggcacaaccaggagctgcatggtaggttaagcgaagaaatcgatcaattacggggcttcattgcctctcaggggatgggtaacgggtgtggacgaagtaacgaacggagctcatgcgagctggaagttctcctgcgcgttaaggaaaatgagttgcagtatctaaagaaggaggtgcagtgcttgcgggacgagctgcagatgatgcagaaggacaaaaggtttactagcggaaagtaccaggatgtttatgtggagcttagtcatataaaaacccgatcagagcgggaaattgaacagctgaaagagcatctgcgcttggcgatggctgcgcttcaggagaaagaatccatgcggaactctctcgcggagtag

SEQ ID NO: 138766 - DNA, 1296 bp, Artificial Sequence
  Description of Artificial Sequence: Synthetic coding sequence
atgggaggctggaagggtcccggacaacgacgcggcaaagagggaccagaggcgcgtagacgggcagctgaacgcggcggcggtgggggtggggggggcgtccccgcgccacgttctcccgcccgcgaaccccgccctcgctcatgtttgcttttgcccccgccttggggagccgctatgacccctgacctactgaacttcaagaaggggtggatgtccatcctggacgagccaggcgaacctcctagcccttccctgacaaccactagcacctcccagtggaaaaaacattggttcgtgctgactgactcaagcttgaagtattatcgcgatagcaccgccgaagaagctgacgaactcgatggcgaaattgaccttcgatcttgtactgacgttaccgagtacgcagtgcagcggaactatggctttcagatacacactaaggatgccgtctacactctgtctgctatgacatctggcatcaggagaaattggatcgaagctcttcgcaaaacagtgaggccaaccagtgctccagatgtaacgaagttatccgattcaaataaggagaatgcactccatagctacagcacccagaagggaccgctcaaggccggcgaacagagggcaggcagcgaggtgatcagtcggggaggacccagaaaagccgacggccagagacaggcacttgactatgtcgagctgagcccccttacacaggcatccccgcagcgcgctcggacgcctgctagaacacctgataggctggccaaacaggaggagctggaacgcgatctcgcccagcggtctgaggaaaggcgcaagtggtttgaggcaacagacagtcggacccccgaagtgccagccggtgaaggcccccggcgcgggctgggcgcgcccctcacggaggaccaacagaacaggctcagcgaggagattgagaaaaaatggcaggaactggagaagcttcctctgcgcgagaacaaacgcgtgcctttgaccgcactgctcaatcagtctcgcggagagcgtaggggaccgccctccgacggccacgaagccctggagaaggaggttcaggctctcagggcccagctggaagcttggaggctccagggcgaagctccgcaaagtgcactgcggagccaggaagatggtcacattcccccaggatatatttctcagctcgtcggcgtgatcacagtgcccgtgttgcaaactcgccctttgtcaagcgagcgcttgtgtgacctgccaaaggttacacccccagctgggttgaagggcggaatctag

SEQ ID NO: 138767 - DNA, 5070 bp, Artificial Sequence
  Description of Artificial Sequence: Synthetic coding sequence
atggaggaagtaccaggagacgccttatgtgagcattttgaggctaacatcctcacccaaaataggtgccaaaactgcttccatcccgaggaggcccatggcgcccggtatcaggaactgcggagcccttccggtgcagaggtgccttattgtgatttgccccgctgtcctccagcacctgaggacccgttgtccgcttccacttccgggtgccagtctgtcgttgaccctggactgcgaccgggccccaagagaggacccagccctagcgcagggctccctgaggagggcccgaccgccgctcctaggtcgaggagtcgggagctggaggcagtgccttaccttgagggtctcactactagcttgtgcggctcctgtaacgaggatcctggctccgatccaacatcttctccggacagcgcaacacccgatgacaccagcaactcctctagtgtggactgggataccgtggagaggcaggaggaggaggctccgtcttgggatgagttagcagtgatgattcctagaaggcctcgggaggggccacgagctgatagctcccagagggctccaagtctgctcacacgcagcccagtgggcggcgacgccgctgggcagaaaaaagaggatacagggggaggcgggcggtcagcaggccagcattgggcgcggctgaggggagagagtggtctatccctggagcgacacagatccaccctgactcaggcttctagcatgactcctcatagcggcccaaggagtactacaagccaggcatctcctgcacagcgcgatacggcccaagccgcatcaactcgggagattcctagagcatcatcccctcacagaatcacgcaacgggacacctcccgcgcctcctccactcagcaagaaatatcccgcgcctcttccactcagcaggagaccagcagagcctcaagtacacaggaggacaccccgagggcctcctctactcaggaggatacgcctcgcgcatcctccactcagtggaacaccccgcgcgcctcctctcccagccggtccacgcagctggacaaccccagaacgagtagtacccagcaggacaatcctcagacctccttccccacttgtactccccaacgtgagaatccacgcactccatgtgtccagcaggacgatcctcgggcctctagccccaaccgaacaacccaacgtgaaaactctagaacttcatgtgctcagagggataaccccaaagcttcccggacttcttccccaaatcgcgcaacaagagacaatcccagaaccagctgcgcccagagagacaacccgcgtgcatctagcccatcacgcgctacccgcgacaatcctacgacaagctgcgcccagagggacaatccaagggcaagtcggaccagctctcccaatagggctactcgagacaaccccagaacttcttgtgcacagcgcgataatcctcgcgccagtagcccaagtcgggcgacaagggacaacccgactacctcctgtgcgcagcgggataaccccagggcctccaggacctcttccccaaatagggcgacacgcgacaatccaaggacctcttgcgcgcaaagagacaaccctcgggcatcaagtcccaatcgcgccgccagagataacccaaccacctcctgtgcccaacgtgataatccgcgggccagccgaacctcaagtcctaaccgagctacaagagacaacccacggaccagttgcgcccagagggacaaccctcgggcttcctcccccaatagagcaacccgcgacaatcctaccactagctgtgcacagagggataatcctcgggcctctagaaccagctcccctaatcgcgctacccgtgataatcctcggacttcctgtgctcagagagacaatccgagagctagctctcccaataggaccactcaacaggactcacctagaacatcctgtgcgcggcgggatgatcctcgagctagctctccaaacaggaccattcagcaggagaacccaagaacttcttgtgccctgagggataacccccgggcctctagcccgtcccgcactatacagcaggaaaaccctagaacctcctgtgctcagagagacgatcctcgcgccagcagtccaaacaggacaacccaacaggagaacccgcgaactagttgcgctagacgcgacaatccccgggccagctccagaaatcggaccattcagcgggacaatcccaggacaagctgtgctcaacgggacaaccccagagcctcctctcccaacagaaccatacagcaagaaaacctgcgcacgagctgcactaggcaggacaatccacgtacctcatcacccaacagagccacacgcgataacccaaggacgtcctgtgctcagcgagacaacttgagagcctcaagccccattcgcgcgacacagcaagacaacccaagaacctgtatccagcaaaacatcccacgcagttctagtacccagcaggacaaccccaaaacttcttgtacaaagagagacaatctgcggcccacctgcacccaacgggatagaactcagagctttagtttccagagggataatcccggcacatcctctagccagtgttgcacacagaaagagaacctgagaccctccagcccacacagaagtactcagtggaacaaccctcggaattctagtcctcatagaactaacaaagatatcccatgggcgtcctttccacttcggcccacacagagcgacggcccgcgcacatcatctcccagccggagcaagcaaagcgaggttccgtgggcctccattgctctaagaccaacgcaaggcgatcgccctcagacatcctcgccgagccggcccgcgcaacatgatccaccacagagtagcttcggcccaacacagtacaacctccccagtcgggccacctcatccagtcacaaccccggtcaccaatctacaagtcgcacatcatctccagtgtatcccgccgcgtatggggccccactgacttcgcccgagcctagccagcctccatgtgccgtgtgcattgggcacagagatgccccacgagctagctcgccaccacgttatctacagcacgatccttttccttttttcccagaacctcgagcacccgagtcagaaccccctcatcacgagcctccatacattccgcctgccgtttgtatcggccaccgcgatgctccacgcgcatcctctccccctcgccacacgcagttcgacccatttcccttcttgccagacacttccgatgccgaacaccagtgtcagtccccacagcacgaacctcttcagcttcccgcccctgtgtgcatagggtatcgcgatgcccccagagctagttccccaccgcgccaagcgcctgagcccagtctattattccaagacttgcctcgtgcatcaacagagtccctcgtcccctccatggacagcctgcacgagtgccctcacatcccaaccccagtgtgtattggccacagagatgcccccagcttttcttcaccccccagacaggctcctgagcccagtcttttttttcaggaccccccgggcacttctatggaatccttagcacccagtaccgattcactgcatggaagcccagtcctgattcctcaggtctgtataggtcatagggacgcccccagggcctctagcccgccgcgtcatcctccctcagatttagctttcttggcgccatcgccctctcccgggtccagcggaggctcgcggggatctgccccgccgggggagacaagacataatctcgagagagaggagtatactgtactggctgacctcccccctccccggcgactagcacagagacagcccggccctcaggcgcagtgtagctctggaggccggacacactctcctggaagagccgaagtcgagcggctcttcggccaagaaaggagaactatgctgccagccaaacaggctgaattgacgagaaggtcccaggccgaacctccacatccttggagccctgaaaagagacctgagggtgacaggcaactccaagggagccctttacccccgcgcacgagcgcgcggacccctgaacgggaattgcggacacagcgacctcttgaatcaggacaggctggacctcgccagccccttggggtttggcaatctcaggaagaacctccagggagccagggcccacatcggcatctcgaacggagctggtcctctcaggagggaggacttggccctggcggatggtggggctgcggtgagcctagtctgggtgccgccaaggctcctgaaggcgcttgggggggtaccagccgagaatataaggagtcatgggggcaacctgaggcctgggaagagaaacccactcacgagctccctcgggagctggggaagcggtctcccctgacaagcccccccgagaattgggggggacctgccgaaagcagccagagttggcactccgggactccaacagcagtagggtggggcgcggagggcgcctgcccctatcctcgcggatcagagcgccgccctgagctcgactggcgggaccttctgggtctgctgagggcccctggagagggggtctgggcaagggtcccatctctggactgggagggtctgttagagctgcttcaggcgcgactccccaggaaagatccagccgggcatagagatgacctggctcgcgccctcgggcccgagctgggacctccagggactaatgatgtgccagagcaagagagtcactcccagccagaaggctgggccgaagccacaccagttaatggtcactcgcctgcactgcagagccagtctcccgttcaattgccctcaccggcttgtacaagtacgcaatggcccaaaattaaagtgaccagaggcccagccacagccacccttgctggcctggagcagacaggacctctgggcagccgctccactgcaaagggtccatcgcttcctgaactgcagtttcagcctgaggaacccgaagagtccgagcccagcagggggcaggatcccttgaccgaccaaaagcaagctgactcatag

SEQ ID NO: 138768 - DNA, 771 bp, Artificial Sequence
  Description of Artificial Sequence: Synthetic coding sequence
atgtctatcctggacgagccgggtgagcctccaagcccttccctcacaaccacgtcgacctcccaatggaaaaagcattggttcgtattaactgacagctctttaaagtattaccgggactcgaccgccgaggaagccgatgaactggatggcgagattgacctgcggagttgtactgacgtaaccgagtacgccgttcagagaaattacgggttccagattcacactaaggacgccgtttatactctgtcggccatgacctccggcattcgtcgtaactggatcgaagcactaaggaagacggtgcgtccaacttctgccccggatgttactaaactcagtgatagcaacaaggaaaacgctctccatagttacagcacccaaaaggggcccctgaaagccggagaacagagagcgggctccgaggtgatttctcgtgggggacccaggaaggctgacgggcagcgccaggccttagattatgtggagctgagcccccttactcaagcgtctccccagagagcaaggacacctgctcgcacgcctgatcgccttgctaaacaggaggagctggagcgggacctggcacaacggagtgaagagagaagaaaatggttcgaggccaccgacagccggactcccgaggtgccagcgggagagggaccaaggcgcggattgggagcccccctcaccgaagatcagcagaaccggttgtccgaagagatcgaaaaaaagtggcaggaactggagaaactccctctgcgagagtag

SEQ ID NO: 138769 - DNA, 252 bp, Artificial Sequence
  Description of Artificial Sequence: Synthetic coding sequence
atgagtatcctggatgagccaggcgagccacccagtcccagtttgacaactacttcaactagtcagtggaaaaaacactggttcgtgctgactgattcatccttgaagtactatagggatagcacagccgaagaagcagatgaactggacggcgagattgacctccggagttgcaccgatgtgactgagtacgctgtgcagcgcaattacggattccagattcacaccaaggacgctgtctacacactgtag

SEQ ID NO: 138770 - DNA, 2577 bp, Artificial Sequence
  Description of Artificial Sequence: Synthetic coding sequence
atggcagaactttctgaagaagctcttttaagtgtcctgcccacaattcgtgttccaaaagctggagaccgcgttcacaaagacgagtgcgcatttagctttgatactcccgagagcgaaggcgggctctacatttgcatgaacacctttttgggatttggtaaacaatacgtagagagacactttaacaaaacaggtcagcgggtttatctacatctgagacgcaccagaaggcccaaggaagaggatccggccaccggaaccggcgatcctcccaggaaaaaaccaacccgactagccattggagtggagggcggctttgatctgtctgaggagaagttcgagctagacgaagacgttaagatcgtgatcctccctgattacctggaaattgctcgtgacggtttaggcgggctgcccgatattgtgcgcgaccgcgtgacctctgccgtggaagcactgctgtcagccgatagtgcctctcggaagcaggaggtgcaagcctgggacggggaagtccgtcaggtctctaagcatgcattctcactgaagcagctggataacccagcccgaatcccaccttgtggatggaaatgctcaaagtgcgacatgcgagagaacctgtggctcaacctgacagacgggagtatcctttgtggtaggaggtattttgacggctctggtggaaacaatcatgccgtcgaacactatagagaaaccgggtatcctctggccgttaagttggggacaatcacccctgatggagccgacgtctatagctatgacgaagatgatatggtacttgacccttctctagccgaacacctgtcacattttgggattgatatgctgaagatgcagaaaaccgataaaaccatgaccgagttagaaatcgacatgaatcagaggataggcgagtgggaactgattcaagaatcgggagttcctctgaaacccctcttcggacccggttacaccgggattagaaacttaggcaactcatgctatctcaactcagtggtccaggtgctgttttccattccagattttcagagaaagtacgtagataaactcgagaaaatcttccaaaatgctccaactgaccctacccaggatttttcgacccaggtggccaaactaggacatgggctgttatctggtgagtactcaaagcccgtgcctgagagcggggatggagaacgcgtgcccgagcagaaagaagtgcaagacggcattgcgccgaggatgtttaaggccttgatcggtaaggggcacccggagttcagtaccaatcggcagcaggacgcccaggagttcttcctgcatctgattaacatggtggagcgaaattgcaggtcctctgaaaaccctaacgaggtgtttcgtttcctggtggaagagaagattaaatgccttgcgactgagaaggtgaagtatacgcagcgggtggattacatcatgcaactccccgttccaatggatgctgcactgaacaaggaggaactcctcgagtatgaggagaagaagagacaggcggaggaggagaagatggcgctgcctgagctggtaagagcacaagtcccttttagtagctgccttgaagcatacggggccccagagcaggtcgacgatttctggagtaccgcgttacaggctaaatctgttgccgtgaaaactactcggtttgcaagcttccccgattatctggtgattcaaatcaaaaagtttacatttggactggactgggtgcctaagaaactcgacgtgtctatcgaaatgcccgaagagctagatatctcacaactgaggggcacaggcctgcagcccggcgaggaggagctgccagatatagcgcccccactcgtgacccccgatgagcccaagggaagtttgggcttctatggtaacgaggatgaagatagcttctgtagtccacacttttctagccctacgagcccaatgttagatgagtctgttatcattcagcttgtcgagatggggtttccaatggacgcatgtcggaaagctgtttattacacgggcaattccggcgccgaggccgccatgaattgggtgatgtcccacatggacgaccctgacttcgcaaacccgctcatcctccctggatcttctggccctgggtccacctctgctgctgctgatccaccgcctgaggactgtgtcacaacgattgtgagcatgggctttagtcgagaccaggcactcaaggcactccgtgctactaataactctctggaaagagctgtcgattggattttctcacatatagacgatctagacgcggaggccgcaatggatatctcggagggacgatcggccgccgactctatctccgagtcagtgccagtaggcccgaaagtgcgagacggcccggggaagtaccagctgttcgccttcatcagtcatatgggaacttctacaatgtgtggacattacgtatgtcatattaagaaagaggggaggtgggtgatatataatgatcagaaggtgtgtgcatcagaaaaaccccctaaggacctgggatacatctatttctaccagagggtggcctcgtag

SEQ ID NO: 138771 - DNA, 750 bp, Artificial Sequence
  Description of Artificial Sequence: Synthetic coding sequence
atggccccaagtcggaaattcttcgttgggggaaattggaaaatgaacggtcgcaagcagagcctcggggaattgatcggtacactcaacgcagccaaggtgcctgcagatacagaagtggtgtgcgctccccccaccgcctatatcgacttcgcccgccagaagcttgacccaaaaattgcagtggcagcccagaattgctataaggttacaaacggggcctttaccggtgagatctcgccaggcatgatcaaagactgcggcgccacatgggtggtcctggggcatagcgaacggcggcacgtatttggcgaaagcgatgaactgattggacagaaggtggcccacgcactcgctgagggactgggggtgatagcctgcatcggagaaaaactggacgagagggaagcgggcatcacagagaaagtcgtgtttgagcagacaaaagtgatagctgacaatgtcaaggactggtcaaaggtcgtcttggcttacgaacctgtgtgggcaatcggaacagggaaaaccgcaacccctcaacaggcccaggaagtgcacgaaaagctcaggggttggctgaaatccaacgtctctgacgctgtcgcccagagtactagaattatttacggtgggtcggtcactggggctacttgcaaggaactggcgtcgcagccggatgtggacggctttctcgtggggggcgcttccctgaagcctgagtttgtggacattattaacgccaaacagtag

SEQ ID NO: 138772 - DNA, 504 bp, Artificial Sequence
  Description of Artificial Sequence: Synthetic coding sequence
atgatcaaggactgcggtgctacatgggtggtgctcggtcactccgaaagacgccacgtgtttggagaatctgatgagttaatcggccaaaaggttgcacatgcgctggctgaaggactgggcgttattgcctgtataggtgagaagttggacgaaagagaggcagggatcaccgagaaggtcgtcttcgagcagacgaaagttattgcagacaatgtaaaagactggagcaaagtcgtgttagcttacgaacccgtctgggccattgggaccggcaagaccgccactcctcagcaggcccaggaagttcacgagaagctgaggggctggctcaagtccaacgtgagcgatgccgtggcccagagtactagaataatctacggaggctccgtaaccggggcaacctgcaaggaacttgctagccagcccgatgttgacggcttcctggtgggcggtgcctctctgaagccagaattcgtggatatcattaacgcaaagcagtag

SEQ ID NO: 138773 - DNA, 1233 bp, Artificial Sequence
  Description of Artificial Sequence: Synthetic coding sequence
atggatgtcatggaattgctggaagaggacctgacctgccccatctgctgctctctgttcgatgacccccgagtcctgccatgctcacacaatttctgtaagaaatgcctggaggggatactcgaaggttcagtgcggaactctctctggagacctgcgccattcaaatgtcccacatgtcggaaggaaacgagcgcaactggtataaactctcttcaggtaaattatagtctgaaaggcatcgtggaaaagtacaacaaaatcaagatcagcccaaagatgcccgtgtgcaaaggccacctgggacagcctttaaacatcttttgcctgaccgacatgcaacttatttgtggcatttgtgccactcgcggcgagcacacaaagcacgtgttctgttcgatcgaagacgcctacgctcaggagcgggatgccttcgaaagcctgtttcagagcttcgaaacttggcggaggggtgatgccctgtcaaggctggacactctcgagacttccaaacgtaaatcacttcagctgctgaccaaggattctgacaaagtgaaggaattcttcgaaaagctgcaacacacactggaccagaagaagaatgagatactatcagacttcgaaaccatgaagttggcagtgatgcaggcatacgacccagaaataaataagttgaacaccattctccaagagcaacgaatggcttttaatattgctgaggcattcaaggacgtcagcgagccaatcgtatttctgcagcagatgcaggaatttcgtgaaaagatcaaagtaatcaaggagacacccctccccccatctaatctccctgcgtctccgttaatgaagaattttgacacttctcagtgggaagacatcaagctggtggatgtggacaagctgagcctaccccaggatacaggcacattcatctccaagataccatggtccttctacaaattgtttctactgattcttctgttggggctggtgattgtattcggcccaactatgtttctcgaatggagcttatttgacgatctggctacatggaagggatgcctgagcaatttctctagttacctgaccaaaaccgctgattttattgaacagtccgtcttctattgggaacaagtgacggacgggtttttcattttcaatgagaggtttaaaaacttcacactggtagttctgaacaatgtagcagagtttgtttgtaaatacaagctgctctag

SEQ ID NO: 138774 - DNA, 1233 bp, Artificial Sequence
  Description of Artificial Sequence: Synthetic coding sequence
atggacgttatggagctccttgaggaggatctgacttgtcccatctgctgctcacttttcgatgatccgcgggttctcccctgttctcacaacttctgtaagaaatgtcttgagggaatccttgaagggagcgtgagaaactctctgtggcgtccggcaccatttaagtgtccaacttgcagaaaggagacctctgccacgggcatcaatagcctgcaagtgaactactccttaaaaggaatcgtggaaaagtacaataaaattaagatatcgcccaagatgccagtgtgtaaaggccatctcggacagcccctgaacattttttgcctcaccgatatgcagcttatctgcgggatatgcgccactagaggcgagcacaccaaacacgtgttttgctcaattgaggacgcttatgctcaggaaagggacgcctttgagtccctcttccagagcttcgagacatggaggcgcggcgacgctctgtcaagattggatacgcttgaaacgtctaaacggaaatctcttcagctgcttactaaagacagcgacaaagttaaggaattcttcgagaagctgcagcacactctggaccagaagaagaatgagattctgtcagatttcgaaacgatgaagctagctgttatgcaggcttatgacccggagattaacaagttgaacaccatactccaggaacaacgaatggcctttaatattgccgaagcttttaaggacgtgtccgagccgattgtgttcttgcagcaaatgcaagagttccgcgaaaagattaaggtgattaaggaaaccccattgccccctagtaatctacccgcatccccactgatgaagaattttgatacatcgcagtgggaagacattaaattagtggatgtcgacaaactgagtctcccacaggacaccggcacttttatttctaagattccttggtctttctacaaactgttcttgctgatcctccttcttggcctagtgatagtatttgggccgaccatgttcctggaatggagtttgtttgatgacctagcgacttggaagggctgtctgagcaactttagtagctacctcactaagacagcggattttattgagcaatccgtattctactgggagcaggtgaccgacggtttcttcatcttcaatgaaaggtttaagaattttactttagtggtgctgaacaacgttgcagaatttgtgtgcaaatacaaactgctgtag

SEQ ID NO: 138775 - DNA, 1224 bp, Artificial Sequence
  Description of Artificial Sequence: Synthetic coding sequence
atggagctcctggaggaggatctgacatgtcccatttgttgcagcctgtttgacgatcccagggtgctgccctgttcgcacaacttctgcaagaagtgtctggagggcatcctcgaaggttccgtgcggaattcactgtggcggccagccccctttaagtgccccacttgcaggaaggagacctccgccaccggcattaacagccttcaggttaactactcacttaaaggcatagtggagaaatacaataaaatcaaaatctcccccaagatgcccgtttgtaaagggcacctcggacaaccactcaatatcttctgtctgactgatatgcaattaatctgcgggatctgtgccacacgcggtgagcatactaaacacgttttttgctccatagaggacgcttacgcgcaggaaagggacgcatttgaaagcctcttccagagcttcgagacttggcgccgaggggatgcattgagccgacttgataccctagaaacttccaaacggaaaagcttgcaactcctcaccaaggattcagacaaggtgaaagagttctttgagaagctgcagcataccctcgaccagaagaagaacgagatcctttcagattttgagactatgaaattagctgtaatgcaggcttatgatcctgaaataaacaagctgaatacaatactgcaggaacagaggatggcttttaacatagctgaggctttcaaagatgtgtctgagcccatcgtcttcctccagcagatgcaggagtttcgtgagaagattaaggttattaaggaaactccgctaccaccatccaacctgccagcgtcccccttgatgaaaaactttgatacctcacagtgggaggatattaagctggtggacgtggacaagctgtctctgccacaggacaccggtacttttatatcaaagattccctggagtttctataaattgttcctcctcatactgctgctgggtctcgttatcgtgtttggacctacaatgtttctggagtggtcactgttcgacgatttggctacgtggaaaggctgtttaagcaatttctcctcttaccttactaagaccgcagactttattgagcagtcagtcttctattgggagcaggtgaccgatggatttttcatctttaatgagagatttaagaacttcaccctggtcgtcctaaacaacgttgccgaatttgtttgcaaatacaaactactgtag

SEQ ID NO: 138776 - DNA, 801 bp, Artificial Sequence
  Description of Artificial Sequence: Synthetic coding sequence
atggaactgctggaggaggatctgacctgccctatttgttgtagcctgttcgacgaccctagagtgttgccgtgttcacataatttttgtaagaaatgtctggagggtattttggagggcagtgtgaggaacagcctctggcgaccagcaccctttaagtgccccacgtgtaggaaagaaacatcagccaccggcataaactccctccaggtcaattactccctgaaaggcatcgtcgagaaatataataaaatcaagatctcccccaaaatgcccgtgtgcaagggccacttagggcagccactgaacattttctgcctgaccgacatgcagctgatctgcggcatttgcgctactcgaggtgagcacaccaagcatgtgttctgtagtattgaggatgcctacgcccaggagcgcgatgccttcgagtctttattccaatccttcgagacttggcgaaggggtgacgccttatcccgcctggatactcttgagaccagcaagcgaaaatccctgcagcttctgacgaaagatagtgacaaggtcaaggaatttttcgagaaattgcagcacacgcttgaccaaaaaaagaatgagatcctcagcgactttgagaccatgaagcttgctgtgatgcaggcttatgatccagagattaataaattaaacaccatcctgcaggagcaacgcatggctttcaacatagccgaggctttcaaggatgtttcagaacctatagtgttcttacagcaaatgcaggaatttcgcgagaaaatcaaggtgatcaaggagacaccttag

SEQ ID NO: 138777 - DNA, 1224 bp, Artificial Sequence
  Description of Artificial Sequence: Synthetic coding sequence
atggagctgctcgaagaggatctcacgtgccccatctgctgttctttgttcgacgatccaagagtgctgccttgtagtcacaacttttgtaaaaaatgccttgaagggatccttgagggtagcgtcagaaatagcttgtggaggcctgcccccttcaaatgtcctacatgccgcaaagagacctctgctaccggcattaattccctacaggtcaattattcccttaaaggcatagtggagaaatataacaaaattaagatctcaccaaaaatgccagtgtgtaaggggcacctaggacagcctttaaacatattctgtctgacagacatgcagttaatctgtggaatttgcgccacccgtggcgagcataccaagcacgtattctgttctatcgaagatgcatatgcccaggaaagagacgcattcgaatcactgtttcagtctttcgagacttggaggcgcggtgacgcacttagtcgccttgacactttggagacatctaagagaaaatctctgcagctccttaccaaggatagtgacaaagtcaaagaatttttcgagaagctccaacacactctcgaccaaaagaaaaacgagattttatcggatttcgagaccatgaagctcgccgtgatgcaggcttacgaccctgagatcaacaagttgaacacaatactgcaagagcagagaatggctttcaacattgctgaggcgttcaaagacgtgagcgaacctatcgtgttcttgcaacagatgcaggagtttcgcgaaaagatcaaggtaattaaggagacaccactgccaccctctaatctgcccgccagccccctgatgaaaaactttgacacatctcagtgggaggatatcaaactcgtagacgtggataagctgtccctacctcaggacactggcacttttatttctaagattccctggtctttttacaagctgtttttgcttatattgttgctggggcttgtgatcgtcttcggacctaccatgttcctcgagtggagcctctttgacgacctggccacatggaaaggctgtctatcaaacttttcttcgtatctcacaaaaaccgctgattttatcgagcagtccgtcttctattgggagcaggtcactgatgggttttttatttttaacgagaggtttaagaactttaccctggtagtgctcaacaacgtcgctgaatttgtttgcaaatacaagttgctgtag

SEQ ID NO: 138778 - DNA, 390 bp, Artificial Sequence
  Description of Artificial Sequence: Synthetic coding sequence
atggaacttctagaagaagatttaacttgtccgatctgctgttccctgttcgatgatccaagggtactgccttgttcacataacttctgcaagaaatgcctcgaaggaatcttggagggaagcgtgcggaatagtctctggcggcccgcccctttcaagtgccccacctgtaggaaagagacctccgcaactggtattaactccttgcaagtaaactattcgctgaagggaattgtagagaaatacaataagataaaaatcagtcccaagatgccagtctgtaagggccacctgggccagccccttaacattttctgcctaacagacatgcagctgatttgcggcatctgtgccacacggggtgagcacacgaagcacgtcttctgctag

SEQ ID NO: 138779 - DNA, 1224 bp, Artificial Sequence
  Description of Artificial Sequence: Synthetic coding sequence
atggagctattggaggaagaccttacttgccctatctgctgctcgttattcgacgatccacgggttctgccctgctctcacaatttttgcaagaaatgtcttgaaggaattctagagggatccgtgcggaacagcttgtggagacctgcaccatttaaatgccccacctgtcgcaaggagacatctgcaaccggaattaattctctgcaggtgaactactcacttaagggaatcgtggaaaagtacaataagatcaagatctcacctaagatgccggtatgcaaggggcacttaggccaacccctgaacatcttctgcctgacggacatgcagctgatctgtggcatctgcgctaccagaggagaacacactaagcatgtgttttgtagtatagaagacgcctacgcgcaagagcgggatgcctttgaatcgctttttcaatcattcgagacctggcgccggggcgatgcactaagccgcttagatacgttggagacctcaaagaggaaaagcctccagttactgaccaaggactcagacaaagtaaaggagttcttcgaaaagctccagcacaccctggaccagaaaaagaacgaaatcctctccgattttgaaaccatgaagctggctgtcatgcaagcctatgatcccgaaattaataagctgaacactatcctgcaggaacagagaatggccttcaatatagccgaagccttcaaagatgtgagcgagcctatcgttttcttacagcagatgcaggaatttagggagaaaattaaagtgattaaggaaactcctctgccaccgtctaacctgcctgcaagtcccctgatgaaaaattttgatacctcacagtgggaagacatcaagctggtggacgttgataagctgtccctgccccaggatactgggacattcatttcaaagattccgtggtcattttataagctgttcctgctcatccttcttctggggctagtcattgtctttggacccaccatgtttttggagtggtcattgtttgacgatcttgccacatggaagggctgcctttctaacttctctagctatctgacaaaaacggctgacttcattgagcagtctgtgttttattgggaacaggtaaccgatgggttctttatctttaacgaacggttcaagaacttcaccttggtcgtgctgaacaacgttgcagaatttgtctgtaaatataagctcctgtag

SEQ ID NO: 138780 - DNA, 669 bp, Artificial Sequence
  Description of Artificial Sequence: Synthetic coding sequence
atgaacgacctctccaaccgggtgtggagtatttctcaggagccagatccggttcagcggctgcaggcctacactgcaacggaacaggaaatgcagcagcagatgagcctgggggaactgtgccacccagtcccgcttagcttcgagcctgtgaagtcattcttcaaggggctggtcgaggccgtggagtctaccctgcagacacctctggacatcagactgaaagaatcgatcaactgccaattatccgacccctcatctacaaagcccggcacgctcctcaaaacatcccccagcccggaacgttccctgcttctcaaaagctgctgggccgcttggggcccgtgtccctgttgtgggagcaccaggtccggtaagtgttggttagtcacggcgtcaccccctgccgctacaacggggaggcttacttgccgtcggagagctcctgccggcggctgggctcggccaaccccaccgttcggagctgccggtcctcgacctcctccagcttgggccgcaaccgctagtccgggtgccagcagcgccaccaccctctcaactggaccttctaccactgcatcggctgcagcatgtggcccggcaactactagcacaggcagcgcaagcagctggacaacacgccctgcatcctccccctccaccacatag

SEQ ID NO: 138781 - DNA, 1329 bp, Artificial Sequence
  Description of Artificial Sequence: Synthetic coding sequence
atggcaggcgccgccactggctcaaggacccctggacggtcggaactagttgagggctgcggctggcggtgtccagagcatggggaccgggtggccgagctgttctgccggcgctgccggcgctgtgtctgcgccctttgtcctgtccttggggcacaccgcggccaccccgtaggtctagctctcgaggcagccgtgcatgtgcagaagctgtcacaggaatgcctcaagcagctcgcaattaaaaagcaacagcatatcgataacatcacgcagattgaggatgcgactgaaaagctgaaggccaacgcagaatcaagcaagacctggctcaaggggaagttcaccgagctacggttgctgctggatgaggaagaagccttggccaaaaagtttatcgataagaacactcaactgaccctgcaggtttatagagagcaggccgactcttgccgggagcagctggacatcatgaacgacctgtctaaccgtgtttggagtatctctcaagagccagacccagtgcagagactgcaggcttatacagctaccgagcaggaaatgcagcagcagatgagtttaggagaactttgccatcccgttcctctcagcttcgaacccgttaaatcttttttcaagggcctggtggaggctgttgaaagcacattgcagacgcccttggacatccggctgaaggagagtattaactgccagctgtctgatccttcctccactaaacctgggactctcctaaaaacatcccctagtcctgagaggtcactgctgctcaagtacgccagaactccaactctcgatccagataccatgcatgcccgattacggttatctgccgatcggcttaccgtaagatgcggcctattggggagcttagggccagtgcctgtgttgaggttcgacgctttgtggcaggtcttggcaagagattgttttgctaccggacggcactattgggaggtagatgtgcaggaggcgggggctggctggtgggtgggcgcggcatatgctagtctgaggcgtcgcggggcttctgccgccgcccgtctggggtgcaatagacaatcatggtgcttgaagagatacgacctcgaatactgggcattccacgacggtcaaagatcccgccttagaccccgggacgacctggaccgtctcggggtgtttcttgactacgaagccggcgtcctggccttctatgatgtcaccggaggtatgtcccatttgcatacttttcgcgctacattccaagagcccttatatcccgctctcaggctttgggaaggcgcaatttcgatccctcggctgccatag

SEQ ID NO: 138782 - DNA, 1329 bp, Artificial Sequence
  Description of Artificial Sequence: Synthetic coding sequence
atggcaggggccgcaactggcagtcgtactcctggaaggagtgagttagtggaaggctgcgggtggcggtgccctgaacatggagatcgcgtcgctgaactcttctgtcgcagatgtagacgatgcgtctgcgccttatgccccgtgctcggcgcccaccgaggacacccggtgggactggccctcgaggccgccgtgcacgtgcagaaactctctcaggagtgcctgaaacaactagcaatcaaaaagcagcagcacatagataatattacgcagatcgaggatgccacggaaaaactgaaggccaatgctgaatcgtcaaaaacctggttgaagggcaagttcaccgaactgaggctgcttctggacgaggaggaagcactggccaagaaattcattgacaagaatacacagctgactttgcaggtgtatcgcgaacaagccgattcgtgccgagaacagcttgacatcatgaatgatctgtctaacagagtctggtccatctcgcaggaacctgatcccgttcagcggctccaggcttatactgccacggaacaggagatgcagcagcagatgtccctcggcgagctatgccatccagttcctctttccttcgaaccggtcaagtcgtttttcaaggggctggttgaggcagtagaatctaccctgcagacccccctagatatccggctgaaggagtccatcaactgccaactgtccgacccctcctccacaaagccaggaaccctgcttaaaacgtcccctagccccgaaagaagtcttctgttaaaatatgccaggacccctacattagaccctgacactatgcatgcccgtctgcggttgagcgccgatcgcttgacagtccggtgcggccttttgggctcactaggccccgtccctgtgctgaggtttgacgcgttgtggcaggtattggcaagagactgcttcgcaaccggacgtcactactgggaagtcgacgtgcaggaggcaggggctgggtggtgggttggagcggcctatgcgtccttaagacggaggggggcgtcagctgccgctagactggggtgcaacagacagtcatggtgcctcaaacgctacgaccttgaatattgggctttccacgacggccaacgcagcagactcaggccccgagacgacctggaccgactcggagtttttctggattacgaggctggagtccttgcattctatgatgtgactggaggaatgtctcaccttcacacttttcgcgctacatttcaggagccactgtatccggccttgcgcctttgggagggagctatttctatcccacggctgccatag

SEQ ID NO: 138783 - DNA, 1221 bp, Artificial Sequence
  Description of Artificial Sequence: Synthetic coding sequence
atggcgggcgctgccacaggatcaagaactcccggtcggtccgagctagtggaaggctgcggctggcgttgtcccgaacacggagatcgtgtcgctgagcttttctgtagacgctgcaggaggtgcgtgtgcgctctgtgtcctgtgctgggtgcccatagaggtcatcctgtcggtctggcccttgaggcagccgtgcacgtgcagaagttgagccaggaatgtctaaaacagctggccatcaagaagcagcaacacattgacaatattactcagatcgaggatgccaccgaaaaactgaaagccaatgccgaatcctcaaagacctggctgaagggtaagtttacagagctacgacttctgctggacgaagaggaggctctcgctaagaaattcatcgacaaaaatacccagctaacactccaagtatatcgggaacaagcagatagttgccgggagcagctcgatatcatgaacgacctcagcaaccgggtgtggtctatctcacaggagccagatcctgtgcaacgtctccaggcctacacagcaactgagcaggagatgcagcagcagatgtccctgggggagctgtgtcacccggtccctcttagcttcgagcccgtaaagagcttttttaagggtctggtggaggccgtcgagagcaccctccaaactcccctggatatccgcctcaaagaatctattaattgtcaactcagtgacccatcatccacgaagcccggtacgttgctgaagaccagtccttcacctgagaggtctctgcttctaaagtacgcacgtaccccaacactcgatccagacaccatgcacgctcgtctgcgcctgtctgcagataggctgaccgtccgatgtggcctgctgggatccctaggccctgtccccgtactgcgctttgatgcgctgtggcaggtcctggctagagattgtttcgcgaccggcaggcattattgggaggtcgatgtgcaggaggccggcgccggatggtgggttggagctgcttatgcaagcctcaggagaaggggggcctctgccgctgcaagacttgggtgcaatcggcagtcttggtgcctcaagcgctatgacctggaatattgggcttttcatgatggtcagcggtctgcctgtggccctgccaccaccagcaccggttccgcctcaagctggacgaccagaccggcctctagcccctctacaacctag

SEQ ID NO: 138784 - DNA, 762 bp, Artificial Sequence
  Description of Artificial Sequence: Synthetic coding sequence
atggcaggggcggctaccggtagtcggactcctggtcgctctgagttagtggaggggtgcgggtggcgctgccccgagcatggcgatagggtggcagaactgttctgcagacgctgcagacgatgcgtttgcgctctgtgccccgtcttaggggcgcaccgagggcatcccgtaggcctggctttagaagccgccgtccacgtgcagaagctgtcacaggagtgccttaagcagctggcgatcaaaaaacagcaacatatcgataacattacccagattgaagacgctaccgaaaaactgaaggctaacgccgagtcctcaaagacttggctgaagggcaaattcacagagcttcgcttactgctggatgaggaagaggccttagcaaaaaaatttatcgataagaatactcagctaaccctccaggtgtatagagaacaggccgatagttgccgggagcagcttgacattatgaacgacctgtctaatcgggtgtggtcgatttctcaggagcctgatccggtgcagcggctccaggcatatacagccaccgaacaggaaatgcaacagcagatgagtctcggtgagttatgtcaccccgtacccctgtcattcgagcccgtgaagtcattttttaaggggttggtggaagcggtcgaatccacccttcagacaccgttggacatccgattgtccccgacaaaccacgcctatagtgccctgaaagtgtcttcccctaggctggtttctaataggccttag

SEQ ID NO: 138785 - DNA, 1329 bp, Artificial Sequence
  Description of Artificial Sequence: Synthetic coding sequence
atggccggagcggctaccggcagcagaactccaggtcggtccgagctggtcgaaggctgtggatggaggtgtcccgaacacggcgaccgggtggccgagctgttctgtagacgttgtaggcgatgtgtctgtgcactgtgccctgtgctgggcgctcaccgggggcacccagtggggcttgcccttgaggcggccgtgcacgtgcagaagctgtcccaggaatgcctgaagcagctggcgatcaagaaacagcagcatatcgacaatatcactcagatcgaggacgctaccgaaaaacttaaggctaacgctgaatctagtaaaacgtggctgaaaggcaagttcactgagctgagacttttgttggacgaagaagaggctctagcaaagaagtttatagataagaatacacagctgacattgcaggtgtatcgcgagcaggcagactcctgccgcgagcagctcgacataatgaatgacctcagtaatcgagtgtggtcgatctctcaggaaccagatccagtgcagcggctccaggcctacacagctactgagcaggagatgcaacagcaaatgagcctgggtgaactctgccatcccgtgccactgagttttgagcctgttaaatccttctttaaaggtctggtcgaggccgtagaaagcaccctccagacacctctcgatattaggctgaaagaaagcataaattgccagctgagcgatcccagctcaacaaagcctggaaccctactgaagacttccccctccccagaacgcagcctgctactcaagtacgcacgtacccctacacttgatcccgataccatgcacgcaagactgaggctgagtgccgaccgcctcacggtgcgctgtggccttttaggttctttggggcctgtccctgtactccgcttcgatgccctgtggcaggtgctggccagggactgttttgccacgggacgccactactgggaggtggacgtccaggaggcgggtgctggatggtgggttggtgcggcttacgcttcactcagaagacgtggcgcgtctgccgcagccaggctggggtgcaaccggcagtcatggtgtctgaaacgatatgatctcgagtattgggccttccacgacggtcagcgcagtagactccggccgcgcgatgatcttgaccgccttggagtgttcttagattacgaggcgggggtgctggccttttatgatgtgacaggcggaatgagccacctgcacacctttcgagccaccttccaggaaccactgtacccagctttacgactttgggaaggtgccatcagtatccctaggctgccctag

SEQ ID NO: 138786 - DNA, 672 bp, Artificial Sequence
  Description of Artificial Sequence: Synthetic coding sequence
atgagcgcaggcagcgacgggggggggcgacacttttgcggaggtatcaactgccagctcagtgacccttccagcaccaaacctggcaccctgttgaaaacctctccgtccccagagaggagcttgctgcttaaatatgcccggacacctaccctggatcctgatacgatgcacgcacgcttgcgcctcagtgctgacagactgacagtgagatgtggacttcttggctcacttggacctgttcccgtacttagatttgatgccttatggcaggtcctggctcgagactgttttgccaccggtagacactattgggaggtggacgtgcaggaggccggggccggttggtgggtaggtgccgcgtatgctagtttacgccgtcgcggagcctcagctgccgcaagactcggctgtaatagacagtcttggtgtctcaagcgctatgaccttgagtactgggcatttcacgatggccagaggagcagactgaggccacgggatgatctggatcgcctgggcgtttttttggattacgaggcaggcgtgctggcgttttacgacgtgactggtggtatgagtcatttacacacctttcgagctacatttcaggaaccattatatcccgcactgcggctgtgggagggcgccatctctattccccggctcccttag

SEQ ID NO: 138787 - DNA, 2316 bp, Artificial Sequence
  Description of Artificial Sequence: Synthetic coding sequence
atgcaccgctccggccgctacggtacgcagcagcaaagagccgggagcaagacagccgggcctccttgccagtggtcgcgtatggcaagcgaaggaaccaacatccctagccctgtcgtcaggcagatcgataaacaatttttaatctgtagcatttgtttagagcggtataagaaccccaaagtcctaccgtgcctgcacactttttgcgagcggtgcttgcagaattatatccccgctcattcactgacactcagctgccctgtctgccggcagacctctatattgccggagaaaggggttgccgcccttcaaaataacttcttcatcaccaacctgatggacgtgttgcagagaactccagggtccaacgctgaagagtcctccattctcgagacggtgacagcagtggccgccggaaaaccgctcagctgccctaaccatgacggaaatgtgatggaattctactgtcagtcatgcgagaccgctatgtgtcgggagtgcaccgagggtgaacacgcggaacatcctacagtcccgctgaaagacgtggtcgagcagcacaaagcctccctgcaagttcagctcgatgctgtgaataagcgtttgccggaaattgacagtgctctgcagttcatttccgagatcattcaccagctcactaaccagaaagcttcgatagtggatgatatacattctactttcgatgaactccagaaaactcttaatgttaggaagtcagtcctgctcatggaactggaggtaaactatggtctgaagcacaaagttctccaatcacaattggacactttactacaaggccaggaatctattaagagttgcagtaatttcacagcacaagcacttaaccacggcactgagacagaggttttgctcgtgaaaaaacagatgtccgagaaactcaacgaactggccgaccaggattttcctctccatccgagggagaatgaccagttggatttcatcgtcgagactgagggtttgaagaagagtatccacaacctgggcaccatactcactaccaacgctgtagcgtccgaaactgttgctacgggcgaaggcctccgacagaccatcataggccagccgatgtcagtaacaattacaacgaaggataaggacggagagctgtgtaagaccggcaacgcctaccttacagcagaacttagcacccctgacggctccgtggcagatggggaaattcttgataataagaacggcacgtatgagttcctctacaccgtccagaaagagggtgacttcacactgtctctgaggctctacgaccagcacatacgggggtcccccttcaagctaaaagtgattcgaagcgcggatgtgagcccaacaactgaaggagtaaaacggcgcgtgaagagccccggcagcgggcatgttaagcagaaggcagtgaagcgcccagcaagcatgtactctaccggcaaacgtaaggaaaatcccattgaagacgacctcatctttcgcgtggggacaaagggaagaaataaaggcgagtttactaacctccagggcgttgctgctagtaccaacggcaagatcctgattgcggactcaaataaccagtgcgtgcaaatctttagcaatgatggacaattcaagagccgcttcggaattcgcggccggagccccggccaattgcaaagacctaccggagtggcagtacatccttctggcgacatcattattgcagattacgacaataagtgggttagtatcttctcatctgatggtaagtttaaaaccaaaatcggctccgggaaactaatgggccccaaaggcgtgagcgtggaccggaatggccatatcattgtggtggataataaagcttgctgtgttttcatattccagccaaatggtaaaatagtgacccgattcggcagccggggcaatggtgacaggcaattcgccggcccacacttcgccgccgtgaactcaaataatgaaattatcattactgatttccataatcattccgtgaaggtattcaaccaggaaggggagttcatgcttaaatttggttctaacggcgagggcaatgggcagttcaatgccccgaccggggttgccgtggattccaacggcaacatcatagtggccgattgggggaactcccggatccaggtctttgacggatctggctccttccttagctatatcaatacctcagctgatcccctgtatggcccccagggattggctctgacctctgatggtcatgtagtggttgctgatagcggcaaccactgcttcaaggtatatagatacctacagtag

SEQ ID NO: 138788 - DNA, 2235 bp, Artificial Sequence
  Description of Artificial Sequence: Synthetic coding sequence
atggcgagcgaggggaccaacatcccaagcccagtggtcagacaaatcgacaaacagttcctgatatgctcaatctgtttagagcgatataagaaccctaaggtgttgccttgcctgcacacattttgtgagagatgcctgcagaactatattccagcacacagtctgacactgtcatgccctgtctgccgccagaccagtattctgccagagaaaggcgttgcagcactgcagaacaatttcttcatcacaaatctaatggacgtcctacagaggacacccggatctaatgccgaggagtccagcatcctggaaacagtgactgccgtcgcagccggaaagccacttagctgtcctaaccatgacggcaacgtgatggaattttattgccagtcttgcgaaaccgcaatgtgccgggagtgtaccgagggcgaacatgcagagcatcctactgtgcccctgaaggatgtggtggaacagcataaagcttccctccaggtacaacttgacgctgtcaataaaaggctccctgagatcgacagcgctctccagtttatcagcgagataatacaccagcttactaatcagaaggcttctatagtggacgatatccacagtactttcgacgagcttcaaaagacacttaatgtgcggaaatctgtgcttctgatggagcttgaagtgaactacggactgaagcataaagtgctccagtcacagctggacaccttgctccagggacaggagagcattaagagttgtagcaatttcactgcacaggccctaaatcatggcacagagacggaggtcctactcgtgaagaaacagatgagtgagaaattgaatgagctcgccgaccaggatttcccacttcacccgagagaaaatgatcaactggacttcatcgtcgagacagagggcctcaagaaatcgattcacaatttgggaacaatcttgaccaccaatgccgttgccagtgaaacagtggcgactggggagggactgaggcagaccatcatcgggcaacctatgtccgtcacaatcaccaccaaagataaggatggggagttgtgtaagaccggaaatgcctatttgacagccgagttgtcaactccagacgggtctgttgctgacggagaaatcttggataacaagaacggaacatatgaattcctgtacaccgtacagaaagagggagattttacactgagcctgcgattgtatgatcaacacattcgcggatctccatttaagcttaaagttatacgctcagccgacgtttctcctactaccgagggcgttaaaaggcgggtgaagtcccctggcagtggccacgtgaaacagaaggccgtaaagaggccagcgtctatgtactccactggcaagcggaaagagaaccccatcgaggacgatctgatttttagggtgggaacgaaaggaagaaacaaaggggaatttacgaacctgcagggagtggcagccagcacaaatggtaaaattctgatcgcagattctaacaatcagtgtgttcagattttctctaatgatggccaattcaagtcacggttcgggatacgtgggcgatcgcctggccagctgcaaaggccaaccggcgtggcagtacacccctctggtgatattattatcgcagactacgataataagtgggttagtatcttcagtagtgacgggaagtttaagaccaaaattggctcaggaaagctgatggggccaaagggggtttcagtggatcggaatgggcacatcattgtcgtggacaacaaagcttgctgtgtattcatcttccaacccaatgggaagatcgtgacgagatttgggtctcgtggcaatggggacagacagttcgccgggccccactttgccgccgtgaacagcaacaatgagattatcattacggacttccacaatcacagcgtcaaagttttcaatcaggagggtgagttcatgttgaagtttggttctaatggagaaggtaatggacaatttaacgcacctacaggggtcgctgtcgattcaaacggcaacatcatcgtcgccgactggggcaattctcggatccaagtcttcgacggttccggaagtttcctgtcatacatcaatacttctgcggacccgctgtacggacctcaggggctggccttaacctctgatggccacgttgtcgtggccgatagcggtaaccactgtttcaaggtctacagatatttgcaatag

SEQ ID NO: 138789 - DNA, 1428 bp, Artificial Sequence
  Description of Artificial Sequence: Synthetic coding sequence
atggccagcgcagcgagactcactatgatgtgggaggaagtgacatgtcctatttgcctggatccttttgtggagccggtgtcgatagagtgtgggcacagtttttgccaagaatgcatcagccaggtgggtaagggaggcggcagcgtctgtcccgtctgtcgacaaagattcctcctgaagaacttgaggcctaaccgccaacttgctaatatggtaaacaacttaaaggagataagtcaggaggcaagagaaggcactcagggggaaaggtgtgctgtgcatggcgaaaggttgcatcttttttgtgaaaaggacggcaaggctctgtgttgggtgtgcgctcaaagtagaaaacaccgggaccatgctatggtaccactcgaggaggctgctcaggaataccaagagaagctgcaggtggccctgggagaactgaggaggaaacaagaactggcagagaaactcgaagtggaaattgccatcaaaagggcagattggaaaaaaacagttgaaacacagaagtctcgcattcatgctgagttcgtgcaacaaaagaacttcctagtggaggaggagcagcgccagctgcaggagttagaaaaggatgagagagagcagctgagaatcttgggagagaaggaggccaaactcgctcagcagtcccaggctctgcaggaactgatctccgagttggacaggaggtgccattcatctgctttggaactcttacaagaggttataatagtgctggagcgtagcgagtcatggaacctgaaggacctggatattacctccccagagctgaggtcagtgtgtcatgtcccgggactcaagaaaatgttgcgcacatgcgccgttcatattaccttggacccagatacagctaacccttggctgatactctctgaagatagacgacaggttcgcttaggggacactcagcagtcaattccgggcaatgaagagagatttgacagctaccccatggtgttgggagcgcagcatttccacagcggcaaacactactgggaggtggacgttaccgggaaggaggcatgggatctcggcgtgtgcagggattccgttagacgaaaaggccacttcctcctttcttcaaaaagcggcttttggaccatctggctctggaataagcaaaaatatgaggctggaacctatccccagacaccgctacatctgcaggttcctccatgtcaggtcggcattttccttgactacgaggctggcatggtgagcttttataacatcaccgatcacggtagcctgatctactcattttctgagtgcgccttcacgggccctctgcggccgttcttttccccaggctttaatgatggcggaaaaaacaccgctcctttgaccctgtgcccccttaatattgggagccagggctccacagattactag

SEQ ID NO: 138790 - DNA, 1428 bp, Artificial Sequence
  Description of Artificial Sequence: Synthetic coding sequence
atggcttctgccgctaggctgactatgatgtgggaagaagtgacgtgcccaatctgtttagacccgttcgtagagcctgtgtccatcgagtgtggacactccttctgtcaggagtgcatttcgcaggttggcaaaggtggtggttccgtgtgcccagtttgccggcagcggtttcttttaaaaaacctgaggccaaacaggcagctggcaaacatggtgaacaatctgaaggaaatctcccaggaagctagagaaggtacccagggtgaacgctgcgctgtgcacggagaaaggctgcacttgttctgcgaaaaagacggtaaggccttgtgttgggtttgcgctcagtcccgcaaacaccgcgaccatgcaatggtccctctggaggaggctgcccaagagtatcaggagaaactgcaggtagccctgggagagcttagaagaaagcaagaactcgccgaaaagctggaggtggaaatagccataaaacgggccgattggaaaaagaccgtagagacacaaaaatctcggatacacgccgagtttgtccagcaaaagaatttcctggttgaagaggagcaacggcaacttcaggaactcgaaaaggacgagagagaacagctgaggatcctcggcgagaaggaggcaaagctcgctcagcagagtcaggctctccaggaattgatatccgaacttgaccgacggtgtcactcttcagcccttgaactcctacaggaggtgatcgtgttgggccctcggtcagagtcttggaatctgaaggatctagacataacgtctcctgagttacggagcgtctgtcatgtgcccggattgaaaaaaatgttgcgaacatgtgctgtccatattacattggaccctgataccgccaatccctggcttattctctctgaagaccggcgccaagtgcgtctgggggacacccagcagagcattccaggcaatgaggagcgctttgactcatatccaatggtgctgggggcacagcactttcactctggcaagcattattgggaagtagatgtcactgggaaagaggcttgggatctgggagtgtgtcgagattctgtgcggcggaagggccatttcctgctttcctctaaatccggtttttggaccatttggctgtggaataagcaaaagtacgaagctgggacatatccacagactccactgcacctgcaagtccccccctgtcaggtgggtattttccttgactatgaggcaggcatggtgtccttttacaacattactgatcacggcagtctgatctatagtttctcggagtgcgcatttaccggcccactgcgcccgtttttctctccaggctttaacgacggaggcaagaatacagcccctttgacactgtgtcccctgaacataggcagtcagggaagtactgactactag

SEQ ID NO: 138791 - DNA, 1497 bp, Artificial Sequence
  Description of Artificial Sequence: Synthetic coding sequence
atggacttttcagtgaaggttgatatcgagaaagaagtgacttgccctatttgcctggaactactgacggagcctcttagtctggactgcggacactctttttgtcaggcctgtatcactgcaaaaattaaagaaagtgtgattatctcacgaggcgaatcatcttgtcccgtttgtcagactaggttccagccagggaacctgaggccaaaccgacatctcgcaaacatcgtagaacgcgtcaaggaagtgaagatgtctccacaggaaggtcagaagcgagacgtttgtgagcaccatgggaaaaaactgcagattttttgtaaggaagacgggaaggtgatttgttgggtctgtgagcttagccaagagcaccagggccaccagacattccggattaacgaggtggtaaaggagtgtcaggaaaaactccaggttgcactccagcgactgattaaggaggaccaggaggcagaaaaactggaagatgacatcaggcaggagcgtaccgcttggaagaactacattcagatcgagaggcagaagattctgaagggtttcaacgaaatgcgggtaatcctggacaatgaagaacagagggagcttcaaaagctggaagaaggggaggtcaacgtcttggataacctggccgccgcgaccgatcaactggtgcagcaaagacaggatgccagcaccctaatcagtgacctgcagaggaggcttagaggcagctccgttgagatgctacaggatgtgatagacgtgatgaagcggtcagagagttggacgctgaagaagcctaaatcagttagcaagaagctgaagagcgtctttcgagttccggatttatctggaatgttgcaggtacttaaagaactgacagatgtgcagtactattgggttgatgtaatgctgaatcccggttccgccaccagtaatgtggctatttctgttgaccagagacaagtgaaaaccgtcaggacttgtaccttcaaaaactcaaatccatgcgacttctctgcttttggtgtattcggatgccagtatttcagcagcggcaagtattactgggaggtggacgtgtccggtaaaattgcttggattttgggagtccactcaaagatcagcagcctcaataagcgaaagagtagcgggtttgcatttgacccctccgtcaattatagtaaagtttattcaaggtacaggccacagtacggctattgggttattggattgcagaacacctgcgagtacaatgcctttgaagattcctcctcatctgaccccaaggtgctgactctctttatggctgtgccgccctgccgtatcggagtgtttttggactacgaggcaggcatagtctcatttttcaacgtgactaatcatggagcattgatttataagttcagcggttgtcggtttagccgaccagcttacccctactttaacccttggaactgcctggtccccatgaccgtgtgccctccgagttcatag

SEQ ID NO: 138792 - DNA, 684 bp, Artificial Sequence
  Description of Artificial Sequence: Synthetic coding sequence
atggacttttctgtgaaagtagacatcgagaaggaggtcacttgcccaatatgtctggagttgctcacggagcccctttcgctggactgtggtcatagcttctgtcaggcttgtatcactgcgaaaataaaggaaagcgtgatcatttcacggggcgaaagctcatgtcccgtgtgccagactcgcttccagccaggcaatctgcggccgaatcgccatttagctaatatagtagagcgtgtgaaagaagtgaaaatgagcccccaagaaggacagaagagggacgtgtgcgaacatcacggtaagaagctgcagattttctgcaaagaggatggaaaagttatttgttgggtgtgcgagttaagccaggaacatcaagggcaccagacattccgcattaatgaggtggttaaggagtgccaggagaagttacaggttgccctgcaaagactgatcaaggaagatcaggaagccgaaaagctggaggacgatatcagacaggaaagaactgcgtggaaaaattacatccagattgagcggcagaaaatcctcaaggggttcaacgaaatgagagttatcctggataatgaggaacagcgggagctacagaagctggaggaaggggaggtcaacgtgcttgacaatctcgctgcggccaccgaccagctggtgcagcaacggtag

SEQ ID NO: 138793 - DNA, 612 bp, Artificial Sequence
  Description of Artificial Sequence: Synthetic coding sequence
atggactttagcgttaaggttgacatcgaaaaagaggtgacctgtccgatatgtctggagctgctcaccgaaccactgtctctggactgcggtcactcattttgccaagcttgtatcacagctaagataaaagaatctgtcatcataagccggggagagagttcatgtccagtatgccagacccggtttcaacctggaaatctgcgacccaataggcacctagcgaatatcgttgagcgggtgaaagaagtgaaaatgtcaccccaggaaggtcagaagcgggatgtttgcgaacatcacgggaagaagttgcagatattctgcaaggaggacggaaaggtcatatgttgggtatgtgagctctcccaagaacatcaggggcatcagacttttaggataaatgaagtagtgaaggagtgccaggagaagctccaggtagcactgcagcgacttatcaaggaggaccaggaagcagagaaattagaagatgacatacgccaggagagaacagcctggaagaattatattcaaatagaaaggcagaagattctgaaggggtttaatgaaatgcgcgtgatcttggataacgaggagcaacgggagctccagtag

SEQ ID NO: 138794 - DNA, 1263 bp, Artificial Sequence
  Description of Artificial Sequence: Synthetic coding sequence
atggatttcagcgtcaaagtggacatcgagaaggaggtgacctgccccatatgccttgagctgttaactgaaccacttagcctagattgtggacattcgttctgtcaggcttgtatcacagccaaaattaaagagtctgtgattatctccagaggtgaaagctcatgcccagtatgccagaccagatttcagcccggtaatctgcgacctaaccgacaccttgccaacatcgtggagcgggtcaaagaagtgaagatgtctccccaggaaggccaaaagagggacgtctgtgaacaccatggcaaaaagctgcaaatcttctgcaaagaggacggaaaagtgatcctcgacaatgaggaacaaagggagctgcaaaaattggaggaaggcgaagtgaacgtgctggataatctggccgccgccactgatcaattggtacagcaacggcaggatgccagcacgctgatcagtgacctccaaaggaggctgcgcggcagctcggtggaaatgctgcaggatgtgatcgatgttatgaagcgctctgagtcctggacactcaaaaaaccaaagtcagtgagcaaaaaacttaaatccgtgtttagggtccccgatttgagtggaatgctgcaggtactgaaagaacttactgatgtccagtattactgggtcgacgtaatgctcaacccaggttccgctactagcaacgtcgccattagcgtggaccaacgccaagtgaaaacagtgcggacttgcacattcaaaaactctaacccttgcgacttctccgctttcggcgtctttggatgccagtatttttcctcaggtaaatactactgggaagtcgatgttagtggcaagatcgcatggatcctcggcgtgcattctaaaatctccagcctaaacaagcggaagagttcaggatttgccttcgacccatctgtgaattactccaaagtctactctagatatcggccacagtacggttattgggtgatcggtcttcaaaacacatgtgaatataatgcctttgaagactcatcgtccagcgaccctaaggtgcttaccctgtttatggctgtacccccctgcaggattggggtcttcctggactacgaagccggaatcgtgtccttttttaatgtcaccaatcatggcgctctgatctataaattctcaggctgtcggttctctcggcccgcatatccttactttaacccatggaattgcctggttccaatgaccgtttgtcctcctagttcctag

SEQ ID NO: 138795 - DNA, 930 bp, Artificial Sequence
  Description of Artificial Sequence: Synthetic coding sequence
atgcgcgttatcctcgacaatgaagagcagcgcgagctacagaaactggaggagggggaagtgaatgtgttagacaatctagctgctgctacggaccagctcgtccagcagagacaggatgcttcaacgcttatctccgatctccaacgtcgactgaggggaagctccgtcgaaatgctgcaggacgttatagatgttatgaagcggtctgagtcttggactcttaagaaacccaaatccgtgtcgaaaaaacttaagtctgtctttagggtgccagatctgtccggaatgttgcaagttctcaaagagctgacggatgtgcagtactactgggtggacgtgatgcttaaccctggtagcgccacttctaatgtggccatttctgtcgatcagcgccaggtgaagacggtgcggacatgtacattcaagaattccaacccgtgcgacttttccgcttttggagtgtttggctgccaatatttctcatctggcaagtactattgggaggtcgatgtgtctggaaagatcgcctggattctgggggtacatagcaagatttcctcgctgaataagaggaaatcaagcggctttgcgttcgaccctagtgtaaattacagtaaggtttattctcggtaccggcctcagtatggatattgggtcatcgggctgcagaacacatgcgaatacaacgcattcgaagactcgtcctcttctgaccctaaggtgctcactctttttatggctgtacccccatgcaggatcggcgtgttcctggattatgaagccgggattgtgtcattctttaatgttaccaaccatggcgctctgatctataagttttccgggtgccgattctcacgacccgcctacccctatttcaacccctggaattgcctggtgcctatgacggtttgccccccctcaagctag

SEQ ID NO: 138796 - DNA, 1893 bp, Artificial Sequence
  Description of Artificial Sequence: Synthetic coding sequence
atggcagaactatgtcccctcgcagaggagctctcatgctccatatgtctggagcctttcaaggagccagtaactacaccatgcggacataatttttgcggttcctgtctcaatgaaacgtgggcagttcaaggctccccttatctgtgcccacagtgccgggctgtgtaccaggctcgccctcagttgcataagaatacagtcctgtgcaatgtagtggaacagtttctgcaggcagatcttgcgcgcgagccgccggcagatgtctggacccctcccgcaagagcctctgccccatctcccaatgcgcaggtggcatgtgaccattgtctgaaggaggcagcagttaaaacatgcctggtatgcatggcttcattctgccaggagcacctacagccacacttcgactccccagccttccaggatcaccccctgcaaccccccgtgagagacttgctgaggcggaaatgtagccagcacaaccggttgagagagttcttctgccctgaacatagtgaatgtatttgccacatttgcctggttgagcataagacttgctcacccgccagtctgtctcaggccagtgccgatctagaggccacgctgcgccacaagttgacagtcatgtactcgcaaattaacggagcctctagagccctggacgacgtgcggaatagacagcaggacgtccgcatgaccgccaataggaaagttgagcagctccagcaggagtacactgaaatgaaagctctgctggatgcctccgagaccacgtctacaagaaagatcaaggaggaggagaagcgggtgaatagtaagttcgatactatctaccagatcctccttaagaaaaagtcagagatccagacattgaaggaggagattgagcagtcccttaccaagagggacgaattcgagtttctcgagaaggcctccaagctcaggggtatttccaccaaacccgtatacattcctgaggtggagctgaatcataaattaatcaaaggcatccatcagtctaccatcgatctaaaaaatgaactcaagcaatgtatcggccgcctccaagaacccacgccgagctctggcgatccaggtgaacacgaccctgctagtacacacaagagtaccagacccgtcaaaaaggtgtcgaaggaagagaagaagtcaaagaagcctccccccgtccctgccttgccctctaagctccccacatttggggcacctgagcagttggtagacctgaaacaagccgggctagaggcggctgccaaggccacgtcctcacatccaaattccacaagcctaaaagctaaagttctagaaacatttttagccaagtcaaggccggagctgctcgaatattacatcaaggtcattctagattacaatacagcccacaacaaggtagctcttagcgagtgctataccgtcgcttccgttgctgaaatgccccagaattataggcctcaccctcagaggttcacatactgttctcaggtcctgggcctgcactgttacaaaaaagggatacattactgggaggttgaactccagaaaaataacttctgtggcgtggggatctgctacggatctatgaacagacagggtccagagtcaaggctcgggcggaacagcgctagttggtgtgtggaatggtttaatacgaaaatttccgcctggcataacaacgtggaaaagacattaccgtctactaaagccacgcgcgttggtgtgctgttgaattgcgaccacggattcgtgattttttttgctgtggctgacaaagtgcatctgatgtacaaattcagggtggacttcacggaagctttgtatcccgctttctgggtgttcagcgccggagcaacgttgagcatctgctcccccaagtag

SEQ ID NO: 138797 - DNA, 1893 bp, Artificial Sequence
  Description of Artificial Sequence: Synthetic coding sequence
atggctgagctttgtccgctcgcagaggagctatcatgctccatctgcctggagcccttcaaggaaccagtaacgacgccctgtggtcataacttttgcggttcctgcttgaacgagacttgggccgtgcagggttccccttacttgtgtccccaatgccgggccgtttaccaagcccggcctcaattgcacaagaacaccgtgctgtgcaatgtagtggaacaatttctccaggccgatctggcacgcgagccaccagcagacgtgtggacccctccagcccgagccagtgcgccttcccctaacgcacaggtcgcttgcgaccactgtctcaaggaggccgcagtgaagacatgtctggtgtgtatggcctctttctgtcaagaacatctgcaacctcatttcgattcccctgcatttcaggatcacccgctgcagccccccgtgagagatttgcttcggaggaaatgttctcaacacaaccgtcttcgggaattcttttgccccgagcactcagaatgcatttgccacatctgtctggtggaacacaaaacctgttcccccgcttcgctcagccaggcgagcgccgatctggaggcgacactgaggcataaactgaccgtaatgtactctcaaattaatggtgcctctcgtgccctagacgacgtacgtaaccggcagcaggacgtgcgaatgactgccaacaggaaagtcgagcagcttcagcaagagtacaccgaaatgaaagccttactagatgccagtgaaaccacctctaccagaaagatcaaggaggaggaaaaaagggtgaactcaaagttcgacactatatatcagatcctgctgaagaagaagagtgagatccaaactctaaaggaggagattgaacagtccctgactaagcgggacgagttcgaatttctagagaaggcatctaaactgagagggatcagcacaaagccagtgtatattcccgaggtggaacttaatcacaagctgataaagggcatccaccagtccactatcgacttaaagaacgagctgaaacagtgcattggtcgcctacaggaaccgactccgagttctggcgaccccggggagcacgaccccgctagtacacataagtcgacccgacccgtcaaaaaggtgtctaaagaagaaaaaaagagcaaaaagccccctccagtgcccgccttgccttctaagttacccaccttcggggcgccagagcagctcgtggatctgaagcaggccggcttagaggccgctgctaaggcaacttctagccaccccaactctacctcccttaaggccaaagtgctggagacctttctcgctaagagtcgtcccgagctcctggaatattatataaaagtcatccttgattacaataccgctcataataaagtagcgctaagtgaatgttataccgtggctagcgttgctgaaatgcctcagaattatcgcccccacccccagcggtttacgtactgttcgcaggtgctgggcctgcattgctacaaaaagggcattcattattgggaagtagagctccaaaagaataatttttgtggggttgggatctgctatggaagtatgaacaggcaggggccagaaagcagactggggaggaacagcgcatcctggtgcgtggagtggttcaatacaaaaatcagcgcatggcacaataatgtggaaaaaacactgccaagcactaaggccactcgtgtgggagtgctgctgaattgcgaccatggcttcgtaatcttttttgctgtcgcggataaagtccacctcatgtataagtttcgtgttgactttacagaggcactgtaccccgcattctgggtattttctgccggggcaactttaagcatatgttctccaaaatag

SEQ ID NO: 138798 - DNA, 1077 bp, Artificial Sequence
  Description of Artificial Sequence: Synthetic coding sequence
atggcatcaggcagcgtggccgagtgtctacagcaggaaacgacatgtcctgtgtgcctgcagtacttcgcagagccaatgatgctggactgcggccataatatttgttgtgcatgtctggcccgatgttggggaaccgcagaaaccaatgtctcttgccctcagtgtcgtgagacattcccacaacgacatatgcgacctaaccggcatctggcgaacgtaacccagctggtcaaacagctccgtacagaacgcccatcaggcccaggcggggagatgggagtgtgtgagaaacatcgagagcccttgaaactttattgtgaagaggaccagatgccaatttgcgtcgtctgcgatagaagtcgggagcacagagggcattctgtgctacctctagaagaagccgtcgagggattcaaggagcagatccagaaccaactggaccaccttaagcgggtgaaggaccttaagaaacgccgaagggcgcagggagaacaagcccgggccgagttattgtctctgactcagatggaaagggagaagatcgtatgggagtttgagcagctgtaccacagccttaaagagcatgagtacagactgttggctcggttggaagaactggacttggccatctataacagcatcaacggcgccattacccagtttagctgtaacattagccacctgagcagtctgattgcgcagctggaggagaagcagcagcagccaactcgcgaactgttgcaagacataggagacaccctgtcccgcgctgagagaatccgaattccggagccatggatcactcctcccgatctgcaggagaagattcacatcttcgctcagaaatgtttgttcctgacggaaagcctcaaacaattcaccgaaaagatgcagagcgacatggagaagatacaggaactgcgcgaggcccagctttactctgtcgacgttacactggatccagataccgcatatccctccttgattttgtctgataatctccgccaggtccgatactcctatctccagcaagatcttcctgacaaccctgagaggtcacccagcaccacgtag

SEQ ID NO: 138799 - DNA, 1542 bp, Artificial Sequence
  Description of Artificial Sequence: Synthetic coding sequence
atggctagtggcagcgtcgctgagtgcctgcagcaggagaccacctgtccggtgtgcctccagtatttcgccgagcctatgatgctggattgtggccacaatatctgctgcgcctgtctggccagatgttggggaaccgccgagacgaatgtgtcgtgccctcagtgtcgagagacttttcctcaacgccatatgagaccaaaccggcacctggctaacgtaacccagctggtgaagcagcttcggacagaaaggcctagcgggcccggcggggaaatgggagtgtgtgaaaaacatcgcgaacctcttaaactctattgtgaagaggatcagatgcccatatgcgtcgtgtgcgatcgctcacgggagcaccgcggccattccgtgctgccgctagaggaagccgtcgagggtttcaaagaacaaatacagaatcagttggaccacctgaagcgggtgaaggatctcaagaaacggcggagagcgcagggcgaacaggcccgggcagaattgctgagcctgactcaaatggagcgggaaaaaattgtgtgggagttcgagcagctttatcattctctcaaagagcatgaataccgtttgctggccaggctggaagagttagacctagcaatatataatagtatcaacggagccatcacccagttcagctgcaacataagccacctgtcaagtctgatagcacaactcgaagagaaacaacagcaacccacccgggaattgctgcaagatatcggcgacactttgtccagggccgagcgcatcagaattccagagccctggattacgccacccgatctgcaggaaaagatccatattttcgctcagaagtgcctctttcttacggaatcgttaaaacaattcaccgagaagatgcagtcagatatggagaaaatacaggaactgagggaggcccagctctacagcgtggacgtcacactggacccagacaccgcatacccctccctcatactctctgataatctccgacaagtgcgctacagctatctacaacaggatctgccagacaatcccgaaagattcaacttatttccttgcgtgctgggaagcccctgtttcattgcagggcgccactattgggaggtggaagtgggggacaaggctaaatggaccataggtgtgtgtgaagatagcgtgtgtcgcaaggggggagtgacatctgccccacagaatggattttgggcagtgtcattatggtacggcaaagaatactgggcattgacttccccaatgaccgcgctgcctctgcgcacacccctgcagcgagttggcatcttcctcgattatgatgccggcgaggtgagtttctacaatgtgaccgaaaggtgccatacctttacattttctcatgcgacattctgcggtccagtccgaccatatttttccctttcctattccggtggcaaatccgccgcgccactgattatttgtcctatgtctggcatcgatgggttctctggccacgtggggaaccatgggcattctatggagacctccccctag

SEQ ID NO: 138800 - DNA, 1542 bp, Artificial Sequence
  Description of Artificial Sequence: Synthetic coding sequence
atggcctctggaagtgtggccgagtgccttcagcaggaaaccacctgcccggtgtgtctacagtattttgccgagcctatgatgctggattgtggacacaacatttgctgcgcatgtctcgctcggtgctggggaaccgcggagactaatgtgtcatgcccccagtgtcgcgaaacttttccacagcgccatatgcgccctaataggcatctcgctaatgtgacacagttagtgaaacagctgcggacagaaagacccagcggaccaggtggcgaaatgggggtatgcgagaagcatagggagccactgaaattgtattgcgaggaagatcagatgcctatttgcgtggtctgcgatagaagtagggaacataggggacacagcgttttgccgctggaagaagccgtggagggatttaaagaacagatccaaaaccagctcgaccatctcaaacgggttaaagacctgaaaaaaagaagacgggctcaaggagaacaagctagagccgaactgctgagcctgacacaaatggaaagagagaaaatcgtgtgggagttcgaacaactgtatcacagcctgaaagagcacgagtataggctactcgctcgcctcgaagagctcgatctggcgatttacaatagcataaacggcgctatcactcaattctcgtgtaatatcagtcatctgagttcactcatcgctcagctcgaggagaagcagcagcagcctactcgtgagctgctgcaggacatcggcgacacgctgtctcgagctgaacgaattcgcatccccgaaccctggattacccctcccgacctacaggaaaagatacacattttcgcccagaagtgtttgtttctgaccgaatcgctgaagcagtttacagaaaagatgcagtccgacatggagaagatccaagaattacgcgaggcccagctgtattccgtggatgtgacgttagatcctgatactgcatacccatctctcattctgtccgacaacctgcggcaagtgcggtactcctacttgcaacaggacttgccagacaaccccgaaaggttcaatctgtttccctgcgtgcttggctccccctgttttattgcaggtcgacattactgggaagtagaggtgggagataaagctaaatggactataggcgtgtgtgaggactctgtttgccggaagggcggcgttactagcgcaccacagaacggcttttgggccgttagcctttggtacgggaaggagtactgggcacttacttctcctatgacagcgctacctctgaggacccctctccagagagtgggaatcttcctcgactacgacgccggggaggtgtccttctacaacgtaaccgaaagatgccatacctttacattcagccacgccaccttctgcggaccagtacggccatacttctctttgtcctacagtggcggaaagtctgctgccccattaattatttgtcccatgagcggcatcgacggtttctcaggtcatgtcggtaaccatggtcactctatggaaacaagtccctag

SEQ ID NO: 138801 - DNA, 1077 bp, Artificial Sequence
  Description of Artificial Sequence: Synthetic coding sequence
atggccagtggcagcgtggcagagtgcttgcaacaagaaactacatgtcccgtctgtttgcagtacttcgccgaaccaatgatgctggactgcggccataacatttgctgcgcctgtctggcccggtgttggggaaccgcagagaccaacgtgtcttgtcctcagtgccgcgaaacatttccacagcgccacatgaggcccaacagacacttagcgaacgttactcagctggtgaagcaactgcggaccgagagacccagtgggccgggcggtgaaatgggcgtgtgcgaaaagcaccgggagcctctgaaactttactgcgaagaggatcaaatgccgatctgcgtggtctgtgacaggtcacgcgagcaccgcggccactctgtgctgcccctggaggaggccgtcgaaggctttaaggagcagattcagaatcagcttgaccatctgaagagagtgaaagaccttaagaagcgccggcgggcccagggagaacaagcaagggcagagctactgtcactgactcaaatggaacgggagaaaatcgtctgggagttcgaacaactctaccactcgctcaaggagcacgaatatcgcttgctagcccgcctcgaggagctggatctggcaatctacaactcaattaatggtgctattacgcagttctcctgcaacatctcacatctttcttccttgatagctcagctggaggagaaacagcagcaacctacacgcgaactattacaggacataggagacactttgtcacgggcggagcgcatacgcatccctgagccgtggatcacccccccagacctgcaggagaagattcacatcttcgctcaaaaatgtctgtttctaactgaatcattaaagcagtttacagagaagatgcagagcgatatggaaaaaattcaagaactgcgcgaagcccagctgtattcagtggacgtgacgctcgacccagacaccgcatatccgtctctcattttaagcgacaatctgcgtcaggtgaggtactcatacttacagcaggacctcccagataaccccgagcgaagtccaagtactacatag

SEQ ID NO: 138802 - DNA, 747 bp, Artificial Sequence
  Description of Artificial Sequence: Synthetic coding sequence
tgacttaaacagtttaccgagaaaatgcagtccgacatggaaaagattcaggagagcgcggacagcctggagggggggatcttggatttaggtagcgtgttgtcccacatactgccagtgtccgaactgagagaggcccaattatattccgtggacgtgaccctcgatcccgacaccgcgtatccatccctcattctgagcgacaacctccgccaggttcggtactcctacctgcagcaggacctgcctgacaatcccgagaggtttaatcttttcccttgcgtcctgggtagcccctgtttcattgcaggtcgacactattgggaggttgaagtgggggacaaggccaagtggacaatcggtgtgtgcgaggatagtgtctgcaggaaaggcggcgttacttcggcaccacaaaacggattctgggccgtttccctctggtacggcaaggaatactgggcactaacctctccaatgactgcattgcctttgagaacccctctgcagagggtgggtatttttctggattacgacgccggggaagtgtctttttacaacgtcacggaacgctgccacacttttactttctcccacgcgacattctgcggacctgttaggccctacttctcactgagctacagcgggggaaagtccgctgctcctctcattatttgcccgatgtctggaatcgatgggttttcggggcatgtgggaaatcatgggcactccatggagacttctccctag

SEQ ID NO: 138803 - DNA, 1077 bp, Artificial Sequence
  Description of Artificial Sequence: Synthetic coding sequence
atggcaagcggaagcgtggctgaatgtctccagcaggagacaacctgcccagtctgtctccagtacttcgcagaacccatgatgttggactgtggtcataatatctgctgtgcttgtctagctagatgttggggaacagctgaaacaaatgtctcttgcccccagtgtcgcgaaaccttccctcagagacatatgcggccgaaccgtcacctggctaacgtgacccagctcgttaaacagctccgcactgagaggccctcaggacccggcggagagatgggggtctgcgaaaagcaccgcgaacccctgaagctctattgtgaagaggaccagatgcccatatgcgttgtttgcgacagaagcagagagcatcgaggccactccgtgctccccctggaggaagccgtggagggctttaaggaacagattcagaaccaattagatcatttgaagcgtgtgaaggacctgaagaagcggcgtcgcgctcaaggtgagcaggcaagagcagagttgctgtcattaacccaaatggagagagagaaaatcgtttgggaattcgaacaactgtatcactctcttaaggagcatgagtataggctgttggctcgcctggaagaactagacctggctatttataattccatcaacggagccatcactcagttttcctgtaacatttcgcatctgagcagtctcatcgcgcaactggaagaaaagcagcaacagcccacaagagaacttctccaggacatcggagatacgctgtcccgagccgaacgcatccggatccctgagccttggatcactccccccgacctgcaggaaaaaatccacatcttcgctcaaaaatgccttttcctcactgagagtctaaagcagttcactgagaaaatgcagtctgacatggaaaagatacaggagctccgtgaggcccagctctacagtgttgacgtcaccctggacccagacacagcgtatccatccctgatactcagtgacaatctacggcaggttcgctattcatacttgcaacaggacctgcctgacaatcccgaaagatccccgagcacgacctag

SEQ ID NO: 138804 - DNA, 747 bp, Artificial Sequence
  Description of Artificial Sequence: Synthetic coding sequence
tagctaaagcagttcaccgagaagatgcagtctgacatggaaaagattcaggaaagtgccgactctttggaagggggaatcctggacctaggatccgtgctgtcacatatcttgcccgtcagcgaactgagagaggctcagttgtatagcgtcgacgtcaccctcgatccagatacagcctacccatcactgatccttagtgataatcttcgccaagtacgctattcctatcttcagcaggatctgcccgataacccagagagattcaacctctttccttgtgtgctgggctctccctgcttcatcgccggcagacattactgggaggtagaggtgggggataaggccaaatggaccatcggggtctgcgaggatagcgtgtgccggaaaggtggcgtcactagcgcaccgcagaacgggttctgggccgtaagtctctggtacggcaaagaatactgggccctcacatctcctatgacagcactccccctccgcacccctctgcaaagagtaggaatattcctggattacgatgctggcgaggtgtctttctacaatgttactgagcgctgtcatacatttacattttcgcacgccaccttttgtggccccgtgaggccgtacttctccctgtcctactctgggggaaagtccgcagcccccttaataatctgtccaatgtccggcattgatggattcagtggccacgttggcaaccacggacattccatggaaacatcaccgtag

SEQ ID NO: 138805 - DNA, 1077 bp, Artificial Sequence
  Description of Artificial Sequence: Synthetic coding sequence
atggcttctgggagcgttgcagaatgcctccagcaggagactacctgccctgtgtgtctgcagtattttgctgaacctatgatgctggactgtggccataacatctgctgcgcttgtctggcacggtgctgggggaccgctgaaactaatgtctcctgccctcagtgccgggagactttcccccaacggcacatgagacccaaccgacatttagcaaatgtaacacagctagtcaagcagctgagaaccgagcgcccatcaggacccgggggtgagatgggggtgtgcgaaaaacaccgggagcccttgaaactgtactgcgaagaggatcagatgcctatttgtgtcgtgtgtgaccgctctcgggagcacagggggcatagcgtcttaccactcgaggaggctgtggaaggcttcaaagaacaaattcaaaaccagctggaccacttaaaacgcgtgaaggatctgaaaaaacggcggagggcgcagggggagcaggcaagggcagagctgttgtccctcacacagatggaaagagagaaaatagtctgggaatttgaacaactctaccattctttgaaagagcatgagtatcgtctgctggctagattggaagagctggatcttgccatctacaatagcattaatggggcaatcactcaattcagctgcaatatttcgcacttatctagtcttatcgctcaactggaagaaaagcagcagcagcctactcgggaattactccaggatataggtgatacgctgtccagggccgaacgcatccgcatccccgagccctggatcaccccccccgatctccaagagaagatccacatcttcgcacagaaatgcttgtttctcactgaaagcctgaaacagttcaccgagaagatgcaatcagacatggaaaagattcaggagctgcgagaggcccagctgtattctgttgacgtaaccctagaccccgatactgcttacccttccctgatcttgtcggacaacctcaggcaggtaaggtactcttatttgcagcaggacctgcccgacaaccctgagaggagccccagcacaacatag

SEQ ID NO: 138806 - DNA, 747 bp, Artificial Sequence
  Description of Artificial Sequence: Synthetic coding sequence
taactaaagcaattcaccgagaagatgcagtccgacatggagaaaatccaagagagcgccgattctctggagggcgggatcctggacctagggagcgttctatcacatattctgcctgtcagcgagctgcgcgaggcccagttgtactcagtcgatgtcaccttagatccagacaccgcctatccaagcctgattctttctgacaatctccgacaggttagatattcatacctgcagcaggatctcccagataaccctgagcgctttaatctgttcccatgcgtgcttggaagcccctgcttcattgctggtagacactactgggaggtggaagttggcgacaaggcgaagtggacgatcggtgtctgtgaggacagtgtgtgtaggaagggcggcgtcaccagtgcgccacagaatggcttttgggccgtctccctgtggtacgggaaggagtactgggcattaacatctccaatgactgcactaccacttagaaccccgctgcagagggtgggcatattcttggattatgacgccggtgaggtgtcattttataacgtgactgaacgctgccatactttcaccttctcccatgccactttttgcggacctgtccgaccctattttagccttagttattcaggcggcaagtccgctgcccctctaataatctgcccaatgtccggaatcgacgggttctctggccatgttgggaaccacggtcacagtatggagacttccccttag

SEQ ID NO: 138807 - DNA, 750 bp, Artificial Sequence
  Description of Artificial Sequence: Synthetic coding sequence
atggccagtgggagcgttgccgagtgtctccagcaggaaaccacatgtcccgtttgcctccagtacttcgccgaacccatgatgctcgattgtggccataacatatgctgcgcctgcttagcgcgttgctggggcaccgctgagaccaatgtttcctgcccacagtgccgtgaaaccttccctcaacggcacatgaggcctaacagacacctggcaaatgtgactcagctagtcaaacagctcaggactgaaaggcctagcggccctggtggggagatgggagtttgtgagaagcatagagaaccgcttaagctgtactgtgaagaagaccagatgcctatttgtgtcgtttgtgaccgaagcagagagcatagggggcacagcgtcctacctctcgaggaagccgtggagggatttaaggagcagatccagaatcagctggaccacctgaaaagggtcaaagacctcaagaagcggcgtagggcgcaaggtgagcaggctcgagcggaactcttgtccctaacccagatggaacgcgaaaagatcgtgtgggagttcgaacagctttaccactcacttaaggaacatgagtaccgtctcctcgcaaggttagaggagctggatcttgcaatttacaattctatcaatggggccatcacacagtttagttgcaacatctcccacctctcaagcttaatcgcgcagctggaggaaaaacaacagcaaccgacacgagagctgctccaatag

SEQ ID NO: 138808 - DNA, 1542 bp, Artificial Sequence
  Description of Artificial Sequence: Synthetic coding sequence
atggcatcaggcagcgtcgccgagtgtcttcaacaggagacaacttgtccggtctgtctccagtactttgcggagcctatgatgttagactgcggccataatatctgctgtgcttgcctagccagatgctggggcacggctgagacaaatgtctcatgcccccagtgtcgcgagacgttccctcagcgtcacatgcggcccaatcgacatttggcgaatgtcacacagctcgtgaaacagctgcggacagagcgcccttcagggccagggggggagatgggagtctgcgagaagcatagggaaccgcttaagctgtactgtgaagaagatcaaatgcccatctgtgtagtgtgcgacagatcccgcgaacaccgcggacactctgtcctcccattggaagaggcagtggagggcttcaaggagcagatccagaaccagctcgatcacctcaagagggtcaaggatctaaagaaacgacgaagggctcagggcgagcaggctagggcagaactgttatcattgacccaaatggagcgcgagaaaattgtctgggaatttgagcagctttatcacagccttaaggaacatgagtacaggctgttggcccggttagaggagctggatttagcgatatataattctattaacggggccatcacacagtttagctgcaacatcagtcacctgtcttccctgatcgcacagttggaggaaaagcaacagcagcccacaagggaattgctacaggacataggagacactctctcccgggccgagcgtattagaattcctgagccatggataacacccccggatctgcaggaaaaaatccacatttttgctcagaaatgcctttttctgacagaatccctcaagcagttcacagagaaaatgcaatctgacatggagaaaatccaggagctgcgggaagcccagttgtactccgttgacgtgactttagatcctgacaccgcctatccatctctcatcctgtctgataatcttaggcaagtgaggtacagttatctacagcaggacctgcctgacaatccggaaaggttcaatctatttccgtgcgtgctgggcagcccatgcttcattgccggtagacactactgggaggtggaggtgggggacaaggctaagtggactatcggtgtgtgtgaggacagcgtgtgtcgcaaaggcggggtgacctccgctccacagaacggcttctgggccgtgtcactatggtacgggaaagaatattgggctctgacaagtcccatgactgcacttccccttcgcactccgctccagcgcgtaggtattttccttgattatgacgccggagaagtgtccttttataatgtgactgaacgctgtcacacctttacattttcgcatgcaaccttctgcggccccgtccgtccatatttttctttatcttattccggtggtaagagtgctgctccacttattatctgtccaatgtcaggtattgacgggttctctggacacgtaggcaaccacggccatagcatggaaacatccccctag

SEQ ID NO: 138809 - DNA, 1542 bp, Artificial Sequence
  Description of Artificial Sequence: Synthetic coding sequence
atggcgagcggctcagtcgccgaatgtctgcagcaagagacaacctgccctgtctgcttgcagtacttcgctgaacctatgatgctggattgtggacacaacatttgttgtgcatgcctagcaaggtgttggggtacagcggaaacgaacgttagctgcccccaatgccgcgagactttcccccagcgacatatgaggccgaacagacacctcgctaacgtgacacaactggtgaaacagctgcgcaccgaaagacctagcggcccgggaggagagatgggagtgtgcgagaaacacagggaacccttgaaactgtattgcgaagaggatcaaatgccgatttgtgtagtatgcgacaggagccgcgagcatagagggcactctgtgttacctcttgaagaagcagtggagggctttaaggaacaaatccaaaatcaactggaccatctcaaaagggtcaaggacttaaaaaagcggcggcgcgcccagggcgagcaggcccgtgcagaattgctcagcctcacacagatggagagggagaagatcgtgtgggagtttgagcagctttaccacagtttgaaagaacatgagtatagactgcttgccagactggaggagctggatctggccatatataattcgatcaatggagccatcacccagttttcatgtaatatatcccacctttcatctctgattgcccagctggaagaaaagcaacagcaacccacccgcgagctgctgcaagacatcggggacacgctgagtagggctgaacgcatcagaatccctgagccttggattacccctccggacctacaagagaagatccacatcttcgcacagaagtgtctgttcttaacggaaagcctgaaacagtttacggaaaagatgcaatccgatatggagaaaatccaagagctcagggaggcccagctgtacagcgtggacgtgacactggatccagataccgcctacccctcgctgatcctgagcgataacctgcgccaagtgcgctatagttacttacagcaggacctcccagacaacccagagaggtttaatcttttcccttgtgtgcttgggagcccgtgtttcattgcggggcggcactactgggaggttgaagtaggtgataaagccaaatggaccatcggcgtgtgcgaagacagcgtatgccgtaagggcggcgttacgtctgctccacagaatggattctgggctgtctcattatggtatggaaaagaatactgggctctgacatctcccatgaccgcacttcccctccggactcccctgcagcgggtaggtatttttctggactacgatgctggtgaagtgagtttttataacgttacagagagatgccacaccttcacttttagccatgcaaccttttgcggcccagtcagaccttatttttccctgtcctatagtggtggaaaatcagctgctcctcttataatatgccccatgtccggaatcgacgggttttcaggtcatgtcgggaaccacgggcatagcatggagacctctccatag

SEQ ID NO: 138810 - DNA, 750 bp, Artificial Sequence
  Description of Artificial Sequence: Synthetic coding sequence
atggcaagcgggagtgtggccgagtgtctccaacaagagacaacttgtcccgtgtgcttgcagtattttgcagagccaatgatgctcgactgcggacataacatatgctgcgcttgcctggcaaggtgttggggaactgccgaaacaaacgtatcttgtcctcagtgcagggaaaccttcccacagcggcacatgcgccccaatcggcatctggccaatgtcacccagctggtgaagcagctgcgcactgagcgtccaagcggaccagggggcgaaatgggagtatgtgagaaacaccgggaacccctcaagctttactgtgaggaggatcaaatgccaatatgtgtcgtttgtgatcggagccgggagcaccgggggcactctgtgctccccctggaggaggctgtagaaggatttaaagagcagatccagaatcaattggaccacctaaaaagagttaaagacctcaaaaaacgcagaagagcgcaaggggaacaggcccgcgccgagctgctttcactcacgcagatggagagagagaagattgtttgggagttcgaacagctctatcattccctcaaagagcatgaataccgcctcttggcacgcctagaggagctcgacctcgctatctacaattcgattaacggcgctataacacaattctcatgcaacatctcccacctgagttcactgattgcacaattagaagagaaacaacagcagccaacaagagagctgctgcaatag

SEQ ID NO: 138811 - DNA, 1542 bp, Artificial Sequence
  Description of Artificial Sequence: Synthetic coding sequence
atggcaagcggcagcgtggccgagtgcttgcaacaagagactacatgtccagtctgccttcagtattttgcagagccgatgatgctcgactgtggccacaatatatgctgtgcttgtcttgcaaggtgttggggaacagccgagacaaatgtgtcgtgtccacagtgcagagagacttttccccagagacatatgaggcccaatcgacatctggctaacgtcacccagctcgtgaagcaacttcgaactgaacgcccatctggacctggcggagagatgggcgtgtgcgagaaacaccgcgaaccgctcaagttgtactgcgaggaagatcagatgcccatttgcgttgtgtgtgaccgatctcgggaacaccgcggacacagtgtgctgccccttgaggaggccgtcgaagggttcaaagaacaaattcaaaatcagcttgaccacctcaagagggttaaagacctgaagaaaaggaggcgggcccagggggagcaggcccgcgcagaactgctcagccttacgcagatggagagggagaaaattgtgtgggaattcgaacagctgtaccatagtctcaaagaacatgagtatcgcctattggcacgactcgaggagctcgaccttgccatatacaattctatcaatggtgccatcactcagtttagttgcaacatctcgcatctgtcttccctgattgcccagcttgaggaaaagcagcaacagcccacaagggaacttcttcaggacataggggatacactctcccgcgctgagagaatccggatccctgagccctggatcacgcctccagacctccaggagaaaatccacatctttgctcagaagtgcctgtttctcactgagagcttgaagcaattcactgagaagatgcagagcgacatggaaaaaattcaggagctgcgagaagctcagctctactccgtggatgtgaccctggatcccgatacggcttatcccagcctcattctgtcggataatctgcgacaggttcggtattcatacctccagcaggatctaccggataatcccgaacggttcaatctattcccctgcgtgctgggctcaccttgtttcattgccggacggcactattgggaagtcgaggtgggtgataaagccaagtggactattggcgtctgcgaggacagcgtatgccggaagggaggagtgaccagtgctccgcaaaatgggttctgggctgtttcattgtggtacggcaaagaatattgggcacttacgtcaccaatgacagccctgcccctaagaacacccctacagcgggtgggtatctttctagattacgatgcaggggaagtgtccttctataacgtgaccgaaaggtgtcatacctttactttcagccacgccacattctgtggaccggtgaggccttatttttcattatcatattccggcggtaaaagcgctgcacctctgatcatctgtccaatgtctggcatagacggcttcagcggccatgtcggcaatcacgggcatagtatggaaacctcgccctag

SEQ ID NO: 138812 - DNA, 744 bp, Artificial Sequence
  Description of Artificial Sequence: Synthetic coding sequence
ctcaagcagttcactgaaaaaatgcagtctgatatggaaaaaattcaggaatcagcagacagtttagaggggggtattttagacctgggtagcgtgctatcacatatcctgcccgtaagcgagttgcgggaggctcagctctactccgtggatgtcaccctggaccctgatactgcctatccgagcctgatcctgagcgacaatctgcgccaagtacgctactcttatcttcagcaggacctgcctgataaccctgagagatttaaccttttcccatgcgtgctggggtccccctgctttatcgccggaaggcactattgggaggtggaagtcggcgacaaagccaaatggacaatcggggtgtgtgaagactccgtgtgccggaaggggggagtgacttctgccccccagaatggattttgggccgtaagcctctggtatggcaaggaatattgggccctcacatcccctatgacagctcttccactgcgcacccctcttcagcgcgtggggatcttccttgactatgacgccggtgaggtgagcttttataatgtaactgagcgctgccacactttcactttctcccatgcaacgttttgcggacctgtgaggccatatttttcgctgagttactctggcggtaagtcggcagcacctttgattatctgcccaatgagcgggatcgacggatttagtggtcacgtaggaaaccatggccacagcatggagacctcgccatag

SEQ ID NO: 138813 - DNA, 750 bp, Artificial Sequence
  Description of Artificial Sequence: Synthetic coding sequence
atggcatcaggatctgtcgcagaatgcttgcagcaggagacaacatgtcctgtctgcctgcaatatttcgccgagcctatgatgctcgattgcggacataacatatgctgtgcttgtctagcaaggtgctggggcacggccgagacgaacgtgagctgtccacagtgccgcgaaactttccctcagaggcacatgagacccaacagacatctcgccaatgtcactcagctagtgaagcagcttcgaactgagcggccatcaggcccaggaggcgagatgggagtctgtgaaaaacaccgcgagccattaaagctctactgcgaggaagaccagatgcccatttgtgtggtgtgcgaccgcagtagagagcatagggggcacagcgtcctaccactcgaagaggctgtggagggattcaaggaacagatccaaaaccagctggatcacctgaaacgggtcaaggacctaaagaagagaaggcgtgcacagggggaacaagcgagagcagagttactgtccctcactcagatggagagggagaaaatagtatgggagtttgagcagctttatcactcacttaaggagcatgaataccgcctgttagcgaggcttgaggagctcgatctggcaatctataactctataaatggtgccattacccagttttcatgtaacatcagtcacctgagctccctgatcgcacaactggaggaaaaacagcaacagccaacccgcgagctgctacagtag

SEQ ID NO: 138814 - DNA, 159 bp, Artificial Sequence
  Description of Artificial Sequence: Synthetic coding sequence
tgactgagggaggcccagctgtactccgttgacgttaccttggatccggacactgcctacccctcacttatcctgtctgataacctgaggcaggttagatacagctaccttcaacaggatctgccggataaccccgagcggtccccctccacaacctag

SEQ ID NO: 138815 - DNA, 696 bp, Artificial Sequence
  Description of Artificial Sequence: Synthetic coding sequence
taaagtgcggactcgctcgagggaggcatcctggacctggggtccgtgcttagtcacatcctgcctgtctctgagctcagagaggcccagctctatagcgtggacgtcacgctggatccggatacagcatatccctctctgattctgtccgataatttacgccaggttcgctacagctatctgcagcaggacctgcctgataacccggagaggttcaatttgtttccttgtgtgcttggctccccttgttttattgctggcagacactactgggaagtggaggtgggggataaggcaaagtggaccattggggtgtgtgaggactccgtatgtaggaagggcggggttactagcgctccacagaatgggttctgggccgtgagcctctggtatggcaaggaatattgggcgctaaccagcccaatgacagctctgccactgcggactccgttacagcgcgtgggaatcttcttagactatgacgccggcgaggtcagcttttacaacgtgaccgaacgatgtcacacttttaccttcagtcacgccacattctgcggcccagttcgaccctactttagcctgtcgtacagcggagggaaatcggcggctccgctgataatctgtcccatgtccgggattgacggcttctctggccacgttggcaaccatggacacagcatggagacctccccgtag

SEQ ID NO: 138816 - DNA, 624 bp, Artificial Sequence
  Description of Artificial Sequence: Synthetic coding sequence
tgattgcgtgaggctcagctgtattctgtggacgtgaccctagacccggatacagcttatcctagtcttattctgtcggataatttgcggcaggttcgatattcttacctccaacaagatttacctgacaacccagagagattcaatctattcccatgtgtactggggtcaccttgcttcatcgccgggaggcattattgggaggtcgaagtgggggacaaagcgaaatggacgatcggggtctgtgaagactcagtgtgcaggaaaggcggagtgacctctgctccccagaatgggttttgggctgttagtctgtggtacggcaaggaatactgggcccttactagcccaatgactgctttgcctctacgtacccccctacaacgtgtgggcatcttcctagactacgacgccggggaagtgtccttttacaacgtaactgaacggtgtcacaccttcacctttagccatgcgactttctgcggccctgtgcgaccctatttcagcctgtcttattccggtggaaagagcgccgctcccctcatcatctgtcccatgagtggcattgacgggttctctggacacgttgggaatcacggccatagcatggaaacttcgccttag

SEQ ID NO: 138817 - DNA, 1077 bp, Artificial Sequence
  Description of Artificial Sequence: Synthetic coding sequence
atggccagcgggagtgtagctgaatgcctgcagcaggagaccacatgcccagtgtgcttacagtacttcgccgagccaatgatgttggactgcgggcacaacatatgctgcgcgtgtctggcccgttgctgggggacagcagagactaacgtttcttgccctcaatgtcgcgagactttccctcagaggcacatgcggccaaatcgtcatttggccaacgtgactcagctagtcaagcagttgagaacagagaggcccagcgggccagggggcgagatgggcgtctgtgaaaagcaccgggagccactgaaattatactgtgaagaagatcaaatgcccatatgcgttgtgtgcgacaggtccagggaacatagaggtcacagcgtgctcccactcgaagaggccgtcgagggctttaaagagcaaatccaaaatcagttggaccatctgaagagagttaaagatctcaaaaaacgtcgccgagcccagggcgagcaggcccgggccgaactgctctccctgacccagatggagcgagaaaaaattgtctgggaatttgagcagctgtaccactcactgaaggagcacgagtatagactgttagctagactcgaggagttggatttggccatttacaactcaatcaatggcgccattacacagttctcttgtaacatctcacatttgtcatccctgatagcacagctggaagagaaacaacagcagccaactagagaactcttacaggacatcggtgacacactgtctagggctgagagaattaggatcccagaaccatggattacacccccggacctacaggaaaagatacacatctttgcacagaagtgcctgtttctgacagagtccctaaaacagttcaccgagaaaatgcagtcagacatggaaaaaattcaagagctccgggaggcccagctctacagcgttgacgtcaccctggatcctgacacagcctaccctagcttgattctgtctgataacctgcggcaagtgcgctacagctaccttcagcaggatctcccagacaacccagaacgtagtcctagcacgacgtag

SEQ ID NO: 138818 - DNA, 747 bp, Artificial Sequence
  Description of Artificial Sequence: Synthetic coding sequence
tgactcaaacagtttactgagaagatgcagtctgatatggagaagatccaggaaagtgcagatagcctggagggcggtatccttgacctcggttcagtactgtctcatatccttccggtgtcagaattgcgagaggcgcagctctattccgtggatgtcacgctggaccccgatactgcctatccttccctcatcttgagcgataatcttaggcaggttcgctactcttacctacagcaggatctgcccgacaatccagagcgattcaacttgtttccttgtgttctgggttccccctgttttatcgctgggaggcactattgggaggtggaggtgggcgataaagctaaatggacgatcggagtgtgtgaggactccgtatgccggaaaggtggcgtcacctcagctcctcagaatggattctgggctgtgtcactgtggtacgggaaggagtactgggcgctaactagccccatgactgccttgccattacggaccccactgcagcgggttgggatcttcctcgattacgacgcaggggaagtgagcttttacaacgtgaccgagcgatgccacactttcactttctctcacgctactttttgtggccctgttcgtccctacttcagcctttcctattccggcggaaagagcgcggctcccttgatcatctgtccaatgtctggcattgacggatttagcgggcacgtaggcaaccacggacattccatggagacatccccctag

SEQ ID NO: 138819 - DNA, 750 bp, Artificial Sequence
  Description of Artificial Sequence: Synthetic coding sequence
atggcgtctggctctgtcgctgagtgcttacagcaagagacaacctgccctgtgtgccttcagtacttcgctgaaccaatgatgctggattgtggacacaatatttgctgcgcctgtctggccagatgttggggaactgctgaaactaatgtcagctgccctcagtgtcgcgaaactttccctcagcggcacatgcgaccaaaccgacatctcgctaacgtgacacagctggtgaaacagttaagaactgagcgcccctcaggccccgggggcgagatgggcgtgtgcgagaagcaccgggagcctctcaaactctactgcgaagaggaccaaatgcccatctgtgtggtttgtgatcggtcaagagaacacagagggcatagcgtgctgcccctggaagaggctgtggaggggttcaaagaacagatccagaaccagttggatcatctaaaacgtgttaaggatctcaaaaaaaggaggcgagcacagggcgagcaggccagggcagaactgttatctctcacccagatggagagagaaaaaatagtgtgggaatttgagcagctgtaccacagcctgaaggagcacgaataccgcctgctcgcccgtctggaggaacttgacttggctatctacaactccataaacggcgctattacacagttttcctgcaatatcagtcacttatcgagtcttattgctcagctggaagagaagcagcagcagcccacccgggagctgctgcagtag

SEQ ID NO: 138820 - DNA, 2202 bp, Artificial Sequence
  Description of Artificial Sequence: Synthetic coding sequence
atggccaagcgggaagatagtcccgggccagaagtccagcccatggataagcagtttctggtgtgtagcatatgtctcgatcgctatcaatgccctaaagtgctcccatgcctgcacacgttctgtgaaaggtgtctccagaattatattccggcccagagtctgaccttgtcctgccccgtgtgccggcaaaccagtatactgcctgaacagggtgtcagcgcgctccaaaataacttctttatatctagcctaatggaagctatgcagcaagctcccgatggcgcccatgatcccgaggacccgcatcccctgtccgttgtggccggtcggcccctgtcttgtcccaatcacgagggtaagaccatggaattctactgcgaagcttgcgagaccgcaatgtgtggggaatgccgggctggagagcacagggagcagcataaagccgctctacagcgacagcttgaggcggtacgtggtcggctccctcaacttagcgccgccattgccctggttggtggcatcagccagcagcttcaggaaaggaaggctgaagcactggcgcagatctctgctgccttcgaagacctggagcaggctttacagcagaggaagcaggcgctcgtgagtgatctggaaaccatttgtggcgccaagcaaaaggtgctgcagtcacagctggatacgctccggcagggccaagaacatatcggtagtagttgtagctttgcggaacaggcgttaagactcggtagcgcccctgaagtgctgcttgtccgcaaacacatgagagaacgcctagctgcactagctgctcaggcttttccagagcggcctcacgagaatgcccagctcgaacttgttctggaggttgatggcctgaggcggtccgtgcttaacttgggagcgctgctcactacgtccgccactgcccatgagaccgtcgctaccggcgaaggcttgaggcaggcgcttgtgggacaacctgcaagcctgacagttaccacgaaagataaagacggaagactcgtccgtacaggaagtgcagagctccgagctgagataacaggccccgatggtactaggctgcctgtgcccgtggttgaccacaagaacgggacctacgagcttgtgtacaccgcaagaacagaaggggagctgctcctttctgtgctgctgtacggtcaaccagtgagaggctcgccgttccgcgtgagggcactcagacccggggacttacccccaagtccagatgacgtcaagcgcagggttaagagtcccggtggccccggatcacacgtaagacagaaggccgtaaggcgaccttcctcaatgtatagtaccggcgggaaaagaaaggacaaccctattgaagacgagctggtgtttcgggtcggcagcagaggccgggaaaaaggcgaattcactaacctgcaaggtgtgagcgccgcatccagtggccgcattgtggtggcagattcaaacaaccagtgcatacaagtcttttccaatgagggccaattcaagttccggtttggcgtgcggggccgtagtcccggccagctgcagaggcccactggtgtggccgtagacacaaacggcgacataatcgtggcagactacgataaccgttgggtcagcatctttagccctgagggaaagttcaaaaccaagattggcgctgggagactcatgggccctaagggcgtcgcagtggatcgcaatgggcatattattgttgttgataacaagagttgctgcgttttcaccttccagccaaacgggaaattggtgggtagatttggcggtagaggggcaaccgaccggcacttcgccgggccgcactttgtggccgtcaataacaaaaacgaaattgtggtcactgattttcataatcactctgtaaaagtttatagcgcagacggcgaatttcttttcaagttcggaagtcacggggagggaaatgggcagtttaatgccccaaccggggtggctgtcgatagtaatgggaatataatcgtcgccgattggggtaacagcaggatacaggtcttcgatagttccggatcctttctgtcttatatcaacacatctgcggagccactatacggacctcaggggttagccctgacgagcgatgggcatgtggtggtggcagacgcgggtaatcattgtttcaaggcctacagatatcttcaatag

SEQ ID NO: 138821 - DNA, 2235 bp, Artificial Sequence
  Description of Artificial Sequence: Synthetic coding sequence
atggctaagcgtgaagactcgcccggtccagaagttcagcccatggacaagcagttccttgtgtgttccatctgcctggaccgctatcagtgtcccaaagtcctgccttgtttgcacacgttctgcgagagatgtctgcaaaactatattccagcgcagtcgctgacgctgagctgtccagtgtgtaggcagacctcaatcttgcccgagcagggggtgtccgcactgcagaacaacttctttatctcaagtcttatggaagcgatgcagcaggcccccgatggtgcacacgaccctgaggatccccacccgctttctgttgtggccgggaggcctctctcttgccctaatcatgagggcaagacgatggagttctactgcgaagcctgcgagacagcaatgtgcggggaatgcagagccggtgaacatcgagagcacggtaccgtccttcttcgggacgtggtggagcagcataaagccgctctgcagagacagctggaggcggtgcggggacggttgccgcaactcagtgcggccatcgctctagtcggaggcatcagccaacaactgcaggagaggaaggcggaggccctagcacagatttcggctgcgttcgaggacctcgagcaagcacttcagcagcgaaaacaagcactggttagcgacctagaaactatttgcggtgcaaagcagaaggtgctccaatctcagctcgacacccttcgacagggccaggaacatatcggaagtagctgttctttcgccgaacaagctctcagacttgggtccgccccggaggtgctgctagttaggaagcatatgcgagagcgcctggccgccctggccgctcaggccttccctgaacgacctcatgaaaatgctcagttagagctggtgctggaagtggacgggctccgccggtccgtgcttaacctgggtgcattgctaactacttctgccactgctcacgaaacggtggcgacaggtgagggcttaaggcaggcactggtgggacagccggcatccctgaccgtcaccacaaaggacaaggacggccgactggtccggaccggaagcgccgaactacgtgccgaaattacgggcccagatggcacgagactgccggtcccagtggttgaccacaaaaatggaacttacgaattggtgtacactgctagaactgagggagagctcctcttgtccgtgcttctctatggccaacccgtaagaggcagcccttttcgagtgcgggcattgagacctggagatcttcctccaagtccggatgacgtcaaaagacgggtgaaaagcccaggcggtccagggagccacgtcaggcagaaggccgtgagaaggcctagttcaatgtatagtactggaggcaagagaaaagacaatcccatcgaggatgagctagtgtttcgggtaggcagcagagggcgggaaaagggcgaatttacaaacctccagggagtctcagccgcttcctcagggcgcatcgtcgttgccgattccaataaccaatgcattcaggtatttagtaatgaaggtcagttcaagttccgttttggtgtccgaggacgcagccctggccaactgcagaggccgaccggtgtggccgtggatactaacggagacatcatcgtggcggactacgacaatcgctgggtgtccatttttagccctgagggcaagtttaagacaaaaataggcgctgggcggctcatggggcctaaaggggtggcagtggaccgcaatggccatattatcgtcgtggataacaaatcgtgttgtgtcttcacatttcagccaaacggcaaactcgtgggcaggtttggggggaggggcgcgacagaccgccacttcgccggcccccactttgtggcggtcaataataaaaacgagatcgtcgtgactgactttcacaatcattccgtgaaagtctacagcgcagatggcgagttcctgttcaagtttggcagtcacggtgaaggaaacggccaatttaatgctcctactggcgtggcagtggacagtaatggtaacataattgtggcagactggggaaacagtcgtatacaagtgtttgatagttctggttcattcctgtcttatattaatacatcagccgagcccttgtatggcccacagggcctggctctaacctccgatggtcatgtagtggtcgccgatgctggaaatcattgctttaaggcctataggtatttgcagtag

SEQ ID NO: 138822 - DNA, 2235 bp, Artificial Sequence
  Description of Artificial Sequence: Synthetic coding sequence
atggctaaacgcgaggattccccaggaccagaagtccagcctatggacaagcaatttttagtctgttcgatctgtttagatcggtatcagtgtcccaaagtactcccatgcttgcacactttttgcgaaaggtgcctccagaattacattcccgcccagtctttgaccctgtcctgccctgtctgcagacagacgagtatattaccggagcagggagtgtccgccctgcaaaataattttttcatatcctcactaatggaggccatgcagcaggctcctgacggagcgcatgaccctgaggatccccaccctctcagtgtcgttgccggccggccgctgagttgtcctaatcatgaggggaagacaatggagttttactgtgaagcttgtgagactgctatgtgtggtgaatgccgtgcaggggagcatagggaacacggtactgtcttattgcgggacgtcgttgagcagcacaaagcagccctgcagcggcagctggaggctgtgcgcggacgactgccccagctctccgctgcaattgcattggttgggggcattagccaacagctgcaggaacggaaggccgaggccctggcgcaaatttcagcagcattcgaggatcttgagcaggctttgcagcaaagaaagcaggcgctggtgagcgatctggagacaatctgcggtgcaaaacaaaaagtattacaatcccagctggataccctcagacaggggcaggaacatatcggcagctcatgctcgttcgctgaacaggcattaaggctcggatccgcgcccgaggtactcctcgttaggaagcacatgcgcgaaaggcttgccgcacttgctgctcaggcctttcccgagcgcccacacgagaacgcccagttggaattagtgttagaggtcgatggcctgaggcgttcagtgctcaacctgggcgcccttttgacaacgtctgcaaccgctcatgagaccgtcgcgacaggcgaagggttacggcaggctttagtaggccagcctgcttcacttacagtcaccactaaagacaaggacgggcgcctcgtgcgaacggggagcgcagagctgcgcgcagagattacaggacccgatggaacgaggttacctgtgcctgtagtggaccataagaatggtacctatgagctggtgtatactgcccgtaccgaaggtgagctgctcctgtccgtcctgctctacgggcagccggttagagggagcccatttcgcgttcgcgcattgcgacccggggacctgccccccagccctgacgacgtaaagcgtcgagtgaaatcaccaggagggccagggagccacgtgaggcagaaggcagttaggcgccctagttccatgtattcaacaggcggcaagagaaaggacaatcccatcgaagatgagttggtgttccgagtgggttcaagaggtagagaaaagggtgagtttacaaacctgcagggggtgagtgctgcctcaagtggtagaatcgttgtggctgactccaataatcagtgcattcaagtcttctctaacgagggtcaatttaagtttagatttggagtacgaggccgatcaccaggccaattacaaagacctaccggggtcgcagtggataccaacggcgacattatagttgctgactacgacaaccgctgggtgagcatcttctcgcccgagggtaagttcaagactaagatcggtgcaggaaggctgatgggacccaagggtgtcgccgttgatagaaacggccacattatcgttgtcgacaataagagttgttgcgtgtttacattccagcctaacggaaagcttgttggaaggttcggcggacgcggggccactgaccgccattttgccggaccacacttcgtggccgtgaataacaaaaatgagatcgtggtcactgatttccacaatcactctgtgaaggtctatagcgcggacggcgagttcctgttcaaatttggatcccacggcgagggcaacggccagtttaacgcgccgacaggagtggcagtcgactctaacggcaatattatcgttgccgactggggaaacagccggattcaggtttttgatagttcagggagctttctctcatacatcaatacatccgcagagcccttgtacggaccacagggactggccctgacctccgacggacacgtggtcgtagcggacgcgggaaaccattgcttcaaggcctatcggtacctacaatag

SEQ ID NO: 138823 - DNA, 2235 bp, Artificial Sequence
  Description of Artificial Sequence: Synthetic coding sequence
atggccaaacgtgaggacagcccaggtccagaggtgcagcctatggacaagcagtttctggtgtgctccatttgtctagaccgataccaatgtcccaaggtgttgccgtgtcttcataccttctgtgagagatgccttcagaactacatcccagcccagagccttacgctgtcctgccccgtgtgccggcaaacatccatactgcctgaacagggtgtgtccgctttgcagaacaatttcttcatttcgtctctgatggaagctatgcagcaggcaccggatggcgctcatgaccctgaggacccccacccattgtcagtggtggccggccggcccctctcctgccctaatcatgaaggcaagactatggagttttactgtgaagcctgtgagacggccatgtgtggagagtgcagggcaggagaacaccgcgaacatgggaccgttctgctccgcgacgtagtggagcagcataaggctgcccttcagaggcaacttgaggcagtccgcggccgacttccccagctgtctgccgcgatagctttagtgggagggatcagtcagcaattgcaagaaaggaaggccgaggcacttgctcagatcagcgccgcctttgaagacctggaacaggccctccagcagcggaagcaggccctcgtcagtgacctcgagactatctgtggcgctaaacagaaagtcctgcagagccagctcgatacactcaggcaaggacaagaacacattggcagctcttgctctttcgctgaacaggctctgcgccttggctctgctcccgaggtgcttctggtgcgcaagcatatgagggaaaggctcgctgctctggccgcacaggctttcccagagaggcctcatgaaaatgcacagctggagctggtattggaggttgacggtctcaggcgttcagttcttaacttaggggcactgctgaccacctctgccactgcacacgagaccgtcgctaccggagaggggttgcgccaagcgctggtagggcagccagcttcgctgaccgtcaccacaaaagacaaagacggaagactggtacgaaccggtagtgctgagcttcgtgccgagatcacagggccagatgggacacggttacccgtccctgttgtggaccataaaaatggcacctacgagctggtctacactgctaggaccgaaggggagctgttgttatctgtcctcctctatgggcagccggtccggggcagccctttcagagtgcgcgccctgcggccaggagatctcccaccttcacccgacgatgtgaaacgtagagtcaaatctcctggtggtcctggcagtcacgtgcgtcagaaggccgtcaggaggccctctagcatgtacagcactgggggaaaacgtaaggataatcctattgaagacgaattggtgttcagagtcggctctcggggccgtgagaaaggcgaatttactaacctccaaggggtttcagctgcgagtagtggtagaatagtagtggccgatagcaacaatcagtgcattcaggtgttcagcaacgaaggccagttcaaattcaggttcggagtgcggggccgtagtcccggccagctgcagaggccaacaggggtggccgtcgacacgaatggagacatcatagtagccgactacgacaacaggtgggtaagtatatttagtccagaaggcaaattcaagacgaagattggggctgggagactcatgggacctaaaggcgtggccgtcgacaggaatggacatataatcgtggtggacaacaaatcttgctgtgtattcactttccagcctaacggaaaactagtgggcaggttcggggggagaggggcgaccgacagacatttcgccggcccgcacttcgtggcagtgaacaataagaacgagatcgtggtgactgactttcataatcactccgtgaaggtgtattcggctgacggagagttcttatttaaattcggcagccatggcgagggcaacggacagttcaacgcacccaccggagtggctgttgatagtaatggtaacataatcgtggcagactgggggaattctcgcatccaggtgttcgactcatcaggcagtttcctgagttacattaacacctctgcggagccgctgtatggcccacagggactagctctaaccagcgacggccatgtggtggtggccgacgccgggaatcactgctttaaggcgtaccgttacctgcagtag

SEQ ID NO: 138824 - DNA, 2229 bp, Artificial Sequence
  Description of Artificial Sequence: Synthetic coding sequence
atggcaaagcgggaagactctccaggtcctgaggtgcagccaatggacaagcagttcctggtgtgttccatatgtctggacaggtatcaatgtccgaaagttttaccatgcctgcacactttctgtgagcgttgtcttcagaactatatcccagcgcagagtctcacgctgtcctgcccagtctgcaggcagacatcaatactgcccgagcaaggggtgtctgctctccagaacaactttttcatctctagtctgatggaagccatgcagcaggcacccgatggcgcgcacgatccggaagatccccatccactcagcgtggtggccggtcgcccgcttagctgccctaaccatgaagggaaaactatggaattttactgtgaggcatgtgagactgctatgtgcggagaatgcagagccggcgaacatagagagcatggcactgtcctcctcagggacgttgtcgaacagcataaggctgctctccagaggcaactggaagcagttagagggcggttgccgcagctgtcagccgctatcgccctggttggagggattagccaacagctgcaggagcgcaaggctgaggccctggctcaaataagtgccgctttcgaagacctcgaacaggccctccagcagcgaaagcaggcccttgtttccgacctcgagacaatatgtggagccaagcagaaggtcctacagtcacagctggacaccctgcgacaggggcaggagcacattggttcttcttgttcttttgcggagcaggcgctgcgcttgggtagcgcacccgaagtgctgctagtgcgtaaacacatgcgggaacgattagccgcattggctgcacaggctttccctgagcgccctcatgaaaatgcgcagctcgagctggtgctggaggtggacgggctgcgtcggtcagtattgaacctgggggccctgctgaccactagtgccactgctcacgagaccgtggccacaggtgagggccttaggcaggcattggtcggccaacctgcatccctcacagtgaccacgaaagataaggacggaaggctggtcaggaccggaagcgctgaattgcgggcggagataactggccccgacggtacaaggctacctgtgccagtcgtagaccataagaatggcacctacgagcttgtctacacggcgcgtacagagggtgagcttttgctgtcagtgctcctatacggccaaccagtccgcgggagcccctttagagtgcgagcactacgccccggagaccttcctcccagtccggatgacgtgaaacggcgggtgaagagtcccggtggtcccggcagccacgtgcgacaaaaggccgtgaggcggcccagctccatgtattcaactggcggaaagcggaaggacaaccctatagaggatgagctagtgtttagggtggggtctagaggccgggaaaagggagaattcacaaaccttcaaggcgtgagcgcagccagctctggaagaatcgtagtggccgactccaataaccaatgtattcaggttttctccaacgagggccagttcaagttcaggtttggtgtcaggggaaggtcacccgggcagctccagcgacccactggagttgctgtggacaccaacggggatatcatcgtggccgattacgataatagatgggtgagcattttcagcccagagggtaagtttaagacgaagatcggagcaggcaggttgatggggcccaaaggggtggccgtagataggaacgggcacattattgtggtggataacaaatcttgctgcgttttcacctttcaaccaaatggaaaattggtaggtcgcttcggtggacggggtgcaaccgaccgtcactttgcggggccgcatttcgtcgcagtcaacaacaaaaatgagattgtcgttacggactttcacaaccattccgtcaaggtttattctgcagatggagagtttctctttaagttcggatcacatggcgaagggaacggccagtttaatgccccaactggagtcgcagtcgacagcaacgggaatattattgacgtttgtcgcgcaagtccctatccatcttacacacctccccatccctgccagtccgccccccacccacccgcttggggtcagaacagtctcccacaggacaggtcaccgtcatcctgcttgcctaccacactctatacacttacggagaccgcaattccccatccgccatactag

SEQ ID NO: 138825 - DNA, 1878 bp, Artificial Sequence
  Description of Artificial Sequence: Synthetic coding sequence
atgaaaaccatggagttctattgcgaggcctgcgaaaccgcaatgtgcggagaatgccgagctggagaacacagagaacatggtacagtgcttttgcgcgacgtcgttgaacaacacaaagcagcactccagcgccagttggaggccgtgcgcggcagactcccacagctcagcgctgctattgcccttgtcggtggaataagccaacaattgcaggagaggaaagccgaggccctagcccaaatttccgcggcatttgaggatctcgagcaggcacttcagcagcgcaagcaggcactagtgtcagaccttgaaacaatatgcggcgctaagcagaaggtgctccaatcacagctggacactttgcgccaggggcaggagcatatcggttccagctgcagctttgcagagcaggctttgagactgggcagcgcccctgaagtccttctagtgcgcaaacatatgagggaaagattggccgcgctcgctgcccaagcttttccagagagaccacatgaaaatgctcagctcgagcttgtactggaggtggacgggctgagaaggtctgtcttaaacctcggggcgctattaacaaccagtgctaccgcccacgaaaccgtagcaacaggggagggcctgcggcaggccctggtaggacaacccgcttcactgactgtgaccaccaaggacaaagacggtcgtctcgttaggaccggaagcgccgagctgcgggcagagataacaggcccagatggaacgcgtctgcccgtcccggttgtagaccacaagaacggaacttacgagctcgtttacaccgctcggactgaaggggaactacttttgtctgtgcttctctatgggcagcccgtccgcgggagccccttccgggtccgcgcgcttcgacctggtgacctacccccttcccctgacgatgtcaagagacgggtgaagtccccagggggacctggaagccacgtgcggcagaaagcagtccgccgcccctcttccatgtacagcactggtgggaagaggaaagataatcccattgaagatgaattggtgttccgcgtcggttctcgtggccgcgagaagggcgaattcactaatctccagggagtgtccgccgcaagttctggacggatagttgtggcagatagcaacaatcagtgcatccaagtattttccaatgaggggcagtttaagtttcggttcggggttcggggccgctccccagggcagttgcagcgtcccaccggcgtggcagtggatactaatggcgacattatagtggccgattacgacaatagatgggtgtccattttttctccggaaggcaagtttaaaactaagattggcgcaggccgacttatggggcccaaaggagttgctgtcgacaggaatggccacataatcgtcgtagataacaagtcttgctgcgtctttaccttccagccgaacgggaagttggtcggccgatttgggggtaggggagcaacagaccgccactttgccggcccccactttgtggccgtgaataacaagaatgaaatcgtcgtcacagatttccataatcactcagtcaaagtttatagcgcagatggcgagttcctgtttaaatttggcagccacggagaagggaacggccagttcaacgcccctaccggagtcgcagtggactccaatggaaacattatcgtggctgactggggcaactctagaatacaggtgttcgacagttccggttcttttctgagctacatcaataccagtgcagaacctctgtacggaccacagggcctcgcactgacgtctgacggacacgtggtcgtcgctgatgccggaaaccattgttttaaggcatatcgttatctccagtag

SEQ ID NO: 138826 - DNA, 2001 bp, Artificial Sequence
  Description of Artificial Sequence: Synthetic coding sequence
atggccaaaagagaagatagtcctggtcctgaagtccagcctatggataaacaattcctggtgtgctcaatctgcctggaccggtaccaatgcccaaaagtgctcccgtgcctccatacattctgcgaacgctgcctgcagaactatatccctgcccagtccctgaccttatcctgcccagtttgcagacagacctcgatcctgccagagcagggcgttagcgccctgcagaataatttcttcattagttccctgatggaggctatgcaacaggctcctgacggcgcccatgacccggaagaccctcatccactctcagtggtagcaggtcgaccactctcttgccccaaccatgagggcaagactatggagttttattgtgaggcatgtgaaaccgccatgtgtggcgagtgccgggcaggagagcacagagagcacgggaccgtgctgctgagagacgtagtcgagcagcacaaagctgcattacagaggcaactcgaagccgtgaggggtcgtctgccccaattgagcgcggcgatcgctttggtcggcggtatttcccagcaactccaggagcgtaaagccgaggccttggcacagataagtgccgcctttgaagatctcgagcaggccctgcagcagcggaagcaggcacttgtgtcagatctggtcgacggactgaggaggagtgttctgaatctgggcgccctgctcaccacctctgctacagctcatgagacagtggccaccggcgagggccttcgacaagcgctcgtgggtcaacccgcctcgctcacggtgactactaaggacaaggacggacgccttgtacggactggctccgcagagttgagagccgaaattacagggcccgacggtacaagattgcctgtgcctgtcgtggaccacaaaaatggaacctacgaacttgtgtataccgcccgaacggaaggcgagcttctcttatctgtcctgctgtatgggcaacctgttcgggggtcccctttcagagtgcgggcacttcgcccaggcgatctaccccctagccctgacgacgtcaaaagaagagttaagagccccggaggacctggttctcacgtcaggcagaaggccgtacggcggccaagtagcatgtattcaaccggcggcaaaagaaaggataacccaatcgaagatgagctggtatttcgggtggggtcccggggccgggagaaaggcgagttcaccaacctgcaaggggtgtccgcagctagctccgggagaatcgtggtggccgacagcaacaatcagtgcatccaggtgttcagcaacgaaggccagttcaagtttagattcggcgtgcggggcagatcaccaggacagctgcagaggccgacaggagtagccgtcgatacaaatggcgacatcatagttgccgactatgataatcggtgggtctctattttttctcctgaaggtaagtttaaaactaaaattggtgctggaagattgatggggcctaagggcgtagctgtggatagaaatggccatattattgtcgtggataataagtcatgctgtgtattcacatttcagcccaacggtaaactagttgggcggttcggcggcaggggcgcgaccgataggcactttgcaggaccccatttcgtggccgtaaataacaagaatgagattgtagtcactgactttcacaatcactctgtgaaggtctactcagctgatggcgagtttctgttcaagtttggatctcacggagaaggcaatggacagtttaacgccccgaccggagttgctgtcgattccaatggcaacatcatcgttgccgactggggcaattcgaggattcaggtcttcgacagctccggctcattcctttcatatataaacacttcggcagagcctctctatggcccacagggccttgctctgacctctgacggacatgtggtcgtcgccgatgctggaaaccattgttttaaagcttaccggtacctgcagtag

SEQ ID NO: 138827 - DNA, 2226 bp, Artificial Sequence
  Description of Artificial Sequence: Synthetic coding sequence
atggctaagcgcgaggatagccctggcccagaggtgcaaccaatggacaagcagtttctcgtgtgtagtatttgtctcgatcgttatcagtgcccaaaagtcttaccatgcttacataccttctgtgaacgctgcctccaaaactacatcccagcccagtcccttactctgagctgcccggtttgtagacagaccagtatcttgccagaacagggagttagcgcgttgcagaacaatttttttatttctagcctcatggaagctatgcagcaggcaccagacggggcacacgaccctgaggacccacaccccctctctgtcgtggcaggtcgcccgctcagctgtcccaaccacgagggtaagacgatggaattctattgcgaggcctgtgaaaccgcaatgtgcggtgagtgccgtgctggagagcaccgggaacacggaacagttctgttgagggacgtcgtagaacagcacaaagcagcactccagaggcagcttgaagccgtgagagggaggttgcctcaactctccgcagccatcgccctcgttggaggcatctctcagcagctgcaagaaagaaaggcagaggccctggcccagatcagtgctgctttcgaggacctcgagcaggcactgcagcaacgcaaacaggccctggtgtctgatctggaaacaatttgcggcgccaagcagaaagttctccagtcccagcttgacactctccggcaaggccaagagcatattggtagcagttgtagtttcgccgagcaggcgttgcgcctgggctcagctcccgaagttcttctcgtgcgaaagcacatgagagagcggctcgcagctctcgctgctcaggcctttccagagcgaccacatgaaaatgctcaattggagctggtccttgaggttgatgggctgaggcgtagtgtcctgaatctcggcgcgctgctgaccacatctgctacggcgcacgagactgtggccacaggggagggcctccgccaggccctcgtcggacagccggcctcactgaccgtgactaccaaagacaaagacggccggctagtgaggactgggagtgccgagctgcgcgccgaaataactgggccagacggaactaggctgccggtgcctgtggtggaccataagaatggaacctacgaactggtgtatacggctcgcactgagggcgagctgctgttatcggtgttactctacggccagcctgtacgtggttccccgttcagggtccgcgcgctgagacccggggatctgccgccaagcccggacgacgtcaagcgcagagtgaaaagcccaggaggtccaggctcacatgtgcgccaaaaggcagtgcggaggcccagttctatgtattccacagggggaaagcgtaaagacaaccccatcgaggatgagctcgtatttcgtgttggctcccgaggtagggaaaagggcgagtttaccaacctgcagggcgtatcggccgcttcctcgggacgtatcgtggttgccgactcaaacaaccagtgcatccaagtgttctctaatgagggccagtttaaatttcgcttcggagtgcgaggacgctcacccgggcagttgcagcgccctactggagtcgcggtggacacaaatggagacattatcgtcgccgactatgataacagatgggtgagcattttttctcctgagggtaagttcaagaccaagataggcgcaggcaggcttatgggacctaaaggcgtggccgtggaccgcaatgggcacattatagtcgtcgacaacaagtcatgttgtgtctttactttccagcctaatggaaaactcgtggggcggttcgggggacgaggcgccaccgatcggcacttcgctggacctcactttgtagcagttaataataagaacgaaatcgttgtcaccgatttccacaaccactccgttaaggtgtactccgcagacggagaattcctgtttaagtttggctcccacggggagggtaacggccagttcaacgcccccactggggtcgcagtggacagcaacggtaacatcattgtctgtcgcgcgtctccctacccgagctacaccccccctcatccgtgccagagcgcacctcaccccccggcatggggccaaaatagcctgcctcaggatcgttctccatccagttgtcttcccactaccctgtacacgctgacagaaactgctatcccacaccccccatattag

SEQ ID NO: 138828 - DNA, 1278 bp, Artificial Sequence
  Description of Artificial Sequence: Synthetic coding sequence
atggcctctggccagttcgtcaacaagcttcaggaagaagtgatatgccccatatgtctagatattctgcagaaacctgtcacaatcgattgtggacacaacttctgcttgaagtgcatcacccaaataggagaaacttcatgcggattcttcaagtgccccttatgcaaaaccagtgtgaggaaaaacgctatccggtttaattccctgttgcggaatcttgtggaaaagatccaagccttgcaggcatctgaagtgcagtccaaacggaaggaggccacgtgtcctagacaccaagagatgtttcattacttttgcgaagatgatggaaaattcctctgttttgtgtgctgcgaatccaaggatcataagtcccacaacgttagcctcattgaagaggctgcccagaattaccaggggcagatccaggagcagattcaggtactgcagcaaaaggaaaaagaaacggtacaggtgaaagcccaaggcgtccacagggtggatgtgtttacagaccaggtcgagcatgagaaacagcggattctgaccgagttcgagttactgcatcaagtgctcgaagaggaaaaaaattttctgctgagcaggatctactggctaggtcatgaaggcactgaggccgggaaacactacgtggcctctactgagccccagctgaatgaccttaagaagctagtggattccttaaaaaccaagcagaacatgccacccagacagcttcttgaggatatcaaagtggtcctgtgcagaagcgaggaattccagttcctgaatcccacccccgtcccgcttgaactcgaaaagaaactgtcggaggctaagtctcgccatgattctattacaggctcactaaaaaagtttaaagatcagttacaagcggaccgtaagaaggacgagaatcgcttttttaagagcatgaataaaaacgacatgaagtcctggggcctgctccagaaaaataatcacaaaatgaacaaaacctcagagcctgggtcctcttccgctggcggccggaccacatcaggtccccctaaccaccacagtagcgcaccttctcactctctgttccgggccagcagcgctggaaaagtcacattccctgtttgtctgctcgccagctatgacgaaatctcaggccagggggccagtagtcaggatacgaagacattcgacgtagctctgagtgaggaacttcatgctgcgttgagtgagtggctcacggcaatacgcgcctggttttgtgaggtgcccagttcatag

SEQ ID NO: 138829 - DNA, 1278 bp, Artificial Sequence
  Description of Artificial Sequence: Synthetic coding sequence
atggcctcgggacaatttgttaataagttgcaggaagaggtgatctgccccatttgcttggatattctgcagaaaccagtcacaattgattgtggccacaacttttgcctgaagtgcatcacccagatcggcgagacctcttgcggatttttcaaatgcccactctgcaagaccagcgtgagaaagaatgcaatccggtttaacagtctgctgaggaatttggtggagaaaatccaggccttacaggctagcgaggtgcagtctaaacgcaaggaagccacgtgtccaagacaccaggaaatgtttcattacttctgtgaggacgacggaaaattcctgtgcttcgtgtgtcgggaatcgaaggatcataagtcccacaacgtaagcctcatagaggaagcggctcagaactaccagggacagattcaggagcaaatccaggttttacagcaaaaagagaaggagacagtccaggttaaggcccagggggttcacagagtcgacgtcttcactgaccaggttgagcacgaaaaacagagaatattgacagagtttgagctgctacatcaggtacttgaggaagaaaagaactttcttctaagtaggatttattggctgggccacgaaggaactgaagctggcaagcactatgttgcgagcaccgagccacagttgaacgatctcaagaagctcgtggactcactgaaaaccaaacagaatatgcctccacgtcagctgctggaaccagcccagcctcacctcccccgctcagaggagttccagtttctcaacccaacgccggttcccctagagttggagaagaagttatcagaggcaaagagccggcatgactccattacaggaagcttaaagaaattcaaggatcagcttcaggccgatcgcaagaaggatgagaaccgatttttcaagtccatgaataaaaacgacatgaaaagctggggcttgttgcaaaagaataaccacaaaatgaacaagacgtctgagccaggatcgtcgagtgcaggcggaagaacaacatccgggcctccgaatcaccactcaagtgccccaagccattccctgttcagagcttcctctgccggaaaggttacgtttcctgtttgtctcctagctagttacgacgaaatcagcggacaaggggcctcttctcaggacaccaaaacgtttgatgtggccctttcagaagagctccacgcggccctgtcagagtggctgactgcaattagggcctggttctgcgaggtccccagttcttag

SEQ ID NO: 138830 - DNA, 1278 bp, Artificial Sequence
  Description of Artificial Sequence: Synthetic coding sequence
atggcatctggccagtttgtaaataaactccaggaggaagtgatatgcccgatatgcctcgatatacttcagaagcccgttacgattgactgcgggcacaatttttgcctcaaatgcattacacaaatcggggagacatcctgtggattcttcaagtgccccttatgtaagacaagcgtaagaaagaacgctatccgtttcaatagtctattacggaacctggtggagaagatccaggctctccaagcttccgaagtgcagagcaagagaaaggaggccacatgccccagacaccaggaaatgttccactacttttgtgaggacgacggcaagttcctgtgcttcgtctgcagggaaagcaaggaccacaaatcccacaatgtcagcctgattgaagaagctgctcagaactatcaagggcagatccaggaacagattcaggtactgcagcaaaaggagaaggaaactgtacaagtcaaagcacagggggtgcacagagtggacgtgtttacagaccaggttgagcacgaaaaacagcgcatactgactgagtttgagttgcttcatcaagtcctcgaggaagagaaaaactttctgctgtctcgcatttattggctgggacatgagggcacagaagctggaaaacactacgtcgccagcactgagcctcagctgaacgacctgaaaaagctggttgactccctgaagactaagcagaacatgccccctagacagctgctcgaggacattaaggtggtcctttgcagatctgaggagtttcagttcctgaaccctacccccgtgcccctcgaactagaaaagaaactatccgaggccaagagcagacatgactcaatcacaggctccctcaagaaatttaaggaccaactgcaggccgaccggaaaaaagacgaaaaccgtttctttaaaagcatgaataaaaacgatatgaagtcttgggggctgttacaaaagaataatcacaagatgaacaaaacctcagaacccggcagctcgtccgcaggcggccgaactacctcagggccaccgaatcaccattcctctgctccatcgcattccctctttcgggcatctagcgccggaaaagtgacttttccagtgtgtctccttgcctcttatgacgagatatcggggcagggggcctctagccaggatactaaaaccttcgacgtggctttgagcgaagagctgcacgcagcactgtccgaatggctgacagccatcagggcctggttctgcgaggtgccctcctcttag

SEQ ID NO: 138831 - DNA, 747 bp, Artificial Sequence
  Description of Artificial Sequence: Synthetic coding sequence
atggcctccgggcagttcgtgaacaagctgcaggaggaggttatttgccctatctgcctagacattctccagaaaccagtcactatcgattgcgggcataacttttgcttgaaatgtattacccagattggagagacatcatgtggctttttcaagtgccccctgtgtaagacctctgtccggaagaatgcgatccgctttaactctttactgcgcaacctggtggagaagatccaagccttacaggccagcgaggtccagtctaaaaggaaagaggccacctgtccacgtcaccaggagatgttccattacttttgtgaagacgacggcaagtttctctgtttcgtctgtcgggaatcaaaggatcacaagagtcacaatgtaagtctgattgaggaggccgcccagaattaccagggccagatccaggagcagatccaagtgctccagcaaaaggaaaaggaaaccgtccaggtgaaagcgcaaggtgtacaccgggtggatgtgtttactgaccaggtcgagcacgaaaagcagcggatccttacggagttcgaattattgcatcaggtgctggaggaagagaagaacttcctactgtcccgaatctattggctcggacacgaagggaccgaagctggaaaacattacgtagcatctacagagccacagttaaacgatctgaagaaattggtggattctttgaagaccaaacagaatatgcccccccgccagctccttgagtag

SEQ ID NO: 138832 - DNA, 1278 bp, Artificial Sequence
  Description of Artificial Sequence: Synthetic coding sequence
atggcctccgggcaatttgtcaacaagcttcaggaggaggtcatttgcccaatttgtctcgacattctgcagaaacccgtgacaattgactgtggacataacttttgccttaagtgtataacccagattggcgagacctcctgcggcttctttaagtgcccattgtgcaagacttcagtgcggaaaaatgctatacggttcaattctctgttgcgcaacctggtggaaaagatccaggctctccaagccagtgaagttcaatccaagcggaaggaggcaacctgcccccggcatcaggagatgtttcattacttttgtgaggacgacgggaaattcttatgtttcgtgtgtcgcgaatcaaaagaccacaagtctcacaacgtctcgctgattgaagaagcagcccaaaattatcagggccagatccaggagcagatccaggtactgcaacagaaggaaaaagagactgtacaggtgaaagcacagggggtgcatcgagttgacgtcttcacagatcaagtcgagcatgagaagcagaggatcctgaccgaattcgagctgttgcatcaagtcctggaagaggagaagaatttcttactaagccgcatctactggcttggacatgaggggactgaggcgggaaaacattacgtggcaagcaccgaacctcagttaaacgatttaaaaaaactggtggattctctcaaaaccaaacaaaatatgcccccaagacagctgctggaggacataaaagtggtgctttgtcgatctgaggagttccagtttctaaacccaacccctgtaccccttgagcttgagaagaaactgtctgaggctaaatcccggcatgatagcatcacggggagccttaagaagtttaaggaccaactgcaggccgacaggaagaaggatgaaaacaggtttttcaagtctatgaataaaaatgatatgaagagctggggcttactccagaagaacaaccacaagatgaataagaccagcgagcccggatcgagttccgcgggcggacgaaccacaagtggacctccaaaccaccacagttctgcacccagtcattctctcttccgggcaagcagcgcaggaaaagtgacatttccagtttgcctccttgcctcgtatgatgagatatcaggtcagggggcgtcctctcaggacacaaagaccttcgacgtggcactgagtgaagagctccacgccgctttgagcgagtggctaactgccatccgggcctggttctgcaaggttccctcgtcctag

SEQ ID NO: 138833 - DNA, 1278 bp, Artificial Sequence
  Description of Artificial Sequence: Synthetic coding sequence
atggcatcaggccaatttgtgaataaactgcaggaggaggtaatatgccctatttgtctagatatactgcagaaacccgtcacaatcgattgtggccacaatttctgcctgaaatgtattacacagattggggaaacatcctgcggcttctttaaatgtccactctgtaaaactagtgtgaggaaaaacgcgattcgatttaactcgctcctgaggaatttagtggaaaagatccaggcactgcaggcaagcgaggtccaatctaagaggaaggaggccacctgtccgaggcaccaagaaatgtttcattacttttgcgaagacgacggtaaatttctttgctttgtgtgtcgggagtctaaagatcacaagagccataacgtgtctctgatcgaagaagctgcccagaactatcagggtcagatccaggaacagatacaagtcctacagcagaaagagaaggagaccgtgcaggtgaaggcccagggcgtgcaccgcgtagatgtctttactgaccaggtggaacatgagaaacagcggattcttactgaattcgaattgctgcaccaggtccttgaggaggagaaaaatttcctgctatcccgaatctactggctgggccacgagggcaccgaagcgggcaagcactatgtggctagcacggagccacagctaaacgatcttaaaaagctggtggattccctgaagacaaagcaaaacatgcctccacggcaattgcttgaggatatcaaggtagtgctgtgcaggtcagaagaattccaatttctaaacccaacgcctgtcccactggagctggaaaagaagctgagtgaagcaaaatctcggcacgattctataaccggttctttgaagaagtttaaagatcagctgcaagcagaccgcaagaaagacgagaatcgttttttcaagagcatgaacaagaatgacatgaagagctgggggctgcttcagaagaacaatcacaaaatgaataaaacctccgagccaggcagttcatccgccggaggcaggaccacgtcaggaccgccaaatcaccattcttctgcgccatcccactcgctgttccgggcctcttcagctggcaaagtgaccttccccgtgtgtctactggccagttatgacgaaatctcaggacaaggagcgtcgtcccaagacaccaaaacctttgatgtcgccctatccgaagagctgcacgctgcactcagtgaatggctgacggcaatacgagcttggttttgtgaagtcccctcttcttag

SEQ ID NO: 138834 - DNA, 1278 bp, Artificial Sequence
  Description of Artificial Sequence: Synthetic coding sequence
atggctagtggccaatttgttaataagctccaggaagaagtgatctgtcctatttgtcttgatatccttcaaaaacctgtcacaatcgactgtggtcacaacttttgccttaagtgtataactcagatcggcgaaacctcatgcgggttcttcaagtgccctctgtgcaaaacgtctgtacgcaaaaacgctatccggttcaacagcttactgagaaatcttgtggagaagattcaggcgctacaggcatccgaagttcagtctaaacgtaaggaggcaacatgccctcggcaccaggagatgttccactacttctgtgaagacgacggaaagttcctgtgtttcgtatgcagagagagtaaggaccacaaaagccacaacgtcagcctcatcgaggaggctgcccagaactatcagggccagatccaggagcaaatccaagttttacaacaaaaggagaaggagacagtccaggtgaaagctcagggggtccacagagttgacgttttcaccgaccaggttgagcatgaaaaacagagaatccttactgaattcgagttactccaccaagtgctggaagaggaaaaaaactttctgctctctagaatatactggttaggacacgaggggaccgaagctgggaagcactacgtggcgtccaccgaaccccagctaaacgacttaaaaaagctggtagacagcctcaaaacaaagcagaatatgccaccccggcaactcctcgaggacataaaagtcgtgctgtgtaggagcgaggaattccagtttcttaaccccactccagttcctttggaactggagaagaagctttccgaagctaaatcgcggcatgattctatcactggctctctaaaaaagtttaaggatcagctgcaggccgatcgaaaaaaagatgagaatcgctttttcaagtcaatgaacaaaaatgacatgaaaagttggggactcttgcaaaagaataatcacaagatgaacaagacaagcgagccaggatctagtagcgctggggggcgaaccacgtccggaccaccaaatcaccacagctccgctccatcccattccctcttcagggcctcttccgctggcaaagttaccttccccgtttgtttgcttgcctcttacgatgagatatctgggcaaggagcatctagccaagataccaaaaccttcgatgtggctttgtcagaggagctgcatgctgccctgtcggaatggttaacagccatacgcgcctggttctgcgaagtgccatcctcctag

SEQ ID NO: 138835 - DNA, 1278 bp, Artificial Sequence
  Description of Artificial Sequence: Synthetic coding sequence
atggcctctggacagtttgtgaacaagctgcaggaagaagtgatctgcccaatctgcctggatattctgcagaaacccgtgacaattgactgtggacacaatttctgccttaagtgcatcactcagatcggggaaacaagttgcggattttttaaatgcccattatgcaagacatctgtgcggaaaaacgctatccgattcaacagcctgttgagaaatcttgtcgagaaaatacaggctttgcaggcctcagaggtgcagtctaagcggaaagaggccacttgccccaggcaccaggagatgttccattacttttgtgaggacgacggaaaattcctttgcttcgtgtgccgcgagtcaaaggaccacaagagtcacaacgtgtctctgatcgaagaagctgcacagaattaccagggccagatccaggaacagatccaggttctccagcaaaaggaaaaggaaacggtccaggtgaaggcacagggggtgcaccgagtggatgtttttaccgaccaagttgagcacgaaaagcagaggatcctgacagaatttgagctgctacatcaggtgttagaggaagagaagaacttcctgctctctagaatctactggttagggcatgagggtactgaggcggggaagcattatgtggccagtactgaaccgcagctgaacgatctgaaaaagttagtggactccctcaaaaccaaacagaacatgccccctcgtcaactgctcgaagatatcaaggtggtactgtgcaggtccgaggaattccagtttctgaaccctactcccgtgcccctggagctggagaagaagctgtccgaggccaaaagccgccatgacagtattacaggatccctcaaaaagtttaaggatcaactgcaggcggatcgaaaaaaggatgagaaccgcttcttcaaaagtatgaataaaaatgatatgaagagttggggtctgctccagaaaaacaatcacaagatgaacaagacctcagagccaggcagcagctccgctggtggcagaactacatccggcccaccaaatcaccattcatccgcccccagtcactcattgtttagagcctcttccgccgggaaggtaacattcccggtgtgtctgttggcttcgtacgatgagatctctggacaaggtgcctccagtcaggataccaagacattcgatgtcgccctttcagaagagctccacgccgctctcagcgagtggctgaccgccatacgggcctggttttgcgaggtccccagctcttag

SEQ ID NO: 138836 - DNA, 1278 bp, Artificial Sequence
  Description of Artificial Sequence: Synthetic coding sequence
atggccagtggccaatttgttaataaactgcaagaagaagtgatttgccctatctgcctggatatcctccagaaacctgtgacaatcgattgtggccacaacttttgcctcaagtgtattacgcagatcggggaaacctcctgtggtttttttaagtgcccattgtgtaaaacgtctgtgcgcaagaacgcgatccgctttaactctctcctccgcaacttagtcgagaagattcaggcactgcaggcctccgaggtgcagagcaagcgcaaggaggccacctgcccaagacatcaggagatgttccactacttctgtgaggacgatggcaaattcctttgtttcgtgtgtcgtgagtcaaaggaccataaatcgcataacgtgtccctgatcgaggaagcggctcagaactaccaaggacagatacaagaacagattcaagtgctccagcagaaagagaaagagaccgtccaggtgaaagctcagggagtacacagggtcgacgtgtttacagaccaggtggaacatgagaaacaacgaattttgacagaatttgagcttctacatcaggtgttggaagaggaaaagaacttccttctctctcgcatctactggctcgggcacgagggaacagaggctggtaagcattacgtggcatcgaccgaaccccagctcaacgacttgaagaaactgatcgattcactgaaaacaaaacagaacatgccccctcggcagcttctggaagatatcaaggtggtgctttgccgaagcgaagaatttcagtttctgaatcctactccggtgccactcgagctggaaaagaagctgtctgaagcgaagtcccgccacgactcaataaccggctccctgaaaaagttcaaggaccagctccaggctgatcgcaaaaaagatgaaaaccgctttttcaaatcgatgaacaagaatgatatgaaaagctggggcctccttcagaaaaataaccataagatgaacaagacctccgagcccggcagttctagcgccggcggtcgaaccactagtggcccacctaaccaccactcttccgccccttctcacagcctgtttcgcgcctccagcgccgggaaagtgactttccccgtctgcttgctggcaagctacgacgagatcagcggccaaggcgccagctctcaggacaccaagacctttgatgtcgccctatccgaagagctgcacgccgctcttagcgagtggctcacagcaatccgagcttggttttgtaaggttcctagttcctag

SEQ ID NO: 138837 - DNA, 1278 bp, Artificial Sequence
  Description of Artificial Sequence: Synthetic coding sequence
atggcgtctggtcagttcgtgaataaacttcaggaagaagtgatctgtccaatctgccttgacatccttcagaaacctgtgaccattgattgcgggcacaacttctgcctgaaatgtatcacgcaaatcggggaaactagttgtgggttctttaaatgccccctgtgcaaaacaagcgtacgcaaaaacgcgatccgcttcaatagcctgctgcggaatctggtggaaaagattcaagccctgcaagcctcagaggtccagtctaagcgcaaagaggccacctgtccacggcaccaggaaatgtttcattacttctgcgaagatgatggaaaattcctgtgcttcgtgtgcagggagagtaaggaccataagtcacataacgtatcactgattgaggaagccgctcagaactatcagggccagatccaggagcagatacaggtattacagcagaaggagaaggaaacggttcaggttaaggcccagggggtgcaccgggtggacgtttttacagaccaggtcgaacacgaaaaacagcgaatcctgacagagttcgagcttctccaccaagtcctcgaggaagagaaaaattttttactctcgcgtatttattggttaggccacgaagggactgaagctggcaaacactacgtcgcctccaccgaaccccaactgaatgatcttaagaagctcgtggatagcctcaaaacaaaacaaaatatgcctccaagacagctcctggaagatatcaaagtagtgctttgcagaagcgaagaattccagttcctcaaccccacgcccgttccactggaactggagaagaagctgtccgaagcgaaatctcgccacgattcaataactggcagcctgaaaaagttcaaggatcagctgcaggccgatagaaaaaaagatgagaatcgcttcttcaaaagcatgaataaaaatgatatgaaatcatgggggctccttcagaagaataaccataagatgaataaaacctccgagccaggctcttcctccgccggggggagaaccaccagtgggccccctaaccaccacagcagcgcgccgagccatagtcttttccgggcctctagtgctggcaaggtaactttccctgtctgtctgctggcatcctacgacgaaatatctggtcagggcgcatcaagtcaggatacgaagacctttgacgtggccctgagcgaagagttgcacgcagcactgagcgagtggctgaccgccatccgggcttggttttgtgaagtgccatcttcttag

SEQ ID NO: 138838 - DNA, 1278 bp, Artificial Sequence
  Description of Artificial Sequence: Synthetic coding sequence
atggcctctggtcaattcgtgaataaactgcaggaagaagtgatctgtccgatatgcctggacatcctgcaaaagcccgtgactatcgactgtggacataatttctgtttaaagtgtatcacccagattggcgagacatcatgcggcttctttaagtgccctctatgtaaaaccagcgtgagaaagaacgctatccgttttaacagcttattacgtaacttggttgagaaaatacaggcacttcaagccagcgaagtgcagagtaagcgaaaggaggcaacttgtcctagacatcaagagatgttccactacttctgcgaggacgacggcaagttcctgtgcttcgtctgccgcgagagcaaggatcataagtcccacaacgtctcactgattgaggaggccgcacagaactatcaaggacaaatccaggagcagatccaagtgcttcagcagaaggaaaaagaaactgtgcaggttaaagcccagggggttcaccgtgtggatgtcttcaccgatcaagtggagcatgaaaaacaaagaattctgaccgagtttgaactccttcatcaggtgttggaagaggaaaaaaactttttgctgtcgaggatttactggttgggacacgaaggtaccgaggccggcaaacactatgtagcgagcacggagccacagttaaacgatctcaagaagctggtcgatagcctcaaaacaaaacagaatatgcctcccaggcaactcctggagcccgctcagccccacctgccacgcagcgaggagtttcagtttctcaatcctacacccgtgccactggagctcgaaaaaaagctcagcgaagcaaagtcaagacacgactctattactgggtctctgaaaaaatttaaggaccaactgcaggccgaccgtaaaaaggacgaaaaccgattctttaagtccatgaataagaacgacatgaagtcctggggcttactacaaaaaaataatcacaagatgaataagacatccgaacccgggtctagttcagccggcggcaggactaccagcgggccgcccaatcaccacagcagcgccccctcccactccctctttcgggctagctcagccggtaaggtgacgttccctgtttgcctgctggcatcttatgatgagatctccgggcagggggcctctagtcaggataccaagacatttgatgtggccctgagtgaggaactgcacgctgccctctctgaatggctgactgccatacgtgcttggttttgtgaggtccccagcagctag

SEQ ID NO: 138839 - DNA, 1278 bp, Artificial Sequence
  Description of Artificial Sequence: Synthetic coding sequence
atggcctctgggcaatttgtaaataagcttcaggaggaagtcatctgccctatttgcctagatattttacagaaacccgtgacaattgattgcggtcacaatttctgcttgaagtgtattacacagataggcgagacttcttgtgggttcttcaagtgccctctctgcaagactagcgtcaggaaaaacgccattagatttaatagtttgctgagaaacttagtggaaaaaatccaagccctgcaagcaagcgaggtgcaaagtaaacgcaaagaagctacttgtccccgtcaccaggaaatgtttcactacttctgtgaagacgatggtaagtttctttgttttgtttgtagggagagcaaggaccataaaagccataatgtgagtttaatcgaggaagccgcgcaaaattatcagggacagattcaggaacagatccaggtgcttcagcagaaggaaaaggaaaccgtgcaggtcaaagcacagggagtacacagggtcgatgtcttcaccgatcaagttgagcacgagaagcagaggattctgaccgagttcgaacttctacatcaggtgcttgaggaggaaaaaaacttcctgctctccaggatttactggctgggccatgaaggtacagaggcgggcaagcattacgtggcttcaaccgagccccagctcaacgatcttaaaaagcttgtggatagcttgaagacgaagcagaacatgcctcctaggcaactcctcgaagacattaaggtggtcttgtgccggagcgaggagtttcagttcctgaatccgacccctgtgccactagagttggaaaaaaagcttagtgaagcaaaatctagacatgacagcatcaccggctccctaaagaaattcaaggatcagctccaggcagatcggaagaaagacgagaacagattctttaagagtatgaacaaaaacgatatgaagtcctggggcctcttacaaaagaataatcacaaaatgaacaagacatccgagccgggctccagttccgcgggcggccggaccacgtcggggccaccaaaccaccatagtagcgcacccagccattcactgtttagggcttcttccgcaggaaaggtgaccttccctgtctgcctactggcctcatacgatgaaattagtggccagggcgcaagttcccaggacacgaagaccttcgacgtagccttgtccgaagagctccatgcagcactatcagaatggctgactgctataagagcatggttttgtaaagttccatcctcctag

SEQ ID NO: 138840 - DNA, 1278 bp, Artificial Sequence
  Description of Artificial Sequence: Synthetic coding sequence
atggcctctgggcagtttgtgaataagctacaggaagaagtgatctgtcctatttgtctggacatcctccagaaacctgtcaccatcgattgtggccataatttttgccttaaatgtataacgcagatcggagaaacttcatgcggcttcttcaaatgtccactttgcaaaacctcagtgcggaagaatgctattcggttcaactcactgctgagaaatctcgtggaaaaaattcaagccctgcaagcctccgaggtgcaatcaaagaggaaagaagccacctgcccacgccatcaggagatgtttcactacttctgtgaggacgacgggaagtttctgtgtttcgtctgtcgcgagagtaaagaccataaatctcataatgtttctcttattgaggaggcagcccagaattaccagggccagattcaggagcagatacaagtcttgcagcagaaggaaaaggaaaccgtgcaggttaaggcgcagggagtccaccgcgtggacgtgtttacggaccaggtggaacatgaaaaacagcgcattttaaccgaattcgagctgcttcaccaggttttggaggaagagaagaatttcttattgagtcgaatctactggcttggacatgagggaacagaggctggcaagcactatgtggcctcaactgaaccgcaactgaatgatcttaaaaagctggtagacagcctgaagacgaagcagaacatgccgccacgtcagctcctggaaccggcacagccccatcttcccagatcagaggagttccagttccttaacccgacaccggtccccctcgagctggaaaagaagctgtccgaagccaagagcaggcacgatagcataactggcagtctgaaaaaattcaaagatcagctccaggcggatcgcaagaaggatgagaacagattcttcaaatcaatgaataaaaacgacatgaaatcctgggggcttctccagaagaacaaccacaagatgaataagacgagcgaacccggaagtagcagcgctgggggcagaacaactagcggcccccctaaccaccacagtagcgccccttcccactctctttttcgcgcttcttctgcggggaaagttaccttccccgtgtgcctgttagcctcttatgacgagattagtggccagggagctagcagtcaagatactaagactttcgacgtggccctgtccgaggaattgcacgccgctttatctgagtggctgaccgccatccgcgcatggttctgcgaagttcccagttcatag

SEQ ID NO: 138841 - DNA, 1278 bp, Artificial Sequence
  Description of Artificial Sequence: Synthetic coding sequence
atggcgagcggccaatttgtgaacaaactgcaggaagaagttatctgtccaatttgcctggatatcctgcagaaacctgtcacaattgattgtggacacaacttttgtcttaagtgtattacacagattggggagacttcctgtggcttttttaagtgcccactttgcaagacctcggtcagaaaaaacgctataagattcaactcgttgctccggaatctcgttgagaaaattcaggccctgcaggcaagcgaggttcaaagcaagcggaaggaggcaacgtgcccgcggcaccaggaaatgttccattatttctgcgaagatgatggaaagtttctttgctttgtgtgcagagagtcgaaagaccacaaatcccacaatgtgtccttgatagaagaggctgcgcaaaactaccaggggcaaatacaagaacagatccaggtgttgcaacagaaggagaaagaaactgtgcaggtgaaagctcaaggagtccaccgcgtggatgtgttcactgatcaggtcgagcatgaaaaacaacggatcttgaccgagttcgagctgttacaccaggtccttgaagaagaaaaaaacttcttactatctcgaatttattggctgggacacgagggtaccgaagctggcaagcattacgtcgcaagcaccgagccacagctcaatgatctaaaaaaattgatcgattccctgaagaccaagcaaaatatgccaccacgacaactcttggaacccgcccagcctcacctgcctagatctgaggagttccaatttttgaacccaacacccgttcccctggagctggaaaaaaagctatcagaggccaaatctcgccacgactccatcaccggctcgctgaaaaagttcaaagatcagttgcaggcagaccgcaaaaaggacgagaaccgcttcttcaagtctatgaacaagaacgatatgaagtcctggggattgttgcaaaaaaataaccataagatgaataagacctcggagccaggctcgtcaagcgccggaggtcggacaacgagcgggcctccgaatcatcactcgagtgccccatctcactccctatttagggcctcctccgccgggaaagttaccttccccgtttgtctgctggcttcgtacgacgaaattagcggccagggggccagcagccaagataccaagaccttcgatgtggctctatcagaggaattgcatgccgccctgagcgaatggctgacagcaatccgggcttggttttgcaaggtcccaagcagctag

SEQ ID NO: 138842 - DNA, 1278 bp, Artificial Sequence
  Description of Artificial Sequence: Synthetic coding sequence
atggcatccggccagttcgtcaacaagctgcaagaagaggtgatttgtcccatctgcctcgatattctgcaaaagcctgttacaatcgactgcggacacaatttttgtctaaagtgtatcactcaaatcggcgagacaagttgcgggttctttaagtgccccctctgtaagacctccgtgagaaagaacgctatccgctttaacagcctccttcgtaacctggtggagaaaatccaggcactccaggcgagcgaggttcagagcaagaggaaagaggccacctgcccccgtcaccaggagatgttccattatttttgtgaggatgacggcaaatttctatgcttcgtatgctgtgagtccaaagaccataaaagtcataacgtgtccttaatcgaagaggccgcccagaactatcaaggccagattcaggagcagattcaggtactgcagcaaaaggaaaaagaaaccgtccaagtcaaggcacagggggtgcatcgggttgatgtgttcaccgaccaggtcgaacacgagaagcaacgcattctgaccgaattcgagctcctgcaccaggtgctggaggaagagaaaaatttcttgttgtcccgtatttactggctcggccacgaaggaacagaagcaggtaagcactacgtggcgtccacggagccacaactcaacgacctcaagaagcttgtggacagcctgaaaacgaagcagaacatgccccctcgacagctgctagaacccgcacagcctcatctcccgagatccgaggagtttcagtttctcaacccaactccagtgcctttggagctggagaaaaagctgtcagaggctaagtccagacacgacagcatcacggggtccctgaaaaagtttaaagatcagcttcaggctgacagaaaaaaggacgagaatagatttttcaagagcatgaataagaacgatatgaagtcatggggcttgctgcagaaaaacaatcacaagatgaacaaaaccagcgaaccaggcagctcctccgctggagggagaactactagtggacctccgaatcatcactccagtgcgccgtcccacagcctgttcagggcttctagtgcgggcaaggtgacattcccggtgtgtctgcttgcctcatacgacgaaatttctgggcagggcgcatctagccaggatactaaaaccttcgatgtggctctctccgaggaactccacgccgctcttagtgagtggctaaccgcgatcagggcctggttttgtgaagtgcccagttcctag

SEQ ID NO: 138843 - DNA, 1278 bp, Artificial Sequence
  Description of Artificial Sequence: Synthetic coding sequence
atggcgagtggccagtttgtcaataagctgcaggaagaggtgatctgcccaatctgcttagatattctgcagaaacccgtgacaatcgactgcggacacaatttctgccttaagtgcattacacagattggtgagacctcttgcggcttctttaaatgccctctctgcaaaacttccgtgagaaaaaatgccataagattcaactccctgttgaggaacttagtggaaaaaatacaggctttgcaagcctcagaggtgcagtcaaagagaaaagaagcgacatgtccaagacaccaggaaatgttccattatttttgtgaggacgatggcaagtttctgtgttttgtgtgtagagaatccaaagaccacaaatctcacaacgtgtcgctcattgaggaagctgcccagaattatcagggacagattcaggagcaaatacaggtgttacagcagaaggagaaagagactgtacaggtgaaagctcagggggtgcacagggtcgacgttttcaccgatcaggtcgaacatgagaagcagagaatccttacagagttcgagctgctgcatcaggtcttagaagaagagaagaacttcctgctatcacgtatttattggctgggtcacgaggggaccgaggctggaaagcattacgttgctagtactgagccacagttaaacgacctgaagaagttagttgactctctcaaaaccaaacagaacatgcctcctagacagttgctagaggatatcaaggtagttctgtgcagaagcgaggagtttcagttcttgaaccctactcctgtgccgctcgaattagagaagaagctctctgaagctaagtcgaggcacgactcgatcactggcagcttaaagaaattcaaagaccaactacaagccgataggaaaaaggatgagaatagatttttcaaaagtatgaacaaaaatgatatgaagagttggggcctgctacagaaaaataatcataagatgaacaagacttccgaacccggttctagtagcgctggaggcagaaccacctccggtccccccaatcaccacagcagtgcaccgtctcattcattgtttagggcctctagcgccgggaaagtgactttcccagtctgcttgttagcttcttatgacgaaatatcaggtcagggagccagctcccaagatacgaaaaccttcgacgtggccctgagcgaggagttacatgctgccctgtccgagtggctcacagccatccgcgcctggttctgcgaagtgccctcctcatag

SEQ ID NO: 138844 - DNA, 1278 bp, Artificial Sequence
  Description of Artificial Sequence: Synthetic coding sequence
atggcgtctggacaattcgtgaacaagctccaggaagaggttatttgtcctatttgcttagatatcctgcaaaagccggtgactattgactgcggtcataatttttgtcttaaatgcataacccagataggggaaacttcctgcggattcttcaagtgcccactgtgcaagacctctgtgcgcaagaatgccattcggtttaacagcctgttacgaaatctagtggaaaagattcaggcgctgcaggccagcgaggtgcagtcaaaacgaaaggaggccacctgccccagacaccaggaaatgttccattatttttgtgaagatgatggaaagttcctttgctttgtgtgccgggaaagcaaagatcacaagtctcataatgtctctctgattgaggaggccgcccagaactaccaaggccagattcaggaacagatacaggttttacaacagaaagagaaggagactgtgcaggtgaaagcccagggagtgcatcgagtggatgtgttcaccgaccaagttgagcacgagaagcagcggatcctgacagagttcgagctgctgcatcaggtgttggaggaggagaagaattttctgctcagcaggatctactggcttggacacgagggtactgaggccggtaagcactatgtcgccagcacagaacctcagctgaacgatctcaagaaactggtggactcgctgaagacgaaacaaaacatgcctccaagacagctgctggagcccgctcagccccaccttccacggtctgaggaatttcagttcctgaaccctacgccagttccacttgagctggagaaaaaattgtcagaagcaaaaagccgtcacgattctattaccggaagcctaaaaaaattcaaagaccagcttcaggctgatagaaaaaaagatgagaaccgatttttcaaatcaatgaacaagaacgacatgaaatcatggggactgcttcaaaaaaataaccacaaaatgaacaagacatccgagccagggtctagctccgctggaggcaggaccacctctgggcctcctaatcaccatagctcggccccttctcacagccttttccgggcaagcagcgcaggaaaggtgaccttccccgtttgcttgctagcgtcttatgacgagatcagcggccagggcgccagttctcaagacaccaagacctttgacgtcgccctgagtgaagaattacatgctgccctatccgagtggctgaccgctattcgggcgtggttctgtgaagtgccatctagctag

SEQ ID NO: 138845 - DNA, 1278 bp, Artificial Sequence
  Description of Artificial Sequence: Synthetic coding sequence
atggccagtggtcaattcgtgaacaagctccaagaggaagtgatttgcccaatatgtctggacatcttgcaaaagccagtgaccattgactgtgggcacaacttttgcttgaagtgtatcacacaaatcggcgagacttcctgcggcttctttaaatgccctctttgtaaaacctctgtacgaaagaatgcaatccgttttaactccttactgcggaatctcgtcgagaagattcaggcactgcaggcctctgaagtgcaatctaaacggaaggaggctacctgtcctaggcatcaggagatgttccactacttttgtgaagatgacggcaaattcctgtgtttcgtgtgctgcgaatcaaaggatcataaatcacacaacgtatcccttatcgaggaggcggcccagaactatcaaggccaaattcaggaacagattcaggtactgcagcagaaggagaaggagactgtgcaggtgaaagcccagggggttcacagagtggacgtgttcacagatcaagtggagcacgaaaaacagcggatactgaccgagttcgagttgctgcatcaagtgctagaagaagagaagaattttctgctctcgcgcatctactggctaggccatgaaggtacagaggcaggcaaacattatgttgcttcgactgagccacagcttaatgatctgaagaaactggtggatagtttgaagacgaagcagaatatgccgcccagacagctacttgaggatatcaaggtcgtgttgtgccggtctgaagaattccagttcctcaatcctactcctgtgcctctggaactggaaaagaaactcagcgaggccaaaagccgccacgatagcatcaccggtagcctgaaaaagttcaaggaccaattgcaggcagaccggaagaaggacgagaataggttcttcaagagtatgaataagaacgatatgaagagctgggggctcctgcagaagaacaatcataagatgaacaagacatctgaaccggggtcaagtagcgcaggtggccgaacgacatcaggcccgcccaaccatcacagcagtgcccccagccacagcttgtttcgcgcttcaagcgctggcaaggtcactttccctgtatgtctgcttgccagttatgacgagattagcggccagggagcaagttcccaggatacaaagacatttgatgttgctctgtctgaggagctgcacgccgccctctcagaatggctcaccgcaatcagggcatggttttgtgaggtgccatcatcctag

SEQ ID NO: 138846 - DNA, 1278 bp, Artificial Sequence
  Description of Artificial Sequence: Synthetic coding sequence
atggccagcggccagttcgtaaataagctgcaagaagaggttatttgcccaatatgtcttgatattctccagaaaccagtaaccatcgattgcggacacaatttctgcctaaagtgcattacgcagataggcgagacctcttgtgggttcttcaagtgcccactatgtaaaacctctgtgagaaagaatgctattcggttcaactcactgctaagaaacctggtagaaaaaatacaggctttgcaggcaagtgaggtgcaatcaaagcgcaaggaggcgacatgtccccgacatcaggaaatgttccactacttttgtgaggacgacggcaagttcctgtgttttgtgtgtagggaatccaaggaccataagagtcacaacgtgagtctaatagaggaagctgctcagaactaccagggccagattcaggagcagattcaagtgctgcaacagaaggaaaaagagaccgtgcaagttaaggcgcagggcgtgcacagagttgatgtctttactgaccaggtggagcatgaaaagcagcgcatcttaaccgagttcgaactcttgcatcaagtgcttgaagaggaaaagaatttcctccttagtcgcatctattggctgggccatgagggaacagaagctggtaaacattacgtggccagcacagaacctcaactgaatgacttgaagaagctgattgattcgcttaagaccaaacagaacatgccgccccgccagctgctcgaagatataaaggtcgtgctgtgcagatctgaggagttccagttcttgaatccaactcctgtccctctggaactggagaagaaattgtcagaggctaagtcaaggcatgactcaatcacggggtctctgaaaaaatttaaagaccagctgcaggccgatcgaaaaaaggacgagaatcggtttttcaagtctatgaataagaatgatatgaaatcatggggactcctgcagaagaacaaccacaaaatgaataaaacctccgagcccgggagctcttcagccggcggtcgcactacaagcggacctcccaaccaccatagctccgcacctagccatagtcttttcagagctagttctgcagggaaggtaacctttcctgtgtgtctactcgcgtcttacgatgagatttccggccagggagcctcttcgcaggacacgaagacattcgacgtcgctttatcagaggagctccacgcggcactcagcgaatggctcaccgcaattcgggcttggttttgcaaggtaccatcctcgtag

SEQ ID NO: 138847 - DNA, 1278 bp, Artificial Sequence
  Description of Artificial Sequence: Synthetic coding sequence
atggcgtccggacagtttgtgaacaaactgcaggaagaggtgatttgccccatctgcctggatatactccagaaacctgtgacaatcgattgtggccacaatttttgcctcaagtgtatcacccagatcggcgagaccagttgcggtttcttcaagtgccccctgtgtaagaccagtgtccggaagaatgcaatcaggttcaacagtttgctgcgtaacttagtggagaagatccaggcactccaggcttcagaggttcaatcaaagcgtaaagaggcaacttgtccccggcaccaggagatgtttcattatttctgtgaggatgacggaaaatttctgtgcttcgtgtgcagagagtccaaagatcataagagtcacaacgtgtccctgatcgaggaggcagcccagaattatcaggggcagatccaagagcagatacaggtgttgcagcagaaagagaaggagaccgtccaggtgaaggcacagggcgtgcatagggtggacgtattcaccgatcaagttgagcacgagaagcaacgtattctgaccgagttcgagctgctgcaccaggtgctggaagaggagaaaaattttctcttatcacggatttattggcttggacacgaagggaccgaagccggcaagcactatgtggctagtacagagccccagctgaacgacctgaaaaagctcgtcgatagtctgaaaactaagcaaaacatgccaccacggcaactgttggagcctgctcagcctcatttacccaggtccgaggagttccaattccttaaccctacgcccgtgccactcgagctggagaagaaactatccgaggccaagagcagacacgactcaattacgggaagcctgaagaagttcaaggaccagttacaggcagacaggaaaaaagatgagaaccggttcttcaagagcatgaacaaaaatgacatgaaatcttgggggctactccaaaaaaacaaccataagatgaataaaacaagcgagcccgggtcctccagcgcaggtggcaggaccacttctggcccaccaaaccaccattccagcgcaccatctcacagcttattcagggcaagcagcgccggaaaagtgacctttcccgtctgtctgctcgcaagctatgacgagatatcaggccagggcgcaagttcccaggacacaaaaacatttgatgttgcccttagcgaggagctccatgcagctctgtccgaatggctgacggccatccgggcatggttctgtaaggttccctcctcttag

SEQ ID NO: 138848 - DNA, 1278 bp, Artificial Sequence
  Description of Artificial Sequence: Synthetic coding sequence
atggccagcgggcagtttgtcaacaagcttcaggaagaagtcatctgccctatttgtcttgatatcctgcagaaacccgtcaccattgattgtgggcataatttttgtttgaaatgcataactcagataggagagacctcctgcggtttttttaaatgtccattgtgcaaaacatcagtgcgcaagaatgccatcagatttaattcactcctccggaatctcgttgaaaagatacaggctctgcaggctagcgaggtgcaaagcaagcgtaaggaggccacttgcccacgccaccaggagatgtttcactatttctgcgaagacgatggaaaatttctgtgtttcgtatgcagggaaagcaaggatcacaaatcacataacgtcagtctcattgaagaagccgcccagaattaccagggccaaatccaggagcaaattcaggtgctgcaacagaaagagaaggaaactgtccaagtgaaagcccaaggcgtccaccgggtcgacgttttcaccgaccaggtggagcacgagaaacaacgcatactgactgaattcgagctcctgcaccaggttctggaggaagaaaagaacttccttctatctcgtatttactggctcggacatgagggcacagaagctgggaagcactacgtagccagcactgagcctcagctcaatgacctaaagaaactcgttgacagcctgaaaactaaacagaacatgcccccgaggcagctgctcgaagacatcaaggtcgtcctgtgtcgatctgaggagtttcagtttttgaacccaacacccgtcccactcgaactggagaagaagctgtcagaagcaaaaagtaggcacgatagtatcacagggtctctcaagaagttcaaggaccaattacaggccgatcgcaagaaagacgagaacaggttcttcaaatccatgaacaaaaacgacatgaaatcttggggactcctgcagaagaacaatcacaagatgaacaagacctccgaacctggttctagcagcgcaggtggcaggaccaccagcggcccccccaatcaccatagcagtgcaccctcccattccttgttccgggcttcaagcgccggaaaagtgaccttcccagtgtgtctactggctagctatgacgagatctccgggcagggagccagctctcaggacactaagacatttgatgttgcactctcagaggagttacacgctgcactatccgagtggttaaccgctatccgggcgtggttctgtgaggtcccctccagctag

SEQ ID NO: 138849 - DNA, 1278 bp, Artificial Sequence
  Description of Artificial Sequence: Synthetic coding sequence
atggcctctggtcagttcgtgaacaaactacaggaggaagtgatttgcccaatttgtttagacatcctccagaagcctgtgacaatcgactgcggacataatttttgtctaaagtgtataactcaaatcggcgagacatcgtgcgggttcttcaagtgtcctttgtgtaagacttccgttcggaagaacgccatcagatttaattccctgctgaggaatctggtggagaagatacaggctctgcaagcctctgaagtgcagtcaaagaggaaagaagccacctgcccaaggcaccaggagatgttccactatttctgtgaggatgacgggaaattcctgtgtttcgtgtgtcgggagtccaaagatcataagagccataacgtcagccttatcgaagaagctgcacagaactatcagggccagatccaggagcaaatccaggtgctacagcagaaagaaaaggagacagtacaggtgaaagcccagggcgtgcatagggtggatgtcttcacagaccaggtggaacatgagaaacaaaggatcctaactgagttcgaactactacatcaggtcctcgaggaggaaaaaaattttcttttgagtcgcatttattggctgggtcacgagggaactgaggcagggaagcattatgtcgctagcactgaaccacagctcaatgacctgaagaagctggtggattcgcttaagactaagcagaacatgcctcccaggcagctgctggaggatattaaggttgtgctttgtagaagtgaagaattccagttcctgaacccaacccctgttcccctggaactggagaagaaactttccgaagccaaatctcgtcatgactctattacaggcagccttaagaaatttaaagaccaactccaggcagaccgcaagaaggacgagaacagattctttaagagcatgaataagaatgatatgaagtcatggggcttgctgcagaagaataatcataaaatgaataagactagtgagccagggtcttcctctgctggagggaggacaacctctggccctccaaatcatcactcatctgcaccttcacacagtctttttagagcatccagcgccggcaaagttactttccccgtgtgcctgcttgcttcttatgacgagatatccggccaaggagccagcagccaggacacaaaaacgtttgatgtggctctttctgaagagctgcatgcagccctcagcgagtggctaactgctatccgggcctggttttgtgaagtacctagcagctag

SEQ ID NO: 138850 - DNA, 1962 bp, Artificial Sequence
  Description of Artificial Sequence: Synthetic coding sequence
atggctgctgctgcggctagccatctcaacttagatgccctaagagaagtactggagtgcccaatttgcatggaatcctttaccgaggagcaactccgcccgaaattgctgcattgtgggcatactatctgtcgccaatgcctcgagaagcttctcgcatcttctatcaacggcgttaggtgccctttttgcagtaagattacaagaattaccagtctaacacaactgactgacaatctaaccgttctcaagatcattgataccgccggcctgtcagaagcagtcggattgctaatgtgcagatcctgcggcagacgactcccaagacaattttgcagatcatgtgggctggtcttatgcgagccctgccgagaagccgaccaccagcctcctggacactgcactctgccagttaaggaagcggcagaggaacgtagaagagatttcggagagaaacttacacggctccgagagctcatgggagagcttcagcgacgcaaggccgctctcgaaggcgtatcaaaggacctccaagcccgatacaaggccgttctccaggagtatggacatgaggagcggcgggtgcaggacgaactggcgagaagtaggaaattttttactggttccctcgctgaagtcgaaaaaagcaattctcaggtggtagaagaacaatcttacttgctcaatatagccgaagtgcaggctgtctctcggtgtgattacttcctcgcgaaaatcaaacaggcagacgtcgccttactggaagaaacagctgacgaagaggaacctgaattgaccgcaagccttccccgcgaacttacgcttcaagacgttgagttactcaaagtgggtcatgtcggtcctctccagatcggacaggccgttaagaagccacggacagttaacgtagaggatagctgggcaatggaagccacagcctccgctgcaagtacaagtgtgacctttcgcgagatggacatgtctcccgaggaggtggtggcatccccacgagcgagtccagccaaacagagaggtcctgaggcagcgtctaacatccagcagtgcttgtttttaaagaagatgggagcgaagggctccactcccggaatgtttaatctgcccgtaagcttatatgtgacctctcagggcgaagtcctggttgctgatcgtggaaactacagaatccaggtgttcactcgcaaaggctttttgaaggaaatcaggcgttccccaagcggtattgactcctttgtgctttctttcctcggggccgacctacccaaccttactcccttgagtgttgcaatgaactgtcaaggtttgataggtgtgacagactcctatgataactctctgaaggtctacaccctggatggtcattgcgttgcctgtcatcgcagccagctttccaaaccctggggaattactgctctgcccagcgggcagttcgtcgtgaccgatgtggaggggggcaaactgtggtgttttaccgttgaccgcggtagcggcgtggttaagtactcatgcctgtgctctgcagtgaggccaaagtttgtgacctgtgacgcagaagggacggtgtactttactcaggggcttggtttgaatctggagaaccgccaaaacgaacatcatctcgaaggcggcttctccattggaagcgtgggtcccgacggccagctggggaggcagataagccacttttttagcgagaatgaagactttcgctgcattgccggtatgtgcgtcgatgcacgcggcgacctgattgttgctgattcatcaaggaaggagattctacattttcctaaggggggcgggtactcggtgctaatcagggaaggcttaacctgccctgtcggcatcgctcttacacccaaaggccagctgcttgtcctcgactgctgggatcattgtatcaagatctacagctaccacttaagaaggtactcgacaccctag

SEQ ID NO: 138851 - DNA, 522 bp, Artificial Sequence
  Description of Artificial Sequence: Synthetic coding sequence
atggccgcagccgctgcctcgcaccttaacttggacgccctgcgagaagtgctcgagtgtccaatttgtatggaaagcttcactgaggaacagctgcgccccaagttgctgcactgcggccacacaatctgtcgccaatgccttgaaaaactccttgcctcttctattaacggcgtccgctgtcccttctgctcgaaaataacccgcatcacctccctcactcaattaaccgacaacttgaccgtgctgaagatcattgacacagcaggcctgtcagaagccgttggccttctaatgtgccggtcgtgcggtagacgtttgccccgccaattctgtcgcagctgcggtcttgttctgtgtgagccgtgcagggaagctgaccaccagccccccggtcattgcacactgcccgtcaaggaggccgccgaggagcgcagaagggatttcggggagaagttaactcgcttacgagaattaatgggcgaactacagcgccgaaaggccgcattggagggagtctag

SEQ ID NO: 138852 - DNA, 1962 bp, Artificial Sequence
  Description of Artificial Sequence: Synthetic coding sequence
atggctgctgccgccgcatcccatctcaatctagatgccttgagggaggtcctagagtgccctatctgtatggaatcttttaccgaagagcagcttcgccctaagctgctgcactgcgggcacacgatctgtagacagtgcttggaaaaactgttggccagcagcattaacggcgtgaggtgcccgttttgctccaagatcacaagaataacctcactcacccagcttactgataatttgactgtcctaaaaataatcgacaccgcaggcctcagtgaggctgtggggttgcttatgtgccggagctgcggccggagactgcctaggcaattctgcaggtcctgtggtttagttctgtgtgaaccgtgtcgagaggccgatcaccaaccaccgggccactgtaccttgcctgtcaaagaggcagccgaagagaggaggcgtgatttcggagaaaagttaacacggctaagggaactgatgggcgagctccagaggcggaaggcagccctggagggggtttcgaaggacctgcaggcgaggtataaagctgttctgcaagaatacggacacgaagaacggagggttcaggacgaattggcgcgctcgagaaaattttttaccgggagtctggcagaggtggagaaatctaactctcaggtagtcgaggagcagagttacttgctgaatatcgccgaggttcaggcagtaagccgttgtgactacttccttgcaaaaattaagcaggccgacgttgcgcttttggaggagaccgcagacgaggaagaacctgaactgaccgcctctttgcctagggagttgacccttcaggacgtagagttgctcaaggttggacacgtcggtcctcttcagatcggccaggcagtgaagaagcctcgtacagtgaatgtcgaagactcctgggctatggaggctacagcctccgcagccagtacgtcagtgacctttagggagatggacatgtcacctgaggaagttgtggcctcgcctcgagcttcacccgccaagcagagaggcccagaagctgcttctaacatacaacagtgcctgttcttgaagaagatgggggccaagggaagcacccctgggatgttcaacttacccgtgtctctgtatgtgacctcccagggggaggtcctggtcgccgacagggggaattatcgcatccaggtgtttacaaggaaagggtttctgaaagagataaggaggtcaccttctgggatcgactcctttgtcttgtcctttctgggggcggatttaccaaatcttaccccccttagtgttgctatgaattgtcagggcctgatcggtgtgacagatagctatgataattcgctgaaggtgtatacattggacgggcactgtgtggcctgccatagatctcagcttagcaaaccctggggcattacagccctgccctcaggccagtttgtggtcactgatgtggagggcggcaagctgtggtgtttcaccgtggatagaggaagcggcgtcgtgaagtattcttgcctttgcagcgccgtgcggcctaaattcgtaacctgcgacgccgagggaactgtgtacttcactcaaggcttggggctcaacctggagaatcggcagaacgagcaccatttggaggggggcttttccatcggttccgtcggtccagacggacagcttggccggcagataagccattttttctctgaaaatgaagatttcaggtgtattgcaggtatgtgtgtggacgccagaggagatctgattgtggccgacagtagccgcaaagagatcctacattttcccaagggcggcggttacagtgtgctcatcagggagggactgacatgccccgtcggcattgccctgaccccaaaaggacagctgcttgtgttggattgctgggatcactgtatcaaaatttactcttatcatcttagaaggtacagcaccccatag

SEQ ID NO: 138853 - DNA, 3384 bp, Artificial Sequence
  Description of Artificial Sequence: Synthetic coding sequence
atggcagagaacaagggaggcggagaagccgagtccggggggggtggctccggcagcgccccggttacagctggcgctgccggcccagctgcacaggaagctgagccacccttaaccgccgtgctggtggaggaggaggaggaagagggtggacgcgctggcgctgaaggaggggcagccggcccggatgacggaggcgttgccgctgcatcctccggatcggctcaggccgcctcgtctcccgccgcatctgtgggaacgggggtcgccggcggagctgtgtctactcccgctcctgccccagctagcgcccccgcacccggtccctccgcgggcccgccccccgggcccccagccagcctcttagacacctgtgcagtttgtcagcagagtttacaaagccgccgggaagctgagccaaagttgttgccctgcctgcactctttctgtctccggtgtctgccagagccagaacgacagctgagcgtccccattccaggcggctctaacggggacatccagcaggtcggcgtaattcgctgtcctgtgtgtcgacaggaatgccggcaaatcgacctcgtggataattacttcgtcaaggacacatcggaggctccttcatcgtctgatgagaaatccgagcaagtgtgtacatcctgcgaagacaacgcgtctgcagtgggcttttgcgtagagtgtggggaatggctctgcaaaacctgtatcgaggcccaccaaagggtaaagttcacaaaggaccacctgattaggaaaaaggaggacgtgtcagaatcggtgggcgcctctggtcagaggcctgttttctgcccagtgcataagcaagagcagctgaagctgttttgtgagacatgcgataggttgacgtgcagagactgccaactgctggagcacaaggagcacaggtaccagttcttggaagaggcatttcaaaatcagaagggcgccatcgagaatcttctcgctaagctcctggaaaagaagaattacgttcactttgccgccactcaggtccagaatagaattaaggaagtgaacgagacaaacaagagggtcgagcaggagattaaggtcgccatcttcaccctaattaatgagataaataagaaaggaaagtctctgctccagcagctggagaatgtcacgaaagagcggcagatgaagctccttcagcaacagaatgatattaccggactttctcgccaggtgaagcacgtgatgaattttacaaactgggcaattgcatcaggaagctctacagcccttctgtactcgaagcgtctgatcacttttcagttgcgtcatatcctcaaggcccgatgcgaccccgtgcccgccgcaaatggggcgataagattccattgcgatcccactttctgggccaaaaacgttgtgaacctaggcaacctggtcatcgagagtaaacctgcacctggttacacacccaatgttgtggtcgggcaggtcccacctggcaccaaccatatttccaaaacgcccgggcagattaacctcgctcaactgcgcttacagcacatgcaacagcaggtctacgctcaaaagcaccagcagttgcagcagatgagaatgcaacagccaccagctcctgttcctacgactacaaccactacccagcagcatcctcggcaggccgcccctcagatgttacagcagcagccaccacggctaatctctgtgcagaccatgcaaaggggcaacatgaattgtggcgctttccaggctcaccagatgcgcctagcccagaatgctgctagaatcccaggtatcccccgccactctggaccccagtactcaatgatgcagccccatctgcagcggcagcatagcaacccaggccatgccgggccgttcccagttgtttctgttcacaacacaacaattaacccgacatcccccaccaccgcgacgatggccaacgccaataggggaccaaccagtccttccgttaccgctatcgaacttatcccaagcgtaacgaaccccgagaacctgccatcattgccggatataccccccatccagttagaggacgcaggatcttcatccctcgataatctcctgtccaggtacatctccggttctcatttgcccccacagcccactagtaccatgaacccgagtcccgggccaagtgccctgtctccaggttcttccggacttagcaacagtcatacaccggttcgaccgccatcaacaagttcaaccgggtctcggggctcttgtggaagcagcggtaggaccgccgagaaaacgtcccttagctttaaaagcgatcaggtcaaggttaagcaggagccgggtacggaggacgaaatttgttcgttctcaggcggtgtcaagcaagagaagacagaagacgggcgtcgctctgcctgtatgctgagttctcctgagagcagtctgacgccccctctctctacaaatctgcatcttgaaagcgaactggacgctttggcctcgctggaaaaccacgtgaagatcgagcccgctgacatgaatgaaagttgcaaacagtcagggttgtcctctctggttaatggtaaatcgccgatacggagccttatgcatagaagtgccaggatcggaggtgacgggaataataaggatgatgaccccaatgaggactggtgcgccgtctgccaaaatggcggcgatctgctgtgctgcgagaagtgccccaaggtgtttcatctgacttgtcatgtgccaacacttctctcattcccaagtggcgactggatctgcaccttttgccgagacatcggcaaacccgaagtagagtatgattgtgataatttgcagcactctaaaaagggcaagaccgctcagggactgagccctgttgatcagaggaaatgtgaaaggctcctgttatacctttactgtcacgagctctccattgaattccaagaaccagtcccagcctcgatcccaaactactataaaattattaaaaagccaatggacctgagcactgttaagaagaagctgcaaaagaaacatagccagcactaccaaattcccgatgattttgtcgccgatgtgcggcttattttcaagaattgcgagcggtttaatgagatgatgaaggttgttcaagtatacgccgatacacaggagattaatctcaaggccgattctgaagtcgcccaggccggtaaggctgtggctctttacttcgaggacaaactgaccgagatttattccgacagaacttttgcccccctgccagagtttgagcaagaagaggatgatggggaggtcaccgaggattcggatgaggacttcatccagccaaggcggaaacgactgaagagcgacgagcgccccgttcatataaagtag

SEQ ID NO: 138854 - DNA, 3333 bp, Artificial Sequence
  Description of Artificial Sequence: Synthetic coding sequence
atggccgagaacaagggtggaggggaggcggagtccggcgggggaggctccgggtctgctcctgttaccgccggtgctgccggcccggccgctcaggaggccgagcctcccctcaccgcagtcctcgtggaagaggaggaagaagaggggggtcgtgcgggggcggagggaggtgctgctggcccagacgacggcggggttgctgctgcaagcagtggatccgcccaagccgcttccagccccgccgcgagcgtcggaacaggtgtggcgggcggcgctgtcagcacacctgctcctgccccagccagtgcacccgcacccgggccaagtgcagggcctcccccaggaccacctgcttccctcctcgacacctgtgcagtgtgtcagcagagcctccagtcccggagggaggccgagcccaaacttctgccgtgtctacactcgttttgcctcaggtgccttcctgagccagaacggcagctgtccgttccaatccccggaggcagtaacggcgacatccagcaggtgggggtgattcggtgtcccgtatgtaggcaagagtgtagacagatcgaccttgtcgacaattatttcgtgaaagatacgtcagaagccccttcttcctctgacgagaagagcgagcaggtatgcacctcgtgcgaggataacgcctccgctgtcgggttttgcgtggaatgtggagagtggctctgtaagacctgcatcgaggcccaccagagagtcaaatttacaaaagaccacctgatacggaagaaagaggatgtctccgagtcagtgggcgcctccggacagcggccagtgttctgtcccgtgcacaaacaggagcagctgaagctgttttgtgagacatgcgatcgcctgacatgtagggattgccaactcctggaacacaaggaacacaggtaccagttcttggaggaggcgtttcagaatcaaaaaggtgcaatcgagaacctgcttgctaagcttctggaaaagaaaaactatgtccacttcgccgcaacccaggtacagaatcgcattaaggaggtaaatgagaccaacaagcgcgtggaacaggagattaaagtcgccatcttcacactaataaatgagattaacaagaaagggaagtcccttctccaacagctcgaaaacgtgacaaaggagcgtcagatgaagttgctgcagcaacagaatgacatcaccggcctaagcaggcaagtgaagcacgtaatgaattttaccaactgggcaatcgcatctggttcttctaccgccctcctgtacagcaaaaggttgataactttccagctgcgccatattttaaaggcccgctgcgatccagtgccagccgccaacggcgccatcaggttccactgtgatccgacgttttgggccaagaatgtggttaacctgggtaatttggttattgagtctaaacccgcccccggatataccccgaacgttgttgtggggcaggtgccgcctgggacgaatcatatctcaaagactcctggtcaaataaacctggcgcagctgagactacagcacatgcagcagcaggtgtacgctcaaaagcatcagcagctgcaacagatgcgcatgcaacagcccccagctcctgtgcccaccaccaccaccaccactcaacaacacccgcgacaggccgctccccaaatgctgcagcagcagccgcctagactcattagcgtccagaccatgcaaaggggcaacatgaattgtggggcttttcaagctcaccaaatgcgactcgcccagaatgccgctcggatcccgggaatcccacgacatagtggcccacagtatagcatgatgcagccccatctccaaaggcagcacagcaacccaggtcatgccggcccctttcctgtggtcagcgtgcataacacgaccatcaatccaacttccccaactactgccacaatggcaaatgctaatcgcggccccacttctcctagcgtcactgctatcgaactgattccctccgtcactaatccagagaacttacctagtctgcctgacatcccgccaattcaactggaggatgccggatccagcagcctcgataatcttctgtcacgttacattagtggatcgcaccttccaccacagccgacaagtacaatgaatccctctcctggaccttccgccctctcccccggaagttcaggactctcaaactcccacaccccggtgaggcccccttccacatcatctactgggagcagaggaagctgcggttctagcggccggacagccgagaagacctcgctcagttttaagagcgaccaggtgaaggtcaagcaggaaccaggaactgaagatgagatctgctctttcagtggcggcgtcaaacaggaaaagacagaagacggtcgtagaagtgcatgtatgctatctagtcccgagagtagcctgacaccgccactgtccaccaacctccacctggagtcggaactggatgctctggccagcctcgagaaccatgttaaaatagaacccgcagacatgaacgagtcgtgtaagcagtctggactgtcctcgctggtcaatgggaaatcccccatccgcagcttgatgcatcgtagcgcccggatcggcggcgacggcaataacaaagacgatgatcctaatgaggattggtgcgctgtgtgtcagaacgggggggacctgctgtgttgtgaaaagtgtcctaaggtattccacctcacatgtcacgtccccaccctgctgtccttcccttccggcgattggatttgcacattctgtagagatattggaaaacctgaagtggaatatgattgtgacaatttgcaacactccaaaaagggaaagactgcacagggtttaagtcctgtcgatcagaggaaatgtgaacgactcctgctgtacttgtattgccacgagctgtccattgagtttcaggagccagtccctgcttccatcccgaattactataagattatcaagaagcctatggacttatctaccgttaagaaaaaactgcagaaaaagcatagccagcattaccaaatacccgacgatttcgtggcagatgtacgcttgatcttcaagaactgcgagagattcaatgaagcagatagtgaggtggcacaggccgggaaagctgtcgcattatacttcgaggacaaactgaccgaaatatactccgaccgcacattcgcacccttgccagagtttgaacaagaggaggacgacggggaagtaaccgaagactcagacgaagactttattcagccacggcgaaagcggttgaagtctgatgagcggccagtgcatattaaatag

SEQ ID NO: 138855 - DNA, 2667 bp, Artificial Sequence
  Description of Artificial Sequence: Synthetic coding sequence
taatctgtcggagcaagtggccagaggcccgtgttttgtccagtgcacaaacaagaacaactgaagctcttctgcgagacctgcgaccggttgacttgccgagattgtcagctgctggagcataaggagcataggtaccaattcctggaagaggcctttcagaatcaaaagggcgctatcgagaatctactcgccaaattgctggaaaaaaaaaactacgtacactttgccgccacccaggttcagaataggatcaaggaagtgaacgagaccaacaaacgcgtggagcaggaaatcaaggtcgccatctttactttaattaacgagatcaataagaagggcaaaagcttgttgcagcagctggagaacgtcactaaggagcgacagatgaaacttctgcagcagcaaaatgatattaccgggctgagcaggcaagtaaagcacgtgatgaacttcaccaactgggctatcgcatccgggagttcaaccgctctgctttattccaaacggctgattacatttcagctcagacatattctcaaggcccgctgcgaccccgttccggccgcaaacggcgctattcggttccactgcgaccctactttttgggctaagaatgtggtgaacctcgggaatttagtaatagagtctaaacctgcacctgggtatacacccaatgttgtcgtcggccaggtgcctccgggaaccaaccatatcagtaagacgcctggtcagatcaacttggcacagctacgactgcagcacatgcaacagcaggtctatgcacaaaagcaccaacagcttcagcagatgcgcatgcaacagccccccgcccctgtgccgacaactacaactactacacagcaacatcctcggcaggcagctccgcagatgctgcagcagcagcccccaagactgatctctgtacaaactatgcagagggggaacatgaattgcggggcctttcaagcacatcagatgcgattggcacagaacgcagcaaggatccccgggattccacgacacagcgggccacagtatagcatgatgcagccgcacctacaaaggcagcactcaaaccccgggcatgctggccctttccccgtggtctctgtccacaacacaacgattaaccctacctcccctacaacagcaactatggctaacgccaacagaggtccgacaagcccatctgttacggcaatcgaactcatccccagcgtcaccaaccctgaaaatctcccatctcttcccgatattcctccaatccaggcaaacgtggttccaatgatgcattcctggtacgaattcggggcgagggagaagacccaggaccaaaatgtgctggaggatgcaggctcatcatcacttgacaatctcttgagtcgctacatatcaggctctcatctgcccccccaacctacgtctaccatgaatccatccccaggaccctccgctctctcgcctggatccagtgggttaagtaactctcatacccctgtgagaccaccgtcaacctcttccacaggcagccgcggctcctgcggatcgtcaggccggaccgctgagaaaacgtctctgtccttcaaatccgaccaggtgaaggtgaagcaggaacctggaacggaggacgaaatctgcagcttctccggcggtgtcaaacaggagaagacagaagatggaaggagatccgcatgcatgttgtcctctcccgaatcatctctgactccaccacttagtacaaatcttcaccttgaatctgagctggatgctctcgcctctctggagaatcacgttaaaatcgaacccgctgacatgaatgagagctgtaagcagtccggactgtccagtctcgtcaatgggaaatcaccaattaggtccctcatgcatcggtccgccaggatcggcggcgacgggaataacaaagacgacgatccaaatgaagactggtgtgcagtgtgccagaacgggggggatctgttgtgttgcgaaaagtgccctaaggtatttcacctcacttgccacgtgcctactctgctgtcctttccttccggcgattggatctgtaccttctgcagggacatagggaaacccgaagtggaatacgactgtgataatctgcagcacagcaagaaggggaaaaccgcccaggggctgtcaccagtggatcagcgcaaatgtgaacgactgttgctgtacctctattgtcacgaactctccattgagttccaagagccagtccccgctagcattcccaattattataagatcatcaagaagcccatggacctctctacggtcaagaagaagctgcagaagaagcatagccagcattaccagatccccgatgacttcgtggcggacgttagactgatctttaagaactgcgagagattcaacgaaatgatgaaagtcgtgcaagtctatgccgacacccaagaaattaacctgaaggcggatagtgaggtggcccaggccggaaaggctgtagccttgtacttcgaggataagctgacagagatatacagcgatcgcacattcgctccgttgcctgaattcgagcaggaagaggacgatggcgaggttacagaagactcagatgaggattttatacagccacggaggaaaagacttaaatcggacgaacggcctgtccatattaagtag

SEQ ID NO: 138856 - DNA, 2280 bp, Artificial Sequence
  Description of Artificial Sequence: Synthetic coding sequence
atgaagctgctccagcagcaaaatgacattacgggcctatcgcggcaggtgaaacatgttatgaacttcacaaattgggccattgcttcaggatcgtctaccgcactgctctactccaagagactcataaccttccaactgcgccacatactcaaggcccggtgtgatccagtgccagctgctaacggcgccattcgctttcactgcgaccccacattctgggccaagaacgtcgtcaacctcggaaatcttgtaattgaaagcaaaccagcgcctgggtataccccaaatgtagtcgtaggacaggtcccaccgggcacaaaccacatttcaaagaccccaggtcagattaacctggcgcaactgagactgcagcacatgcagcagcaggtgtatgcccaaaaacaccaacagttgcagcagatgaggatgcagcagcctcccgccccggtcccgacgacaacaaccacgacgcagcagcatcctcggcaggccgccccccagatgctccaacaacaaccacctaggctcatctcggttcagacaatgcagcggggcaatatgaattgtggcgcctttcaggcccaccaaatgcgactggcccagaatgctgccaggattccaggcatcccgagacattccggaccacaatatagtatgatgcagcctcacttgcaaagacagcactctaatcctggtcatgctggcccattccccgtagtgtcagtgcataacactactatcaatcctaccagcccaaccacagccacaatggctaatgctaacaggggcccgacctcaccaagcgtgaccgctatagagctgattccatccgtaacgaatccggagaatctgccaagtctgcctgatatccctccgatccaggctaacgtggtaccaatgatgcatagttggtacgaatttggtgctcgagaaaagacccaggatcagaatgtcctagaggacgccggatcatctagcttagacaatctcctgagcagatatatttcaggcagccacctccccccacagcccacctccaccatgaatcctagccctggcccatctgccctctcccctggctcgagtggcctctctaactcccacactccggtgcgtcctcccagcacaagttccacggggagccgcggaagctgtggttcaagtggccgtacagctgaaaaaacctcactgagttttaagtccgaccaggtgaaagtcaagcaagagccagggactgaggacgaaatttgttcattcagcgggggagtcaaacaggagaagacagaagatggaagaaggtcagcatgtatgcttagctcgcctgagtccagcctcaccccaccactctctactaatcttcatctggagagcgagctcgatgcactcgcctcactagaaaaccacgtgaagattgagcctgccgatatgaacgaaagctgtaaacagagcggactgtcctctttggttaacggaaaatcacccataaggtccctgatgcataggagtgccagaatcgggggcgacggcaataacaaagacgacgacccaaatgaggactggtgcgccgtgtgccagaacgggggcgacctgctctgctgcgaaaagtgtcctaaggtttttcacctcacgtgccatgtaccgactttattgagttttccctccggagactggatctgcaccttttgcagagatattgggaagcctgaggtggagtatgattgcgacaatcttcagcacagcaagaagggtaagactgctcagggattatcacccgtggaccagcgcaaatgtgagcggctcctgttgtacttatactgccacgagctcagcatcgagtttcaagagcccgtccccgcgagcatacccaattactacaagattatcaaaaagcccatggatctctcaaccgtcaaaaagaagctgcagaagaagcactcccagcactaccagattccagacgactttgtggccgacgtgcggttaatatttaagaactgcgaacggttcaatgagatgatgaaggttgtgcaagtttatgctgatacacaggaaattaatctgaaggctgattctgaagtggcccaggctgggaaagcggtagcactgtactttgaagataaactgaccgaaatttatagtgaccggacttttgctcctctgccagaatttgaacaggaggaagacgacggtgaggtgaccgaagattcagacgaggacttcatccagcctcgccggaagcgcttgaagtcggacgagaggccagtgcatatcaagtag

SEQ ID NO: 138857 - DNA, 2529 bp, Artificial Sequence
  Description of Artificial Sequence: Synthetic coding sequence
atgtgtgggtcagaacggatattgcaggctggtaatattttagagatccgggtcgggcaagctggggctaggcgtgtcgcaacaatgacctcacccgtgctagtcgacatccgggaggaagttacatgtcccatttgtctggagctcctgaccgaacccctttctatcgactgtggccattcattctgccaagcatgtatcacccctaatggcagagagtccgtgatcggccaggagggggagagatcttgcccggtgtgccaaacgtcctaccagcccggcaaccttaggccaaatagacacttagcaaatattgtccgccggctgcgcgaggtggtcttgggtcccggcaagcagctcaaggccgtgctgtgtgccgatcatggtgaaaagctacaactcttttgccaggaggacggcaaagtcatttgctggctgtgtgagcgctcccaggagcacaggggacaccacacatttttagttgaggaagtggcacaggagtaccaggagaagttccaggaaagcttgaaaaaactgaagaacgaggagcaagaagccgagaagcttactgcattcattcgtgagaagaaaacatcttggaagaaccagatggaacccgagcggtgcagaattcagactgagttcaaccaactgcgtaacatccttgatcgcgttgaacagcgggaattgaaaaagttggagcaggaagagaaaaaaggactgcgcatcatagaagaggccgagaacgacctcgtgcaccaaacccagagcttaagggagctgatcagcgacctggagcgcagatgtcaggggtcaacgatggaactcctgcaggacgtgtccgacgtgactgaaagatccgagttctggacgctgcggaagcctgaagccctccctaccaagctcagaagcatgttccgtgcccccgacctgaagcggatgttacgcgtctgtagagagttgacagatgtacagagctattgggctatacagggtagccttacaaggcgggagcggagagcaagcggcgttaggactagaagatcccaggggtctagcgccatggccagcaagatccttctgaacgtgcaggaggaggttacttgcccaatctgtcttgagctgcttaccgaacctctcagtctcgattgtgggcattctctatgtagggcgtgcatcacagtgtctaataaagaagccgttacgagcatgggcggcaagtcatcttgtcctgtttgtggtatctcctactcctttgaacacctgcaggctaaccagcacctcgccaacattgtagagcgactgaaggaagtcaagctgagccccgataacgggaagaaaagagatctgtgcgaccaccacggtgagaagctgttgctcttctgcaaggaggaccgtaaagtaatctgttggctgtgtgaaaggagccaggaacacaggggccaccataccgtcctgaccgaggaagtcttcaaggagtgccaggaaaaattacaagcagtattaaaacggcttaaaaaagaggaggaggaggccgagaaactcgaagccgacatccgggaagagaaaactagctggaagtaccaggtccagactgaaaggcagcgtattcagacggagttcgatcaattgcgctccattcttaataatgaggaacaaagggagctgcagaggcttgaggaggaagaaaagaaaacgctggataagttcgccgaggccgaagacgaactggtccagcagaagcagttggttagggagctgatcagcgacgtggagtgccgttcacagtggtcaaccatggaactgcttcaggatatgtctggcattatgaagtggagcgagatctggagactaaagaaaccaaaaatggtgtctaagaaattaaagactgtttttcacgctcccgatctgagtcggatgctacagatgttcagggagctcaccgcagtgcggtgttactgggtggacgtgacactgaactcggtcaatctgaatttaaatttagtattgtccgaggatcagcgccaggtgatcagcgtgcctatttggccctttcagtgctacaattacggggttttgggctcccagtacttttcctccgggaagcactattgggaagtggacgtttcgaaaaaaactgcctggatcttaggtgtgtattgcagaacttattccagacatatgaaatatgttgttagacgctgcgccaaccgacaaaatctgtacaccaagtatcgcccacttttcggttactgggtgattggcttacagaataagtgtaaatacggcgtgtttgaggagagcctgtcaagcgacccggaggtgctcaccttgagcatggccgttccgccctgccgcgttggggtttttttggactacgaagccggaatcgtctcctttttcaacgtcacttcccacgggagcctcatttataagttctctaagtgctgcttctctcagcctgtgtatccatacttcaacccatggaattgtccagctccaatgacactgtgtcctccgtcaagctag

SEQ ID NO: 138858 - DNA, 1467 bp, Artificial Sequence
  Description of Artificial Sequence: Synthetic coding sequence
atggcttctaagattttgctcaacgtgcaagaggaggtgacttgtcctatttgtctcgagctgctgacagagcccttgtctctcgattgcggccactctctctgtcgagcctgcatcaccgtgtcaaacaaagaagccgtgactagcatgggaggaaagagtagctgccccgtttgtggaatctcatatagcttcgaacacctgcaggctaaccaacacttggctaacatcgtggagagacttaaggaagtgaaactttccccagataatggcaagaaacgggacctctgcgaccatcatggagaaaaactgctgctattttgcaaggaggacaggaaggtcatctgctggttgtgcgaaagatctcaggaacatcggggccaccatactgtgttgactgaagaagtatttaaggaatgccaggagaaactgcaggccgtactcaagcgacttaagaaggaagaagaagaagcggaaaaactggaagcggacattagggaggagaaaacatcctggaaatatcaagtgcagaccgagcgccaacgtatccagacagagttcgaccagctgcgaagtattctgaataacgaggagcagagagagctccaaagactggaagaagaagagaagaagaccctagataagttcgccgaagccgaggacgagcttgttcagcagaagcagcttgtgcgtgagctgatctccgacgtggaatgtagatcacagtggagtaccatggagctgctccaagacatgagtggaatcatgaagtggtccgaaatttggcgcctcaaaaagcctaaaatggtcagtaagaaactcaaaacagtgtttcacgcacccgacttgagtagaatgctgcagatgtttagggagctgaccgcagtccgatgttattgggtggatgtgacgctgaactcagtaaaccttaacctgaacctcgttctttctgaggaccaacggcaggtgatttctgtgcctatttggccgtttcagtgttataactacggtgtgctcgggtctcagtatttcagctctggtaagcactactgggaggtggacgtgtctaagaagaccgcttggattctgggcgtatattgccggacctattctagacatatgaagtacgtggtgagacggtgcgctaataggcagaatctctatacaaaataccgacctctctttgggtattgggtaatcggcctccagaacaaatgcaagtacggagtgtttgaagagagccttagcagtgatcctgaggtactgactctgtctatggctgtccctccatgtcgagtgggggtctttctggactatgaagccggaatcgtgtcattcttcaatgtcacatcacacggctctctgatttacaagttcagcaaatgctgtttttctcagccagtgtacccctatttcaacccctggaactgcccggccccaatgacgctttgcccaccctccagttag

SEQ ID NO: 138859 - DNA, 1467 bp, Artificial Sequence
  Description of Artificial Sequence: Synthetic coding sequence
atggctagcaaaatcttacttaatgttcaggaagaggtgacctgtccaatttgccttgaattgttaaccgaaccacttagtcttgactgcggacacagtctctgtagagcttgcatcactgtaagcaacaaggaagcggttacttccatggggggcaaatcttcttgcccagtttgtgggatatcctattcatttgaacatctgcaagcaaatcagcacctggccaacatagtggaacgcctgaaagaagtcaaactgagcccggataacggcaagaagagagacttatgcgaccatcacggcgaaaaactacttcttttttgcaaggaggacaggaaagtgatctgctggttgtgtgaaagatcacaggaacaccgggggcatcacaccgtgctaactgaggaggtcttcaaggaatgtcaggagaagttgcaggctgtacttaaacgcctgaaaaaagaggaggaggaggctgaaaaactcgaagcagatattcgggaggagaagacctcctggaagtaccaggtacagacagaacgccagagaatacaaactgaatttgatcaactgcgaagcattcttaataatgaagaacaaagggagctccagcggcttgaggaggaagagaagaagaccctggacaaatttgccgaggcggaggacgagcttgttcaacaaaagcagcttgtgcgagaattgatctcagacgtcgagtgtcggagccagtggagcacgatggagctccttcaagacatgtctggcatcatgaaatggtctgagatatggcgccttaagaagccaaaaatggtgagtaaaaagctcaagacggtgttccacgctcctgatctgagccgaatgctccagatgttcagagagcttactgcagtacgatgctattgggtggatgtgactctaaactccgtgaatttaaacctgaacctggtgcttagtgaagaccagaggcaggtcataagcgtgccaatctggccttttcagtgctacaactacggcgtgctcggttcacagtatttttctagtgggaagcattactgggaagtcgacgtatcgaagaaaacagcctggattttgggcgtttactgtcgcacttattctcgccacatgaaatacgtcgtccggcgttgtgccaaccggcagaacttatacaccaagtatcgaccactgttcgggtattgggtgattggcctacagaataagtgtaagtacggcgtgtttgaggagagcctgtcgagcgatccagaagtcctcacactgagcatggccgtgcctccttgcagggtaggtgtgtttctggactacgaagctggaattgtgagttttttcaatgtgacttctcacggcagtttgatctacaagttttctaagtgctgcttcagccagccagtctatccttatttcaacccatggaattgcccggctcctatgactctgtgccccccatccagctag

SEQ ID NO: 138860 - DNA, 1467 bp, Artificial Sequence
  Description of Artificial Sequence: Synthetic coding sequence
atggcgagcaagatactacttaatgtgcaagaggaagttacctgcccaatctgcctggaactgttaaccgagcccctctccctggattgtgggcactccctgtgtagagcttgtataacagtcagtaacaaggaggctgtgacctccatggggggaaagtccagttgcccagtctgtggaatcagctacagtttcgagcacctccaggctaatcagcatctggccaacatcgtggagcgtctgaaagaggtaaaactttcccctgacaatggaaaaaaaagagacctatgtgaccaccacggtgagaaattactcttgttttgtaaggaagatagaaaggttatttgttggctctgcgagcgctcgcaagagcacagggggcaccacaccgtcctaaccgaggaagtgttcaaggaatgccaggagaagttgcaggcggtcctaaaacggttaaagaaggaggaagaagaggccgagaagcttgaagccgacatcagggaagaaaaaacaagctggaaataccaggtacaaaccgagagacaacggattcagacagagttcgatcagttgagaagcatcctcaacaacgaagagcaacgagagctgcagcgactggaagaagaggaaaagaagaccctggataagttcgcagaggccgaggatgagcttgtgcagcaaaagcagctcgtccgcgaactgatcagcgacgtagagtgccggtcccaatggtcaacaatggaactccttcaggacatgtccggcatcatgaaatggtctgaaatctggcgtctgaaaaaaccaaaaatggtgtcaaagaaactgaagaccgtgtttcatgcccccgacttgagccgtatgctacagatgttccgcgaattaaccgccgttcgttgttattgggtggacgtgacactgaacagtgtgaatctcaacctcaacctggtattgtccgaggaccaacgacaggtgatctccgttcccatttggcctttccagtgttataactatggcgtcctgggtagccagtacttttccagcggcaagcactattgggaggtcgatgtgagtaagaagaccgcatggatactgggagtgtattgtagaacatactctcgccacatgaagtacgtggtgcgcaggtgtgccaacaggcagaatctgtatacaaaatatcgtccactcttcggctactgggtgattggcttacagaacaaatgtaagtacggcgtgttcgaggaatctttatcttccgaccccgaagtgctgaccctttccatggcagtccctccatgcagggttggggtcttcctggattacgaggctggcattgtttccttttttaatgttacaagccatggaagtttgatctataagttcagtaagtgttgtttctcacaacccgtttatccttacttcaacccatggaactgtccggccccgatgacactgtgtccaccttcttcgtag

SEQ ID NO: 138861 - DNA, 2187 bp, Artificial Sequence
  Description of Artificial Sequence: Synthetic coding sequence
atgtctgaaagcggcgagatgtcggaatttggctatattatggagctcatcgccaaaggcaaggttaccatcaagaatatcgagagggaactgatctgccccgcctgtaaggaattgttcacgcatccactgattctcccttgtcagcactctatttgccataaatgtgtgaaagagctgcttctcaccctggacgattctttcaatgacgtaggatctgacaacagtaaccagtcctcgccccggctgcgcctgccctctccctctatggataaaatcgacagaatcaatagacctggatggaagcgcaattcgcttactccccgaaccacagtgttcccatgccccggttgtgagcatgacgtcgatttgggcgaacgaggcattaacgggctattccgaaatttcacactagagacaatcgtggaacgctatcgccaggccgcccgcgccgccactgccataatgtgtgacctctgtaagcctcccccgcaggagagcacaaagtcctgcatggattgctccgcctcctactgtaatgagtgcttcaagatccaccacccttgggggaccattaaggcccagcacgagtatgtgggtccaaccaccaacttccggcctaagatcttgatgtgcccagagcacgagacggaaagaattaatatgtattgcgaactttgcaggcggccggtgtgtcatctgtgcaagcttggcggaaatcacgctaaccaccgggtgaccaccatgtcctctgcctacaaaactctaaaagaaaagctgagtaaagacattgactatttgattgggaaggagtctcaggtgaagtctcagatatccgaattgaatctcctgatgaaggaaactgaatgtaatggggagcgagccaaagaggaagcaattacccacttcgaaaaattgtttgaagtgcttgaggaacgtaaatcttcagttctgaaggcaatcgactcgagcaagaagctcaggctggataagttccagacgcagatggaggagtatcagggcctgctggagaataatgggctcgtgggttatgctcaggaggtcttaaaggagacagatcagtcctgctttgtacaaacagcaaagcagcttcacctccgtatccagaaagccacggagtcactgaagtcgtttcggccagccgctcagacgagctttgaagattacgtggtaaatactagtaaacaaacagagctgctaggcgaactttcattcttttcttctggtattgacgtgcccgagatcaatgaagaacagtctaaggtgtataataacgctctgatcaactggcatcaccccgaaaaggacaaagccgacagttacgtcctggagtaccgcaagatcaaccgagatgacgaaatgtcttggaacgaaatagaagtgtgcggtacctccaagataattcaggatctggaaaattctagtacttatgcctttcgggtgcgagcttataagggatcaatctgtagcccttgctcaagagagctgattctacacactcctcctgccccagttttctcattcctttttgacgagaaatgcggctataataatgaacacctattgctaaatctgaaacgtgatcgcgtcgagagccgggctggattcaatttgcttctcgcagccgagcgcattcaggtaggctactatacctccttggactacattatcggtgatacaggaatcaccaagggtaagcacttctgggcttttcgtgtagaaccttattcctatctggtaaaggtgggagtcgccagttccgacaaacttcaagagtggttacgttctcctagggatgccgtgagccctaggtacgaacaagactctggccatgactcaggatctgaggacgcatgctttgattcatcccagccctttacccttgtcaccataggaatgcagaagttctttatcccaaagagccccacctccagcaacgagcctgaaaaccgagtgctgccgatgccaacaagtattggcatcttcctcgactgtgataagggaaaagtggacttttacgatatggaccagatgaagtgcctctatgagagacaggtcgattgctcccacaccttgtatcctgcattcgctttgatgggctcaggtggaatccagctggaggagccaatcaccgccaagtatctcgagtaccaagaggacatgtag

SEQ ID NO: 138862 - DNA, 186 bp, Artificial Sequence
  Description of Artificial Sequence: Synthetic coding sequence
atgagcgagtctggcgagatgagcgagttcggttacattatggaactcatcgcgaagggcaaagcctccgcaatgggattacagcagacacacgaacattctaggctgacaagcaaaggaggcgaagcccgatgtccgttcgagatctctgaggtgggaaaacagtctctgccgcggcgcacgtag

SEQ ID NO: 138863 - DNA, 183 bp, Artificial Sequence
  Description of Artificial Sequence: Synthetic coding sequence
atgagtgagtctggggaaatgtcagaatttggctatattatggagctaatagccaagggaaagatgcccgactggcggaggggctatagatgtcggcagggatgcggcaaaaccaccgagctcgcgacagccaccgacttttcacaaactggtaataagagcgggaagcatttcaaaacgtag

SEQ ID NO: 138864 - DNA, 2895 bp, Artificial Sequence
  Description of Artificial Sequence: Synthetic coding sequence
atggacgagcagtcagtcgagtctatcgccgaggtatttaggtgttttatctgtatggagaaactccgagacgcaaggctgtgcccccactgttcaaaattatgctgttttagctgcatccgaaggtggttaacggagcagcgcgcacaatgccctcattgcagagcccctctgcagctccgtgagttagtaaactgcaggtgggctgaggaggttacccagcaactcgacacgctccagctttgcagcctgacgaaacacgaagagaacgaaaaggataagtgtgagaaccaccatgagaagctgagcgtgttctgctggacctgcaagaaatgtatctgccaccagtgtgctctctggggcggaatgcacggcggtcacacttttaaacccctggcagaaatatatgaacagcatgtgactaaagtcaatgaggaagtggctaaactccggcggaggctgatggaactcatttcattagtccaggaggttgagcgaaatgtcgaggctgtgagaaacgccaaggacgaacgagtgcgggagatccgcaacgctgtggagatgatgattgctcgactcgatacccagctcaaaaataagctgattactctgatggggcagaaaaccagtctcactcaggaaacagagctgctcgagtcattattgcaggaagtggaacatcagctgaggtcctgctcgaagtcagagttaatttccaaatcttcagagatcttaatgatgtttcagcaggtccatcgcaagcccatggccagctttgtcaccactccggtgcctcccgatttcacgtcagagttggtgccctcttatgactcagccaccttcgtgttggagaatttctctactctgcgacaacgggcagatccagtttacagcccaccactacaggtcagtggactgtgctggaggctaaaggtgtaccctgacggtaatggtgttgtgagaggatactaccttagtgttttcctggaactgtccgctggtcttcctgaaacatcgaaatatgagtatcgagtcgaaatggttcatcagagctgtaatgatcctaccaagaatatcattagggaattcgcatcagacttcgaggtgggtgagtgttggggttataatcggttctttcgtctcgacctgttagctaacgagggctacttgaatccccagaacgacactgttatcttgcgctttcaagtccgcagtccaacatttttccagaagtcgagggaccagcattggtatattacgcagctggaggcagcccaaaccagctacattcagcaaatcaataacttaaaggagagactaactattgagctgagtaggacccagaagagcagagatctgagcccacctgacaaccaccttagcccccagaacgatgacgccctggagacgagagcaaagaagagcgcctgtagcgatatgctgctcgaaggcggacccaccacggcgagcgtgcgcgaagctaaggaggatgaggaggacgaagagaaaattcagaacgaagattaccaccatgaactgtcagatggcgacctagatctggatttggtgtatgaagatgaagtgaaccagcttgacggctcctcttcttcagcttcaagcacagccacctctaatacagaagagaacgatatcgatgaagagacaatgtctggcgagaacgatgttgagtacaacaacatggaactagaggaaggagaactcatggaagacgccgcagccgctggacccgccggatcgtcgcatggctacgtcggcagtagcagtcgcatctctcgtcgcacacacctgtgcagtgccgctacgtcaagtctgctggatatagacccacttatcttgattcaccttctggatttaaaggatagatcgtctatcgagaacctgtggggcctccagccccgcccacctgcgtcccttctgcagcctaccgcatcctatagccggaaagacaaagaccagcgaaaacagcaggccatgtggcgagtccctagtgatcttaaaatgctcaagcgtctcaagacacagatggctgaagtcaggtgcatgaagaccgatgtgaagaacacccttagtgagataaaaagcagttctgcagccagcggtgatatgcagacatcgcttttttctgcagatcaggctgccctggccgcttgcgggacagaaaacagtgggagactgcaggacctgggaatggagctgctcgccaagagcagcgtcgctaactgttatatcaggaacagtaccaataagaaaagcaattctcctaagccggctcggagctcggttgcaggctccctgtctctgcgccgggccgtcgaccccggagagaactcgcgctctaagggtgactgccagacattgtctgaagggagtccagggtcctcccagagcggctctagacattcatctcctcgagcactcatccacgggagcatcggggacatcctgcccaaaaccgaggaccgccagtgcaaagccctcgactctgacgctgtggtagtagctgttttcagtggcctacccgcagtcgaaaagagaaggaagatggttacccttggcgctaacgcaaagggcgggcaccttgaggggcttcagatgacagatctcgaaaataacagcgagaccggggaactgcaaccggtgctgcccgaaggtgcctctgccgcccctgaggagggaatgtcctcagactccgacatagaatgtgacaccgaaaatgaggagcaggaggaacatacatcagtcgggggctttcacgactctttcatggtgatgactcagccacctgatgaagacacccacagttcttttcctgacggcgagcagattggccctgaagacttgtcatttaatactgacgagaactctggacggtag

SEQ ID NO: 138865 - DNA, 2412 bp, Artificial Sequence
  Description of Artificial Sequence: Synthetic coding sequence
atgcacggcggccacacctttaagccgctggccgagatctacgagcaacatgttacaaaggttaacgaggaggttgcaaagctgaggagacgcctgatggagctcatttctcttgtgcaagaggttgaaagaaacgttgaggctgttcgaaacgccaaggacgagagggttcgtgagatcagaaacgccgtcgagatgatgattgcgcgcctcgatacccaactcaaaaacaaattaatcacactgatgggacagaaaacttctcttacgcaggagacggaattgctcgaaagcctgctccaggaggtcgagcatcaactcagaagctgctcaaagagtgaactgataagcaaatcctcggaaattctaatgatgttccagcaggtacaccgaaaacccatggcttcatttgtgaccacccccgtgcccccggatttcaccagcgagttagtcccctcctatgatagcgccacctttgttctggagaatttcagcaccctgagacagagagccgacccagtttattcaccacccctgcaggtgtccggtttatgttggaggttaaaggtgtaccccgacggcaatggcgtggtgcgcggctactacctctcagttttcctggagctgtcagcaggactccccgagaccagcaagtatgaatatagggttgagatggtgcaccagagctgtaacgacccaacaaagaatatcatccgagagttcgccagcgatttcgaggtgggagagtgctggggctataaccgtttctttcggctggacctgctcgcgaatgaaggataccttaacccacagaatgataccgtcattctgcgcttccaagtaaggtcgccgacatttttccagaagtctcgagatcagcactggtatattacacagctcgaagccgcacagaccagttacatccaacagatcaacaatctaaaagaacggctgacaattgagctctccagaacacaaaaatctagggatctgagccccccagataatcacttatccccgcagaacgatgacgccctggagacacgcgcgaagaagagtgcatgcagcgatatgttgcttgagggcgggcctacgaccgcatcagttagggaagcaaaagaggacgaggaggacgaagagaagatccaaaacgaagactaccatcatgagcttagcgatggtgaccttgacctggacctggtctacgaagacgaggtcaatcagcttgacggctcttcatcaagcgcaagcagcaccgccacctctaataccgaagaaaatgatatcgatgaggagaccatgagcggggaaaatgatgtcgagtacaataatatggagctggaggagggagaactcatggaggatgctgctgcagcgggaccagctggatccagccacggttatgtgggcagcagctcccgcatatcccgcaggacccacttgtgctctgcagctacctcaagtctgttggacatcgaccccctcatcctgatccacctcctcgaccttaaggaccgatcatctatagagaacctgtgggggcttcagcctcgacctccggcgtccctgctacagccaactgctagctacagtagaaaggataaagatcaaagaaaacagcaggctatgtggcgggtgcctagtgacttaaaaatgctgaaacggctgaagacacaaatggctgaggtgaggtgtatgaaaacagacgtgaagaatacgctgtccgagattaagagctcctcagcagcgtcaggcgatatgcaaacgtcattattctctgctgaccaggcagctctcgcagcctgcggcactgagaactcaggcaggctacaggatctgggaatggagctcctcgcaaaatctagtgtcgcgaactgctacattcgaaactccacaaacaagaaatctaattcccctaagcctgccagatcgagcgtcgctggctccctcagtttgcggagggctgtggacccgggagaaaatagtaggtccaaaggagactgtcagacactgtcagaggggtcccccggcagctctcagagcggatccaggcacagctcgcctagggctttgatccatggttcaatcggagatatcctacctaagactgaggataggcaatgtaaggctcttgattcggatgcagtcgtcgtcgctgtattttcaggcttgccagcagtggaaaagaggaggaaaatggtgaccttgggcgcgaacgccaagggcggccacttagaagggctgcagatgacggacctcgagaacaacagtgagaccggcgagctccagcccgtgttgcccgagggagcctcagccgccccagaggaggatactcactccagctttccggacggcgagcagattggcccagaggacctgtcgttcaatactgacgagaactcagggaggtag

SEQ ID NO: 138866 - DNA, 2793 bp, Artificial Sequence
  Description of Artificial Sequence: Synthetic coding sequence
atggacgaacagtctgtcgagcgctggttaaccgagcaaagagcccagtgcccccactgtagagcccccctccagctcagagaactggttaactgccggtgggccgaggaggtaacacagcaacttgatacacttcagctatgctccctaacaaagcacgaggagaatgaaaaagacaaatgcgaaaaccaccacgagaagctttcagtgttctgttggacctgtaagaagtgcatttgtcaccaatgcgccctgtggggcgggatgcatgggggacacacttttaagcccttagcagagatctacgagcaacacgttacaaaggttaacgaagaagtggcaaagctacgaaggagactcatggaactgatttccctcgtacaagaggttgaacggaacgttgaagccgtccggaatgcaaaagatgaaagagttcgtgagatcagaaacgcggtggagatgatgattgctcggctcgatactcagctgaagaacaagctcattacgctcatgggccagaaaacatccctcacccaggagacagagctgttggagagtctcctgcaggaagtggagcatcagctccgaagttgctcgaaaagtgaactgatttccaagtcaagtgagatcctgatgatgttccagcaagtgcatcggaagcccatggcctcttttgtcacaacccctgtgccccctgacttcacaagtgaactggtgccttcttacgacagcgctacatttgtgttagaaaacttttccacactacggcagcgggctgatcccgtttatagcccacctctgcaggtgtctgggctctgctggcgcctgaaagtttaccccgatggcaacggggtggtgcggggatattacctgagtgtctttctggagcttagcgccggactgcctgaaacctcaaagtacgaatatcgggtggaaatggtccaccagtcttgcaatgatccaacaaaaaacatcatacgcgagttcgcctccgatttcgaagtcggtgagtgctggggctacaatagattcttccggctcgacctcctggccaatgaggggtacctaaatccccagaacgacacagtaattctgcgatttcaagtccgctcacctacgttcttccaaaagtcccgggaccagcattggtatatcacccaactcgaggccgcacaaactagctacatccaacagatcaacaatttgaaagaacgccttaccattgagctgagtagaacgcagaaatccagagacctgtcgcccccagataaccatttgagccctcagaacgacgacgctcttgaaacgcgcgcgaagaagtctgcatgcagtgatatgctgcttgaaggggggccaactacagcatctgtacgggaggcaaaagaggacgaggaagacgaggaaaagatacagaatgaggattaccaccatgaactgagcgatggagatctggaccttgaccttgtctatgaggatgaggtaaatcagctcgacgggagcagttcatcagcgtcttccaccgccacatctaataccgaggagaatgatatcgacgaggaaaccatgtcaggtgaaaacgacgtggagtacaataacatggagctcgaggaaggtgagctgatggaagacgcagctgcagcagggccagccggatccagccacgggtacgtgggcagttcctcccgaatttcaaggcggacacacctatgctccgccgccactagctccctgctagatatcgatcccctgatactgatccacttactcgacctaaaggacaggagctccatagagaacctgtggggcctacaaccaaggcctccagcgtccctgctgcagccgaccgcttcttactctagaaaggataaggatcagcgcaagcagcaggccatgtggagggtgccttcagacctcaaaatgcttaagcggctgaagacacagatggccgaggtgcgatgtatgaaaaccgacgttaagaacaccctgagcgaaattaaatccagcagcgccgccagcggcgacatgcagacatctctattttccgccgaccaggctgcattagcagcatgcgggaccgagaattccggcaggctgcaagaccttggaatggaactgctggcgaaatccagcgttgccaattgttatatacggaatagtaccaacaagaagtccaacagtcccaagcctgccagatcctcagtggccggttctttatcgttgcgccgggccgtggaccccggcgagaattcacggtctaagggtgactgccagacactttctgaaggttcgccgggttcatcacagtccgggtcacgccactcctctccaagggcactgatccacggctccatcggcgacatcctgcctaaaaccgaagacaggcagtgtaaggcgcttgattctgacgccgtggtcgtcgctgtgttctctgggttgccagcggtagaaaaaagacggaagatggtgacattgggagccaacgcgaagggggggcatctggaaggtctccagatgactgacctggagaacaactcagagacaggcgaactgcagcctgtccttcccgagggggcctcagcagctccggaggaaggcatgtcttccgatagtgacatagagtgcgacacagagaatgaagagcaagaggagcatacaagcgtaggagggtttcacgacagcttcatggtaatgacacagccacccgatgaggacactcactcctcttttcctgatggcgagcaaattgggcctgaagacctgtcgttcaatacagatgagaactctgggcggtag

SEQ ID NO: 138867 - DNA, 2895 bp, Artificial Sequence
  Description of Artificial Sequence: Synthetic coding sequence
atggacgaacagagcgttgagtcgattgcggaggtgtttagatgtttcatttgcatggaaaagttgcgagacgctcggctgtgtccccattgttcgaaattgtgctgcttcagctgcatacgcagatggcttacagaacagcgtgcccagtgcccccattgccgggcccccctgcagctccgggagcttgtgaattgcaggtgggcggaggaggtgacacaacagctggatactctgcagctctgttccctgaccaagcatgaggaaaacgaaaaggataaatgcgagaatcatcacgaaaaactctccgtcttctgttggacatgcaaaaaatgtatatgccatcagtgtgccttgtgggggggcatgcatggaggtcacaccttcaaacccttagctgagatctatgagcagcacgtcactaaagttaacgaagaggtcgcaaaactcaggaggcggctcatggaactcatcagcctagtgcaggaggtcgagagaaacgtggaggcagtgagaaatgctaaagacgagagagtgcgtgagattcgcaatgcagtagagatgatgatcgcacgcctggatactcaactgaagaataaactgattacgctgatggggcagaaaacaagcctgactcaggagaccgaacttcttgagtcattgttgcaggaagtagaacatcaattacgcagctgcagcaaatccgaattgatcagcaaaagctccgaaatcctgatgatgttccagcaggtacatagaaagccaatggcctcttttgttactacccctgtgccccctgattttacctccgagctggtgccctcttacgactctgccacattcgtgcttgaaaacttcagcacactcaggcagagggccgatcctgtgtattccccaccccttcaagtctctgggctgtgttggcggttaaaggtgtatccggatgggaatggcgtggtcaggggctactacctgtcggtgttcctggagttgagcgccgggctccccgaaacttctaaatacgaataccgcgttgagatggtgcaccagtcctgcaacgaccctacaaagaacataattcgagaattcgcctctgactttgaggtcggagagtgttggggttataacagattttttcgactggacctcctcgccaatgaaggatatctgaacccacaaaatgatactgttatacttcgattccaggtacggtcgccgactttctttcagaaatcgcgcgaccaacattggtatatcactcaactcgaagctgcacagacaagctatatccagcagatcaataatttgaaagagaggcttacaatcgagctgtcgcgcacccagaagtctagggatctaagcccccctgataaccatttatctccccagaacgatgacgccctggaaacacgggcaaagaagtcggcatgcagtgatatgttgctggaaggcggccccacaacagcgtctgtgagggaggctaaggaagacgaggaagacgaagagaagatccaaaatgaggactaccatcacgaacttagcgacggagacttggatctggatctcgtgtatgaagatgaggtgaaccagttagacgggtcatcgagctcggcgagctctacggcgacaagtaatactgaagagaatgatatcgacgaggaaaccatgtccggagagaatgacgtcgaatataataatatggagcttgaggaaggcgagctcatggaagacgccgccgccgcaggccctgccggctcctcccacggctacgtgggctcatcctctagaatatcccgcagaacccacctgtgctctgcggctacatcaagtttgcttgatattgaccctctgatcttaatccatctcctagatctcaaagacagatcgtcaattgagaatctgtggggtcttcagccccgccctcccgcatccctgcttcaacctaccgcttcttacagtcgcaaggataaggatcaacgcaaacagcaagccatgtggcgcgtgccttctgaccttaaaatgctcaagaggctcaaaactcagatggcagaggtccggtgtatgaagaccgacgttaagaatacactgagcgagataaaaagcagttcagctgcatctggagatatgcagacctctttgttcagcgctgatcaggctgccctggctgcctgtggcactgaaaactctggccggttgcaggatctgggaatggaactattggccaagtcctctgtggctaactgttacattcgcaactctacaaacaaaaagagtaatagccccaagcctgcccgttcttccgtggcagggtctttatctcttcgcagggcggtagacccgggggagaactcccgtagcaaaggtgactgtcaaacattgagcgaaggctccccaggctccagccagtcaggttcaagacatagttcaccacgagcgctgattcatggcagcatcggcgatattctgcccaaaacagaggacaggcagtgtaaggccttagactcagatgcggtagttgtggcggtgtttagtggtctaccggctgtcgagaaaaggaggaagatggtcacactcggcgccaacgctaagggcggccacctggaggggttacagatgactgatctggagaacaactcagaaactggtgaattgcagccagtcttgcctgaaggcgcctccgcagcaccagaggaagggatgagctcagatagtgacatcgagtgtgacaccgaaaatgaggagcaggaggaacatacctctgtggggggattccacgacagcttcatggtgatgacgcagcctcccgatgaagacactcacagctcctttcccgatggtgaacaaatcggcccagaagatctttccttcaatacagacgaaaattcggggcgctag

SEQ ID NO: 138868 - DNA, 1557 bp, Artificial Sequence
  Description of Artificial Sequence: Synthetic coding sequence
atggctgaaaccagtcttcttgaggcaggggcaagtgcagcctccactgcagctgccctggaaaacttgcaggttgaagcatcctgctcagtgtgccttgagtatttgaaggagcctgttattattgagtgtggtcataacttttgcaaggcttgtatcacgcgatggtgggaggacttggaacgggactttccatgtcccgtctgtcgcaagactagtaggtataggtccctccgccccaatcgccagctgggaagtatggtggagattgctaagcagctccaagccgtgaaaaggaaaatccgtgacgagtcactatgtcctcaacatcacgaggccttgtccctgttctgctatgaggaccaagaggcagtctgtctaatttgcgccatctcacacacacacagagcacataccgtggtgcctctggatgacgccacgcaggagtataaggagaaactgcagaagtgcctcgaaccccttgagcaaaaactccaggagatcacccgatgtaagtctagcgaagagaagaaacccggggagttgaagcgactggtcgagtccaggcgccaacagatcctgagggagtttgaggaactccatcggagactcgacgaagagcaacaggtgttgctgtctcggttggaggaagaggagcaggacattctccagcggctccgggagaacgctgcccatttaggagacaagcggcgcgatctggcacacctcgccgccgaggttgaaggaaaatgccttcagtctggcttcgaaatgcttaaagacgttaagtctacccttgagaagaatatacctagaaagtttggcggctccctgtctaccatctgtcccagggatcataaggccttgctcggcctggtgaaggagattaaccgatgtgaaaaggtgaaaacgatggaagtcacaagtgtcagtattgaactggagaagaacttctcaaatttccccaggcagtatttcgccctccggaagattctaaaacagttaatagccgatgttaccctggacccagagactgctcaccctaacttggtgcttagcgaggatcgcaagtccgtgaagttcgtggagacacggcttcgtgatttgcccgacacccctcgccgctttactttttacccatgtgtgttggctactgaaggattcacatccggacggcactactgggaggtggaggtaggcgacaagacacattgggccgttggtgtctgtagggactccgtgtctaggaagggagaactaactcctcttcccgaaaccggctactggcgggtgcgtctctggaacggcgacaaatacgcagccacgacaacacctttcacaccgctgcacattaaggtaaaaccaaagagagttggtatttttctcgactacgaagccgggacactaagtttttacaatgtcaccgataggagtcatatctacacgtttacagacacttttacagaaaaactgtggccactgttttatcccggtattagagccggacggaaaaatgcagccccacttaccataagacccccaacagactgggagtag

SEQ ID NO: 138869 - DNA, 1467 bp, Artificial Sequence
  Description of Artificial Sequence: Synthetic coding sequence
atggcagagacatccctgctggaggctggggctagtgccgcctctactgccgccgctctcgaaaatctgcaagtggaggcttcctgctctgtgtgtctggaatacttgaaggagccggtcatcattgaatgtggccataacttctgcaaagcttgcatcactagatggtgggaagatctcgaaagagattttccctgccctgtctgtcggaaaacctctcgctatcgctcactgcgtccaaatcggcagcttggctcgatggtcgaaattgccaaacaactgcaggctgtcaagcgcaagattagggatgagagcttgtgtccccagcaccacgaggcgctgagtcttttttgttatgaggatcaggaggctgtttgcctgatctgtgcaatatcccacacgcaccgcgcccatactgttgtccccctcgacgacgccacacaggaatataaagaaaagctccagaagtgcctagagcctctcgaacagaagctccaggagatcacacgttgcaagagctcagaggagaaaaagcccggcgaactgaaaaggctggtggaaagtcggcggcagcagattctgagggagtttgaggaacttcatcggaggctggatgaggaacaacaggtattacttagtcgtctcgaagaggaagagcaagacatactacaaaggctgagggagaatgctgctcaccttggtgataagcggcgcgatctcgctcacctcgccgccgaggtggaaggaaagtgccttcagagcggctttgaaatgctgaaggacgtcaaatctacgctcgagaagtgtgagaaggtgaaaactatggaagttacgtccgtcagcatcgaactagagaaaaacttttccaacttccctcgacaatactttgcactccgcaaaattctgaagcagctgatcgcagacgtcaccctggatcccgaaactgcacacccaaacctcgtgctttccgaggacagaaagagcgtcaaattcgtggaaactcgcctcagagaccttcctgatacgccccggagatttactttttacccatgcgtgctcgcgacggagggtttcactagcggaaggcactattgggaggtagaggtgggcgacaagactcactgggcggttggggtatgtcgcgactccgtctctcggaaaggtgagctgactcctttgccagagacaggctattggcgcgtcagattgtggaatggcgacaaatacgctgcaactacaacgccgtttacacctctgcatattaaggtgaagcctaaacgcgtgggcatcttcctcgattacgaagctggcaccttgtctttttacaatgtcaccgatcgtagtcatatttataccttcacagatacctttaccgaaaaactttggccattattttaccccggcatccgtgcgggtcggaaaaacgccgctcccctcaccatcaggccgccaaccgattgggagtag

SEQ ID NO: 138870 - DNA, 1467 bp, Artificial Sequence
  Description of Artificial Sequence: Synthetic coding sequence
atggccgaaacctccctcctcgaagcaggcgcatcagcagcttctaccgctgccgcattggagaaccttcaggtagaggcaagctgttccgtttgtttggagtatctgaaggagcccgtgatcatcgagtgtggccacaacttctgtaaggcgtgcattactcgctggtgggaagaccttgaaagagattttccctgcccggtgtgtcgtaagacatctagatataggagtctgaggccaaacagacagttgggcagcatggtggagatagcgaagcagctccaggccgtcaaaagaaaaataagagacgaaagcctatgtccccagcaccatgaagccttgtcgctgttttgttatgaagatcaggaagctgtttgtctcatctgtgccatttctcacacacacagggcccacactgtggtacctctggatgacgctacacaagagtataaggaaaagttacaaaaatgtctggaacctttagagcagaaactgcaggaaattactcgatgcaagtcaagcgaagagaagaagcccggtgaactgaaacggctcgtagagtcaagaaggcagcaaattctccgtgagttcgaggagctccaccgccggctagatgaggagcagcaggtgttgttgagccggctggaggaagaggaacaagacatacttcagaggctacgggaaaatgcagctcaccttggggacaaacgcagagatctggcccacctcgctgccgaggtagagggaaaatgcttacagtccgggttcgaaatgttgaaagatgtgaaaagcaccctggagaaatgcgaaaaggtgaaaacaatggaggtcacctccgtgagtatcgagttggagaaaaatttctcgaacttccctcgccaatactttgcgttgagaaagatcctaaaacagttaatcgccgatgtgacactggacccagagaccgctcatccaaatctggtcctgagcgaagaccgcaagtccgtgaaatttgtggagactaggctccgcgacttgccggataccccacgaaggttcaccttctatccttgtgtgctggccactgagggttttacttctgggcgccactattgggaagttgaggtcggagataaaacccattgggcggttggggtttgccgagatagtgtctcgcggaaaggagagctcacccccctgccagagaccggctactggcgcgttcgcttatggaacggcgacaaatacgcagcaaccacaaccccattcacgccgcttcatattaaagtgaaacctaaacgcgttggcatctttctcgactacgaggccggtacattgtccttttacaacgtcaccgataggagtcacatatacacatttaccgacacattcactgaaaagctgtggcctctcttttacccaggaatccgggcgggtcgcaaaaacgccgctcccttgacgatccgtccccctacggactgggagtag

SEQ ID NO: 138871 - DNA, 1557 bp, Artificial Sequence
  Description of Artificial Sequence: Synthetic coding sequence
atggcagagacaagcctgcttgaagcgggtgcctccgccgcttcaaccgctgccgctctcgagaatctccaggtggaagcctcttgcagtgtgtgcctggaatatctgaaggaaccagtaattatcgaatgcggtcataacttctgtaaagcatgcatcacgaggtggtgggaagatctggaacgggactttccatgccctgtctgcagaaaaactagccgctaccggtcccttcggcccaaccgtcagcttgggagtatggttgagatcgcaaaacagctgcaggccgttaaaagaaaaatacgtgacgagtcgctttgccctcagcatcatgaggcattatccctgttttgctacgaggaccaggaggcagtgtgcctgatctgtgcaatctcacacacccacagagctcacaccgttgttcccctcgatgatgctacccaagagtacaaggaaaagttgcaaaaatgtctggagcccctcgaacaaaagctccaggaaatcaccaggtgcaagtcaagtgaggaaaagaagcctggggagctgaaacgcctggtggagagtcgtaggcaacagatcctgcgggagttcgaagaactgcataggcgacttgatgaagaacagcaggtgttattgtcacgcttggaggaggaggaacaagacatccttcagaggctgcgcgaaaatgcggctcaccttggagataaacgtcgcgatctggctcatttggccgccgaggtcgaggggaagtgcctgcaatctgggttcgaaatgctcaaggatgtcaaaagtacactagaaaagaacattcctagaaagtttggtgggagtctatcaacaatctgtcctagggaccataaggctctcttgggactggtaaaagagatcaatcgctgtgagaaagtgaaaaccatggaagtgacatctgtgagcatcgagcttgagaaaaatttctctaactttcctagacagtatttcgcacttaggaagatactcaaacaactaattgctgacgtgaccttggatccggaaaccgcacacccaaatctggttttgtccgaggacaggaagtccgtaaagtttgtggagacacggctgcgcgaccttcccgatactccgaggagatttacattttatccctgcgtgctagccaccgagggtttcaccagtggaaggcactactgggaagtggaagttggcgacaagacccactgggctgttggcgtgtgtcgggattccgtgtcaagaaaaggggaactcactccactacccgagaccgggtactggagagtccggctctggaacggcgacaagtacgccgctacaacaactccatttacccctctgcacattaaggtgaaacccaagagggtgggcatttttttagactatgaggcagggacacttagcttttacaatgtaacggaccgctcgcacatttatacctttaccgacacattcactgagaagctgtggcccttgttttacccggggatacgtgcaggtcgtaagaacgccgcccctttgaccatccggccccctactgactgggagtag

SEQ ID NO: 138872 - DNA, 1467 bp, Artificial Sequence
  Description of Artificial Sequence: Synthetic coding sequence
atggccgagaccagcttgctcgaagctggagcatcggccgcctcaacagcggctgccttggagaacctacaggtcgaggcctcctgttccgtctgcctggagtacctcaaggagccagtgataatagaatgtggacataacttctgcaaagcatgcattacccgctggtgggaggacctagaaagggatttcccctgtccagtctgccggaagaccagtcgctaccgcagtctacgtcctaatcggcagttgggttctatggtggaaatcgctaaacagttacaggctgtgaagcggaaaataagggacgagtctttgtgtcctcaacatcacgaggcactctccctgttttgttacgaagatcaggaagccgtgtgtctaatttgcgctatcagccacacacatagagctcacaccgtggtgcctttggacgatgctacccaggagtataaagaaaaactgcagaaatgccttgaaccactggaacagaagctgcaagagattacacgttgtaaatcatccgaggagaagaaacctggcgagctcaaaagactggtggaaagtaggcggcagcaaatcctgcgcgaattcgaggagctccaccggcgtctggacgaagagcaacaagtgttactgtctcgcttggaggaggaggagcaggatattctgcagcgtcttcgcgagaacgcagcgcacctgggtgacaagagacgcgacctagctcatttggccgcagaagtcgagggaaaatgcctccaatcaggcttcgaaatgttaaaggatgtcaagagtacgctggaaaagtgtgagaaggtgaaaacgatggaagtgacttccgtcagtatcgagctggaaaagaacttcagcaatttcccccgtcagtactttgctctgcgcaagatccttaaacagcttatcgcagacgtcacgctggaccctgaaacagcgcatccgaacctggtcttatctgaagaccgcaagagcgtgaagttcgttgagactcgcttgagggacttgcccgacaccccgcgccggtttacgttctatccttgtgttctggccactgaaggatttacttctgggagacactactgggaagtggaagttggagacaaaacccactgggccgtcggcgtctgtagagactccgtctccagaaagggagagctgacccccctaccagaaaccggatattggagagtgcgcctctggaatggcgataaatatgccgctaccaccacaccttttactccgctgcacattaaagtaaaaccaaagcgtgtggggatcttcttggattacgaggcaggcacgctctctttctacaatgtcacggatcgttctcatatctatacttttacagacaccttcacagagaagctatggccacttttctaccctggaatccgggctggccgtaagaacgctgcccctctcaccatcagacctcccaccgactgggaatag

SEQ ID NO: 138873 - DNA, 1557 bp, Artificial Sequence
  Description of Artificial Sequence: Synthetic coding sequence
atggccgaaacctctctgctcgaggccggcgcctccgcggcatccaccgctgctgcgctcgaaaacttgcaggttgaggccagctgtagtgtctgccttgagtacctcaaggagccggtgattatagagtgtggacataacttttgcaaggcctgcataacgaggtggtgggaggatctggagagggatttcccttgtcccgtctgcagaaagacaagtagatatcgcagcctcagacccaatcgccagctcggaagcatggttgaaatcgccaagcagctgcaggccgtaaagcggaaaattagagacgagtcgctatgtccgcagcaccacgaggcattgtctttgttttgctacgaggaccaggaagccgtgtgtctgatttgtgccatatcacacacacacagagcccacacagtggtgcctctcgatgatgccacccaggagtataaggaaaagttacagaagtgtctggagcctcttgagcagaagctccaggagatcacgcggtgtaaatccagtgaggagaaaaagccaggagagctgaagagacttgtggagagccgtcggcagcagattctgcgcgagtttgaggaactgcaccgaaggctggacgaggagcagcaggtcctactttctaggttggaggaagaggaacaggacatactccaacgccttagggagaatgctgcccatttgggtgacaaacgccgggacctggctcacctcgccgcagaagttgaagggaagtgcctccagtccgggtttgagatgctcaaggacgtgaaatccactctcgaaaaaaacatccccagaaagttcggaggctcactgtctactatctgcccccgtgatcataaggcactgctgggtctggtgaaggaaatcaaccggtgcgagaaagtgaagaccatggaggtcacgagtgtgagcatagagcttgaaaagaatttctcaaatttccctcggcagtattttgcattacgcaaaatcctaaagcaactgatagccgacgtgaccctggatcccgagactgctcacccaaacctggttctttcagaggataggaagtcagtgaagtttgtggagactcggctgagagatctgcctgacacaccccgccgctttaccttctatccttgtgtgttagcgactgaggggtttacctccggtagacactattgggaggtggaggttggcgacaagacacattgggccgttggggtttgcagggacagcgtctccagaaagggagagctgaccccactgcccgagacgggctattggcgggtccgactttggaacggcgacaaatacgctgcaacgaccacccctttcacacctcttcacatcaaggtcaagcctaagcgcgtcggtatttttttggattacgaagccgggacactctctttttataatgtgacggaccgtagtcacatctataccttcaccgacaccttcactgaaaaactgtggccactcttttaccccggtatccgggcaggcagaaagaatgcagccccgcttactataaggcccccaaccgactgggaatag

SEQ ID NO: 138874 - DNA, 1467 bp, Artificial Sequence
  Description of Artificial Sequence: Synthetic coding sequence
atggctgaaacttcattacttgaagctggggcttcggcagcctctactgccgccgcattggagaacttacaggttgaagcatcctgcagcgtttgtctggagtatcttaaggagcccgtgattatcgaatgcggacataacttttgcaaggcatgtatcactagatggtgggaggacctcgagcgcgattttccatgcccagtgtgccggaaaacatctagatacaggtccctgcgcccaaaccgccaattaggatcaatggtagagatagcaaaacaactgcaggccgtgaagaggaagatccgggatgaatctctgtgcccgcaacaccatgaagcactcagccttttttgttacgaggatcaggaagctgtctgcctcatctgcgccatatcccacacacaccgcgcacatacagtcgtgcctctggatgacgcaacccaggaatataaagaaaaactccagaagtgcctggaacctctggagcaaaaactacaggaaattaccaggtgcaaatcatccgaagagaagaagccgggcgaactgaagcgactcgtggaatcccggaggcaacagatcttgagggaattcgaggaacttcacaggagattagatgaagagcagcaggtcctgctgagtcgactggaggaggaagaacaggatatactacaacgactgagagagaacgcagcccacctgggagacaagagaagggacttagctcacttggcagcagaggtcgaagggaagtgcctccagtccggctttgaaatgctgaaggacgtgaagtctaccctcgagaagtgtgaaaaagttaaaacaatggaggtgacatccgtgtccatcgagctggaaaaaaatttctcgaacttcccacgacagtattttgctttaaggaagatccttaagcaactgatcgccgatgtaactctggatcctgaaacggcacaccctaacctggtcctgagcgaagaccgtaagagcgtgaaatttgtagaaaccaggctgcgcgacctaccagacacccccaggcggtttaccttctacccttgcgttctcgccacagaaggcttcacctccggtagacactattgggaggtggaagtgggcgacaagacccattgggccgtgggggtctgccgtgatagtgtatccaggaagggcgaacttaccccgttgccagaaacaggctattggagagtccggttatggaatggagataagtatgctgcaacaaccacacctttcactcctctgcacatcaaagttaaaccaaagagggtgggtatatttttagattacgaggctggaacactgagtttctacaacgtaacagacagatcgcatatttacactttcactgataccttcaccgaaaaactctggcctctgttctacccaggcattcgtgccggacgcaagaacgctgctccccttactataagaccgcctaccgactgggaatag

SEQ ID NO: 138875 - DNA, 1467 bp, Artificial Sequence
  Description of Artificial Sequence: Synthetic coding sequence
atggccgagacctccttgttggaagcaggagcgtccgcagcaagtaccgctgcggctttggagaacttgcaagtggaggccagctgttctgtgtgcttagaatatttaaaggaaccagtgattattgagtgtgggcataacttctgcaaggcttgcatcactcggtggtgggaagatctggaacgcgattttccctgtcccgtctgccggaagacgtcacgctaccgttcactgcggccgaataggcagctgggttcaatggtggaaatcgcaaaacagctgcaggctgtcaaacgaaagatacgggatgaaagcctgtgtccacagcaccatgaggcgctgagtttattctgctacgaagaccaggaagcggtgtgcctcatttgcgccatttcacacacacaccgcgctcacacagtggtcccgcttgatgatgcgacccaggagtataaggaaaagctccaaaaatgcctggagccacttgagcagaagctccaggaaattactcgctgcaagtcgagtgaagaaaaaaagcctggagaattgaagagattggtcgaatctcgacgacagcagatactccgcgaatttgaggaacttcacaggagactggacgaggagcagcaggtactgctgagtcgtttggaggaggaagagcaagacattctccaacggctgcgtgagaatgccgcccacttgggcgacaagagacgggaccttgctcacctggcagccgaggtcgagggtaagtgcttgcaaagtggctttgagatgctgaaagacgtgaaaagcaccctcgaaaagtgcgagaaggtaaagaccatggaagtcacatccgtgagcattgagctcgaaaagaacttttctaattttccacgccagtacttcgcccttagaaaaatactcaagcagttgattgcagacgttactcttgatccggagacagctcaccccaacttggtgctgagcgaagataggaaatccgtgaaattcgttgagaccagactgcgagacctcccagataccccaagaaggttcactttctatccttgtgtattggccactgagggatttacgtcggggcggcactattgggaagtcgaggtgggcgacaaaacacattgggcggtgggcgtttgtcgcgatagcgtgtcgcgcaagggggaactcaccccattgcccgaaaccggctactggcgggtccgactgtggaacggcgacaagtacgccgctacgactacacccttcacaccgctgcatataaaggtgaaaccaaaaagggtcggcattttcctggactatgaggctgggacgctcagtttttataacgtgacagaccggagccatatatacacattcacggatacttttactgagaagctttggccgttgttttatcccgggattagggcaggtcgaaaaaacgcagccccactgacaatcaggccacccacagactgggaatag

SEQ ID NO: 138876 - DNA, 1467 bp, Artificial Sequence
  Description of Artificial Sequence: Synthetic coding sequence
atggccgagacctctcttctcgaggctggggcatctgcggccagcacagcagcagctctggaaaacctacaggttgaggcttcctgcagtgtatgtctggagtacctgaaagaacccgtaatcatcgaatgcggtcacaacttctgtaaggcgtgcataaccagatggtgggaagacctcgagcgggattttccctgtcctgtctgcaggaagactagtagatataggtcgcttaggccaaacagacaacttggttccatggtagagatagccaagcagcttcaggccgtgaagcgaaaaattagagatgaaagcctttgcccacagcatcacgaggctctctcccttttctgctacgaagaccaagaagctgtgtgcctcatttgcgctatctcccacactcaccgagcacacaccgtggttccgctggatgacgccacccaagaatataaggaaaagttacaaaagtgcctagaaccactcgaacagaagctgcaggaaatcacaagatgcaaatccagcgaggaaaagaaacctggggaactaaagcggttggtagagtcccgcagacagcagattctcagagaatttgaggagttacacaggagactggacgaggagcagcaagtactgctatctcggctggaggaggaggagcaagacatactgcaacgtctaagggaaaatgcagcccacctgggggacaaacgccgggatctcgcccatctggccgcagaagtcgaaggaaagtgcctccagtccggatttgaaatgctgaaagatgtaaagtctactctggagaagtgcgagaaagttaaaactatggaagtgactagtgtgtctatcgagttggaaaagaacttcagcaattttccaaggcaatacttcgccttacggaaaatactgaaacagctcatagcggatgtgactctagacccagagaccgcccaccctaatttggtgttaagtgaagatcggaaatcagtaaagttcgtggagacccgcctgcgggaccttccagatacgccccggagatttacgttttatccttgcgtattggctacagaaggattcacatcagggaggcattactgggaggtcgaagtcggcgacaagactcactgggcggtcggcgtgtgccgtgatagcgtcagcaggaaaggggaattgactcccctgccagagaccggatattggcgggtgaggctgtggaacggcgataagtacgccgccaccaccaccccctttacaccacttcacattaaagtgaagcccaaaagagtggggatcttcctagattatgaggctggaacactttctttctataacgtgactgataggagccacatctataccttcaccgatacattcacagagaagttatggccactcttttatcctggaatccgagctggtcgcaaaaatgctgccccattgacaattcggccacctactgattgggaatag

SEQ ID NO: 138877 - DNA, 435 bp, Artificial Sequence
  Description of Artificial Sequence: Synthetic coding sequence
atggcagagaccagtctgctagaagcaggcgcgtccgccgcctccaccgctgccgccctcgagaacctacaggtggaggccagctgtagcgtatgcctcgaatacctgaaagaaccagtaataatcgagtgtgggcataatttctgcaaggcgtgtataactaggtggtgggaggaccttgagagggatttcccttgtccagtctgccgaaaaacaagccgatatcgcagtctccgtccaaataggcagctcgggagcatggtcgagatcgcaaaacagcttcaggcagtcaaacgtaaaatccgtgacgagagtctatgtccgcagcaccacgaggccttgtctctgttctgctatgaagatcaggaggctgtgtgtctcatttgtgcaatctcccacacgcaccgagctcacaccgtggtgccgctggattag

SEQ ID NO: 138878 - DNA, 684 bp, Artificial Sequence
  Description of Artificial Sequence: Synthetic coding sequence
taaacatcccggtacagatccctcagacctaaccgccagcttggaagcatggtggaaatcgccaagcaactgcaagcagtaaagagaaagataagagacgagagtctctgcccacaacaccacgaggccctaagtctgttctgctacgaggatcaggaggctgtgtgtttaatctgcgccatctctcacacccaccgcgcgcacaccgttgtccccttggatgacgccacccaagagtacaaggaaaagctgcaaaagtgtctggagccgctggagcaaaagctccaggagatcacgaggtgtaaaagttccgaggaaaaaaaacctggtgaacttaagcggctggtggagtcgcggcgtcagcagatcttgcgggagtttgaggagctgcatcgcagactggacgaggagcagcaagtcttactcagtcgtcttgaggaagaagagcaggatatactgcagaggctgcgggaaaacgcagcacatctgggcgataagcggagagatttagcgcacctggccgcagaggtggaaggtaaatgcctgcagtccggtttcgagatgttgaaagacgttaaatccacacttgaaaagtgtgaaaaagtcaagactatggaagtcaccagtactactccttgcaccagccttcactctgagattaacgataacgtgaggggccgctag

SEQ ID NO: 138879 - DNA, 225 bp, Artificial Sequence
  Description of Artificial Sequence: Synthetic coding sequence
atggctgagacgtccctgctagaagccggcgcctccgcagccagcaccgctgccgctcttgaaaatctgcaggtcgaggccagttgctcagtttgtctggaataccttaaggaacccgtgattattgaatgcggccacaacttctgtaaggcctgtatcactcgatggtgggaggatctggagagagattttccctgccccgtttgcaggaagacgtcaagatag

SEQ ID NO: 138880 - DNA, 1254 bp, Artificial Sequence
  Description of Artificial Sequence: Synthetic coding sequence
atggtggagattgcaaaacagctgcaggccgtgaagcggaagatcagggacgaaagcttatgccctcaacaccatgaggcgctgtccttattttgttacgaggaccaagaggccgtctgtttgatttgtgccatctcccacacacacagagcccacacagtggttcctttggacgacgcaacacaagaatacaaagagaaactgcagaagtgccttgaaccgttggagcaaaagttgcaggagatcaccagatgcaagtcttctgaggaaaaaaagcccggtgagttgaagagacttgtagagtcccgccgtcagcagatactgcgcgaatttgaagagttgcaccgtcggctggatgaggagcagcaggtgcttttgagccgcctggaggaagaggagcaggacatcctgcagaggctgcgggagaatgctgcccacctgggcgacaagcgcagggatctcgcccatctcgccgctgaggtggaaggcaagtgtctgcagagcggatttgagatgctgaagcccgttttgtcggcgagggaggaatgcgaaaaagtgaagactatggaagtgacttctgttagtatagagctcgagaaaaattttagcaatttccccagacagtacttcgctctgaggaaaattctgaaacagctcattgcagatgtcaccctggatccagagactgcccacccaaatctggtgctatccgaagataggaaaagcgtaaaattcgtcgagacacgattacgcgacctgcctgacacccccagacgatttaccttttatccttgcgtgctcgcgacggaggggtttacttctggacggcattactgggaggtggaagcagctcactgtgtcctagctcaggatccagagaatcaagccctagccaggttttactgctataccgaaaggactatcgcgaaacggctggtgctcaggcgcgatccctcggttaagagaacactgtgcaggggttgcagctccttgctggtgccaggcctgacatgcactcagagacagcgcaggtgccggggacagcggtggaccgtgcaaacctgcctaacgtgtcaacgttcccagcggttcctgaacgaccccggccatctcttgtggggcgatcgcccggaggcgcagcttgggtcccaggcagacagcaagccccttcaaccattaccaaatacagcccatagcatctctgaccgcctgcccgaagagaagatgcaaactcaggggagttctaaccaatag

SEQ ID NO: 138881 - DNA, 1557 bp, Artificial Sequence
  Description of Artificial Sequence: Synthetic coding sequence
atggcagagacaagcctcttggaagcgggtgcttcagcagcttctaccgccgccgcccttgaaaatttgcaggtggaggcctcttgtagcgtgtgcctggagtatcttaaggaaccagtcatcattgagtgcggacacaacttttgtaaggcctgtataacccgctggtgggaggatctggagagggactttccctgtcctgtgtgccggaaaacgtctagataccgttctctgcggcccaaccgccagctgggcagcatggttgaaattgcgaaacaactgcaagctgtcaaaaggaaaatccgggacgaatcactgtgcccgcagcaccatgaagccctatctctgttttgttacgaggaccaggaagcagtgtgtttgatctgtgctatcagccatacacatagggcccacaccgtcgtaccactggatgacgccacgcaggagtacaaagaaaaattgcagaaatgcctggagcccctggaacagaaacttcaggaaattaccagatgtaagagttccgaggagaaaaagccaggcgagctaaaacgcttggttgaatccaggcgccaacagatcctacgggaattcgaggaacttcatagaagactggatgaggagcagcaagtgctgttgagccggctggaagaggaggaacaggacattttgcaaagacttcgtgagaatgcggcacatttaggcgacaaacgtcgggatctggctcacctcgctgctgaggtagaaggcaaatgcctgcaatctggctttgaaatgcttaaggatgtcaaatctactctagaaaaaaatataccacggaagttcggagggtctctctctactatttgtccacgtgatcacaaggccctcctaggactcgtgaaggaaatcaaccggtgcgagaaagtgaagactatggaagtgacctcagtatccattgagctcgagaaaaacttttccaacttcccacgacagtacttcgcactgagaaagatcttaaagcaattaatcgctgacgtcaccctggatcccgagacagcgcacccaaatttggtcctgtctgaggaccgaaagtccgtcaaatttgtggaaacccgattgagagatctccccgacaccccccgccgatttaccttttacccctgtgtgttggccacggagggattcacaagtgggcggcattattgggaggtagaggtgggtgataagacacattgggcagtgggagtttgtcgtgatagcgtgtctaggaaaggtgagctgaccccattgccagagacgggatactggcgcgtgcggttgtggaacggggacaaatatgccgctaccaccacccccttcacacctctccacatcaaagttaagccaaagagggtgggcatcttcctcgactatgaggctgggacactgtctttttacaatgtcaccgataggtctcacatctacaccttcacggatacgtttaccgagaagctgtggcccctgttttatcctgggatcagggcaggccggaaaaacgcagcacccctcactatacgacctcctaccgattgggaatag

SEQ ID NO: 138882 - DNA, 1467 bp, Artificial Sequence
  Description of Artificial Sequence: Synthetic coding sequence
atggctgaaacctctctcttggaagccggtgcttcagctgcaagcacagcagcggcccttgaaaatttacaggtggaggctagctgtagcgtgtgcctggaatatcttaaagaacctgttatcatcgagtgcggacacaatttctgtaaagcttgcattacccggtggtgggaagatttagaaagagacttcccctgcccagtgtgtaggaaaactagtagatatagatccctccgccccaatcggcagttggggtccatggttgaaatcgctaagcagctgcaagcagtgaaaagaaagatccgggatgagagcctgtgcccgcagcatcacgaggcactttcattattctgctacgaagaccaagaagccgtgtgtctgatttgcgccatttcccatactcacagggcccacacagtcgtgccattggatgatgctacccaggagtacaaggagaagctgcaaaaatgtctggaacctttggagcagaaactgcaggaaataacgcgctgtaaatctagtgaggagaagaaaccaggcgagctgaagcgcctcgtcgaaagtaggaggcagcaaatcctccgggagtttgaggagctgcacaggcggctggacgaagagcagcaggttctgctgtcccggctggaggaagaggaacaggacatcctccaacgtctaagggagaatgcagctcatctgggagataaaagacgcgatcttgctcatcttgccgctgaagtcgagggaaaatgtctgcaatcaggtttcgagatgctgaaagacgtcaagagtactcttgagaaatgtgagaaagtgaagacaatggaggtgacttccgtgtccatcgagttggagaaaaacttcagcaacttcccacgtcaatattttgccctgcgaaagattttgaaacagttaatcgcggacgttacactggaccctgagacggcgcatcccaatctggtgctgagcgaggatcgcaaaagcgtgaaattcgtggaaacacgattgagagacctgcctgataccccccgccggttcaccttctacccctgtgtacttgccaccgaaggcttcacaagcggtagacactactgggaggttgaggtgggggacaagacacattgggctgtgggagtttgcagagacagcgtgtctcgtaagggtgagctgacgccactgccggaaactggatactggcgggtgcgactgtggaacggtgataagtatgccgctactactacaccttttacacctctacacatcaaggttaaacccaaaagagtagggattttcctcgattacgaagcagggacactctcattttataacgttacagatcgcagccacatatacaccttcactgacaccttcacagaaaagctgtggcctctgttttatccaggtattagggcgggtcggaaaaacgcagcccctctcacaatccgcccgcctacagattgggagtag

SEQ ID NO: 138883 - DNA, 435 bp, Artificial Sequence
  Description of Artificial Sequence: Synthetic coding sequence
atggcggaaacatctctgttagaggcaggtgcatcagccgctagtacagcggcagccctcgaaaacctccaggtcgaagctagctgctcagtgtgtctggagtatctgaaggaacccgtcataatcgagtgtggccacaacttttgcaaggcctgtattacaagatggtgggaagatctcgaacgtgatttcccttgcccagtctgtcgtaagacgagccgctacaggagcctgcggccgaacaggcagctaggtagcatggtggagatagccaagcaattacaggcagttaagaggaaaatccgggatgagtcgctgtgtccccagcaccatgaggccctgtcactcttttgttacgaggatcaggaagcggtatgtctgatctgtgccatctctcatacacacagggcacacaccgtggttcctctggactag

SEQ ID NO: 138884 - DNA, 225 bp, Artificial Sequence
  Description of Artificial Sequence: Synthetic coding sequence
atggctgagacaagtctcctggaggctggggcctccgccgcgtctacggccgcggccctcgaaaacctgcaggtcgaagccagctgctccgtgtgcctggaatacctgaaggagcctgtgatcatcgagtgtggacataacttttgtaaagcctgcatcactcgctggtgggaggatctggagagggactttccctgcccagtgtgccgcaaaacgagtcgctag

SEQ ID NO: 138885 - DNA, 147 bp, Artificial Sequence
  Description of Artificial Sequence: Synthetic coding sequence
atggcagagacttccctactggaggccggcgcttccgctgcatccacagctgccgcactggagaacctgcaggtggaggctagttgcagcgtctgcctggaatatctgaaggagccggtcattatcgagtgtgggcataacttttag

SEQ ID NO: 138886 - DNA, 1467 bp, Artificial Sequence
  Description of Artificial Sequence: Synthetic coding sequence
atggcagagaccagcctgctcgaggccggggcgtctgccgcctctaccgccgccgcgctggagaacctgcaagtcgaagcttcatgcagcgtgtgcctcgaatacttaaaagaaccggtgattatcgagtgtgggcacaatttctgcaaagcttgcattactcgttggtgggaggatttagagagggactttccgtgtcccgtgtgccggaagacttctcgttatagaagcttgcggcccaatagacagctcggaagcatggttgaaatcgccaagcagctacaggcagtgaagcgaaagatccgggatgaaagtctgtgcccccagcaccatgaggctctgagtctgttctgttatgaagatcaggaggccgtgtgtctcatatgtgctatcagtcatacacaccgcgcccacactgttgtgcctctggacgatgcgacgcaggaatataaagagaaactgcagaagtgtttggaacccctggagcagaaacttcaggagataactagatgtaaatctagtgaagaaaagaagccgggtgagttgaaaagactcgttgaatctcgcagacagcaaatcttgcgcgagttcgaggaactccatcgccggttggatgaagagcagcaggtgctcctttcccgcttggaagaggaggagcaagacattctacagcgtctgagagagaacgcagcacacctgggggataagcggagagacctcgcacacctggccgcggaggtcgaaggcaagtgcctgcagtccggatttgagatgttgaaagacgtgaaatctacgctggagaaatgtgaaaaggtgaagactatggaggtgaccagcgtgagcatcgagctggagaagaatttctccaatttcccacgtcagtactttgcgctgagaaaaattctgaagcagttaatcgcggatgtgacactggatccagagactgctcatccaaacttggtactctcagaagaccgcaaatcagttaaattcgtggagactaggttgagggatctgcccgacactcctcgtagatttacattctatccctgtgtgttggctacagaggggttcacctctggtcggcattattgggaagttgaagttggagataagacccactgggccgttggggtctgccgcgactccgtttctaggaaaggggaactgacccctcttcccgagactggttattggcgcgttagactctggaacggagataagtacgctgccaccaccaccccttttacccccctccatatcaaagtgaagccaaaacgcgtgggaatcttcctggattacgaggcaggaacattatctttttataatgtcaccgacaggtctcatatctacacattcactgacacgtttacggagaagctttggccccttttctatcccgggatccgtgccgggaggaagaatgcagcgccgctgacaatccgtccacccacagactgggaatag

SEQ ID NO: 138887 - DNA, 684 bp, Artificial Sequence
  Description of Artificial Sequence: Synthetic coding sequence
tgaacctccagatataggtccttgcggccaaatcgccaactgggtagtatggtggaaattgctaaacagctacaagcggtgaagcggaaaattcgggatgagagcctgtgtccccagcatcatgaagcactgtcactgttttgttacgaggatcaggaggcagtctgtctcatctgcgccatctcccatacacatcgggcccacaccgtggtgccactggatgatgcaacacaagagtataaagaaaaactccagaagtgtctcgaacctctggaacagaaactccaggaaatcactcgttgcaagtcaagtgaagagaagaagcccggagagctgaagcggctcgtagagagcaggcgtcagcagattctgcgggaattcgaggagctgcatcgcagactggacgaggaacagcaggtactactgtcccggttagaggaagaagaacaggacatcctgcaaagactgagagagaacgctgcccacctaggggataagagaagagatctggcccacctggccgcagaggtggagggaaaatgcctacagtcggggttcgagatgctgaaggacgtgaaaagtacactggaaaagtgcgagaaggttaagacaatggaggtgacatcaacgacaccctgcacaagcctgcactccgagattaacgacaacgtgcggggccgctag

SEQ ID NO: 138888 - DNA, 147 bp, Artificial Sequence
  Description of Artificial Sequence: Synthetic coding sequence
atggccgagacatctttgctcgaagccggagcctcagccgcgagcaccgcagctgcgctagagaacctgcaagtggaggcctcatgtagcgtgtgtctggagtacctgaaagaaccagtgatcattgagtgtgggcacaacttctag

SEQ ID NO: 138889 - DNA, 147 bp, Artificial Sequence
  Description of Artificial Sequence: Synthetic coding sequence
atggcggagaccagtttgcttgaagccggcgcaagtgctgcctccaccgctgccgccctcgagaatcttcaagtagaggcaagctgcagcgtctgtctcgagtacctcaaagagcctgtgattatagaatgcggccacaatttttag

SEQ ID NO: 138890 - DNA, 180 bp, Artificial Sequence
  Description of Artificial Sequence: Synthetic coding sequence
atggctgagacctcactcctggaggcaggggccagcgctgctagcacggccgcagccctggagaatttgcaagtggaagcctcgtgctcggtgtgtttggagtacctcaaagagcctgtcatcattgagtgcggccacaatttttgcaaggcatgtatcacaagatggtgggaagattag

SEQ ID NO: 138891 - DNA, 180 bp, Artificial Sequence
  Description of Artificial Sequence: Synthetic coding sequence
atggccgagacatctctcctggaagccggtgctagtgctgcgtccacagcagccgctttggagaacctccaggtagaggctagttgcagcgtctgcctcgagtacctgaaggagcccgtgattatcgaatgcggacacaacttctgtaaagcctgtattacacgctggtgggaagactag

SEQ ID NO: 138892 - DNA, 435 bp, Artificial Sequence
  Description of Artificial Sequence: Synthetic coding sequence
atggcagaaactagtcttctcgaggctggcgcatccgctgcttctaccgcggcagcactggagaacctccaggttgaagcctcttgttctgtctgcctggagtatctcaaggagcctgtcatcatcgagtgtggtcataacttttgtaaggcttgcataactaggtggtgggaggacctggagcgggattttccctgtccagtgtgtaggaagacctcccggtaccgaagcttacgacccaacaggcagttggggtcaatggtcgaaattgcaaagcagcttcaggccgtcaagcggaagatcagagacgagtctttgtgccctcaacatcatgaagctctgtctctgttctgctacgaagatcaggaggcagtgtgtctaatctgcgccatctcgcacacccatcgggcccatacagtcgttccccttgactag

SEQ ID NO: 138893 - DNA, 1557 bp, Artificial Sequence
  Description of Artificial Sequence: Synthetic coding sequence
atggccgaaacctccctcctggaagctggcgctagtgccgcctcaacggctgctgcgctggagaatctacaagtggaggccagttgcagcgtgtgtctggagtaccttaaagaacctgttataatcgagtgcggacataatttttgcaaggcctgcattacccgctggtgggaagatctggagagagactttccttgtcccgtctgcaggaaaacgagcagatatcgaagcctccgacctaaccggcagctgggttcgatggttgaaatagcaaagcagttacaggcagtaaagagaaaaattcgtgatgagagcctctgccctcagcaccatgaagcattaagcttattctgctacgaagatcaagaggccgtgtgcctgatttgcgccatctcccatacacaccgcgctcacaccgtggtgcccttggatgacgcaacccaggaatataaagaaaagctccagaaatgcctggagcctctggagcagaagttgcaggagatcacgcgatgcaaatcctctgaggaaaagaagcccggagagcttaaacggcttgtggaatcccgacggcagcagattctcagggagtttgaagagctgcataggcggctcgatgaagagcagcaagttttgttatctaggctggaggaagaagaacaagacattctgcagcgactgcgggaaaatgcagcccatttgggcgacaagaggcgggacctagcgcatctggccgctgaggtcgagggaaagtgcctgcagagtggctttgaaatgctcaaagatgtcaagtccacactagaaaagaatattcctagaaaattcggaggtagtctgagtactatttgcccccgggaccacaaggcactgctggggctggttaaggaaattaatcgctgcgagaaggtaaaaaccatggaggtcacttccgtcagcattgagctggaaaaaaacttctctaactttccccggcagtactttgcattacgcaagatactcaagcagctcatcgctgacgtcacgctggacccagagaccgcccatccaaacctggtcctgagtgaggacaggaagtcagtcaagtttgtggagacgcgcctgcgcgatcttcccgacaccccccgcagattcacattttatccctgtgtgttggctacagagggctttacttctggccgacactactgggaagtggaggtgggcgataagacgcactgggcagttggcgtttgccgggattcggtaagcagaaaaggggagcttacccccctgcccgagaccggctactggagagtgagactgtggaatggcgacaaatacgccgccacgacaacgcctttcactcctctccacatcaaggttaagcccaagagggtgggtatttttctcgattatgaggctgggaccttgtctttctacaacgtaacagatcgttctcacatttacacgttcaccgacacttttaccgagaagctctggcccctgttctacccaggtatccgtgccggacgaaaaaacgctgcacccttgacgattagaccgcctaccgactgggagtag

SEQ ID NO: 138894 - DNA, 684 bp, Artificial Sequence
  Description of Artificial Sequence: Synthetic coding sequence
tgaacatctcgctatcgttccctccgccccaaccggcaattgggcagcatggtcgaaatcgccaagcagctgcaggccgtcaagaggaaaatcagagatgagtctctctgcccacaacaccacgaagcactatcactgttttgctacgaagatcaagaagcagtgtgtctaatatgcgctatctctcacacccacagagcgcatacagtggtacctcttgatgatgcaacccaggagtataaagaaaaactgcagaagtgtcttgagccgcttgagcaaaaactccaagaaattaccaggtgcaaaagtagcgaagagaagaaacctggagaactcaagaggcttgtggagtcaagacggcaacagatcctaagggagttcgaggagctgcacagaaggctggacgaggagcaacaagtgcttctttctcggcttgaagaagaagaacaagacatcctccaacgcttgagggagaatgctgctcacctgggagataagcggagagatctcgcccatcttgccgccgaggtagaagggaaatgccttcaatcaggctttgaaatgctgaaggacgtgaagagcacacttgagaagtgtgaaaaagtcaagaccatggaagtgacgtctacgaccccctgtacctctttgcatagtgagataaacgataatgtgcgtggacgctag

SEQ ID NO: 138895 - DNA, 684 bp, Artificial Sequence
  Description of Artificial Sequence: Synthetic coding sequence
taaacaagccgttaccggtccctgcggcctaaccggcagttaggttcgatggtcgagattgcgaagcagctgcaggcagtaaaaagaaagataagggatgagagcctgtgccctcagcaccacgaggccctgtccctgttctgttatgaagatcaggaggcagtgtgtctaatctgcgccatcagccatacccaccgagctcatacggtggtgccccttgacgacgccactcaggaatataaagaaaagctgcagaaatgtctcgaaccactcgagcaaaagctgcaagagattactagatgcaagtcttcggaggaaaagaaacccggcgagctgaagcgcctggtagaaagcaggcgtcagcagattttgcgggaatttgaagagctgcatcggagattagatgaagagcaacaggttctgctctctaggctggaggaggaggagcaggacatccttcagcgtctgagagaaaacgcggcacatctgggcgataaaagaagggaccttgcccacctggccgccgaggttgaggggaagtgtctgcagtctggtttcgagatgctgaaggatgtcaaaagcactctggaaaagtgtgagaaggtcaaaactatggaagtcaccagcacaacaccttgcactagcctgcactccgaaataaatgataacgttaggggccgctag

SEQ ID NO: 138896 - DNA, 147 bp, Artificial Sequence
  Description of Artificial Sequence: Synthetic coding sequence
atggccgaaacctctctgctagaggccggcgccagtgcagcaagcacagcggccgccctagagaatctgcaggtggaggcatcatgctcggtctgcttggagtatctcaaagagcccgttatcatcgagtgtggacacaacttctag

SEQ ID NO: 138897 - DNA, 1557 bp, Artificial Sequence
  Description of Artificial Sequence: Synthetic coding sequence
atggctgagacctccctcttggaagcgggtgcctcagctgcctccacggccgcggcgttagaaaaccttcaggtcgaagcttcatgctccgtatgtttagaatacctgaaggaacccgttattatcgagtgcggccacaacttctgcaaggcttgcatcacccgatggtgggaagatctggagcgcgactttccctgcccggtatgtcggaagacatctaggtatcggagcctaaggcccaatagacagttaggctcgatggtggagatagcgaagcaactgcaggctgtaaaacggaaaatcagagatgaaagcctgtgtcctcagcaccacgaggctctgtctctgttctgttacgaagaccaggaggccgtatgtctcatctgcgccatcagccacacacacagagcccatacagtagtgcctcttgacgatgccacgcaggagtacaaggagaaactgcagaagtgtctggaaccactggaacaaaaactccaagaaatcacaaggtgtaagagctctgaagaaaaaaagcctggcgaactgaagagactcgttgaatctagaagacagcagatccttcgtgaatttgaggagctccaccggagactggacgaagaacagcaggtgctcctgagcagattggaggaagaggagcaagatatactccaaagattgagagaaaatgccgcccatttaggcgacaagcggcgtgatttggcgcatctagccgctgaagtcgaaggtaagtgtctacagtcgggcttcgaaatgttgaaagatgtcaaaagtacgctggaaaaaaacattccacgcaaatttgggggatccctctccactatatgccccagagaccacaaggcgcttctgggactggtgaaggaaataaatcggtgtgaaaaggttaaaactatggaggtgacttccgtctccatcgaactcgagaaaaacttcagtaatttcccaaggcagtacttcgcccttcggaagatcttgaagcagctgatcgccgatgtaaccctggaccccgaaaccgcgcacccaaatctagtcctcagcgaggaccggaaatctgtaaaattcgttgagactaggttacgcgatctccccgacacccctcggagatttactttttacccctgcgtgctggctaccgaaggattcacctccggccgacactattgggaagtggaggtaggcgataaaacccactgggccgtgggggtctgcagggacagcgtaagcaggaagggtgagcttactcctctgcctgagactggctactggcgagttcgcttatggaatggggataaatacgctgcaactacaaccccatttactccactgcacattaaagtgaagccaaaaagggtaggcatttttttagattacgaagctggtaccctctccttttataacgtcacagaccgtagccatatttacacatttacggacacttttaccgaaaagctttggcccttgttttatcccggaatccgcgcagggagaaagaacgccgctcctctgacaattcgtcccccaaccgactgggagtag

SEQ ID NO: 138898 - DNA, 225 bp, Artificial Sequence
  Description of Artificial Sequence: Synthetic coding sequence
atggccgaaacttccttactggaggctggggcatcagccgccagtacggccgccgccctggagaatctgcaagtggaggcaagttgtagcgtttgtctcgagtatttgaaggagcctgtgattatcgagtgcggccataatttttgtaaggcttgcatcactaggtggtgggaggatcttgagcgcgatttcccgtgtccggtttgcagaaagacgagtagatag

SEQ ID NO: 138899 - DNA, 180 bp, Artificial Sequence
  Description of Artificial Sequence: Synthetic coding sequence
atggcagagacctctctcctggaggccggagcgtccgctgcttctaccgcggcagccctagagaatttgcaggtggaagcctcatgcagcgtgtgtcttgagtatttaaaagagcctgtgattatcgagtgcgggcataatttctgcaaggcctgcattaccagatggtgggaagattag

SEQ ID NO: 138900 - DNA, 147 bp, Artificial Sequence
  Description of Artificial Sequence: Synthetic coding sequence
atggcggaaacatccctgctggaggccggcgctagtgctgcttccactgccgctgcgttggagaacttgcaggtcgaggcctcctgtagtgtgtgtttagaataccttaaggagccagttattatcgagtgtgggcacaatttctag

SEQ ID NO: 138901 - DNA, 786 bp, Artificial Sequence
  Description of Artificial Sequence: Synthetic coding sequence
atggcagaaaccagcttactcgaggctggagccagcgccgcctcgaccgctgcagccctggaaaatctgcaggtcgaggcctcctgttcggtttgcctggaataccttaaggaaccggtaataatcgagtgcggccataacttttgcaaggcctgcattacacgctggtgggaggacctagagcgagactttccatgcccagtctgccgcaaaacatctcggtatcgatccctgcgcccaaaccgccagctaggctctatggttgagatcgctaagcagctgcaggctgtaaagagaaagattcgggacgagtctttgtgccctcagcaccatgaagccctgagcctgttttgctatgaggatcaggaggctgtgtgtctcatctgcgcaattagccatactcacagagctcacactgtcgtgcccctggatgacgccacacaggagtataaagagaagcttcagaagtgcctcgagccgctggaacaaaagctgcaggagataactagatgcaaatcttctgaggaaaaaaaaccaggagaactgaaaaggctggtagagtctcggcgacagcagatcttacgcgagttcgaagaactacaccgccggttagatgaggagcagcaggtgctcctgagtcggctggaggaagaggaacaagacatcctccagcgcctgcgggaaaacgccgcccatcttggagacaaaagacgcgatctcgcccatcttgccgcagaagtggaaggaaagtgcctccagagcggatttgaaatgctgaaggtctag

SEQ ID NO: 138902 - DNA, 180 bp, Artificial Sequence
  Description of Artificial Sequence: Synthetic coding sequence
atggccgagactagcctgctcgaggccggggctagcgcagccagcactgcagcagccctggagaatctccaggtcgaggccagctgctccgtatgtctcgagtacctcaaggaacctgttatcattgagtgtggccacaatttttgcaaagcttgcataacacggtggtgggaagattag

SEQ ID NO: 138903 - DNA, 435 bp, Artificial Sequence
  Description of Artificial Sequence: Synthetic coding sequence
atggccgagacctctctgcttgaagctggagcatctgccgccagcaccgctgccgctctggagaacctgcaggtggaagcctcatgttcagtgtgcctggaatacctgaaggagcccgtcattattgagtgcggtcataacttctgtaaggcctgcatcacccgctggtgggaagatcttgagcgcgactttccttgcccagtgtgcagaaaaacttctcgctatcgttccttaagacccaatcgacagcttggctcaatggtcgaaatagcgaagcagctccaggctgtcaagagaaagatacgagacgagtccctgtgcccacagcaccacgaggctctaagcctgttctgttacgaggatcaagaggctgtctgtctgatctgtgcaattagccacactcaccgggctcacacagtggtgcctctggattag

SEQ ID NO: 138904 - DNA, 1467 bp, Artificial Sequence
  Description of Artificial Sequence: Synthetic coding sequence
atggccgaaactagcctgctcgaggccggagcctcagccgcctctacggcagcagccctcgaaaatttgcaggtcgaagcgtcctgctcagtctgtctggagtacctcaaggagcccgtcatcattgaatgtgggcataatttttgtaaggcatgtataacaaggtggtgggaggaccttgagagagacttcccttgccccgtctgtagaaaaactagccgttatagatccctgcggccaaacaggcaattaggctccatggtggagatcgccaagcagttgcaagctgttaagcggaaaatacgggatgagagcctctgtccgcagcaccacgaggccctaagcctgttttgttacgaggatcaggaggccgtctgtctgatctgcgccatttcccacacccaccgcgctcacaccgtggtacccctagatgacgccactcaggagtataaagaaaagttgcagaaatgtctagagcccttggaacagaagctccaggagattacaagatgtaaaagctccgaggagaagaaacccggcgagctcaaacgattggtggaatctagacggcagcagattctgagagaatttgaagagctccacaggcgacttgacgaagagcagcaggtgctgctgtctaggctggaggaagaagagcaagacatcctccagcgccttagagagaatgctgcccacctcggggataagcgccgggatcttgcccatctggcagccgaggtggaaggtaaatgcctgcagtcaggattcgaaatgctaaaggacgtcaagagtacactcgagaagtgcgaaaaggttaagaccatggaagtgactagcgtgagcatagagcttgagaagaattttagtaactttccaaggcagtattttgcgctgagaaagattcttaagcagttaattgccgacgtgacattggatcctgaaaccgcccatccaaacctggtgctctcagaggatcgcaagagcgtgaagtttgtagaaactcgcctccgcgatctgcccgacacccctagacgttttaccttttacccatgcgttcttgcaaccgaaggcttcacctcaggaagacactattgggaggtagaagtgggcgataaaacacactgggctgtgggggtgtgtagagatagtgtttcccggaaaggcgaactgacgccactgcctgagaccggatactggcgagtgagattgtggaatggggacaagtacgccgctactacgactccatttacacctctccatatcaaagtcaagcctaagagagttggtatttttctggactacgaagcgggcacactgtccttctacaacgtgaccgaccgcagccatatatacactttcaccgatactttcaccgagaagctgtggcctttgttttatccaggaatcagagccggccggaagaacgccgcacccctgactatccgaccacctaccgactgggagtag

SEQ ID NO: 138905 - DNA, 1467 bp, Artificial Sequence
  Description of Artificial Sequence: Synthetic coding sequence
atggccgagaccagtttgctggaggcgggggctagtgcggcatcaacggccgctgcgcttgagaacttacaggttgaagcatcatgcagtgtttgtttggagtatcttaaggaaccagtgatcatcgagtgtggtcacaacttctgcaaggcctgcattacccgctggtgggaggacctcgaaagagactttccttgtccagtgtgccggaaaacatcgcggtacagatctctgcggcccaatagacagctcgggagcatggtggaaatcgctaagcagttgcaggcggtgaaaaggaagattagagatgagagcctttgtccacagcatcatgaagctctgtcactcttctgctatgaggaccaggaggctgtttgcctcatctgcgcaataagtcacacccaccgtgcgcatacagtggtgccactagatgatgctactcaggaatataaggagaaattgcaaaaatgcctggaaccccttgaacagaaactgcaagaaattacccgttgtaagtccagcgaagagaaaaagccaggagaattgaaaagacttgttgaaagccgccggcagcagatcctaagggaattcgaagagctgcatagacgtctagacgaggagcagcaagtcctcctgtccaggcttgaggaggaagagcaagacattcttcaacggctcagggaaaatgctgcacatctgggagataagcgccgagacctggcccatctcgctgccgaagtggagggcaaatgcttacaatctggtttcgagatgcttaaagatgtgaaaagcaccctcgaaaagtgcgagaaagtgaagacaatggaagtcacctcggtgagtatagagctagagaagaacttttctaacttccccagacagtacttcgcccttcgtaagatactgaaacaactcatcgccgacgttacgttggacccagaaaccgcccatccgaatttggtgctcagtgaagacagaaaatctgtcaaatttgtggagaccaggctgcgagacctacccgacactcctcgtagattcactttctatccttgcgtactcgccaccgaaggcttcacaagtgggagacactattgggaagtggaagttggcgataagacccactgggcagttggcgtgtgtagagacagcgtgagccgcaaaggagagctgactccacttcctgagacgggctactggagggtccgtttgtggaatggtgataaatatgcagctaccacgacaccattcacaccccttcacatcaaggtgaagcctaaacgagtaggcatattcttagattacgaggctggcaccctctcattttataatgtaaccgatcgatctcatatctacacctttaccgatacttttaccgaaaaactgtggccgctgttctaccccggtattagggccgggcggaagaacgctgctccactcactatcaggcctcctaccgactgggagtag

SEQ ID NO: 138906 - DNA, 786 bp, Artificial Sequence
  Description of Artificial Sequence: Synthetic coding sequence
atggcggagacctcacttctagaggccggcgccagtgcggcatctactgcggcagccctcgagaatttacaggtcgaagcttcatgctcagtgtgcctggagtacctcaaggagccagtgataattgagtgtgggcacaatttttgcaaggcctgcattactcggtggtgggaggatctcgaaagggatttcccttgtcccgtatgcaggaaaacatctcgctaccggtcactgaggcctaaccgccagcttgggtcgatggtagaaattgcgaagcagctgcaagccgtcaagcgaaagatcagagacgaatctctgtgtcctcagcaccacgaggctttatcgctattctgctatgaggatcaggaagcagtgtgtctcatatgcgcaatcagtcacacacatcgcgctcacactgttgtgcctctggatgatgccacgcaagagtacaaggagaaacttcaaaagtgcctcgagcctctagagcagaagctccaagagataaccaggtgcaaatcaagcgaggaaaaaaaacccggcgagctaaagagattggtcgagagtagaaggcaacaaattcttcgcgaatttgaggagttacacagaagattggatgaagaacagcaggttctccttagtcggctggaggaggaggagcaggatattctgcaaagactgagagagaacgccgcccatctgggtgacaagaggcgcgacttagcacaccttgccgctgaggtggaaggaaagtgcctacaatctggctttgagatgctgaaagtgtag

SEQ ID NO: 138907 - DNA, 1467 bp, Artificial Sequence
  Description of Artificial Sequence: Synthetic coding sequence
atggccgaaacaagcctactggaagctggagcatcagccgcctctaccgcagccgccctggaaaacctgcaggtcgaggcctcatgcagcgtgtgtctggagtacctgaaggaaccggtaataatcgaatgtggccacaatttctgtaaggcttgcattacccggtggtgggaagatctcgagagggatttcccctgcccggtgtgcagaaagacaagcaggtaccggtcccttagaccaaacagacagttgggctcaatggtcgaaatcgccaagcagcttcaagccgtgaaaagaaaaatccgcgatgagagcttgtgtcctcagcaccacgaggccctgagtctattttgctacgaagaccaggaagctgtatgcctgatatgtgccatttcccacacccatcgggctcacacagtagttcccctggacgacgcgactcaagaatataaggagaagctacagaagtgcctggagcctcttgaacagaaactgcaggaaatcacaagatgcaaaagctcagaggaaaaaaagccgggcgaacttaagcggttggttgagagcaggcgacagcagattctgagggaatttgaagagctccataggcggctggatgaggaacagcaagtgctgctctctaggctcgaggaggaagaacaggacattctgcagagactccgcgagaacgctgctcatcttggagacaaacgcagagacctggctcacctggctgcggaagtagaaggcaaatgcttgcaaagcggcttcgaaatgctaaaggacgtgaaatcaacactggagaagtgcgagaaggtgaaaacaatggaggtaacgagcgtctccatagaactagaaaaaaattttagtaactttccacgccagtactttgccttgagaaagatcctgaagcaactgatagccgatgtaactttggaccctgaaaccgcccatcctaacctggtcctaagcgaggatcgcaagtcagtgaagtttgttgagactaggcttcgcgacctgcctgacacgccacggagattcacattttacccttgtgttctggctacagagggattcacatcaggaaggcattactgggaggtcgaagtaggtgataagacacattgggccgtgggcgtttgccgtgattcagtgagccgtaagggggagttgactcctctcccagagacgggatattggcgggtgcgtctctggaacggggacaaatacgcagccacaaccaccccctttaccccccttcacataaaggtgaaacctaagagagtggggatcttcttggattatgaagcgggcactctctccttttacaacgtcaccgataggtcccacatatacacattcaccgacacttttaccgagaagctgtggcccttgttctatcccggtatcagggctgggcggaagaatgctgcccccctgacaatccgcccaccaactgattgggaatag

SEQ ID NO: 138908 - DNA, 180 bp, Artificial Sequence
  Description of Artificial Sequence: Synthetic coding sequence
atggctgagacatccctattggaagctggcgcatctgccgccagtacggccgccgcgctcgaaaatctgcaggtggaggcttcttgtagtgtttgtctcgagtacctcaaggaacccgtgatcattgaatgtggccataacttttgtaaagcttgcatcacgaggtggtgggaggactag

SEQ ID NO: 138909 - DNA, 180 bp, Artificial Sequence
  Description of Artificial Sequence: Synthetic coding sequence
atggctgagacatctctgctcgaggcaggtgcttcagctgcaagtaccgccgctgcactggagaatctgcaagtcgaggcttcatgttctgtgtgccttgagtacctaaaggagccggttatcatagagtgcggacacaacttctgcaaggcttgcatcacgcgctggtgggaggattag

SEQ ID NO: 138910 - DNA, 684 bp, Artificial Sequence
  Description of Artificial Sequence: Synthetic coding sequence
taaacttctcgctatagatctcttaggccaaacagacagctggggtctatggtcgaaattgccaagcagcttcaagcggtcaagcgtaagatcagagatgagagtctctgccctcaacatcatgaggctctttctcttttttgttatgaagaccaggaggccgtatgtctgatttgtgctattagtcacacacatcgcgcgcatacagtggtgccactcgatgacgcgacccaggaatataaggaaaagctccagaaatgtttggagccactggaacagaaactgcaggaaattacccgctgtaagagttccgaagaaaagaaacccggagaactgaaaagattagtggagtctagacgacagcagattctgagggaattcgaggagttgcaccggcggctagatgaggagcaacaggttctgttgtctagattggaggaagaggagcaggatattcttcagcggttgcgcgaaaatgcagcgcatctcggcgacaagcgcagggatctcgctcacctagcagcagaggtagaaggaaaatgtttgcaaagtggattcgaaatgttgaaagacgtgaaaagcacactcgagaaatgtgaaaaagtgaagaccatggaggttacgagcaccacaccatgcacaagcttgcactccgagataaacgacaacgtccggggcagatag

SEQ ID NO: 138911 - DNA, 1467 bp, Artificial Sequence
  Description of Artificial Sequence: Synthetic coding sequence
atggcggaaaccagcttactcgaggcgggagcttcggcggccagcaccgccgccgcattagagaatctgcaagttgaggcctcatgcagcgtctgcctggagtatttgaaagagcctgtgattattgagtgtgggcataatttctgcaaagcatgcattaccaggtggtgggaggacctggaaagagatttcccttgccctgtctgtaggaagacaagtaggtatcggtctctcaggccgaatagacaacttgggtccatggtggagattgcaaagcagctgcaagctgtgaaacggaagataagggatgaatcattgtgccctcagcatcatgaagccctgtcccttttctgctatgaggaccaggaagcagtatgcctgatctgcgccataagccacacccaccgggcccacacagtcgtgccgctggacgatgccacccaagagtacaaagagaagctccagaagtgcctggaacctctggagcagaagctccaggaaattacccgttgcaagtcgtcagaagaaaagaagcccggcgagttgaagaggttggtggagtctcgtcgtcagcagatcctacgagagtttgaagaactgcacagacgcctggacgaggaacagcaggtgcttttgagcaggctggaggaagaggagcaggacatccttcagcgcttgcgcgagaatgcagcgcacctgggcgacaagcggagggacctggcacacctggccgcagaggtcgagggtaagtgtttgcagagcgggtttgaaatgctgaaagatgtgaagtctacactggagaaatgcgaaaaagtgaagacaatggaagttacctccgtgagtatagaactcgaaaagaatttctcaaactttcctcgccagtacttcgccctcagaaagatcctgaagcagttaatcgccgacgtcacattagaccctgagacagcccaccccaatctggttttgagcgaagaccgtaagtccgtaaagttcgtcgagacgaggctccgagatctgcctgatactcccagaaggtttacattctatccctgcgtgctggcaaccgaggggtttacatctgggcgccactactgggaagtagaagtgggagacaagacacactgggcagttggcgtctgcagggactcagtgtcccgcaaaggggaactaacaccactccccgaaacaggatattggcgcgtgcgactctggaatggcgataagtatgccgccacgacaactcccttcacaccgctacatatcaaggtgaagccaaagcgggtggggatctttctggactatgaggcgggaactctcagtttctacaacgtcacagacagatcccatatttatacttttacagatacttttaccgaaaaactgtggccactgttctatccgggcattcgagccggccggaaaaacgctgccccgttaaccatccgccccccgaccgactgggagtag

SEQ ID NO: 138912 - DNA, 225 bp, Artificial Sequence
  Description of Artificial Sequence: Synthetic coding sequence
atggcggaaacctcactgctggaggccggcgcctccgctgctagcactgcggccgccctcgagaacctccaggtagaggcttcttgcagcgtgtgcctggagtacctcaaagaacctgtgattatcgagtgtgggcacaacttctgtaaagcatgcatcactcgctggtgggaggacttggagcgagactttccttgcccagtttgtcgcaaaacaagccggtag

SEQ ID NO: 138913 - DNA, 684 bp, Artificial Sequence
  Description of Artificial Sequence: Synthetic coding sequence
taaacatctaggtaccgaagcctgagacctaatagacaattaggaagcatggtggaaattgctaagcagctgcaggccgtcaagagaaagatcagagatgagtctctctgtccacagcatcacgaagcgctcagcctcttttgctacgaagatcaggaagctgtgtgtctcatctgcgcaataagccacacacatagagcgcacaccgtggtgccccttgatgacgccacccaggagtacaaagagaagttgcagaagtgcctcgagccactagaacagaagctccaggagatcaccaggtgcaagagctcggaagaaaaaaagcccggcgaactgaagagactggttgagtcccggcgacagcagattctgcgggagttcgaagaacttcaccggcgcctggacgaagagcagcaagtcttgctgagccggttggaggaggaggagcaggatattctccagagactgagggagaatgcagcccatctgggcgacaagcgacgcgacctggcccatctagcagccgaagtggaaggaaaatgtctccagagtgggttcgaaatgcttaaggatgtcaagagcactctagaaaaatgtgaaaaagtcaagacaatggaagtcacctcaactactccgtgtacgtccttacattccgagattaatgataacgttcggggtcgctag

SEQ ID NO: 138914 - DNA, 1467 bp, Artificial Sequence
  Description of Artificial Sequence: Synthetic coding sequence
atggcggagaccagtctgctagaagccggcgcctcagcagcctcaacagctgccgccctagaaaatctccaggtggaagcgtcttgctctgtgtgtcttgagtatttgaaggagcccgtgatcattgagtgcggacataacttttgtaaagcctgtatcacaagatggtgggaagaccttgagcgggatttcccttgcccagtatgtcggaagaccagccgttatagatcactgagaccaaatcgccagctagggagcatggtggagatagctaaacaactccaggcagtgaagagaaagatccgtgatgaatcgctttgtccgcagcatcacgaagctctatcgctgttttgttacgaggatcaggaggctgtatgtcttatctgtgctatcagccacacacatcgagcacatacggttgtgccattggacgatgccactcaggagtataaggagaaactccagaagtgtttggagcctctagagcagaaactgcaagaaattactagatgtaagtccagtgaagaaaagaagccaggagagctaaagagacttgtggagagccgcaggcagcaaatcttgcgcgagtttgaggagctgcataggcgcctggacgaggagcagcaagtgttgttgtccaggctggaagaggaggagcaagatattctgcagaggctccgcgagaatgcagcccaccttggagacaagcgacgggacctagcacacctcgccgccgaagtcgaggggaaatgcctgcagtctgggtttgagatgcttaaggacgtaaagtctactctggaaaagtgcgagaaggtgaagactatggaggtgacatcagtctcgattgaattggagaaaaacttcagtaactttcctcgccagtattttgctctgcggaaaatcttgaagcaacttatcgcagatgtgactttagatcctgagacagctcatcccaacctcgtgctttctgaggaccgtaaatccgtgaaatttgtggagaccagattgcgggatctccccgacaccccacggagattcactttctatccctgcgtgctggccactgagggctttacatcaggcaggcactactgggaagtcgaagtgggtgacaagacgcattgggctgttggcgtgtgcagagattccgtctcccgaaagggggagctcacaccgctgcctgaaaccggctactggagggtgagactatggaacggcgataagtatgctgccactactactccttttactccactgcacataaaagtgaaacctaaacgagtgggcatttttctggattacgaagccggcaccctcagtttttacaacgtgactgacaggtctcatatttacaccttcactgacacattcaccgaaaagctgtggcccttattttacccgggcattcgcgcagggagaaaaaatgccgctcccctgactattaggccaccaaccgattgggagtag

SEQ ID NO: 138915 - DNA, 1467 bp, Artificial Sequence
  Description of Artificial Sequence: Synthetic coding sequence
atggccgagacgtctctcctggaggccggcgctagtgctgccagtacagctgccgccctggagaaccttcaggttgaggccagctgcagtgtgtgcctggagtacctgaaggaacccgtcatcattgaatgtgggcacaacttctgtaaagcgtgcatcacaaggtggtgggaggatttggagagagattttccttgccccgtgtgtagaaaaacttcccgttacagatctcttcgccctaaccggcagttaggttccatggtcgaaatcgctaaacagctgcaggcagtaaagcggaagattcgtgacgagtcactatgcccgcagcaccacgaagcactttctcttttttgctacgaagatcaagaggccgtttgcctgatctgcgctatatcccatacgcaccgagctcatacagtggtgcctctagatgatgcaactcaggagtacaaagaaaaactccagaaatgcctcgagcctcttgagcaaaaattgcaggagatcacgcggtgcaagtccagtgaggagaaaaaacctggcgagttgaaacgcctggttgaatccagacgccagcagattctcagagagtttgaggagttacatcgcaggctagacgaggaacagcaagtgttactaagcagattagaggaggaggagcaggacatcctgcagcgattacgtgagaacgccgctcacctgggcgataaacggagggatctggcccacctcgcagccgaggtggagggcaaatgcctgcaaagcggatttgaaatgctcaaagacgtcaagtccacactggagaaatgtgagaaggttaagaccatggaggttacgtcagtgagtatcgagcttgaaaaaaattttagcaatttcccgaggcagtatttcgctctcagaaagatcctcaaacagctcattgccgatgtgactctggatcccgagaccgcccaccccaacctcgttctgagcgaggaccggaagagtgtgaagtttgtggagacaagattgagagatctgcccgatactcctcgaaggtttacattctatccctgcgtgctggctaccgaaggctttacaagcggacgccattattgggaagtcgaggtgggggataaaacccactgggcagtgggggtatgccgcgattccgtgagtagaaaaggcgagttaactcccctgcctgagaccggctattggcgtgtccgtctctggaatggagataaatatgcagcaactactactccattcaccccattgcacatcaaggtgaaacccaagagggtcgggatcttcctggattacgaagctggcaccctgtccttctacaacgtgacggatcggagccacatatatactttcaccgatacatttacagaaaagttgtggcctctgttctatcctggaatcagggccggccgcaagaatgctgcacctctgactattcgaccacccaccgattgggaatag

SEQ ID NO: 138916 - DNA, 786 bp, Artificial Sequence
  Description of Artificial Sequence: Synthetic coding sequence
atggctgaaacaagccttctggaggccggagcctccgctgctagcactgccgcagctttagagaacctgcaggtcgaagcctcttgctctgtatgcttggagtatctcaaggagccagttattatcgagtgcgggcacaatttctgcaaggcctgcataactcggtggtgggaagatctggagagggactttccgtgccccgtgtgccgcaagacgtctagatacaggagtctccgccccaacaggcaactgggcagtatggtggaaatcgctaaacagcttcaagccgtcaaaagaaagattcgggatgagagcctctgtccccaacaccacgaggctcttagcctgttctgctacgaagatcaggaggccgtgtgcctcatatgcgcgatttctcacactcatcgggcccacactgttgtgcctctggacgatgctacccaagagtacaaggagaaactgcaaaagtgtctagagcctctggaacagaaactgcaggagattacgcgatgcaagtctagcgaggaaaaaaaaccaggcgagctgaagagactcgttgagtcgagaaggcagcagattcttagagagttcgaggagctccaccgaaggctggatgaagaacagcaggtgctgttgagtcggttggaggaggaggaacaggatatcttacagcgtctgagagaaaatgctgctcacttaggagataaaagaagagacctggcccatctggcagctgaggttgagggaaagtgtttgcagagcgggttcgagatgttgaaggtatag

SEQ ID NO: 138917 - DNA, 225 bp, Artificial Sequence
  Description of Artificial Sequence: Synthetic coding sequence
atggccgaaacatccctcctggaagccggggcctcagctgcatctacggccgctgcattggaaaatctgcaggtcgaggcctcttgtagcgtttgtctagagtacctgaaggaacccgtgattatagagtgcggacataacttctgtaaagcctgcataactcggtggtgggaggatctggaaagggactttccctgcccagtgtgccgaaagacgagccgttag

SEQ ID NO: 138918 - DNA, 180 bp, Artificial Sequence
  Description of Artificial Sequence: Synthetic coding sequence
atggccgaaacttcattgctcgaagccggcgcttcagcagccagcacggcggcagcactggaaaatctgcaggtggaagcgtcgtgttctgtgtgcctggagtacctcaaagaacctgtcatcattgagtgcggccacaatttctgtaaagcctgtatcaccaggtggtgggaggattag

SEQ ID NO: 138919 - DNA, 786 bp, Artificial Sequence
  Description of Artificial Sequence: Synthetic coding sequence
atggctgaaactagcctgctcgaagccggtgcatctgcagcctcaactgcagccgcattagagaacctccaggtagaagccagctgttccgtgtgcctggaatatctcaaggagccggtcatcattgagtgcggccacaatttttgcaaggcttgcattacgagatggtgggaagatcttgagagagacttcccctgtcccgtgtgtaggaagactagcagatacaggtctttgagaccaaacaggcagttagggagtatggtggagatagctaaacagttacaggctgtgaaacgaaaaatccgggacgagtccctttgccctcaacatcacgaagcgctgtccctgttctgctacgaagatcaggaagcagtgtgcctgatctgcgccatatcgcatacacatcgagcccacacggtagtaccactggatgatgccacccaggagtataaggaaaagcttcaaaagtgtctggagccccttgagcagaagctccaagagatcactcgctgtaaatcatctgaagagaaaaaacccggtgaactaaaaagacttgtggagtccagaaggcagcaaatcctacgggaattcgaggaattgcacaggcgactggatgaggagcaacaggtcttattgtctcgactagaggaagaagagcaggatatcttgcagagactcagggaaaatgcggcccaccttggagataaacgccgcgacctggcccacctggccgcagaggttgagggaaagtgtctccagagtggctttgagatgctgaaagtgtag

SEQ ID NO: 138920 - DNA, 1467 bp, Artificial Sequence
  Description of Artificial Sequence: Synthetic coding sequence
atggctgaaacaagtttgctggaggcaggagcctcagctgcctcaacagccgctgctctcgagaacctgcaggtcgaggcatcatgctcagtatgtttagaatatctcaaggagcctgtgattattgaatgcggtcacaatttctgcaaggcgtgtattactagatggtgggaggacctggagagagactttccctgcccagtctgcagaaagacttcacgatatcgctccttaagacccaacagacaactgggctccatggtggaaatcgccaaacaactgcaggccgtgaagcgtaaaatacgcgacgaaagtctgtgcccacaacaccacgaggctctgtctctgttctgctacgaggatcaggaggctgtctgccttatctgtgcgatatcacacacccacagggctcacacggtggtgcctctggacgatgccacacaggagtacaaagagaagctgcaaaaatgcctcgaaccacttgagcagaagctccaagagataaccagatgcaaatcgagtgaggagaagaagccaggcgaacttaaacgtctggttgagtcccggcggcagcagatcctccgtgagtttgaggaactccatcggagactagatgaggagcagcaggtgctgctctccagactcgaagaggaagaacaagatatactgcagaggttgcgcgaaaacgcagcccatctcggggacaagcgcagagatctggcgcacctggctgctgaagtggaggggaagtgcttacagagcggcttcgaaatgcttaaggacgttaagtccaccctggagaagtgcgaaaaggtaaagacgatggaggtgacctcggtgtcaatcgagctggagaaaaatttttcaaatttcccacgccaatactttgcattgcgcaaaatactaaaacaactgatcgccgacgtaaccttagatccggaaactgcccatcctaatctggtgctgagcgaagatcgcaaatctgtgaaattcgtggagacacgattacgggacctgccggacacgcccagacgctttacattttacccatgtgttcttgccaccgaaggcttcacgagtggaagacactattgggaagtggaagttggcgacaagacccattgggcagtcggcgtgtgccgtgacagcgtgtctcgaaaaggggaactgaccccgctgcccgagaccggctactggagagtgaggctgtggaatggggataagtatgccgccacaacaaccccattcacacctctgcacatcaaggttaaacctaaaagagtgggtatctttttggattatgaggctggcaccctaagcttctacaatgtcaccgacagatcacacatctacacctttaccgacactttcacagagaaactgtggccactgttttacccgggcattcgagccgggcggaaaaatgccgcaccacttacaatcagacctcctactgactgggaatag

SEQ ID NO: 138921 - DNA, 1557 bp, Artificial Sequence
  Description of Artificial Sequence: Synthetic coding sequence
atggccgagacaagtctcttggaggcgggcgcttctgcggcctctactgccgcagctcttgagaacctccaggttgaagcttcctgcagtgtttgtttggagtacctgaaagaacccgttataatcgagtgcgggcataacttttgcaaggcatgcatcacaaggtggtgggaggaccttgagagagattttccttgcccggtgtgccggaagacatcaagatatagatcactgagaccaaatcgtcagctcggaagcatggtggagatcgccaaacagttacaggccgtgaagcgcaaaattcgggatgagtccctgtgccctcagcatcatgaggctctgtccctgttttgttacgaggatcaagaggctgtgtgcctgatttgcgccatttctcatacccaccgggcccacactgtggttccattggacgatgccacccaggaatacaaagagaagctgcagaagtgtctcgagcctctcgagcagaagctccaggagatcaccagatgtaaatcctccgaagagaaaaaacccggcgagctgaaaaggttggtcgagagcaggaggcagcagatactccgcgaattcgaagagctgcaccgaaggttggatgaagaacagcaggtgctcctatctcgcctcgaggaagaggagcaggatatactgcagcgtctgcgggagaatgctgctcatctcggggacaagcggagagacctcgcccacctcgcggctgaggtggagggaaaatgtctgcaatccgggtttgagatgttgaaggatgtcaaaagcacacttgagaagaacattccacggaaattcggcgggagcttgagcacaatttgccctcgcgatcacaaggccttgctgggactggtcaaagagataaatcggtgcgaaaaggtgaaaacaatggaagttacaagcgtctccatcgagctggaaaaaaatttcagtaactttccacggcagtacttcgctctgcgaaagattctgaagcaactgatcgccgacgtgaccctagatcccgagaccgcccaccctaatctcgtgctgtcagaagaccgaaagagcgtgaagttcgtggagacccggctgagagacctgccagacacaccacgccgctttacattttacccctgtgtcctagccacggaagggttcacctctggtagacactattgggaggttgaagtgggggacaaaacacactgggccgtgggtgtctgtcgggatagtgtgtcaagaaaaggagaactgacacctctgccagaaacaggttactggagggtgcgcctgtggaacggagacaaatacgctgcgaccacaactcctttcaccccgttgcacattaaggttaaacctaaacgtgtgggaatcttcttggactacgaagccggcaccctgtctttctacaatgtcacagatagaagtcacatctacacttttactgatacattcacagagaagctttggcctctgttctaccctggcatcagggcgggtcgcaaaaatgcagccccgctgactattagaccacccacggactgggagtag

SEQ ID NO: 138922 - DNA, 1467 bp, Artificial Sequence
  Description of Artificial Sequence: Synthetic coding sequence
atggctgagacatctctcctggaagcaggcgctagcgcagcctctactgccgctgccctggagaacctgcaggtggaggcgtcgtgtagtgtgtgcctggaatatctgaaggagccagtgattattgagtgcggccacaatttctgcaaagcatgcataacacgatggtgggaggatctcgaacgggacttcccttgtccagtgtgccggaaaacgagccgctatcgaagtctgaggcccaatcgtcagctggggtccatggtagagattgcaaaacagctgcaggcagtgaagcgaaaaatccgggacgagtcgttgtgtccccaacaccatgaggccctcagcctcttttgctatgaggaccaggaggctgtgtgccttatttgtgccatcagccatacccatcgcgcgcacacagtggtgccacttgatgatgccacccaagagtataaagaaaaattgcagaagtgcctggagcccctggaacaaaagctgcaggagatcacaagatgtaagtcctccgaggagaagaagccaggcgagctgaaaaggctcgtcgaaagccgccgtcagcagattttgagagagttcgaggaattgcataggcgccttgacgaggaacaacaagtgttgctgagccgccttgaagaagaggagcaagacattctgcagcgactgcgggaaaatgctgcacacctcggggacaaacgtcgggatctggcacaccttgccgcggaggtggaggggaagtgccttcaaagtgggtttgagatgctgaaagacgtcaagtctaccttggagaaatgcgagaaggtgaagactatggaggtgacctcagtgagcatcgaactggagaagaactttagcaacttccccaggcagtacttcgcccttcgaaaaatcctcaagcagctgattgcggacgtgactctggaccctgaaacagctcacccaaacctcgtgctgagcgaagaccggaaaagcgtaaagttcgtggagactaggctgagagatctacccgatacacctagacgctttaccttctacccatgtgttctcgcaactgaaggattcactagtgggcgacactattgggaggtcgaggtgggagacaaaacgcactgggccgttggggtgtgtagggactcggtttccagaaaaggagagcttacccccttgcccgagacaggctattggcgcgtccgcctgtggaacggagacaagtatgcggccaccactactcccttcacacctctccatatcaaggtcaaacccaagcgagtggggatattcttggactacgaggccggcacgctttccttctataacgttactgatcgaagtcacatttatactttcaccgataccttcaccgaaaagttatggccgctattctatcctggcattcgcgcgggccgtaagaatgcagcgccattgacaatcagaccccctacagactgggaatag

SEQ ID NO: 138923 - DNA, 786 bp, Artificial Sequence
  Description of Artificial Sequence: Synthetic coding sequence
atggcagaaacctccctgctggaagcaggcgcgtcggccgcttctacagcagcagctttagagaatctacaggtggaagctagctgctccgtgtgcctggaatacctcaaagagcccgtgatcatcgaatgcgggcacaatttctgtaaagcctgcataactcgctggtgggaggacctcgagagggatttcccgtgccccgtgtgcagaaagacctctaggtatcgcagcctacggcccaacaggcagttgggttccatggtcgagatagccaaacaactgcaggctgtcaaaagaaaaatacgagacgaaagcctctgcccgcagcatcacgaggccctctctctattttgctatgaggaccaggaagccgtgtgcctgatttgcgcgatttcacacacacaccgagcccacaccgtggtgccacttgatgatgccacccaggagtataaggagaaacttcagaagtgtcttgagcctcttgaacagaagcttcaggagattaccaggtgcaagtcgagcgaggagaagaagccgggagagctcaagaggctcgtcgagtcccggcgccagcaaatcctgagagaatttgaagagctgcatagacgcttggacgaagaacagcaggtgctgctcagtagattagaggaggaggaacaggatatcctgcaacgccttagggagaatgccgcacacctgggggacaaacggagggacttggcccatttggccgcagaggttgaaggcaaatgcctccagagcggctttgaaatgctgaaggtgtag

SEQ ID NO: 138924 - DNA, 225 bp, Artificial Sequence
  Description of Artificial Sequence: Synthetic coding sequence
atggcagagacttcattgctcgaggctggtgcctccgccgcttccacagcggccgctctagagaatctccaggttgaagcatcgtgctccgtatgcctggaatacttgaaggagccagttattattgaatgtgggcacaacttttgcaaagcttgcattacccgttggtgggaagacctcgagagagactttccctgccccgtgtgcaggaaaacctctaggtag

SEQ ID NO: 138925 - DNA, 1236 bp, Artificial Sequence
  Description of Artificial Sequence: Synthetic coding sequence
atggccgaaacatctcttctggaggccggggcaagcgccgccagcactgccgcagcactggaaaacctgcaggtggaggcctcatgttcagtgtgtctggaatacctgaaggaacccgtgatcatcgagtgcggtcataacttctgtaaggcttgcataactcgctggtgggaagaccttgagcgcgattttccttgtcccgtttgcagaaagaccagccggtatcgctctctgaggcctaacaggcagctaggttccatggtcgagatcgcaaagcagctacaagctgtgaagcgcaaaatccgtgacgagtcactctgtccccagcaccacgaagcgctgagtctcttttgctatgaggaccaagaggcagtctgcttgatatgcgccatttctcatacacaccgagctcacaccgttgtacctctggatgacgccacccaagagtacaaggaaaaactccagaaatgtctggagcccctggagcagaagctgcaggagatcaccagatgcaaatcaagcgaggagaaaaagccaggtgagttgaaaaggctcgtagaaagtagaaggcagcagattctccgggaattcgaggaactgcaccgacgcctggatgaggagcaacaggtgctgctgtcaaggctggaggaggaagaacaggatatccttcagagactccgtgagaatgctgcacacttgggtgacaagcggagggatctggctcacctggccgctgaagtagagggtaaatgcctccagtccggctttgaaatgctgaaacctgtcttgtctgcacgcgaggaatgtgaaaaggtcaagacaatggaagtgactagcgtgtctatcgaactagaaaagaatttcagtaattttccgcgtcagtacttcgccctacggaaaattctgaagcagttaattgccgacgtcaccctggacccagaaaccgcgcacccgaaccttgttctctccgaggatcgtaagtctgtaaagtttgtggaaaccagactgagagatcttcccgatacgccccggcgctttacattctatccttgcgtcctggccaccgagggttttacctctgggcggcactactgggaggtggaagtcggagataaaacccattgggccgtcggcgtatgtcgcgatagcgtgtccaggaagggcggctgcggttacggtatggggactaacatgcagccgccccctcacctgctccctctctgtaccagtcggtag

SEQ ID NO: 138926 - DNA, 1467 bp, Artificial Sequence
  Description of Artificial Sequence: Synthetic coding sequence
atggccgagacttctctgctcgaagctggcgccagtgctgcttcaacagctgctgcactggagaacctacaagttgaagcaagctgctccgtctgcttagagtacctcaaggaacccgtgattatagagtgcggccataatttttgcaaggcatgtattaccaggtggtgggaagacctggagcgggattttccctgcccagtgtgtcggaagacaagtaggtacagatccctccgcccaaaccgccagttaggtagtatggtcgagattgcaaagcagttacaggccgtcaagcgtaagatccgagatgaaagcctgtgcccgcaacaccacgaggctctgtccctgttctgttacgaagatcaggaagcggtgtgcctgatctgtgccattagccacacacacagagctcacactgtagtgccactggacgacgctactcaggaatacaaggaaaagttgcagaaatgtcttgagcccctggaacagaagcttcaggagattactcgctgcaagtcttccgaagaaaagaaaccaggggaactcaaacgattagtggagtcccgcagacagcagattctcagggagttcgaagaactgcacaggaggctggatgaggaacagcaggttctcctgagccgcctggaggaggaagagcaagacatcctccagcgcctccgcgagaacgcagcccacctgggtgataagaggcgggacttagctcacttagccgcagaagtcgagggaaagtgcttacagtctggcttcgagatgctgaaggacgtcaagagcacactggagaagtgcgagaaagtgaagaccatggaggtaacgtccgtctccatcgagttggagaagaacttctctaacttcccacgtcaatactttgccctgcgtaaaatcttgaagcagctgatagccgatgtgacactggacccagagactgcccatcctaacctcgttctatcggaagataggaagtctgtgaaatttgtggagacaaggctcagggatctgcccgacactccacgtcgatttacattttatccatgcgttctggcgaccgagggtttcacttccggcaggcactactgggaggtcgaagtaggagataagacccattgggccgtaggcgtatgtcgcgattctgtcagtcgaaagggagaactaacccctcttcctgagaccggatactggcgcgttagactgtggaacggagacaaatacgctgctacgaccaccccttttacaccactgcatatcaaggtgaaacctaagagagtcggaatcttcctcgattatgaagctggcaccctctcattttacaatgttaccgaccgcagtcacatttacacctttaccgacactttcacagagaaactatggccgttattctaccccggaattagagctgggcgtaagaacgcagctcctctgaccattcggccaccgacagactgggaatag

SEQ ID NO: 138927 - DNA, 786 bp, Artificial Sequence
  Description of Artificial Sequence: Synthetic coding sequence
atggccgagactagccttctggaagcaggtgcctccgccgcctccacagccgcagccttagaaaatttgcaagtggaggccagctgctccgtatgcttagagtacttgaaggagcccgtgattattgaatgcggtcataatttttgcaaggcctgtatcacgcggtggtgggaggacctcgagagagactttccatgtcctgtctgcagaaaaactagtcggtataggagtctgagacccaatagacagcttggctccatggtggagattgccaaacagctgcaggcagtcaaacgaaaaatcagggatgaaagtctctgccctcagcaccatgaggccctgagcctgttctgctatgaagaccaggaggctgtgtgcttgatatgtgctataagtcacacacatagagcacatacagtggtgccactggacgatgctacccaggagtacaaagagaaactccagaagtgtctggagcccctcgaacaaaagctgcaggaaatcactcgttgtaaatcctctgaggagaaaaaacccggtgagttgaaacgtctcgtggaatcccgacggcagcaaatcctgcgcgagttcgaagagttacatcgacgcctcgacgaagaacaacaagtgctgctctcgcggctggaggaagaggagcaggatatcctccaacggctcagagagaacgccgcacatcttggggacaagcgccgggatctcgcccacctggctgcggaagtggaaggtaagtgcctccaatcaggattcgaaatgctgaaagtgtag

SEQ ID NO: 138928 - DNA, 147 bp, Artificial Sequence
  Description of Artificial Sequence: Synthetic coding sequence
atggcagaaactagcctcctggaagcaggggcaagtgcggcctctactgcggccgcacttgaaaaccttcaggtggaggcatcctgctctgtgtgcctggaatacctcaaggaaccagtgatcatcgagtgtggacacaacttttag

SEQ ID NO: 138929 - DNA, 786 bp, Artificial Sequence
  Description of Artificial Sequence: Synthetic coding sequence
atggcagaaaccagtctcctggaggcaggagcttcagccgcgtccactgccgcagctctcgagaacctgcaggtcgaggctagctgcagcgtgtgtcttgagtatctcaaggaaccagtgatcatcgagtgcggccataacttctgcaaggcttgtatcacaaggtggtgggaagaccttgaacgggacttcccctgccccgtgtgccgaaagacctctcgttatagaagtcttagacccaaccgtcagcttgggagcatggtcgaaattgcaaagcagctgcaagccgttaagaggaagatcagagatgaatccttatgccctcagcaccatgaggccctgtcacttttctgttacgaagaccaggaggccgtgtgtctgatctgtgcgatttctcatacgcatcgcgcacatacagttgtgcctctcgacgacgctacccaggaatacaaggaaaagctccaaaaatgcctagagcccctagaacaaaagttacaagagatcacacggtgcaagtcttctgaggagaaaaagcccggggagctcaagcgtctcgtcgagtcccggcgacaacagattttaagagaatttgaagaactacacagacggctggatgaagagcagcaagtcctgcttagtcgcctagaagaagaggagcaggatatactgcaaaggctgcgggaaaatgctgcacatttgggcgacaaaagacgcgatctagcacacctagctgctgaagtggagggcaaatgtctccagagtggttttgagatgctcaaagtttag

SEQ ID NO: 138930 - DNA, 1467 bp, Artificial Sequence
  Description of Artificial Sequence: Synthetic coding sequence
atggccgagacgtcattactcgaagctggcgcgtcagccgcctcaacggctgccgccctcgaaaacctccaggtcgaggcgagttgctccgtgtgcctggaatatctgaaagagcccgtcatcattgaatgcggacataacttctgcaaggcctgcatcacccggtggtgggaggatcttgagcgggactttccttgccctgtgtgtcgcaaaactagcagatatcgaagcctgaggccaaatcgtcagctgggatctatggttgaaatcgccaaacagcttcaggccgtcaagcgaaaaatcagggatgagagtctgtgtccacaacaccacgaggctctgtcccttttctgttacgaggaccaggaggcagtctgcctgatctgtgccatcagccatacgcaccgggcacatacagttgtgcctctggacgatgccacccaggaatacaaggaaaagctgcaaaagtgcttggagcccctagagcagaagctccaagagataaccaggtgtaaatcatccgaagagaagaagcccggcgaactgaaacggctggtggagtcacgcaggcagcagattttgcgagagtttgaggagttgcatcgacgcctagacgaggagcaacaggtattgctcagtagattagaggaggaggaacaggatattctgcaacggcttagagaaaatgcagcccaccttggagacaaaagacgcgatctggcccacctggcggccgaagtggaaggcaagtgtctgcagagcggatttgaaatgctgaaggatgtcaaatccaccctggagaagtgcgagaaagtgaagacaatggaagtaacgtcagtctccatcgaattagaaaagaatttttcaaatttccctcggcagtactttgccctgcgaaagattctcaagcaattgattgccgatgtgactttagaccccgagacagcccatccgaatctggtgctgagcgaggatagaaagagtgtcaaattcgttgagaccaggctccgcgacttacctgataccccaaggagattcacattttacccctgtgtgctcgctactgaaggttttacctccggcaggcactattgggaggtggaggtgggagacaagacacactgggcggtcggagtctgccgagactccgtcagtcgcaaaggggagttaacccccttaccagaaacaggctactggcgcgttcgattgtggaacggggataaatatgcagcgactaccacaccgtttaccccactgcatattaaagtgaagccaaaacgggtaggaatattcttggattacgaggccgggacattgtcgttttacaacgtaacggacagaagtcatatctacacctttactgatactttcacagagaagctctggccactgttctaccctggaattcgggctggtcgtaaaaacgcagcaccactcacaatacgccctccaaccgattgggaatag

SEQ ID NO: 138931 - DNA, 225 bp, Artificial Sequence
  Description of Artificial Sequence: Synthetic coding sequence
atggcagagacctccctactggaagcaggcgctagcgctgccagcactgcagcagctttagaaaatctgcaagtggaagctagttgttctgtatgcctggagtacctgaaagaaccagtcattatcgagtgcgggcacaatttctgcaaagcctgtataacccgttggtgggaagacctggaacgggactttccatgccccgtctgcaggaaaacaagtcgttag

SEQ ID NO: 138932 - DNA, 1467 bp, Artificial Sequence
  Description of Artificial Sequence: Synthetic coding sequence
atggcagagacttcactcctggaagctggggcaagcgccgcgagcaccgccgctgctttagaaaatcttcaggtagaagcctcatgttcagtgtgcctggagtacttgaaagagcccgtgatcattgaatgtggtcataatttctgtaaggcatgtattacacggtggtgggaggacttggagagggacttcccatgcccagtctgtcggaagacatcccgctatcgatctcttcggcccaaccgccagcttggcagtatggtcgagatagccaaacaacttcaagctgtcaagcggaagatcagagacgaatctctgtgcccgcagcaccacgaggcgctttcgctcttttgttatgaggaccaggaggccgtgtgtctgatctgcgccatttctcacacccatcgagcacacactgtggtaccacttgatgacgcaacccaggaatataaggaaaaactccagaagtgtttggagcctctagagcagaagctccaggaaataacaaggtgtaagtcgagcgaagaaaaaaagcccggggaactgaagaggctcgtcgagtcccggcgtcagcagatactccgggaatttgaggaactgcataggcggctggacgaggaacaacaggttcttctgagccggcttgaggaggaagaacaggatattcttcagcgcctgcgggagaacgccgcccacctaggggacaagcgacgagacctggcccatttagccgccgaggtagaaggtaagtgcctgcaatcagggttcgaaatgttaaaggacgttaagagcactctggaaaagtgcgagaaagtgaagactatggaagtaacctctgtgtcaatagaactcgagaagaatttttcaaactttccacgccaatactttgccctgcgaaagatcctgaagcagctgatagccgacgtgacgttggaccctgagacagctcatcctaatctggtcctatccgaggataggaaatctgtgaaatttgtggagacgagattgcgggacttgccagatacaccacgcaggttcaccttctatccctgtgtgctggctacagaagggtttacatcaggaagacactactgggaagtcgaagtcggtgacaagacccattgggctgtcggcgtctgtcgagactccgtgtcaaggaagggtgaattgacgccgctccccgagaccggctactggcgtgtgcgcctctggaatggcgataaatatgcggccacaactacaccgttcacccccttgcacataaaggtgaaacccaagcgagtaggaatattcctggactatgaggccggtaccctgtcgttctacaacgtgacagaccggagtcacatctatacatttacagataccttcactgaaaaactgtggcccctgttttatcctggaattagagctggacgaaagaatgcggcaccgctaacaatccgccctcctacagactgggagtag

SEQ ID NO: 138933 - DNA, 1557 bp, Artificial Sequence
  Description of Artificial Sequence: Synthetic coding sequence
atggcggagacaagtctgctggaggctggagcaagcgcggctagtaccgcagccgctctggaaaacctgcaagtcgaggcctcctgtagcgtctgtttggagtacctgaaggaaccagtcattattgagtgcggtcataacttttgcaaggcttgtattacaagatggtgggaagacctggaacgtgattttccatgtcccgtgtgccgcaagacttcacggtatcggtccctgagacctaaccgacagcttgggtctatggtggaaatagctaagcagttacaggccgtgaaaaggaagatccgagatgagagcctttgccctcagcatcacgaagcactgagtctgttttgttacgaggatcaagaggccgtgtgccttatttgcgccatcagccatacccacagggcccacaccgtggtcccgcttgacgacgcgacccaagagtacaaggagaagctgcagaaatgcctggagcccctggagcaaaagttacaggaaattactagatgtaagtcatctgaagaaaaaaaacctggagagctgaagagactggtggagagtagacgtcaacagatactgagggagtttgaagagctgcaccgccggttggacgaggagcaacaggtgttgctgtctagattggaggaagaagaacaggatattctgcaacgcctccgggagaacgctgctcatcttggagacaaaaggagggacctcgcacacctggctgcagaggtggaaggtaaatgtctccaatcaggcttcgagatgcttaaagatgtgaaatccacgctggagaagaacatcccacgtaagtttggaggcagcctaagtacaatttgccctcgtgatcacaaagcactgctgggcctggtgaaagaaatcaatagatgtgagaaagtgaagacaatggaagttacatctgtgtccatagagctggaaaagaacttctccaattttccacgccagtacttcgcactgcggaaaatcctaaaacagctcatcgcggacgtaacactagatcctgaaactgcacaccccaatttggtgctgtctgaagatcgcaaatccgtaaaatttgtggagactagacttagggacctccccgataccccaagaagatttaccttttatccctgtgttctggccactgagggattcacaagtggcaggcactattgggaggtggaggtgggggacaagacacactgggctgtcggagtctgcagagatagtgtgtcgagaaagggagagctgacgccactgccagagaccggatactggagggtgcgactgtggaacggagacaagtacgcagccaccactacacccttcacacctctgcatatcaaggtcaagccaaagcgagtgggcatcttcctggactacgaggctggaaccctgtcattttacaatgtgacagaccggtcgcacatttataccttcacggatacctttacagagaaactctggcctcttttctacccaggcatccgagccggacgtaaaaacgcagcgcctctgacaatcagacctcccactgattgggagtag

SEQ ID NO: 138934 - DNA, 1467 bp, Artificial Sequence
  Description of Artificial Sequence: Synthetic coding sequence
atggctgagacttctttgttggaggccggcgccagtgcggcatctacagccgctgccctggaaaatctccaggtcgaggcgagctgctccgtgtgcctggagtaccttaaagaaccagtgataattgagtgtggacacaatttctgtaaggcctgcatcacccgttggtgggaggacctggagagggactttccatgtccggtctgcagaaaaacgtccaggtacaggtccctgcgacccaataggcagctcgggtcaatggtagagattgccaaacagcttcaagccgtcaaaaggaagatcagggacgaatctctgtgcccacagcaccacgaggcactttccctattttgttatgaggaccaagaagccgtgtgtttaatctgcgctatttcgcatacacaccgtgcccacactgtcgtgccattagacgacgcaacacaggagtataaggagaaactgcagaaatgcctcgagcccctggaacagaaattacaggaaattacacgttgcaagagctcggaggaaaagaagcccggcgagttgaagagattggtggagtcccgacgtcaacaaattttacgggagtttgaggagctacacaggcgattggacgaggagcagcaggtgttgttgagcaggcttgaagaagaagaacaggacattctgcagaggcttcgtgaaaatgccgcgcacctgggagataaaagaagagacctggcccatttagccgcggaggtcgaaggcaaatgcctccaatctgggtttgaaatgctgaaggacgtcaagtctacactggagaagtgcgaaaaagttaagacaatggaagtcaccagtgtatctatagaattagaaaagaacttttccaatttcccaaggcagtactttgcattacgcaagattctcaagcagttaatagccgatgtcacactggatccggaaactgcgcatcccaacttggtgctgagtgaagaccgaaaatccgtgaagttcgtggaaacacggctcagggatcttccagacacccctagaaggtttaccttttatccctgcgtgctggccacagaaggatttacaagtggccggcactactgggaggtggaagtcggcgataaaactcattgggccgtgggggtatgcagggattctgtcagccggaagggggagctcactccccttccagagactgggtactggagggtgaggttgtggaacggggataaatatgcagctaccacaacccccttcacccccctccacatcaaggtaaaacctaaaagggtggggattttcctggactacgaagcaggaacccttagtttctataacgtgaccgaccgctcccatatctatacatttaccgacacttttacagaaaagctttggccattgttctaccccggcatcagagccgggaggaagaatgcagcacccctgactatccggcctccaactgactgggagtag

SEQ ID NO: 138935 - DNA, 435 bp, Artificial Sequence
  Description of Artificial Sequence: Synthetic coding sequence
atggccgagacgtctctgctggaagccggtgcgtctgcagcctctaccgcagcggctctggaaaacctgcaggtcgaagcctcctgctccgtttgcctggagtacctaaaggaacctgtcattattgagtgcggacataacttctgtaaggcttgtattaccaggtggtgggaggacctggagagggatttcccctgtcccgtttgtcgcaagactagccggtataggagtctgcggcccaaccgacaactcggctccatggtcgagattgctaagcagttgcaagcagtcaagcgaaaaattcgggatgagtcactttgtccacaacatcatgaggcccttagcctgttttgttacgaggaccaggaggccgtttgcctaatttgcgctattagccatacccatcgggctcatactgtggtcccactggactag

SEQ ID NO: 138936 - DNA, 435 bp, Artificial Sequence
  Description of Artificial Sequence: Synthetic coding sequence
atggcggaaacctcattactcgaggccggggctagcgcagcgtcgacggcagcagccttggagaacctgcaggtcgaggcctcctgcagcgtgtgtctagaatatttgaaagagccagtgattatcgaatgtggccataatttctgtaaagcttgcattacccgctggtgggaagacctggaacgggacttcccatgcccggtctgtagaaaaacttctagataccggagtctgcgcccaaacagacagctgggctccatggttgaaatcgccaagcaattgcaggccgtcaaaagaaagatccgcgatgagagtctttgcccccaacaccatgaggccctgagcttattctgttatgaagaccaggaggccgtgtgtctcatatgcgccatatcacacacccatcgggcccataccgtagtacccctggattag

SEQ ID NO: 138937 - DNA, 684 bp, Artificial Sequence
  Description of Artificial Sequence: Synthetic coding sequence
tgaactagtcggtatcgctcacttcggcccaaccggcagctggggtcaatggtggagatagccaagcagttacaagcagtgaagcgaaagattagggatgagtcactgtgcccccagcaccatgaagccctgagcctcttttgttatgaggaccaggaagccgtgtgtttaatttgtgccatcagccacactcatcgcgctcacaccgtagtcccactggatgacgccacacaagagtacaaagaaaagctccagaaatgtctcgaaccgctcgagcaaaagttgcaagaaatcacccgatgcaaaagctcagaggaaaagaagcctggagaactgaagcggctggttgaaagcagacggcagcaaatcctgcgagagttcgaggaactgcaccgtagattggacgaggagcaacaagtgcttttgtccaggctggaagaggaagagcaagacattttacaacggctgcgggaaaacgccgcacacctcggtgataagcggagagacctggcacacttggcggccgaagtggaagggaaatgcctccagtccggatttgaaatgttgaaagacgtgaagagtacactggagaaatgcgagaaggtgaaaaccatggaagtcacctccactacaccttgcacgagtctgcattcagaaataaacgataacgtgcgcggccggtag

SEQ ID NO: 138938 - DNA, 147 bp, Artificial Sequence
  Description of Artificial Sequence: Synthetic coding sequence
atggctgaaacctcactattggaggccggcgcttctgccgcgagcaccgcagcagcccttgagaacctccaggtcgaggcgtcttgcagtgtgtgccttgaatatttgaaagaacccgtgatcatagagtgtgggcacaatttctag

SEQ ID NO: 138939 - DNA, 435 bp, Artificial Sequence
  Description of Artificial Sequence: Synthetic coding sequence
atggcggaaacctccctcctggaggccggggccagcgctgcatccactgctgccgctctggaaaacttgcaggtggaagcctcatgctcagtttgcctggaatatttgaaggaaccggtgatcattgagtgcgggcataatttttgcaaagcatgcattacgcgctggtgggaggacctggagcgcgacttcccttgcccagtatgcagaaagacgagcaggtatcgcagtctgcggccaaatcggcagctaggttctatggtggagatcgctaaacaactccaggcggtgaaaagaaagatacgcgatgagtcactatgcccacagcaccacgaagcactgagtcttttttgctacgaagaccaggaagctgtctgcctgatctgcgctatcagccatacacaccgcgctcataccgtcgtaccgctagactag

SEQ ID NO: 138940 - DNA, 1467 bp, Artificial Sequence
  Description of Artificial Sequence: Synthetic coding sequence
atggccgaaacaagtctgttggaggccggagctagcgctgcctctacagctgcagccctcgaaaacctccaggtggaagcatcgtgcagtgtgtgcctggaatatttgaaggaacccgtcataattgagtgtggtcataatttctgcaaagcctgtataacccgctggtgggaggacctcgagagggactttccatgccctgtttgccgcaaaacgagccggtaccgtagcctgcgtccaaaccgccaactcggcagtatggtggagattgctaaacaactacaggcagtcaaacgcaagatcagagacgagtccctgtgtccccaacatcacgaggccctatcactgttttgctacgaagatcaggaggcggtgtgcttaatttgtgctatttcacatacacacagagcacacactgtggtccccctggacgacgcgacacaggagtataaggagaaactccagaagtgtctcgagcctttggagcagaaactccaggaaattaccagatgtaagagctctgaggaaaaaaagcccggcgagctcaaaaggctggtcgagagccgccgccaacagatcctgcgcgaattcgaggagctccataggagactggatgaagagcagcaagttctgttgtcccggttggaagaggaagagcaggatatcctacaaaggctgcgtgaaaacgctgcccaccttggcgataagcgtagagatctcgctcacctcgctgcagaagtcgaaggtaaatgcctgcagtcaggatttgagatgctgaaagatgtgaaatccaccctggaaaagtgtgagaaagtaaaaacaatggaggttacatctgtgtctatcgagcttgaaaagaacttttccaatttcccaaggcagtacttcgcgctgcggaagatattgaaacaattgatagccgatgtgactctggatcccgagacagcgcacccaaacctggtcctgtccgaagacagaaaaagcgtcaaatttgtggagacaaggctgagggacctaccagatacccctagaagattcaccttctacccatgcgtcctagcgactgagggatttacatcaggccggcactactgggaggtcgaagtgggcgacaagacccattgggccgtgggagtctgtagggattcagtatccaggaaaggcgaactaaccccgctgcctgagacaggatattggagggttcgcctgtggaatggcgacaagtatgccgccactacaactccatttacacccctgcacattaaggttaagcccaagagagtaggaatcttcctggactatgaagcaggaactctctcattttacaacgtgaccgatagatcccatatatacaccttcacggacactttcaccgaaaagctatggcctcttttttaccctgggatcagagccggaagaaagaatgctgcccccttgacaatacgtccgcctaccgactgggaatag

SEQ ID NO: 138941 - DNA, 1467 bp, Artificial Sequence
  Description of Artificial Sequence: Synthetic coding sequence
atggctgagacgtcgctgctagaggcaggcgccagtgctgcatccacggctgcggccctagagaatcttcaggttgaggcttcatgtagcgtgtgccttgagtatctgaaagaaccagtgatcatagagtgtggtcacaacttctgtaaagcttgcataacccggtggtgggaggatctggaacgcgatttcccctgcccagtttgtaggaagacctcgagataccgaagtctgcgccctaacagacagctgggcagcatggtcgaaattgcaaagcaactgcaggccgttaagagaaagatcagggacgagtccttatgtccccagcaccacgaagccttatccctgttctgttacgaggatcaggaagcagtgtgtctgatttgtgctatctcgcacactcacagggcgcacacagtcgtgccactggatgatgctacccaggaatacaaggagaaattacagaagtgcctggagccattggaacagaagctccaagagatcacaaggtgcaaatcctccgaagagaaaaagccaggcgaactaaaaaggctcgttgagagtagacgtcagcagattctgcgcgaattcgaggagcttcaccgaaggctcgacgaagagcaacaagttctgttgagcaggctcgaagaggaggaacaggacattctacagagactccgcgagaacgccgcccatttgggggataaacgcagagacttggcgcacctggctgccgaagtggagggaaagtgcctgcagtcaggctttgagatgttgaaacccgtcctctcagctcgtgaggaatgcgagaaagttaagaccatggaagttacatcagttagtattgagctggagaaaaatttttctaacttcccccgccagtattttgcactgcggaaaatcctgaagcaactgatcgccgatgtaacactcgacccagagaccgcacaccccaatctggtgctttccgaggataggaagagtgtgaagttcgtggagacaaggctccgagatcttccagatactccacgcagatttacattctatccttgtgtgcttgctaccgagggtttcacctctggacgacactactgggaggtggaggtaggagataaaacgcactgggcagttggagtctgtagagacagcgtttctcgtaagggagaactgacccccctcccagaaaccggatattggcgcgtaaggctctggaacggagacaagtacgctgcaacgactaccccctttactcccctccatattaaggtgaagccgaagagagtcgggatctttttagattacgaagcagggacattgtcattttataacgttaccgaccggagtcacatttacacgtttacagataccttcacagagaagctgtggcctttattttatccaggcatcagggccggtcgtaagaatgccgctcccctcactatccggccacccacagactgggagtag

SEQ ID NO: 138942 - DNA, 1557 bp, Artificial Sequence
  Description of Artificial Sequence: Synthetic coding sequence
atggccgaaactagcttgctggaggccggggccagcgcagcatccaccgctgcagccctggaaaacctgcaggtggaggcctcgtgcagcgtatgtctcgagtacctcaaggagccagttataatcgagtgcgggcataacttttgcaaagcctgtattacacggtggtgggaagacctggaaagagactttccctgtcccgtatgcaggaagacttctcggtacagatcactccgcccaaacaggcagctgggttccatggtggaaatcgccaagcaactacaggcggtcaagcggaagatcagggacgaatcattgtgcccccagcaccatgaggccctgagcctattctgttatgaggaccaagaagcggtctgcctcatttgcgcaatctcccacacccacagagcacacacggttgtgcctttggatgacgccactcaagaatacaaggaaaagttacagaaatgtctcgagcctctcgagcaaaagttgcaggaaatcactaggtgcaagtccagtgaggagaagaagcccggtgaattaaagcgcctggtggagagtagaagacagcagatcctgagggaattcgaggagttgcataggcggttggatgaagagcagcaagtcctgctgtcccgtttagaggaagaggagcaggacatactgcaacgcctgagagaaaatgccgctcatctgggggacaagcggagggatctcgcccacttggccgccgaagtcgaaggaaaatgtctgcagagtggattcgaaatgctaaaacctgtgttgagtgcaagggagaaaaacatacctcggaagtttgggggcagcttaagtacgatctgtccccgtgatcataaggcgctgcttggattagttaaagagattaaccgatgcgaaaaagtgaaaactatggaagtgacatccgtatctatagaattggagaagaatttttccaattttcctaggcaatactttgccctgcggaaaatcttgaagcagctcattgccgatgtcacactggacccagaaaccgcacatcccaacctggtgctgagtgaggacagaaagtctgtaaaatttgtggagactcggctgcgagatttgccagataccccacgtaggttcactttttatccttgcgtactcgccaccgagggcttcactagtgggaggcactactgggaagttgaggtaggcgacaagacccactgggcagtgggagtgtgcagggacagcgtgagccggaagggggagttaaccccactgcccgagacgggatattggcgagtcagattgtggaacggcgataagtatgcagctaccactaccccattcacgccgttgcatatcaaagtgaaaccaaagcgagttgggatatttctcgattatgaggccggtacactctccttctacaatgtgacggatcgcagtcacatatacacctttactgacaccttcacagagaagttatggcctttgttctatccaggcattcgagccggaaggaagaatgcggcccccctgacaatccgcccaccaactgattgggagtag

SEQ ID NO: 138943 - DNA, 1236 bp, Artificial Sequence
  Description of Artificial Sequence: Synthetic coding sequence
atggcagagacatcactgctggaggccggagctagcgccgcctctactgctgccgcactcgaaaacttgcaggttgaggcgtcttgctcagtctgcctcgaatatctgaaggaacccgtgataatcgagtgcggtcacaacttctgcaaagcctgcattactcgatggtgggaagatctagagcgtgacttcccctgtccagtttgccgaaagacttcccgctatcgctcactacggccaaatcgccagttaggcagcatggtggaaatagcaaaacagctgcaggcagttaagcggaaaatccgcgacgaatcactctgtccacaacaccacgaagcgctgagcttgttttgttatgaggaccaagaggcagtctgtttaatctgtgccatcagccatacacacagagcacatactgtggtgcccctggatgacgcaacacaggagtacaaggaaaaacttcagaagtgtctggaaccccttgagcagaaacttcaggaaatcacacgatgtaagtcgtctgaggagaaaaagccaggcgagctgaaacgtctggttgagtctcgacgacagcagattctgagggaatttgaagaactccatcggcgcctggatgaggagcaacaagtgctgttgagtcgcctcgaagaggaagagcaggacatcctgcaacgcctcagagagaatgcagctcacttgggcgataagcgccgggatctcgctcatctggccgcagaagtggagggaaaatgtctacaatcggggttcgaaatgctgaaaccagtgctgtcagcccgagaagaatgtgaaaaggtgaagactatggaggttacaagcgtgagcatagagcttgaaaaaaacttctccaattttccacgccagtattttgcactgcgcaagatcttaaaacagctgattgccgacgtcacacttgacccagagaccgcacatcccaacctggtgctcagtgaggacagaaaaagcgtgaagtttgtggagacaagactgcgcgacctccctgatacgcccagaagattcactttctatccatgtgtcctcgccacggaagggtttacctctgggaggcactattgggaggtggaggtgggggacaaaactcactgggccgttggagtgtgccgcgactctgtatctagaaagggcggctgcggctacggaatgggaactaacatgcagcccccccctcacctccttcctttgtgcacgagcaggtag

SEQ ID NO: 138944 - DNA, 1557 bp, Artificial Sequence
  Description of Artificial Sequence: Synthetic coding sequence
atggctgaaacatcactcctggaagccggcgcctcagccgcctccaccgccgctgcccttgagaatttacaggttgaagccagctgttcagtgtgcttggagtacctgaaggaaccagttataatcgagtgcggccacaacttttgtaaggcctgtatcacccggtggtgggaagacctggaaagggactttccgtgtcctgtgtgcagaaagacctcaaggtaccgaagcctgcgaccaaacaggcagcttggcagcatggtcgagatcgcaaagcagttgcaggctgtgaaacgtaagatccgtgacgaatccctctgtccgcagcaccacgaggccctgagcctgttctgctacgaggatcaagaagctgtgtgtctgatttgtgccatttcgcatacacaccgcgcccacacggtggtgccgctggacgatgccacccaagaatataaggagaagctgcaaaaatgtttagagccgctagagcagaagcttcaggagatcacaaggtgtaagagctccgaggagaaaaaacctggcgaacttaagagactggtggaatctagacgacaacagatcctacgtgaattcgaggaactgcaccgacgactagatgaagagcagcaggtcctgctatcacgacttgaagaagaggagcaggatatccttcagagactacgggaaaatgctgctcatctgggagataaaaggcgggatttggctcacctggcagcagaggtggaaggcaagtgcttacagagtggtttcgagatgcttaaaccggtgctatcagctcgagagaagaatattcccagaaaatttggtggctcactgtctaccatttgtccaagagaccataaagctctcctcgggttagtcaaagagattaatcgttgcgagaaagttaagaccatggaggtcacctccgtgtccattgaacttgagaagaactttagcaattttccgagacagtattttgcactaaggaagatcctgaagcagcttattgcagatgtgacgctggatcctgagactgctcatcctaatttagtcctctcggaagaccggaagagcgtgaagtttgtcgagacccggctcagagacctgcccgacaccccgagacggttcactttttacccctgtgtgctcgccacagaggggttcacgtccggccgccactattgggaagtcgaagttggggacaagacccactgggccgtaggcgtttgcagggactcagttagcagaaaaggcgagctgacgccattacctgaaaccgggtattggagagttcggctgtggaacggcgataaatatgccgctacaactaccccatttacaccccttcacatcaaagttaagcccaagcgggtgggtatctttcttgattatgaagccgggaccttgtcattctacaacgtcaccgatagaagccacatctatactttcactgacactttcactgagaagctgtggccactgttctatcctgggatcagagccggcagaaaaaatgcagcacccctgactattagaccccccaccgactgggagtag

SEQ ID NO: 138945 - DNA, 1467 bp, Artificial Sequence
  Description of Artificial Sequence: Synthetic coding sequence
atggcggagacctctctgctcgaagccggcgccagcgccgcttctacagccgctgccctagagaacctccaagtggaggccagctgttcagtgtgcctggaatacctgaaggaacctgtgatcatagaatgcgggcacaatttttgcaaagcgtgtatcaccagatggtgggaagacctcgagagggacttcccatgtccagtctgtaggaaaacctcccggtataggagtctgcgaccaaaccgccaacttgggagcatggtcgaaatcgccaaacagctgcaggcggtgaagcgcaaaatccgtgatgaatcactttgtcctcaacaccacgaggcgctgtccttgttctgctatgaagaccaggaggcagtatgcctgatttgcgccatttctcatacccaccgagctcataccgtggttccactcgacgacgccacacaggaatacaaagaaaaactgcagaaatgcctggaaccattggagcaaaagctccaggaaatcacccgatgtaaatctagtgaggagaagaagcctggcgaactcaaacgtctggtggaatcccggcgccagcagatcttgcgtgagtttgaggagcttcatcgccgcctcgatgaagaacagcaggttttgctgtcacgtcttgaagaggaagagcaggacattctgcaacgcctcagagaaaatgctgcccatttgggcgacaagaggcgggatctggcacacctcgccgccgaggtggaggggaagtgtcttcagtcaggttttgaaatgctgaaacctgtcctgagcgctagagaggagtgtgagaaagttaaaaccatggaggtgacctccgtgtccatagagctggaaaagaacttttctaatttcccccggcagtactttgctctcagaaagattctgaaacagcttatagccgatgtgaccctcgacccagagacagcacatcctaatctcgttctctcagaggacagaaaaagtgttaagttcgtcgagacacgactaagagacttacctgacacgcccaggcgattcacgttttatccttgcgtgttggcaacggaaggctttactagtggtcgccactattgggaggttgaagttggcgacaaaactcactgggcggtcggagtgtgtcgtgatagtgtatctcggaaaggtgaactgactcctcttccggagacaggatactggcgtgtgcgcttgtggaacggtgataagtacgcagccacaactacccctttcactcctctccacatcaaggtgaaacccaagcgagttgggatctttttggactacgaggctggcacattgagcttctataacgtcacagataggtcacacatctatacatttaccgatacattcactgagaagctctggccccttttttaccccggcatcagggccggcagaaagaatgccgccccgctgaccatccggccccccacagactgggaatag

SEQ ID NO: 138946 - DNA, 1557 bp, Artificial Sequence
  Description of Artificial Sequence: Synthetic coding sequence
atggccgaaacttccctactggaagcaggagccagtgcagcttcaacagccgcagcgctcgaaaacctgcaggttgaggcctcatgctctgtctgtcttgaatacctgaaggaaccagtgattatcgaatgcggccacaacttctgcaaggcatgcatcacccgatggtgggaggatctcgagagagactttccatgccccgtgtgccgtaaaacaagtaggtaccgctccctacgcccaaaccgacagcttggtagcatggtggagattgctaaacagctgcaggcggttaaacgtaagattcgagacgagtctttgtgccctcaacatcatgaagccctttctctgttctgttatgaggatcaggaggcagtgtgcctcatttgcgccattagtcacacacacagagcacatacggtcgtgcctctggatgacgccacacaggaatataaggagaagttacagaaatgtctcgaacccttggaacagaaactccaggaaatcacacgctgtaaatcttccgaagagaagaaaccaggtgaactaaagcggttggtagagagcaggaggcaacagatcctgcgagagtttgaggaactgcaccggcgcctggatgaagagcaacaggttcttctttcccggttagaggaggaagaacaggatatcctgcagcgcctccgtgagaatgccgcccatttgggcgataagagaagggatctggctcatctggctgcggaggttgagggcaagtgcttacagtccggatttgagatgttgaaagatgtcaagagtacactcgagaagaatatacctaggaagttcgggggttctctgagcacaatttgtccccgcgaccacaaggccttgctggggctggttaaggagatcaatcgctgcgagaaagtgaaaaccatggaggtgacgtcagtgtctatcgaattagaaaagaatttcagcaattttcccagacaatactttgccttacggaagatactgaagcagctcattgccgatgtgaccctagatcccgagaccgcacaccccaacctggtgctgtcagaggaccgcaagtcagtcaagttcgtcgagaccagactgagggacttaccagatacgccacggagatttactttttatccttgtgtgctcgccaccgaggggttcacaagtgggagacactactgggaggtggaagtaggggataagacacattgggctgtcggcgtctgccgcgactctgtgtccaggaagggagagctgacccccctgcccgagacaggttattggagggtaagattatggaacggtgataaatatgccgcaaccacaacccctttcacgcccctacacatcaaggtgaaacccaagcgtgtcgggattttccttgactacgaagctgggacattatccttctacaatgtgactgatcgcagccatatttacacatttaccgatacatttacggaaaagctgtggccactgttttatccaggcattcgcgcggggcgcaaaaacgccgctcccttaaccattaggccccctactgactgggagtag

SEQ ID NO: 138947 - DNA, 1467 bp, Artificial Sequence
  Description of Artificial Sequence: Synthetic coding sequence
atggccgaaacttccttgctggaagcaggtgctagcgccgccagtacggccgctgctctcgagaacctgcaggttgaggcaagttgcagcgtttgtctcgaatacttaaaggagccagtgattatagagtgtggacataatttttgcaaggcctgcatcacccggtggtgggaagatctcgaacgcgatttcccatgcccagtctgtcgtaaaacctcaagatacaggagtttgagaccaaatcgccaacttggctccatggtggaaattgctaagcagctgcaggccgtaaaacgcaagattcgtgacgagtctttatgcccacaacatcatgaagcgctcagcttgttctgctacgaggaccaggaagccgtgtgtctaatttgcgccatttctcacacccaccgcgcgcatactgtcgttcccctcgatgatgccactcaggagtacaaagagaaactgcagaagtgtctggagccattggaacaaaaactccaggaaattacacgttgtaagagctcagaggaaaagaagccaggagagctgaagagactggtagagagccggcggcagcagatcctcagagaattcgaagagttgcacagacgcttagatgaagagcaacaagttttactcagcaggcttgaagaggaggagcaagatattctccagaggctgcgggaaaacgccgcacatttgggagataaaagacgtgacctggcacacttggcggcagaggtggagggcaagtgcctgcaaagcggattcgagatgctaaaaccagtcctttcagccagggaagaatgtgagaaagtcaaaaccatggaggtcaccagcgttagcatagaacttgaaaaaaactttagcaactttccgcggcagtacttcgcattaaggaaaatcctgaaacagctgatagcagatgtcacacttgaccctgagacagcccatccaaatctggtcctgagtgaagatcgcaaatctgtaaagtttgtcgagacccggctgagagatctccctgatacaccacgccggttcaccttctatccctgtgtattggctacggagggcttcacaagtgggcgccactactgggaggtggaggtgggggacaagacgcattgggctgttggagtctgcagggactctgtgtccagaaagggcgaattgacgcccctcccagagacgggttactggcgggtgagactgtggaacggggacaaatacgctgccaccactacacccttcactccattgcatatcaaggtcaagcctaaacgcgttggcatctttctggactatgaggctggaacattatccttttacaatgtgacagataggagccacatttatacatttactgatacttttactgaaaagctgtggccactgttttaccctggaatccgggcaggtaggaagaacgccgcccctctgacgattaggccccccaccgactgggaatag

SEQ ID NO: 138948 - DNA, 1467 bp, Artificial Sequence
  Description of Artificial Sequence: Synthetic coding sequence
atggcagagacctcactgctagaagcgggcgcatccgctgcgagcaccgcagcagctcttgaaaaccttcaagtggaggcttcctgcagcgtatgcctggaatatttaaaagagcctgttattatagaatgcggccataacttctgtaaggcttgtatcaccaggtggtgggaagacctcgagcgcgacttcccatgtcccgtctgtcgcaaaacttcacgctaccggtcactgcgaccaaaccgtcaactgggctcaatggtggagatcgctaagcagctccaggcagtgaagagaaagattagagacgaaagcctgtgtccgcaacaccacgaggcgctttcactattctgctacgaagaccaggaagccgtttgcctgatctgtgccatctcccacactcatagggctcatactgtggtgcctctggatgacgctactcaggagtacaaggaaaagttgcagaagtgccttgagcctttggagcaaaaactgcaggaaatcacaaggtgcaaatcttctgaggagaagaagccaggggaacttaaacgtctggttgaatcgaggcggcaacagatcctgcgcgagtttgaagagttgcatagacggctggacgaggaacagcaggttctgctgtctagacttgaagaagaagagcaagacatcctgcaacggctgagggaaaatgcggcccatctgggcgacaagagacgcgaccttgcccacctcgcggcggaagtggagggtaagtgcctccagagcgggtttgaaatgctcaaaccagtgttgagcgctagggaggagtgcgagaaagttaaaactatggaggtgactagcgtatctatcgagttggaaaagaatttttctaactttccgagacaatacttcgccctacggaaaattttaaaacagctaatagctgatgtgactctggatcctgaaacagcacatcctaacctggtcctgagcgaggaccggaaatccgtgaagtttgttgaaactagattgagagacttacccgatacacccaggcgtttcacattttacccttgtgtgctcgcaactgaggggttcaccagcggcagacactactgggaagtcgaagtgggggacaagacacactgggccgtgggagtttgccgtgactctgtgagcagaaaaggtgagctgacccctctgcccgaaacaggctactggagagtgagactgtggaacggcgataagtatgctgccaccactaccccgttcacgcctcttcacattaaggtgaaaccaaaaagagttggaatctttctggattacgaagctggcactctttccttttataatgtgacggaccgcagtcacatatacacatttaccgacacctttacagaaaaactgtggccgctgttttaccccggcatccgcgcgggtcgcaaaaacgccgcccctcttacaattagacctcccaccgactgggaatag

SEQ ID NO: 138949 - DNA, 1467 bp, Artificial Sequence
  Description of Artificial Sequence: Synthetic coding sequence
atggctgaaaccagtctgcttgaagcaggcgcatccgccgcttcaaccgcagccgctctggagaatttgcaggtcgaagcgagttgctccgtctgtctggagtatctgaaggagcccgtcattattgagtgcggccacaacttctgcaaggcctgcataactaggtggtgggaggatcttgaaagggacttcccatgccctgtgtgccgaaagactagccgatacagatccctgcggccgaacagacagttggggtccatggtggagattgcaaaacagctccaggccgtgaaaaggaaaatccgcgacgagtctctgtgcccccagcatcacgaagcgctcagcctcttctgttatgaagaccaggaggccgtgtgtctcatctgcgccatctcccacacccatagagcacatactgtcgtgccattagatgatgccacgcaggagtacaaggagaaactgcagaagtgtctagagccccttgagcagaaactgcaggagatcaccaggtgtaagagctctgaagagaaaaagcccggagaactgaagcgactcgtggaatcgagacgacagcaaatcctgagagagttcgaggagctgcatagacggttggatgaagaacagcaggttcttttatctcggctggaggaagaggagcaagatatccttcagcggcttcgggaaaatgcagcacacctgggagataagaggagagatttggcgcatctcgcggctgaagtcgaagggaagtgtctgcagtctgggtttgaaatgttaaagcctgtgttatccgcccgggaggaatgtgaaaaagttaagaccatggaagtcacctcggtctctatcgagctggagaaaaacttttccaattttccccgccaatactttgccctgcggaagatcctaaaacagctgattgctgatgtgacattggatccagagacggcccatcccaatctggtactgagcgaagacagaaagtccgttaagttcgtggaaaccaggctacgagacctgccagacactccgcgccgctttacgttctatccatgcgtgttggcaaccgagggcttcacctctgggagacattattgggaggtggaagtaggagacaaaactcactgggccgtgggagtgtgccgggatagtgtgtcacggaagggcgagctcacaccactgccggagacaggatattggagagtgaggctctggaacggggataagtacgctgccaccaccacacccttcacccctctgcacattaaggtgaagcctaagcgtgtcgggatttttctcgactacgaggctggaacgctcagcttctacaatgtgaccgaccgaagtcacatctacacttttacagatacattcaccgagaaactgtggccacttttttatccgggcatccgggccggcaggaagaacgcagccccacttaccatccgccctcctacagattgggagtag

SEQ ID NO: 138950 - DNA, 1557 bp, Artificial Sequence
  Description of Artificial Sequence: Synthetic coding sequence
atggccgaaacctcactgctggaggccggagccagcgcggcttcaaccgccgcggccctcgaaaacctccaggtggaagcaagctgttccgtatgtctcgagtacctcaaggagcccgtaatcatagaatgcggtcacaacttttgtaaagcttgtatcacacgctggtgggaggatttagaacgggactttccctgccctgtatgcaggaagacctctcgctaccggtcgctgcgaccgaatcgtcaactcggcagcatggtagaaatagcaaagcagctgcaggcggtcaagcgaaagattagagatgagtctttgtgccctcagcaccatgaagccctcagtctgttttgctatgaggatcaggaggcggtttgtttaatctgtgctattagtcacacccaccgagcccacaccgtggtccctctggacgacgcaactcaggaatacaaagagaagttgcaaaagtgtctggagcccttggaacagaaactgcaggagatcacacgatgcaaatcttcggaagaaaagaagcctggggagctgaaaagactcgtcgagagtaggcgacagcagatcttgagggagttcgaggagctgcaccggcgcctggatgaggaacaacaggtgttgctgagccgcctggaagaagaagaacaggacattctgcagagattgcgggagaacgctgcgcacctgggcgacaagagaagggacctcgctcatctggccgccgaagtcgaaggtaagtgtctccagtcaggttttgaaatgctgaaagacgttaagagcacactcgaaaaaaatataccccgcaagttcggtggaagtcttagcactatttgcccaagggatcataaagcgttgctgggattggtcaaagagattaaccgctgtgaaaaggtgaaaactatggaagtaacaagcgtaagcattgagcttgagaaaaatttctccaactttccccggcagtatttcgctctgaggaagatcctaaagcagttaatcgcagacgtgaccctcgatcctgaaacagctcacccaaacttagtactctcagaagatagaaagtccgtgaagtttgtggagaccaggctgagagacctccccgataccccccgcaggtttacattctacccatgcgtgcttgcaacagaagggttcacctcggggagacattactgggaggttgaagtgggagataagacccactgggctgtcggcgtttgcagggactcagtcagtcgaaaaggggagcttacaccactccctgagaccggatactggcgtgtaaggctgtggaacggcgataagtatgccgctaccaccacccccttcacccctctgcatattaaagttaaaccaaaacgggtcgggatttttttggactacgaagcggggacactgtccttttataatgtgacagatcgcagccatatttatacattcaccgacacctttacagagaaactttggccccttttctaccctggcatccgggccggacgaaagaacgctgcaccattaactatccgcccccctaccgattgggagtag

SEQ ID NO: 138951 - DNA, 1236 bp, Artificial Sequence
  Description of Artificial Sequence: Synthetic coding sequence
atggcggagacatctctgcttgaggcgggagcaagcgctgcctccaccgccgctgccctggaaaacttacaggttgaggcctcatgtagcgtctgtctggaatacctaaaagaaccggtgatcattgaatgtggccataacttttgcaaggcttgcatcactcggtggtgggaggacttggagagggactttccttgccccgtgtgtcgcaagacctccagataccggtcattgcgtcctaaccgacagctcggttccatggtggaaattgctaagcagctgcaggccgtgaagcgcaaaattagagacgaatccttgtgcccacaacatcacgaggccctttcactattctgctacgaagaccaggaagctgtttgcctgatttgcgcaatttctcacactcaccgtgcacataccgtggtaccacttgacgatgccactcaagaatacaaggagaagctgcagaaatgtctggaacctctggagcagaagttacaggaaattacccgttgcaagtccagcgaagaaaaaaaacccggagaactgaagcgactcgtggaaagccgccgccagcagattctccgcgagtttgaggagttgcaccgccggctggacgaagagcagcaggtgttgctgtctcgtctggaggaggaggagcaggacatcttgcagcggctccgcgaaaacgccgctcatctgggggataagagacgggacttagctcacctcgccgcagaggtcgagggcaagtgtctacagtccggctttgaaatgctgaagcccgtgctctctgcccgggaagagtgcgaaaaagtcaaaactatggaagtgaccagcgtctcaattgagctggagaagaatttttctaattttcctcggcagtactttgcactgagaaagatcttgaaacaactgattgcagacgttaccctggatcccgagacggctcatcccaacttagttctgagcgaggatcgaaaatcggtgaaattcgtggaaacccggttgcgagatctccctgacaccccaagacgatttaccttttatccgtgcgtgctggccacggagggtttcactagcggtcgtcattactgggaagtcgaggtgggagacaaaactcattgggctgttggggtgtgcagagattctgtcagtaggaagggaggatgcggctatggaatggggaccaacatgcagccccccccacatctgctgcctctgtgtacctccagatag

SEQ ID NO: 138952 - DNA, 1557 bp, Artificial Sequence
  Description of Artificial Sequence: Synthetic coding sequence
atggctgagacaagcctgttggaagccggcgccagcgccgcttccactgctgccgcactcgagaatttgcaggtggaagcttcctgctccgtgtgtttggaatacctgaaggagcctgtgattattgagtgtgggcataatttctgtaaggcttgcataactcgctggtgggaggacttggaaagggactttccatgtcctgtttgccgcaagacttctagatatagaagcctgagaccgaacagacaactcggctccatggtggaaatcgccaagcagctgcaagcagtgaaacgcaaaatcagggacgaatccctgtgtccccagcaccatgaagcgctgtccctcttctgctacgaggatcaggaagccgtctgtctgatatgtgcgataagccacacacatcgcgcacacacagttgttcccctggacgacgcgacccaggaatacaaagagaaactccagaagtgcctcgaacccctggagcagaagctccaagagatcactaggtgcaaaagcagcgaggaaaagaaacccggtgagttgaaaagacttgtagaatcgcgacgtcagcagattctccgcgaatttgaggagttacatcggaggctggatgaggagcagcaggtgctactctctcgactggaagaagaggaacaggacattttacagcggctccgggaaaatgcggcacacctaggggacaagcgccgtgacctcgcccacttggccgccgaggttgagggcaagtgtctgcagtccggctttgagatgctgaaaccagttctgtctgctcgggagaagaatatccctcgaaaatttgggggatcgctgagcacaatatgtcctagagatcacaaggctctcctgggccttgtaaaagaaatcaaccgatgtgagaaggtcaagacgatggaagtgacctcggtgagcatcgaactggaaaaaaacttctcaaattttccccggcagtatttcgccctcagaaagatcctgaaacaattgatcgcagatgttactttagaccctgaaacagcccaccccaacctggttctctccgaggataggaagtctgtgaagtttgtggagactcgactccgcgacttgcccgatacgccccggaggttcaccttctacccttgtgtccttgctacagagggcttcacctcaggccggcactattgggaggtcgaagttggagacaagacccactgggctgtgggtgtatgccgggactccgtgtctcggaaaggggagctgacacccctgccggagacaggatactggcgcgtaaggctgtggaacggcgataagtacgccgctaccactacgccttttactccactgcacattaaggtgaagccaaagcgggtgggtatctttcttgactatgaagcagggaccttatctttctataatgtgacagatcgatctcacatctatactttcaccgacaccttcacagaaaaattatggcccctgttttaccccgggattcgagcgggaaggaaaaatgccgctcccctgactattcgccctccaactgactgggagtag

SEQ ID NO: 138953 - DNA, 1236 bp, Artificial Sequence
  Description of Artificial Sequence: Synthetic coding sequence
atggccgagacaagtctgttggaagctggagcttctgctgctagcacagctgcagcgctagaaaatctgcaggtcgaagcctcttgctccgtctgcctggagtatctgaaggagcctgtcatcatcgagtgcggccacaacttctgtaaggcttgtatcacaaggtggtgggaggacctggaacgcgatttcccctgtcctgtatgtaggaaaacaagtcgatacagaagtcttcgcccaaataggcagctaggctccatggtggaaatcgcgaagcagctgcaggccgttaagagaaaaataagggacgagagcctgtgtccccagcaccacgaagccctaagtctgttctgctacgaagaccaagaggccgtgtgtttgatttgcgccatctcacatacccaccgagcacacacagttgttccactcgatgatgcaacacaggagtataaggagaaactacaaaagtgccttgaacctttggagcagaagttgcaggaaattactcgatgcaaatcttccgaagagaagaaacctggcgagctcaaacgattggttgagtcacgtagacagcaaattcttagggaattcgaggaactgcacaggagactggacgaggagcaacaggttctgctatctagattagaagaggaggagcaggatattctgcagaggctgcgagagaatgctgcccacttgggggacaagagacgcgatctggcgcacctcgcggccgaggtggaaggcaaatgcctccaaagcgggttcgaaatgttgaagcctgtgctctccgcaagagaggaatgtgagaaagtgaagactatggaggtaactagcgtctcgatcgaactcgagaagaatttttctaactttccccgccagtacttcgccctccgaaaaatcctgaagcaactgatagcagatgtcaccttagatccggagactgctcatccaaatctggtgttgtccgaagacagaaaatcagtgaaattcgtcgaaacgagactcagggatctgccagacacgccacggcgctttactttctacccgtgcgtgctggccacagaggggttcacctctgggcgccactactgggaggtcgaggtaggcgataagacccattgggctgtgggtgtttgccgagacagtgtgtcaaggaaaggtggatgcgggtatggcatgggaactaacatgcagcccccacctcatcttctgcctctctgcacttcgagatag

SEQ ID NO: 138954 - DNA, 1236 bp, Artificial Sequence
  Description of Artificial Sequence: Synthetic coding sequence
atggctgagacttccctgctggaagctggggcctccgcagcatccacagctgcagccctggagaatctccaggtggaagcatcgtgtagcgtctgtctcgagtatcttaaagagccggtcatcatagagtgtggacataacttttgcaaagcctgtattactcggtggtgggaggacctggagcgggactttccatgcccggtgtgtaggaagacaagtcgatacagaagtctgagaccaaaccgacagttaggcagcatggtggagattgctaagcagctccaggcagtaaaacgcaagattcgggacgagagcctgtgcccccaacaccacgaggcgttgtcacttttctgttatgaagaccaggaagccgtgtgcctgatctgtgccatcagtcacacacatagagcgcatacagttgtccccctcgacgatgccacccaggagtacaaggaaaaactgcagaaatgccttgagcctttggaacaaaagctacaagaaatcacccgttgtaaatcttccgaggaaaaaaaacccggcgagttgaaaaggctcgttgagagccggcgccaacagattctacgggagtttgaggagctgcacaggcgattggacgaggaacaacaggtgctgctgagtagactcgaggaggaagagcaggacatcttgcaaaggctacgcgagaacgccgcacatctgggggacaagcgtagagaccttgcccacttggccgcagaggtggagggaaaatgtctgcagagcggctttgagatgctcaagccagtgctgtcggccagggaggaatgtgagaaagttaaaactatggaggtgaccagcgtgagcatcgagttggaaaagaactttagtaattttcccagacagtatttcgccctgcgtaagatccttaagcagctgatcgccgacgtgacactcgacccggaaacggctcatcctaatctggttctgagcgaggataggaagagcgttaagtttgtggagacacggctgcgtgacttgcccgacaccccccgccgcttcactttctacccttgcgttctcgcaaccgaggggttcacctccggccgccactactgggaagtagaagtgggtgataaaactcactgggcagtcggcgtatgtagggattcagtctcccggaagggcgggtgcggatacggcatgggcaccaacatgcagcctcccccccatctgctacccctttgtacgtcgaggtag

SEQ ID NO: 138955 - DNA, 1557 bp, Artificial Sequence
  Description of Artificial Sequence: Synthetic coding sequence
atggctgaaaccagcttgttagaggccggggcttccgcagccagcactgccgctgctttggaaaatctgcaggtcgaggctagctgcagcgtctgcctggagtatctcaaagaaccggtgatcatcgagtgcggccacaacttttgtaaggcctgcattacccgctggtgggaagatctggagagagatttcccgtgccctgtctgccgaaaaacatccagataccggagcttgcggccaaatcgccagctgggttctatggttgaaatagccaagcagctgcaggccgttaagcggaaaatcagagatgagtcattgtgtccgcaacaccacgaagccttgtccctgttctgctacgaggatcaggaagcagtgtgcttaatctgcgctatttcgcatacgcacagagcccacaccgtcgtgccactggatgatgcgacccaggagtacaaggagaagctccagaagtgcctggagccactcgagcagaaactgcaggagataacaagatgtaagagcagtgaggaaaaaaaacctggtgagctgaagcggttagtggagagcaggcgtcagcaaatcctgagagagtttgaggagctgcatagacgcctagacgaggagcaacaggtgttactgagccggttagaggaggaagagcaggatattttgcagagactccgagaaaatgctgcacacctcggagacaaaagacgagatcttgcccatctggctgccgaagtagagggaaagtgcttgcaaagcggcttcgaaatgctgaaggatgttaaaagtacactggaaaagaatattccgcgcaaatttggcgggtccttatcaaccatctgtccaagggatcacaaggcactgttgggcctggtcaaggagatcaaccggtgcgaaaaagtgaaaaccatggaggtaacaagtgtgagtatcgaattagaaaaaaactttagcaactttccccgtcagtatttcgcgctcagaaaaatccttaagcagctgattgcagatgtgacactggaccccgaaaccgcacaccctaatctggtccttagtgaagatagaaaaagtgtgaaatttgtggagactcggctgcgtgacttaccggacaccccacgtcgcttcactttctatccttgtgttctcgcaacagaaggcttcacttctggtcggcattactgggaagttgaggtgggcgacaagacccattgggctgtgggtgtctgcagagactctgtgtccaggaaaggtgaactgactcctcttccagaaacaggctattggagagtgcgcttgtggaacggcgataaatacgctgccaccaccaccccctttacccccctgcatatcaaagtgaaaccgaagagagtggggatcttcctcgactacgaggccgggaccctgagcttttacaatgttaccgacagatcacacatttacacatttacggacacattcactgaaaagctctggccattgttctatccaggcattagagcgggcaggaagaacgccgctcctctcaccatccggccaccaactgattgggagtag

SEQ ID NO: 138956 - DNA, 1557 bp, Artificial Sequence
  Description of Artificial Sequence: Synthetic coding sequence
atggctgaaacgtccctcctcgaagctggagctagcgcagcatcaactgctgctgcattggaaaatctacaggttgaagctagctgctctgtgtgtctggaatatctgaaggagcctgtgatcattgagtgcggacacaacttctgtaaggcctgcattacacgctggtgggaggatttagaacgggactttccatgcccagtttgtcgaaagacttcacgctacaggtccctacggccaaaccggcagcttggttctatggttgaaatagcgaagcaactgcaggccgtaaagaggaaaattcgagatgaatcactgtgcccgcaacatcatgaggccctgtccttattttgctacgaagaccaggaggctgtttgtctcatctgtgcaatcagccacacccatagggcgcatacagtagtgccgcttgacgatgctacacaggagtacaaagagaagctgcaaaaatgcttggagcctcttgagcagaaactacaagaaatcaccagatgcaaaagttctgaagaaaaaaaaccgggggaactcaagaggctggtggagagcaggaggcagcagatccttcgggagtttgaggagcttcatcgaagactggatgaagaacagcaagtcttactgtctcgccttgaggaagaggagcaagacatactccagcggcttcgggaaaatgctgcccacctcggtgataagcgcagagacctggcccatctggcagccgaagtcgaaggcaagtgcctccagtctggtttcgagatgctgaaacccgttctctctgcccgggaaaaaaatatccctaggaagtttgggggttcactcagcacaatttgcccacgggatcacaaggccttgctggggttggtgaaggaaataaacagatgcgagaaagtgaagaccatggaggtcacttcagtctcaattgaactagaaaaaaacttctccaacttccctagacaatatttcgccctccgcaaaatcttgaagcagctaatcgcagatgtgactctcgatccagagactgctcaccctaatctcgttctgtctgaggacaggaaaagcgtaaagttcgtggagacacggcttcgcgacctccctgacacgcccaggcgttttacgttttatccttgcgtgctagcaacagaggggttcacctcggggaggcactattgggaagtcgaagtgggcgacaaaacccattgggcagtgggtgtgtgtcgggattctgtgtctcggaagggcgaattaacaccgctgcccgaaacggggtactggagagtcagactgtggaacggcgacaagtacgcagctactaccactcccttcacacctctccacattaaggtaaaacctaagagagtgggtatcttccttgactatgaagctgggacactgtctttctacaatgtgactgatcgaagtcacatctacacctttacggatactttcaccgaaaagttatggccattgttttatcccggcatccgcgccggacggaagaacgccgcccccctgaccattcggccacccacagactgggagtag

SEQ ID NO: 138957 - DNA, 1557 bp, Artificial Sequence
  Description of Artificial Sequence: Synthetic coding sequence
atggcagaaacctctctgctggaggccggtgccagtgccgctagtacagccgctgcactggagaacttgcaggtcgaggctagctgcagtgtgtgccttgagtatctgaaagagcctgtgataatcgaatgcggtcacaacttttgcaaagcctgcatcacgagatggtgggaggaccttgagagagatttcccctgtccagtgtgtaggaagacatcccgttatcgctcactgaggcctaatcgccaactgggctccatggtagagatcgccaagcaattacaggccgtgaagcgaaaaatccgagacgagtccttatgtccccagcaccacgaggctctttccctgttctgctatgaggatcaggaagccgtatgcctcatctgcgcaatctcacatacgcatagagcccacacagtggtacctctggacgatgccacccaggaatacaaggaaaaacttcaaaagtgcctcgagccccttgagcagaaactgcaggaaatcacccgttgcaagagttccgaggagaaaaagcccggagaactgaagaggctggttgagagccgtaggcagcagatcctccgcgagtttgaggagcttcaccgacgtcttgacgaggaacagcaagtcctcttaagccgcctcgaggaagaggaacaggacattcttcagcgcctcagggaaaatgccgcgcacctcggggataaacggcgggaccttgctcatctggccgctgaggtagaaggtaaatgcctccagagcggatttgagatgctgaagcccgttctgtctgccagggagaaaaacatccctcgcaagttcggaggctcactgtcgacaatctgccctagagaccacaaggccctcctgggccttgtgaaagaaattaacagatgcgagaaggttaaaaccatggaggtgacgtctgtgagcatagagctggaaaaaaatttcagcaacttcccccggcaatattttgccttgcgtaaaatcctgaaacaacttatcgcggatgttacactcgaccctgagaccgctcacccaaacttggttttgtccgaggacaggaaatccgttaaatttgttgagacacgtttgagggatctccctgatacgccgcgtcgctttaccttctacccctgcgttcttgcaactgagggcttcacatcggggagacattattgggaggtagaggtgggtgacaagactcactgggcagttggggtatgtcgggatagtgtgtctcgaaaaggcgaactgacccccttaccagagactgggtattggagagtaaggctgtggaatggcgacaagtacgccgcaacgacaaccccctttacacccctgcacatcaaagtgaagccaaaacgggtgggcatttttctcgactacgaggcaggtacactgagcttttacaatgttacggaccgctcacacatttatacctttactgacactttcactgaaaagttgtggccacttttctaccccggcattcgagctggtcggaagaacgcagcgccattgaccatccgaccacccaccgattgggagtag

SEQ ID NO: 138958 - DNA, 1557 bp, Artificial Sequence
  Description of Artificial Sequence: Synthetic coding sequence
atggccgaaacatccctgctggaagcaggcgcatcggctgcaagcacagctgccgctcttgagaacctccaggtcgaggcttcatgcagcgtctgcctggaatatctgaaggaaccagtgattattgagtgcggacacaacttttgtaaagcctgcataacgcgctggtgggaggatctggaaagagacttcccatgccccgtatgtaggaaaacgtctcgttatcggagcctaagacccaatcggcagttagggtctatggtcgaaatcgcaaagcaattgcaagcagtgaagcgaaagataagggacgagtccttatgtcctcagcatcacgaggctcttagcctcttttgttacgaggaccaggaggccgtgtgcctgatctgcgccatcagccacacccatcgagcccacactgtggtcccgctcgatgacgccacacaggaatataaagaaaagctccaaaagtgcctcgaacccctcgaacagaagctgcaggagataacacgctgtaaaagcagcgaagaaaaaaagcccggagaacttaagaggttggtcgagtccagacgccagcagatcctgagggagttcgaggaactacaccgccgcctggatgaggaacagcaggtgctcctctcccgacttgaggaggaagaacaagatatcctgcagcgtctccgcgagaatgccgcacacctcggcgacaagcgcagggatctggcacacttagccgcagaggtcgagggcaaatgtctgcagtctggttttgaaatgctgaaagatgtgaagtccaccttggaaaagaacattccccggaaatttggggggtcactctctacgatctgtcctagggaccacaaagctttgctggggctggtgaaggaaatcaataggtgtgagaaggtgaaaaccatggaggtcacctcagtctcgatagaactggaaaagaattttagtaattttcccagacagtactttgcattaaggaaaattctgaaacaactgattgccgatgtgactctcgatcctgaaacagcccaccccaacctggtgctgtccgaagacagaaaatccgtcaagttcgtcgagacacggctccgggacctccccgacacgccccggcggtttaccttttatccatgcgttctggcgaccgaaggcttcacaagtggccggcactactgggaagtcgaggtaggcgacaaaacccactgggctgtgggagtgtgcagggactctgtttcaagaaagggggagctgacccctctgcccgaaacagggtactggcgtgtgcgcctgtggaacggagacaaatacgccgctacaaccacaccattcacacctcttcatattaaggtgaaaccaaagagagtgggcatttttctggattacgaggccggtactttatccttttacaacgtcacagacaggagtcacatttatacttttaccgacaccttcaccgaaaagttgtggcccctcttctaccctggcatccgtgccggaagaaagaacgctgctccactcaccattcgccctcctaccgattgggagtag

SEQ ID NO: 138959 - DNA, 1557 bp, Artificial Sequence
  Description of Artificial Sequence: Synthetic coding sequence
atggccgaaacctctcttttggaagcaggagccagcgcagcttctactgctgccgccctggagaacttacaagtcgaggcctcctgctcggtctgcttggagtatctgaaggaacctgtgattatcgagtgcggccacaatttttgcaaggcatgcatcactagatggtgggaggacttggagagggactttccgtgtccagtttgtaggaagacatcgcgctatagatctttgcgccccaatcggcagctggggtccatggtcgaaatcgctaagcagttgcaggcggttaagcgcaaaatccgcgatgagagcctttgtccccaacatcacgaggccttgtccctgttttgttatgaggaccaggaggctgtgtgtctcatctgcgctatctctcacacccatcgcgcacacacagtggttccattggatgatgctacgcaagagtacaaggaaaagctgcagaagtgtctagagccgctggagcagaaactccaggagatcacccgttgcaagagctctgaggagaagaaacccggggaactgaagcgcctcgtggaaagccggagacagcagatactgagggagtttgaagagctacatcgtcggttagacgaggaacagcaggtgctgctgagtaggctggaggaggaggaacaagacattctgcaacgtctgagggaaaatgctgcacatctgggagacaagagaagggatctggcccatttggctgcggaagtggaaggcaagtgtctgcagagtggattcgaaatgctcaaacctgtgctctcggcaagggagaaaaatatccctcggaaattcggagggagcttgtctactatatgtcctcgagatcacaaagccctgctcgggcttgttaaggaaataaatcggtgtgaaaaggttaaaacaatggaagtgacatccgttagtatcgagctggaaaaaaacttctctaattttcctcgacaatatttcgccctgcggaagatacttaaacaactgatagcggatgtgaccctggatcctgagactgcacacccaaacctagtgctgtcagaggaccgcaaaagcgtgaaattcgtagagaccagactcagggacctgccagacacaccacggcggtttacattctacccctgcgtgctggccaccgaaggcttcacaagcggacggcactattgggaagtggaggtcggcgataagacccattgggcggtaggcgtgtgcagggatagtgtttcccggaagggggaactgaccccactcccggagaccggctactggcgggttcgtctttggaacggtgacaagtacgccgccacaacgaccccgtttaccccgctgcacatcaaagtaaaacctaagcgggtaggcattttcctggattacgaggcaggcacccttagtttctataatgtcacagacagaagccacatttatacatttacagatacctttaccgagaagctgtggccgctcttttacccaggtatccgggccggacgcaaaaacgctgcccccctgacgatccgcccccccactgattgggagtag

SEQ ID NO: 138960 - DNA, 1254 bp, Artificial Sequence
  Description of Artificial Sequence: Synthetic coding sequence
atggtggagatagccaaacagttacaggccgtgaaacgtaagatccgggacgaaagtctttgtccacaacaccacgaagcgctctcgctgttctgttacgaggaccaggaggctgtatgcctcatctgcgcgatttctcacacccatagggcccacactgttgtcccacttgatgatgcaacacaggagtataaagaaaagctccaaaagtgcctcgaacctctggagcaaaagttgcaggagatcacacggtgcaagagcagtgaagagaagaagccaggggagttgaagaggctcgttgaaagcagaagacagcagatactgagggaatttgaagaactgcaccgaaggctggacgaagaacagcaggtgctgttgagcaggctggaggaagaagagcaggacatcctgcagcggcttagggaaaacgcagcacacctaggcgataaacgaagggaccttgcgcatctcgcagccgaagttgaggggaaatgcctgcagagcggcttcgaaatgcttaaacccgttctgagtgctcgcgaagaatgtgaaaaagttaagacaatggaggtgacttcagtttcaatcgagcttgaaaaaaacttctccaacttccccaggcagtatttcgcactccgcaagattcttaaacagctgatcgctgatgtgacgctcgatcccgaaacagcccacccgaacctggtgctttcagaggacaggaaatcagtcaaattcgttgagacccggcttcgcgatttaccagatacaccccgcaggttcacattttacccctgcgtcctcgctacggagggattcacctcgggacgccactactgggaggtcgaagcggcccattgcgtgctggcacaagaccccgaaaaccaggctctcgcgcgcttctactgctatactgagagaaccatcgccaagcgtctcgtcctgaggagggacccatcggtgaagcggaccctttgcagaggatgctcatctctgttggttcctggcctcacttgtacacatcgccagcgacggtgcagaggccaaagatggactgtacagacctgtctcacgtgtcaaagatcgcagagatttctgaacgacccaggacacttgttgtggggtgacaggcctgaggcccagctcggttcacaagcagatagtaagcctttgcagcctttaccgaacacagcccatagcatcagcgatcgtttgccggaagaaaagatgcagacacaaggcagttcaaatcagtag

SEQ ID NO: 138961 - DNA, 1254 bp, Artificial Sequence
  Description of Artificial Sequence: Synthetic coding sequence
atggttgagattgccaagcagttgcaggccgtgaagcgaaaaatccgcgacgaaagtctctgcccccagcatcatgaagcccttagcctgttctgttatgaagaccaggaggcagtgtgtctcatttgcgccatcagccatacacaccgcgctcatacagtggtgcccctggatgacgctacgcaggaatacaaggagaaactgcagaagtgcttggagcctctggagcagaaactgcaggagatcacccggtgcaagtcgagtgaagagaagaagcccggggaacttaagcggctagtggagagtcgcagacagcaaattcttagggagttcgaggagctacaccggaggcttgacgaggagcagcaggtgctgctgtcgcggttggaggaggaggagcaagacattctgcagagactgcgtgagaacgccgcacatcttggtgacaagcgacgggatctagcacatctggccgctgaagtagaggggaaatgtctgcaatccggctttgagatgctcaagcccgtgctgtcagcccgcgaagagtgtgagaaggtgaaaacaatggaggtgacttccgtgagtatcgagctcgaaaagaatttcagtaactttccacgacagtatttcgcactgaggaaaatcctgaaacaactgattgccgacgtgactctcgacccagagacagcccacccaaatctggtactgagcgaagatcggaaatctgttaagtttgttgaaaccaggttacgggacctgccagacacaccgaggaggtttacattctacccatgcgtgctagcaaccgaaggctttaccagtggacgacattactgggaagtcgaagcggctcattgtgtgctggcccaggaccctgaaaatcaggctctcgcgcgcttctactgctatactgagaggaccattgccaaaagattagtccttcgacgagacccctcagttaagagaactctatgtcgtgggtgcagctcgcttcttgtacccgggctcacatgcactcatcgacagcgccgctgcagaggtcaaaggtggactgtgcagacatgcctgacgtgccagaggtcccagaggttccttaatgatccgggccacttactctggggcgataggcccgaagcacagctaggatcacaggccgatagcaaacccctacaacccctgccaaacaccgcacactctatctctgaccgcctgccagaggagaaaatgcagacacagggctccagtaaccagtag

SEQ ID NO: 138962 - DNA, 1236 bp, Artificial Sequence
  Description of Artificial Sequence: Synthetic coding sequence
atggcagagacatccctgctggaagccggcgcaagcgccgcatctaccgctgctgccttggagaatctgcaggttgaggcttcctgtagcgtgtgtctggagtatcttaaggagcctgtgattatcgagtgtggccataatttctgtaaggcctgtataacccggtggtgggaggacctagagagagatttcccatgtcccgtgtgcagaaaaacatctcgatacagatccctaaggccaaatagacaattgggtagtatggtggagattgcaaagcaactgcaagccgtcaaaagaaagatcagggatgagtcactgtgccctcaacatcacgaggcactctccctgttttgctacgaggaccaggaagccgtgtgtttgatttgcgccatttcccatactcaccgagcccacactgtagtgcctctggacgatgcgactcaagagtacaaagaaaagcttcagaaatgcctcgagcctctcgagcagaagctacaggaaatcacaagatgtaagagctctgaggaaaaaaagccaggcgagcttaagcgactggtagagtctcgcagacagcagatactgagggagttcgaggagctccaccgcaggctcgacgaggagcaacaggtgctgttgtcacggctggaagaagaagagcaggatatcctgcagcggcttagggagaacgcagcccatctcggggacaagaggcgggaccttgcgcacctggccgccgaagtcgaaggtaagtgcctgcagagcggtttcgagatgctgaaaccagtgttaagcgcgcgcgaggaatgcgaaaaagttaagaccatggaggttacatcagtcagcattgaacttgaaaaaaacttctccaatttcccacgccagtatttcgcactccggaagatccttaaacagcttatcgctgacgtgaccctggacccagagaccgcacatccaaatctggtgcttagcgaagacaggaagagcgtcaagtttgtggaaacacgtctacgggatttgccggacactccacggcggttcaccttctatccctgtgtgctggcgaccgaggggttcacgtctggccggcactactgggaagttgaagtgggggataaaactcactgggccgtaggcgtgtgtcgcgattcagtgtctagaaagggcggatgcggatatggtatgggcacaaacatgcagccacctccacatttactgcctctttgtacctcaagatag

SEQ ID NO: 138963 - DNA, 1254 bp, Artificial Sequence
  Description of Artificial Sequence: Synthetic coding sequence
atggttgaaatcgcaaagcaactgcaggctgtgaagaggaagatccgtgatgagtcgctgtgcccgcagcatcatgaggctctttcactgttttgctatgaggaccaggaggctgtgtgcctgatttgtgctatctcacatacccatagagctcacacggttgttcccctggacgacgctacccaggagtataaggaaaagctccagaagtgtctcgagcccctggaacagaaactgcaggagatcacacggtgcaagtcctctgaggagaagaagccaggcgaattgaaacgcctggtggaatcccgacggcaacagatcctgagggagttcgaggagctccatcgcaggctggacgaagaacaacaagtgctcctgtctaggctcgaagaggaggagcaggacatcctgcaacgattacgcgaaaatgccgcacatctgggtgacaaacggcgggacctggcgcatctggcagctgaggtggagggcaaatgcctgcagagcggattcgagatgctaaagcctgtgctgtcagctagagaggagtgcgaaaaggtgaaaaccatggaagtgacctcagtgtctattgaactcgagaagaatttctcaaattttccccgccagtattttgccctccgaaagatcttgaaacagcttatcgctgatgtgaccctggaccccgagaccgctcaccccaatctggttctctcggaggacaggaaatctgttaaatttgtagaaaccaggttacgggacctaccagacaccccacggcggtttacgttttacccatgtgtgctggccactgaaggatttacttccggtcgccattactgggaagtcgaggccgcgcattgcgtactggcccaggatcccgagaatcaggcgctcgctaggttttattgttataccgagaggactatcgccaagcgcttggtgctgagaagggatccaagtgtgaagagaactctgtgcaggggctgcagttccctgttagtgcccggtctgacctgcacacatcgccaacgtcggtgtcggggacagcggtggacagtgcaaacctgcttaacgtgccaaagaagccaacgattcttaaacgacccagggcatctgctctggggtgatcgccctgaggcccaattaggtagccaggccgacagtaaacccctgcagcctctgcccaacacagcccactccatctctgaccgattaccagaggagaagatgcagacacagggtagttctaaccagtag

SEQ ID NO: 138964 - DNA, 1557 bp, Artificial Sequence
  Description of Artificial Sequence: Synthetic coding sequence
atggctgagacatcccttttggaggctggtgcctccgccgcttcaactgccgctgcattagaaaacctccaggtcgaggcaagctgtagcgtctgtttagaatacttaaaagagccagtaatcatcgagtgtggccataacttctgtaaggcttgcatcacccgatggtgggaagatcttgagcgcgatttcccctgtccagtctgtcgaaagactagtcgctatagatccctgcgacccaaccggcagttgggctccatggtagagatcgctaaacaactccaggcagttaagagaaagatcagggatgagagtctatgtccccagcaccatgaagcactatcattgttctgctacgaagatcaggaagccgtttgtctgatatgcgcgatttcgcatacacacagggcccataccgtggtccccctcgatgacgctacccaggagtataaagaaaaattgcagaaatgccttgagccactcgagcagaaattgcaggaaatcacccgctgcaagtcatctgaagagaagaagcccggagaactgaaaaggctcgtggaaagtcgccgtcagcagattctgagagagtttgaggagctgcaccgcaggctggatgaggagcagcaagtgctactcagcaggctagaagaagaagagcaggacattctccagagactgagggaaaacgccgcacatctcggagacaagaggcgtgatctagcacacctcgcagcagaggtggaaggaaagtgtctgcagtcagggtttgaaatgctaaaacccgtgttaagtgcccgcgagaagaacatcccaaggaaattcggtggctcgctgtccacgatttgccctcgggatcacaaagcgctcctgggtctggtcaaagagattaaccggtgcgagaaagtgaagacgatggaagttaccagcgtttctatcgagcttgaaaagaacttttccaattttccacgtcagtacttcgctcttaggaaaatcttgaagcagcttatcgccgacgtcactctggatccagaaacagctcatcccaacctcgttctgtcagaagataggaagagtgtgaagtttgtagaaacacgcttacgggatctccccgatacgccgcggaggtttaccttttacccttgcgtgctggctaccgagggcttcacctcagggagacattactgggaggtcgaagttggtgacaagactcactgggccgtgggggtgtgccgggacagtgtaagccgaaagggagagctgacgcccctgccagagaccgggtattggcgggtgaggctgtggaatggcgataaatatgccgccacaactacaccgttcactcccctgcacattaaagtgaagcctaagagagtcggaatcttcctggattacgaggcgggtaccctgtccttctataacgtgaccgacaggagtcacatctacacttttactgacacatttactgagaaactatggcccctgttctatccaggaatcagagccggaagaaagaacgcagccccactgactatacgacctccgactgattgggaatag

SEQ ID NO: 138965 - DNA, 1254 bp, Artificial Sequence
  Description of Artificial Sequence: Synthetic coding sequence
atggtcgaaatagctaaacagctgcaagccgtcaagagaaaaatccgagatgaatctctgtgcccccagcaccacgaggccctgagtctgttttgctacgaagaccaagaggcagtgtgtcttatttgcgccataagtcacacacaccgtgctcacaccgtggtgcccttagatgatgccactcaagagtacaaagaaaaattgcaaaaatgcctggaacctctcgaacagaaactgcaggagatcactagatgtaaaagcagtgaagagaaaaagccaggagagttgaaacgcctggttgaaagccggaggcagcagatcctgcgcgaatttgaggagctgcataggcgcttggacgaagagcagcaggtgttactgtctcgcctcgaagaggaagagcaggacatattgcagagactgcgagagaatgcagcccacttaggagataagagaagagacctcgcccacctcgccgctgaggtagaaggaaaatgcctccagtccggctttgaaatgttgaaacctgtgctttcagcccgcgaggagtgcgagaaagtgaagactatggaggttacgtccgtgtctatagagctggagaagaacttttccaactttcccaggcagtattttgccttacggaaaattctcaagcagctgattgccgatgtgacgttggatcccgaaacagcacaccctaacttggtgctgtccgaagatagaaagagtgtcaaattcgtcgaaacacgactgcgtgatctaccagatacgccacgcagattcaccttttacccatgcgtgctggccacagaggggtttacaagtggtaggcattactgggaggtcgaggcggcacactgcgttttggcacaggatcccgaaaaccaggcactggctcgcttttactgctataccgagcgaaccatcgcaaagcgcctggtgctacgcagggatccttcagttaagcgcaccctgtgccggggttgctcatcccttttggtgccagggttgacatgcactcagcgccagcggcgctgtcggggccagcgttggacagtgcaaacttgcttaacctgtcagcggagtcagcggtttttgaacgaccccgggcacctgctgtggggtgatcggccagaggctcaactggggagtcaggccgacagcaaaccgctgcagcctctgcccaatactgctcatagtatcagcgacaggctgcccgaggagaagatgcagaccaagggctctagcaaccaatag

SEQ ID NO: 138966 - DNA, 1236 bp, Artificial Sequence
  Description of Artificial Sequence: Synthetic coding sequence
atggccgaaactagtctgctggaagctggcgcttccgctgcgtctaccgccgctgcccttgagaacctacaggtggaggccagctgtagtgtttgtttagagtacctgaaggagccagtcataatcgagtgcggacacaacttttgtaaagcgtgtataactagatggtgggaggacctggagcgggactttccttgtccagtctgccgaaagacctcgcggtaccggagtttaagaccaaacagacagctcggcagtatggtggagattgccaaacagctacaggcagtcaagagaaaaatcagggacgagagcctgtgtcctcagcatcacgaggctctaagcttgttctgctacgaggatcaggaggccgtgtgcctcatttgtgcaattagccacacccatcgagcacataccgtagtgcctttagacgatgcgacacaggagtataaggagaaactacagaagtgtctcgagcctctggagcaaaagctccaggagattactagatgtaaaagctcagaagaaaaaaaaccaggcgagcttaaaaggctggttgagtcaagacgccaacagattctgcgggagtttgaggagctccataggaggttggacgaagagcagcaggtgctcctcagccgcctcgaggaagaagaacaggacattcttcagcgcctgcgcgagaacgctgctcatcttggagacaagcgtcgcgacctggcgcacctggctgcagaagtcgaggggaagtgtttacaatccggcttcgagatgttaaagcctgtcctgtccgcacgtgaagaatgcgagaaggtgaagacaatggaagtgacgtccgtctctatagagctggaaaaaaactttagtaacttccctcgccagtactttgctctgcgaaaaatcctcaagcagctgatcgcagacgttacactcgatcccgagacagcccatccaaacctcgtgctctctgaggatagaaaatccgttaagtttgtggagacacgcctgagggacctgcctgacacaccgaggcgctttactttctatccttgtgtgctggccaccgaaggcttcacatccggccgtcactattgggaagtcgaagtcggcgataaaacacattgggccgtgggcgtgtgtcgagactcagtctcacgaaagggggggtgtggttacggaatgggtaccaatatgcagccacccccccacctgctcccactgtgcacaagccggtag

SEQ ID NO: 138967 - DNA, 1254 bp, Artificial Sequence
  Description of Artificial Sequence: Synthetic coding sequence
atggtcgaaatcgcaaagcaactgcaagccgtcaagcgcaagatccgcgatgagtcgttgtgtcctcagcatcacgaagctctgagtcttttttgttacgaggaccaggaagctgtgtgccttatatgcgctatatcccatacccatcgggcacacaccgtggtgcctctggatgatgcaacccaggagtataaagagaaattgcagaaatgtctggaaccgctcgagcagaagctgcaggaaatcacccgctgtaagtcatctgaggagaaaaagcctggagagctgaaaagactggtggaatctaggcgccagcaaatattgcgggaatttgaggaactgcatcgcaggctggatgaggaacagcaagttctgttgagtagactggaagaggaagagcaagatattttgcagaggctgagggagaacgccgctcacctgggggataaaagaagagacctagcgcatttggcagctgaagtggaaggtaagtgccttcaatccggttttgagatgctgaaacccgtccttagcgcaagggaggagtgtgagaaggtaaaaaccatggaagtgacatctgtgtccattgagcttgagaagaatttctcaaatttcccgcgccagtatttcgccctgcggaaaattctcaagcagctgatcgccgacgtgacactcgatcccgagactgcacatccgaacttagtgcttagcgaggaccgtaaaagtgtgaagtttgttgaaacccggctgagggatttgccagacacaccccggagattcaccttttacccttgcgttcttgcaacagaggggttcacatcaggccgtcattattgggaggtggaagccgcacattgtgtgctggctcaggatcctgaaaaccaagcgttggctaggttctattgttatacagagcggactatcgccaaaagactggttctcagaagagaccctagcgtaaagcggaccctctgtcggggatgctccagcttactggtccctggtttaacgtgtacccagcgacaaagaaggtgtcggggtcagagatggaccgtccagacgtgccttacttgccaacgctcccagagatttcttaatgatccaggacaccttctgtggggagatagacctgaagcacagctcggctctcaggccgatagtaagccactacagcccctcccaaatacagcgcacagtataagtgacaggttgccggaagaaaaaatgcagactcaggggtcatctaatcagtag

SEQ ID NO: 138968 - DNA, 1557 bp, Artificial Sequence
  Description of Artificial Sequence: Synthetic coding sequence
atggccgaaacctcgctcttggaagcaggagcaagcgcagccagcactgcggccgcactcgagaatctgcaggtggaggcttcctgcagcgtgtgtctagaatatttgaaagaacctgttatcatcgaatgtggacacaacttctgcaaagcctgcatcacacgctggtgggaggacttagagcgggactttccttgcccggtctgccgcaaaactagccggtacaggtctttacgccctaataggcagctgggttcaatggtggaaatagccaaacagcttcaggctgttaagcggaaaattcgcgatgagagcttatgtccacaacatcacgaggctttatctttgttttgttatgaggatcaggaagctgtttgcctcatctgcgcaatctcacacactcaccgggcccacaccgttgtgccgctcgacgacgcgactcaagagtataaggaaaaactgcagaaatgtcttgagcccctggaacaaaaacttcaggaaatcacacgctgcaagtcctctgaagagaagaaacccggcgagctgaagagactcgtcgagtcacgacgccagcagatattgagagagttcgaggagctgcatcgccgtctggatgaagaacagcaggtattactctctaggctggaggaggaggaacaggacattctccagcgcttgagagagaatgcagcacacctgggtgacaagagaagagatctggcacatctggcggctgaggttgagggcaagtgtttacagagtgggttcgagatgctaaaggacgttaaatccacactggaaaaaaacatccctcggaagtttggagggtccctgtcaactatctgtcccagggatcacaaggccctgctgggtttggtgaaagaaataaataggtgcgagaaagtcaaaacaatggaagtgacttcggtatcaatcgaactggagaaaaacttctccaactttccacgacagtacttcgctctcaggaaaatactcaagcaactgatagccgatgtgaccttggaccctgagacagcccatccaaacctcgttctgagcgaagataggaaatcggtgaaatttgttgagacaagactcagagacctacctgatacacccagaagatttacattttacccttgcgtactagctaccgaagggttcaccagcgggcggcactactgggaggtcgaagttggagacaagacccattgggcagtcggggtgtgtcgagattctgtatcccggaagggtgagttaacccctctgccagagacaggctattggcgcgtcagactgtggaatggtgataaatatgcagcaacaaccacaccattcacaccattacatatcaaggtgaaaccgaagagggtgggtatcttcctggattacgaggccgggaccctttctttctataacgtgaccgaccggtcccacatatacacgtttaccgacacctttactgagaagctttggcctctattttatcccggaattagagcagggagaaagaatgcagctcctctgaccatccgtccccctacagactgggagtag

SEQ ID NO: 138969 - DNA, 1557 bp, Artificial Sequence
  Description of Artificial Sequence: Synthetic coding sequence
atggctgagacgtcactcttggaggccggggctagcgcggcttctaccgccgcggctctggaaaacctgcaagtggaggcgtcatgttcagtctgcctcgaatatctcaaggagccagttatcattgagtgcggacataacttttgtaaggcttgcatcacccggtggtgggaggatctggaaagggacttcccctgtcccgtttgcagaaagaccagtagatataggtcactgagacccaatcggcaactgggcagcatggtcgaaatcgctaaacagttacaggccgtcaaaaggaaaataagggatgagtctctatgtcctcagcaccacgaggccctcagtctgttctgttatgaggatcaggaggccgtgtgtctgatttgtgcgatctcccacacccacagggcccataccgttgttccgctggacgatgccacgcaagaatacaaagagaagctgcagaaatgtctagagcctctagagcagaagttgcaggagatcacgcggtgcaagtcttccgaagagaagaagcccggggagttaaagcgcctcgtagagagcagacgacagcagattttgcgggaattcgaggagctgcatcggaggctcgatgaggaacagcaggtgcttctcagccgtttggaagaggaagagcaggacatcctgcaaagactcagggagaatgcggcccacctgggggacaaacgtcgggatctggcacatcttgctgcagaagttgagggcaaatgcctgcaatccggcttcgagatgctgaaggacgttaaaagtaccctggagaagaacatcccaaggaagtttgggggtagcttatcaaccatctgcccaagggaccataaggctttactcggacttgtgaaggagataaatcgctgcgagaaggtcaagactatggaggtgacttccgtttccatcgagctcgaaaaaaacttctcgaacttcccgaggcaatattttgccctgcgcaagatattgaaacaactgattgcagatgtgactctggacccagagacagcccaccccaacctggtgctctcagaagatcgcaaaagtgtcaagtttgtggaaacccgtctaagagacctgccggataccccacggcggtttaccttttacccctgcgtccttgcaactgagggtttcaccagtggccgccattattgggaggtggaggtcggcgacaaaacccactgggccgtaggcgtctgtcgagattctgtgtctagaaagggtgagctgacccctctaccagaaactgggtattggagggtgcgactgtggaacggagataagtacgccgctacaacaactcctttcactcctctccacattaaagtgaagcctaaaagggtgggaattttcctggactatgaagcgggcactttatctttctataacgttacggatcgatcccatatctacactttcaccgatactttcacagaaaaattgtggccgctgttttatcctggcatcagagccggccgtaagaatgcagctccgctgacaatccggccaccaaccgattgggaatag

SEQ ID NO: 138970 - DNA, 1467 bp, Artificial Sequence
  Description of Artificial Sequence: Synthetic coding sequence
atggccgaaacaagtctgttggaggccggcgcctctgcagcctccactgccgctgcccttgagaatctccaggtggaagcctcctgcagcgtatgcctggaatacttgaaagagcctgtcatcattgagtgtggccataatttctgcaaagcttgcattactaggtggtgggaagatctggaacgggatttcccatgccctgtctgtcgcaagactagcagatacagatccctgagacctaatcgtcaactggggagcatggtggagattgctaaacagttacaagccgtgaagcgcaaaatcagagatgagagtctctgtcctcagcatcatgaagcactgagcttgttttgctatgaggatcaggaggccgtctgcctcatttgtgccatttctcacacacatcgtgcacataccgtcgtgcctctggacgacgcgacccaggagtacaaagaaaagctccaaaagtgcttggagcccctcgagcagaaactgcaggaaattactaggtgcaagtcttctgaggagaagaagccaggtgagctgaagagacttgtggaatctcgaaggcagcagatcctccgggagtttgaggagctccatcggagactggatgaggagcagcaggtgctcttgtctcgcctggaggaggaggaacaggatatcttacagcgcctgcgcgaaaatgccgctcaccttggagataagcgcagagacctggcccatctggcagccgaagttgaggggaaatgccttcagtccggcttcgagatgctcaaaccggtgctgagcgcgagggaggagtgtgagaaggtcaagactatggaggtgactagtgtgtctattgagcttgaaaaaaattttagcaattttccacgccagtacttcgcccttcgtaagatactgaaacagctgatcgccgacgtaaccttagatccagagacggcccatcctaatttggtactctcagaagaccggaagtccgttaaatttgtagagacaagactacgcgatctgcctgatactcctagacggttcactttctatccttgcgtgttagcaacagagggtttcacctccggtagacactattgggaagtcgaagtgggagacaagactcactgggccgtgggcgtgtgcagggatagcgtgtctagaaaaggcgaattaactcccctaccagagaccggctactggcgggtacgtttatggaatggcgataagtacgcggctaccactacaccatttacccctctgcacatcaaggttaaacctaagcgtgttggaatcttcttggactacgaggccggaaccttgtccttctataatgtcaccgatcggtctcacatttacacttttacagacacgttcactgagaaactgtggcccctattttaccctggtatccgcgcgggtcggaagaatgcagcccccctgacaatccggcctcctaccgattgggaatag

SEQ ID NO: 138971 - DNA, 1467 bp, Artificial Sequence
  Description of Artificial Sequence: Synthetic coding sequence
atggccgagactagcctacttgaagcgggcgcatccgcagcgtcaactgccgctgccctcgaaaacctccaggtggaagcttcctgcagcgtttgcctagaatatcttaaggagccagtcatcattgagtgcgggcacaatttttgcaaggcttgcattacccgttggtgggaagatctggaacgagacttcccttgtcctgtgtgtcggaaaacttccagataccgctctcttcggcccaaccgccagttgggctctatggtagaaattgccaagcagcttcaggctgtgaagagaaagattagggatgaatcactgtgtccccagcatcacgaggcgctaagtttgttttgttatgaagaccaggaggccgtatgcctgatctgtgctatctctcatactcacagagcccacactgtcgtgcctctggacgacgctactcaggagtataaagagaagctgcagaagtgcctcgaacccctggaacagaagttgcaagagattacccggtgcaaatcctcagaagagaagaagccgggcgagctcaagcgactggtagaaagcaggcggcaacaaatacttcgggagttcgaggagctgcatcggcgactggacgaggagcagcaagtgttgctaagtagactggaagaggaagagcaagatatcttgcagcggctgcgtgagaatgcagcccatttgggggacaaaaggcgcgatcttgctcacttagcagccgaggtggaggggaagtgcctacaatcaggctttgaaatgctgaagccagtgctgtccgcaagggaagagtgcgagaaggtgaagacaatggaggttacatccgtaagtatcgaattggaaaagaatttttctaattttccccgccagtactttgcattgcgtaaaatactcaaacagttgatcgccgatgtgactctggacccggagacggcccatcccaacctggtcctgagcgaggaccgaaaatccgtaaaattcgtggagacccggctgcgcgacctgcctgacacaccaaggcgctttactttctatccttgcgttttggctacagaaggatttacctctgggaggcactactgggaggtagaagtgggtgacaagacacactgggccgtcggagtttgccgagactcagtaagcagaaagggagagttgactcccctgccagagactgggtactggagggtgagactttggaacggggacaagtatgccgcgacaactacaccttttacacctctgcacattaaagtgaagcccaaaagagtcggaatctttctagattacgaggccggtaccctgagcttctataacgtcactgacagatcacatatctacactttcacggacacattcacggagaagctgtggcctctgttctacccgggcattagggctggcaggaaaaacgccgctcctttgactataagacctccgacagattgggaatag

SEQ ID NO: 138972 - DNA, 1254 bp, Artificial Sequence
  Description of Artificial Sequence: Synthetic coding sequence
atggtggagatcgccaaacagctccaagccgtcaaaaggaaaatcagagatgaatccctgtgcccacaacaccacgaagcgttgtccctgttttgctacgaggatcaggaggccgtgtgtttgatatgtgcaatttcccatacccatcgcgcccacaccgttgtgcccctcgatgacgccactcaggaatacaaggaaaagctccaaaaatgtctcgagccactagagcaaaaactgcaagaaatcacacggtgcaaaagctctgaagaaaagaagccaggcgagcttaagcggctagtggagtccaggagacagcagatcttacgcgaattcgaggagctgcatcggagactcgatgaggaacagcaagtcctgctctccagattagaggaggaggagcaggacattctgcagcgacttcgcgaaaacgctgcacacctcggggataagcggcgggacttggcgcatcttgctgccgaagtcgagggcaagtgtttgcagtcaggcttcgaaatgcttaagcctgtcctttctgccagagaagagtgcgagaaggtgaagactatggaagtgactagcgtgtcaatagaacttgagaagaacttttccaactttccacggcagtacttcgctttacggaagatcttaaaacagttaatcgctgacgtgactctggaccctgaaactgcacatccaaacctcgtgctgtccgaagatagaaaatcagtgaagtttgtggagacgaggctgagagacctcccagacacccccagacgatttacattctatccctgcgttctggcaaccgagggatttacatctggacggcactactgggaagtcgaggctgcccactgtgtcctggctcaggatccagagaaccaagccttggcccgcttttactgctatacagagaggacaatcgccaagcggctcgttctgaggcgcgacccctccgtgaaaaggacactgtgtcgagggtgctcctctttactggtgccaggactaacctgcacgcagcgtcagagaaggtgtcggggccagcgctggacagtgcagacctgtttgacgtgtcaacgatctcagcgctttctgaatgaccccggtcatctgctgtggggagatcgaccggaagctcaactggggtcacaggcggacagcaagcccctccagcctctcccaaatacggcgcattccataagcgacaggcttccagaagaaaagatgcagacacaggggtcgtccaaccagtag

SEQ ID NO: 138973 - DNA, 1893 bp, Artificial Sequence
  Description of Artificial Sequence: Synthetic coding sequence
atggcagctgtcgctatgaccccgaacccagtgcagaccctccaggaggaagctgtatgcgctatttgcctggattattttaccgatccagtatctatcggatgtggtcacaacttttgcagagtttgcgtcactcagctttggggtggtgaagacgaggaagatcgcgacgaactggatcgtgaagaggaggaggaggacggggaagaggaagaggttgaggcagtcggagccggcgcggggtgggacacacccatgagggatgaggattatgagggcgatatggaagaagaggtggaggaagaggaggagggagtattctggacatcaggcatgtcacgcagtagctgggataacatggactacgtctgggaggaagaagacgaggaggaggatctcgattactacttgggcgacatggaggaggaggacctgcggggagaggatgaggaggatgaagaggaggtgcttgaagaagtggaggaggaagacctggacccagtcacacctctccctcctcccccagctccccgtcggtgtttcacatgtcctcagtgtaggaagtctttccctcggcgctcatttaggcccaatctacagctagcaaacatggttcaggtcatcaggcaaatgcatcccacccctggccgcggctctagggtcacagaccagggcatatgtccgaagcaccaggaggctctcaagttgttctgcgaagtggacgaagaagcaatttgtgtcgtctgtcgggaaagcaggtcacacaaacaacatagcgtggtgcccctagaggaggtggtgcaggagtacaaggctaagttgcagggtcacgttgaacctttacgcaagcaccttgaagcagtgcagaagatgaaagccaaagaagagagacgagttactgagctgaagtctcagatgaaatccgaactggctgccgttgcctctgagttcggtagactgacacgtttcctggccgaggaacaggctggactagagagacggttaagggagatgcatgaggcacagctggggcgggccggtgctgcagcatctaggctggctgaacaggccgcacagctgtcaaggttgctggctgaggcacaagaaaggagccagcagggagggctgcggctccttcaggatataaaggagaccttcaaccgatgcgaagaggtacagttgcagccccctgaggtttggtcaccagatccatgtcagcctcacagtcacgactttctgacagacgcaatagtgagaaagatgtcaaggatgttctgccaagccgcccgggtcgatctgacactagaccccgatacggcacaccctgccctgatgttgagcccagataggagaggcgtcaggctcgcggaaagacgccaagaggtcgcagaccaccctaagcgtttctccgctgactgttgcgttcttggcgcccagggctttagaagcggacgccattactgggaagtggaagtcggggggcgtaggggatgggctgtcggcgctgctcgggaatcaacccatcacaaggagaaggtgggtccaggaggaagtagcgtcggctccggcgatgcttcttccagccgccaccaccaccggagacggagactacatttaccgcagcagcctttgctgcaaagggaagtctggtgtgtgggaacgaacgggaaacgctatcaggctcagagctctaccgagcagaccctcctgtcccccagtgaaaaaccaagaagattcggagtctacctggactatgaggcaggtaggctgggcttctacaatgcagaaacgctcgcccatgtacataccttctccgcggcatttctgggtgaacgggtgtttcccttcttccgcgttctttccaaggggactagaatcaagctctgtccatag

SEQ ID NO: 138974 - DNA, 1557 bp, Artificial Sequence
  Description of Artificial Sequence: Synthetic coding sequence
atggccgctgtcgcaatgacaccaaacccggttcagaccttgcaggaagaagcggtctgcgccatctgcctggactatttcactgaccctgtaagtattggctgcgggcacaacttttgtcgtgtttgcgttacacagctttggggcggagaagacgaagaggacagggacgagctggaccgggaagaggaggaggaggacggggaggaagaggaagttgaggcggttggcgccggggccggttgggacacgcccatgagggatgaggactatgagggggacatggaagaagaagtggaagaggaagaagagggcgttttttggactagcggcatgtctcggtcatcttgggacaacatggactacgtctgggaggaagaggacgaagaggaggacctcgactattatctaggggacatggaagaggaagacttaagaggggaggatgaagaggacgaagaagaggtgttggaagaggtggaggaggaggatcttgatccagttaccccactgcctccgccgcctgcgcctaggcggtgtttcacatgtccccagtgcaggaagtctttcccccggcggagctttcggcccaatttgcagctggccaatatggtgcaagtcatccggcaaatgcatcctactccgggacggggctcgagggtgaccgatcagggaatctgcccaaagcatcaggaggctttaaagctattctgcgaagttgacgaggaagccatttgcgttgtatgtcgggagtcacgaagtcataaacaacattccgtcgtgccgctggaagaggttgtgcaggaatacaaagccaaactccagggccatgtagagcctctgaggaagcacttagaagctgtccagaaaatgaaagctaaggaggaaaggcgagtcaccgaactgaagagccaaatgaagagcgagctcgctgccgtggctagtgagtttggcagactcacacgatttcttgcagaggagcaggccggtctggagcggagactccgggagatgcacgaagcccagctcgggagagctggagcagcggcctccagactagccgaacaagcagcccagctgagccgacttctcgctgaagcccaggaacggagtcagcaggggggacttcgactcctgcaggatataaaagagacatttaatagatgtgaagaagtgcagcttcagccaccagaggtatggagccctgatccctgtcagccccactcacacgattttctgacagatgccatcgtgcgcaagatgtcacgaatgttctgccaggccgccagggtggacctgactttggatcctgacaccgcacacccagctttgatgctatcccctgaccgcaggggtgtgaggttagccgagcggaggcaggaggtggccgatcatccgaagcgcttcagcgccgattgttgtgttctgggagcccaaggctttcggagcggacgccactattgggaagagccgaaggagcctagctggcctccggctcagcccagcctcacatattatgtgtgtccgactgaccgtcctgagttttcttttacctag

SEQ ID NO: 138975 - DNA, 453 bp, Artificial Sequence
  Description of Artificial Sequence: Synthetic coding sequence
ctgcaggaggaggccgtatgcgccatttgtctggattactttaccgaccctgtttctataggctgcggccacaacttctgtcgggtgtgtgtcacacaactgtggggccgccgcggaggtggatctggaggctacccggtaacccctttgcccccacccccagccccacggcgttgcttcacgtgtcctcagtgtagaaagtccttcccccgaagatctttccggccaaacctccagctcgccaacatggttcaggtaatccgccagatgcacccgactccaggacggggctccagagtcacagaccagggcatatgtccgaagcaccaagaggcattaaagttgttctgtgaggtggacgaggaggccatctgcgtggtttgcagagaatcccgaagtcataagcagcatagcgtggtgcctctcgaagaggtcgtgcaggaatataaatag

SEQ ID NO: 138976 - DNA, 948 bp, Artificial Sequence
  Description of Artificial Sequence: Synthetic coding sequence
atgaaagccaaagaagagcgtagggtgacagagctgaaatcacagatgaaaagtgagctggctgctgtagccagcgaattcggacgccttactcgatttcttgccgaggaacaggcgggcctggaacgacgacttagggagatgcacgaggcccagttaggacgcgcaggagccgcagcctctagattggccgagcaggcagctcagctgagtcggctgctagctgaggctcaagaaaggagccagcagggggggctaaggcttctccagcaagatattaaagaaacttttaacagatacgcaatcgtccgcaaaatgtcccggatgttctgccaggcagccagagtggatttaacactcgaccccgataccgctcatcccgcgctgatgttgagccctgaccgcagaggtgttcgtctggcggagagaaggcaggaagtcgctgaccacccaaagaggttttcggccgattgttgtgtgctgggcgcccaaggctttagatctggcagacattactgggaagtggaggttggcggcagaagagggtgggccgtgggtgctgctagagaatctactcaccataaggaaaaagtcggccctggcggttccagcgtggggtctggggacgcttccagctcacgacaccaccacaggcgtcgccgcctacatttgccccagcaacccctgctgcagcgtgaagtctggtgtgttggcactaatggcaaacgttatcaggcccagagctcaacggagcagaccttactttcgccttccgaaaagcccagacgcttcggagtgtacctggactacgaggctggtagacttggattctacaatgccgaaacgctggcccacgtgcacaccttttccgccgcatttctaggagaaagagtattcccattttttagggttttgtccaaaggcaccagaataaaactgtgcccttag

SEQ ID NO: 138977 - DNA, 1035 bp, Artificial Sequence
  Description of Artificial Sequence: Synthetic coding sequence
atggcttctggagtgggggccgcttttgaagagctcccgcacgacggcacctgtgacgagtgcgagcctgatgaggctcccggggctgaggaggtgtgccgcgaatgcgggttttgctattgcaggcgacacgctgaggcccatcgacagaagttcctgagccatcacctcgccgagtacgtgcacggcagccaggcctggacacctcctgccgacggcgagggggctggaaaggaagaagctgaggtgaaagttgagcaagagagggagattgagagcgaggcaggagaggagtctgagagtgaggaggagagcgagtctgaagaggaaagcgaaactgaagaggagtccgaggacgagagcgacgaggaatccgaagaggatagcgaggaagagatggaggacgagcaggagtcagaagcggaggaggataaccaggaagaaggggagtccgaggctgagggggaaacagaggccgagagtgagtttgacccagagattgagatggaagccgagagagtggccaagcggaagtgccccgatcacggcttggacttgagcacatactgtcaagaagatcgacagcttatctgcgtgctgtgccccgtaatcggggcccaccaaggtcaccagctaagcactcttgacgaggccttcgaggagttaaggtctaaggatagtggggggttgaaagcggctatgattgagctggtggagcggttaaaattcaagagctctgaccccaaggtaacacgcgatcaaatgaagatgttcatccagcaggaattcaagaaggttcagaaggtgatagccgacgaggaacagaaagccctgcatttagtggatatccaagaggcaatggccaccgctcacgtgaccgagatacttgccgacatccagagccacatggaccgattgatgacccaaatggcacaagctaaggaacagcttgatacatctaacgaatcggccgagccaaaggccgagggtgatgaggaaggcccaagtggggcttcagaggaggaggacacatag

SEQ ID NO: 138978 - DNA, 1743 bp, Artificial Sequence
  Description of Artificial Sequence: Synthetic coding sequence
atgtctgagaaccggaaacctctgctcggtttcgtgtctaagctcacgagcggaacggccctaggcaattctggcaagactcattgcccactgtgtctgggactgttcaaggccccgagactcctaccatgcttgcatacagtgtgtaccacctgcttggaacagcttgaaccattctccgtagtagatatccgggggggtgacagcgacacaagctctgaaggcagtatcttccaggagcttaagccgcgtagcctgcagtcccagattggcattctgtgcccggtctgcgatgcccaagttgacctgcctatgggtggcgtgaaggctttgacaattgatcatctggcagttaacgacgtgatgctggagtcattaaggggggaggggcaggggctggtatgtgatttatgcaacgatagagaagtcgagaaaagatgtcagacctgcaaagccaacctttgtcacttttgttgtcaggctcaccgtcggcagaagaaaacgacctaccacactatggtcgacctcaaagacctgaaaggatattctcgtatcggtaagccaatcctgtgcccagtgcaccctgccgaggagcttaggttgttctgcgagttctgcgatcggcccgtgtgtcaggactgtgtagtgggcgaacaccgagaacatccgtgcgactttacatccaacgtcatacataagcacggcgattccgtatgggaattgctgaagggaacacaaccccacgtggaggccctggaggaagcactcgcacaaatccatattattaactccgccctgcaaaagcgggtggaggcggttgctgccgatgtgagaacgttctcggaaggatatattaaagcgatcgaggaacaccgtgacaagctccttaagcaactcgaggatatcagagcgcagaaagaaaattccctgcagttgcaaaaggcccagctggaacaattacttgcagacatgcgaacaggtgtggagttcaccgagcatctgctgacctccggctccgatttggaaattctcatcaccaagagagtcgtggtggaacgactgcgcaaactgaacaaagtacaatattccactagacctggcgtgaatgataagataaggttctgtccacaagagaaggccggccagtgccggggatatgaaatatatggcacaatcaacacaaaggaagtggatcccgccaaatgtgttctgcagggagaggatctgcaccgggcccgtgaaaagcagaccgcgagctttactcttctgtgcaaggacgccgctggcgaaatcatggggagggggggggataatgtccaggtggccgttgtgccaaaagacaagaaggactcccctgtgaggacgatggtgcaggacaataaggatggcacctactacatttcctacacccccaaggaaccgggggtgtacactgtatgggtctgtatcaaggagcaacacgtccaggggtcgccttttacggttatggtgaggagaaagcatagaccgcactccggagtattccattgctgcacattctgcagtagcgggggccaaaagacagctcgatgcgcatgcggcggaacaatgcctggaggctatctgggttgcgggcacggccataagggacaccccggacatccccattggtcatgttgcgggaagtttaacgaaaaaagcgagtgcacatggactggaggacagtctgcccctcgttctctcctgcgtacggtggccctctag

SEQ ID NO: 138979 - DNA, 1572 bp, Artificial Sequence
  Description of Artificial Sequence: Synthetic coding sequence
atgctctccggggtgacacttgagggcggcggagcacgttccggcgaggggcggcggtcacgcaccgagctaaagcctagatcacttcagtcacagatcggcattttatgcccggtctgtgatgcacaggtcgaccttccaatgggaggcgtgaaggccttgactatcgaccaccttgcagtgaacgatgtcatgctcgaaagtcttcgcggagaagggcagggactggtttgcgatttgtgtaatgatagggaggttgagaaaagatgccagacttgtaaagccaacttgtgccatttttgttgtcaggctcatcgaagacaaaagaagacgacataccacacgatggtcgatttaaaagacttaaaaggctactctaggattggtaagccaatcctgtgcccagtgcatcctgcagaggagctccgactgttctgcgagttttgtgaccgccccgtctgtcaggattgcgtagtcggggaacaccgggaacatccctgtgattttacatctaatgttatacacaaacatggcgattccgtgtgggagcttcttaagggcacacagccgcacgtcgaagcactggaagaggccctcgcccagatccacatcatcaacagcgccctgcagaaacgcgtggaagccgtggctgcggatgtgaggactttttctgaggggtacattaaggctattgaggagcaccgggacaaacttctcaaacagctcgaggacatcagggcgcaaaaggagaacagtctgcagctgcaaaaggcgcagctagagcagctgctggcagacatgcgtaccggtgttgagttcactgaacacttgctaacctcaggcagtgacttggaaatcctgattaccaagcgggtggtcgtggagagacttcgcaagctgaataaggtccagtactccactagacccggcgttaacgacaaaattagattttgcccgcaggaaaaagctgggcagtgcagaggctatgagatctacggcactattaacactaaagaggtcgatccagcaaaatgtgtcctgcagggggaggacctccatcgggcaagggagaagcagactgcctcatttactttgttatgcaaggatgctgctggcgaaatcatgggtcgtggcggagataacgtgcaggtggcagtggtacccaaggacaagaaagacagtccagttcgcaccatggtacaggataacaaggacggcacgtactatattagctacactcctaaggagccgggggtgtacacagtctgggtctgtatcaaggaacaacatgtgcagggtagtcccttcactgtcatggtgagaagaaagcatcgcccccattccggggttttccactgttgtaccttctgctcatctggcggtcagaaaacggcccgctgcgcatgcggcggaaccatgccaggcggttatctgggctgtggtcatggccataaaggtcaccccggccaccctcattggagctgctgcggcaagttcaacgagaaatctgagtgtacctggaccggcgggcagtctgcccctagatctttgttgcgcaccgtcgccctgtag

SEQ ID NO: 138980 - DNA, 1689 bp, Artificial Sequence
  Description of Artificial Sequence: Synthetic coding sequence
atgtccgaaaatcgtaaaccgcttctaggcttcgtgagcaaactaacgtccggaaccgccctgggcaattcaggaaagacccactgccctctgtgcctggggctgtttaaggctccgagactgttgccatgtctgcataccgtctgcactacttgccttgagcaactggagcctttttccgtggtagacattcgggggggcgacagtgatactagttccgagggctctatttttcaggagctaaaacccagatctctgcagtcacagatcggcatcttgtgtcccgtgtgcgatgcgcaagtagatcttcccatgggaggggtcaaagcgctgacaatcgaccatctggctgtgaatgacgttatgttggaatcactaaggggcgaaggtcaagggctggtttgcgacctgtgcaatgaccgcgaggtcgagaaaagatgtcagacctgcaaggcaaacctgtgccacttttgctgtcaggcccatcgacgtcagaaaaaaacaacgtaccacaccatggttgatctgaaggacctgaaaggatattcacgcatcggtaagccaatattgtgtcctgtacatcctgcggaggagttacgtctcttttgcgagttctgcgatagacctgtgtgccaggactgtgtggtgggcgaacacagggagcatccatgtgactttaccagcaatgtgatacataagcacggcgactccgtgtgggagcttcttaaagggacccaacctcacgtagaggcgctggaagaggcattggcgcagattcatataatcaatagcgcccttcagaaaagagtggaagcagtggccgctgacgtgaggactttttccgagggctacatcaaagccatagaagaacaccgtgacaagcttctgaaacaattggaagacatcagagcacagaaggaaaactctctccaattgcagaaagcccagctggaacagctgctggctgacatgagaacaggcgtggagtttactgaacacctactcacgtccggttcagatctggagattttgattacgaaaagggtggttgttgagaggctcaggaaactcaacaaggttcagtattcgacacgccctggagtcaacgataaaattcggttttgtccacaggagaaggccgggcaatgtagggggtatgagatatacgatctgcatagggctcgagaaaagcaaaccgcttcctttacactgctgtgcaaggacgccgcgggagaaatcatgggcaggggcggggacaatgtgcaagtcgctgtggtgcccaaggataaaaaagactctccagtccggactatggttcaggacaacaaggatggtacatactacattagttatacccccaaggagcctggggtctataccgtgtgggtctgcataaaggaacaacatgtgcaggggtcccccttcactgtcatggtgcgaagaaagcaccgaccacatagcggtgtctttcactgttgcacattctgtagtagcggagggcaaaaaaccgctaggtgtgcctgtggcgggactatgcccggggggtatcttgggtgcggccatggacacaaagggcatccaggtcatccccattggtcctgttgcggtaaatttaacgagaaaagtgaatgcacttggactgggggtcaatctgccccccgctcgctgttaaggacggtagcactgtag

SEQ ID NO: 138981 - DNA, 1917 bp, Artificial Sequence
  Description of Artificial Sequence: Synthetic coding sequence
atggatgggtccgggccttttagctgtccaatctgtcttgagcctctgcgtgagccggtcacactcccatgcggtcacaacttttgtctggcctgcctgggagcattgtggccccatagaggagccagtggcgctgggggaccgggaggggccgcccggtgtccattatgtcaggaaccatttccagacgggctccagctaaggaagaaccacacgctgtccgagctcttgcagctgcggcagggttctggacccggttccgggcctgggcctgcccctgctctcgcaccagaacctagcgccccttctgctctcccaagcgtaccagagccttccgcaccttgcgccccagaaccctggccagcaggggaggagccggtgcgatgtgacgcgtgtcccgagggtgcagctcttcccgccgcgttgtcttgtctgtcttgtctcgcatcgttctgcccagcgcatctgggtccccacgaacgcagccccgccttgcggggacatcggcttgtacctccgctgcgccgtctcgaggaatccctgtgtccccggcacctccgccctctcgagaggtactgtcgtgccgaacgcgtgtgcctgtgcgaggcgtgcgcagctcaggagcatcgggggcatgagcttgtgcctttagagcaagagagagccctgcaggaagcggagcagagtaaggtgttgtccgctgtggaagatcggatggatgagctcggcgccggtatcgcgcagagtcgaaggaccgtggcccttatcaaatctgccgccgtggcggagcgggagagagtctctcgattattcgctgacgccgctgcagccctccaggggtttcagacccaggtgctcgggtttatcgaggagggtgaggctgctatgttgggaaggagtcagggtgacctgagacgccaggaggaacaaaggtcaaggttgtctcgggctcgtcaaaacttgtcccaggtgcccgaggcagactcagtctcctttctgcaggaactgctggcattgcggctcgccttagaagatgggtgtggacctggcccaggcccacctcgggaactatcttttactaagtcatctcaggcagtcagagcggtcagagacatgctggctgtcgcatgcgtaaatcagtgggaacagttgagaggccctggaggcaatgaagacgggccccagaaactggacagcgaagctgacgctgaaccacaggacctggagtccaccaatctgcttgaaagcgaagcaccacgcgattatttcctgaaattcgcctatattgtagatctagactctgacacagcagataaattcctgcagctgtttggcacgaagggggttaaacgcgtgctctgtcccataaattaccctctgagcccgacaagatttactcactgcgagcaagtcctgggcgagggtgcacttgaccggggcacctactactgggaggtggagataatcgaaggttgggtttctatgggtgtcatggcggaagatttcagtccacaggaaccctacgatagggggcgcttgggccgaaatgctcacagttgttgcctgcagtggaatggacggtcgttctccgtgtggttccacggtctggaggcacccttgccccacccgttctccccaaccgtgggagtctgcctggaatatgcagatagggctctcgccttttatgcagtgagggacggtaaaatgtctttactgcgtaggctcaaagcttcaaggcctcgtcggggagggatacctgcatctccaatcgaccccttccagtctcggctggattcccacttcgcaggtctcttcacacatcggctgaagccagctttcttcttggagtccgtggacgcccacctccaaatcggacctctaaaaaaatcttgcatatcagttttgaagcggcgttag

SEQ ID NO: 138982 - DNA, 1482 bp, Artificial Sequence
  Description of Artificial Sequence: Synthetic coding sequence
atggccagtggtatactcgtgaatgtgaaggaagaggttacctgccccatttgcttagagctcctcacacagccactgagccttgactgtggtcactccttctgtcaggcatgtttgaccgcgaatcataaaaagagcatgcttgacaaaggtgaaagctcttgcccagtgtgcagaatctcataccagcccgaaaacattcgacccaaccgccacgttgctaacatagtggagaaactccgtgaagtgaagttgtccccagagggccagaaagtcgatcactgtgcacgacacggtgagaaactgctcctattctgtcaggaggatggcaaggtgatttgttggctctgcgaacgcagccaggaacaccgcggacaccacacattcttgacagaagaagtggcccgagagtaccaggtgaaactgcaggccgcactggaaatgctacgtcaaaagcagcaggaagctgaggaactcgaggcagacatccgcgaggaaaaggcttcttggaaaactcagatacagtacgataagactaacgtactggcagattttgagcagctgcgggacattctggattgggaggaatccaatgagctacaaaatttagagaaagaagaggaagacattctcaagtcattgacaaattcagaaactgagatggttcagcagacacagtctctaagagagcttattagtgatcttgagcatagacttcaaggttctgtaatggagttgctccaaaaggttagcgggaaaattctccggaccgaaaatgtgaccctcaaaaaaccagagaccttccctaaaaatcaaaggcgcgtgttccgcgccccagatcttaaagggatgcttgaggtgtttcgcgagctgactgatgttcggcgatattgggtggacgttactgtggcccccaacaatatcagttgtgctgtaattagcgaagataagagacaagtatcatctcctaaacctcaaattatatatggggctagaggaacacgctaccagacctttgtgaattttaattactgtactggaatactcggcagccaaagcattacaagcggcaagcactactgggaggttgatgtgagcaagaaaacagcatggatactcggggtttgcgctggttttcagcctgacgctatgtgcaatatcgagaagaacgagaattaccaaccgaaatatggatactgggtgatcggcctggaagagggtgtcaagtgtagcgctttccaggattcctccttccacactccgagtgtcccctttattgttcccttatcggtcatcatatgccccgatcgtgtgggcgtgtttctggactacgaggcttgcacagtatccttttttaatattacgaaccatggctttctcatctataagttctctcattgctcattctcacaacccgtcttcccctatctgaacccccggaagtgcggagtccccatgacactttgtagcccttccagttag

SEQ ID NO: 138983 - DNA, 981 bp, Artificial Sequence
  Description of Artificial Sequence: Synthetic coding sequence
atggcgtcggggatattggtgaatgtgaaagaggaagtcacctgtcccatctgcctcgagctgctgacccagcccttgtcattggactgtggtcatagcttctgccaggcgtgtctcacagccaaccataagaaatccatgctcgacaagggagaatcatcatgccctgtttgcaggatttcataccagcccgaaaatattcgtcctaatagacatgtggctaacatagtcgagaaacttcgggaagtcaagttgtcccctgagggtcaaaaggtggaccattgtgcaaggcacggcgagaagctcctccttttctgccaagaggatggaaaggtgatctgctggctttgcgagagatcccaggaacatcggggtcatcatacatttctgaccgaggaggtcgctcgcgagtaccaggtgaaactgcaagccgcattagaaatgttgcgacagaagcagcaagaggccgaagagttggaagctgacatccgagaagagaaggcgtcttggaagactcagatccagtacgataaaacgaacgtgctcgccgattttgagcagcttagggatattctggattgggaagagtcgaacgaactgcagaatctggaaaaagaggaagaagacattctgaagtctctgactaactcggaaactgaaatggtgcaacagacccagtcactacgcgagcttatctccgacctcgagcacagactgcagggcagtgtcatggaacttctgcagggcgtggacggtgtgattaagaggactgagaacgtaactttgaaaaagcctgaaacttttcctaagaaccaacggagagtgttccgtgctcccgacctgaagggcatgctggaggtgtttcgggaactgaccgacgtacggcggtattggggctggtccgccatggcgagaagccgcttcactgcgacatccaccagccagatccaggctattctcctcccacagccccctaagtag

SEQ ID NO: 138984 - DNA, 1482 bp, Artificial Sequence
  Description of Artificial Sequence: Synthetic coding sequence
atggcctcaggaatcctggttaatgttaaagaagaggtgacctgccctatctgcctggaacttctaactcaaccactcagtctggattgcggccactccttctgtcaggcatgtcttacggcaaatcataagaagagcatgttggacaagggagaaagctcctgtcccgtatgcagaattagctatcaaccagagaacatccgccccaacaggcacgtggctaacatcgtcgagaagctccgcgaagtaaagctttccccggagggtcaaaaggtcgatcactgtgctaggcatggcgaaaagctgttattgttttgtcaagaagacggcaaagtgatatgttggttgtgtgagcgatcacaagaacaccgcgggcaccacacattcctaactgaggaagtggctcgcgaatatcaggtaaagctccaggctgcactggagatgctccggcagaaacaacaggaagctgaagagctggaggcggatatcagagaagagaaagcctcctggaaaactcaaatccagtacgataagaccaatgtcctggccgactttgagcaacttagagatatactggattgggaggagagcaacgagttgcagaacctggagaaggaggaggaagacattctgaagtccctgactaacagcgaaaccgagatggtgcagcaaactcagtctcttagagagctcatctctgacctggaacaccgactacaggggagcgtgatggaactgctgcaaggggtggacggcgtcataaaacgtaccgagaacgtgacactgaagaagccagaaactttcccaaagaaccaacgacgtgtgtttcgtgcccccgatctgaaaggaatgctggaggtgttccgagaactcaccgatgtccgccgatattgggttgatgttactgtggcccccaacaacattagttgcgccgtgatttcggaggataagcgtcaggtgtcttcacctaagcctcaaataatctatggagcaagaggcacaaggtaccaaacttttgtcaacttcaattactgtaccgggatcctgggctcacagagcataacctctggcaaacattattgggaggtcgatgttagcaagaagacagcgtggattttgggcgtgtgcgctggatttcaacctgacgccatgtgcaatattgagaaaaatgaaaactatcagcccaagtatggctattgggtaatcggcctggaggaaggggtcaaatgctctgctttccaggattcaagttttcatactccctcagtaccttttatcgttccattatccgtgatcatttgccccgatcgggttggtgtgtttctcgattacgaagcctgtaccgtttccttctttaacatcactaaccacggattcttgatctataagtttagccactgttcattcagccagccagtgtttccatacctgaatccaaggaaatgtggggtccccatgacattgtgctccccatcgtcttag

SEQ ID NO: 138985 - DNA, 1044 bp, Artificial Sequence
  Description of Artificial Sequence: Synthetic coding sequence
atggcatcgggaatactcgttaacgtgaaagaggaagttacctgcccaatttgtctggaactgcttacccagcccctgagtttagactgtggccattctttctgccaggcatgccttacagcaaaccataaaaagtcaatgctcgacaagggagaatccagttgccctgtgtgtcggatctcctaccagcccgaaaacattcgcccaaacagacatgtcgccaatatcgtcgaaaagcttcgggaggtgaaattaagccccgagggacagaaagtcgaccattgcgcccggcatggggaaaaactgttgttattttgtcaggaggacggcaaggtgatatgttggctttgtgaaagatcacaggagcaccgcggtcaccacacatttttaactgaagaggttgccagggaataccaggtgaaactccaggctgccctggaaatgttacgccagaagcagcaggaagccgaagagctggaagcagacataagggaggaaaaagctagctggaagacccagatccagtatgataaaacgaacgtactcgccgatttcgagcagctgagggatatcttagactgggaagaaagcaatgaacttcagaaccttgaaaaggaagaggaagatatcctgaaatctttgacaaactccgagaccgagatggtccaacagacccagtcactgagggaattgataagcgatctcgagcaccgtttacagggctctgtcatggagctcttgcaaggcgtggacggagtgatcaagaggactgagaatgtgacgctgaagaaacccgagacatttcctaagaatcaacgacgagtgtttcgagccccggacttgaagggaatgctcgaggtgtttagagagttgacggacgtgcggaggtattgggggaaggagaagagtcactaccacaaacctccatgcggactctcactcctgctgtctctatctttcaggattctatgctccttgttgggtagttgcttcaaaatatacgacagtcccagcaaaacacatataacatatccttctctgtag

SEQ ID NO: 138986 - DNA, 984 bp, Artificial Sequence
  Description of Artificial Sequence: Synthetic coding sequence
atggcttccggcatattagttaacgtgaaggaggaggtgacttgccccatctgtttggaactgctcactcaacctctttcattggattgcggtcactctttttgccaggcgtgcctgaccgccaatcacaaaaagagcatgttagataaaggcgagtcttcttgccccgtgtgccgtatctcctaccagcctgaaaacatacgccccaacagacacgtggcgaacattgtcgaaaagctgcgggaggtcaagctctcccccgagggtcaaaaagtggatcactgtgcccggcacggcgagaagctgctgctcttctgtcaggaggacggaaaggtcatttgttggctttgcgagagatctcaggaacacagaggtcatcatacattcctgacagaggaagtggcaagagagtatcaagttaaacttcaagcggccttagagatgctacgccaaaaacagcaagaggcagaggagttagaagctgacatccgtgaagagaaagcttcatggaagactcaaatccagtacgacaagacgaatgtgctcgcggattttgaacagcttagggatatcctcgattgggaagaatccaacgagctccagaacctagaaaaagaagaggaggacattctgaaaagtctgactaattccgagaccgaaatggtgcagcagacccagtccctaagagaactgattagcgacctggagcatcgcctgcaaggatctgtgatggagcttcttcaagccggagtgcaatgcctcatcctccggactgagaacgttaccctgaagaagccggaaaccttccccaaaaaccagaggcgggtttttcgcgcccccgacctgaaagggatgctcgaggtctttcgtgagcttactgacgtcagacggtactggggctggagtgctatggctagatctcggtttacagctacctccaccagccagattcaagcaatcctcttgccacagcccccaaagtag

SEQ ID NO: 138987 - DNA, 981 bp, Artificial Sequence
  Description of Artificial Sequence: Synthetic coding sequence
atggcaagcggcattctcgttaacgtgaaggaagaggtgacatgtcccatttgcctggagctgttgacccagcctctcagtctcgattgtggccactctttctgtcaagcctgcctcacagccaatcacaagaagtcgatgctggacaaaggcgaatcctcctgtccggtctgccgcatttcgtaccagcctgagaatatcaggcctaatcggcatgtcgccaatattgtggagaagctgcgggaggtgaagctaagccctgagggacagaaagtggaccattgcgcccgtcacggggagaaactgctgctgttctgtcaggaggatggcaaggtgatatgctggctgtgcgaacgcagccaagagcatcgcgggcaccacacttttttgacggaagaggttgcacgggaataccaggttaagcttcaagctgctttggaaatgctgcggcagaaacagcaggaggccgaagagttagaggccgacattcgcgaagaaaaggcttcctggaaaacccagatccagtacgataaaacaaacgtgctcgcagatttcgagcagctgagagatattctggattgggaggaatcaaacgagctccagaacctggagaaagaggaggaagacatcctgaagtctctgacaaattccgaaaccgagatggtgcagcagacccagagtctccgggagctgatatccgacctcgagcatcgtctacaaggctccgtcatggaactgctgcaaggagttgatggcgtcattaagaggacagagaatgtcacattaaaaaagccagaaaccttcccaaagaatcagagacgggtcttccgggcccctgatcttaagggcatgctggaagtcttcagggagctcacagatgttagaaggtactggggctggtccgctatggcccgctcacggtttacggccacttctacctcacaaatccaggccatcctgctgcctcagcctccaaaatag

SEQ ID NO: 138988 - DNA, 630 bp, Artificial Sequence
  Description of Artificial Sequence: Synthetic coding sequence
atggccagtgggattctggtgaacgtgaaggaggaagtgacttgtcctatttgcctggagctccttacccaacctttatctctggactgtggccattctttttgtcaagcatgtctcaccgccaatcataagaaatccatgctagataagggcgagtcttcctgtcctgtgtgcaggatttcttaccaacccgaaaatatccggccgaaccgccatgttgccaacatcgttgagaaactcagggaagtgaagctctctccggagggacagaaggtcgaccattgcgccagacacggggagaagcttttgttattctgtcaggaagacggtaaagtcatctgctggctttgtgagcgctcacaggaacacaggggtcatcacacgtttctcactgaggaggtagcaagagaataccaggtcaaattgcaggccgctctggaaatgctcaggcagaaacagcaggaggccgaggagctcgaagctgatatccgcgaggagaaagccagttggaaaactcagatacagtacgataaaaccaacgttctcgccgactttgaacaactccgcgacattcttgactgggaagaatccaatgaactgcagaacctggagaaggaagaagaggactag

SEQ ID NO: 138989 - DNA, 219 bp, Artificial Sequence
  Description of Artificial Sequence: Synthetic coding sequence
atggctagcggaatcctagttaatgtcaaggaggaggtaacatgccctatctgcctggaacttctaacacagcctctgagccttgactgtggacactcattttgccaggcctgtcttaccgccaaccacaagaagtcaatgctggataaaggggaatcatcctgtcccgtttgtaggatctcctaccagccagaaaacatccggcctaaccgacactag

SEQ ID NO: 138990 - DNA, 816 bp, Artificial Sequence
  Description of Artificial Sequence: Synthetic coding sequence
atggcttctggtatcctggttaacgttaaagaggaggttacttgcccaatctgtctggaactgctcacccagccgttgagtcttgactgtgggcactcattttgccaggcgtgccttaccgcaaatcataagaagtctatgcttgacaaaggagaatcctcgtgccccgtgtgcaggattagttaccagcccgaaaacataaggcccaatcgtcatgtggctaacatcgttgagaaactgagagaagtgaagcttagtccggagggccaaaaggtcgaccattgtgcaagacacggtgagaaattgctgcttttttgtcaggaggatggcaaggtgatttgttggttgtgcgagcggtcacaagaacaccggggtcaccacacgttccttacagaagaggtagcgcgcgaataccaagtaaagctgcaagctgctctagaaatgctccgccaaaagcagcaggaggctgaggaacttgaggctgacatccgggaggagaaggcctcctggaagacccaaatccagtatgacaagaccaatgtgttagctgacttcgagcagttacgggacattctcgactgggaggaatccaatgaattgcagaacttagagaaagaggaggaggatatcctgaagagcctgaccaacagtgagaccgaaatggtacagcaaacccagtcactacgcgaactgatttcagatctggaacatcgcctgcagggctctgtgatggaattactccaggacggcgagcgtgacctggaagaagcaaggaatttttctaaaaaatccaaggagtccgtttcctccagctag

SEQ ID NO: 138991 - DNA, 1464 bp, Artificial Sequence
  Description of Artificial Sequence: Synthetic coding sequence
atggcctggcaagtgagcctcctggaactcgaggattggctgcagtgtccaatctgcctggaggtcttcaaggagccacttatgttacaatgcggtcactcatattgtaagggatgtttggtgtcactctcatgccatttagacgccgagctgaggtgtcctgtctgccgccaagctgtcgacggttcttcttctttacctaacgttagcctcgctagagtcatcgaggctctgaggctgcctggcgacccagagcccaaggtctgtgtgcatcacagaaatccgcttagtctattttgcgaaaaggatcaagaactcatctgcggactatgtgggctcttgggtagccatcagcaccatcctgttaccccagtgagcaccgtgtatagtaggatgaaagaagaactcgccgcacttatatcggagctgaagcaggagcagaaaaaggtcgatgagctcatcgctaagcttgttaataatagaactcgcatcgtaaatgagagtgatgtgttctcctgggttatcaggagggagtttcaagaactgcaccacctggtggatgaggagaaggcccgatgcctcgaggggataggcgggcacacacgtgggttggtggccagtctggacatgcaattagaacaggctcagggtacaagagagagactggcccaggcagagtgcgtgcttgaacagtttggtaatgaggatcaccacaagttcatccgaaaattccatagtatggcctcccgggcagaaatgccccaggcgcggccccttgaaggggccttttctcctatctccttcaagccaggtctccaccaggccgacattaagcttaccgtgtggaaaaggctcttcagaaaagtgctgcccgcaccagaacctctgaaactcgacccagcaaccgcgcaccccctactggagctgtctaaaggaaatactgttgtgcagtgtgggttattggcccagcggcgcgcatcccaacccgagagattcgattacagcacatgcgtactggcctcaaggggattcagttgcggacggcactactgggaagttgtagtggggagcaagagtgactggcggttgggcgtgatcaagggcaccgcaagccggaaggggaaattgaaccgctcaccagagcacggagtgtggctgataggattgaaggaaggacgggtgtatgaagctttcgcttgtccacgtgtccccttaccagttgctggtcatcctcataggatcggtctctatctccattacgagcagggcgagctgacattcttcgatgctgacaggccagatgacctaagacctctttacacatttcaagccgactttcagggaaaactgtatccaatcttagacacttgctggcatgagcgtgggtctaacagtctacccatggttctgcctccccccagtgggcccgggcccctttcccctgagcagcccacgaaactgtag

SEQ ID NO: 138992 - DNA, 1464 bp, Artificial Sequence
  Description of Artificial Sequence: Synthetic coding sequence
atggcatggcaagtgtctctgcttgagctggaggactggctgcagtgtcctatttgcttagaggttttcaaagagccactcatgctccaatgtggtcattcctactgtaaggggtgcctagtgagtctgagctgtcacctggacgctgagctgcgttgtcccgtctgtcgacaggcagtggatggctccagctcactccctaatgtgtccctcgccagggttatcgaagcactccgtcttcctggggaccctgaacccaaggtgtgtgtccaccatcggaatccactgagcttgttctgcgagaaggaccaagaactaatatgcggactatgcggcttgctgggcagtcaccagcaccaccccgtcacccctgttagcactgtttattcaaggatgaaagaggagctcgccgccctgattagcgagttaaagcaagagcagaagaaagtggatgagttgattgcaaagctggttaataacaggacacgaatagtgaacgaaagcgatgtgttttcatgggtaattagacgggaattccaagagctccaccacctggtggacgaagagaaggcaaggtgtttggaggggatcggcggacataccaggggtttggtggcctccttggacatgcagctggaacaggcacaaggaacacgcgaaaggttggcacaggctgaatgtgtactggagcagtttggaaatgaagatcatcacaagtttattaggaaattccactctatggctagccgcgccgagatgccacaggctcggcccctcgagggcgcgttttcccccatcagtttcaagccgggtttgcaccaggctgacatcaagctcactgtgtggaaacgcctgttccgcaaagtgcttccagctcccgaacctttgaaactagaccccgccaccgctcaccccctgcttgagctgtctaaaggcaacactgtcgtgcagtgcgggttgctggcacagagaagagcctcacagccggaaaggttcgactactctacttgcgtgttggcatctcggggtttttcttgtggaaggcattattgggaggtggtagtaggaagcaaaagcgactggcgactcggcgtaataaaggggacagcctctagaaagggcaaactcaacagatcacccgagcacggcgtgtggttaattggactgaaagaaggccgcgtctatgaagcatttgcctgcccaagggtgcctctgcccgtggcgggccacccacacagaataggcttgtaccttcactatgagcaaggcgagctgacctttttcgatgctgataggccagacgacctgcgtcccctgtacaccttccaggctgacttccagggaaaactctatccgatcctggacacatgttggcacgaacgcggcagcaatagcctgcctatggtgttgccacccccaagcggaccagggcctttgtcgccggaacaacccactaagttgtag

SEQ ID NO: 138993 - DNA, 1467 bp, Artificial Sequence
  Description of Artificial Sequence: Synthetic coding sequence
atgacatcacctgtcctcgtagatatcagggaggaggtgacctgccctatttgcctggagctgctgactgaaccactgtccatcgattgcggccacagcttttgccaggcctgtatcactccaaatggaagggagagcgttatcggtcaagagggcgaacggagctgtcccgtgtgccagacctcttatcaacctggaaatctcaggcccaaccggcatctggctaatattgttcgccgcctgagagaagttgtactcggcccgggtaagcaactgaaggcagtcctgtgcgctgaccacggtgagaagctgcagctgttttgccaggaagatggcaaggttatttgctggctatgcgagagatcacaagagcacagaggtcatcatacgttcctcgtggaggaagttgcccaggaatatcaggaaaaattccaggaatcacttaagaaactcaaaaatgaggaacaagaggcagaaaaactaaccgcttttatcagagaaaaaaaaacttcttggaagaatcagatggagcccgaaaggtgcaggatccaaaccgagtttaatcagctcagaaatattttagatagggtggaacaaagagagcttaaaaagttggaacaagaagagaaaaaggggctaaggatcattgaggaagctgaaaacgatcttgtgcaccagacccaaagtcttcgcgaactgatctccgatttggaacggaggtgtcaaggcagcacgatggaattgcttcaggatgttagcgatgttactgagaggagcgaattctggactctccgtaaaccagaagcgcttccgaccaaactgagatctatgttccgggcccctgacctcaagagaatgctgcgcgtgtgcagggaactgactgatgttcagtcgtattgggtggacgtcaccctgaatcctcataccgcaaatttaaatttggtgctagctaagaatcgccgtcaggtaaggtttgttggcgccaaagtgtctgggccctcctgcctggaaaaacactatgactgcagcgtcctggggagtcagcatttttctagcggcaagcattactgggaggtggacgtggcaaagaaaactgcatggatcctcggtgtctgttctaattcactcggacccacattcagttttaaccacttcgcccaaaatcactccgcctacagtcggtatcagccccagagcggctattgggtgatagggttgcaacacaaccatgagtaccgtgcttacgaggactctagcccctctctccttctgtctatgacggtccccccacgcagggttggcgtgtttctggactacgaagccgggactgtgagtttctacaacgtgactaatcacggcttccctatctatactttctccaagtattatttcccaacaacattatgtccttattttaatccatgtaattgcgtgattcccatgaccttacggcggccctcttcctag

SEQ ID NO: 138994 - DNA, 1551 bp, Artificial Sequence
  Description of Artificial Sequence: Synthetic coding sequence
atgtgtggctccgaaagaatacttcaggcagggaatattctggagataagagtggggcaggcgggagcaaggcgggtggctaccatgacgagtcccgtactagtcgatatccgggaggaggtaacatgtcctatatgtctagagctcctgaccgaaccactgtccatagattgtggtcactccttttgtcaggcatgcatcacccctaatggccgggaatcagtgatcggccaggaaggggaacgctcctgccctgtgtgtcagacctcctatcaacctggcaacttacggcccaatcggcatctggccaatatcgttcgtaggctacgcgaggtggttttggggcccggtaagcagctgaaggctgtcctgtgtgccgaccacggggaaaagcttcagctattctgccaagaggacggcaaggtcatatgctggctgtgcgaaaggagccaggaacacagaggacaccatacatttctcgttgaagaggtcgcgcaggagtatcaggagaaatttcaggagagcctcaaaaagttaaaaaacgaagagcaggaagctgaaaagttgaccgctttcataagggaaaaaaagaccagctggaagaaccagatggagccagagcggtgccgcatccagactgaatttaaccaactccgcaatattcttgatcgagtggaacagagagaactcaaaaaactcgagcaggaagagaagaagggcctgcgaatcatcgaggaagccgagaacgacctcgttcaccagactcagagtctgcgggaattaatctctgatctggagagacggtgccaggggagtaccatggaactgctccaggatgtgagtgatgtgacagagaggtcagaattttggacgctgcgtaagcccgaggcattgccaacgaagttaaggtctatgttcagagccccagacctgaagaggatgctgagggtgtgtcgcgaactaaccgatgtacagtcttattgggtggatgtgactctgaacccccataccgcgaacttgaacctggtccttgctaagaatcgcagacaagtgcgattcgtcggggctaaggtgtccgggcctagctgcctagagaagcactacgattgctccgtgttgggatcgcaacacttcagtagcggcaaacattactgggaggtagacgtggccaaaaagactgcctggattttgggtgtctgcagtaatagcctggggcccaccttcagctttaatcactttgctcagaaccactcggcctattcccgctatcagcctcagtcaggctattgggtaatcggcctacagcataatcacgagtaccgcgcatacgaagactctagcccgtctctgctcctttcaatgacagtgcctccaagacgcgtgggagttttcctggattacgaagctggaaccgtgagtttctacaatgtaaccaaccatggtttcccgatttacactttctccaagtactatttccccacaacactgtgtccatactttaacccttgtaattgcgtgatccctatgaccttgagaaggccaagtagctag

SEQ ID NO: 138995 - DNA, 1389 bp, Artificial Sequence
  Description of Artificial Sequence: Synthetic coding sequence
atgacctctcctgtgttggttgacatccgggaggaggtgacctgccccatttgtctcgagctgctcactgagccactcagtatcgactgcggacactccttttgccaggcctgtataaccccaaatggacgggaaagcgtgatcggacaggaaggagaaagatcctgccctgtctgccaaacttcctatcagcccggaaacctgcgccccaatagacatctggctaacatagtgcgtcgactcagggaagaggatgggaaggtgatttgttggctatgcgaacggagccaagagcacaggggacaccatacttttctggttgaggaggtggcacaggagtatcaggagaagtttcaagagtcgctgaagaaactcaaaaatgaggaacaagaggccgagaagctcaccgcttttattagggaaaaaaaaacctcttggaagaatcagatggaaccagagagatgtagaatccagaccgagtttaatcaactgcggaacatcctggatcgcgtcgagcagcgagagctgaaaaagctcgagcaagaagaaaagaagggcctgcgcattatagaagaggctgaaaatgatctagtgcaccaaacacagagcctgagagagctaattagcgatttggaacgccgctgccagggaagcactatggaacttctccaggatgtctccgatgtgacagaaaggagtgagttttggactttgcgcaaaccagaggctctgccaacgaagctgaggagtatgtttagggcccctgatctcaagcgtatgttgcgagtgtgcagggagctgacagatgttcaatcctactgggtcgacgtgacacttaatccccatacagcaaatctgaatttagtgctcgctaagaataggcgtcaagtcagattcgtcggagccaaggtgagtggcccttcttgcttggaaaaacactacgactgcagcgtcctggggtcccagcactttagtagtggcaagcactactgggaggtggatgtcgccaaaaaaaccgcatggattctgggcgtctgcagtaatagtctcgggcctacgttctcctttaatcacttcgcccaaaatcactccgcctattctcgctaccagccacagagcgggtattgggtgattgggttgcaacataatcacgagtacagagcctacgaggatagctcgcctagcctccttctgtctatgactgtgccgcctcgaagggtcggggttttcttggattatgaggctggaactgtgtcattttacaatgtgaccaaccatggattcccaatctatacattttccaagtactactttccaacaaccttgtgcccctatttcaatccctgcaactgtgtgatcccgatgacccttaggcgcccttcatcctag

SEQ ID NO: 138996 - DNA, 1188 bp, Artificial Sequence
  Description of Artificial Sequence: Synthetic coding sequence
atgtgtggatccgaacggccttggcggaaaaccgcagccctgctgtctggcggctgggaaggccacctgctcgcttgcgagaggagccaagaacacagaggccatcacacattcctggtggaggaggttgcacaggagtatcaggaaaagtttcaagagtcactgaagaaattgaagaatgaagaacaggaggccgagaaactcacagcattcattagggaaaagaaaacgagctggaagaaccagatggagccggaaaggtgtaggatccagaccgagttcaaccagctcagaaacattctcgacagagtcgaacagagagagctgaagaagttggaacaggaagaaaaaaagggcctccgcatcattgaagaagcagagaatgacttggtacaccagacccagtccctccgcgaactcatttctgaccttgagagaaggtgtcagggcagcacgatggagctgctccaggacgtgagtgacgtgaccgagaggagcgagttctggactctccggaagcccgaggctctgcctaccaagctccgtagcatgtttcgggctccagatctgaaaagaatgttgcgcgtgtgtagagaactgaccgacgtgcagtcttattgggtcgacgttactttaaacccacatactgctaatttaaacctcgtcttggcaaagaatcggcgccaagtgcgatttgtgggcgccaaagtaagcggaccaagctgtctggagaagcattacgattgcagtgttctgggctcgcagcactttagcagcggcaagcactattgggaagtcgatgtggccaagaaaaccgcctggatcctcggagtgtgctcaaattcgcttggacccactttttcctttaaccatttcgcacagaatcactcagcatattcacgctatcagccccaatccggatattgggtgattggcctgcagcacaaccacgagtatagagcctacgaggattcctctcctagcctgctgctgtccatgaccgtcccaccacggagagtcggcgtgtttttagattatgaggccggaaccgtttccttctataacgttactaatcacggcttccctatctacacctttagtaagtactattttcccaccaccctctgcccctattttaacccttgtaactgtgtcatccctatgacactgcgccgcccctcatcttag

SEQ ID NO: 138997 - DNA, 942 bp, Artificial Sequence
  Description of Artificial Sequence: Synthetic coding sequence
atggaaccggaaaggtgccggatacagactgagtttaatcagcttcgtaatattctggaccgggtcgaacaacgcgaactcaagaaactcgagcaggaggagaaaaagggactgagaattatcgaggaagcggaaaatgacttggtgcaccaaactcagagtctccgggagcttatctccgatctggagcgacgttgtcagggaagcacaatggaattgctccaggatgtgagtgatgtgacggagcgttctgaattttggactctgagaaagcctgaagctctgcctaccaaactcaggtccatgttccgggcaccagatctgaaacgaatgttgcgcgtatgccgcgaactaactgatgtgcagtcatactgggtggatgtcacactgaatccccatacagcaaacttaaatcttgtgctcgcaaagaataggaggcaggtgcgcttcgttggcgctaaggtatcaggaccctcatgcctcgagaagcactatgattgctctgtcctgggatcccagcatttctcatccgggaagcattactgggaagttgacgtggccaagaagacagcatggatactgggcgtgtgctctaatagcctgggtcctaccttctcatttaaccacttcgcacaaaatcacagcgcttatagtcgataccaacctcaatcgggatactgggtgattggactacagcataaccacgagtacagggcttacgaggattccagcccatccttgctgctgagtatgacagtgcctccccggcgcgtgggggtctttctcgactacgaggctggaaccgtgagtttttataatgtaactaatcacggatttcctatttataccttcagtaagtactatttccctacgacgctgtgcccctactttaatccctgcaactgcgtgatccctatgactctacgcaggccaagtagctag

SEQ ID NO: 138998 - DNA, 942 bp, Artificial Sequence
  Description of Artificial Sequence: Synthetic coding sequence
atggaacctgaacggtgtaggatacaaaccgaattcaatcagttgcgcaacatcctggacagggtcgagcaaagagaactgaaaaagctggagcaagaagaaaaaaaggggcttaggatcatcgaggaggccgagaatgaccttgtccaccagacgcagagtctgcgggagctgatctctgatctggaacgacgctgtcaagggagtacaatggagttactgcaggacgtgagcgatgtgacagaacggagcgagttttggacacttaggaaacctgaggccctgcccactaaattgaggagcatgtttcgggcacctgatttgaagcgtatgttgagggtgtgcagggaactcacagatgtccaatcttattgggttgacgtaacgcttaatcctcacactgcaaacctgaatctggtgcttgctaaaaacaggcgccaggtccggtttgtaggagccaaggtgtctgggccctcctgcttggagaagcattatgactgttcagtgttgggatctcagcactttagctccgggaagcattattgggaggtggacgtcgctaaaaaaacagcctggattttgggggtgtgctcgaacagcctgggccccaccttctctttcaatcatttcgcacagaaccactctgcatacagtaggtaccagccccaatctggttattgggtgatcgggctacagcacaatcacgagtatagagcttacgaagattcctcaccgtctctgctattgagcatgactgtgcccccacgaagagtgggggtgtttctcgattatgaggctggcactgtgtctttctataatgtgaccaaccacgggttccctatttataccttctccaaatactattttcccaccaccctctgtccttatttcaacccttgcaattgcgtcattcccatgacgctgagaagacctagctcctag

SEQ ID NO: 138999 - DNA, 942 bp, Artificial Sequence
  Description of Artificial Sequence: Synthetic coding sequence
atggagccagagcgctgcaggatacagaccgaattcaaccagctgcgtaacatactggatcgtgttgagcaaagagagcttaagaaactggaacaggaggagaaaaaaggactacgcattatagaagaggccgagaacgatctggtgcatcagacacaatcactgcgggagctcattagcgatttagagaggcggtgccagggtagcacgatggaactgcttcaagacgtatcggacgtcactgagagatctgaattttggacactacgcaagcctgaggctctgcccacgaagcttagatctatgttcagagcccccgacctcaaaaggatgctccgggtatgccgggagcttactgatgtgcagtcctactgggtggatgtcactctgaaccctcatacggcgaaccttaatcttgtgctcgccaagaataggagacaagtcagattcgtgggagcgaaggtgtctggtccctcatgcctcgaaaagcactatgactgcagcgttctcgggtctcaacactttagtagcggcaagcactactgggaggtcgacgtcgcaaaaaagaccgcctggattctaggggtctgctccaatagcttaggccccacattctctttcaaccactttgctcagaatcactccgcgtactctagataccagccacagtccgggtattgggtaattggccttcagcacaaccatgaataccgtgcttacgaggactcatccccttccctgctgctgtccatgactgtgccccctcggagggtcggtgtgtttcttgattacgaagccggaacggtaagcttttataacgtcactaaccatggatttcctatttacaccttttctaaatactactttccgactacactgtgtccctactttaatccctgtaattgcgtcatcccaatgaccctaagaagaccgtcgtcttag

SEQ ID NO: 139000 - DNA, 942 bp, Artificial Sequence
  Description of Artificial Sequence: Synthetic coding sequence
atggagccagagcggtgtagaatccagacagagtttaaccagctccggaacattctcgacagagtggaacaaagggagttgaaaaagctcgagcaggaggagaagaaggggcttcggattatcgaggaggccgaaaatgatctggttcatcagacacaatctctgcgcgaactgatcagtgacctggaacgcagatgccagggttctacaatggagctgctccaggatgttagtgatgtgaccgaacgatcagagttctggactctgcggaaacccgaggctctgcctaccaaactgaggagcatgttccgagcccccgatctgaagcgcatgcttcgtgtgtgccgtgagctcaccgatgtgcagtcatactgggtggatgtcaccttaaatccacatacagctaatctgaatttggtcctcgcaaagaataggaggcaggtcagatttgtcggggccaaagtatccggtccgtcatgtctggagaaacattacgactgtagtgtgctggggtctcagcattttagcagcggaaagcattactgggaggtggacgtagctaaaaagacagcatggatcctcggggtgtgtagtaatagcctgggccccactttttcttttaatcacttcgctcaaaatcactctgcctattcaagatatcagccccagtccggttattgggtgatcgggttacaacacaatcacgaataccgcgcctacgaagacagtagcccatcattgttgctgtctatgacagtaccgccgcgccgcgtcggagtttttctcgattacgaagccgggacagtgagcttctacaatgtgacgaatcacggcttccccatatacactttttcaaagtattacttccccacaacattgtgcccatattttaacccttgcaattgtgttatccctatgacacttcggcgaccttcctcttag

SEQ ID NO: 139001 - DNA, 3651 bp, Artificial Sequence
  Description of Artificial Sequence: Synthetic coding sequence
atggcccgcaattgctccgaatgcaaggaaaaacgggccgcccatatcctgtgtacctactgcaatagatggctttgtagcagttgcacagaagagcaccggcattctcccgtacccggaggcccgttctttccacgagcacaaaagggctccccaggggtaaatggcgggccaggcgacttcacgctatattgtcctttgcacacccaggaggtgctgaaactgttctgcgagacatgcgacatgctcacgtgtcatagctgcttggttgttgaacacaaagagcatcgatgtcgacatgtggaggaggtgttgcaaaatcagcgaatgctgctagaaggcgtcacaacccaggtagcgcataagaaaagctcgctgcagacatcagccaagcaaattgaggatcggatattcgaggtgaaacaccagcatagaaaggtagagaaccagatcaagatggcgaagatggtacttatgaacgaactcaataaacaagccaacggcctcatcgaagagctggaaggcataacaaatgagaggaaacgtaaattggagcagcagctgcagagcattatggtcctcaatagacagtttgagcacgtccagaatttcattaattgggccgtatgctctaagacctcagtgccatttctgttcagcaaagaactgatcgtgttccagatgcagcggctgcttgagacctcctgtaatactgaccccgggtctccctggtcaattaggtttacttgggagcccaacttctggactaaacaattggccagcctcgggtgcatcacaaccgagggtgggcagatgagccgagccgacgctcccgcgtatgggggcttgcagggaagcagcccgttttaccagtctcaccagagtcctgtcgcccagcaggaggccttgagtcacccatcgcacaaattccagagccctgctgtttgcagctcttcagtgtgttgttctcactgcagccctgttagcccatcccttaaaggccaagtcccgcccccatctatccacccagcacattcctttcgacagcccccagaaatggtgccccaacagcttgggagtctacaatgtagcgcactactccctcgggagaaagaactggcttgcagccctcacccgcctaagctcctgcagccgtggctcgaaacccagccacccgtcgagcaggagtcaacatcccaaaggctggggcagcaattaacctcacaacccgtgtgcattgtgccaccacaagatgtccagcagggcgctcatgcacaaccaactctccagaccccaagcatccaggtccagttcggtcaccatcaaaagctgaaactttctcattttcagcaacagccgcagcagcagctccccccgccgcctccacccttgccccaccccccaccgcccctacctcctccaccccagcagccccacccacccctcccgccgtcacagcacctcgcgtcttcacagcacgagtctccaccgggccccgcctgtagccagaatatggatatcatgcaccataagttcgagctagaggagatgcagaaggatctagagctcctcctacaagcacagcaaccctctttacagctttcccagaccaaaagtccccagcatctgcagcagacgatcgtgggccaaatcaattacatcgttcgccagcccgcacctgtgcagagtcagagccaggaagagactctccaagcaactgacgagcctccagctagtcaggggagcaagcccgctttacccctggacaaaaataccgccgccgcgttgcctcaagcctcaggcgaggagacccctctgtcggtgccccctgtagactctactatccagcattcttcccccaacgtggtgagaaagcactcaaccagcctttctatcatgggatttagcaacacgcttgagatggaactgtcctctacaaggttggaaaggcctttagagccgcagatccagagtgtgagcaatcttacagccggagcaccacaggccgtgcctagtctgttgtcagctcctcccaaaatggtgagtagcctaaccagtgtacagaaccaggctatgccaagcttgactacttcccacttacagaccgtgcctagtctggtgcacagtacgttccagtcaatgccgaacctaatctccgatagcccgcaggccatggcctcacttgcgtcggaccatcctcaggccgggccatctctgatgtctggtcacacacaggcagtgccttccttggccacctgtccactacagtctattcctcccgtgtcggatatgcagccagaaactggatcatcatcctcatctggacgcacctcgggctctttgtgtccccgagacggcgctgatccaagtctggagaatgctctgtgcaaagtcaagctggaagaaccaatcaatctcagcgtgaagaaacctcccctagctcctgtggtgtctaccagcactgctctgcagcaataccagaacccaaaggaatgcgagaactttgaacagggagccctggagctggatgccaaagaaaatcagagtatcagggcatttaacagcgagcacaagatcccttacgtaaggctggaacggctcaaaatatgcgccgcctcctctggcgagatgcccgtctttaagctcaaaccacaaaagaatgatcaggacggtagctttttgctaataatcgagtgcggaacggagagctcctcgatgagcattaaagtctctcaggaccgactgagcgaggcgacacaagcacccggtctcgagggacgtaaggtgaccgtaaccagcctggcaggccagaggcccccagaagtggaggggacctctcctgaggagcaccggttgatcccaagaacacctggagctaaaaaagggccaccagcgccaattgagaacgaggatttttgcgcagtgtgtctgaacggaggagaactcttatgctgcgatagatgtcccaaagttttccatctgtcctgtcacgtgcccgccttgctgagcttcccaggcggcgaatgggtttgcactctctgccgcagcctgacccaaccggaaatggaatacgactgcgagaacgcttgttataatcaacccggcatgagggcttcacccggactgagtatgtacgatcagaagaagtgcgaaaaacttgtgctgtctctgtgctgtaataatctctctttaccattccacgaacctgtctcccctctcgcccgccactactatcagattatcaagaggcccatggacctgtctataattagacggaaacttcagaagaaagatccagcacattacaccacaccggaagaggtggtctcagatgtcagactaatgttctggaactgcgcgaagtttaactaccccgattcagaagtggctgaggcaggccggtgcctggaggttttttttgagggctggctcaaggagatttatcctgagaaacgatttgcccagccaaggcaggaagattctgactctgaagaagtttcatcagagagcgggtgcagcaccccacagggattcccgtggccgccctatatgcaggaaggtattcaaccaaaaaggaggagaagacacatggaaaacgagcgcgccaagcgcatgtcttttaggcttgcaaactctatttcgcaagtgtag

SEQ ID NO: 139002 - DNA, 1458 bp, Artificial Sequence
  Description of Artificial Sequence: Synthetic coding sequence
atggatcctactgccctggtggaggctattgtggaagaagtggcttgtcctatctgcatgacttttcttcgtgagcccatgtcaatagactgtggacactccttttgtcactcttgcctcagtggcttgtgggaaattcctggagaatcccagaactgggggtacacatgtcctctgtgtcgcgccccagtgcagcctagaaacctccgaccaaattggcaactcgccaatgtggtggagaaagtgcggcttctgcgcctgcatcccggaatggggctgaagggagacctgtgcgaaagacacggggaaaaactgaaaatgttctgcaaggaagatgtgcttataatgtgcgaggcctgttctcagagccccgagcatgaagcccactctgtggtgcccatggaagatgtcgcttgggaatataagtgggagctgcacgaagcacttgaacatctgaagaaggagcaggaggaggcctggaaactggaggtgggggagcggaagcgtacagccacttggaaaattcaagtagaaacaagaaagcagtctattgtttgggaattcgagaagtatcagcgactcctggaaaaaaaacagcctccacaccggcagctgggggcggaggtcgccgcggctctcgccagcttacagcgggaagctgctgaaacaatgcagaagctcgaactgaaccattccgaactgattcagcagtctcaagtgctgtggagaatgatcgccgaattgaaggagcgctcccagaggcctgtcaggtggatgctccaagacatccaggaagtcctaaacaggagtaaatcctggagtctgcagcaaccagaaccaatatccttggagctgaagacagactgcagagtgcttggactgagagaaatactgaagacatacgccgctgatgtccgtctagatcctgataccgcctactcgagattaatcgtgtcagaagatcggaaacgggtacactatggcgacaccaatcaaaaactccctgacaatccggaacgcttttaccggtataacatcgtcctgggttctcagtgtataagcagcggacggcattattgggaggtcgaagtaggtgatcggtctgagtggggactcggcgtctgtaagcagaacgtagacagaaaagaagtggtctatctatctccccactacgggttctgggtgattagacttcggaaaggaaacgaatatcgcgcaggcacagatgagtacccaatcctatcgttacccgtgcccccccgccgcgttggaatcttcgttgactacgaggctcatgacatttccttctataacgttacagactgcgggtcacacatctttactttccccagataccccttccctgggaggctgctcccctatttctccccctgttactccatcggaacgaacaacacagccccgttggcaatctgctcgctggacggcgaggattag

SEQ ID NO: 139003 - DNA, 621 bp, Artificial Sequence
  Description of Artificial Sequence: Synthetic coding sequence
atgcagaaactagagctgaaaaccgattgccgggtgctgggattgcgcgaaatcctgaaaacttacgccgcagacgttagactggatcccgatacagcatactctcggctcatcgtgtccgaggaccgtaagagggtccactatggagacaccaatcagaagctgccggataacccagaaagattttacaggtacaatattgtgctgggatcccaatgcatcagttccggtcggcactattgggaggtagaggtcggagacaggtcagagtgggggcttggagtctgtaagcagaatgtcgatagaaaggaggtggtatacctttctcctcattatgggttctgggttataagactgcggaaagggaacgaatacagggccggtaccgatgaatacccaatcctctccttgcctgtgccacctagacgagtgggcatattcgttgactatgaagcacatgatatatccttttataacgttacggactgcggcagccacatcttcacctttccaagatatccgttccctggacgactcctgccctatttctcaccctgctactccatcggaaccaacaacacagcgccattggccatatgctcccttgacggcgaagattag

SEQ ID NO: 139004 - DNA, 1536 bp, Artificial Sequence
  Description of Artificial Sequence: Synthetic coding sequence
atggcggctgtcgggcccagaacaggcccaggcaccggagctgaagccctggcccttgccgcagagctgcagggcgaggcgacctgtagtatttgcttagagctctttcgcgaacccgtatcggtggaatgcggacatagtttttgtagggcctgcatcggtcggtgctgggaaaggccgggtgctgggtctgttggcgctgccacgcgagctcccccgttccctcttccttgtccccagtgccgagaacccgcacgtccttcacagcttaggcctaatagacagctggcggccgtcgctaccctgcttagaagattttctctcccagcggctgctccaggcgaacacggctcacaggcagcagcagcgcgggctgctgccgctcggtgtgggcagcacggtgagccctttaagctatattgtcaggacgacggtcgcgctatctgcgttgtctgtgatcgcgcccgggaacatcgcgaacatgcagtgcttcccttagatgaggctgtgcaggaggcaaaggaactgttggaaagccgtctgagggtgctgaagaaagagttagaggattgcgaagtgttcagaagcaccgaaaagaaagagagcaaagaactcctgaagcaaatggccgcagaacaggaaaaagtaggcgcagagttccaggcactgcgagccttcctggttgagcaggagggacgcttacttgggcgactcgaggagttatccagggaagtggcccagaagcagaacgagaatctggcccagttaggtgttgaaattacccagctctctaagttgtcttcacagattcaggaaacagcccagaaacccgaccttgactttctgcaggaattcaaaagcactctttctcgctgcagtaatgttcccgggcccaagcctacaaccgtttcttctgagatgaagaacaaggtgtggaatgtctcgctgaagacctttgtccttaagggaatgcttaaaaagttcaaggaggacctgagaggcgagctcgaaaaagaggaaaaggtcgagttgacacttgaccctgatacagctaacccccgcctcatactctctttggacctcaaaggggttcggttgggtgagcgcgcccaagacctgcctaaccatccttgccggttcgacaccaacactcgagtgttggccagctgtggcttttcgagcggacggcaccattgggaggtggaggtggggagcaaagatgggtgggcttttggagttgcacgagaaagtgttcggcgtaaagggctgaccccattcactcccgaggagggggtatgggcgttgcagctgaatggtggccagtactgggccgtaacctccccagaacggagccctctctcatgtggacacctgtcgagagtaagggtcgcattagacctcgaagtgggtgccgtctctttttatgctgtggaggatatgagacatctgtatacttttcgggtcaacttccaggagcgcgtgtttcctctattcagcgtgtgctcgaccggtacttatctacggatatggccttag

SEQ ID NO: 139005 - DNA, 666 bp, Artificial Sequence
  Description of Artificial Sequence: Synthetic coding sequence
atggcggccgtgggcccgcgaacagggcctggtaccggagccgaggccctcgccctggccgcagaactgcagggagaggccacatgcagcatctgcctggaacttttcagggaacccgtatctgtggaatgtggacactctttctgtcgggcctgcattggccgctgttgggaaagacccggggctgggtcagtgggcgcagccacccgagctccacctttccctctgccctgcccacaatgccgggaacctgctcgcccctctcagctccgccctaataggcagctcgccgccgttgccacactgctgcggaggttttcactaccagcagccgcccccggggaacatggctcgcaggccgctgctgctcgcgcagcggccgctagatgtggacagcatggcgagccatttaagctctattgccaagacgatggcagagcaatttgtgtggtctgtgatcgcgctagggagcatcgcgaacacgccgtgctcccacttgacgaagcggtccaggaagccaaggaacttctcgaaagtaggttgcgcgtattgaagaaggagctggaagactgcgaagtctttaggtcaaccgaaaaaaaggagagcaaagaactgcttgtgagccaggcacccgcgggccccccctgggacatcacagaggcttag

SEQ ID NO: 139006 - DNA, 912 bp, Artificial Sequence
  Description of Artificial Sequence: Synthetic coding sequence
atggcagcagaacaggagaaggtgggagccgagttccaggccctccgagccttcttggtagaacaggagggcagattactgggccggctggaggagctgagtcgcgaggtcgcacagaagcaaaacgaaaacctggctcagcttggcgtggaaattacgcagctgtctaaactgtcttcacagatccaggaaacagcccaaaagccagatctggatttcctgcaggaattcaaatccacactatctcgatgctccaatgtgcccgggcccaaacccaccactgtgagctcagagatgaagaataaagtgtggaatgtttcactgaagaccttcgttcttaagggaatgctgaagaagtttaaggaggatctgcgtggcgaactagaaaaagaggagaaggtcgagttgacactggatccagataccgcaaatccaagattgattctgagcctggatctcaagggcgtgaggctgggagagagagcccaggatctccccaatcatccctgtagattcgacacaaatacccgagttctggccagttgcggcttctcatctggacgccaccattgggaggtcgaggtgggatcgaaggacggatgggcatttggggtcgcacgggagtccgtgagacgcaagggactaactccatttacacctgaggagggcgtctgggcgctccagttgaatggaggccagtactgggccgtgacttcacctgagaggtcaccactgtcctgtggtcacctctcccgcgtgagggttgctcttgacctagaggtgggcgccgtctcattttatgcagttgaagatatgcgacatctctatactttcagagtgaatttccaggaacgagtgttcccgctctttagcgtgtgtagcactggcacttatctccgtatctggccttag

SEQ ID NO: 139007 - DNA, 912 bp, Artificial Sequence
  Description of Artificial Sequence: Synthetic coding sequence
atggccgcggaacaggaaaaggtgggagccgagttccaggcccttagggcattcttagtggagcaagaaggacggctgcttggcagacttgaagaactgtctcgggaggttgctcaaaagcagaacgaaaatctggcccagctcggtgttgagattacccagctgtccaagcttagcagtcagattcaagaaacagctcagaaaccagaccttgattttcttcaagagttcaagagcaccttgagtagatgcagcaacgtgcccggtccaaagcccacgaccgtttcaagtgaaatgaagaataaagtctggaacgtgtctcttaaaacgttcgtgcttaagggaatgctcaaaaagttcaaggaagacttgagaggtgaacttgagaaggaagagaaagtcgagttgacacttgatcccgatactgccaatccccgattgattctgagcctcgacctgaaaggcgtccgcctcggcgaaagggcacaggatctcccaaaccatccatgccggtttgacaccaacacaagagttttagccagttgtggcttctccagcgggagacatcactgggaggtcgaggtaggaagtaaggacggttgggccttcggtgtagcgcgtgagtccgtccgacgcaagggcctcacccccttcaccccagaggaaggtgtgtgggcactgcaactgaacgggggccagtattgggccgtgacaagccctgagcgctctcccctgagctgtggccatctctcaagggtgagagtggcactggacctggaagtgggtgccgtgtcattttacgcagtggaggatatgcggcacttgtacaccttccgggtaaatttccaggagagggtgttccccttattttctgtctgcagcaccggtacatatctcagaatctggccctag

SEQ ID NO: 139008 - DNA, 990 bp, Artificial Sequence
  Description of Artificial Sequence: Synthetic coding sequence
atgacccaagcaaccggtcaaatgctctgtctgcatgttcaggttcccttacagctgctgcttctcggtcagaaacaaatggccgctgaacaggagaaagttggcgccgagtttcaggcgctgagggcattccttgtggagcaggagggtcgactgctgggtcgcctcgaagaactcagcagggaggtggcacagaagcagaacgagaacttagcacagctcggagtcgaaataactcagctttccaaactcagctctcagattcaggagaccgcccagaagcccgatctcgacttcttgcaagaattcaaaagcaccctgagccgatgttccaacgtcccaggacccaaacccaccaccgtttcctctgaaatgaagaacaaagtttggaacgtctccctgaagactttcgtgttaaagggcatgctgaaaaagtttaaggaggacctcaggggtgagctcgagaaggaagagaaagtggagttgacactagatccagatactgcgaatccacgcttaattcttagccttgacctgaagggtgtgcgcttaggagaacgcgcgcaggacctgcccaatcacccttgtcgatttgacaccaataccagagttctggcaagctgtggattctcgtctggtaggcaccactgggaggttgaagtgggtagtaaagatggttgggcattcggggtggctcgggagtcagttaggaggaagggcctgacccccttcacaccagaagagggagtctgggccttgcaactcaacggcggccagtattgggccgtgacctctcccgagcgtagtcccttatcatgtggacatttgagtcgggtcagggtggctctggatttggaagtgggtgctgtaagtttttacgccgtggaagacatgcggcatctctatacattccgcgtgaatttccaggagcgggttttcccgctctttagtgtctgctccactgggacgtatcttcgcatctggccgtag

SEQ ID NO: 139009 - DNA, 912 bp, Artificial Sequence
  Description of Artificial Sequence: Synthetic coding sequence
atggcggccgagcaggaaaaggttggcgcggagtttcaggcattacgtgcattcctagtggagcaggaggggcgcctactgggcagactggaggagctgtcccgcgaggtggcccaaaagcagaacgaaaatttggcccagctcggcgtggagattacccagctaagcaaactgtcctctcaaatccaagaaaccgcgcagaagccggatctcgatttcctgcaggagtttaagagcaccctttctaggtgctccaatgtgcccggccctaaacccactacagtgtcttccgagatgaagaataaagtctggaatgtctcattgaaaacattcgtcctgaagggcatgttaaagaagttcaaagaagatttaagaggtgaattagaaaaggaggagaaagttgaattaaccttagaccctgatacagctaacccaaggcttatcctctctctggatctgaaaggcgtacgcctgggagagcgcgctcaagatttacccaaccatccttgtaggttcgacaccaacacccgggtgttagccagctgcggcttcagttccggccggcatcattgggaagtagaagttggctctaaggacggatgggcattcggagtggcccgggaatccgtacgcaggaagggtcttactcccttcacacctgaggaaggcgtctgggcactccagcttaacggaggccagtattgggcagtgacatcaccagaacggtctccgttatcttgcggccatctgagccgggtaagggtcgctctcgatctggaggtcggtgccgtttccttttacgccgtcgaggatatgcgacacctgtacacttttcgagtcaactttcaggaacgcgtctttcccttgttctccgtgtgttccacaggaacttatttaaggatctggccctag

SEQ ID NO: 139010 - DNA, 1434 bp, Artificial Sequence
  Description of Artificial Sequence: Synthetic coding sequence
atgtctgcggcccctggtcttctgcatcaggagctttcttgcccactctgtcttcagctctttgacgccccggtgacagctgagtgtggtcattcattctgtcgcgcctgtcttggcagagtcgccggcgagcccgctgctgacgggacagtgctttgcccctgctgccaggcgccgactcggccccaggccctgtccactaaccttcagcttgccagactggtggaggggctcgcacaggtgccccagggacactgcgaggaacatctcgacccactgagcatttactgtgaacaagatcgcgcactagtgtgcggtgtgtgcgcatcacttggcagccatcgaggacaccgactgctgcctgcagccgaagcccacgctcgactaaaaacacagctgccccagcagaagctccagctgcaggaggcctgcatgcgcaaggaaaaatctgtcgcggtgctcgaacaccagctggttgaagttgaggagactgtaagacaattcaggggagcggtgggcgagcagctgggcaaaatgcgggtcttcctggctgcactggaaggatcgctcgatagggaggccgagcgggtccggggcgaagccggagttgccttaaggcgcgagcttggcagcctaaacagctaccttgagcagctgaggcagatggaaaaagtcctcgaggaggtcgccgacaagcctcagacggagtttctgatgaagtactgcctagtgaccagccggctacagaagattctcgcggagtccccccctcccgcccgccttgatatccagctgccaataatttcagacgactttaaattccaggtctggagaaagatgtttcgggcgttaatgcctgcgttagaggagctgactttcgatccctcctccgctcatccatccctcgtggtgagctcgtctggcaggcgagtggagtgctccgaacaaaaagccccgccagccggggaggatccacggcagttcgataaggcagtggccgtcgtggcccaccagcagctcagtgagggggaacattactgggaggttgatgtcggagacaagccaaggtgggccctgggggttattgccgcagaggcaccaagacgaggccgccttcatgcagtgccatctcagggcctatggctgctcgggctgagagaaggcaagatcctggaggcccatgtagaagcgaaagagccccgggcccttaggtcaccagagcgacgccctacgcggatcggcttgtacctgtcttttggggacggcgtgctgtcattttacgatgcgtccgacgcggacgctctagtgcctctgtttgccttccatgagagactgccacggccagtatacccattctttgatgtgtgttggcacgacaaggggaaaaacgctcagcctctgctcctcgtggggcctgaaggtgcggaggcctag

SEQ ID NO: 139011 - DNA, 753 bp, Artificial Sequence
  Description of Artificial Sequence: Synthetic coding sequence
atggcctggcaggtcagcctacttgaacttgaggaccggttacaatgccctatatgtctagaggtttttaaggaaagcttaatgctgcagtgcggacactcttactgcaaggggtgcctggtgtccctctcttaccacctggataccaaagtcagatgtcccatgtgctggcaggttgtcgacggctccagttcgctaccgaacgtatccctggcgtgggttatcgaggccctgaggctccctggtgaccccgagccaaaggtttgcgttcaccatcgcaaccccttgagcctgttttgcgagaaggatcaggaattaatatgcggattgtgcgggttgctgggctcgcatcaacaccatcctgtcacccccgtgtccaccgtgtgttccagaatgaaggaggagctcgccgcattgttctctgagttgaagcaggagcaaaagaaagttgacgagcttatcgcgaaactggtgaaaaataggactcggattgttaacgagtcggatgtgttctcgtgggttatccgaagggaattccaagaacttcgacatcctgtggatgaagagaaggcaaggtgcctggaaggaatcggaggccatactcgagggttggtcgcaagcctcgatatgcagcttgaacaagcacaggggacaagggaaagacttgcacaggcagaatgtgtcctcgagcaattcggaaacgaagatcaccatgaattcatatggaaattccacagcatggcgtctcgttag

SEQ ID NO: 139012 - DNA, 849 bp, Artificial Sequence
  Description of Artificial Sequence: Synthetic coding sequence
atggcttggcaggtcagtctgctggagctcgaagaccggctacaatgtccaatctgtctggaagtgttcaaagagtctctgatgctacagtgtgggcattcttactgtaagggctgcttggtgtccctcagctaccaccttgataccaaggtgcgatgtccgatgtgttggcaagtagtggatggttcaagcagtttaccaaacgtgagtctggcttgggtgatcgaagcgctgcggctccccggcgatcccgagcctaaggtttgcgtgcaccaccgcaacccactgtccctgttttgcgagaaggatcaggagctcatctgcggcctctgtgggctgctgggctcccaccagcaccacccagtgaccccagtctccaccgtctgttccaggatgaaggaggaattagccgcgttattctccgaacttaagcaggaacaaaagaaggtcgacgagctgatcgctaagctggtcaagaataggacccgaatcgtcaatgagagcgacgttttctcgtgggttattcgtagggagttccaggaacttaggcatcccgtcgatgaagagaaagcaagatgccttgagggcattgggggccatactcgtggcctcgtggcctctctggatatgcagttggaacaggctcaggggactcgtgagagactggcacaggccgagtgcgtcttggagcagttcggtaatgaagaccaccatgaattcatctggaagtttcactctatggcaagcagattaaccaaaaccgaagaacttgagaaaaagtggcggaacggcctggctgcctcccattctctcccacaacaggtccgcccccagaggcgcacaccatag

SEQ ID NO: 139013 - DNA, 753 bp, Artificial Sequence
  Description of Artificial Sequence: Synthetic coding sequence
atggcatggcaggttagcctgcttgagcttgaagaccggttgcagtgtccgatctgcttagaggtgtttaaggaatccctgatgcttcaatgtgggcactcttactgtaagggttgtctcgtcagtctgagctaccacctggatactaaggttagatgcccaatgtgctggcaagtggtagatgggtctagctctttgcccaacgtgagtctggcctgggtaattgaggccctacgcctgcctggggaccccgagcccaaagtttgtgtgcaccatagaaatccgctttcgctgttctgtgagaaggaccaggaactgatctgcggcctatgcggcctcctgggttcccaccagcatcaccccgttacaccagtctccacagtgtgttcccgcatgaaagaggagttagccgcactgttcagcgagctcaagcaagaacagaagaaggttgacgagttgattgccaagcttgttaaaaaccgcaccagaattgtgaatgagtctgacgtttttagctgggtgatacgtagagaatttcaagagctgaggcacccggtggacgaagaaaaggctagatgcttagaaggcatcggcgggcacacccgtggcttagtggcttctctcgatatgcagctggaacaggcacagggaactagggagcgactggctcaggcagagtgcgtgttggagcagttcggcaacgaggaccaccacgaatttatctggaaatttcatagcatggctagcagatag

SEQ ID NO: 139014 - DNA, 750 bp, Artificial Sequence
  Description of Artificial Sequence: Synthetic coding sequence
atggcttggcaagtaagtctgttagaactggaggacaggttgcaatgccctatatgtcttgaagtttttaaagagagtctcatgttacagtgcggtcattcctactgtaagggatgcttggtgtccctgagttaccatctcgatacaaaggtgcgatgcccaatgtgctggcaggtcgtcgacggcagctcctcgcttccgaacgtctcacttgcctgggtaatagaggctctccgcttgccgggagatcctgagcctaaggtgtgtgtccaccaccggaatccactgtccttgttttgcgagaaagaccaggagctgatatgtggcctgtgcggactgttgggatcccatcagcaccatcccgtgactcccgtatccaccgtctgtagtaggatgaaagaggagttagccgcgctgttcagtgagctgaagcaggaacagaagaaggtcgacgaattgattgcgaagctggttaagaaccgaacccggattgtcaatgagagtgacgtctttagctgggtcatccgtagggaattccaggagctgcggcatccagtcgacgaggagaaggctcggtgcctggagggaatcggcggccacacaagaggccttgtggcaagcctcgacatgcagctggagcaggcccaggggacacgcgagcgtctggcgcaggccgagtgcgtgctggagcagttcggtaatgaggatcaccatgagttcatctggtttcatagcatggccagcagatag

SEQ ID NO: 139015 - DNA, 753 bp, Artificial Sequence
  Description of Artificial Sequence: Synthetic coding sequence
atggcctggcaggtatctcttctggaactggaagattggcttcagtgccctatctgcctggaggtgtttaaagagtcccttatgctgcagtgcggacattcatattgtaagggatgtctggttagcctctcgtaccaccttgacaccaaagtgcggtgccccatgtgttggcaggtggtggacggatcctccagcctgcctaacgtgtccctcgcctgggtcatcgaagcactgagactccctggtgaccccgaacccaaggtttgcgtgcaccataggaacccccttagtctgttttgcgaaaaagaccaggaattaatttgcggcctgtgtgggctcctcggctcacaccagcaccatccggtgactcctgtgagtactgtgtgttctagaatgaaggaagagctcgccgctttgttctctgaactgaaacaagaacagaaaaaggtggacgagctcatagcaaaactggtaaagaaccggacgcgcatcgtgaacgagagcgatgtgtttagctgggttattcggcgcgagttccaggagctcaggcacccagtggacgaggaaaaggctcggtgcttagagggaattggaggccacacccggggactggtggcatccttagacatgcagctagaacaggcccaaggtacccgcgagcggctcgcccaagcagagtgtgtgttggagcagttcgggaacgaagaccatcacgaattcatctggaaattccattccatggccagccggtag

SEQ ID NO: 139016 - DNA, 750 bp, Artificial Sequence
  Description of Artificial Sequence: Synthetic coding sequence
atggcatggcaggtgtccctgttggaacttgaggattggctccagtgtccaatatgcttagaggtgtttaaggagtccctgatgcttcagtgtgggcactcttattgcaagggatgtttggtttccctcagttaccatcttgacacaaaggtgaggtgtcccatgtgctggcaggtggtagatggctcttcttcactgcccaacgtgtcactagcttgggtgatcgaagcacttaggctccctggagaccctgagcccaaggtctgcgtacaccacagaaatccacttagcctcttttgtgagaaagaccaggaactgatttgcggcctctgcggtctgctggggtcacaccagcaccatcccgttactcctgtgagcaccgtgtgttctcgaatgaaggaggagctcgccgcactgtttagtgagctcaaacaagagcagaaaaaggtagacgagcttattgctaaactggtaaagaacagaaccagaatcgtcaacgaaagtgatgttttctcctgggtcattcggcgggaatttcaagagctgcggcacccagtggacgaagaaaaagctagatgtctcgaaggaatcggaggccacacacgtgggctggtggcaagcctcgacatgcaactggaacaggcccagggaacgcgagagagactggcacaggcagagtgtgtcttggagcagttcgggaatgaagatcaccacgagtttatctggtttcatagtatggcctccaggtag

SEQ ID NO: 139017 - DNA, 1656 bp, Artificial Sequence
  Description of Artificial Sequence: Synthetic coding sequence
atggccgaaaattggaaaaattgtttcgaagaggaacttatctgcccaatctgcttgcatgtcttcgtggagcctgtgcagctaccatgcaaacacaacttttgcaggggctgtataggtgaggcctgggccaaggacagcgggctggtgaggtgtccagaatgtaatcaggcctataaccagaagcctggccttgagaagaacctaaaactgaccaacattgtggagaaattcaatgccttgcacgtggaaaaacctcctgccgccctacactgcgtgttctgccggagaggcccgcctctgcccgcacagaaggtgtgtcttaggtgcgaggctccctgttgtcagtctcatgtacagacccatcttcaacagcctagtactgcccgcggccatttgctggtcgaagcggacgatgttcgagcctggagctgcccacagcataacgcctatagactctatcactgtgaagccgagcaagtggctgtgtgtcaatattgctgttattattccggagctcaccagggccactctgtgtgcgatgttgagattcgcagaaacgagatccgtaagatgctgatgaagcagcaggaccggctagaggagcgtgagcaagacatagaagaccaactgtataagcttgaaagcgataaacgcctcgtggaagaaaaagtgaaccagcttaaggaggaggttcggcttcagtacgaaaaactgcaccagctgctcgatgaggatctcagacagaccgttgaggtgctagacaaagctcaggccaagttctgtagtgaaaacgccgctcaggcccttcacctcggagagcgcatgcaggaagcaaagaagctcctcggttctttgcagttattgtttgacaagaccgaggatgttagcttcatgaagaatacaaaatcagtgaaaatcctgatggacagaactcagacctgtaccagttccagcttgtcccccactaaaattgggcacttgaatagcaagttgttcctgaatgaagtggctaagaaagagaagcaactgagaaagatgctggagggaccgtttagtacgccggtgccgttcttgcagtcggtgccactctatccttgcggagtgtcatcttccggagcagagaagcggaagcacagtactgcattccctgaagcctcgtttctggaaacctcctccgggcccgtcgggggccaatacggagccgccgggacagcatcgggcgaaggccagagcggacaaccactggggccatgctcctcaacccagcaccttgttgcgttgcctgggggcgcgcagcctgtgcatagtagcccagtgtttcctcccagccagtacccgaacggttccgcagcccaacagccaatgctgcctcagtacgggggcaggaagattctcgtgtgttctgtagacaattgttactgctccagtgtggcaaaccacggcggccaccagccataccctagaagcggacattttccgtggactgtgccctctcaggagtatagtcatcctctgcctcccactccctcagtgccccagtcattaccttctctggcagtgagagactggctggacgcctcccaacaaccgggtcatcaagatttctacagggtgtacggacagccgtcaactaagcactatgtgacctcttag

SEQ ID NO: 139018 - DNA, 1653 bp, Artificial Sequence
  Description of Artificial Sequence: Synthetic coding sequence
atggctgaaaactggaaaaattgttttgaggaggagctgatttgcccaatctgcctgcacgtgtttgtcgaacccgtgcagctaccatgtaaacacaacttttgtagaggctgcatcggtgaggcctgggctaaggatagcgggctggtgcgctgccctgagtgcaatcaggcctataatcagaagccaggtctggagaagaacctcaagttaacaaatattgtggaaaagttcaatgccctgcacgtggaaaagccaccagctgcattgcattgcgtgttctgccggaggggcccaccattgcccgcccaaaaggtatgtttgcggtgcgaggcaccctgttgtcaaagccatgtgcagacccaccttcagcagccctcaacggcacgggggcatctgcttgtcgaagcggatgatgtgagagcatggtcctgtccccagcacaatgcataccggctctatcattgcgaggccgaacaggtggccgtttgccaatactgctgctattactccggggctcatcaagggcattccgtctgtgatgttgagattaggagaaatgagattcggatgctgatgaagcagcaggacaggttagaagagcgcgaacaggatattgaggaccagctatataaacttgaatccgataagcgcttagtggaagagaaagttaaccagttgaaagaagaagttcgtctacagtacgaaaaactccatcaactgctggatgaggacctccgccagactgtggaagtcttagacaaggcgcaggcgaagttttgctcagaaaacgcggctcaggctctgcacttaggagagcggatgcaagaagctaaaaagttgctgggttctctccagttgctctttgataaaacagaggatgtgagcttcatgaaaaatactaagtccgtcaagattctgatggaccggactcagacgtgcacgtcctctagtttaagcccaacaaaaatcgggcatctgaatagcaaacttttcctcaatgaggtagctaagaaagaaaagcagctgcggaaaatgctggaaggcccgttctccaccccagttccgttcctgcagtctgttcctttatatccctgcggcgtaagcagctcaggcgctgaaaagcgaaaacattctacagcattccctgaggcgtcatttctcgagaccagttctggccctgttggaggacagtacggtgcagcaggcaccgcttcgggggagggtcagagtgggcaaccactcgggccctgcagcagcacgcagcacctggtggcacttccgggcggggcccagcctgtccatagctctccggtgttcccgccaagccagtatccaaacggctccgctgctcagcagccaatgcttccgcagtacggcgggcggaagattctggtgtgcagcgtcgataattgctactgtagctcagttgctaatcatggcggacaccaaccttacccccggtctgggcattttccttggacagtgccctctcaggagtactctcaccccctgccccccacgccttcggtgccccaatctctgcctagcttggccgtgcgggactggttggatgcctcccagcaaccggggcaccaggatttttacagggtatacgggcaaccctctacaaaacattatgtgacctcatag

SEQ ID NO: 139019 - DNA, 2133 bp, Artificial Sequence
  Description of Artificial Sequence: Synthetic coding sequence
atggaggaaatggaggaggaactgaagtgtccagtttgcggttccttttatcgcgagcccatcatcctgccttgctcccataacctttgtcaggcttgtgctcgcaacatcttggttcagactccggaaagcgaaagccctcagagccatagggcggccggtagtggggtcagtgactatgattatcttgacctggacaaaatgtctttgtacagcgaggcagattccggctacggctcctacggcggctttgcatccgcacccactacaccctgtcagaagtctcccaatggcgtgcgggtgttccctcccgcaatgccacctcctgcaactcatttgtctcccgcactcgccccagttccgcgaaattcctgcattacatgcccgcagtgtcatcgctccctgatcctggatgaccgaggtttgagaggattcccgaaaaacagagtcttagaaggggttattgaccggtaccagcagtccaaggcggccgccttgaagtgtcaactgtgcgaaaaagcccctaaggaggctaccgtcatgtgcgagcagtgcgacgtattctattgtgatccctgcaggctgcgctgtcaccctccacgtggcccgctagctaagcacaggctcgtcccaccagcccaaggaagggtgtcaaggaggctgtcacccaggaaagttagcacatgcaccgatcacgaattagagaatcacagtatgtactgtgtgcagtgcaagatgccggtctgttaccagtgtctggaggagggcaaacacagtagtcatgaagtcaaagctctcggggccatgtggaaactccataaatcgcagctgagccaagctttgaatggcttgagcgacagggcgaaggaggctaaagagtttctcgtgcaactcagaaatatggtccagcagatccaggagaattctgttgagtttgaagcctgcctggtggcgcaatgcgatgccctgatcgacgcactgaaccgtcgtaaagcacagcttctcgcacgcgtgaacaaggaacacgagcacaagttaaaagtggtacgggatcagatctctcactgtacggttaagctcaggcagactactgggctgatggagtattgcctggaggtgattaaggaaaacgacccaagcggtttcctgcagattagcgacgcactaatcaggagggttcacctgaccgaggatcagtggggaaagggcactttgacccctaggatgactactgacttcgacctgagcctggacaactctccccttctccagagtattcatcagcttgatttcgtgcaagtgaaggcttctagccctgtgcccgcaactcccatcctgcagctggaagaatgctgcacgcacaacaattccgctaccctgtcctggaaacaaccccctctttctactgttcctgctgatgggtacattctggagcttgacgacgggaacgggggacaatttagggaggtgtacgtaggtaaagagactatgtgcactgtggatgggttgcattttaactcgacctataacgcgcgggttaaggcttttaataagacgggcgtgtctccctacagtaagacccttgtcctccagaccagcgaggtcgcatggttcgcattcgaccctgggtcagctcactccgatattatcctgagcaatgataacctcaccgtgacctgcagctcctacgacgatcgggtagtactcggcaaaaccggtttctctaaggggatccattactgggagctcacagttgatagatacgacaatcaccccgatccagcattcggagtagcacggatggatgtaatgaaggacgttatgttggggaaggacgacaaggcttgggccatgtacgttgataacaaccgttcatggtttatgcacaacaattcccatacaaaccgcactgaggggggtatcactaagggggcaaccatcggcgtcctgctggacctgaatcgtaagaacctgacattcttcattaatgatgagcagcagggtcctatcgcattcgataatgtcgaggggctattctttccggcagtttcccttaaccgcaatgttcaggttacactccacactggccttccagtgccggacttttactccagtcgtgcaagcatcgcttag

SEQ ID NO: 139020 - DNA, 2409 bp, Artificial Sequence
  Description of Artificial Sequence: Synthetic coding sequence
atggaggagatggaggaagaactcaagtgtcctgtgtgtggcagcttctatcgggagcccatcattctaccgtgctctcacaatctatgccaggcgtgcgcccggaatatcttggtgcagacccctgaaagcgagagcccccagagccatagagccgccgggtccggggtcagcgattatgactacttggatcttgacaagatgtcactgtacagtgaagcagactctggctatggatcgtacggcgggttcgcctctgcaccgaccacaccctgccaaaagtccccaaatggcgtgagggtgttcccacctgctatgccaccccctgccacccacctttcacccgccttggcccctgtcccaaggaattcctgcattacttgtccgcagtgtcatcgatctcttatcctggacgaccgtggtctaagaggcttcccgaagaaccgggttttggagggggtgatagaccgctaccaacagtccaaagcagccgccctgaagtgtcagctctgcgagaaagcacctaaggaggctacagtgatgtgcgagcagtgcgacgtgttctactgcgacccctgtaggttgagatgtcatcccccaagaggtcccttagcaaagcatcgactggtcccacccgcccagggtcgcgtcagccggcgtctgtcaccacgcaaggtgtctacgtgcacagatcacgaattagaaaaccattcgatgtattgcgtgcagtgtaaaatgccggtttgttatcaatgcttagaggaaggtaagcattcttcgcatgaggtcaaggcgctgggagcaatgtggaagttacataagtctcagctgagccaggcccttaacggcctctctgaccgcgctaaggaagccaaagaatttctcgtccagctgagaaatatggtgcagcagatccaggagaattcggtggaattcgaagcctgcctggttgcgcagtgcgacgccctaatcgatgcattaaatcgacgtaaagctcagcttctggcccgcgtaaacaaagaacatgagcacaagctgaaagtagtgagggaccaaatatctcactgtactgtaaaattaagacagactacaggactgatggagtactgcctggaagtgatcaaagaaaacgaccccagcggcttcctgcagatcagcgatgccttgatcaggcgcgtgcatctgaccgaagatcagtgggggaaggggaccttgactccacgaatgaccactgatttcgacctctcacttgacaactcccccctgttgcagtctatccaccagttggacttcgtgcaggtcaaggttcctgcaacccctatcttacagctggaggaatgctgtacacataacaattccgccacactgtcctggaaacagccacctctctccactgttcctgccgacggctatatcttagagttggatgatggaaatggaggccagtttcgcgaagtgtacgttgggaaggagacaatgtgcactgtggacggcctacactttaattctacgtataacgcacgggtcaaagcctttaataaaactggagttagcccttattctaagactctcgtccttcaaacctctgaagacacagatagcgaggagcagacactcccctttcctgtgccatccgaacgcttgccgcttcgaaggatgagcccatttagttccactctgaacttgcagccttctttccctgggcgctcctattttgattttaggagttccccacatcaactctctttgcactcatccttgcagagtctgaatgctcccggttgtaacttcgagacacagagcgccccctactcacagctggtcgacatcaagaaactgctcgccgttgcctggtttgcgttcgaccctggatctgcccactctgatatcattctgtccaacgacaacctgacagtgacctgtagctcgtacgacgatcgtgtggtcctgggaaagacaggattttccaagggcattcactactgggaactcacagttgatcgctacgataatcatccagatccagcttttggggttgcgcgtatggatgtgatgaaagacgtgatgttggggaaggatgacaaagcatgggcaatgtacgtggacaacaacagatcctggttcatgcacaataatagccatacaaaccgcactgagggcggaatcaccaagggcgccactatcggagtgttgcttgatcttaacaggaaaaatctaaccttcttcataaatgacgagcagcagggccctatcgcatttgacaacgtagagggccttttcttccctgccgtgagcctgaataggaacgtgcaggtctctactctgccgctgagactgaacagctgctgttggctgccagtgcagcgtctgccacgggccgtccaatcgaatcgacgggaaggctcttag

SEQ ID NO: 139021 - DNA, 1653 bp, Artificial Sequence
  Description of Artificial Sequence: Synthetic coding sequence
atggaggagatggaagaagagctgaagtgtcctgtctgcggatccttctacagagaaccaattatcctgccatgctcccataacttgtgtcaggcctgtgcacggaacatattggttcagacccctgaatctgagtcaccccagagccaccgcgcagcaggaagcggggtgagcgactacgattatctcgacctggataagatgtcattgtactctgaggccgactccgggtacggatcctacggaggcttcgcttccgccccaaccacgccctgccagaaatcgccaaatggcgttcgagtgtttccccctgccatgcccccccccgccacacacctgtcaccagctttggcgcccgtgcctagaaacagttgtatcacctgtccacagtgccacaggtctctgattctggacgacaggggcttaaggggatttcctaagaacagagtcttggagggcgtcatcgaccgttatcaacaaagcaaagcggcggcattgaaatgtcagctctgcgagaaagcaccgaaagaggctaccgtgatgtgtgaacagtgcgacgtcttctactgtgacccctgtcggctccgatgtcacccaccccggggtcctttggccaaacacaggttagtgccccccgctcaggggcgagtttcccgacggctgagccctaggaaagtctccacatgtacagatcacgagctggagaatcactctatgtactgtgtacagtgtaagatgcccgtgtgttatcagtgcctggaagagggcaaacactccagccacgaggtgaaggccctgggagccatgtggaagctgcacaaaagccagctctctcaagccttgaatgggctgtccgatcgcgctaaggaagcgaaggaattcctcgtgcagcttaggaatatggtgcagcaaattcaagagaattccgtggaattcgaggcttgcctcgtggcccagtgtgatgccctgatcgacgccttaaatcgtcggaaagcccagttactggctcgggtgaataaagagcatgaacataagctcaaggtcgtcagggaccagatctctcactgcacggtcaaattacggcagacaaccggattaatggaatactgtttggaggtcatcaaagagaacgatccaagcggattcctgcaaatcagcgacgcattgattcggcgcgtgcatctgacagaagatcagtggggcaaaggcacgcttactccacgcatgacaacggactttgatctcagtttggataactcacccctgctgcagtccatacatcagctcgactttgtacaagtgaaggcttcttccccggtgcccgccacaccaattctgcagctcgaggagtgttgtacgcataataactccgccacactaagctggaagcagccgcctctttcaaccgtgcctgcggacggctacatcctcgaactcgatgatggtaacggcggtcagttcagggaggtctacgtggggaaggagactatgtgcaccgtcgacggacttcattttaatagcacttacaacgcaagggtgaaagctttcaacaaaacaggcgtgagtccatacagtaaaacgctcgttctgcagacttcagagggcaaagcgctacagcagtacccatctgagcgtgagttgcgcggcatctag

SEQ ID NO: 139022 - DNA, 3750 bp, Artificial Sequence
  Description of Artificial Sequence: Synthetic coding sequence
atggccactgccgctaccgaggaaccttttccgttccacggactcctgcctaagaaggagaccggagccgccagcttcctttgtcggtatccggagtatgatggtaggggagttttgatcgctgtcctggatactggtgtggatcccggggctcctggtatgcaggtcacgacagacgggaagccaaaaatcgtggacatcattgacacaaccggttccggggacgtaaatactgccacagaggtcgaacccaaggacggggagatcgtcggcctaagtggacgggttctgaagatcccggcatcctggacaaatccctccgggaaatatcacatcggcattaagaatggctacgatttctaccctaaggccctgaaggagcgaattcaaaaagagcgtaaggagaaaatttgggacccggtccacagggtagccttggctgaggcatgtcgaaagcaggaggagttcgacgtcgccaataacggatcctcccaggcaaacaaactgattaaggaagagctccagagtcaagtggagctgctgaactcattcgagaagaaatattctgatcctgggcccgtgtacgactgtctggtctggcatgacggcgaggtttggcgggcttgtatagacagcaatgaagacggagacctgtcgaagagtaccgttttgaggaattacaaagaagctcaggaatacggatctttcggcacagctgagatgctaaattattccgttaatatttatgacgacggcaatctgctctccatcgttacgtctggcggagctcacggaacccacgtggcatctatcgcagcaggccacttccctgaggagccagagcggaatggagtggctcctggggcccagattctgagtatcaagatcggagatacccggctctcaaccatggagacaggtaccggtcttatcagagctatgatcgaagtgatcaatcacaagtgtgatctggtgaactatagttacggcgaggccacccattggccaaattccggcaggatctgcgaggtgataaacgaggcagtttggaagcacaacataatatacgtcagttccgctgggaacaatgggccctgtcttagcaccgtgggttgtcctggcggcacaacatctagcgttattggagtgggcgcctatgtctcccccgacatgatggttgccgagtatagtctgcgggagaagctccctgccaaccagtacacctggtcctcacgaggccctagcgcagatggggcactgggcgtatcaataagcgcccccggtggagccatagcttctgtccccaactggacactgcgaggtacacagctgatgaatggcaccagcatgtcctctcccaatgcctgcgggggcatcgccttgatcctctctggactgaaggctaacaatatcgactacaccgttcacagcgtgcgcagggcactcgaaaatactgctgtcaaggccgataacattgaagtgttcgcccagggacacggtatcattcaggtggataaggcgtatgattatctcgtgcagaacaccagcttcgcgaacaaactgggctttacggtcactgtcggaaacaatcgcggtatatatctgagggatcctgtccaggtggcagccccttcagaccatggcgtgggaattgagccagtctttcctgaaaacactgaaaactccgaaaagatctcactccagttacacctcgctctgacttcaaactcgtcttgggtgcagtgcccaagccatttggaactgatgaatcagtgcagacacattaatatccgcgtggacccacgggggctgcgcgaagggctccactatactgaggtttgcggatacgacatcgcgtcacctaacgccggacctctgttccgggtacctatcaccgccgtcattgctgctaaagtgaatgagtcttcccactacgatctggcattcacagacgttcatttcaaacctggccagattcgacgacacttcatagaggtccccgaaggtgccacatgggctgaggtgacagtgtgcagctgctcgtcagaagtcagtgcaaagttcgtactgcacgccgtgcagttagtgaagcaaagggcctatcgttcccacgagttctataagttctgcagtctgcctgaaaagggtacgctgaccgaagcctttcctgttcttgggggcaaagctatagaattctgcattgctagatggtgggcctccctatcagacgtgaacatagactatactatcagcttccacggtatagtctgtactgcaccacagctgaacatacacgcatccgagggcattaatcggtttgatgttcagtctagcctaaagtacgaagacctggccccttgcataactctgaaaaactgggtccagaccctaaggcccgtatctgccaaaactaaacctctgggctcacgggacgtccttcctaacaacagacagctctacgagatggtcctgacctacaactttcaccagcccaagtcaggggaagtcacgccatcatgtcctctgctgtgcgaacttctctacgagtcagagttcgacagccagctttggatcatattcgatcaaaacaagcgacagatggggtcgggggatgcctacccacatcaatactcactgaagctagagaagggcgattacacaatcagactgcaaatcagacacgagcagatctcagacctggagagactcaaggatctgcccttcatcgtatcacaccgcctgagcaacactctgtcactagacatccacgaaaaccattcgttcgctctactggggaagaagaaatctagtaatctaaccttacccccaaagtataaccagcccttcttcgtgacttccctgccagacgataaaatacccaagggagctggacctgggtgttatctggcagggagtctgacactgtcgaagaccgagcttggcaaaaaggcagacgtgatacccgtccattactacctgatccctcctcccactaagacgaagaatgggtctaaggacaaggaaaaagattctgaaaaggagaaagatttgaaggaggaatttaccgaggcactgcgcgatctgaagatacagtggatgacgaagctcgattcctccgacatttataatgaactcaaggagacataccctaactacttgcccctgtacgtcgctaggcttcaccagctggatgcagagaaagagaggatgaagcgtttgaatgagatcgtcgatgccgcaaatgcggtcatcagccacatcgatcagaccgctctggcggtgtacatcgccatgaagaccgacccaagacctgatgcggctactatcaaaaatgatatggataagcaaaaatctactctcgtggacgctctttgtcgcaagggctgcgccctggccgaccacctgttacacacccaagcacaggatggtgccatatccactgacgccgagggtaaagaagaggagggtgaatccccacttgattcactggccgagactttctgggagacaaccaagtggactgaccttttcgataataaggttctgactttcgcttataagcacgctctggtgaacaaaatgtatggacgcggtctaaaatttgctaccaagcttgtggaggaaaaacctacaaaagaaaactggaaaaattgcattcaactcatgaaactcctgggctggacacactgcgcttccttcacagagaactggctgcccattatgtatccacccgattactgtgtgttttag

SEQ ID NO: 139023 - DNA, 1791 bp, Artificial Sequence
  Description of Artificial Sequence: Synthetic coding sequence
atgctgccttctcaggctcagggacttctttggtgggtctttcccctgttccctgcatcttctctctcttacccccccgtgtcctatagagctgacggcctggccagaaataccttcctgaaggcatgcagtgaatcctctagttcatctaatatctccactatgctggtgacacatgattatactgctgtgaaagaggacgaaataaacgtctaccagggcgaagtggtgcagattctcgccagtaatcaacagaacatgttcctcgtcttccgcgccgctacagaccagtgtcctgccgctgagggctggatccctggctttgtcttggggcatacttcagccgtgatcgtggagaacccagacgggacgcttaagaaatccacaagctggcacaccgccctaagactccggaagaaatcagaaaagaaggataaagacgggaagcgggagggaaagctggagaatggctatagaaaatcacgcgagggattgagcaataaagtctctgtgaagctgctcaaccctaattatatctacgacgttccaccggaattcgttataccattgtcggaggtgacttgtgaaactggggagaccgtagtcctgaggtgtcgggtgtgcggccgtccaaaggcttcaattacctggaaaggccctgagcataatactctcaacaacgacggtcattacagtatttcctactcagatttaggtgaggccactctgaagattgtcggcgtcactactgaggatgacgggatttatacttgtattgcggttaatgatatgggaagcgctagcagctctgcctccctgcgcgtgctcggacctggcatggatggcatcatggtgacctggaaggataactttgactcgttctactctgaggtggccgaactgggtcgcggtagattcagtgttgtgaagaagtgtgaccagaaaggaacgaagagagccgtagccaccaagtttgtgaataaaaagctgatgaagagggatcaggtgactcatgagctgggaatccttcagagtcttcagcaccctctgctagtcggattgctggatacatttgagacgccaacaagctatattctcgtgctagagatggccgaccaggggcgactgttggattgcgtggtgcgatggggctctttaacggagggaaagatccgggcacatttgggtgaggtgctagaggcagtgcggtacctgcataactgcagaatagctcacctagatctgaagccggaaaatatcctagtggatgagtcgctggccaaaccaactatcaaactagcagattttggggatgccgtgcagctgaacactacatattatatccaccagctgctcggcaacccggagttcgctgcacctgaaattatcctggggaatcccgtatccctgacatcagacacatggtccgtgggagtactgacatatgtgttactttctggtgtgtctcccttcctcgatgactccgtggaggagacatgtctgaacatctgccgcctagatttctcatttcccgatgattacttcaagggcgtaagccagaaagcaaaggagttcgtgtgcttcctgctgcaggaagatccagccaagagacccagcgctgccctcgccctgcaagaacaatggcttcaggcggggaatggtaggtctaccggcgtcctggatactagccgtctgacgtcgtttattgagcgccgtaaacatcagaacgatgtgcgaccgattaggtcaatcaagaattttctgcaatctcgtctcctaccgagggtttag

SEQ ID NO: 139024 - DNA, 9294 bp, Artificial Sequence
  Description of Artificial Sequence: Synthetic coding sequence
atgtcggggtctagtggaggcgcggccgcccccgccgctagcagtggacccgctgccgcagcgtctgctgccggtagtggatgcggcgggggggctggcgaaggggcagaagaggctgcaaaggacttggccgatatcgctgccttctttcgttctgggttccgtaaaaacgatgaaatgaaagccatggatgtcctcccaatattgaaggaaaaggttgcctatctgagcggtggcagggataagcgagggggccctatccttactttccctgctaggtcaaatcacgacagaataagacaggaagacctcagaagattgatcagttatctcgcttgtatcccaagtgaagaggtatgcaaaagagggtttactgtaatcgtggatatgagagggtctaagtgggacagtatcaagcctctacttaagatcctgcaggagagcttcccctgttgtatccacgtcgccttgatcattaagcccgacaatttctggcagaagcagcgtaccaacttcggttcctcaaaattcgagttcgaaacaaacatggtgtccctcgagggactgaccaaggtggtggatccgagccaattgactcctgaatttgacggctgtctggagtataatcatgaagagtggattgagatacgggtcgcattcgaagactacatcagcaatgctacccatatgcttagccgcctggaagagttgcaagacattctcgccaaaaaggaactcccgcaggacctagaaggagctaggaacatgatcgaggaacacagccagcttaaaaagaaagtgattaaggcccctattgaggacctcgatttggagggccagaagctgttgcagcgaattcaaagctctgaatccttccctaaaaaaaacagcggctctggaaatgccgatctgcagaatttgctcccaaaggtttccacaatgctggacagacttcacagcaccagacagcatctgcatcagatgtggcacgtgagaaaacttaagctggatcagtgtttccagctccgcctttttgaacaggacgctgaaaagatgtttgactggattacacataacaagggcttattccttaatagttatactgaaataggtacatcccacccacacgccatggagcttcagacccagcacaatcacttcgccatgaattgcatgaacgtatatgtcaatatcaaccgtattatgagcgttgcaaaccgcctcgtggagtctggacactacgcttcccagcagattcgtcagatagcatcccaactggagcaggaatggaaggcattcgcggcagctctggacgagcgcagtactctgctagatatgtccagcatatttcatcagaaagcagagaagtacatgtcaaacgttgattcctggtgcaaagcctgtggggaagtagatctcccatccgagctgcaggatctcgaggacgcaatccaccatcaccaggggatttacgagcatattaccctggcgtattcagaggtatcccaggatggaaagtccctgttagataagctgcagcgacccttgaccccaggctcctccgacagtctaactgccagcgcaaactacagcaaagcggttcaccatgttctagatgtaatccatgaggtactgcatcatcagcgccagctcgaaaatatctggcagcaccgcaaagtaagactccatcaacgccttcaattgtgtgtgtttcagcaggacgtgcaacaggtgttggactggatcgaaaaccacggggaagcttttctgagcaaacacactggagtaggtaagtccctccacagagcaagagccctgcagaaacgacacgaagactttgaagaggtggcacagaatacttacaccaacgctgataagctcctcgaggccgctgaacagcttgctcagaccggggaatgcgaccccgaagagatttaccaggctgcacaccaattggaggaccgcatacaggatttcgtgcgccgggtggagcagaggaagatacttctggatatgtcagtctcctttcatactcacgtcaaggagctctggacatggcttgaggaattgcagaaagagctgctggatgatgtctatgccgagtctgtagaggctgttcaagacttaatcaagcgctttggtcaacaacagcagaccacacttcaggtgaccgtgaatgttataaaggagggggaggacctcatccagcagttgcgggacagcgcaatctcctcgaataagaccccccataacagcagcatcaaccacattgagactgtgctgcagcagttagatgaggctcaaagccagatggaagaactgtttcaggagcgtaagatcaagcttgaactgtttctgcagctccgcatcttcgaacgcgatgcaattgacatcatctccgatttggaatcatggaacgacgaactgtctcaacagatgaatgatttcgacactgaagatttgactatcgctgaacagcgactccaacaccatgccgataaggctctcaccatgaacaatctcacgttcgacgtaattcatcaagggcaggaccttcttcagtacgtcaatgaagtgcaagcctcgggggttgagctactgtgcgaccgggatgtagatatggctacaagggttcaagacctcctggagtttttgcacgaaaagcagcaggaacttgacctagccgctgagcagcaccgaaagcatctagagcagtgcgtccaattaagacacctccaggccgaggtcaagcaggtcctaggctggatccggaatggcgagagcatgctgaatgctggactgatcacggcgagcagccttcaggaagccgagcagttgcagcgagagcacgaacagttccagcacgccatagaaaagacccaccagagcgctctccaagtgcagcagaaagccgaagccatgctacaagcaaaccattatgacatggacatgattagagactgtgctgagaaagtagctagccactggcagcagctcatgcttaagatggaagaccgcctgaagttggtgaacgctagtgtagccttttacaaaacatcagaacaggtgtgtagtgtgctcgaatcacttgagcaggaatataagcgggaggaagactggtgcggcggagccgacaagctcggccctaactctgaaactgatcacgttacaccaatgatttccaaacacctcgaacagaaggaggcctttcttaaggcctgtaccctcgcaaggcgaaatgccgatgtgttcctgaaataccttcatcggaattctgttaacatgccaggcatggtaacacatatcaaggcaccagagcaacaagtcaagaacatactgaatgagctgtttcaacgggaaaacagggtgctgcactactggactatgcggaagcgcagactggatcagtgtcaacagtacgttgtgttcgagcggagcgcaaaacaggctctcgagtggatacacgataacggggaattctatctgagcacacacacctccactgggtcatccatccagcatacccaagaactgcttaaagagcatgaagagttccagattaccgccaaacagactaaggaaagagtgaagttgctcattcagctcgcagatggcttttgtgagaaaggccacgcccacgccgccgaaatcaagaagtgcgttacagcggtcgacaagaggtaccgcgacttctctctccgcatggagaagtacaggacctctctcgaaaaagcactgggaatctcatctgattctaacaagtccagcaagagtctgcagctggatattattcctgcgagcatccctggaagtgaggtcaagctgagagacgccgctcatgagctcaacgaggagaagaggaagtccgcgcggaggaaggaatttattatggccgagcttatacagaccgagaaagcctacgtgagggatctgagagaatgcatggatacatatctctgggaaatgacatccggagtcgaggagattccccccggcattgttaacaaggagctgatcatttttggtaacatgcaggaaatttacgaattccacaataatatcttccttaaggagctggagaaatatgaacagctgccagaggatgtcggccattgcttcgtgacgtgggcagataagttccagatgtacgtcacatattgcaaaaataagcccgactctacccagctgatactcgagcatgcaggatcctatttcgacgaaattcagcagagacacggcctggccaacagtatctcctcctatctgatcaaaccagtgcagcgaattaccaagtaccagttacttctgaaagagctgcttacctgctgtgaggagggcaaaggtgagatcaaggacggtctggaggttatgctctcagtgcccaaacgtgctaacgacgctatgcacctgtcgatgctagaagggttcgacgaaaacattgagtctcagggagaactgattctacaggagtccttccaggtatgggatcccaaaaccctcatccggaagggacgtgaacgccatctatttttattcgagatgagcctggtctttagtaaggaggtcaaagacagcagcgggcgatctaaatacctttataaatccaaactgtttacctcggagctcggcgtgacagaacatgttgagggagacccctgtaagtttgccctgtgggtggggcgaaccccgacttccgacaataaaattgtgctgaaggcctcctctattgaaaacaaacaagactggattaagcacatccgcgaggttatccaggaacgcacaatccacttaaaaggcgcactcaaggaaccaatccatattcccaagaccgctcccgcaactcggcagaagggacgcagggacggggaggatctggacagtcagggcgacgggtcaagtcagccagataccatctctatcgcctctagaacatctcaaaacaccctggactccgacaaactgtcaggggggtgcgaattaaccgtggtcattcatgacttcaccgcatgcaactctaacgaactcaccatccgccgaggacagaccgtcgaggtgctggagaggccccatgacaagccagactggtgtctggtaagaactactgacagaagcccagccgcagagggactggtcccgtgtggtagtctgtgtattgcccactctaggtccagcatggaaatggagggaatcttcaaccacaaggacagtttgagcgtcagttctaacgatgctagtccaccagcctccgtggcttcattgcaaccccacatgattggtgcccagtcttcccccggcccaaaacgcccaggcaacaccctccgcaagtggctgacgtcgccagttcggaggctgagtagcgggaaggccgatggccacgtgaagaagctggcccataaacacaagaagagccgcgaggtgaggaaatctgctgacgccggttcacaaaaagatagtgacgatagcgctgccactccacaggatgagaccgtggaggagaggggtaggaatgaggggttgtcatccggcacgttgtccaaatcaagctccagcggaatgcaaagttgcggtgaggaggagggggaagagggagccgacgctgtacccctccctcctcctatggcgatccagcagcacagcctccttcaacctgattcacaagacgacaaagcaagctcccgccttcttgtgagacccacctccagcgaaactcctagcgccgctgagctggtgagtgccatagaagaattggtaaaaagcaagatggctttagaggatagaccatcttcactccttgttgatcagggagactcctcatccccctcctttaacccttctgataattcgcttctttcctcctcttccccaattgacgagatggaggaaaggaagtccagttctttgaagaggagacactacgtgctgcaggagctggttgagactgagagagattacgtgagggacctcggatacgtggtcgaagggtatatggctctgatgaaagaggacggcgtgcccgatgatatgaaagggaaagataaaatcgtttttggcaacatccatcagatctatgattggcatcgcgatttttttttgggcgagctcgagaaatgcttagaggacccggaaaagctgggatcactgttcgtgaagcacgagcggaggctgcacatgtacatcgcttactgccagaacaaacccaagagcgagcacattgtttctgaatacattgataccttcttcgaggatcttaagcaacgcttgggacatcgcttgcagctgaccgacctcctgattaaaccagtccaacgtataatgaagtaccagctcctgttaaaggattttctgaagtacagcaaaaaagcctcactggacactagtgaactagaacgtgcagtcgaggttatgtgcatcgttccacgccgatgtaacgacatgatgaatgttggacgccttcaggggttcgatggtaagatagtggcccagggaaagcttcttctgcaagatacctttctggtcactgaccaagatgctggattattgccaagatgtagagaacgacgaatatttctgttcgagcagatagtgatctttagtgagccgcttgacaagaaaaaaggtttcagcatgcccgggtttctgtttaagaactccattaaggtgagctgtctgtgtctagaggaaaacgttgagaacgacccatgtaagtttgctctgactagtagaactggcgacgtcgtggaaacgttcatactgcacagcagcagtcccagtgtccggcagacctggatccacgaaattaaccagatactagagaaccagcgaaattttttaaacgctctgacgtctcccatcgagtatcagcgtaaccatagcggggggggaggggggggaggctctggcggatctggtggcggaggtggttctggcggcggtggtgcgccgtccggcgggtccgggcacagcggaggtccatcctcctgcgggggggccccatctacctcgagatcccgcccctccaggatcccacaacccgtgcgtcatcacccacccgtcctggtgtctagcgctgcctccagtcaggcggaggccgacaaaatgtccggaacgagtacccctggcccctcactgcctcccccaggggcggcaccggaagccggacccagcgcgccgagtagacggccccccggagccgacgctgaggggagtgagcgagaggcggagcctattcctaagatgaaggtcctcgaatcgccccggaagggagccgccaatgccagcggctccagcccagacgctcccgccaaagacgccagggcctcccttgggacactgcccttgggcaaaccccgggcaggtgctgcctcaccgctgaattctcctctaagttctgccgtgccgagcctggggaaggagccattcccaccgtcgagccctcttcagaagggagggtctttttggtcctcaattcccgctagtcctgcttctcgcccaggaagttttaccttcccgggggacagtgattctttacaaaggcagactcccagacacgccgcccccggcaaagacaccgatagaatgagcacctgttcctcagctagtgagcagtccgtccaatcaacccagagtaatggaagtgaatctagcagtagtagcaacatttctacgatgttagtgacgcacgactacacggctgtgaaagaagatgaaatcaacgtctatcagggggaagtggttcagatcctggcatctaaccagcaaaatatgtttctggtgtttagggcagcaaccgaccagtgtcccgcagcagagggctggatcccaggttttgtcctcggacacacttcagctgtgatagtggaaaatccggatggtaccctgaagaaatccacgtcctggcacacggccctgaggctccgcaagaaatcagaaaagaaggacaaagatggcaagagagagggaaagctggaaaacgggtacaggaagtctagggaaggccttagtaataaagtttccgtcaagttgctgaatcccaactacatctatgacgttccacctgaatttgtgatccccctcagtgaagttacatgcgagaccggggaaactgtggtgctgcgctgtagggtgtgcggtcggccaaaggcaagcattacatggaagggtccagagcacaacacgctcaacaatgatggacactattccatctcatacagcgatctgggtgaagcaacccttaaaatcgtcggcgtgaccaccgaggatgacggaatatacacatgcatagctgttaacgatatgggaagcgcctccagttcagcgtcactccgggtcctaggcccaggtatggatggaattatggtcacctggaaggacaatttcgatagtttctattccgaggtggctgaactaggccgggggaggttctctgtggttaagaagtgtgatcagaagggtacaaagcgtgctgttgccaccaaatttgtcaataagaagctgatgaagagggaccaagtgacccatgagcttggtattctgcagtcactgcaacatccgttgctcgtgggtttattggacacattcgagactcctacctcctacatcctggttctggagatggcagatcagggtagactgttagactgcgtagtaagatggggaagtttaactgaagggaagatcagggcccacttaggtgaagtgttggaagcagtgcggtacctccataactgtcgtatcgcacacctggacctgaaaccggaaaatatcctggtcgatgagtccctggccaagccaacaattaaattggccgatttcggcgatgcagtgcaactgaataccacgtattacatacatcaactcctgggaaacccggagttcgctgcccccgaaatcatcctgggaaaccctgtcagtttgacaagtgatacctggagtgtgggagtacttacctacgtgctcctgagcggtgttagcccctttctggacgattccgtcgaagaaacttgtctaaatatttgccgtctggacttctcgttccccgatgattattttaagggagttagccagaaagccaaagagtttgtgtgtttcctgcttcaggaagaccccgctaagcgcccttcagctgcgttggcacttcaggaacagtggctacaggcgggcaatggcagatccaccggagtccttgatactagccgcctcaccagcttcattgagcggaggaaacaccagaatgacgtgcgaccgattaggtccattaaaaatttcctgcaatccaggttgcttcctagagtttag

SEQ ID NO: 139025 - DNA, 7503 bp, Artificial Sequence
  Description of Artificial Sequence: Synthetic coding sequence
atgctcgataggttgcattctacccgacagcatctgcaccagatgtggcacgtgcgcaaactgaagctggatcagtgcttccagttgcggctcttcgagcaggacgcagaaaaaatgttcgattggataacccataacaaagggctgttcctgaacagctatacagagattggaacctcacaccctcatgccatggaacttcaaacccaacacaaccacttcgctatgaattgcatgaacgtgtacgtgaacatcaaccggataatgtctgtggccaatcggctggtcgaatcagggcactatgcttctcagcagattagacagatagctagtcaattggagcaagagtggaaggctttcgccgctgcccttgacgagaggagcaccctgctggatatgtcatccatcttccaccagaaggcagagaaatacatgtctaatgttgatagctggtgcaaggcttgcggcgaggtggaccttccttctgagctacaggacctagaggacgctatccatcatcaccagggaatctacgaacatattactctggcgtacagcgaggtgtctcaggacggcaaaagtctgttggacaaattacaaaggccactgactcctggcagctccgactcccttactgcttctgccaactactccaaagctgtgcatcatgtgctggacgtgatccacgaagtgctccatcatcagaggcaactagaaaatatatggcagcaccggaaggtacgtctgcatcaacgcttacagttgtgcgtgttccagcaggatgtgcagcaggttctagattggattgagaatcatggcgaggctttcttatctaaacacactggggtcgggaaatccctgcatagggccagagctcttcagaagcgccatgaagactttgaggaagtcgctcaaaacacttacactaacgcagacaagttgctggaggctgctgagcaacttgcccagactggagagtgtgatcctgaagagatctatcaggcagcccatcagctggaggataggatccaggatttcgttagacgcgtagaacaacgcaaaatactgttggatatgtcagtcagcttccacacacatgtgaaagagctctggacgtggctggaagaactccaaaaggaactactggacgacgtgtacgctgagagcgtagaagcagtccaggacctcatcaagagatttgggcagcagcagcagaccactctccaagtaaccgtgaacgtgatcaaagaaggtgaagacctgattcaacaactgcgcgattccgccatatcaagcaataagaccccacacaattcgtccattaaccatatagagacagttctccagcaacttgatgaagcacagtcacaaatggaggagcttttccaggagaggaaaattaagctagagctgttcctgcagctccgtattttcgaaagggacgccatcgatattatctcagacctcgagtcttggaatgatgaattgtcccagcagatgaatgatttcgatactgaagacctaaccattgctgaacaaaggctccagcatcacgcagataaagcacttacgatgaacaacttaactttcgatgtgatccaccagggccaggatctgctacagtatgtgaatgaggttcaggcctccggcgttgagttgctatgcgaccgggacgtggacatggccactagggtccaggatctcctggagttcctgcacgaaaagcagcaagagcttgatctggccgctgagcagcaccgcaagcatctcgaacagtgtgtacagctccgtcatctgcaggctgaggtcaaacaggtcctggggtggattagaaatggggagtcaatgcttaatgccggtctgatcacggccagttcactgcaagaggctgaacaattacaaagagaacacgaacaatttcaacatgccattgagaaaacgcaccaatccgccctgcaggtgcagcaaaaggcagaagcgatgctccaggccaaccattatgatatggacatgattagggattgtgcggagaaggtcgctagccattggcagcaactaatgctcaagatggaggatagactcaaattggtaaacgcatcagtggcattctataaaacctcagagcaggtctgcagcgttttggagtctcttgaacaggagtataaacgcgaagaagattggtgtggcggggcggacaaattggggcccaacagcgaaaccgatcacgtgaccccgatgatctcaaagcatctggagcagaaggaagcattcctcaaggcttgtacactcgctaggcgaaacgccgacgtgttcctcaagtatttgcatagaaatagtgtgaatatgcccggtatggtaacacacatcaaagccccagagcagcaggtgaagaatattcttaatgagttattccagcgggagaatcgagtacttcattattggacaatgaggaaaagaaggttggatcagtgccagcagtatgtggtcttcgaacgatccgcgaaacaagccctggagtggattcacgacaatggggaattctatctgtcgacccatacatctaccggttccagtatacagcatacgcaggagctacttaaagaacatgaggagttccaaatcaccgccaagcagaccaaagagcgagtcaaacttctcatccagctggctgatggcttttgtgagaaaggtcacgcccacgctgccgaaattaaaaagtgcgtgaccgcagttgataaaaggtaccgcgacttctctcttagaatggagaagtatcgtacctccctggaaaaagcactgggaatctcatctgatagtaacaaatcttcaaagagcttgcagcttgatattattcccgcatccattcctggcagcgaggtcaagctccgggacgcggcccatgagttaaacgaggagaagcgtaagtcagccagacggaaagagttcataatggccgagcttatacagaccgaaaaagcttacgtccgagacctcagagaatgcatggatacctacctgtgggaaatgacaagtggggttgaggaaatacctcctggtatcgtgaataaagaattaattatctttggcaacatgcaagagatctacgaattccataacaatatatttctgaaggaactagagaagtatgaacagcttcctgaggacgtgggacattgcttcgtcacatgggccgataaattccagatgtacgtgacttactgtaaaaacaagccggattcaacacaactcatcctagagcatgctggtagctactttgatgaaatccaacagcggcacggactggccaatagcatatcctcatatctgattaaaccagttcagcggattactaaataccaactcctgctgaaggaactcctgacctgctgtgaagagggcaaaggagagataaaagacggactagaagttatgctgtcagtgcccaagcgcgcaaacgacgctatgcatctatctatgttagaggggttcgatgaaaacatcgagtcgcaaggagaactcatcctccaggagtcctttcaagtttgggaccccaaaaccttgatcagaaaaggacgggagcggcatttgtttttgtttgagatgtcactggtattttccaaagaagtcaaggactcatccggccggagtaagtatttgtacaagagcaagttgtttaccagcgaactgggggtgactgagcacgtcgagggcgatccttgtaagtttgccctgtgggtgggccgaacccccacatcagataataaaatagtgctgaaggcctccagcattgagaacaagcaggactggatcaaacacattagggaagttattcaggaacgaactattcacttaaagggggctttgaaggagcctatacatataccaaagacagctcctgcgaccagacagaagggacgtcgcgacggcgaagacttggactcccagggggacgggtcttcacaaccggacacaatctccatagcgtcccggacttcccaaaacactctggactctgataagctgtcaggcgggtgtgaattaacggtcgttattcacgactttacggcctgcaactctaacgagctgaccattcgaagaggtcagactgtcgaggttctcgagcgcccccacgacaaaccagactggtgtcttgtgaggaccaccgacagatcaccagctgcagagggcctcgttccttgcgggtctctgtgcattgctcactctcgtagcagtatggagatggaaggcatcttcaatcacaaggactcactgtctgtatcatcaaacgacgcaagcccccccgccagtgtcgccagtctgcagccccatatgatcggtgctcagagcagcccaggacccaaaagaccagggaataccctccgcaagtggctgacctctccggtgagaaggttgtcctcaggtaaagcagacggccacgtgaagaaactagcccataagcataaaaagagccgagaggtccggaaatctgccgacgctggcagccagaaggattccgatgatagtgcagcgaccccccaggacgagaccgttgaagagagaggcagaaatgagggcctgtcctccggaaccctctctaagagctcttcctctggcatgcagtcctgcggcgaggaggagggagaggagggcgccgacgcggtccctttgcctcccccaatggctattcagcagcattcccttcttcagccagactcccaagacgacaaggccagctctcgactgctggtgcggcctacaagttcagagacccccagcgcagcggaactggtgagtgccatcgaggaactggtgaaatcaaagatggccttagaagaccgcccctcctcattgcttgtggaccaaggcgatagttcttctccttcgtttaaccctagcgataattctctcctgtcttctagttcccccattgacgaaatggaagagcggaaatcctctagcctaaaacgccggcactacgtgctgcaagaactcgttgagaccgagcgggattacgtgagggacctcggatatgtggtggaaggatacatggccctgatgaaagaggatggagtccctgacgatatgaagggcaaggacaaaatcgtattcggcaatattcatcaaatttacgactggcacagagacttttttctcggggaactagagaagtgcttggaggatcctgaaaagctcgggtctctgttcgtgaagcatgagcgcagactacatatgtatattgcgtactgccagaataaaccgaaatcagagcatatcgttagcgaatatattgacaccttcttcgaagaccttaaacagcgactcggacaccgcctgcagctgaccgacttgctgattaagcctgtccaacgtataatgaagtaccaactgttgctgaaggatttcctgaagtacagcaaaaaggcttcactggacactagcgagctcgaaagggccgtggaggtgatgtgcatagtgccacggaggtgcaacgacatgatgaatgtcggcaggttacaaggctttgacggcaagattgttgcccaaggtaagctgctattacaggataccttcctcgtcactgaccaggacgctggtctgttgcccagatgccgagaacgcagaatcttcctgtttgaacagatcgtcattttctctgagcctctggacaaaaaaaaggggttttccatgcctgggtttctgttcaaaaactcaattaaagtaagctgcctctgtctggaagaaaatgtggaaaacgatccatgcaagttcgccttgacatcacggacgggggatgtggtcgaaacctttatcctccattcttcatccccttctgtgaggcagacctggatccatgaaatcaaccagattctggagaaccagaggaacttcttgaacgctttgacaagccccattgagtaccagaggaaccatagcggcgggggtggtggtggcggtagcggaggcagcggcggggggggcggttcaggcggcggcggcgctccttctgggggtagtggccactcaggaggaccctccagttgtggtggagctccaagcacttcccgaagccggccttcgagaattcctcagccagtccggcaccaccccccagtgctggtgagcagcgcagccagcagccaggctgaggcggataagatgtctggcacctctactcctggcccttctctcccccctcccggcgccgctccagaagccggaccctcggctccaagtaggcggccaccaggtgcagacgccgaaggttcagagagagaggccgagccaatccctaaaatgaaagtcttagagtctccccgcaaaggcgccgccaacgcatcgggctcatcacccgatgcccccgctaaggacgcgcgcgccagtctgggaaccctgcctctggggaaacccagagctggcgcggcaagccccctaaatagtccactttcctctgcagtaccaagtcttggcaaggaaccattccccccttcttcgccattacagaaaggcggatcattttggtctagtatccctgcttcacctgcatcaagaccaggcagttttactttccctggggattcagactctctgcaaaggcagacgccacgacatgccgcacccggtaaggatactgacagaatgtcaacctgtagttcggcaagtgagcaatctgtgcagtcaacacagagtaatggctctgagtctagctcttctagtaacatcagcaccatgctggtgactcacgactataccgccgttaaagaggatgaaatcaatgtgtatcagggagaggttgttcagatactggcctccaatcagcagaacatgttcttggtgtttagggcagccaccgaccagtgtcccgccgcagagggctggatacccggtttcgtgctgggccacacctccgcagtgatcgtggagaatcctgacggtaccctcaagaaatccacatcatggcacacggctctccgcctgaggaagaagagtgaaaaaaaagataaagatggtaagagagaaggtaagttggagaacggctaccgaaagagtcgagaaggtctatcaaataaagtcagtgtcaaattgctgaatcctaattacatctacgacgtacctcccgagttcgtcataccgctttctgaggttacctgtgagaccggtgaaacagtcgtgctccgctgtcgggtgtgcggacgtccaaaagcatctattacatggaagggacctgagcacaacactctaaacaacgatggccactatagcatctcgtattccgatctgggggaggccacactgaagattgtaggcgtgactaccgaagatgatgggatttatacctgcatcgctgtgaatgacatgggctcagcgtcttcctcagccagcctgagagtgctgggaccgggcatggacggaattatggtcacatggaaggacaatttcgactccttctattccgaggtggccgagttgggacgggctaattggaacaattggtcaccgtattag

SEQ ID NO: 139026 - DNA, 8766 bp, Artificial Sequence
  Description of Artificial Sequence: Synthetic coding sequence
atgtcgggatcctctggaggggcagctgcgccagcagcaagttccgggcctgctgcggcagcatctgccgcaggttctggctgcggtgggggggccggcgagggtgccgaggaagccgccaaagacctggccgatattgccgcattctttagatctggcttccgtaaaaacgacgaaatgaaagccatggatgttctccctatcttgaaagagaaggtcgcctatctaagcggcggcagagataaacggggagggccaatcctgactttccctgctcggagcaaccacgacaggatcagacaggaggatttacggcgcctgatctcctacctcgcgtgtatcccctcagaagaggtgtgtaagcgggggtttaccgtcatcgtggacatgcgaggatccaaatgggactcgatcaagcctttgcttaagattctccaggaaagtttcccttgctgcatccatgtggccctgatcataaaacccgacaatttctggcaaaagcagcgcacaaacttcggatctagcaagtttgagtttgagacgaatatggttagtctcgaaggcctgacaaaggtggtagatccaagtcagctgacgccagagttcgatggttgtctggagtataaccacgaggaatggatagaaattcgcgtggcattcgaggactacatctcaaacgccactcatatgctgagtagattggaggagctgcaggacattctcgcgaagaaagaactaccacaggacttagaaggcgcccggaacatgatagaggaacatagccagctcaagaagaaggtgatcaaagcccccatagaggacctggacctggaggggcagaaactcctgcaaaggatacagtccagtgagagcttcccaaaaaagaacagtggcagcggtaatgccgaccttcagaatctgctgccgaaggtgagcacaatgcttgatcgcctacactccacaagacagcaccttcatcagatgtggcatgtgcgcaaactgaagctggaccagtgttttcagttaaggctgtttgagcaggatgccgagaaaatgtttgactggattacccataataagggcctctttctcaatagttatacagagatcgggacatcccacccccacgctatggagctgcagacacagcacaaccacttcgccatgaactgtatgaacgtttacgtgaacatcaatcggatcatgagtgttgcgaacagacttgtggagagcggacactatgctagtcagcaaattcggcagattgctagccagctcgaacaagagtggaaagcctttgcagccgccttggacgagcggtctaccctcctcgacatgtcctcgatctttcaccagaaggccgagaaatacatgagcaatgtcgattcttggtgtaaagcctgcggagaagtagatctacctagcgagctccaagacctggaggacgctatccatcatcaccagggcatatacgagcacatcactttagcctacagcgaagtcagtcaagatgggaagagcttgctggataaattgcagcggccactgacaccaggatcctcagactctctcaccgcttcagctaactacagtaaagcagtgcaccacgtgctggacgtcatccatgaagtcctccaccaccagaggcagttggagaatatatggcagcaccgcaaggtgcgtttgcaccaaaggttgcagttgtgcgtatttcagcaggatgtgcagcaggtgctggattggattgagaaccacggcgaagcgtttctgagcaagcacactggggtcgggaagagcctccatagggcgagggctctccagaaacggcacgaggactttgaggaggtcgcgcaaaatacctacaccaacgccgataaactgctggaagcagctgagcagctggcgcagactggagaatgtgacccggaggaaatttatcaggccgcacaccaactggaagatcgaatccaggattttgtgagacgagttgagcagcgaaagatcctgttggacatgtcggtatccttccatacacacgtgaaagagctgtggacctggttggaagagttacaaaaagagcttttggacgacgtgtacgcggaatccgttgaagctgtgcaggacctaatcaagagatttggccagcagcagcagaccaccctgcaagtaaccgttaatgtgataaaggaaggggaggacttaatacagcagcttcgagattccgccatcagctctaataaaacacctcacaacagttctatcaatcacattgagactgtgttgcagcaactagacgaagcacagtcccagatggaggagttattccaagagagaaagatcaaactagagctgtttttgcagctgcgcatatttgaaagggatgcgattgatattatatccgatttggaatcctggaacgatgaacttagccagcagatgaacgatttcgatacagaagacctaacaatcgcagaacagcgtctccagcatcacgcagataaggccctcacaatgaacaatctcacattcgacgtcatccaccaaggccaggatctgttgcaatacgtgaatgaagttcaggcctcaggagtggagctgctgtgcgaccgcgatgtggatatggccacaagggtccaggatctgctggagttcctgcacgaaaagcagcaggagctcgatctggcggccgagcagcatcgaaagcatttagaacagtgcgtccaactgcgacatttacaggccgaggtcaaacaggtgctcggctggatcaggaacggcgagagcatgctaaacgccgggctcataactgcctcttcgcttcaagaggctgaacaactgcagagagagcatgagcagttccaacacgccattgagaagacccaccagtctgctctgcaagtccagcagaaggccgaggccatgttacaggcaaaccattacgacatggacatgatccgtgactgtgctgaaaaagtcgcttcccactggcaacagttgatgttaaaaatggaggacagattgaaactcgtgaatgcttctgtcgctttttacaaaacatccgagcaggtctgcagcgtactggagagcctggagcaggagtacaagcgggaagaggactggtgtggaggggctgataagttagggccaaactcggagaccgaccacgtgacccctatgatcagcaaacatctcgaacagaaagaagcattcttgaaggcctgcacccttgccaggaggaatgccgacgtgtttttgaagtatctacaccggaactcggtgaacatgccaggcatggtgactcatatcaaggcaccggagcagcaggtgaagaacattctaaatgaacttttccagcgcgaaaatagggtactccattattggaccatgaggaagaggagactcgaccaatgccaacaatatgtggtatttgagagaagcgcgaaacaagccctggagtggatccacgataatggcgagttctacctctcgacccacactagcactgggagttctatacagcacacccaggaattattaaaggagcacgaggaatttcagattacggcaaagcagacgaaggaacgagtcaagctcttaattcagctggccgacggcttttgtgagaaaggccatgctcacgcagccgaaatcaagaagtgcgtaactgccgtggacaagcgctaccgcgacttctcccttaggatggagaaatatcgcacatccttagaaaaagctctgggcatctcaagcgatagcaataaatcaagcaagtccttacagcttgatattattcccgctagcatacctggttctgaagtgaaactgcgggatgcagcgcatgagctgaacgaggagaagagaaaatctgcccggcgaaaggagtttattatggcagagttaattcagaccgaaaaagcctacgtgagagatctacgggagtgtatggacacctatctttgggaaatgacatcaggcgtcgaagaaatccccccaggtatcgttaataaggagcttattatctttggcaacatgcaggaaatttatgagtttcacaataacattttcctcaaagagttggaaaaatacgagcagctaccagaagatgtgggacactgctttgttacctgggccgacaaattccagatgtatgtcacttactgtaaaaacaagcctgactcaacgcagctcatcctggagcacgctggctcttatttcgacgaaatccagcagagacatggcctcgcaaacagcatctcctcctacttaattaaaccagtccagcggatcaccaagtaccagctgctgctgaaggaacttctgacatgctgtgaggagggcaaaggggagattaaagacggcctggaagtcatgctatcagtgcccaaaagggccaatgacgctatgcatctctctatgctggagggcttcgatgagaacatcgagtctcaaggtgaactgatcctgcaagagtcatttcaggtatgggatccaaagacactgataagaaaaggtcgagagaggcatctgtttctgttcgagatgtctcttgtgttttccaaggaggttaaagacagcagcgggcgatccaagtacctgtataaatccaaactgtttacctccgaactgggcgtgaccgagcacgtggagggagatccctgcaagttcgctctctgggtcgggaggactcccacgagcgacaataaaattgtcctcaaggctagttccatcgagaataagcaagattggattaagcacatccgagaagttatccaggaaagaacaatccatcttaagggcgccctcaaagagccaatccacatccccaagactgctcccgctacccggcagaaggggcggagggatggggaggacctggacagtcagggagatgggtcaagccagccggacaccatatctatcgcttccagaaccagtcagaacaccctcgacagcgacaaactctccggaggctgtgaactgaccgtggtgattcacgattttacagcctgtaatagtaatgaactgacgataagaagaggacaaactgttgaggttctcgagcgccctcatgataagccggactggtgtttggtacgaactactgaccggagccccgcggccgagggacttgtgccatgtggctccctgtgcatcgctcacagcagaagttctatggaaatggaaggcatctttaatcataaggactccctgtctgtgagctccaatgacgcctctcctcccgcttccgtcgcatctttgcaaccccacatgattggcgctcagtcgagcccgggccctaagcggccaggtaataccctccgaaagtggctaacttcccctgttcgcagactctcatccggcaaggccgacggccacgtcaaaaagctggcccataagcataagaagtcccgggaggtacggaaatcagccgatgctggatcccagaaagatagcgatgactcagcggctacgcctcaggacgagactgtggaggagagagggcgcaatgagggattaagcagtggaacgctgtcaaagagtagtagctcgggcatgcaatcatgcggcgaggaggagggtgaagagggagccgacgctgttccactccctccaccaatggccattcagcagcatagtttgttgcagcccgactcccaagacgacaaggcttccagccggctgctcgtgaggccaacttcttccgaaacgccatctgcagcagagttggtgtccgcaatcgaggaattggtgaagagcaaaatggcgctcgaggatcgtcctagcagtttgctggtcgatcagggcgatagttcctctcccagctttaaccccagcgacaattcactgctttcatcctcctctcctatcgacgaaatggaggagagaaagagcagctcactcaaaaggaggcactacgtgcttcaggagctggtggagacagagagggactacgtccgcgatcttgggtatgtcgtggaaggctacatggccttgatgaaggaggatggagtgcccgacgatatgaaggggaaggacaagatagtgtttggcaacatacatcagatctacgattggcacagggatttctttcttggagagctggagaagtgtctcgaagatccagagaagcttggaagcttgtttgtaaagcatgagcgaagactgcatatgtatattgcgtattgtcagaataaacccaagtcagaacatatagtgtctgaatacattgatacattcttcgaggacctgaagcagaggctcggacatagactccagctaaccgatctgctgattaagcctgtccaacgcatcatgaagtatcagctcctcctaaaggattttcttaagtactccaaaaaggccagccttgacacttctgaattggaacgcgcggtcgaagtgatgtgtatcgtgccccggcgctgcaatgacatgatgaatgtcggccgccttcaggggtttgacggcaagatcgtcgctcaggggaaactacttctgcaggacacattcctggtgacagaccaggacgctggccttctgcctagatgtcgggagcggaggatctttttatttgaacagatcgtcattttctctgaaccgttagacaagaaaaaaggcttctccatgccgggctttctctttaagaattcaatcaaagtgtcctgcctttgccttgaggagaacgttgagaatgatccctgcaaatttgcgttgacctctcggacgggcgatgtggtagagacttttatcctgcactcctcaagcccatccgtcagacagacgtggatccacgagattaaccagatcctcgagaaccaacgaaatttcttgaacgcactgacgtcacccatcgagtatcagagaaatcattccggaggaggcggtggcgggggatccgggggctcaggcggcgggggaggtagtggcggaggaggcgccccatccgggggcagcgggcattctgggggcccatcttcatgtggcggagcccccagcacttctaggagtcgcccttctaggattccccagccagtcaggcaccatcctcctgtcctcgtgtccagcgctgccagcagtcaggcagaagctgataagatgagcgagagcgaaagtagctcctcctccaacatctcaacgatgctggtaacccacgactatacagctgtgaaggaggatgaaatcaatgtgtatcagggggaggtcgtgcaaatcctcgcttccaaccagcagaatatgttcctggtctttcgggccgccacagaccaatgccctgctgccgagggatggattcccgggtttgtgctgggccatacttccgcagtcatcgtggagaatccagatggaacgttaaagaaaagcactagttggcatactgctttacgccttagaaaaaagtcggagaagaaggacaaggatgggaagagggagggcaaactcgaaaacggctatcggaagtctagggagggattaagcaataaggtgtctgttaaattgttgaaccccaactacatctatgatgttccacccgagttcgtcattcccttaagcgaggtgacctgtgaaacaggtgagactgtcgttctgagatgtcgtgtgtgtgggcgtcccaaagcttctattacgtggaagggaccagagcacaacactcttaacaatgacgggcattatagcatttcatattccgatttgggcgaggcaaccctgaaaatcgttggcgtgacaacggaggacgatggtatctacacatgtattgccgtgaacgacatgggcagcgcatccagctcggcaagtctacgggtactggggccgggtatggacggcatcatggtgacttggaaggacaatttcgattcattttatagtgaggtcgccgagctggggcggggacgattctcggttgtgaagaagtgtgaccaaaaaggcactaaacgagctgtggctaccaagttcgtgaataagaagcttatgaagcgggatcaagtgactcacgagttggggatcctgcagtccttacagcaccctctgttagtggggctcctggacacttttgagaccccgacttcttacattcttgtcttggaaatggctgatcaggggagactcctcgactgcgtggtgaggtggggctctctgaccgaagggaaaatcagggctcatttgggcgaagtgttggaagccgtaaggtacttgcataactgccgcattgctcatctggacctgaagccagagaacatactggtggacgaatccctggcaaaaccaaccataaagctggcggattttggtgacgctgtccagcttaacaccacgtattatatacatcaactactgggaaatcccgaattcgcagcccccgagatcatcctgggcaatcctgtttccctcacttctgatacgtggagtgttggggtgcttacatacgtgctactgtctggcgtgtcaccatttctcgatgactccgtagaggagacgtgtctgaatatatgccggctcgacttcagctttcccgacgattactttaaaggagttagtcagaaagctaaagagtttgtttgttttctgctgcaggaagacccagccaaacggcctagtgctgcgctggccctccaggagcagtggctgcaggccggaaacggcagaagtactggtgtcctcgatacatcaaggttgactagctttatcgaacgacgaaagcaccagaacgacgtgagaccgattagatctatcaagaattttctccagagtcggctgctcccaagggtgtag

SEQ ID NO: 139027 - DNA, 768 bp, Artificial Sequence
  Description of Artificial Sequence: Synthetic coding sequence
atggccctagaagataggccttccagcctgctggtggatcagggtgatagcagctcgcctagtttcaatcccagtgacaatagcctgctcagcagtagctctccaattgacgagatggaggaaaggaaatctagctctctcaagcgaaggcactatgtgcttcaggagctggttgaaacggaacgagattatgtaagagatctgggctatgtagttgaaggctatatggctctcatgaaggaggacggagtgccagatgatatgaagggaaaagataagatcgttttcggcaatatccatcaaatctacgactggcatcgggacttctttctcggtgaactggaaaaatgcctggaagacccggaaaagctaggatccctgtttgtgaaacatgagaggcgactccatatgtacattgcctactgccagaacaaacctaagtccgaacacattgtttcggagtacatagatacctttttcgaagatctgaaacagagacttggccacaggttgcaactcactgacctcctgatcaagcccgtgcaaagaataatgaaataccagctgttacttaaggactttctgaaatacagcaagaaggccagtttggacacaagcgagctggagagggccgtcgaggtcatgtgtatcgtacctcgccgctgcaatgacatgatgaacgtcgggaggctgcagggatttgatggacgggtggtcgccctgtgtcatcgctttaaggaaacgttccgcgagatctgctggttctag

SEQ ID NO: 139028 - DNA, 1203 bp, Artificial Sequence
  Description of Artificial Sequence: Synthetic coding sequence
atgaacggtcagctggacctttccgggaaactgatcatcaaggcccagctcggggaggacattcgccgaatcccgatacataatgaggacataacctacgatgaactggtgctgatgatgcaaagagtattccgtggcaagctgctctctaacgatgaggtcaccataaagtataaggatgaggacggggatctgatcaccattttcgacagtagcgacctgagcttcgcaatccagtgttcaagaattttgaaattaaccctgtttgtgaacgggcaaccaaggcccctcgaatcctcccaggttaaatatctgcgcagggagctaatcgaacttcggaacaaagtaaatcggctgctcgactctcttgagccccctggagagcccggcccctccaccaacattcctgagaacgacacggtggacggcagagaggaaaaatccgccagcgatagctctggaaagcagtcaacacaggtgatggcagccagcatgagtgcattcgaccccctgaagaatcaggacgaaataaacaaaaacgtgatgagcgcctttggtctgactgatgatcaggtctcaggcccaccatcagcgcccgctgaggatcgctcaggcacacccgattcaatagcttcaagcagtagcgccgcacatccaccaggagtccagcctcaacagcctccctacaccggagcccagacacaggcaggtcagattgagggacaaatgtatcagcagtaccagcagcaagctggctacggcgcccagcaaccccaggcaccacctcaacaaccacagcaatatggtatccagtacagcgcttcatactctcagcagacaggtccacaacagcctcagcaattccaggggtacggacagcagccgaccagtcaggcccccgcccccgctttttctgggcagcctcaacagcttccagcgcagcctccacagcaatatcaggcaagtaactatcctgctcagacctacactgcccaaaccagccagccaaccaactatacggtggcaccggcatctcaaccaggcatggccccctcgcagcccggtgcctaccagccacgcccagggtttaccagccttcccggctccactatgacccctccaccatccgggccaaatccgtacgccaggaatagaccccccttcggccaggggtacactcaacctgggccaggctacaggtag

SEQ ID NO: 139029 - DNA, 1101 bp, Artificial Sequence
  Description of Artificial Sequence: Synthetic coding sequence
atgaatggccaattagacttatccggtaagctaattattaaggcacagctgggcgaagacattcggcgcatccccatccacaacgaggatatcacctacgatgagcttgtgttgatgatgcaacgcgtcttccgcggcaaactcctgagcaatgacgaggtcaccataaagtacaaagatgaggatggggacctgatcacgatatttgattcctccgacctgtcttttgcaatccaatgctcaaggatcctcaaattgaccctgtttgtgaacggccaaccccgaccgctggagagcagccaggtgaaatatctgcggagagaactgatagaactgcgcaacaaggtgaatcgactgctggattcactggaaccccctggtgagcctggaccaagcacgaacatccccgaaaacgatacagtagacggccgcgaggagaagagcgcctcagacagttccggcaaacagtcaacacaggtgatggccgcctctatgtcagcttttgaccccttaaagaatcaagacgagattaacaaaaacgtgatgtccgctttcggtctaactgacgatcaagtctcaggaccacctagcgctcccgctgaggatcggtccggcaccccagattctattgcctcgtcatcatccgcggcccacccgccaggggttcaaccacaacagccgccatatactggcgcccaaacccaggccggccaaatgtatcaacagtacagcaatagacctgccatggtccattccagccgaaggctgcacttatcttcactcaatagtatggttttctctatccaacaagccattgtctcccgcctggacctaaacaatctgtcctcatcacgggacatggcgagcaatcagctgcctagacatcaactgctccctttcttagtgtcattgaacaattgtctactgtctcggcattcctccactcggcgagctattatcctgcacaagctaacgcttcctaaactgctttccctcctgatcatcctgtggttgctgcccttgaatctcgaatggctgcaggccaacttgggtcctatcaaccaggatcaagtgctcctgcatttcctggaagttccttag

SEQ ID NO: 139030 - DNA, 474 bp, Artificial Sequence
  Description of Artificial Sequence: Synthetic coding sequence
atgaatggtcaacttgacctgtctgggaagcttataatcaaggcccagttaggcgaagacatacgccggatcccaatccacaacgaagatataacttacgatgagctggtcctgatgatgcagcgggttttcagaggaaagctgctgagtaatgacgaagtgacaatcaagtataaggacgaagacggtgacctgattactatatttgacagctccgacctgtcgttcgcaatccagtgctcccgtattcttaagctgacactgttcgttaacggccagccccggcctttagagagttcccaggtgaaatatctcagaagagagcttatcgagttgcggaacaaggtcaacaggctactggacagccttgaacctcccggagagcctggaccctccacgaacattcctgaaaatgatactgttgatggtcgtgaggagaagagcgcctcagactcaagcggtaaacagtcgtag

SEQ ID NO: 139031 - DNA, 387 bp, Artificial Sequence
  Description of Artificial Sequence: Synthetic coding sequence
atgaatggacagcttgatctgtctgggaagttaattattaaggcccagctcggcgaagatattagacggatcccaatccataatgaggatatcacctacgacgagctggtgctcatgatgcagagagtgttcagagggaagctcttgagcaatgatgaggtaactatcaagtacaaggacgaagatggcgatttaattaccatttttgatagcagtgacctcagctttgctattcagtgtagcagaattttgaaattgacactgtttgtcaacgggcaaccacggcctctggaatcctctcaggtcaaatatctccgccgagaattgattgaattgcgaaacaaagtgaacaggctgctcgactccttggagccgccaggggaatag

SEQ ID NO: 139032 - DNA, 546 bp, Artificial Sequence
  Description of Artificial Sequence: Synthetic coding sequence
atgaatgggcagctggatctgagtgggaaactaatcatcaaggcccaattgggggaggatatccgtcggattccgatccataatgaggacattacatatgacgagctggttctgatgatgcagcgtgtgtttcgaggcaagctgttatctaacgacgaggttacaatcaagtacaaagacgaggacggcgacctgatcacgatcttcgactcatcagatctgtccttcgcgattcagtgttccagaattctcaaacttactctgttcgtcaatggacagccccggcctttagaaagtagccaggttaaatatctacggcgggagctgattgagctgaggaacaaagtgaatcggctacttgactcactcgaacccccaggcgaacctggcccaagtactaacatccctgagaatgacactgtagacgggcgagaggaaaagtcagctagcgacagttccggtaaacagtccacgcaggtcatggccgcttccatgtccgcctttgacccgctcaagaaccaagatgagattaacaagaatgtctag

SEQ ID NO: 139033 - DNA, 1203 bp, Artificial Sequence
  Description of Artificial Sequence: Synthetic coding sequence
atgaacggtcagctggatctgtcaggaaagctgatcatcaaggcgcagctgggagaggatatcaggcggattccaattcacaatgaagatattacctatgacgagctggtgctcatgatgcaacgggtgttccgggggaaactactatctaacgatgaggtcactattaagtacaaggatgaggatggtgatctaatcactatcttcgactcatccgatctgtcctttgccatccagtgctctaggatcctgaagctgactctctttgttaacggacagcccagacctctcgaaagttcccaggtaaaatatcttcgaagagagttgatcgagctaaggaataaagtgaataggttgttagactctctggagccacccggggagcccggccccagcacgaatatcccagagaacgacacggtcgacgggcgggaggaaaagtcagcctcagactcatccgggaaacaaagcacacaggtgatggcggcaagcatgtcagctttcgacccactgaagaaccaggacgagataaacaagaatgtgatgagcgccttcggattaaccgacgatcaggtcagcggaccaccatccgcacccgcagaggatcgtagcgggactccagatagcatagcttcatccagcagcgcagctcaccccccaggggtccaacctcagcagccaccttatacgggcgcccaaactcaggcggggcagattgaggggcagatgtaccagcagtaccagcaacaagccgggtacggggcccaacagcctcaggcacctccccagcagccacagcagtatggcattcaatattcagcctcatatagccagcagacagggccccagcaaccacagcagttccaggggtatgggcagcagccaacctcccaggcccccgcgcccgctttttctgggcagccacagcaactccccgctcagccgccccaacaatatcaggcctccaattaccctgcccagacctatacagctcagactagccagcctactaattatacagtagctccggcctcccaaccaggcatggctccatcccagcctggcgcctatcagcctagaccaggatttaccagcttgcccggcagtaccatgacacccccgcctagcggccctaacccctacgctcgcaaccgccccccctttggacagggttacacccagccgggacccggctacaggtag

SEQ ID NO: 139034 - DNA, 1191 bp, Artificial Sequence
  Description of Artificial Sequence: Synthetic coding sequence
atgaatggccaactggatctgagcggaaaattaattattaaagcacagctcggcgaggacattaggagaattcctattcacaatgaagatatcacatacgatgagcttgttctcatgatgcagcgggtctttaggggtaaactcctgagcaatgacgaggtcaccattaagtacaaggacgaagatggggacctcatcaccatcttcgattcctccgatctcagttttgccatccaatgttctcggatacttaaactcaccctatttgtaaacgggcagcctcgacctctggagtcatcacaggttaaatatcttaggagggagctcatagaattaaggaataaggtgaatcgtcttcttgactccttggagcctccaggggagccaggtccttctactaacatacctgagaatgacactgtggacggaagggaggagaagtctgctagcgactccagcgggaagcagtcgacacaagtaatggccgccagcatgtcagctttcgatccactgaaaaatcaggacgagattaacaaaaatgtcatgtccgcattcggactgaccgacgaccaggtttcaggccccccttctgcacccgcagaggaccggtccggtacaccggacagcattgcttcctcgtcctcagccgctcaccccccgggcgtgcagccacagcaacctccatacacaggcgcccagacccaggccggccagatgtatcagcaataccagcagcaggctggatacggtgcccagcagcctcaggcccctccccaacagccccagcagtacggcatccagtactcagcgagttattcccagcagacgggcccgcagcagccacagcagttccaggggtatgggcaacagccgacatcccaggccccagcccctgcatttagtggacagccacaacagctgccggcccagccacctcagcagtaccaggcatcgaattaccctgctcagacttacaccgcgcagaccagtcagccaactaactacacagtcgcacctgcctcacagccaggcatggccccctcccaacctggtgcatatcagccccggcccggctttacgtccctcccaggatccaccatgacccctcctccttctggccctaacccctacgcccgtaataggccaccctttggccagggctacactcagcccgggccggggtataggtag

SEQ ID NO: 139035 - DNA, 729 bp, Artificial Sequence
  Description of Artificial Sequence: Synthetic coding sequence
atgggggaagcctcccccccggcaccagcccggaggcacttgcttgtgctgttactgctgttaagcactcttgtcatccccagcgccgcagcgcccatccatgacgctgatgcccaggagtcctccctgggtctaaccggcctgcaatccctgctgcagggtttttctcggttgtttctgaaagggaatctgctgaggggtattgattcacttttttctgctcccatggattttaggggactgcccgggaactaccataaggaagaaaaccaagagcatcagttgggcaacaatactttgagcagccatctccagattgacaaaatgaccgataacaagactggcgaggtgctcatctctgagaatgtcgtagcatccatccagcccgctgagggctcattcgagggggacctgaaggtgccacgcatggaagagaaggaggccctggtgcccatccagaaagccacagattcctttcacaccgagctgcacccacgcgttgccttttggatcattaagctgccaaggagaaggtcacatcaggacgccctcgagggcgggcattggctgtcagaaaaaaggcaccgcctccaggcgatccgagacggacttaggaaggggacccacaaggacgtgttggaagaagggacagaaagttcttcgcattcccggctttctcccagaaaaacccacctgctatacatcttgcgacccagtagacagctatag

SEQ ID NO: 139036 - DNA, 1980 bp, Artificial Sequence
  Description of Artificial Sequence: Synthetic coding sequence
atgcaggggagcagcctgtggctgtccttgaccttcagatcagccagagtgctttctcgcgcccgcttcttcgaatggcagtctcctggcttacccaacaccgctgccatggagaatggtaccggcccttacggtgaagagaggccacgggaggtgcaggagaccaccgtgaccgagggggccgcaaaaatcgcctttccaagtgccaatgaggtgttttacaatcctgtgcaggagttcaatcgggacctcacttgtgccgtcattaccgagttcgcccgaatccagctgggtgcaaagggcattcagattaaggtgcctggagagaaggatacccagaaagttgtggtggatctcagcgaacaggaggaggagaaagttgagctgaaggagtctgagaacttagcaagcggagatcagccacgcactgctgctgtcggagagatctgcgaggaaggcctccatgttctggaaggcctggccgcaagtggactccgaagcatcagattcgcactggaggtcccggggctgcgtagtgttgtcgcgaacgatgcctccacacgcgcggttgatctgatccgacgaaatgtccagctaaatgacgtggcccacctagtgcagccctcccaggccgatgccaggatgttaatgtaccagcaccagagagtgtccgaacgcttcgatgtcattgaccttgacccatatggatctcccgccacctttctggatgctgccgtgcaagctgtgtcagagggaggactgctgtgcgtaacatgtacagatatggcggttttggcaggtaattctggtgaaacttgctattcgaagtacggagccatggccctcaagtctagggcatgtcatgagatggcactgaggatcgtactgcattccctcgacctccgagcaaattgttatcagagattcgtcgtgccactcctcagcatcagtgccgacttctacgtgagggtgttcgtccgagtgttcacaggccaagcgaaagtgaaggcctccgcatctaagcaggcgcttgtatttcagtgtgtcggctgtggcgcatttcatctgcagcggctgggaaaggcaagtggtgttcctagtgggcgcgctaagttttctgccgcatgtggacctcctgtgactcccgagtgtgaacactgcggccaaagacaccagctgggcggaccgatgtgggctgaaccaatccacgatctggatttcgttggtagagtcctcgaggcggtttctgcgaatcccggtcgtttccatacctcggagagaatccgcggagttctcagcgttataaccgaagagctaccagacgtgcctctttattataccttggaccagttgtcctccaccattcattgtaacacaccgtcgctcctccagctgagatccgctctgcttcacgctgactttcgagtgagtctcagtcatgcatgcaaaaacgcagtcaagacagacgctccggcatccgccttatgggacattatgcgctgctgggaaaaagaatgtccggtgaagcgagaacgcttatcggagacaagtcctgctttccgcatactgagtgtcgagcctagactgcaggccaacttcactataagagaggatgccaacccatctagccggcagaggggtctgaaaagatttcaggccaaccctgaagcgaactggggaccacgaccccgtgcccggccgggcggaaaagcggctgatgaggccatggaggagaggaggcggctattacaaaacaagaggaaggagccgcctgaggacgtcgcccagcgggccgcacgcctcaagacattcccatgtaagcggtttaaggaggggacgtgtcagcgcggcgaccagtgctgctactcccatagtcctcctaccccaagagtatccgcggatgccgctccagactgcccggaaactagcaaccagacaccaccaggcccaggtgccgccgccggccctgggatcgactag

SEQ ID NO: 139037 - DNA, 1980 bp, Artificial Sequence
  Description of Artificial Sequence: Synthetic coding sequence
atgcagggcagtagcctgtggctgtcattgacattcagatcagcgagggttctgtcgagagcacgctttttcgaatggcaatctcccggactcccaaatactgccgctatggagaacgggacgggaccctacggcgaggagaggcctagggaggtgcaggaaacaacagttacagaaggcgctgctaaaattgcctttccgtctgccaacgaagtgttctataatcccgttcaggaattcaatcgggatttgacctgcgccgtgatcacagagttcgctcggattcagttaggcgccaaaggaattcagatcaaagtacctggcgagaaggatacccagaaggtggttgtggatttgtcggagcaggaggaggaaaaggtcgagctcaaggagagcgagaaccttgcctctggcgatcagccacggacagctgctgtgggagaaatttgcgaagagggacttcatgtgctcgagggtttggcagcctctgggctcaggagcataaggttcgcactcgaagtgcctgggctgcggagcgtggtcgcgaatgacgccagcacccgggcagtcgatcttatccgaaggaatgtacagctgaacgatgtagcccatctcgtacagcccagccaagccgatgcacgaatgctcatgtaccagcatcagagggttagcgagcgcttcgatgtgatagacctcgacccatatggttctcctgctaccttccttgatgctgctgtgcaagcagtgtcagagggaggcctactgtgcgtcacatgcacggatatggctgttcttgctggcaattccggagaaacttgctactctaaatatggggccatggccttgaagtcaagggcttgtcacgagatggccctgcgaatcgtcttacattcccttgatctgcgcgccaactgttaccaaaggttcgtcgtgccgctcctaagtatttcagccgacttctacgtgagagtctttgtgagggttttcactggtcaggccaaggtgaaggccagcgcaagcaagcaagcactggtctttcagtgtgtaggatgcggagcgttccacttgcaacgactgggcaaggcatccggcgttccatctggacgggccaaattctctgccgcatgcgggccccccgtcacaccagaatgcgagcactgtggccagaggcaccagctcggggggccaatgtgggccgagcctatacatgacctggatttcgtcggcagggttctggaggctgtgtctgccaatcccgggcggtttcacacaagtgagcgaatccgcggggtgctctctgtcattaccgaggagttgcccgatgtcccactgtactatacgctggaccagttgtcttcaacaattcactgtaacacgccaagccttcttcagttgagaagcgctcttctccacgccgactttcgtgtctctttgagtcatgcttgtaaaaatgccgtgaagactgatgcacctgcatcagcactctgggacattatgaggtgctgggagaaggagtgccccgtgaaaagggaaaggcttagcgaaacatcccctgcatttcggatcctatcggttgaaccgaggctgcaggccaactttaccataagagaggacgctaatccaagttccagacaacgcgggctgaaacgctttcaggccaatcctgaggctaactgggggcctcgcccaagggctaggccggggggcaaggctgcagatgaagctatggaggaaagacggcgtctgcttcagaataagaggaaggaaccacccgaagatgtggcccagcgcgcagcaaggctgaagacctttccatgcaagcgatttaaagaaggcacttgtcaaagaggggatcagtgctgttattctcattcccctcctactccacgggtctctgccgatgcggcccctgactgtcccgaaacctctaaccagacgccgcccggacctggagcagcggctggacctgggatagactag

SEQ ID NO: 139038 - DNA, 1878 bp, Artificial Sequence
  Description of Artificial Sequence: Synthetic coding sequence
atgtccgagaatctggacaatgagggaccgaaaccaatggagtcttgcggacaagaaagtagtagcgccctttcatgccctaccgtgtctgtgccacctgctgcccccgccgcccttgaagaggtggaaaaggagggggctggcgctgcaacaggacctggtccgcaacctgggctttattcctatatccgcgacgacctatttacgagcgaaatatttaaattagagctgcagaacgtgcctagacacgcttcattctctgacgttagaaggtttctggggcgcttcggtttacaaccacataaaactaagctcttcggacagcctccatgcgcgtttgtcacttttcgatccgccgctgaacgggataaagctctccgagtgctgcatggagctctctggaaaggcagacctctgagcgtgaggttagctagaccaaaagcagatccaatggcgcgacggcggcgccaggagggggagagcgagccacccgttaccagagtcgccgatgtcgtgacacctctgtggacagtgccgtacgctgagcaactggagagaaagcagctcgagtgcgagcaggttctgcagaaactcgcaaaggagattggatcaaccaacagggccctgctgccctggctcctggagcaacggcacaaacataacaaagcatgttgccctctggaaggagtccgcccctcacctcagcagacagagtaccgaaacaagtgcgagttccttgtcggagtgggcgtggatggcgaagataacactgttgggtgccgactgggcaagtacaaggggggcacatgcgctgtggccgctcccttcgacactgttcatatccccgaagcgacaaagcaggtggtcaaggcctttcaggaatttatcaggagcacgccatactctgcctacgatcccgagacatacactgggcactggaaacaactgacagtacgcacaagtagacgacaccaagcaatggcaatcgcatacttccacccccaaaaactctcccccgaggagctggcagaattgaagacttccttggcccagcactttacagccggcccaggccgtgccagcggagtaacctgcctgtactttgtggaagaaggacaacgcaagacgccttctcaggaaggactccctcttgagcatgtagccggggaccgctgcatccatgaggatctcctgggcttgactttccgaattagccctcacgctttcttccaggtcaatactcccgccgctgaagtgttgtacaccgtgatccaagactgggcgcaactggatgcaggatccatggtgttggacgtgtgttgcggaactgggactattggcctggcactcgcacgcaaggtgaaacgcgtgatcggagtggagctgtgcccggaggccgtggaagatgccagggtgaacgcgcaggataacgagctctccaacgtggagtttcactgcggcagggctgaagacttggttccgacactggtatctagactggcatcccagcacctcgtcgctatcttagatccgccccgtgctggcctgcactccaaagtgatcctcgccattaggagggccaagaacttgcgccgacttctgtacgtgtcctgcaatccccgggcagccatgggcaattttgtcgatttatgccgggccccctcaaatcgggtcaagggcatcccattccgcccagttaaggctgtggcggtcgatctgtttcctcagactccacattgtgagatgctcatcctgttcgagcgggtggaacatcccaatggtaccggcgtcctgggacctcacagccctccagctcagcccacccctggcccccctgacaatacactccaggagacgggtacattcccatcatcctag

SEQ ID NO: 139039 - DNA, 1878 bp, Artificial Sequence
  Description of Artificial Sequence: Synthetic coding sequence
atgtcggagaatttggacaatgaggggcccaaaccaatggaaagttgcgggcaggagagcagcagtgcacttagctgccctacagtttccgtgccccccgcagcccctgcagcactggaggaagtcgagaaagaaggtgccggcgccgcaaccggaccaggccctcagcccggcctgtactcttacattagggatgaccttttcacctcagagatctttaaactggaactgcaaaatgttccgcgacatgcctcattcagcgacgttagaaggtttctgggtcggttcggcctccagcctcacaaaaccaagctgtttgggcagcccccctgtgcctttgtaacattccgtagcgccgccgagcgggacaaggccctgcgcgtcctgcacggtgctctgtggaagggaagacccctttctgtgcggctggctagacccaaggccgatccaatggcccgaagacgccgtcaggaaggcgaatccgaacctcctgttacgagagtggctgatgtggttacccctttgtggacagttccatacgctgaacagcttgaaaggaagcaacttgagtgcgagcaagtgctccagaagctggcaaaagaaattggatcaaccaatagggccctgttaccctggttgctggaacagcgtcataagcataacaaagcgtgctgccctcttgagggtgtccgaccatcaccgcaacagactgagtacaggaataaatgcgagtttcttgttggcgttggggttgacggagaagataacacagtgggctgtcgtttggggaagtacaagggcggaacctgcgccgtcgccgcgcctttcgatacagtccatatacccgaagctaccaaacaggtggtaaaagctttccaggaatttatccggagtacgccttacagtgcttatgatcctgagacatataccgggcattggaagcagcttacagtgcggacgagccgtaggcatcaggccatggcgattgcttacttccatccccagaaactgtctcctgaggagctggctgagctcaagacgtcactagctcagcattttacggctggaccaggacgggcttctggggtcacatgcctgtatttcgtcgaagagggtcagcggaagaccccctcccaagaagggctgcctctggaacacgtggctggggaccggtgcatacacgaagatctgctcggcctgaccttcaggatctcacctcatgccttctttcaagtaaacacccctgccgcagaggtgctctacacagtgattcaggattgggcgcaactggacgcaggcagcatggtgctggatgtgtgctgtggaacgggcaccattgggctggcgctggcacgcaaagtgaagcgtgtgattggggtcgagctgtgcccagaagcggttgaagacgcaagagtgaatgcacaagacaatgaactgtcaaatgttgaatttcactgcggacgtgcggaggacttggtgcccactcttgtctcccggctcgcctctcaacacctagttgctatcctggatcctccgcgagctgggctccattcgaaggtcattctagctataaggcgcgccaaaaatttgcggcgcttgctctatgttagctgcaaccctagggccgcgatgggaaattttgttgacctgtgccgagccccatccaatcgagtgaaggggattcctttccgcccagtcaaagcagtggcagtggatctgtttccccagactccccattgcgaaatgctgatactatttgagagggtggaacaccctaatggtactggtgtacttggacctcactccccacctgctcagcctaccccaggacctccagacaatacgctacaagagactggaacgtttccatcgagctag

SEQ ID NO: 139040 - DNA, 1689 bp, Artificial Sequence
  Description of Artificial Sequence: Synthetic coding sequence
atgagcgaaaatctcgacaatgagggccccaaacccatggaatcgtgtggacaggagtcatcatctgccttatcttgtcctaccgtatcagtgccacctgctgctcctgccgccctggaagaggttgagaaagagggggcaggcgccgcaactggccccggaccgcagccaggtctgtactcctatatccgggatgatctcttcacctctgagatcttcaagctggaactgcagaacgttcccaggcacgcctcattcagcgacgtgcgccggttcttagggcggttcggacttcagccccacaaaacgaagctgttcgggcagcccccctgcgccttcgtgacattcagaagtgctgctgagcgcgataaggcactgcgggtactccatggtgccttgtggaaaggccggccattgtcggttcgcctggctcgtcccaaagccgaccctatggcccgacggcgccgccaggagggggagtccgagccccccgtcacgcgggtggccgacgtggtgacacctctttggactgtaccttatgccgagcagctcgaacgaaaacaactcgagtgtgaacaggttctgcagaagttagccaaagaaatcggctcaacaaatcgagccctgctaccctggcttttggagcagcggcataagcacaacaaggcctgttgtcccctcgaaggggttcgcccctcaccccagcagacagaataccggaacaagtgcgaattcctagttggagtgggagtggatggggaggataataccgtgggctgtaggctcgggaagtataaaggcggcacctgcgccgtcgccgccccattcgatacagtgcacatccccgaagccactaaacaggttgtgaaggccttccaggaatttattcggagtaccccttatagcgcctatgatcctgaaacctatactggccactggaagcagttgaccgtgcggacaagccgccgacatcaagccatggctattgcttatttccaccctcaaaagttgagtccagaagagctggccgaactgaaaaccagtctcgcgcagcattttacagcgggtcctgggagagcgtcaggtgtgacatgcctgtacttcgtagaagagggtcagaggaaaacaccctcccaagaggggttgcccctggaacacgtggccggggaccgttgcatccatgaagatctcctgggtctcacctttcggatctctccgcatgctttcttccaggttaatacacctgctgccgaggtgctgtatactgtgattcaggattgggcccagttagatgccgggtctatggtgttggacgtttgctgtggaactggcactatcggccttgcgctggccagaaaagtaaaacgtgtgataggcgtagagctgtgtccagaggcagtggaagacgctagggtcaacgcgcaggacaacgagttatctaacgtggaatttcactgcggaagagctgaagatctggtaccaacccttgtatcccggctagcatcgcagcatctggtagctatccttgaccccccccgagctggcttacactcaaaagtcattctggccatccggcgcgccaaaaacctgaggaggttactttacgtgagctgtaaccccagggctgctatggggaatttcgtcgatgccccgctctttccaccacaacctcttcaatctccaatctag

SEQ ID NO: 139041 - DNA, 1530 bp, Artificial Sequence
  Description of Artificial Sequence: Synthetic coding sequence
atggtgctctggatcctatggcgacctttcggcttttcgggccggttcctgaaactggagagtcatagcatcactgagtcaaagagcctaattcctgtggcatggacatcgctgacacagatgctgttggaagcccctggtatcttccttctcgggcagagaaagagattctcaaccatgcctgagactgagactcacgaacgggaaaccgagttattcagtcctccatcggatgttagagggatgacaaagctggatcgaactgcttttaaaaagactgttaacattccggtgctgaaggtgcgcaaggagattgtgtcgaagctcatgaggtctctgaagcgggctgctctccaaaggcccggcattaggagggttatcgaggaccccgaagacaaagagagcaggctcatcatgcttgatccatataagatctttacccatgacagctttgagaaagcagagctgtcagtgctggaacaattaaacgtgagtcctcagatctccaaatataatctggaactcacgtacgaacacttcaaatccgaagagattttacgcgccgttctgcccgagggacaagatgtcacctccggatttagccgaattgggcatatagcacacctcaaccttcgcgaccatcaattgagcttcaagcatctaatcggccaggttatgatcgacaagaacccaggaattacaagcgcagttaataagattaataacatagataatatgtaccggaattttcaaatggaagtgctctctggtgagcagaacatgatgactaaggtccgagagaacaattacacctatgagttcgacttctcgaaggtgtactggaatccccgcctgtctacggaacacagtaggatcaccgagctcctgaagcccggagacgttttgtttgacgttttcgctggagtgggcccatttgccatccctgtcgctaagaagaattgtaccgtgtttgcaaacgatctaaacccagagagccataagtggttgctctataattgtaagctgaacaaggtggaccagaaagtaaaagtgtttaatttggacgggaaggatttcctgcagggtcccgtgaaggaggagttgatgcaactcctcgggctatccaaggagcggaagcctagtgtgcacgtggtgatgaacctgccagctaaggctattgagttcctcagtgctttcaagtggctccttgatggccagccatgtagcagtgaattcttaccgattgtccattgttactccttcagcaaggatgcaaaccctgcagaagatgtgcgtcagagggccggcgccgttctgggcattagtctcgaggcttgtagttccgtgcacctggtgaggaacgtggctcccaacaaagaaatgctttgtatcactttccaaatccccgccagtgtgctatataaaaatcaaacacgcaatcccgaaaaccatgaggatccccctttgaaacgccagcggaccgcggaggcattctctgacgaaaagacgcagattgtttctaatacctag

SEQ ID NO: 139042 - DNA, 1266 bp, Artificial Sequence
  Description of Artificial Sequence: Synthetic coding sequence
atgcaggcccttagacatgttgtttgcgctctgtccggaggcgtggattccgccgtcgcagctctcttgcttagaaggcgaggctaccaggtgaccggtgtgtttatgaaaaattgggactcactcgatgagcacggagtttgtacggctgataaggactgtgaagatgcctacagggtttgccagatattggatattccctttcatcaggtgtcctacgtcaaagaatactggaacgacgttttttccgatttcctgaacgagtatgagaagggacgaacaccgaatcctgacatcgtttgtaacaagcacatcaaattttcctgtttttttcattacgctgtggataatctgggagccgacgcaatcgctactggtcactacgctagaacttcgcttgaggacgaggaagtgttcgagcaaaaacacgtcaagaagccggagggtttgtttagaaatcggtttgaggtcaggaatgccgtgaagctattgcaggcagccgatagcttcaaggaccagaccttttttctgtcgcaggtttcgcaggacgcattacggaggactatttttccactgggcgggcttaccaaggagtttgtaaagaagattgccgccgagaacaggttgcaccacgtgttgcaaaagaaggagagtatgggaatgtgtttcattgggaagcgcaacttcgaacactttctgctgcaatatctgcagccacggcctgggcactttatttccatagaggataataaggtcctgggaacacacaagggctggtttctgtatacactcggacagagagcgaatatcggcgggctgagggaaccctggtacgtcgtggaaaaggacagcgttaaaggagacgtgttcgttgccccccgcactgatcaccccgccctgtatcgagatctactgcgaacctcaagggtacattggatagccgaagagccgcctgcggcactggtgagggataagatgatggagtgccacttccggttccgccaccaaatggcgctggtaccatgcgtcctcactctgaatcaggatggtactgtgtgggttaccgccgtccaagccgtgagggccttagccacaggacagtttgccgtgttttataagggggatgagtgcctcggctccggtaagatcctacgtttaggcccatccgcttataccttacagaagggacaaagaagggcaggtatggccaccgaatctccctcagacagtcctgaagacggacctggcttgagtcctcttttgtag

SEQ ID NO: 139043 - DNA, 300 bp, Artificial Sequence
  Description of Artificial Sequence: Synthetic coding sequence
atgcaggcgctcaggcacgtggtgtgcgcactttccggcggtgtggatagcgctgttgccgccctgcttctgagaaggaggggctaccaggttacaggcgtcttcatgaagaattgggatagcttagacgagcacggagtgtgcaccgccgacaaagactgcgaggatgcttatagggtgtgccaaatactggacatccccttccaccaggtttcctacgtgaaggagtactggaacgacgtgttccggggacggtgtcattgtcatcgatccctgtgcaagaattttcccggccggtag

SEQ ID NO: 139044 - DNA, 396 bp, Artificial Sequence
  Description of Artificial Sequence: Synthetic coding sequence
atgaagaattgggattcgttggatgaacatggtgtatgcacggccgataaggattgtgaagacgcttaccgtgtgtgccaaatcctggatattccattccatcaggtaagctatgtcaaagagtactggaacgacgttttttcagacttcctgaacgagtatgaaaagggtcggacgccaaatcccgacatcgtgtgcaacaagcatatcaaattttcctgcttttttcactatgctgtggataatttgggcgccgatgccatcgctactggccactacgcaaggacgtccctagaggacgaggaggtgttcgaacagaaacacgtgaagaaacctgagggcctgttccgcaatcggtttgaggttcgcaatgccaggttccctcgcatgccctag

SEQ ID NO: 139045 - DNA, 300 bp, Artificial Sequence
  Description of Artificial Sequence: Synthetic coding sequence
atgcaggcgctgaggcacgtggtttgtgcactgtctggcggcgtcgattccgcagtcgccgctctgctcctccggcgacggggctaccaagtcaccggcgtgttcatgaagaattgggattccttggatgaacacggcgtgtgcaccgccgataaggattgcgaggacgcatatagagtgtgtcaaatcttggacatcccattccaccaggtgtcctacgtcaaggagtattggaacgatgtatttcgcgggcggtgccactgccaccggagcctctgtaagaactttcctggcaggtag

SEQ ID NO: 139046 - DNA, 300 bp, Artificial Sequence
  Description of Artificial Sequence: Synthetic coding sequence
atgcaggcattaaggcacgtggtgtgtgctctgtcagggggcgtggacagcgctgtggctgctctgctgcttcggcgtagaggctaccaagtaacgggcgtctttatgaagaactgggatagcctggatgagcacggtgtttgcacggccgacaaggattgtgaagacgcgtacagagtgtgtcagatcctcgacatacccttccatcaggtctcttatgtgaaggagtactggaatgacgttttccggggccggtgccactgtcaccgtagcctctgcaaaaattttccagggagatag

SEQ ID NO: 139047 - DNA, 300 bp, Artificial Sequence
  Description of Artificial Sequence: Synthetic coding sequence
atgcaggccttgcgccacgtggtttgcgcgctctctggaggagttgattctgccgtggctgcgctcttgcttcggagaagaggatatcaagtgactggcgtctttatgaagaattgggacagtttagacgaacacggcgtgtgtactgccgacaaggactgcgaagacgcataccgtgtgtgtcagattctggacattccgttccatcaggtgagttacgttaaggagtattggaacgacgtgttccggggacggtgtcactgccatagatccctgtgcaagaatttccccggtcgctag

SEQ ID NO: 139048 - DNA, 501 bp, Artificial Sequence
  Description of Artificial Sequence: Synthetic coding sequence
atgcaggccctgaggcatgtcgtctgtgctctcagtggcggcgtggattcagccgtcgcagccctgctactcagaaggcgaggctaccaggtgaccggagtctttatgaagaattgggatagcctggatgaacacggggtgtgcactgcggacaaagactgcgaggatgcctaccgcgtgtgtcaaattctggacatcccttttcatcaggtgagctatgttaaagagtactggaatgacgtcttctcggactttctgaatgaatacgagaagggcagaacccctaaccccgatattgtgtgtaataaacacattaaattctcttgcttcttccactatgcggtcgacaacctgggagccgacgcaattgctactggccactatgcaaggacgtcgctagaggatgaagaggtctttgaacagaagcatgtcaagaaaccagaggggttgttcagaaatcggttcgaagttaggaatgccagatttccacgcatgccttag

SEQ ID NO: 139049 - DNA, 1038 bp, Artificial Sequence
  Description of Artificial Sequence: Synthetic coding sequence
atggaaccactccgagtgctagaactgtactccggtgttggcggaatgcaccatgctctgcgcgagagctgtatccccgcacaggttgtcgccgctattgacgtgaatacagtggctaatgaagtgtataaatacaacttccctcatacacagctgcttgctaagactatcgaggggatcacgctcgaggagtttgacagattgtcattcgatatgattctgatgtccccgccttgtcaaccgtttacacgggacctcctcatacaaacaatcgaaaactgcggattccagtaccaggagttcctgcttagtccaacaagtctaggaatccccaactccaggctgcgctacttcttgattgctaagctccagtcagagccactaccttttcaggctccagggcaggtcctgatggagtttccaaagatcgagagcgtacacccccagaaatacgcaatggacgttgagaacaagattcaggaaaagaacgttgagccgaacatcagctttgacggctccatccagtgttcaggtaaggatgctatattatttaagcttgagactgccgaagaaatccaccggaaaaatcaacaggactcagacctgagcgtgaagatgttgaaggattttttagaggacgataccgatgtaaaccagtatctactgccaccaaagtcccttttgagatacgccctgctgctggatattgtacagcctacttgccgacggtccgtgtgcttcacaaagggatacgggtcttacattgaaggaaccggttccgtgcttcagacagctgaggatgtacaagtcgagaatatatacaagtcgttgaccaacttatcgcaggaggaacaaattacaaagctcctgatactgaagctccggtattttacgcccaaggagatcgctaatcttctgggattcccaccagaattcggattccccgagaagattacagtaaagcagcgctacaggctcctcggtaactcactcaatgtgcacgtggtggccaagttgatcaaaattctgtacgagtag

SEQ ID NO: 139050 - DNA, 216 bp, Artificial Sequence
  Description of Artificial Sequence: Synthetic coding sequence
atggaacccctccgggtactggaattatactcaggagttggcggaatgcaccacgcccttcgtgagtcttgcataccagcccaggttgtcgctgccatcgatgtgaatacggtggcaaatgaggtgtataagtataatttcccacacacccagctgcttgccaagactatcgaaataactaaaataacaaaggtgtatagtttcggaaaatgctag

SEQ ID NO: 139051 - DNA, 354 bp, Artificial Sequence
  Description of Artificial Sequence: Synthetic coding sequence
atggaacccctgagggtcttagaactgtacagcggggtgggaggcatgcatcacgcactcagggagagctgtattccagcccaggtcgtcgcggccattgatgtgaataccgtggccaatgaagtgtacaagtataactttcctcacacccaactcctggccaagacgattgaaaggccacttgatactaacaatcgaaaactttggctgtctgtgccccgggtaagcattatctctaatctttcctggcacagcaagtttaaagccactatcttctcatattgcaaagcctccgtcagagccatcaccctgtcaagtccttggtccggcacggacggtgtcccacagaactag

SEQ ID NO: 139052 - DNA, 1176 bp, Artificial Sequence
  Description of Artificial Sequence: Synthetic coding sequence
atggaacctctgcgcgtgctggaattgtactcaggcgtgggtgggatgcaccacgctctgcgcgagagttgtatacccgcccaagtggttgcagccatcgatgttaataccgttgccaacgaggtgtataagtacaacttcccccacactcaattattagcaaaaactatcgagggcatcacgttggaagagtttgaccggctctcttttgacatgatcctcatgagtcctccttgccaacccttcacaaggattgggcggcagggtgacatgactgatagcaggaccaacagctttcttcacatcctggacatcctaccacggctgcagaagctgcccaaatacatactcctcgagaacgtcaaaggtttcgaggtgtcatcaacaagagatctcttgatacagacaatagagaactgtggttttcagtatcaggagtttctgctctcgcccacttctctgggaattccaaatagtaggttgaggtactttctcattgccaagttgcagagtgagccactacccttccaagcccctggtcaggtgctgatggagttcccaaagatcgaaagtgtccacccccagaagtacgccatggacgtcgagaataagatacaggaaaagaacgtcgaacccaacattagttttgatggctctatacagtgcagcgggaaagatgcaatcctctttaagctggagactgccgaggagattcatagaaagaaccagcaagattctgacctcagcgtaaagatgctgaaagactttctggaagacgacacagacgtgaatcagtatctgctaccgccaaagtctctgctgcgttatgccttacttctagacatcgttcagcccacttgtcgccgttcagtttgttttaccaaggggtatggtagctatatcgagggcacaggctccgtgttgcagacggcggaggatgtgcaggtggagaatatttacaagagtctcactaacttatcgcaggaggagcaaatcacaaaactcctaatcctgaaactcagatatttcacacccaaggagatcgccaacctcctgggttttccacccgaattcggctttccagagaaaatcactgtgaaacagcgatatcgccttttgggtaactccctgaatgtgcacgtggttgcaaagctgattaaaatcttatacgagtag

SEQ ID NO: 139053 - DNA, 1104 bp, Artificial Sequence
  Description of Artificial Sequence: Synthetic coding sequence
atggagcctctcagggttctggaattatatagcggcgtcggaggtatgcatcacgctttgcgtgagtcctgtattcctgcacaggtcgtcgcagcaattgatgtgaatactgtcgcgaatgaggtgtataagtataacttccctcatacgcagctcctggcaaagacgatcgagggcatcacactcgaggaattcgacaggctctccttcgacatgatactaatgtcgcctccttgccaaccttttactcgcctgcagaaactgcctaagtatattctccttgaaaatgtgaaaggtttcgaggtgtcttcaaccagagatttacttatccaaacaattgaaaactgcggcttccagtaccaagagttcctactgtcaccaacctccctgggtatcccaaactcacgcctgcgctacttcttaatcgcaaagctccagtccgaaccactgccatttcaagccccaggacaggtactgatggaatttcccaaaattgaaagtgtgcatccacagaaatatgctatggacgtggagaacaagatccaggagaagaacgttgaacctaatatttcttttgacgggagcattcaatgttccggtaaagacgcaatcctgttcaagctggagacagccgaggagatacaccgaaagaaccaacaagattccgatctgagtgtcaagatgctgaaagacttcctcgaagatgacaccgatgtgaatcagtacctgctgcctccaaaatctctgctgaggtacgcactcttgttagatatagtgcagcctacctgcaggcgttcggtgtgttttaccaagggttacggatcctacatcgaagggacgggaagtgtgctgcagactgccgaagatgtacaggttgagaacatttacaagagtctgactaatctgtcacaggaggagcagatcaccaaattgttaatcctcaaactaaggtatttcactcccaaggaaattgccaacctgctgggcttcccccccgaatttggctttcccgagaaaatcacagtgaagcagcgctacagactcctcggtaattcattgaatgtgcacgttgttgctaaattaatcaagatcctgtatgagtag

SEQ ID NO: 139054 - DNA, 933 bp, Artificial Sequence
  Description of Artificial Sequence: Synthetic coding sequence
atgtccacgctctccctgatgaaatacacctcaatcattttcttgactcacagctacctgccacgcagattaaagatcgggcggcaaggcgacatgacagacagccggaccaacagcttccttcacattcttgacatcctgccccgagatttactcattcagacaatcgaaaattgcgggtttcagtaccaggaattcctgctgtctcctacgagtctggggatccccaattccaggctccgttacttcctaatcgctaagcttcagagcgagccccttccgttccaagcacccggacaagttttgatggagttcccaaagatcgaaagcgtacatccgcagaaatacgccatggacgtcgaaaacaagattcaggaaaaaaacgtcgagcccaacatcagttttgatggaagcatccagtgctctggtaaggatgctattttgttcaaactggagactgcagaggagattcataggaaaaaccagcaggactcggacttaagcgttaagatgctgaaagatttcttggaagatgatacagatgtaaatcagtatttattgccaccgaagtctttgctccggtatgccctgctcctggatattgtgcagccaacatgcaggcgatcagtgtgcttcacaaaaggatacgggtcctacattgagggtactggctccgtgctacaaacggccgaagacgtccaggtggagaatatatataaatctctgacaaatctgagtcaggaagaacaaattactaagctactgatactcaagctgcgctacttcacaccaaaagagatcgccaacctgctcggctttccccccgagttcggtttcccagaaaagatcaccgtgaaacagcgctaccgcttgctcggcaacagcctcaacgtgcacgttgtggccaaactcataaaaatcctgtacgaatag

SEQ ID NO: 139055 - DNA, 1305 bp, Artificial Sequence
  Description of Artificial Sequence: Synthetic coding sequence
atgttaagatgcctctaccactggcatcggccagtgttgaaccggcgatggtcccggctgtgcctgcccaagcagtacctattcactatgaagctccagtctcctgagttccagagtctgtttacagagggcctgaaaagcctgaccgagctgttcgtcaaggagaaccacgagctgaggatcgcgggcggggcggtgagggacctgttaaacggcgtgaagcctcaagacatcgactttgccaccacagccacacctactcaaatgaaagaaatgttccagtctgccggaattcggatgataaataaccgcggcgagaagcacggcactatcacagccagattacacgaagagaattttgagatcactaccttacggatcgacgtcaccactgatggcaggcatgcagaggtcgagttcacgactgattggcagaaggatgccgagaggagggatcttaccatcaacagcatgtttctcggcttcgacggaacactcttcgactacttcaatgggtatgaggacctgaaaaataagaaagtgaggttcgtcggacacgcaaagcagcggatccaagaggactatctccggatactgcgatacttcaggttttacggtcgtattgtggataaacctggtgatcacgatcctgaaacactggaggccattgctgaaaacgccaagggtctggccggcatcagtggcgagcggatttgggtggagctgaagaaaatcctggtgggtaatcatgtgaatcacctgatccatctgatctacgatttggacgtggctccgtacattggattacctgcgaacgcaagtcttgaggaattcgataaggtgagcaagaatgtggacggattttcacctaaacctgtcacactgttggcatcactgttcaaggtgcaggacgatgtaacgaaactcgatctgcgcctgaagattgctaaggaggaaaagaatttggggctgttcattgtcaaaaatcggaaagatctgattaaggctactgactctagtgaccccttaaaaccttaccaggacttcatcattgatagtcgcgagcctgacgccactacaagagtctgcgaactcctgaagtaccagggcgaacattgtctcttgaaagaaatgcaacagtggtccatcccccctttcccagtctctgggcacgacataaggaaggtaggaatctcgagtggaaaggagattggcgccctcctgcagcagctgagagagcagtggaagaaatcggggtaccagatggaaaaggatgaattgctcagctatataaaaaagacatag

SEQ ID NO: 139056 - DNA, 1245 bp, Artificial Sequence
  Description of Artificial Sequence: Synthetic coding sequence
atgctgagatgcctttatcactggcatcgtccagtgctgaatagaaggtggagccgtctatgcttacctaaacagtatctatttacaatgaagctacaatctcccgaattccagtcactcttcactgaggggcttaagtccctcacggagctttttgtaaaagagaatcatgagttgcgcatcgctgggggtgcagtgagggatctactgaacggcgtgaagccacaagacatagatttcgctactaccgcgacacccacccagatgaaggagatgttccaatccgccgggatcagaatgatcaataacagaggggaaaagcatggcacaatcacagccaggttacacgaagaaaatttcgaaatcacaacacttaggatagatgtgactacagatggaaggcacgccgaagtagagttcacaacagattggcaaaaagatgctgaaaggcgggatctgaccattaattccatgtttcttggatttgatggcactctgttcgactactttaatggctacgaggaccttaaaaacaaaaaggtgcggttcgtgggccatgcaaagcagaggattcaagaggattaccttagaatcctgagatacttcagattttatggaagaatcgtcgataagccaggggaccatgatccagagaccctggaggcgattgccgaaaacgccaagggactcgctggtatctctggcgaacgaatctgggtggagctgaagaaaattctggtgggtctgcccgcgaacgcctcactggaagagttcgataaagtgtccaagaacgtcgacgggttctctcctaagccagtgacgctcctggcgtcgctgtttaaggtgcaggacgatgtcaccaaactggacctcaggctgaagatcgctaaggaagagaagaatctcgggctgttcattgttaaaaacaggaaagacttaatcaaggccacggactcttccgaccctctaaagccataccaagacttcataattgattcccgggaaccagatgccacgactcgagtgtgtgaacttctgaaatatcagggggagcactgcctgttaaaagagatgcagcagtggagcattccacctttccctgtgagtggtcatgacatccgcaaggtcggtatctcatcggggaaggaaataggggcgctactgcagcagttgagggaacagtggaagaaatccggctatcagatggagaaggacgaacttctatcatatataaagaaaacctag

SEQ ID NO: 139057 - DNA, 174 bp, Artificial Sequence
  Description of Artificial Sequence: Synthetic coding sequence
atgctgcgatgtctgtatcactggcaccgtcctgtgctcaatagacggtggtccagactgtgcctgcctaagcagtatcttttcaccatgaagctgcaaagtccagaatttcagagtctgttcacggagggcctaaagagcctcaccggcattaatgcctttcacgagaactag

SEQ ID NO: 139058 - DNA, 174 bp, Artificial Sequence
  Description of Artificial Sequence: Synthetic coding sequence
atgctaaggtgtctataccattggcacaggccagtgttgaatcggaggtggtcccggttgtgtcttcctaaacaatatttatttacaatgaagctgcagagtccagagtttcagagtctgttcactgaggggctgaagagccttacaggaatcaacgccttccacgaaaactag

SEQ ID NO: 139059 - DNA, 189 bp, Artificial Sequence
  Description of Artificial Sequence: Synthetic coding sequence
atgctgaggtgtctttaccactggcaccgtcctgtcttgaatcgtagatggagtcgactgtgtctgcccaagcagtacttgttcactatgaagctgcagtctcccgagtttcagagcctgttcacggaaggcctcaagagcctgaccgaactctttgtgaaagaaaatcacgagctaagaatagcctag

SEQ ID NO: 139060 - DNA, 174 bp, Artificial Sequence
  Description of Artificial Sequence: Synthetic coding sequence
atgctgcgatgtctttaccattggcaccggcctgtcctgaataggcggtggagcagattgtgcttacccaagcagtaccttttcaccatgaaactccagagtcctgagttccaaagcctatttacggagggtctcaagagtttgacagggatcaatgcctttcacgagaattag

SEQ ID NO: 139061 - DNA, 1305 bp, Artificial Sequence
  Description of Artificial Sequence: Synthetic coding sequence
atgctccgctgcctgtatcactggcatcggcctgtcctgaacaggcggtggtcgcggctatgcttgccgaagcagtacctatttaccatgaaacttcagagccctgaatttcaaagcctgtttaccgagggcctgaagtccctgacagagctattcgtaaaggagaatcatgagctgaggatcgctggtggggccgtgcgggatttgttgaacggtgtcaaaccacaggacatcgactttgcgaccaccgcaacccctacccagatgaaggagatgtttcaaagcgcgggcattcggatgattaataaccgtggggagaaacacggcaccatcacggctaggctccatgaagagaacttcgaaattacaactctcagaatagatgtgaccactgatggcagacacgcagaggtggaatttaccaccgactggcagaaagacgcggaaaggagggatctgactatcaacagcatgttcctcgggttcgacggcacgctcttcgactacttcaatggctacgaggatctgaagaacaagaaagtcaggttcgtgggtcatgccaaacaaagaatccaagaggattacctccgaattctcaggtattttagattctatggacggattgtcgacaagcccggggaccacgacccagagacacttgaagctatcgccgagaatgctaaaggactcgctgggatcagtggagagcgaatctgggttgagctcaagaaaatattagtggggaatcacgtaaatcacctgatccacttaatctacgacttagatgtcgcgccttacatcggcctgcctgcaaatgcctcgctcgaagaatttgacaaagtctctaagaacgtggatggtttcagccccaaaccagtgacgctgcttgcaagtctattcaaggtccaagacgacgtgacaaagcttgaccttcgtctgaaaatcgctaaggaagagaagaacttgggactgttcatcgtgaagaaccgcaaggatctgattaaggcaactgactcaagtgacccgctaaagccgtaccaagactttattatagacagcagagaaccggacgccactaccagggtctgtgaactgctgaagtaccagggggagcattgtcttttgaaggagatgcagcagtggagtatacccccatttccagtgtccggacacgacattcgcaaggtgggtatcagctccggcaaggaaatcggagcgctgctgcagcagctccgggagcaatggaagaaatctggctatcagatggaaaaagatgagttactctcatatataaaaaagacttag

SEQ ID NO: 139062 - DNA, 762 bp, Artificial Sequence
  Description of Artificial Sequence: Synthetic coding sequence
atgaacttcagcggtgggggacgacaggaggctgccggtagtcgggggaggagggccccccgaccccgtgaacaagacagagacgtacaactctcaaaggccttgtcatatgccctgcggcacggagccctgaagctcgggctgcccatgggagctgacggctttgtgcctctggggacacttctgcagctgccccaattccgcggatttagtgccgaggatgtgcagcgagttgttgataccaatagaaagcagaggtttgctctgcagctaggcgacccctccacagggctgttgatccgggccaatcagggccatagtctgcaggtccctaagctggagcttatgcccctggagacccctcaggcattgccacctatgctcgtacatggtacattttggaagcattggcccagcatccttttgaaaggtctgtcctgtcaggggaggacccacattcacctagctcctggcctgccaggtgatcctggtatcatctccggaatgagaagtcattgtgagatagcagtatttatagacggccccttggctttggcagacggtattcccttttttaggagcgccaacggtgtcatactcacccctgggaatactgacgggttcctgctcccaaaatacttcaaggaagctttacaacttcgacccacccgcaagcccctttctttggccggcgatgaagaaacagaatgccaaagtagtccaaaacattcgagtcgggagagacgacgaattcaacagtag

SEQ ID NO: 139063 - DNA, 768 bp, Artificial Sequence
  Description of Artificial Sequence: Synthetic coding sequence
atgaacttttctgggggtggaaggcaggaggccgcaggctcccgcggccggcgggctccaagaccaagagagcaagaccgagacgttcaactcagtaaagctctgtcctatgcactacgccatggagctctgaagttaggactgcctatgggagctgacggattcgtccctcttgggactctcttgcagctgcctcagtttaggggattttccgcagaggatgtccagcgggtggtggatacgaaccgaaaacagcgatttgctctccagctcggcgatccatcaaccggtctgctgataagagctaaccagggccattcgctgcaggtgggggtacccaagctcgagctgatgcctttggagactccacaagcactcccccctatgcttgtccacggcaccttttggaaacattggcccagtatcctcctgaagggcctctcatgccagggcaggacccatatccacctggcaccaggtctgccgggagatccaggaataatctctggaatgcggagtcattgcgaaatagccgtatttatcgatggcccattggctctggccgacggcatacctttctttcgttcggccaatggcgtcattcttaccccagggaacacagacgggtttctcctccccaagtatttcaaagaagcgttgcagctgagacctacgagaaagcccctttccctggcaggggatgaggagactgaatgccagagttccccaaagcatagtagccgagaaaggcggcggatccagcagtag

SEQ ID NO: 139064 - DNA, 615 bp, Artificial Sequence
  Description of Artificial Sequence: Synthetic coding sequence
atgggcgccgacgggttcgtgccccttgggacattattgcagcttccacagtttcgaggcttctctgccgaagatgtacagcgcgtggtcgacactaatcgaaagcagcggtttgccctccagctgggtgatccatctaccggactcttgatcagagcaaaccagggtcatagtctgcaggtgcctaaactggaacttatgcccttggagacgcctcaggccctcccacccatgctggtgcacggcaccttctggaagcactggccgagcatcctcctcaaagggctgtcctgtcagggcagaacccatatccatctcgctccagggctgcctggagacccgggcatcataagtgggatgagatcacactgtgaaatcgctgtgttcattgacggaccgttggctcttgctgatggaattccgtttttcaggtccgcgaacggggtgatcttaacccctgggaatacagatggatttctactgcctaagtacttcaaggaagccctgcagctcaggccaacaagaaagcccctcagcctcgctggggacgaggaaacagaatgccagagtagccctaagcactctagccgagagcgtagacggatccaacaatag

SEQ ID NO: 139065 - DNA, 651 bp, Artificial Sequence
  Description of Artificial Sequence: Synthetic coding sequence
atgaattttagcggcggtggtaggcaagaagccgccggctcaaggggccggagggcacccagaccacgagagcaagatcgagacgtgcagctgtccaaggccctgtcctacgccctgaggcacggcgccttgaaactggggcttcccatgggcgccgatggtttcgtgccactcggaacgcttctccagctgcctcagtttcgaggcttttcggccgaggatgtgcagagagttgtcgacactaacaggaagcagagatttgctctacaattgggagatccttctactggcctgttaatacgggccaatcagggacacagcttacaggtgcctaaattggaactgatgccgcttgaaactcctcaagctctgcctcctatgctcgtccacggcaccttttggaaacattggccatcaatcctgctcaaagggctcagctgccaggggcggacccatatccacttggctccggggcttcccggcgaccctggtatcatctccggtatgagatcccactgcgaaattgcagtgttcattgacggaccacttgcccttgccgggaaacccctatcgctggccggagacgaagagactgagtgccaaagcagccctaagcatagcagtcgcgagaggcggagaatccagcagtag

SEQ ID NO: 139066 - DNA, 504 bp, Artificial Sequence
  Description of Artificial Sequence: Synthetic coding sequence
atgggtgcagacgggtttgttccattgggcaccttgttacagctgcctcagttcaggggctttagtgccgaagatgtgcagcgcgtggtagataccaatcggaagcagcggtttgctctacagttaggagatccatctaccgggcttcttattagggctaatcagggacattcactgcaagtgcccaaattggagttaatgcctctggagacaccccaggcgttgccccccatgctggtgcacggtacattctggaagcattggcccagtattctcctaaaaggcttgtcttgccagggcaggacacatatccacttggccccagggctgcccggcgacccagggatcatatctggtatgcgctcccactgtgagattgccgtctttatcgatggcccacttgccctagcggggaaacccctgagcctcgccggtgatgaagaaaccgagtgccagtcgtcgcccaagcacagctctcgagagcgccgccgcatccaacagtag

SEQ ID NO: 139067 - DNA, 516 bp, Artificial Sequence
  Description of Artificial Sequence: Synthetic coding sequence
atggaagaaaggggcgactcagaacccacaccaggatgctctggactgggtcccggcggcgtgagaggcttcggggacggaggaggggccccatcatgggctcccgaggacgcttggatgggtacgcatcccaaatacctcgagatgatggagctggatatcggcgatgccacgcaggtttacgttgcctttctggtgtacctggacctgatggaaagcaagtcctggcacgaagtcaactgtgtggggttacctgaactgcagctgatatgcctcgttggcaccgaaatcgagggggaggggttgcagacagttgtgccaaccccgatcacagcctcattatcgcacaatcggatacgggagatccttaaagcatcccgcaaactccagggagatcctgatctgccaatgtctttcactctggcgattgtcgaatccgactcaaccatcgtgtactacaagctgactgacggattcatgttgccagatccccagaatatcagtctgaggcgttag

SEQ ID NO: 139068 - DNA, 390 bp, Artificial Sequence
  Description of Artificial Sequence: Synthetic coding sequence
atggaggagcggggtgacagtgaaccgactcctgggtgctctggactgggtcccggcggagtgcgggggtttggggatggcggcggtgccccctcatgggcacccgaagacgcttggatgggcactcaccccaagtatctagagatgatggaactagatattggcgatgcaacccaggtttatgttgccttcctggtgtacctggatctgatggaaagtaagagttggcacgaagttaactgcgtggggctgccagagctccagctgatctgtctagtcggcaccgaaatagagggggaaggtctgcagaccgtcgtgccaactcccattaccgccagtctgagtcataatcgtatattcttgctggaggatgatatccacgtctcttag

SEQ ID NO: 139069 - DNA, 1398 bp, Artificial Sequence
  Description of Artificial Sequence: Synthetic coding sequence
atggctgaggccgtttttcacgctcccaaaaggaaaaggagagtgtatgaaacttacgagagtcccttgccaatcccctttggacaagaccatggccctctgaaggaatttaaaatttttagagcggagatgatcaacaataatgtgattgtgagaaacgctgaagatatcgaacagctctacggaaagggctattttgggaaaggtatcctgagtagatccaggccctctttcacaatctcagacccaaaactggtggcaaagtggaaggatatgaagacgaacatgcccattattacatctaaaaggtatcagcacagcgtcgagtgggcggccgagctcatgagacggcagggccaggatgagtctacagtgaggagaattctgaaggactataccaagccccttgagcacccaccagtcaaacgaaatgaggaggcgcaggtacacgacaaattaaattccggaatggtcagcaatatggaggggactgctggaggcgagaggcctagcgtggtgaacggtgactccggcaagtccggtggagtgggagatcctcgtgaaccactgggatgcttacaggagggtagcggctgccatcccaccaccgagtccttcgaaaagagcgtgcgcgaggatgcctccccccttccacacgtgtgctgttgtaagcaagatgcgctgatcctgcaaagaggcctgcaccatgaggatggctcgcagcacatcggacttttgcatcccggcgaccgcggcccagatcatgaatacgttctggtggaggaggcagaatgtgcaatgtcagaacgggaggctgctcccaacgaagagctcgttcagaggaatcgcctcatatgtaggagaaatccatatcgcattttcgaatatctccaacttagcctggaggaggcatttttcttggtgtacgcacttggatgcctgagtatctactacgaaaaagagccactcacaatagtgaaactgtggaaagccttcacagtggtacagcctacattccggacaacctacatggcttatcactactttaggtccaagggttgggtgcccaaagtaggtctaaagtatggcactgacctgttgctttatcgtaaagggcctccattctaccacgctagctactcggtgattatcgaacttgttgacgatcactttgagggaagcctaagaaggccactgtcctggaaatcactggccgcattgagtagggtttctgtgaatgtgtctaaggaactcatgctgtgctatctgattaagccgagcacaatgacagacaaagaaatggagtcccctgaatgcatgaagaggattaaggtgcaagaagtaattttgtcccgctgggttagttcccgggaacgaagcgatcaggatgacctgtag

SEQ ID NO: 139070 - DNA, 1320 bp, Artificial Sequence
  Description of Artificial Sequence: Synthetic coding sequence
atggctgaagccgtgttccatgcccccaaaagaaagcgccgcgtgtacgaaacctacgagagcccgttgcctatccctttcgggcaggatcatggaccactgaaggagtttaaaatttttcgtgctgaaatgattaacaataatgtaattgtccggaatgcagaggacatcgaacagttatatgggaaaggatattttgggaagggtatcctgtcccgttcaaggccctcgtttacgatctctgacccgaaactggttgccaagtggaaggatatgaaaaccaacatgcctattatcacatccaagcggtatcaacattctgtcgaatgggctgccgaactgatgcgcagacaggggcaggacgaaagtacagtgcgccgcattctgaaagattacacgaaaccattagagcaccctccagtgaagcgaaacgaggaagcacaggtccatgacaagctgaactccggaatggtcagcaatatggagggtaccgccgggggcgaacgccctagcgtggttaatggcgactccggtaagtccggaggcgtcggggacccaagggagccactgggttgccttcaggaaggcagtgggtgccacccaaccaccgaatcattcgaaaagtctgtgcgggaagacgctagccccctccctcacgtctgctgctgtaagcaagatgctctgatcctccagagggggctccatcacgaggatggctcccagcacataggactgctgcatcccggcgatcgggggcctgatcacgagtacgtcttggtagaggaggctgagtgcgctatgtctgagagagaagccgccccgaatgaggaagcctttttcctggtctacgctctaggatgcctgagtatctactacgaaaaagaacctttgaccatagtaaagttgtggaaagcgtttactgttgtgcagcccacatttcgtacgacatacatggcatatcactacttccggtccaagggttgggtgccgaaagttgggttgaaatatggaacggatctgctcctataccggaagggaccacctttctaccacgcttcgtattctgtgataatagagctcgtggatgaccactttgaaggctccctgcggcgccccctcagctggaagagcctcgctgcgctgtctcgagtcagcgtgaatgttagtaaagagctgatgctttgttatctgattaaaccctctaccatgaccgacaaggaaatggaatcaccagaatgcatgaagcgcatcaaagttcaggaggtgattctgtctcgatgggtgtcatcccgcgagcgttccgaccaggatgatctgtag

SEQ ID NO: 139071 - DNA, 1347 bp, Artificial Sequence
  Description of Artificial Sequence: Synthetic coding sequence
atggccgaagccgtgtttcacgcgcctaaacgcaaacgccgcgtttatgagacttacgagtctccgttaccgattcccttcggccaggaccatggacctttgaaggaattcaagatattcagagcagagatgatcaacaacaacgttatcgtgcgcaatgccgaagacatcgagcaactctatgggaagggctactttggcaaaggaatcctctcgagaagtagacccagctttacaatttctgatccaaaactcgtggcgaaatggaaggacatgaaaaccaacatgcctattatcaccagtaagcgctatcagcacagcgtcgaatgggctgcagagttgatgcgccgacaaggtcaggacgagtctactgtccgcaggatcttgaaggattatactaaacctttggagcatccccccgtcaagcggaatgaggaggcccaggtgcatgacaagctgaacagcgggatggtatcaaatatggaaggaaccgccggaggcgagaggcccagcgtcgtcaatggagattcggggaaatcggggggcgtcggagatccaagggagcccttaggttgcctccaagaggggtcaggatgtcatccgactactgaatcatttgagaaatccgtacgcgaggatgcatccccactcccacacgtgtgttgttgcaagcaggatgcccttatcctgcagaggggcctgcatcatgaggatgggagtcaacacattggtctgttgcatccgggcgaccgagggcccgatcacgaatatgtgttggttgaggaagccgagtgtgctatgtcagagcgggaggccgcccctaacgaagaactcgtgcaacgtaacagattaatttgcaggcgcaatccatacagaatattcgaatacctgcaactgagcctcgaggaggagcccttgacaatcgtcaagctctggaaagccttcaccgtggtccaacctacatttagaacgacttatatggcataccactacttcagatccaaaggctgggtgcctaaggtggggctgaaatacggcacggatctcctgctgtatcgaaaaggccctccattctatcacgcgtcttactccgtaattattgagctggtggatgatcactttgaggggtccctgaggcggccgttgagctggaaatcactggcagcgttaagtcgggtttccgtcaatgtgtcaaaagaactaatgttatgctatttgattaagccaagcacaatgaccgacaaggagatggaatcacccgaatgtatgaaaagaattaaagtccaggaggtgatcctttccagatgggtgtcaagccgggagcgctccgaccaagatgacctttag

SEQ ID NO: 139072 - DNA, 1398 bp, Artificial Sequence
  Description of Artificial Sequence: Synthetic coding sequence
atggctgaggccgtgttccatgcgcccaagcgaaaacgtcgggtgtacgaaacttatgagtctccactgccaattccgttcggccaggatcatggaccgctaaaggaatttaagattttccgcgctgaaatgatcaataacaacgttattgtgcgaaatgccgaggacattgaacaactgtatggcaaaggctactttgggaaaggaatcctctctagatcacgaccctctttcacaatttcagaccccaagctagtggctaagtggaaggatatgaaaaccaatatgccaataatcacatcaaagcgttatcagcacagtgtggaatgggcagctgaactgatgcggcgacaggggcaggacgaatcaactgtcaggcggattcttaaggattataccaagccattggaacaccctcctgtgaaaaggaacgaggaggcccaggttcacgataaactgaattccggtatggtctctaatatggaaggaacagccggtggcgagcgaccttccgtagtgaacggcgatagcggaaagagcggcggtgtcggtgacccgagggaacccctgggatgcctgcaggagggttctgggtgccacccaacgactgagagctttgagaagagcgtaagggaggacgcaagtcccctgcctcatgtgtgttgctgcaagcaggacgctctcatcctacagcgcggactgcaccatgaggatgggagccagcatattgggttgctgcaccctggagacagaggcccagaccatgaatatgtgcttgtggaagaggcagagtgcgcgatgtcagagcgcgaggcagctccaaatgaagagcttgttcagagaaaccgcctgatttgccgtcgcaacccataccgcatcttcgagtaccttcagctgtccctagaagaagccttctttctcgtttacgccctggggtgcctgagcatctattacgaaaaggaacccttaacaatagtgaagctatggaaggccttcacggtggtgcagcctacatttagaaccacctacatggcctatcattactttagaagcaaaggttgggtgcctaaagtgggccttaagtatggcaccgacctgctgctctataggaaaggtcctccattttaccatgccagctactccgtgattatcgaactggtggatgaccactttgaagggtcgctgcgccggccgctgagctggaagtctctggctgccctttcccgagtgagtgtgaacgtgagcaaggaactgatgttgtgctacctgatcaagcctagcacaatgacagataaggaaatggaatcccccgaatgcatgaaaaggatcaaagtccaggaggtcatcctcagcagatgggtctctagtcgcgaaaggagtgatcaggatgatctgtag

SEQ ID NO: 139073 - DNA, 1320 bp, Artificial Sequence
  Description of Artificial Sequence: Synthetic coding sequence
atggccgaggccgtgttccacgccccaaagcgaaagcggcgagtttacgagacgtatgaaagcccattgccaataccatttgggcaggaccacggtcctctgaaggagttcaagatttttcgggcagagatgatcaacaacaatgtgattgtccggaacgcggaagacatagaacagttgtacggtaaagggtacttcggcaaaggtatcctatctaggagccgcccaagctttaccatctcagatccaaaattggtggcgaaatggaaggacatgaaaacaaatatgcctatcatcacctcaaagcggtaccagcattccgttgaatgggcagcagagcttatgcggagacagggtcaggacgagtcgaccgttcgaaggattttgaaagactacaccaagcccctcgagcatcctccagtcaaacgaaatgaggaggcccaggtgcacgacaagctgaattcagggatggtgagtaatatggaaggcactgcgggtggcgagcggccttcagttgttaacggagacagcggaaagagtggtggagtcggggacccaagagaacccctgggttgcctccaggaggggtctggatgtcacccaaccacagaaagtttcgagaaatctgttagggaagatgcatctcctctccctcacgtctgctgttgcaagcaggatgctctgatactacaacgagggttacatcatgaagacggttcccagcatatagggctgctccatcccggcgatagagggcccgatcatgaatacgtcctggtagaggaggcggagtgcgcgatgtcggagagggaggccgcacccaatgaagaggccttcttcctggtgtatgcactaggatgtctgagtatatactatgagaaagagcctctaacgattgtgaagctgtggaaggccttcaccgttgttcagcccacgttcagaaccacatacatggcctatcactactttcgaagcaaggggtgggtgccaaaggtgggtctcaagtatgggacagatctgctactataccgtaaaggtcctccgttctaccacgctagctattccgttattatcgagctggtcgacgaccactttgagggttccctccgccgtcctttgtcatggaaatccctggccgctttgtcccgggtcagtgtaaatgtgtccaaggagctgatgctgtgttatctgataaagcctagtacgatgactgacaaggagatggagagcccagagtgcatgaaacggatcaaggtgcaggaggtcatcctgtcccgctgggtgtcctctcgagaacgatcagaccaagatgacctttag

SEQ ID NO: 139074 - DNA, 1209 bp, Artificial Sequence
  Description of Artificial Sequence: Synthetic coding sequence
atggccgaggcagtgtttcacgcaccaaaacggaagagacgagtgtacgaaacttatgaaagtcccctgcctatccctttcggacaggaccacggccccctaaaggagttcaagatttttagggcggagatgatcaataacaacgtgatagtaagaaatgcggaggatatagaacagctgtatggaaagggatacttcggaaaaggaatcttaagcaggagccggcccagtttcaccatctctgacccgaagctggtggccaaatggaaggacatgaagactaacatgcccatcatcacctccaagaggtatcagcactctgtcgagtgggccgcggagctgatgagacgacaggggcaggacgagtcaactgtgcggaggattcttaaagattatactaagccactggagcatcccccggtgaagcggaatgaagaggcccaggttcacgataagctaaattccggcatggtgagcaatatggagggtaccgcgggcggtgaaagaccgtcggtggttaacggagattctgggaagtccggcggtgttggcgacccacgggaacctttgggatgtcttcaggagggctcaggatgccaccccactacggagtcttttgagaaaagcgttcgagaagacgcctcacctctgccccatgtgtgttgctgtaagcaagatgctctgatacttcaacgtgggctgcaccatgaagacggtagtcagcacataggcttactgcatcctggcgacagaggccccgaccatgaatacgtgctcgttgaggaagcagagtgcgcgatgtccgagcgtgaggctgcacccaatgaagaagccttctttctggtgtacgccctcggctgcttatcgatctattatgagaaggagcccctcaccatcgtcaaactctggaaagcattcactgtggtgcaaccaaccttcagaactacttatatggcctaccattatttcaggtcaaaaggctgggtccctaaagtggggctgaagtacgggacagaccttctgctgtaccgaaaaggacctccgttctatcacgcatcatactccgtgatcatcgaattagtggacgaccatttcgagggcagcctgcggaggcccctgagttggaagagcttggccgcactgagcagagtgtccgtgaacgtgtccaaggtgacacagcatcagttatgtcattggagtgtcacttag

SEQ ID NO: 139075 - DNA, 1137 bp, Artificial Sequence
  Description of Artificial Sequence: Synthetic coding sequence
atggcagaggctgtcttccacgcccccaagcgtaagagacgggtttacgagacctatgagtccccactccccatacctttcggccaggaccacggccctttgaaagagtttaagatcttccgcgctgagatgattaataacaacgtcatcgtccgaaacgcggaggacatcgagcagctgtatggaaagggctactttgggaaggggattctttcaagatcccgcccctccttcacaatctccgaccctaaacttgttgcgaaatggaaggacatgaagactaacatgccaattattaccagcaaaaggtaccagcactctgttgaatgggcagccgagctgatgcggcgccaaggtcaggacgaaagcaccgtgcggaggatacttaaagactacaccaaacccctggagcacccccctgttaagagaaacgaagaggcgcaagtgcatgataagctcaatagtggcatggtgtccaacatggaaggcactgcgggaggggagagaccctctgttgttaacggagatagcggaaaaagcgggggcgtaggggatcctagagaaccacttggctgtctgcaggagggctccggctgtcatccaacaaccgagtccttcgaaaagtccgtccgtgaggatgcttcccccctcccccacgtttgctgctgcaagcaggacgcactaatccttcagaggggcctgcaccacgaggacgggagccagcacattgggttgctccaccccggcgatcgagggcccgatcacgaatatgtgctggttgaagaggccgagtgcgctatgtccgagagggaagctgccccaaatgaggaactggtgcagcggaaccggcttatttgcaggcggaatccgtaccgcattttcgaatacctgcagttgtcactcgaagaggcgttcttcctagtgtacgccctaggctgtctgagtatctattacgagaaggaacctctcactattgtgaagctctggaaggcgttcacggtagtgcaaccaacatttaggacaacatacatggcataccattatttccgatctaagggatgggtgccaaaggtgggcctcaaatatgggaccgatctgcttttgtatcgtaaaggaccacctttctaccatgcttag

SEQ ID NO: 139076 - DNA, 1317 bp, Artificial Sequence
  Description of Artificial Sequence: Synthetic coding sequence
atggccgaggccgtattccacgcacccaaaagaaaaagaagggtatacgaaacatatgaaagccccctcccaatcccctttggacaggaccacggtcctttgaaggagtttaagatttttagggccgaaatgattaataataacgttattgtgcgaaatgcagaggatatcgaacagctctacggcaaggacatgaaaaccaatatgccaatcataacatccaagagatatcagcactccgttgagtgggcggctgaattgatgcggcgacagggccaggacgagagcacagtacgacggattttaaaggactacacgaagccattggaacatccgcccgtgaagagaaatgaggaagcacaagtccacgacaagctaaatagcggaatggttagcaatatggagggcaccgctgggggagaacgcccatccgtcgtcaacggcgactcaggtaaaagcggcggggtgggcgaccccagggagccactgggatgtctgcaggaaggcagcgggtgccaccccacaacggagtctttcgagaaatcagtgcgggaggatgcttctcctctcccccatgtctgctgctgcaagcaagatgcacttattttgcagaggggcctccaccatgaagatggatcacagcacatcgggcttcttcaccccggcgatcgcggccctgaccacgagtacgtcctggtggaagaggcagaatgcgccatgtccgagagagaagctgcgcccaatgaggaactggttcagagaaatcggctgatctgcagacggaatccgtacaggatctttgaatacttgcagctcagcctcgaggaggctttcttcctggtatacgcgctcggttgcctcagcatttactatgagaaggagcctttgaccatagttaaactatggaaggcgtttactgtcgtacagcccacctttcgtaccacctacatggcatatcactactttcgatcaaagggctgggtgcccaaggtgggattgaagtacggtacagacctgctcctgtatcgtaaagggccacctttttaccatgccagctactccgttatcatcgagctggtggatgaccactttgaggggagccttaggaggccacttagctggaagtcgctggcagccctgagtagagtgtctgtaaatgtctccaaagagttaatgctgtgttacctaattaagccgtccaccatgaccgataaggagatggagtcccctgaatgtatgaagcgcatcaaggtccaagaggtaatcctgagccggtgggtgtcctcaagggagcgaagcgatcaggacgatctgtag

SEQ ID NO: 139077 - DNA, 1221 bp, Artificial Sequence
  Description of Artificial Sequence: Synthetic coding sequence
atggccgaggcagtgtttcacgcgcccaagcgcaagcggcgtgtgtacgaaacctacgaatcaccacttcccattcctttcggtcaggaccatgggccgttaaaagagttcaaaattttcagagcagaaatgataaacaataacgtaatcgtgagaaatgctgaggacattgagcagctctacggaaagggctatttcggaaagggcattctctctcgatccaggccgagtttcaccatctcagacccaaagctggtggctaagtggaaggatatgaaaaccaatatgccgataatcactagcaagcggtaccaacacagcgtggagtgggcggccgagctgatgagacggcagggccaggatgaatctacagtgcgcagaatactcaaagactataccaagcccctggaacacccaccagtgaagcgaaacgaagaggctcaagtgcacgacaagcttaacagtggcatggtgtcgaacatggaaggaactgctggcggggagcggccctcagtaagggggctccaccatgaagacgggagccagcatatcggcctcctccatccaggcgacagagggcctgatcacgaatatgtacttgtggaagaagctgaatgtgctatgagcgaacgggaggcagctcccaatgaggaattagtgcagcggaatagactcatctgcaggagaaatccctacagaatcttcgagtatttgcagctgtctctggaggaggcttttttccttgtgtacgctctgggctgtctgagcatctattatgagaaggaaccactgaccatcgtgaaattatggaaggcatttactgtggttcagcctacattcagaaccacctacatggcttaccattattttcgaagcaaggggtgggtgcctaaagtcggcttaaagtacggcacggatctgttactgtaccgaaaaggacctcccttctatcacgcatcttactcagtgatcatcgagttggtggatgatcactttgagggatcgctcaggcggcccctgtcctggaagtccctcgcggctttgtctagagtgtctgtaaacgtcagcaaagaattaatgttgtgttacctgatcaagcctagtacaatgacggacaaggagatggagtccccagaatgtatgaaaaggataaaggtccaggaggtcatcttgtcacggtgggttagcagccgggagagaagcgatcaggatgacttgtag

SEQ ID NO: 139078 - DNA, 933 bp, Artificial Sequence
  Description of Artificial Sequence: Synthetic coding sequence
atgctggtagtggaggtggccaatggtagaagcctggtatggggtgccgaggcagtccaggccctgcgtgaacgtctaggggtcggtggcagaacggtgggggcactgcccagaggcccacgtcagaatagcaggctcggactgcccctcctactgatgcccgaggaggctcggctgcttgcagagatcggcgctgtgactctagtttctgccccacgcccagacagccgtcaccacagcctggccctgacctctttcaagagacagcaggaagagtccttccaagagcaatcagcactcgccgccgaggctcgcgagacccggcgccaagaattactcgaaaagatcaccgaggggcaggctgccaaaaaacagaagctcgaacaggcaagtggtgcctcctcaagccaagaggcagggagttcgcaagccgctaaagaggacgaaacatcggacggccaggcaagcggcgaacaggaggaggccgggccatcttcaagtcaggctgggccatctaacggcgttgcaccgctgcctcggagtgctcttctggtgcagctcgccaccgcaaggcctcggccagtaaaagctcgtccactcgattggcgagtgcagtctaaggattggccacacgccggacgacctgcccacgaattacggtatagtatctatagggatctgtgggagcgcggcttctttctgagcgctgctggcaagttcggcggcgattttctggtgtatcccggtgaccccctccgcttccacgcccactacatagcgcaatgttgggcacctgaggatactatccctctgcaagacctagtcgctgctggcaggctgggcacgagcgtgcgcaaaacgttgttgctctgcagtccacagcctgacggaaaggtggtgtacactagcctccagtgggctagcttacagtag

SEQ ID NO: 139079 - DNA, 933 bp, Artificial Sequence
  Description of Artificial Sequence: Synthetic coding sequence
atgctcgtggtggaagtggccaacggaaggagcctagtttggggagctgaggctgtccaagctctgcgggagcggctcggagtgggcggacggacagtcggcgctctgcctcggggcccccggcagaactctcgcttaggactgcccctgcttttgatgccagaggaagccagacttctggccgagattggagctgtcaccctggtttctgcacctcggcctgattcgagacaccactcccttgccctgacaagctttaagagacagcaagaggaatcattccaggagcagagcgccctggccgccgaggctagggaaacacggcgacaagagttgctcgagaagattacagagggtcaagctgccaaaaaacaaaagctggagcaggcctcgggcgcctccagtagtcaggaagccggctcgtcacaggcggccaaagaggatgagaccagcgatggacaggcgagtggagagcaagaagaagccggaccttcctcaagtcaggcagggccgagcaatggcgtggcaccattacctcggagcgcactcctggtgcaactggcaaccgctcgccctcgacctgtaaaggcgcgccctctagactggagagtacaatccaaggactggcctcacgccgggagaccagcccatgaactgaggtatagcatctacagagacctctgggagcgcggttttttcctcagcgcggcaggcaagttcggtggagacttcctcgtctatcctggagaccctctgcggttccatgctcactatatcgcccagtgctgggcgcccgaggataccataccactgcaggacctggtggccgcaggcaggctgggcaccagtgtgaggaaaactcttctcctgtgtagtccacagccagatggaaaagtcgtttataccagtctgcaatgggccagcctgcagtag

SEQ ID NO: 139080 - DNA, 933 bp, Artificial Sequence
  Description of Artificial Sequence: Synthetic coding sequence
atgttggtcgtagaggtggccaacggccgaagcttagtttggggtgcagaggccgtgcaggcgttgcgggagcggcttggagtgggtggtcgaaccgtaggcgcactcccgagaggcccccgtcagaattcacgcctcggtctcccactgctgctgatgccggaagaggcccggctgctagcggaaatcggggccgtgactctggtctcggcaccaagaccagactctcgtcaccacagcttggctttaactagttttaagaggcagcaggaggagtcctttcaggagcagtcagcgcttgcagcagaagcccgcgagactcggcgtcaagaactgcttgaaaagattacggagggacaggctgccaagaagcagaaactggaacaggcctctggcgcatcttcttctcaggaggccggaagctcacaggccgccaaggaggatgagacctcagatggccaggcgtccggagaacaagaagaggcaggcccctcatcttcccaagcagggcccagcaatggcgtggccccactcccaagaagcgcattgctagtccagctggcaacggcccggcctaggccagtgaaagctcggcccttagattggcgggtccaatcaaaagattggccccacgctggccgaccagcacacgagctgcggtattcaatttaccgtgatctctgggaacgcggtttctttctgagtgctgccgggaagttcggaggcgactttctggtctaccccggcgatcccctgcggtttcacgcccattatattgcacagtgttgggcaccggaagacaccatacccctccaggatctcgttgccgctgggagactcggaactagcgtgcgaaaaaccctcctgctgtgcagcccacaacccgacggtaaagtggtctatacatctctccagtgggctagccttcagtag

SEQ ID NO: 139081 - DNA, 939 bp, Artificial Sequence
  Description of Artificial Sequence: Synthetic coding sequence
atgctggtagtcgaggttgcgaacggccgctctcttgtgtggggagccgaggccgtgcaggcccttagggagcggctaggagtgggtggtaggaccgtaggtgctctgccacgtgggcctcgacaaaattccagattaggtctgcccctacttcttatgccagaggaagcaagactcctggctgaaattggggcggtgacattggtgtcagcaccgaggcccgattctagacaccatagtttggccttgactagctttaagcggcagcaggaagagtcatttcaggagcagtccgcactcgccgcagaagccagggagacgaggagacaggagctgctggagaaaatcacagaggggcaggccgcaaagaagcaaaagctggagcaggcttccggagctagcagctcccaggaggcagggtcatcacaggctgcgaaggaggacgaaaccagcgacgggcaagcctccggagagcaggaggaggctggcccgagcagttcccaggccggtccatccaacggcgtggccccacttccccggagcgcactgttggttcagttagccacagccagacctaggcccgtgaaggctaggcctcttgattggcgcgtgcagtcaaaagattggccccacgccggtcgcccagcgcacgagcttaggtactctatttatcgcgatctgtgggaacgcggcttctttctgagtgcagcagggaagttcggtggtgactttctcgtctaccccggagaccctctccgttttcacgctcactatatcgcacagtgctgggcccctgaagatacaattcccctccaggatctagtggccgctgggaggctaggtacttccgtgcggaaaacactgctactgtgtagtcctcagcctgacggttttaaatcacaggaagtgagcatcaatctggtgtacaaatgcagctag

SEQ ID NO: 139082 - DNA, 729 bp, Artificial Sequence
  Description of Artificial Sequence: Synthetic coding sequence
atgctggtggtggaggtggccaatggtaggtctttggtttggggggccgaagctgttcaggcgctccgagagcgcctaggtgtgggagggcggaccgtgggcgccctgccaagggggccaagacagaattcacgcctgggccttccactcctcttaatgcctgaagaagctcgtcttttggctgaaatcggagccgtaacactcgtgtctgctccgcggcctgattcccgtcaccacagcctagccctgacaagtttcaaacgacaacaagaggaaagtttccaggagcagtccgccctggcagcagaagctcgcgaaacacgcaggcaggaacttctggagaagatcacagaaggccaggccgcaaagaagcagaagcttgaacaggctagcggggccagctccagccaggaggcaggaagctcacaagctgctaaagaggacgagacatccgatgggcaggcctcaggggagcaggaagaagcgggacctagcagtagtcaggctggcccctcaaatggcgtggcccccctacctcggtcggctctgctggtgcagctcgcgaccgccaggccccggcccgtcaaagctagaccactggattggcgtgttcaatcaaaggactggccccacgcagggcggcccgcccatgaactcagatactcaatctatcgcgacttgtgggaacgcgggttttttcttagtgccgcaggcaaattcgggggttag

SEQ ID NO: 139083 - DNA, 1581 bp, Artificial Sequence
  Description of Artificial Sequence: Synthetic coding sequence
atggaaccagaacccgagcccgctgcagtcgaggtccctgctggcagggtcttgtccgctcgtgagctttttgctgcaagatcaaggtctcagaaactgcctcaaaggtcccacggcccaaaggatttcctccccgacggctcggctgctcaagctgagcgcttgcgccgatgtagggaggaattgtggcagctgcttgccgagcagcgggttgagcgtctgggttctcttgtcgctgcagagtggcgacccgaggaaggattcgtcgaactgaaatcccctgcaggaaagttctggcagacaatgggattcagtgagcagggacggcagcgactccatcccgaggaagccctctacctcctggaatgtggatccatacatctctttcaccaggacctgccgcttagcattcaggaagcctaccaactgctgctcaccgatcatactgtcacgttcctgcagtaccaagtgttctcccatctgaagcgactgggctacgtggtgagaagatttcagcctagttctgtgcttagcccgtacgagaggcagttaaatctggacgcgagtgtgcagcacctagaggacggggacgggaaacgcaagcgatccagcagtagcccgcgctcaatcaataaaaaagctaaggcgttagacaactccttacagcccaagtcactcgcggctagttctccccctccctgcagccagccctctcagtgtccggaagaaaagcctcaggaaagttcacccatgaagggccctggaggtcccttccagttactaggctcgttgggcccatcgccaggccccgccagagaaggcgtcggctgtagctgggagtctgggcgggctgagaacggcgtcactggggctggaaaacgacggtggaattttgagcagatctcttttcctaatatggccagtgatagtaggcacacattgctaagagctcctgctccagaactgttgccagcaaatgtggctggacgggaaactgacgccgaaagttggtgtcagaagctaaaccaaagaaaggaaaaactgagccgacgcgagcgggagcaccacgcagaagcagcccagtttcaggaggatgtgaatgcagatcctgaagtgcagcggtgcagctcttggcgcgaatataaggagttgctgcagcgtagacaagttcagagatcgcagcggcgggccccgcatctgtgggggcagccagtgacgccactcctgagtcccggtcaggctagcagcccggctgttgtcctccagcatatctccgtgttgcagacaacccatctgccagacggcggagctcgtctgctcgagaaaagtggcgggcttgagatcatcttcgatgtgtaccaggccgacgctgtggccacatttaggaaaaacaatcccgggaagccatacgcacggatgtgcatctccggctttgatgagcccgtaccagatctgtgtagccttaagcgcctgagctatcaatcaggcgatgtgccccttatctttgcactggtggaccacggtgacatctctttctactccttccgggacttcactctaccccaggatgtaggccactag

SEQ ID NO: 139084 - DNA, 594 bp, Artificial Sequence
  Description of Artificial Sequence: Synthetic coding sequence
atgggattcagtgagcaaggccgacagcgtctgcacccagaagaggccctgtatctcttggaatgcggatctatccacctgttccatcaggatctgccactcagcatacaggaggcataccagttgctgctgactgaccataccgtgacctttctgcagtaccaggtgtttagccacctgaagaggctgggatacgtggtgcggaggttccagccttccagcgttctgagtccatatgagaggcagctcaatctcgatgcaagtgtgcagcacctggaggacggcgatggaaaacgaaagcgatccagttcaagtcctcggtccataaataaaaaggcgaaggccctcgacaatagcttgcagccaaaatctctggctgcgagctctcccccgagcggaacatcccggtgccctcgcatgtggggtacagacttgaccgccttacagagaatggagttggcccccggcgacagagactgcctcttctctggaacgatctctgccgctagttgtacgcagacactcacctgttccttcagaggccagagcggcccttggccatgggtatcagacacccatcgggtgaaattatag

SEQ ID NO: 139085 - DNA, 534 bp, Artificial Sequence
  Description of Artificial Sequence: Synthetic coding sequence
atggagcccgaaccagaacccgcagccgtggaagtcccggctgggcgggtcctaagcgcacgagaattgttcgccgcgcgctcacggtcacagaagctgccccagcgatcacacggcccgaaggactttctgccggacggctcagctgctcaagcggagagactgagacgctgtcgcgaagagttgtggcagttactcgctgaacagcgagtcgagcgactgggttcccttgtggctgccgagtggcgccccgaagagggtttcgtagagcttaagtcacccgctggcaagttctggcaaaccatggggtttagtgagcagggtcgacagcgcttacacccagaagaagccctttacctgttggaatgcggtagtattcatctttttcatcaggacctgccactctccattcaggaggcttaccaactgctcctcaccgaccacactgttacattccttcagtaccagcctcccgaagaggtgggactgtgcggaagcaccatacccacaaaattgtgccctgtgcctgtatag

SEQ ID NO: 139086 - DNA, 4296 bp, Artificial Sequence
  Description of Artificial Sequence: Synthetic coding sequence
atggaccgccggaacgactatggctaccgggtgcccctttttcagggacccctgcctccacctggctctctgggccttccatttccacctgatatccaaacagagactactgaagaagattctgtcttgctcatgcatacgctgttagcagccaccaaggatagtctggccatggatccacccgtagtcaatcgtccgaagaaatcaaagacgaaaaaggcaccaatcaagacaatcaccaaagcagcccccgccgctccacccgtgccagccgctaatgagatcgccacaaataaaccaaaaatcacatggcaggccctgaatttaccagtcatcacccagatctcacaggctctacccactaccgaggtgaccaacacgcaagcctcgagtgtcactgctcagccaaagaaggcaaataaaatgaagagagtaacagcaaaggcagcacaaggatcacaatcaccgaccggtcacgaagggggaacaattcaactaaagagtcctttgcaagtcctgaagcttcctgtgatatctcagaacattcacgcccctattgcaaatgagtctgcatcaagccaggccctgataacctctatcaagccaaagaaggcctccaaagccaagaaagcggccaacaaggccatcgcctcagctaccgaagtctctctggcagcgaccgccacccatacagctacaactcagggacagatcactaatgagaccgcttccatccacacaaccgctgccagcatccgtaccaagaaggcctccaaggcccgtaagacaatagctaaggtaattaatactgacactgagcacattgaggctttgaacgttacagacgcagctactcgtcagattgaagcctccgtggtggctattcgacccaagaagagtaagggtaagaaagccgcatcacgcggccctaattctgttagcgagatctcagaagcaccacttgcaactcagatcgtaacgaaccaagccctcgcagccactctgcgagtcaaacggggcagcagggcccgcaaggcagcaacaaaggcacgagccacagagagtcagacaccgaacgcagatcagggcgcccaggccaagattgcaagcgcacagaccaatgtttctgccctagagacacaagtagccgccgcagtgcaagcgctggccgacgattacctggcacagctttcactggagccgacaactcggacgcgcggtaagcgcaatcgcaaatcaaagcacttgaacggtgacgagcgtagtggtagtaattacagacgaataccctgggggcgccgtccggccccgcctcgagacgtcgcaatcttgcaggagagggctaacaagttggtaaaatatctgttggtgaaagaccagacaaaaataccaatcaagcggagcgatatgctccgggatgtcatccaagaatacgatgaatactttcctgagattatagagcgggctagttacaccttagagaagatgtttcgcgtgaacctcaaggaaatcgacaagcagtcttctctgtacatcttaatctcaacccaggaatctagtgcaggcatcctcggcactactaaggacactcctaagctaggcttgctcatggtgatcctcagtgtaattttcatgaacgggaacaaggccagtgaagcagtgatctgggaggtgctcaggaaactcggactgcgccccggagtccgtcattctttattcggggaggttcgaaaactgatcacagatgagtttgtgaagcaaaagtatctcgagtacaaacgggtccctaatagccggcctcccgagtacgaatttttctggggtttaaggtcataccacgaaacctctaagatgaaggtgctgaagtttgcatgtagggtgcagaaaaaagatccaaaagattgggccgttcagtaccgggaagccgtggagatggaagtgcaagccgctgccgtggctgttgcggaggccgaagcccgcgcagaagcaagagcacagatggggattggggaagaagccgtggctgggccttggaattgggatgacatggacattgactgtctcacccgcgaggagctgggagacgatgctcaggcgtggtcccgattttcgtttgaaattgaggcaagagctcaggagaacgccgacgcctccaccaacgtcaacttctcacgcggagcatcaacacgggccggtttttctgatggggcgagtatcagctttaacggggcaccttcttcaagtggggggttctcaggcggaccaggtatcacctttggggtcgccccgtctaccagtgcatccttttctaacaccgcaagcataagttttggaggaactctcagcacctcaagttccttctcctctgccgcgtctatcagctttgggtgcgcacactccactagtacgtccttctcatctgaggcctcaattagcttcggtggaatgccctgtaccagcgcatctttttctgggggcgtgtccagctcattctccggaccacttagcacatccgcgacctttagtggcggagcatccagcggctttggcgggacactgtccactacagctggatttagtggcgtgctttctacttccacctcattcggatctgctcctaccacttcgaccgtatttagtagtgccctgtccacttccacaggctttggcgggatactgagcacctccgtatgtttcggagggtctcccagtagtagcggctcctttggcgggaccctctccacctctatttgctttgggggcagtccatgcacctcaacaggctttggcggcacgcttagcaccagtgttagcttcgggggatcctccagtacctctgcaaacttcgggggcacgttgagtaccagtatctgtttcgatgggtcacctagcaccggagccggattcgggggcgccctgaatacaagcgcctcttttgggagcgtgttgaatacaagtacagggttcgggggagcgatgtcaaccagtgcagacttcggcggaactctgtctacctccgtctgtttcgggggcagccccggtaccagcgtttcctttggctcagccctgaacaccaacgctggctacggcggagccgttagcaccaacaccgactttggtgggaccctgagcacctcagtgtgcttcggcggatctcctagcacatctgctgggtttgggggcgcgctcaacacaaacgcctccttcggttgcgccgtctctacatctgccagtttttctggcgccgtgtcgacttctgcctgtttctcaggcgcaccaatcaccaacccaggcttcggaggcgcattttcaaccagcgccgggtttggaggtgccttgagcacggcagccgacttcggcgggaccccctccaacagcatcgggttcggcgcagcaccaagcactagtgtgagcttcggaggagcccacgggacgtccttgtgcttcggaggggccccttcaacctccctgtgttttggctcagcttctaatacgaacttatgcttcggcggtcctcctagcacaagcgcatgcttcagcggcgcaactagccccagcttttgcgatggaccctccacctcaaccggattcagcttcggaaatgggctgtctaccaacgctggctttggtggtgggctcaataccagcgccggcttcggcggcggcctgggaacctctgccggattcagtggcggcctgtccacatccagcggctttgacggaggcctgggaacaagcgctggctttggaggtggcccagggacaagtaccggttttggaggcggcctagggaccagcgccgggttttctggcggccttggcacttcagccggcttcggggggggtcttgtcacctcggatggttttggaggtggactcggcacgaatgcctcattcgggagcactttgggaactagtgccggattcagcgggggtttaagcacatctgatgggtttggcagtaggccaaacgcctccttcgaccgcggattgtcaacaatcataggttttggaagcgggagcaacacatctacaggtttcaccggcgagccctccacttcaaccggatttagctcggggcccagcagcattgtagggttctctggcggcccgtctacgggcgtggggttttgctcagggccaagcacctccggattttccggtgggccttcaactggggccggatttgggggtggccccaataccggcgccggctttggggggggaccatctacgtcagccggctttggttcgggggccgcgagcctgggcgcttgcggcttcagctatgggtag

SEQ ID NO: 139087 - DNA, 2121 bp, Artificial Sequence
  Description of Artificial Sequence: Synthetic coding sequence
atggacagacgcaacgactacgggtatcgtgtcccgttgttccaaggacccctgcctcctccaggctccctgggcctgcccttcccacccgacatccagaccgaaactaccgaggaggatagcgtgttacttatgcacaccctcctggcggcaaccaaggattctttggcaatggaccctcccgtggtcaatcgcccaaaaaagagcaagacgaagaaggctcctattaagaccattactaaggcagcccctgccgctccaccggtgcccgccgccaacgagatcgctacaaataagccaaagatcacatggcaagccctgaaccttcccgttattacacaaatcagccaggccctaccaaccaccgaagtgaccaacactcaagctagcagcgtcacagcacagcctaaaaaagcaaataaaatgaagagagttacagccaaggccgcgcaagggtctcagtctcccacaggccatgagggtggcacaatccagctaaagtccccactgcaggtattgaaactgcctgtcatctctcaaaacatccacgcccccatagctaacgagagtgcttcctcacaagccctgatcaccagcattaaacctaaaaaagcttcaaaggcaaaaaaggccgccaacaaggctatcgccagcgcgacagaagtcagtctcgccgcaacagctacccatacagccaccactcagggccagattacgaacgagacggcttctattcataccactgcagcttcgattaggactaaaaaagctagcaaagcccggaaaacgatcgccaaagtgattaataccgacaccgagcacattgaggcattaaatgtaacggatgccgccaccagacagattgaggcttcggtggtagcaattcgtccaaaaaagagcaaaggaaagaaggcagcatctcgaggccccaacagcgtttctgaaatcagtgaggcgcctctggcaacccaaattgtgactaaccaagcccttgccgcaacactgcgtgtgaaacgcgggtccagagcacgaaaggcagctaccaaagcccgcgctaccgagtcgcaaacaccgaacgccgatcagggtgcccaggccaagattgccagcgcccaaaccaacgtgtcagccctggagacccaagtggcagccgcagtgcaggccctggccgacgactaccttgcccagctctcgctagagcctaccaccaggacccgcggcaaaagaaataggaagtcaaagcacctgaacggagatgaaaggagcgggtctaattacagaaggattccttgggggagacgccccgcccctccaagggatgtggcgatcctgcaggagagggccaacaaacttgtgaaatatctgctcgtgaaagaccagacaaaaatcccgataaagagatcggatatgctgagagatgtcatccaagaatatgatgaatacttcccggagatcattgagcgcgcttcttatacgttagagaaaatgtttcgcgtgaatctcaaggagatcgataagcagagctcgttatatattctgatttccacccaggaatcttccgcaggcatactgggaactactaaggatacacccaaattagggctgctgatggtcatcttgtcagtgattttcatgaacggaaacaaggcctctgaagccgtgatctgggaggtgctaagaaaacttggactcaggcctggggtaagacacagtctgttcggagaggttagaaaactgatcacagatgagtttgtaaagcagaaatatttggagtataagagggtacctaatagccgacctccggagtacgaatttttctggggcctgcggtcttatcacgagactagcaaaatgaaagttctgaaattcgcctgcagagtgcaaaaaaaagatcccaaggactgggccgtccagtacagagaggctgtggaaatggaagtgcaggcagccgcagtggccgtggcggaagccgaagccagagccgagatatatagtccttgccttcaaatcccattaattaactgcagttctccttcccacggcgctaaagtgcacccttggaacctgtgcccccattcttctcagggctcctatgggcagtccgcagagggcgtgatgtag

SEQ ID NO: 139088 - DNA, 1074 bp, Artificial Sequence
  Description of Artificial Sequence: Synthetic coding sequence
atggatagacgcaatgattatggctatcgagtgccactcttccagagcaaacatctcaacggggacgaacggtccggctccaattaccgtcgaattccatggggccggagaccggcacccccccgtgacgttgcaatcctgcaggagagggcgaacaagctggtgaagtacctgctcgtgaaggatcagaccaaaattccgatcaaacgctccgatatgttacgcgacgtaatccaggagtatgatgagtacttcccagaaatcattgaacgcgcttcttacactctggagaagatgttcagggtcaaccttaaagaaatagataaacaatcttctctgtacatccttatatctacccaggagagtagtgccggcattctggggaccactaaggatacccctaaattagggctgttgatggtcatcctgtctgtaatctttatgaatgggaataaggcaagcgaggccgttatctgggaggtgctcagaaagctagggctcaggccaggagtccgccactctctgtttggagaggtgaggaaactgataaccgatgagtttgtcaagcaaaaatacctagagtataagagagtgcccaactctcgtccaccagaatacgagttcttctggggtctcaggtcctatcacgagacctccaagatgaaggtgctgaagtttgcctgccgggtgcaaaaaaaggacccaaaggattgggcagtccagtacagggaggccgttgaaatggaagttcagctgcagctgtggctgtggttgcggttaaaacccggtctgtcaggcagcaataccagcacaggatttactggcgaaccctctactagcactgggttttcctcaggtccctcttccatcgtcggcttcagcgggggtcccagcacaggggtcgggttctgttctggtccaagtacctccggatttagcggcgggccatccaccggagcaggctttggaggcggaccaaacaccggagcaggctttggcggtggtccgtccactagcgccggcttcgggtccggagcagccagcttgggcgcttgtggattctcttatggctag

SEQ ID NO: 139089 - DNA, 2121 bp, Artificial Sequence
  Description of Artificial Sequence: Synthetic coding sequence
atggatcgtagaaacgattatggctatcgggtgcccttgttccaaggtcccctacctcctccagggagcttagggctcccttttccgccagacatacagacagaaactacagaagaagattccgtgctgttaatgcacacattgcttgccgcgaccaaagactcccttgcaatggatcccccagtggtgaataggcctaaaaagagcaaaacaaaaaaggcaccaatcaagacaattacaaaggctgcaccagccgcaccgcccgtccccgcagccaatgagattgctacaaataagcctaagattacgtggcaggcgttgaatctgcccgttatcactcagatatcccaggcactgccaacaacggaggttaccaacactcaggccagcagtgttaccgctcagcccaaaaaggccaacaaaatgaaaagggtcacagccaaagctgcacagggatcccaatctcctaccggccacgaggggggcacaatacagctcaaatcgccgctgcaggtccttaagctccctgttatcagccagaatatccacgcacccatcgcaaacgagtctgcttctagccaagcgctgatcacatcgatcaaacctaaaaaggccagtaaggctaagaaggctgcaaataaggctatcgccagcgcaactgaggtaagtctggctgccacagccactcacaccgccaccacacaaggccagatcactaatgaaactgcgagtattcataccaccgccgctagtatcaggaccaaaaaggcatccaaagcaaggaagactatagccaaagttatcaatacggacaccgaacacatagaagctctgaacgtcaccgacgctgctacgcgccagatcgaggccagtgttgttgctattagaccaaagaaatcaaagggcaagaaagctgcctcaagagggcctaacagtgtgtccgagatcagcgaggctccattagctactcagattgttactaaccaggccctggccgcaacactcagggtaaagagaggctctcgggcacgcaaagccgccaccaaagccagggctacagaatcccagacccctaatgctgaccagggggcgcaggcaaaaatcgctagcgcgcaaacaaatgttagcgcactggaaacgcaggtggccgcagccgtacaggctcttgctgacgattatctcgcccagctctctctggagccgacaactcgcacccggggtaaacgaaatagaaaatcaaaacacctgaacggagacgagcggagcggaagtaactaccggcgcattccgtggggacgccgacctgctccacctcgcgacgtcgccatcctgcaggagcgggccaacaagctggtgaaatacctcctcgtgaaggatcagaccaagatcccaattaagcggtctgacatgttgcgggacgtaattcaggaatatgacgaatacttccctgaaatcatcgagagagcctcatacaccctggagaaaatgtttcgagtaaacttgaaggagatagataagcagagcagcctttatatcttaatttcaacccaggagagctcagctggtatcctcggcaccactaaggacacacctaaattaggcctgctgatggtcattctcagtgtcatcttcatgaatggcaacaaagcgtctgaagcagtgatctgggaggtcttgcgcaaactgggcctgaggcccggcgtccgccattcactgtttggggaggttagaaagctcataactgacgaatttgtgaagcagaagtacctcgaatacaagagagtccctaattcccggccacctgagtacgaatttttttgggggttacgatcttatcatgagaccagtaaaatgaaagttctgaaatttgcttgtagggtgcagaagaaggatccaaaggactgggccgtccaatacagagaggcggtggaaatggaagttcaagctgctgcagtggctgtggctgaagccgaggcacgcgcggaaatctatagcccttgtctccaaattcccctgattaactgttcaagcccctcacacggcgcgaaggtacatccttggaatctctgtcctcactctagtcagggcagctatggccagtctgcggagggcgtgatgtag

SEQ ID NO: 139090 - DNA, 3105 bp, Artificial Sequence
  Description of Artificial Sequence: Synthetic coding sequence
atggatcgcaggaatgattacggatacagggttccgctctttcagagtaagcatctgaatggtgatgagcgcagtggatcaaattatagacgcatcccctggggccggcgccctgcaccaccaagagacgtggctattctgcaagaacgtgctaataaacttgtgaaatatctgctggtcaaggaccagactaaaatacccattaagcggagtgacatgcttagagacgtgattcaggaatatgacgagtacttcccagagatcatcgagcgggcatcttacactctggagaagatgtttagagtgaacctgaaggaaattgacaaacagtctagtttatatatcttaatttcaactcaggaatcatcagccggcatcctagggaccaccaaagatacaccaaagttgggtctgcttatggtgattttatctgtgatctttatgaatgggaataaggctagtgaggctgtgatctgggaggtcctgcgcaagctgggcttacgtccgggagttaggcattcactgttcggggaagtccggaagcttattaccgatgaattcgtgaaacagaagtatctggagtataagcgcgttccaaatagtcggcctcccgagtacgaatttttctggggcctgagaagctatcacgagactagcaaaatgaaggttctgaagtttgcctgcagggttcagaaaaaggaccctaaggattgggctgtgcagtaccgggaagccgtggagatggaggtgcaggcagccgctgtagctgttgctgaagctgaggcccgtgcagaggcaagagcccaaatggggatcggcgaggaggcggtggccggaccctggaactgggacgacatggacattgactgccttaccagggaggagcttggggatgacgctcaagcatggagtaggttttctttcgaaattgaggctcgggcgcaggaaaacgcagacgccagcacgaatgttaatttcagccgcggggccagtacacgcgcaggcttctctgatggcgcctccatatcttttaacggcgctccatcttcctctggcggattttctggaggtccaggtattaccttcggggtagctcccagtacctcggcgtctttctcaaatacagcatcaatctccttcggtggtactttgagtaccagtagctccttctccagcgcggcctcaatcagcttcgggtgtgctcactctacatcaacctccttcagcagcgaagcttccatttccttcgggggtatgccatgtacttcagcctcctttagcggcggcgtgtcatcaagtttttcagggcccctttcaactagcgccacattctccggtggagcctccagtggattcggcggtactttgagtacaactgcagggttttctggagtactgagcacttccacatccttcgggtccgcacctaccaccagtactgtgtttagcagcgcactatctaccagcactggcttcggcggcatcctaagcacatctgtgtgctttggaggaagtccaagttccagcgggtcctttgggggtaccttgtctacttctatatgctttggggggtccccttgtacttcgacaggattcgggggaacattaagtactagtgttagtttcggagggagtagttctactagcgcaaatttcggcggcaccctcagcacctccatttgctttgacggctcccctagcacgggcgccggcttcgggggcgctctgaacacttctgcgtcatttgggtccgtcctaaatacatcaacagggttcgggggagcaatgtccacctcggccgatttcggtggaacactgtcaaccagcgtttgttttggaggatctccaggaacgtccgttagtttcggaagtgctttgaataccaatgctggctacggcggcgcagtctctaccaacacagacttcgggggcacactctctacttctgtctgctttggaggctcacccagcacctccgcaggctttggtggagcgctgaacaccaacgcttccttcggatgtgctgtgagcacaagcgcgagcttttccggagccgtgagcacgagtgcctgctttagcggcgcgcccattactaaccctggatttggtggcgctttctccacctctgcagggtttggcggcgctctctctaccgccgctgactttggggggaccccaagtaatagcattgggttcggggccgcaccatcgacatctgtatcctttgggggtgcacacggaacctctctgtgtttcggcggggctccaagtaccagcctgtgcttcgggtcggcttccaacactaacctgtgcttcggaggcccaccatccaccagcgcttgtttctctggcgccaccagcccttcattctgtgatggaccctctacctccactggatttagtttcggcaacgggctgagcactaacgctggttttggcggcggcctgaatacatccgccgggttcggtggcgggttaggcactagcgcagggttcagtgggggcctgagcacaagcagtgggttcgacgggggtcttggcacctccgccggcttcggaggagggcctggtacgagcaccggctttggaggcggcctcggcaccagcgcaggattttctggaggactggggacatccgcagggttcggcgggggccttgtgacttccgacgggttcggcggaggattgggaactaatgcctccttcggaagcaccctcggtacctcagccggtttttccggcgggctttccacgtctgacggatttggatctcggccaaatgcctccttcgatagagggctgtctacaattattggttttggatctggctcaaacacctcgacaggattcacaggcgagcccagcacgtcgactggcttttcttcaggacctagttccattgtaggcttcagcggtggccccagcacaggagtcggcttctgctccgggccaagtacctctggcttttcaggagggccgagtacaggcgcgggatttgggggtggccccaacacaggagctgggttcggtggcggcccctctacttccgccggctttggatctggggccgctagccttggcgcttgcggtttttcttacggctag

SEQ ID NO: 139091 - DNA, 693 bp, Artificial Sequence
  Description of Artificial Sequence: Synthetic coding sequence
atgcacactttgctggctgccacaaaagactcactggcaatggatcctcctgttgtgaaccgtcccaaaaaatccaaaacaaaaaaagcccccatcaagacaatcactaaggccgccccagctgccccccctgtgccggccgctaacgagatcgccacaaataagccaaagattacctggcaagccctcaatttgcccgttatcacccaaattagccaagctctccccaccaccgaggtcactaatactcaggcctccagcgtgactgcccaaccaaaaaaagcaaacaaaatgaagcgggtcacggccaaggccgcacagggaagtcaaagccctacagggcacgagggaggtacaatacaactcaagtctcccttgcaggtgctgaagttacctgtcatcagtcagaacatacacgcaccgatcgctaatgagagtgctagttcgcaggccttgattacttcaattaagcccaagaaggcatcaaaggccaaaaaagctgcaaataaggccattgcctccgccacggaggtgtcacttgcagcaaccgccacccacactgccacaacgcagggacagattaccaacgagacagcttcaattcacacaaccgccgcttcaataaggaccaagaaggcgtcgaaagctcgtaagaccatcgctaaagtaatcaacaccgacaccgagcactag

SEQ ID NO: 139092 - DNA, 510 bp, Artificial Sequence
  Description of Artificial Sequence: Synthetic coding sequence
atggatagaaggaacgactatgggtatcgggtcccgttgtttcagggcccacttccaccccccggatccttaggactgcccttcccgcctgacatccaaactgagaccaccgaagaggacagcgtcctgcttatgcataccttactggctgcgacgaaggattccctcgcaatggaccccccagtggtgaaccgacctaaaaaatccaaaaccaaaaaagcccctattaagacgatcaccaaggccgcccctgccgccccccccgtaccggccgctaacgagatcgccacaaataagcctaagattacatggcaggccctaaatctccccgtgatcacccagattagccaggccttgcccactactgaggtcacaaacacccaagccagcagcgtaaccgcccagcctaaaaaagcgaacaagatgaagcgtgttaccgccaaggcagctcagggcagccagtctcctacagggcacgagggcggaactatccaactcaagtccccctag

SEQ ID NO: 139093 - DNA, 2889 bp, Artificial Sequence
  Description of Artificial Sequence: Synthetic coding sequence
atgctgcgagatgttattcaggagtatgatgagtacttccccgagattatcgaacgcgcctcctatacactggaaaaaatgtttcgggtgaacctcaaggagatcgacaaacaaagctccctctacattctgataagtacgcaggagtcaagcgcgggcatcttgggtacaaccaaagacactcctaagctcggactcctgatggtcattctgagcgtcattttcatgaatgggaataaagccagtgaggcggtcatttgggaggtcctccgcaagctgggcttacgacctggcgtgagacatagcctgtttggcgaagtgcgcaagctgattaccgacgaattcgtaaaacagaagtatctggagtacaaacgagtgcccaattcaaggccacctgaatatgagttcttttggggactccggtcatatcacgaaactagcaaaatgaaagtgttgaaattcgcctgtagagtccaaaaaaaggaccctaaggattgggccgtgcagtaccgggaggccgtcgagatggaggttcaggctgccgccgtggccgtcgcggaagcggaagctcgggcagaggcgcgagcccagatgggaatcggggaggaagctgtcgccggcccatggaactgggatgatatggatatcgactgcctgaccagggaggaattgggagacgatgctcaggcctggtcacgtttctccttcgagatcgaagcccgggcccaggagaacgccgatgcaagcacgaatgtgaacttcagccgaggtgcgtcaaccagagccggcttttccgatggtgcaagtatttcatttaacggcgccccttcatctagcggggggtttagcggaggacctgggatcactttcggcgtcgcacccagcacatccgcctctttttcaaacaccgcgagcatttcctttggcggcaccttgtccacatcttccagcttttcgtctgccgcctccataagttttggctgtgcacattctacttctacaagttttagtagcgaggccagtatttctttcggcggaatgccgtgcacctccgcctcattcagtggcggagtgagctcttcttttagcggaccgctgtcaacatcagctactttctccggtggcgcgtctagtggctttggaggcactctcagcacaactgcgggattctcaggagttctgtctacctccaccagcttcggcagtgcgccaaccacttctacagtgtttagctccgcactgagtacatctactggcttcggtgggattctgtccacgagcgtctgctttggtgggtcacccagctcttcggggtctttcggaggtaccctgagcacttctatatgttttggaggttcgccttgtacctctactgggtttggcggtaccctcagtacctccgtgtcatttggcggctctagtagcaccagcgctaactttggcggcacactctcaacatccatctgctttgatgggtcgcccagtaccggcgcgggattcggcggggccttaaacactagtgcaagttttgggagtgtccttaatacttcaactggttttggcggagccatgtccactagcgctgactttgggggaacactgagcacctccgtctgttttggtgggtcccctggcaccagtgtaagttttggttcagcgttaaatacgaacgcagggtacgggggagccgtgtctacaaatactgattttgggggaacactttcaacctctgtgtgctttggtggatcacccagcaccagtgctggattcggtggtgcactgaataccaacgcttcctttgggtgtgccgtttctaccagcgctagcttctctggcgccgtgtcgacctcagcgtgctttagcggcgccccgattactaacccaggctttggtggagcattcagtaccagcgctgggtttgggggtgcgctcagtacggccgctgactttggaggcacacctagcaactctatcggctttggcgccgcacccagtacctccgtgtccttcggaggggcccatggcaccagcctttgcttcggcggggcgccaagcacttcactctgtttcggatcagccagcaacacaaatctgtgctttgggggccctccctcaaccagcgcatgcttcagtggcgctacatctccatccttttgcgatggcccgagtacctctacgggcttctctttcggcaacggactctcaaccaatgccggcttcggtggtgggctgaacacaagtgctggattcggtggagggctcggaacgagcgccggtttctctggtggactaagtacaagctctggttttgacgggggcctgggcacctctgccggattcggaggaggcccagggacatcaactgggtttgggggtggcttgggcacatcagcagggttctctggtggtctgggcactagcgcaggattcggcgggggcctggttacttctgatggatttggaggcggtttagggaccaatgccagctttggcagcacattgggcactagtgccggcttttccgggggcctaagtacatcagatggatttggcagccggcccaatgcatcttttgaccgcggattgtctaccataatcggcttcggcagcggctccaataccagtacgggatttactggggagccatccacttctaccggcttttcatcaggaccaagttccatcgtgggattctccggtggaccttcaaccggcgtggggttctgttccgggccgagcacatccgggttctctggcggaccttccacaggtgccggcttcggcggtggtcctaacactggggcagggttcggcggtgggccctccacctctgctgggttcggcagcggtgccgcctctctcggggcctgtggatttagctacggatag

SEQ ID NO: 139094 - DNA, 366 bp, Artificial Sequence
  Description of Artificial Sequence: Synthetic coding sequence
atgcacaccttgctggccgcaaccaaagatagccttgcaatggaccctccggttgtgaaccgaccgaagaagtctaaaactaaaaaggcacccattaagactatcaccaaagccgctccagcagctcccccagtgccggctgccaacgaaatcgccacaaataaacctaaaataacctggcaggccctgaacctccccgttatcactcagatctcacaggccctaccgactaccgaggtgacaaatacacaagcatccagtgtgacggcgcagccaaaaaaagccaataagatgaagagagtgactgcgaaggctgcgcaggggagccagagtccgaccgggcacgaggggggcaccattcagtag

SEQ ID NO: 139095 - DNA, 579 bp, Artificial Sequence
  Description of Artificial Sequence: Synthetic coding sequence
atgcacactttgctagcggctaccaaagatagccttgctatggatccccccgtcgtgaacagacctaagaagagcaaaaccaaaaaagcccccattaagaccatcacaaaggctgcccccgccgctccgcctgtgcctgccgccaatgagatcgctaccaataagccgaaaatcacatggcaggctctaaatttgcccgtcattacgcagatcagtcaggccttgccgaccacggaggtgaccaacactcaagcgtcgagcgtaaccgcccagcctaagaaagcaaataagatgaagcgcgtgaccgcaaaagccgcccaaggcagccagtcacccaccggccacgagggcggtacaattcaattgaaatcccctctccaggtgctgaaactacctgtaatctcccaaaatattcacgccccgatcgccaacgaaagtgcaagttctcaggcacttataactagcattaagcctaaaaaggccagcaaggcaaaaaaggctgccaataaggctatcgcatcagctactgaagtcagcttggcagcaacagcgacccacacagccactacacagggatag

SEQ ID NO: 139096 - DNA, 531 bp, Artificial Sequence
  Description of Artificial Sequence: Synthetic coding sequence
atggatcggcgcaatgattatggctatagggttcctctcttccaggggcccctgcctcctccggggagcctggggctgccgtttcctcctgatatacagactgaaacgaccgaagaagattctgtgttactcatgcacacccttctggctgctaccaaggactcactggcaatggatccacccgtagttaatcgcccaaaaaagtctaagactaaaaaggcccctattaagaccattacaaaggccgcaccggcagcccctccagtgccagctgccaacgaaatcgcaacaaacaagcccaagataacttggcaggccctcaacctccccgtgatcactcagatctctcaggccctccccacaacagaggtgacaaacacccaagcatctagcgttacggcccagcccaaaaaggctaataagatgaagagagtcacggccaaggccgctcagggctcccagtcccctacaggccatgaagggggcactattcagcttaagtcacccctgcaggtgttaaagctgccctag

SEQ ID NO: 139097 - DNA, 507 bp, Artificial Sequence
  Description of Artificial Sequence: Synthetic coding sequence
atggatagacgtaatgactacggttaccgcgtgccgctatttcaagggcccctcccacccccagggtccctgggacttccttttcctccagacatccagactgaaacaacagaggaggactccgtcctgctgatgcatacactcctggccgcaacgaaagatagcctggccatggatcctcctgtggtgaatcgaccaaagaagagcaagactaaaaaggccccaattaagacgattaccaaagccgctcccgctgcccccccggtgccagctgctaatgagatcgcgactaacaaacctaagataacgtggcaagcgctcaacctaccagtcattacccagatctcccaagccctccccaccacagaggttacaaacacccaggcaagttccgtcaccgcccagcctaaaaaagccaataagatgaaaagagttactgccaaggccgcccagggctcacagtcccccacggggcacgaggggggaactatccaactgaagagctag

SEQ ID NO: 139098 - DNA, 2046 bp, Artificial Sequence
  Description of Artificial Sequence: Synthetic coding sequence
atggaccgacggaacgattatggataccgcgtgcctctgttccagggacccctgccccctcccggatcactgggcctcccttttcctccagacatccagaccgaaacaacagaagaggacagcgtgctgctgatgcataccctgctggcagcaactaaagacagcttggctatggatccccctgtcgtgaatcgaccgaagaagagcaagacgaaaaaagcacctataaaaactataacaaaggcggcaccggcagcccctcccgtgcccgcagcaaatgagatcgctaccaacaagcctaaaatcacttggcaggctctcaacttgccagtcattacccagatatcacaggccttacctacaactgaggtaaccaatacccaggcctcgagcgtcacagctcaaccaaaaaaggccaacaagatgaagcgagtaaccgcaaaagccgcccagggctcgcagagccccaccggacacgagggcgggaccatacagctcaagagcccactccaggtactgaagctccccgtgatttcacagaatatccacgccccaattgccaacgagtccgcctctagccaggccttgattacatccattaagccaaagaaagccagcaaggcgaaaaaagcagctaacaaagctatcgcatctgccacagaggtcagtctggctgctactgcaactcacacagcaacaacccagggacagatcaccaatgaaactgcctctatccacacaaccgctgcttcaataaggacaaagaaagcttccaaagccagaaaaaccatagcaaaggtgattaacacagatacggagcacatagaggctttgaacgtgacagatgcagccacccgccaaattgaagccagcgtggtggcgataaggccaaaaaagtcaaagggcaaaaaggcggcgtccaggggtcccaatagcgtgtccgaaattagcgaagctcccctggccacccagatcgttacaaatcaggccctagctgccaccctgagggtgaaaagaggctcacgggcccgaaaagcggctactaaagcccgcgctacagaatctcagacccctaacgccgatcagggagctcaagccaaaatagcttcagcccaaacgaacgtatccgctttggagacccaagtggccgccgcagttcaggcactggccgatgactacctagcacagctgtccttggagcctacaacccgaacccgcggaaaaagaaaccgcaaaagcaaacacctgaacggggatgagagaagtggctccaattatcgccgaataccgtggggacgtcgaccagcccctccaagggatgttgctattttgcaagagcgtgccaataagctggtaaaatatctgctcgtcaaagaccagacaaagattcctatcaagagatccgacatgcttagggacgtcatacaagagtacgacgaatacttcccagaaatcatcgaaagggcaagctacaccctcgagaaaatgttccgggtgaacctaaaagagattgataagcagtccagcttatatatcctgattagtacccaagagtcctctgcaggaattctcggcaccactaaggacacccccaagcttggcttgttgatggttattttgagtgtgatctttatgaacggtaataaagcgagcgaggcggttatttgggaagttctccgcaaactaggccttcggcctggggttcggcattcactgttcggggaggttagaaagctgatcactgacgagtttgttaagcagaaatatctggaatacaagagagtgcctaacagcagaccccccgaatatgagtttttttggggattgaggtcctatcacgaaacttcaaagatgaaagtgttgaagttcgcatgccgggtacagaaaaaggaccctaaagactgggccgtgcagtaccgcgaagcagtggagatggaggtccaagcagcagctgtagcagttgctgaggccgaggctagagctgagtggtttcagcaccagcactggctatactggagaacacagcaccaacacggcttgcagtag

SEQ ID NO: 139099 - DNA, 372 bp, Artificial Sequence
  Description of Artificial Sequence: Synthetic coding sequence
atgcacaccctgcttgctgctaccaaagattccctggccatggatccgccagtcgtgaatcgcccgaaaaaaagcaagactaagaaggcccccattaaaactatcaccaaggctgcgcccgccgctccgcctgtgcccgccgctaatgaaatagcaacaaacaagcccaaaatcacatggcaagcactaaatttgcctgtgatcacccagatcagccaggcactgccgacgactgaggtgactaacacccaagctagctcagttaccgcacagccgaagaaagcgaacaagatgaagcgcgttactgccaaggcggcccagggatcccagtcacccaccggtcatgagggcggcacgatccagcttaagtag

SEQ ID NO: 139100 - DNA, 216 bp, Artificial Sequence
  Description of Artificial Sequence: Synthetic coding sequence
atgcatactctccttgccgccaccaaggactcactcgccatggaccctcctgtcgtaaatcggccaaagaaatctaaaacaaagaaagcccccattaagaccatcaccaaagccgcaccagccgcaccacctgttcccgccgcgaatgagatagcgacgaacaagcccaagattacctggcaggcccttaaccttccagtgatcacccagatttag

SEQ ID NO: 139101 - DNA, 195 bp, Artificial Sequence
  Description of Artificial Sequence: Synthetic coding sequence
atgcatacgctactggctgccaccaaggacagccttgctatggatccacccgtggtcaacagaccaaagaagtctaagactaaaaaagctcccatcaaaacaataaccaaggcagcacctgctgcccctccggtccccgccgcaaatgagatcgcaactaataagcctaagattacttggcaagccctgaactag

SEQ ID NO: 139102 - DNA, 930 bp, Artificial Sequence
  Description of Artificial Sequence: Synthetic coding sequence
atggatcgccggaacgattacgggtatagagtgcccctgttccagtctaaacacttgaatggagacgagcgatcaggaagcaactaccgaagaattccttggggtaggaggcctgcccccccacgtgatgtagccatccttcaggaacgcgccaacaagctagtgaagtatcttctggttaaagaccagacgaagatccccattaagcggtccgacatgttgcgcgatgtgatccaggagtacgacgaatacttccccgaaattattgaaagggcttcctacacattggagaagatgtttagggtcaatctgaaggagatcgataaacagagctcactgtatatcctaatctccacgcaggagtctagcgccggaattctgggcacaactaaggacaccccgaaattaggcctgctgatggtaattctaagcgtgatattcatgaacggaaataaagcctcggaggccgttatctgggaggtgctgaggaagctgggtctgcggccaggagtccggcatagtctgttcggggaagtcagaaagctaattacagacgagttcgttaagcagaaatacctggaatacaagagggtccctaattcacggccccctgaatacgaattcttttggggcctgaggtcctaccacgagacatcaaagatgaaggtactcaagtttgcttgtcgtgtccaaaagaaagatccgaaagattgggcagtgcaatacagggaggccgtcgaaatggaagtacaggccgcagctgtggcagttgctgaggcggaagctcgcgctgagatctacagtccctgtctgcagataccgctcatcaactgctccagcccatcccacggcgccaaggttcatccgtggaacctgtgtccacacagctcccaggggagttacggccagtccgctgagggggtaatgtag

SEQ ID NO: 139103 - DNA, 1263 bp, Artificial Sequence
  Description of Artificial Sequence: Synthetic coding sequence
atgcctggaggttgtagccggggacccgcggctggggacggccgcctccgcctggccagattagccctggtgctcctcggatgggtgagctcttcatctcctacctccagcgcctcttcgttctctagtagtgcacccttcctggcctcagccgtgtccgctcagcctcccctaccagaccaatgtccggccctctgcgaatgttcggaagccgcgagaactgtaaagtgtgtgaataggaacctcacagaagtgcccacagacctgcctgcatacgtgcgcaacctctttctgacgggcaatcaattggcggtgttgccagccggtgctttcgcccggcgcccgccattagctgagctggccgctttaaacctgtcagggtcaagactggatgaggtgagagccggggccttcgaacacctacccagtcttcggcagctcgaccttagtcacaacccacttgccgacctcagtccctttgccttctccgggagcaacgcaagtgtttctgcacccagcccactcgtagagttgatactgaaccatatcgttccgcctgaagatgagagacagaaccgcagttttgaaggaatggtcgtcgcagctctgcttgctggtagagccctacagggcttgcgcaggttagaactggcatcaaaccattttctgtacctgccccgggacgtgctagctcagctcccctcccttagacatctcgacctgagcaataacagcttagtgtcactgacctacgtctcctttaggaaccttacacacctggaaagcctccacctggaggataatgccctgaaagtactccataatggcacactagcagagctgcagggcttgcctcacatacgtgtgtttcttgacaacaacccttgggtgtgcgattgtcacatggctgatatggtgacatggctgaaagaaactgaggtggtgcagggaaaggatcggctcacttgcgcttaccctgagaaaatgagaaatcgggtcctgcttgagcttaactctgccgacctggactgtgaccccattttacccccttccctgcaaacctcgtatgtgtttctcggcatcgtgctcgctctgattggagccatatttctgcttgttctgtacttaaacaggaaagggataaagaagtggatgcacaatattagggatgcctgccgcgaccacatggagggctaccattacagatatgaaattaacgctgaccccaggctgaccaacctttcctctaattctgacgtatag

SEQ ID NO: 139104 - DNA, 1263 bp, Artificial Sequence
  Description of Artificial Sequence: Synthetic coding sequence
atgcctggaggctgttctcgggggcccgcagccggagacggaaggctgcggttggctcggctagccctggtcctgttgggatgggtctcgtctagctctccgacctccagtgccagctctttctcaagcagcgccccctttctggccagcgctgttagtgctcagcccccactgcccgatcagtgtccggcactgtgcgagtgtagcgaagcagcccgaactgttaagtgcgtaaatcggaatctaactgaagttcctacggatctgcctgcttatgtaaggaacctgttcctgaccggaaaccaactggcagtgcttcctgcgggagccttcgcaagacgccctccactggccgagcttgccgcattgaatctgtccggctctcgactagatgaggtgagggcaggtgccttcgaacacctgccctctctgagacagctcgatctctcccataatccgctcgcagatctgtccccgttcgcttttagcggatcaaatgccagcgtttcagccccttcccccctggtggaactgatcttaaaccacatagtgccaccggaagacgaacgccagaaccggtcttttgagggaatggtcgtcgccgccctcctggcaggtagggcgctgcagggtttacgaagactggagctggccagcaaccattttctgtatctacctcgagacgttctggctcagctgccaagccttagacatcttgatctgtctaataatagtctcgtgagtcttacatatgtgtcattcagaaacctgacccatctagaaagcttgcatcttgaggataacgccctcaaggtcctccataatgggaccctcgctgagctgcagggtcttccccacataagagtcttcctcgataacaatccttgggtgtgcgactgtcatatggccgacatggtgacctggctcaaagagactgaagtggtccaaggcaaagatcgcctcacctgtgcgtatccagaaaagatgcgaaaccgcgtgctgcttgaactcaattctgccgatttagactgtgaccccatcttgcctcccagccttcagacaagctacgtgttcttaggcattgtacttgccctaatcggcgcgatctttctgttagtcctttatctgaacaggaagggaattaaaaaatggatgcacaatatcagagacgcgtgcagggatcacatggaaggataccattaccggtatgagatcaatgccgatcctcgacttactaacctctctagtaacagcgacgtgtag

SEQ ID NO: 139105 - DNA, 1263 bp, Artificial Sequence
  Description of Artificial Sequence: Synthetic coding sequence
atgccggggggctgttccagaggtccagccgctggcgatggtcgcttaaggctggccaggctggccctcgtgctgctgggatgggtgtcctcctcttctccaacaagctctgcctccagcttttcctcaagcgccccctttctcgcatctgcagtaagtgcccagcctccgcttccggaccagtgtccagcactctgcgagtgtagtgaggcagctcgcaccgtgaaatgcgtcaatcgtaacctgacagaagtgcctacagatctgccagcttacgtgcgcaatctgtttttaaccggcaatcaattagctgtgctgcccgcaggagccttcgctcgccgccctcctctggccgaactggccgcactgaacctttcgggttcaagactggacgaagtccgggccggcgcattcgagcatctccccagtctgcggcaattggatctcagccataaccctcttgctgacctcagtcctttcgccttcagtgggagtaacgccagtgtctcggcgccatcaccactggtcgagctgattttgaaccatattgtgccccccgaggacgagcggcagaaccgatcttttgaaggtatggttgtggctgctttgctcgctggacgcgctcttcagggcttgaggagactggagttagcatccaaccattttctctacctgccacgggacgttctcgcccagctaccttccctccggcatctggatctctccaataattctctagtgtcccttacttatgtaagttttagaaatttgacacacttagagtctctacacttggaggacaacgcgcttaaagtgctgcacaacggcacactggccgaactgcagggattgccacacatccgagttttcctggataacaacccctgggtgtgtgactgccacatggctgatatggtcacgtggctgaaagagaccgaggtcgtgcagggcaaagatcgcttgacttgtgcatatcctgaaaagatgcgcaatcgagtgttacttgagcttaactccgcagaccttgattgcgatccgatcctgcctcctagcctccagaccagttacgttttcttgggtatagtcctggctctcattggagccatttttctgctggtcctctacctcaatcggaaaggcatcaagaagtggatgcataacattagggacgcctgccgggatcacatggaaggataccactacaggtacgaaattaacgccgacccgcgtctcaccaacctgtccagcaactcagatgtgtag

SEQ ID NO: 139106 - DNA, 1056 bp, Artificial Sequence
  Description of Artificial Sequence: Synthetic coding sequence
atggcattgccctttcaaaaggaacttgaaaagtataagaatattgacgaggacgagcttttgggcaaactgagcgaagaagagctcaaacagctggagaatgtcctagacgatttggaccccgaatccgctatgctacccgcaggcttccgtcagaaggaccagactcagaaagctgctacagggccttttgaccgtgagcatctgctgatgtatctggagaaggaggcgctagaacagaaagatagagaggacttcgtccccttcaccggggagaaaaaagggagggtctttatccctaaggagaagcctattgaaaccaggaaggaggagaaagtaaccttggacccggagctggaagaggctctggcttctgcaagcgatacagagctgtatgacttggccgcagtgttaggcgttcacaatctgctgaataaccctaagtttgatgaggagacagcaaacaacaagggaggtaagggccctgtgcgcaacgtcgttaagggtgagaaggtgaaaccagtgtttgaggagcctccaaatccaactaacgtcgaaatatccttgcaacagatgaaggcaaatgacccctcacttcaggaagtgaatcttaacaacatcaagaatatcccgatccccaccttacgggagttcgctaaggccctggaaacgaacacacacgtgaagaagttttctcttgctgcaacgcggagcaacgaccccgtcgctattgctttcgctgacatgttgaaggtgaataagactttgacttccctgaatatcgaatccaattttattactggcactgggattttggcgctagtggaggctctcaaggagaatgacactctgactgagataaagatcgacaatcaacgccagcagctcggcaccgccgtggaaatggagattgcccaaatgctcgaggagaactccagaatattgaaattcgggtatcagttcacaaagcaaggtccccggacccgagttgctgcagccatcaccaagaacaatgacctcgtgcgtaaaaaaagggttgaggctgacagacggtag

SEQ ID NO: 139107 - DNA, 948 bp, Artificial Sequence
  Description of Artificial Sequence: Synthetic coding sequence
atggccctgccttttcaaaaagagctagagaaatataaaaacatcgacgaggatgaacttttagggaagctatcagaggaggaattaaaacagctcgagaacgtcctcgacgacctcgaccctgagagcgcaatgttgcccgccgggtttcgacagaaagatcagacccagaaggccgctacggggccctttgatagggaacacttgttgatgtatctggaaaaagaggccctcgagcaaaaagaccgcgaggactttgttccctttactggggaaaagaagggccgagtatttatcccaaaggaaaagcccatcgagacccggaaagaagaaaaggtgacattggacccggagttggaagaagcattggcatccgccagtgataccgagctttacgatctagctgccgtgctaggagttcataatctactcaacaatccgaagttcgacgaggagactgcgaataataagggtggaaagggacccgttcggaacgtggttaagggcgagaaggtaaagccagtctttgaagaaccccctaaccctactaacgtcgagatctcgctgcagcaaatgaaggcaaacgaccctagcctccaggaggttaacttgaataacataaaggcctttgcggacatgctcaaggttaataaaacgcttacctctctgaacattgagtccaactttataacaggtactgggatccttgcactggtggaggccctgaaagaaaacgatacccttacagaaatcaaaattgacaaccagcgccagcagctggggactgccgtagagatggaaattgcacagatgttagaggagaacagtcggatcttgaaattcggatatcagtttacgaagcagggtcctcggaccagggttgccgccgctattacaaagaacaacgatctggtgcggaagaaaagggtagaggccgacaggcgatag

SEQ ID NO: 139108 - DNA, 1059 bp, Artificial Sequence
  Description of Artificial Sequence: Synthetic coding sequence
atggcgttaccatttcgtaaggacctcgaaaagtataaggatctagacgaagacgaactgctaggaaaccttagtgaaaccgagttaaaacagctggagacagtgcttgacgacctagaccccgagaacgcactcctccctgcagggttccggcagaagaaccagaccagcaagtctacaactgggccattcgacagagaacaccttctgtcttacctggaaaaggaagctctggagcacaaggacagggaagattatgtcccatatactggggaaaagaagggcaaaatcttcattccgaagcagaagcccgtgcagacgttcaccgaggaaaaagttagtctggacccagagctggaggaagctcttacttctgcgtcagataccgagctatgcgaccttgccgccatcctgggtatgcacaatctgattaccaacacaaagttctgcaacatcatgggatcatctaatggggtagatcaagagcacttcagtaatgtggtgaaaggggagaagatcctgccagtgtttgacgagccaccgaatccaactaatgtcgaggagtccctcaaaagaacaaaggaaaacgacgcccacctggtcgaggtaaatctcaacaacatcaaaaatatacccatcccaacattgaaagactttgctaaagctctggaaactaatactcacgttaagtgcttcagtctggctgctacccgaagtaacgaccctgtagcaacagctttcgcagagatgctaaaggtcaacaagacgctcaagtctctgaatgtggaatcaaacttcattacgggcgtcggtattctggccttgattgacgcactacgagataacgaaacccttgctgagctgaaaatcgataaccagagacagcagctaggcacggcagtggaattggagatggctaagatgcttgaagaaaataccaacatcctgaaattcggttaccagtttactcaacagggaccacgcaccagggcggccaacgcgatcacgaaaaataatgacttagtcagaaagcgccgtgtcgagggtgatcaccagtag

SEQ ID NO: 139109 - DNA, 1059 bp, Artificial Sequence
  Description of Artificial Sequence: Synthetic coding sequence
atggccttacccttccggaaggacctggagaagtacaaagacctggacgaagacgagctcctcggaaacctctccgagaccgagttaaagcagttggaaacggtccttgacgatctggatcctgagaatgcactgcttcccgccggttttcggcaaaagaaccagacctctaaaagtaccactggaccattcgacagggagcacttgctgtcctatttggagaaagaagcgttagaacacaaagatagagaagattacgtcccttatacgggcgagaagaagggcaagatatttatccctaagcagaaaccagtgcagacttttactgaagagaaagtgagtctcgatccagagctggaagaagccctaacctccgcttccgacaccgaattgtgcgacttggctgccatcctgggaatgcacaacttaattaccaacacgaaattttgcaacatcatggggtcctctaatggagtcgatcaggagcacttcagcaacgtggtgaagggtgagaagatcctgccagtgtttgatgaacctccgaaccccaccaacgttgaggaatctcttaagagaaccaaggagaatgatgcacatttagtggaagttaatcttaataacattaaaaacattccaatacccacattgaaggacttcgccaaggccctggaaaccaatacacacgtgaaatgcttctcactggccgcgacacgtagcaatgacccagtggcaacggccttcgccgaaatgctgaaggtgaataagacgctgaaatctttgaatgtagaatcaaatttcatcaccggggtaggcattctcgccctgatcgatgccttgcgagataatgaaaccctcgccgaactgaagattgataaccagcggcagcaactaggtacagccgtggagctcgaaatggcaaagatgctggaagaaaatacgaatatactcaagttcgggtatcagttcacacagcaggggccccgaacaagggccgcgaacgccatcacaaagaacaatgacctagtacggaagaggcgggtcgaaggggaccatcagtag

SEQ ID NO: 139110 - DNA, 102 bp, Artificial Sequence
  Description of Artificial Sequence: Synthetic coding sequence
atggccttaccattcaggaaagacctcgagaagtataaagaccttgatgaagacgaactgctggggaatttgtctgagacagaactaaaacagctcgagtag

SEQ ID NO: 139111 - DNA, 1038 bp, Artificial Sequence
  Description of Artificial Sequence: Synthetic coding sequence
atgagttcttaccaaaaagagttggagaaatacagggacatcgatgaagatgagattctgaggacactgtcaccggaagagctcgagcagttggactgcgagttacaggagatggaccccgagaatatgctgctgccagccgggttaagacagcgggaccagaccaagaagagtccaaccggcccattggatagagaggcattactccagtacctggaacaacaggctctggaggtcaaggagagggacgacctggtgcctttcacgggcgagaaaaaggggaagccctatattcagccaaagcgggaaattcccgctgaagaacagattacacttgagcccgagctggaggaggcacttgcacacgcgacggatgccgaaatgtgcgatattgcggcaatcctcgatatgtacacgctgatgtctaataaacaatattacgacgctctgtgctcaggagaaatttgtaacactgaaggaatttccagcgtggtgcaaccagacaagtataaacccgtacccgatgaaccacccaaccctacaaacatcgaggagattctgaaacgcgtcagatccaacgataaggagctagaagaggtgaaccttaacaacattcaagacattcctatcccaatgctctccgagctttgtgaggcaatgaaagccaatacttacgtaaggagcttcagtctggtcgccacacggagtggcgaccccatcgccaacgcggtcgcagacatgttacgggaaaacagaagcctgcagagcctaaatatcgaaagtaattttattagcagtacaggattgatggccgtcttaaaagcagtgagagagaacgccactctcacggaacttcgggtcgataaccagcggcagtggccaggcgacgcagtggagatggagatggccaccgtcttggagcagtgccctagcatcgtccggttcgggtatcattttacgcaacaggggccacgagcccgcgctgcccaggctatgaccaggaataacgaacttaggagacagcagaagaaaaggtag

SEQ ID NO: 139112 - DNA, 831 bp, Artificial Sequence
  Description of Artificial Sequence: Synthetic coding sequence
atgtctagctaccagaaggagctcgaaaagtacagagatatagatgaagatgagatcctgcggacattgtctccagaggagcttgaacagctagattgcgagttacaggagatggatccagaaaatatgctgttgcctgcagggttgagacagcgtgatcagaccaagaagtctcccaccggcccccttgaccgagaggcactccttcagtatctggagcagcaggctctggaagttaaggaacgggacgaccttgtgcctttcacgggcgaaaaaaaaggggtcgtgcagccagacaaatacaagcccgttcctgatgagccacctaacccaaccaatattgaggagattctgaagcgggtcaggtctaacgacaaagagctggaagaggtgaatttaaataatatccaggatatccccatacccatgttgagtgagctatgtgaggccatgaaggccaacacctacgtgcgatcgttctccctggtagccaccagatccggcgaccctatcgccaatgcggtggcagatatgctaagagagaaccggtcgctgcagtccctgaatatagagtccaactttataagttccactggtctcatggctgtcctcaaggcggttcgggagaacgccactctcaccgagcttcgagttgataaccaaaggcagtggcccggcgatgctgttgaaatggagatggctacggtgctggagcagtgtccatcaatcgtaagattcggatatcactttacacagcaggggccacgagcccgtgcagctcaggcgatgacacgcaataacgagctccggagacagcagaaaaagaggtag

SEQ ID NO: 139113 - DNA, 429 bp, Artificial Sequence
  Description of Artificial Sequence: Synthetic coding sequence
atgagttcgtaccagaaggagttggaaaaataccgggacatcgatgaggacgagattctgaggacgctctcacccgaagagctggagcagctcgactgtgaattacaagaaatggacccagagaacatgctcctgccagcaggcctgcgccagcgggatcaaactaaaaaaagtccaactggtcccctagatcgggaggccttgctgcagtacctggagcaacaggcgctggaggtcaaagagcgagatgaccttgtcccatttacaggcgaaaagaaggggaaaccatacatccagcccaagagggaaattccagctgaggagcagatcacactcgagcctgagctggaggaggcccttgcgcatgcgaccgacgccgagatgtgcgatattgctgccatactcgatatgtataccctcatgagctag

SEQ ID NO: 139114 - DNA, 855 bp, Artificial Sequence
  Description of Artificial Sequence: Synthetic coding sequence
atggatgctatcaagaagaagatgcagatgttgaagctggacaaagaaaacgcactcgaccgcgccgaacaggccgaggcagataagaaggccgcagaagacagatccaagcagctcgaagaagatatcgccgccaaagagaaactgctgcgcgtgagcgaggatgaacgcgatcgcgtgcttgaagaacttcacaaggctgaggacagcttgttagctgcggaagaggcagccgctaaggcggaagctgacgtggcttctctgaatagacgcatacagttggtggaagaggagctggatagggctcaggaacggctcgccacggctctgcagaagctggaagaggcagagaaggcggccgacgagagcgaacgtggcatgaaggtgatcgaaagtagggcccagaaagacgaggagaagatggagatacaggagattcagctaaaggaggccaagcacatagcagaagacgccgatcgcaagtatgaggaagtggcgaggaaacttgttatcattgagtccgacctggagagagccgaagaacgcgccgagctgagcgagggcaaatgtgcagagctggaggaggaacttaagaccgtgaccaacaatctgaagtccttggaagctcaggctgagaagtattctcaaaaggaggataggtacgaggaagaaatcaaagtgctgtcagacaaacttaaagaggctgaaacccgggccgaattcgccgaacggtctgtcaccaaactggaaaaatccatcgatgacctcgaagaaaaagtcgctcatgcaaaggaggagaacctgtcaatgcatcagatgctggaccagacactactggagctcaacaatatgtag

SEQ ID NO: 139115 - DNA, 855 bp, Artificial Sequence
  Description of Artificial Sequence: Synthetic coding sequence
atggacgccataaaaaaaaaaatgcaaatgctcaagcttgacaaagagaacgcactggaccgcgccgaacaagccgaggccgacaaaaaggccgcggaggaccgcagcaagcaattagaggacgagctcgtttccttgcagaagaagttaaaagggactgaggatgaactcgacaaatattccgaggcactgaaggatgcccaggagaagcttgaattggcggagaaaaaggctaccgacgccgaggccgacgtcgcctcattgaacagaagaattcagctggttgaggaggagctggatagggcccaagagagactcgctaccgccctgcagaagctggaagaggcagagaaggcagctgacgagtccgagcgcggcatgaaggtcatagagtccagagcacagaaagatgaagagaagatggagattcaggagatacagctcaaggaggccaagcatatcgcagaagatgccgataggaagtatgaagaggtggcccgcaagcttgtgattatcgagtccgatctcgaacgtgccgaagaacgagctgaactcagtgaggggcaggtacggcagttagaggagcagctccgaatcatggatcaaaccttaaaagccctaatggccgccgaggataagtacagccagaaggaggaccgttatgaagaagagataaaggtactctcagataaattgaaggaggcagaaaccagagccgaattcgctgagcgcagcgtcacaaagctcgagaagagtatagacgatctggaggatgagctatacgcccagaagctcaagtacaaagccatttccgaggagttagatcacgccttgaacgacatgacttctatgtag

SEQ ID NO: 139116 - DNA, 738 bp, Artificial Sequence
  Description of Artificial Sequence: Synthetic coding sequence
atggctggaagttcttctctcgaggccgtccgcagaaaaattagatccttacaggagcaggctgatgccgctgaggagagagccggaactcttcaaagagaattggatcatgaaaggaagcttcgggagacagctgaggcagacgtggcttcccttaaccgacgcatccagctggtagaggaggagctggacagagctcaggaacgcttggcgactgccctccagaagctcgaggaggcagagaaggcagcagacgaatcggagcgaggaatgaaagtgatcgagtctagggcccagaaggacgaagaaaagatggagattcaggagatccagctgaaggaagccaagcatatcgccgaagatgctgacagaaaatacgaagaagttgcccgtaaactggtcatcatcgaaagtgacctggagcgcgcggaggagcgagccgaactgtccgagggaaagtgcgccgagctggaagaggaactgaagactgtcacgaacaacctaaaatcactggaggcacaggcagaaaagtattcccaaaaggaggatagatatgaggaagaaataaaagtgttgtccgataaactgaaagaggcggagacacgcgccgagttcgccgagaggtcagtgaccaaactggagaagagcatagacgacctggaagaccagctctatcagcagctcgagcagaacagacgcctgaccaacgagctgaagctagcactgaatgaggactag

SEQ ID NO: 139117 - DNA, 981 bp, Artificial Sequence
  Description of Artificial Sequence: Synthetic coding sequence
atggatgccataaagaaaaagatgcagatgctaaagcttgataaggagaatgccttggatcgcgcagagcaggctgaggcagacaaaaaggcagcggaggaccgatcaaaacagttggaggaggatattgccgctaaagagaagcttctgagggtgagcgaggatgaaagggatcgagtattagaggagttacataaagcagaagatagcctgctggctgctgaggaggccgccgccaagctggaagacgaactcgtgtcactgcagaaaaagctgaaggggacagaggatgaacttgacaagtacagcgaggccctcaaagatgcgcaggagaagctcgagttagcggagaaaaaagcgacagacgccgaagccgacgtggcctccttgaatcgcaggatacagctcgtggaggaagagcttgatagggcacaggaaaggctggctaccgccctgcagaagcttgaagaagccgagaaggcagccgacgagagcgagcgggggatgaaagtgatcgagagccgcgctcagaaagacgaagaaaagatggaaatccaggaaatacagttgaaggaagccaaacacatagctgaagacgccgatcgcaaatacgaggaggtcgcacggaagctggtgattatcgaatccgacctcgaacgcgcagaagagagagctgagctctcggagggcaagtgtgcagaactggaagaagagctgaaaacagttaccaacaaccttaagtcgttggaagcccaggctgaaaagtactcccagaaagaagatcgatacgaggaagaaattaaagtgctatctgacaaattaaaggaggccgagacccgcgcagaattcgcagagcggagtgttaccaagctggagaagtctatcgacgacttagaagaaaaagtagcacatgccaaggaggagaatctcagcatgcatcagatgctggatcagactttacttgagctgaacaacatgtag

SEQ ID NO: 139118 - DNA, 855 bp, Artificial Sequence
  Description of Artificial Sequence: Synthetic coding sequence
atggacgctattaagaaaaaaatgcaaatgctgaagctggataaggaaaatgccctggaccgagctgagcaagccgaggcagacaagaaggccgccgaggatcggtcaaagcaactggaagacgaactggtgagtctgcagaagaaactcaaggggactgaggatgaacttgacaaatattccgaggctctcaaagatgctcaggaaaaactcgaacttgccgaaaaaaaagccaccgatgccgaggctgacgttgcgagcctgaaccgtcgaatccagctggtggaggaagagctggaccgggctcaagagaggctcgcaactgctctgcaaaaactcgaggaagccgagaaagctgctgacgagtccgaaagaggaatgaaagtgatcgaatctagggcgcagaaggatgaggagaaaatggagatccaggagatccagctgaaggaggcaaagcatatagccgaagacgccgatcgcaaatatgaggaagtggcccgcaaactagtgataatcgaaagtgatttggaacgcgccgaagaacgggctgaactctctgagggacaggtgaggcagctggaggaacagctgcgaattatggaccagaccttgaaagctttgatggccgctgaagacaaatatagccaaaaggaggaccgctacgaagaggaaatcaaagtgctgtctgacaaactcaaggaggcagaaactcgcgcggaattcgcagagcggtccgttaccaaactggaaaaaagcatcgatgacctcgaagagaaggtcgcacatgccaaggaagaaaatttatccatgcaccaaatgctggatcagaccttgctcgagcttaacaatatgtag

SEQ ID NO: 139119 - DNA, 855 bp, Artificial Sequence
  Description of Artificial Sequence: Synthetic coding sequence
atggatgcaattaagaaaaaaatgcagatgctgaagcttgataaagaaaatgcactagatcgcgcagaacaggccgaagcagataagaaagccgcagaggatcggtccaagcagctggaggacgaacttgtgtccctccaaaagaaactgaagggaacggaagacgagctagacaagtactccgaagctctcaaggacgctcaggaaaagcttgaactcgccgagaaaaaggccaccgatgccgaggcggacgttgcctcattaaaccggagaatacagctggtggaggaagaactagaccgggcccaggaacgactggctaccgctctgcagaagctggaggaagccgaaaaagcagctgacgaaagtgagaggggcatgaaggtaatagagtcaagagcccagaaggacgaggagaaaatggagattcaggagatccagctcaaggaggctaagcatatagctgaagatgccgaccgaaaatatgaggaagtcgcccggaagctggtgattattgaatcggaccttgagagggctgaggagcgggctgagctgtcagaagggaaatgtgctgaactggaagaggaactgaagactgtaacaaataacctgaaaagcttggaagcccaggccgaaaagtactcccagaaggaagatagatacgaagaagagattaaggtgttgtctgacaagcttaaagaggccgagacacgcgctgagtttgctgagaggagtgtcaccaaactagagaaaagcatcgacgatctggaagacgagctgtatgctcagaaactaaaatataaggctattagcgaggagctcgaccatgctttaaacgatatgaccagcatttag

SEQ ID NO: 139120 - DNA, 855 bp, Artificial Sequence
  Description of Artificial Sequence: Synthetic coding sequence
atggatgcgattaagaagaaaatgcagatgctaaagctcgacaaagaaaatgcattggaccgcgcggaacaggctgaggcggataagaaagctgcagaggaccgttctaagcaattggaagaagacattgcagctaaggagaagctcctgcgcgtctctgaagacgagcgcgatcgggttctagaggaacttcacaaggccgaagactccttactggcagccgaggaagccgcagcaaaagccgaagccgacgtcgctagtctaaaccggagaatacagcttgtcgaagaagaactcgatcgggctcaggagagacttgccacagccttgcaaaagctggaggaggcagaaaaggcggccgatgagtctgaacgcggaatgaaagttatcgagtccagggcccaaaaagatgaggagaaaatggaaatacaagagatacagctcaaagaagccaaacacatcgcagaagatgccgaccgaaaatacgaggaggtggctcgaaagctcgttataatcgagtctgacctcgagcgcgccgaggaaagagccgagctgtcggagggacaggtgcgacagctcgaggagcagctacgcatcatggaccagaccttaaaggcgctcatggccgcagaggacaagtactctcagaaggaggatagatacgaggaggagatcaaagttctgtccgacaaactgaaagaagctgagacacgcgcagaattcgccgagcgttcagtaactaaactggagaagagcatcgacgacctggaggagaaagtggcgcacgctaaggaggagaacctgagcatgcaccaaatgctcgatcaaactcttttggagcttaataatatgtag

SEQ ID NO: 139121 - DNA, 855 bp, Artificial Sequence
  Description of Artificial Sequence: Synthetic coding sequence
atggatgcgatcaaaaagaagatgcaaatgctcaagttggacaaggaaaatgctctggacagagctgagcaagcagaggcggacaaaaaggctgccgaagatcgatccaaacaattagaggacgaactcgtgtcactccaaaaaaaacttaaaggaaccgaagatgagttggataagtacagcgaggcacttaaagatgcccaggaaaagctggagctggccgaaaaaaaagctacggacgcagaggctgacgtagcaagccttaatcgcagaatccaacttgtcgaggaggaactggacagggctcaggaacggctagccaccgccttgcagaagctcgaagaggccgagaaggcagccgacgaatcggagaggggtatgaaggtgatcgaatcccgtgctcagaaagacgaagagaagatggagatccaggagatccagctgaaagaagcaaagcacatcgccgaagatgcggatcgaaaatatgaggaggtagctcgcaaactggtgattatcgaaagtgatttggagagagctgaggagagagcagagctatcggagggtaaatgtgctgagttagaagaggaactaaagaccgtcaccaataacttgaaaagtctcgaggcacaggctgagaagtactcccagaaggaagaccgatacgaggaggaaatcaaggtgctgtcagacaagcttaaggaggctgagaccagagcagaattcgccgagcggtccgttacgaagctcgaaaagtccattgatgacctggaagagaaggttgctcacgctaaagaggaaaacctgagtatgcatcagatgctggaccagactctgctcgaacttaataacatgtag

SEQ ID NO: 139122 - DNA, 798 bp, Artificial Sequence
  Description of Artificial Sequence: Synthetic coding sequence
tgacgggctgagcaggcagaagcggacaagaaagcagctgaggatcgaagcaagcaactggaagacgaactggtaagcctgcagaagaagctgaagggtaccgaggacgaactagacaagtatagcgaggccctgaaggacgcccaggagaaactcgagctcgctgagaagaaagctactgatgctgaagctgacgttgcttctctgaacagacgaattcagttagtagaagaagagttggacagagcacaggaaagactcgctactgcactccagaaactggaggaagccgagaaagcagccgatgaaagcgagagaggcatgaaggtcattgagagtcgcgcccagaaagatgaagaaaagatggagatccaggagatccagctgaaagaggccaagcacattgcggaggatgctgacaggaaatacgaggaggtagcacggaagttagtgatcatagaatcagatttggagagagctgaggaacgggcagaactgtctgaaggaaaatgcgctgaactcgaagaggagcttaagactgtgactaacaacctgaagagccttgaagcccaggccgagaagtactcacagaaggaggatcgatatgaagaagagatcaaagttctttcagacaagctgaaagaagcagaaacgagggctgagttcgccgaacgatccgtgactaaactggagaagtctattgacgacctggaagatgagctgtatgcccaaaagctgaagtacaaagcgatatccgaggaactggatcacgccctgaatgacatgacctcaatgtag

SEQ ID NO: 139123 - DNA, 855 bp, Artificial Sequence
  Description of Artificial Sequence: Synthetic coding sequence
atggatgctatcaagaagaagatgcagatgctgaaacttgataaggaaaacgcaatagatcgagcggaacaggctgaagccgataagaagcaggcagaggatcgctgtaagcaactggaggaggaacaacaggccctgcagaaaaagttgaagggtaccgaggacgaagtagaaaagtatagcgaaagtgtgaaggaagctcaggaaaaattggagcaggcagagaagaaggccacggacgctgaggcggatgtggccagtctgaaccggcggattcagctggtggaagaggaattagaccgggcccaggagagactcgcaacagccctgcagaagctcgaggaggctgagaaagcagccgatgagtccgagagaggcatgaaggtgattgaaaaccgcgccatgaaggatgaggaaaagatggagctgcaggaaatgcagcttaaggaggccaagcatatcgccgaagacagcgacagaaagtacgaagaggtcgctagaaaacttgtaatcttggaaggcgagctcgagagatccgaagagcgcgctgaggtcgcagagagcaagtgtggagacctcgaagaggagctgaagatcgtgaccaacaatctcaaatctcttgaggcgcaggccgataagtactctacaaaggaagacaagtatgaggaggagatcaaactcctcgaagaaaaactgaaagaggcagagacacgcgcggagttcgccgaaaggagtgtggcaaaactggaaaagacaatcgacgacttggaagagaccctcgcctccgccaaagaagaaaacgtcgagattcatcagaccttagaccaaacattgctggagctgaacaacctgtag

SEQ ID NO: 139124 - DNA, 855 bp, Artificial Sequence
  Description of Artificial Sequence: Synthetic coding sequence
atggacgctattaagaagaaaatgcagatgctgaaactagacaaagaaaacgctatagaccgggcagaacaagctgaagcagataagaagcaggcagaggataggtgcaagcagctggaagaagaacagcaggccctgcaaaagaaacttaaggggaccgaagatgaggtcgagaagtacagcgagtccgtaaaagaggcacaggagaaactagaacaggctgaaaagaaagctaccgatgccgaagccgatgtggctagcctgaataggagaatccagctggtggaagaagaactggatcgagcgcaggaaagactggccaccgccctccagaaacttgaggaggccgagaaggcggcagacgagtcagagcgtgggatgaaggtcattgaaaacagagctatgaaggatgaagaaaaaatggagctgcaggagatgcaacttaaggaagcgaaacatatcgccgaggatagtgaccgtaaatacgaagaagttgctcggaagttggtcattctagagggggagttggagaggtccgaagagagggcggaggttgccgagtctaagtgcggtgatctggaggaggagttgaaaattgtcaccaataacctgaaaagcctggaagcccaagcagataaatacagcactaaagaagacaaatacgaagaagaaattaaactgttggaggaaaaactcaaagaggctgagactcgggcagagttcgccgagagatcagtagccaagctggaaaagacgattgatgacctggaggacgaggtctacgcgcagaagatgaagtacaaggccatcagcgaggaactggataacgctttaaacgacatcacttcactctag

SEQ ID NO: 139125 - DNA, 855 bp, Artificial Sequence
  Description of Artificial Sequence: Synthetic coding sequence
atggacgcaatcaaaaagaagatgcagatgttgaagctggacaaagagaatgcaatcgaccgcgccgaacaggcggaggccgacaagaagcaagcagaggaccgctgcaaacaactagaggaagagcaacaggccctgcagaagaaattaaaggggacggaagatgaggtggagaagtactcagagagcgtgaaggaagctcaggagaaactggagcaggccgagaaaaaagccactgacgctgaagctgatgttgcctctctaaaccggcgaatccagttggtagaagaggagttggatagggcccaggagcgtctggcaaccgcactccagaaattagaggaagctgagaaggctgctgatgagtcagagcgcggtatgaaggtcattgaaaacagggcaatgaaagacgaggaaaagatggaactgcaagaaatgcagctaaaagaggccaagcacattgccgaggattcagataggaagtatgaagaagtcgctcgcaaactggtgatcttggagggcgaattagagcgatccgaagaacgtgccgaagtggccgagagtcgtgctagacagttggaggaagagctccggactatggaccaagcacttaaatctcttatggctagcgaagaagagtattctaccaaagaggataagtacgaagaagagattaaactgcttgaggagaagctcaaggaagctgagacccgcgccgagttcgctgagaggagtgtggcgaaactggagaaaaccattgacgatcttgaggaaacactggcttcagctaaagaagaaaacgttgagatccaccagacattggatcaaacgctgctcgagttgaataatctgtag

SEQ ID NO: 139126 - DNA, 969 bp, Artificial Sequence
  Description of Artificial Sequence: Synthetic coding sequence
atggacgcaatcaaaaagaaaatgcagatgctgaagctggataaagaaaatgccatagatcgggcagaacaagcagaggcggataagaagcaggccgaagaccggtgcaagcagctcgaagaggagcagcaggcgctgcagaagaaactgaaaggaacagaagacgaagtcgaaaaatattctgaatcggtaaaggaagcccaggagaagttagagcaggcagagaaaaaagccactgacgccgaggctgacgtggcctccttgaaccgtcgaattcagttagtcgaagaagaactggatagagcacaggaaagacttgccaccgccctgcagaaactcgaggaggccgaaaaagccgccgacgagtctgagagaggaatgaaagtcattgaaaatagggctatgaaggacgaggaaaaaatggagctgcaggaaatgcagctgaaagaggcaaagcacattgctgaggatagtgacagaaaatatgaggaagttgcccggaagctagttattcttgagggagaacttgaaaggtctgaggagagagctgaggtggctgagtccaaatgcggcgacctagaagaagaattgaaaattgtaaccaataatcttaagtctctcgaagcgcaggcggataaatattccaccaaggaggacaaatacgaagaagagattaagctgctcgaggagaagttaaaagaggctgaaaccagagccgagttcgcagagcgatcagtggctaaactagaaaagaccatcgacgacctggaggagagcacatcaattgccacgactgagcactggtttactcccgatacgctggcactgactgacacacccagcccatgcaccgagcccacccataagactccctggccaacattgaagcccctgtgtacgggcactccctggctgtccctcagcgactcccccctgcatgttggcacatgtggaccgattaagccctag

SEQ ID NO: 139127 - DNA, 858 bp, Artificial Sequence
  Description of Artificial Sequence: Synthetic coding sequence
atgatggaagccatcaaaaagaagatgcagatgttgaagcttgataaggaaaatgcactggacagagcagagcaggccgaagcagaacaaaagcaagccgaagagcgaagcaagcagctcgaggacgaactcgccgcaatgcagaaaaagctaaagggcactgaggacgaactcgacaaatattccgaggccctgaaagatgcgcaggagaagttagaattggccgaaaagaaagccgccgacgcggaggctgaagtggcctccttgaatcgccgcatccaacttgtagaggaagaacttgatagagcacaagagagactggctaccgctctacagaagttagaggaggcagagaaggcagcggatgaatccgagcgcgggatgaaggtgatcgaaaacagagccctcaaggacgaggaaaagatggaactgcaggagatccagttgaaagaagccaaacacatagctgaagaggcagaccgcaagtatgaggaggtggctcggaaattggtgattatagagggtgatctcgagaggactgaggaacgggcagagcttgccgaaagtaggtgtcgagaaatggacgaacaaatccgactcatggatcagaacctcaagtgcctgagtgcggctgaggagaaatactctcaaaaggaggacaagtatgaagaagagattaagatactgactgacaaacttaaagaggccgagactagggctgagtttgccgagagatcagtggccaaactggaaaagaccatcgatgacttagaggataagctgaagtgtacgaaagaggagcacctgtgtactcagagaatgctggatcaaactctgctggatctgaacgaaatgtag

SEQ ID NO: 139128 - DNA, 744 bp, Artificial Sequence
  Description of Artificial Sequence: Synthetic coding sequence
atggcaggaatcaccacaatcgaagccgtgaagaggaagatccaggtgctgcagcaacaggctgacgacgccgaggagcgcgcggagcgtctgcagcgtgaagtcgagggcgaacggcgggcccgcgagcaagctgaggcagaggttgcatctcttaaccgccgcatccagctagtggaagaggagctggatcgcgcacaggaaagattggccaccgccctacagaagctggaagaagcagagaaagccgccgacgagagtgagcgcggaatgaaggtgattgaaaatcgggcccttaaggacgaagaaaaaatggagctccaagaaatccagctgaaggaggccaaacacatagctgaggaggctgatcgcaaatatgaggaggttgcaagaaaactcgtaattatcgaaggggatctcgagagaaccgaagagcgagccgagctggccgagagcaagtgctcggaactcgaagaggagttaaagaacgtcactaacaacctgaaatcgcttgaggcccaggccgaaaaatactcccagaaagaagacaaatatgaggaagagattaaaatcctgaccgacaagttgaaggaggccgagacgcgtgctgaatttgcagaacgcagtgtcgctaagctagaaaagaccattgatgacctggaagagaggctgtatagccaactggagaggaatcgtctcttgtcaaacgaactgaaactgactcttcacgatctttgtgactag

SEQ ID NO: 139129 - DNA, 747 bp, Artificial Sequence
  Description of Artificial Sequence: Synthetic coding sequence
atggccggaatcaccacaatcgaggcagtgaagcgtaagatacaggtcctgcagcagcaggctgatgacgcagaggaacgcgcagagagactccagagagaggtggagggagagagaagggctagggaacaggccgaagcggaggtagctagtcttaaccgccgcatccagctggtggaggaagaactggatagagcacaggaacgtctggcgaccgccctccaaaaactggaggaagctgaaaaggccgctgatgagagcgagcggggaatgaaagtcatcgagaaccgagcccttaaggacgaagagaagatggagctccaggagatccagctgaaggaggccaaacacatagctgaggaggccgaccgcaaatacgaagaagttgcaagaaagttggtcattatcgaaggggatctcgaaagaaccgaggaaagggcagagttggctgaatcacgttgtagagagatggatgagcagatcaggcttatggaccaaaacttaaaatgcctgagtgccgcagaggaaaaatactcccaaaaagaggataaatacgaagaagagatcaagatcctgaccgataagctgaaagaggccgaaactcgtgcagagtttgctgagcggtccgtcgccaagttagaaaagaccattgacgatctagaggatgaattgtatgctcagaagctgaaatataaggctatttcagaagagctggaccacgccctgaatgacatgaccagtatctag

SEQ ID NO: 139130 - DNA, 747 bp, Artificial Sequence
  Description of Artificial Sequence: Synthetic coding sequence
atggccgggatcactacaattgaagccgtcaagaggaaaatacaggtgctgcagcagcaggctgacgacgcggaagagagggccgagcgactgcaacgtgaggtggaaggggagaggagagctagagaacaggctgaggctgaggtggcctccttgaataggcgcatacagttagtagaggaggagctggatcgcgctcaagaacggttggcaaccgccttacagaagctggaggaggcagaaaaagcagcggatgagagcgagcgtgggatgaaagtaattgagaaccgagctctcaaagacgaagaaaagatggaactgcaggaaatacaacttaaagaagccaaacatattgccgaagaggcggatagaaaatatgaggaagttgcccgaaaactggtgatcatcgagggagacctggagcgcaccgaggaaagagccgagctggcggagagcaagtgttctgagctcgaagaggagctcaagaatgtgaccaacaatttaaaaagtctggaggcacaggcagaaaaatactcacagaaggaggacaagtatgaggaagaaatcaagattctgacagacaagctgaaagaggcagaaaccagagctgaatttgctgaaagatcggtcgcaaaactggaaaaaacaattgacgacctggaggacaaactgaagtgcaccaaggaggaacacctctgcacgcagcgcatgctcgaccagacgttgctagacctcaatgagatgtag

SEQ ID NO: 139131 - DNA, 675 bp, Artificial Sequence
  Description of Artificial Sequence: Synthetic coding sequence
atggcaggcattaccaccatagaggctgtgaaaaggaagatacaggttctgcaacaacaggccgacgacgctgaggagagagctgaaagattgcaacgcgaagtggagggcgaacgaagagcgcgcgagcagcgactggccaccgcccttcaaaagttagaggaggctgaaaaggcagctgatgagtctgagcgcggaatgaaggttatagagaaccgggctctgaaggatgaggagaaaatggagctacaggaaatccagttgaaggaggcaaaacatatcgctgaggaagctgacagaaagtacgaggaggtagcacgaaagctcgtcatcattgagggagatctggagagaacagaagaacgcgctgaactggcagagtctcggtgcagggagatggatgagcagatccgacttatggaccaaaaccttaaatgtctttctgccgctgaggaaaaatactcccaaaaagaggataaatatgaggaagagatcaaaatactcactgataagctgaaagaagccgaaaccagggctgagtttgcagaacggtccgtggctaaactggaaaaaactattgacgacttagaggataaacttaaatgcacaaaggaagaacacctttgtacccagagaatgttagaccagaccctgctggacctcaacgagatgtag

SEQ ID NO: 139132 - DNA, 858 bp, Artificial Sequence
  Description of Artificial Sequence: Synthetic coding sequence
atgatggaggctattaaaaagaaaatgcagatgttaaagcttgacaaagaaaacgctttggatagggcagaacaagcggaggccgagcaaaagcaagccgaagagcgttcaaagcagctagaagatgagttagctgccatgcagaaaaagctaaaaggaacagaggacgagctcgataagtatagcgaggcattaaaggatgcacaggaaaagctcgagctggccgaaaaaaaagcggctgacgctgaggctgaagtagcatccctgaacagacggatccaactcgtggaagaagagctcgacagggctcaggaaagactcgctactgcacttcagaagctcgaggaagccgaaaaggctgctgacgaatcagaacgtggaatgaaggttattgagaatcgggctttaaaagatgaagaaaagatggagttgcaggaaatccaactgaaagaagctaagcacatcgccgaggaggccgataggaagtacgaagaggtcgctaggaaacttgtgatcattgaaggagatcttgagaggacagaggaacgtgctgagttagctgaatccaaatgttccgaactggaggaggaactgaaaaacgtcactaataacctgaaaagcctggaggcccaggccgaaaaatactctcaaaaagaggacaagtacgaagaagagatcaaaatcttgactgacaaactcaaggaggcggaaacccgcgccgagtttgcagaaaggtccgtagccaaactcgagaaaaccatcgacgacttggaggacgagctgtacgctcagaagctaaagtacaaagcgatctcggaggaattagaccacgccctcaatgacatgaccagtatctag

SEQ ID NO: 139133 - DNA, 744 bp, Artificial Sequence
  Description of Artificial Sequence: Synthetic coding sequence
atggctggaataaccactattgaagctgtgaaaagaaagattcaggtcctccagcagcaggcagacgatgccgaagaacgcgcagagcgattgcagcgtgaagtggaaggagagaggcgcgcccgcgagcaagcggaagccgaagtcgcttctttaaaccgtagaatccagctcgttgaagaggagctcgatcgagcacaggaaaggctcgccaccgccttacaaaaattagaagaggccgagaaggcagccgacgaaagcgaacgtgggatgaaggttatagaaaacagggcactgaaagacgaggagaagatggaactgcaagaaatccagctgaaagaggctaaacacattgcggaggaggcagatcgcaagtacgaagaggtggcacgaaaacttgtgatcattgagggagacctggagcgcacggaggagagggcagagctggcagagtccagatgcagagagatggacgagcagatccggcttatggatcagaacctgaagtgcttaagcgctgctgaggaaaagtacagccagaaggaagataagtacgaggaggagatcaagatccttactgataagctcaaagaggcggagacccgagccgagttcgctgagagaagcgtggctaagctggagaaaaccattgatgatctcgaggaaagactttatagtcaattggaaagaaaccgtctgctgtctaatgaactcaagttgacactgcacgacctttgcgattag

SEQ ID NO: 139134 - DNA, 747 bp, Artificial Sequence
  Description of Artificial Sequence: Synthetic coding sequence
atggcgggcataacaaccatcgaagcggtcaaaaggaagatacaggtccttcagcagcaggcggacgacgccgaggaaagagctgagaggcttcaacgagaagtcgagggggaaagacgtgcacgcgagcaggctgaagcagaggtagcatccctcaaccggaggattcagctggtggaagaagagcttgatcgagctcaggaaaggctggccaccgcgctgcaaaagcttgaggaggcggagaaggcagctgacgaatcagagaggggtatgaaagtgatcgagaaccgggcactcaaggacgaagagaagatggaacttcaggaaatccagttaaaggaggctaaacatatagccgaggaggcagacaggaaatatgaggaggtcgccagaaagctcgtcattatcgagggcgaccttgagaggaccgaagagcgggcagaactcgccgagtctagatgcagagagatggatgaacagattaggttaatggaccagaatctgaaatgcctatccgcggcggaagagaagtacagccagaaagaggataaatacgaggaggagatcaagattctgaccgacaagctgaaagaggctgagacacgggccgagttcgctgagagatccgttgcaaaattagaaaagacaattgacgatctagaggataagttaaagtgtaccaaagaggaacacctctgcactcagcggatgctggatcaaaccctcctggatctcaatgagatgtag

SEQ ID NO: 139135 - DNA, 228 bp, Artificial Sequence
  Description of Artificial Sequence: Synthetic coding sequence
atgatggaggcaatcaagaaaaagatgcagatgttaaagctcgacaaagagaatgccctggatcgtgcagaacaagctgaggctgagcagaaacaggcggaagagcggtccaagcagttggaagatgagctggccgctatgcaaaagaagcttaaggggactgaagacgagttagataagtactctgaagctttgaaagatgcccaggagaaactcgagttggcttag

SEQ ID NO: 139136 - DNA, 747 bp, Artificial Sequence
  Description of Artificial Sequence: Synthetic coding sequence
atggccggtttaaattctttagaggccgtaaaacggaaaattcaagccctccagcagcaggcagacgaagccgaagatagagcgcagggcctgcaaagggagctggatggggaaagggagaggcgggagaaggccgaaggcgacgtcgctgccctcaaccggcgcatccaacttgtggaggaagagcttgatagggcccaggaacggctggctacggctctgcagaagctcgaagaggctgagaaggccgccgacgagagcgagcgaggaatgaaagtaattgagaatcgggccatgaaggacgaagagaaaatggagattcaggagatgcagctcaaagaagctaaacatatagccgaagaagccgatcgtaagtatgaggaagtggccagaaagctcgtgatcctggagggcgaattggagcgggccgaagagcgagctgaggtcagcgaacttaagtgcggcgacttggaggaggaactgaaaaatgttaccaacaatttgaagtcactcgaggctgcctcggaaaagtactccgagaaagaggataagtacgaggaggaaatcaagctcctatctgataaactgaaagaagctgaaacacgagctgagttcgccgagagaaccgttgccaagcttgagaagacaatcgatgacctggaagagaaactggcgcaggccaaggaagaaaacgtcggactgcaccagacgttagatcagacactgaatgaacttaattgcatatag

SEQ ID NO: 139137 - DNA, 855 bp, Artificial Sequence
  Description of Artificial Sequence: Synthetic coding sequence
atggaagccataaagaagaagatgcagatgttgaagttggataaagagaacgcgatcgatcgggcagagcaagcggaagcagacaaaaaggcagccgaggacaaatgcaagcaggtcgaggaggagttaacacacctccagaagaagttaaagggaactgaggatgaactggacaaatactccgaagatctgaaggatgcgcaggagaaacttgagcttaccgagaaaaaagcatctgacgcggagggcgatgtcgcagccctgaaccgccgcatccagcttgtcgaggaagagcttgatagagcccaagagcggctggctactgcactacaaaaactggaagaggcagagaaggccgcagatgagagcgagcgagggatgaaggtcattgagaatagggctatgaaggacgaggaaaaaatggagattcaggagatgcagcttaaagaggccaaacatattgccgaagaggccgaccgaaaatatgaggaggtggctaggaagctggtgattttggagggcgagttagagagagcagaagagcgtgccgaagttagcgaactcaaatgtggcgatttggaagaagagttgaagaatgtcaccaacaatctcaagagcctggaggctgcctctgagaaatactccgaaaaagaagataagtacgaggaagaaatcaaattgttgtctgataaactgaaggaagccgagacacgcgccgaattcgcagagcggacagtggcaaagctggaaaaaaccatcgatgacctggaggagaaactggctcaggccaaggaagagaatgtaggcttgcaccagactttagatcagacattgaatgagctgaactgtatctag

SEQ ID NO: 139138 - DNA, 855 bp, Artificial Sequence
  Description of Artificial Sequence: Synthetic coding sequence
atggaggccatcaaaaagaagatgcagatgctcaagctggataaagagaacgcaattgatcgggcagagcaagcggaggctgacaagaaggccgccgaggacaaatgtaaacaggtggaggaggagctgacacacctccagaaaaagctgaaaggcaccgaggacgaactggacaagtacagcgaggatcttaaggacgctcaggagaagctcgagctgactgaaaaaaaagcttcagacgcagagggagatgtcgcggctctgaacaggcgcattcagctcgttgaggaagaactcgatcgcgcccaagaacgcctagcaaccgcactccagaaactagaagaggcagagaaagccgccgacgagagcgagcgcgggatgaaggtgattgaaaatagagccatgaaagatgaggagaagatggagatccaagaaatgcagttgaaggaggcaaagcatattgcagaagaggccgatcgaaaatatgaggaagtggctagaaagttggtgatcctagaaggggagctagaaagagctgaggagagggcagaggtcagtgagctgaagtgcggagacctggaggaggaactcaaaaacgttactaacaacttgaaatccttggaggccgcaagcgagaagtattcggagaaggaagataagtacgaagaagaaataaagctgttgagcgataagttaaaggaggctgagactagggccgaatttgcagagcggactgttgcaaagctggaaaagaccattgatgacctggaggagaaactagcccaggccaaagaagaaaacgtggggctgcaccagacccttgatcaaacactgaacgaactcaactgcatctag

SEQ ID NO: 139139 - DNA, 2244 bp, Artificial Sequence
  Description of Artificial Sequence: Synthetic coding sequence
atgggaaggctcaacgaacaacggctgttccagcccgatctgtgcgacgtcgacctggtcctggtaccgcagcgatctgtgtttccagctcacaagggggtgctcgccgcgtattcgcagtttttccactccctgttcacacagaacaagcagctgcaaagggtggagctttccctcgaggcactggcccccggcggcttacagcagatcctgaattttatctacacatccaagctactggtgaatgcagccaacgtgcatgaggtcctttccgcagccagtttacttcagatggccgacattgccgcctcttgtcaggagcttctggacgctaggagcttgggcccacccggcccgggtaccgttgcgctggcccagccagcagcaagttgtaccccggccgcaccaccttattactgcgacataaagcaggaggcggacacgcctggtctgcctaagatttatgccagggagggtccggacccatattccgtacgtgtggaagatggagccgggactgccggaggaacggttcccgctaccattggcccggcccagcctttttttaaggaagagaaggaaggaggtgtagaagaggccggagggccccctgccagtctttgcaagctagagggaggcgaggaattagaagaagaactcggcgggagcggcacctacagcaggagggagcaatcccagatcatcgttgaagtcaatctaaacaaccagaccttgcatgtctccacaggacccgagggaaaacctggcgccggtccctcccctgctactgtggtactgggcagggaggacggcctgcagagacacagcgatgaagaggaggaggacgatgaggaggaagaagaggaagaggaggaagaggaaggcggtggttcaggacgcgaagaggaagaggaggaagagggcggaagccagggcgaagaagaggaggaagaggaagatggccactccgagcaggaagaggaggaggaggaggaagaggaggagggtccatctgagcaggatcaggagtcctctgaagaagaggaaggcgaggagggcgaagcaggcggaaagcagggaccaaggggcagtcgatcttctcgcgccgatccgcctccacatagccatatggcgactcgctccagggaaaacgctaggcggcgagggaccccggaaccagaggaagcaggccgccggggcgggaagcgcccaaaacctcccccgggggtagcttcagcttctgccagaggcccccccgccaccgacggtctgggggccaaagtaaaacttgaagagaaacagcaccatccctgccagaagtgcccaagagtgtttaataacagatggtatctggaaaagcacatgaatgttactcacagccggatgcaaatctgcgaccaatgcgggaaaagattcctcttggaaagtgaattgcttctgcacagacagactgattgcgagcggaacatccagtgcgtcacatgcggtaaggcttttaagaagctgtggagtctgcacgaacataataaaatcgtgcacggatacgccgagaagaagttttcttgtgagatctgcgagaagaaattctacaccatggcccatgtccgcaaacatatggtcgcccataccaaggatatgccatttacttgcgagacctgcggaaagtcttttaaacggtctatgagccttaaggtgcactccctgcaacactctggtgagaagccctttcggtgtgagaattgtaacgagaggttccagtacaaatatcagctacggagccatatgtctatccatattggccacaagcaatttatgtgccaatggtgcgggaaggacttcaacatgaagcaatacttcgatgaacacatgaagacacacaccggtgagaaaccatatatttgtgaaatctgcggcaaaagtttcaccagtaggcctaacatgaagcgccaccgccggacacatacaggcgagaaaccttacccctgtgacgtgtgtggacaaaggtttagattcagcaacatgctcaaagcccacaaagaaaagtgtttccgggtttctcacacccttgctggtgatggggtgcccgcggctcccggacttccaccaactcaacctcaggcccacgctctgccactcctccccggccttccacagaccctcccccctcccccccatctgcctccaccccctcctttgtttcctactaccgccagccccggcggacgcatgaatgcaaacaattag

SEQ ID NO: 139140 - DNA, 483 bp, Artificial Sequence
  Description of Artificial Sequence: Synthetic coding sequence
atgacggaccagcaggctgaagccaggtcttacctatccgaggaaatgatagcagagtttaaggctgcatttgatatgtttgatgccgatggtggaggggacattagtgttaaggagttgggcaccgtaatgcgaatgctgggccagaccccgactaaagaggaactggacgccataatcgaagaggtggacgaagacggcagcggtaccatcgactttgaggaatttctggtgatgatggtacggcagatgaaagaggacgcgaaggggaaaagcgaagaagaactggctgaatgttttagaatattcgatcggaacgccgacggatatatagaccccgaggaattagctgaaattttccgggcttctggtgaacacgtcaccgacgaggagattgagagcctcatgaaggatggcgataaaaataatgatggaaggattgactttgatgaattcttgaagatgatggaaggagtgcagtag

SEQ ID NO: 139141 - DNA, 438 bp, Artificial Sequence
  Description of Artificial Sequence: Synthetic coding sequence
atgatcgccgagtttaaggcagccttcgatatgtttgatgcggatggcggtggcgatatcagtgtcaaagagctgggtactgtcatgaggatgttgggccaaacacctacaaaagaggagctcgatgctatcattgaggaagttgacgaggacggatcaggaaccatcgactttgaggaatttctcgtgatgatggtgagacaaatgaaagaggatgcaaagggtaaaagcgaggaggaactggcggagtgtttcaggattttcgatagaaatgctgatgggtatatcgaccccgaggagctggccgaaattttccgcgcgtctggtgaacacgtgactgatgaagaaattgaatcactcatgaaggatggtgataagaataacgacgggcgcatcgactttgatgaattcctgaagatgatggagggcgtgcagtag

SEQ ID NO: 139142 - DNA, 564 bp, Artificial Sequence
  Description of Artificial Sequence: Synthetic coding sequence
atgcccgaagtggaaagaaagcccaaaatcacagccagcagaaagctcttgctgaaatcattaatgcttgccaaggcaaaagagtgttgggagcaggagcacgaggagcgcgaagccgaaaaggtccggtacctggcagaacggatccccactttgcagacacgcggactaagcctatcggcccttcaggacctgtgtagagagctacatgctaaggtggaggttgtggatgaagagagatacgatatcgaggcgaagtgcttgcataataccagagagataaaagatctaaagctgaaggtgatggacctgcgaggaaagtttaaacggccaccgctgagacgcgtacgcgtatccgctgacgcgatgctaagagctctgctgggctcaaaacacaaggtctccatggatttgcgcgccaatctcaaaagtgttaagaaagaggatacagagaaggaacgccccgtagaagtcggcgactggagaaagaatgttgaagccatgtccggaatggaaggacggaagaagatgttcgacgccgcaaagagtcctaccagccaatag

SEQ ID NO: 139143 - DNA, 564 bp, Artificial Sequence
  Description of Artificial Sequence: Synthetic coding sequence
atgccagaggttcaacggaaacctaagattacggcttcaagaaagctgcttctgaagagcctgatgcttgcaaaggctaaagagtgttgggagcaggagcacgaggaaagggaggcagagaaggtaagatatctcgccgagaggattcccaccttacagacccgtgggttgagtttgtctgccttgcaggatctgtgccgggaactgcacgctaaggtcgaagtggttgacgaagaaaggtacgatatagaggcaaagtgcctccacaacacccgggagattaaggaccttaagctcaaggttatggacctgcgcggtaagtttaaaagaccacccctgagaagagtacgagtatcagccgacgcaatgctgcgcgcccttctgggcagtaagcacaaggttagcatggatcttagagcgaatctgaagtccgttaagaaggaggataccgaaaaggagcgcccagtggaggtgggcgattggaggaaaaacgtggaagccatgtccggaatggaaggcagaaagaaaatgtttgacgcagccaagtctcctacatctcagtag

SEQ ID NO: 139144 - DNA, 564 bp, Artificial Sequence
  Description of Artificial Sequence: Synthetic coding sequence
atgcctgaggtggaacggaagcccaaaattacagccagccggaaactcctcctcaaatctctgatgctggcgaaagctaaggagtgttgggagcaggagcacgaagagcgagaggccgagaaagtgcgctaccttgcagaacggatcccaactctccagacgcggggcctcagcctgagcgccctgcaagatctgtgccgtgagctacacgccaaggtcgaagtggtagatgaggagcggtatgatattgaggccaagtgtctccataatactagagaaatcaaagatcttaaactgaaggtgatggacttgcgcggtaagttcaaaagaccccccctgcgccgggttagggtttctgccgatgcaatgcttagggcactgctggggtccaagcacaaggtgagtatggatctgcgcgcgaacctcaagtcagtgaagaaggaggataccgaaaaagagagaccagtggaagtgggcgactggcgtaagaacgtcgaagcgatgtcgggcatggaaggtagaaaaaagatgtttgacgccgctaaatcaccaactagtcagtag

SEQ ID NO: 139145 - DNA, 564 bp, Artificial Sequence
  Description of Artificial Sequence: Synthetic coding sequence
atgccagaggttgaacggaagcccaaaatcaccgcctctaggaaactcttgctgaaatctctgatgctggccaaggccaaagaatgctgggagcaggagcatgaagaacgtgaagccgagaaagtaaggtatctggccgagcgcattcctaccctccaaaccagggggctcagtctgagcgccctgcaggacctctgccgagagcttcacgccaaggtggaagtggtggatgaggaacggtacgatattgaggccaagtgtttgcacaataccagagaaataaaagacttaaagttaaaggttatggacctgagaggcaagtttaaaagacccccgctgcgtagggtgagggtgtctgccgacgcgatgttgcgcgccctgctcgggtctaaacacaaagtttccatggacctcagggccaacttgaagagcgtcaaaaaagaagacactgaaaaggagaggcctgtggaagtcggcgattggaggaagaatgtcgaggccatgagcggcatggaaggacggaagaagatgtttgacgctgccaagagccccacctcacagtag

SEQ ID NO: 139146 - DNA, 564 bp, Artificial Sequence
  Description of Artificial Sequence: Synthetic coding sequence
atgcccgaggtgcagcggaagccaaagatcacagcctctcgcaaactcctccttaaaagtttgatgctcgccaaagcaaaggagtgttgggaacaggaacatgaagagagagaggctgagaaggttaggtaccttgccgaacgcatacctactctccagactaggggattgtccttgtcagctctccaagatttatgccgcgaactgcacgctaaggtagaagtcgtggacgaagaaagatacgacattgaggccaaatgtttgcataacacacgcgagattaaggacctgaagctcaaagtgatggatctcagaggcaaatttaagcgtccgcccctgcgcagagttcgggtatctgctgatgccatgctgagagctctgctgggctcaaaacataaggtttctatggatctgagagcaaacttgaaatccgttaagaaagaagatacggagaaagaacgacctgtggaagtgggggattggagaaagaatgtggaggctatgagcggaatggaggggcgcaagaaaatgtttgacgcagccaagtcacccacaagccaatag

SEQ ID NO: 139147 - DNA, 414 bp, Artificial Sequence
  Description of Artificial Sequence: Synthetic coding sequence
atgcctgaggtggagagaaagcccaagatcactgcctctagaaagttgctgctcaagtcactgatgctcgccaaagctaaggagtgctgggaacaggaacacgaagaaagagaagcggaaaaagtgaggtatctagctgaacggattcctaccctgcagacacgcggcctgtcgctgagcgctctgcaggacttgtgtcgcgagcttcatgccaaagtggaggtggttgacgaagaaagatatgacattgaggccaagtgcctgcataacaccagggaaatcaaagacctaaagctgaaggtaatggatctccgcgggaaattcaaaaggccaccccttcggcgtgttcgggtgagtgccgatgccatgctccgcgccctcctggggagtaagcacaaagtttcaatggattag

SEQ ID NO: 139148 - DNA, 549 bp, Artificial Sequence
  Description of Artificial Sequence: Synthetic coding sequence
atgtctcagtgcaagaagcgaaaccgggccatcaccgctcgccgccagcatttaaagtcagtgatgctccagatagcagccaccgagctggagaaagaggaatctagaagggaggctgagaaacaaaattatctggctgaacactgtccacctttacatatccctggaagcatgtctgaagtgcaggaactgtgcaagcagctgcacgcaaaaatagacgccgccgaggaggagaagtacgacatggaggttcgggtccagaagacaagcaaagagcttgaagatatgaaccagaagctctttgatctgagagggaagtttaaaaggccacctttgcgtcgcgtacgaatgagtgctgacgccatgctaaaagcacttttggggagtaaacacaaggtatgtatggatctccgcgctaatctgaaacaggtgaagaaagaagacacagaaaaggagcgggacctgcgggacgtgggcgattggcgtaagaatattgaggagaaaagcggaatggagggacgcaagaagatgttcgaaagcgaaagttag

SEQ ID NO: 139149 - DNA, 549 bp, Artificial Sequence
  Description of Artificial Sequence: Synthetic coding sequence
atgggcgatgaagagaaacgcaacagggcgatcacagcacggaggcagcacctgaaatccgtgatgctccagatagcagctacggagctggaaaaggaggagtcccgaagggaagccgagaagcagaattacctcgcagaacattgtccccccctgcacattccagggtctatgtccgaggtgcaggagttgtgtaagcagctgcacgcgaaaatagacgcagccgaggaggagaaatatgacatggaggtgcgtgtgcagaagacctcaaaggaacttgaagacatgaaccaaaagcttttcgatttaagggggaaatttaagcgcccccccctgcgcagagtgagaatgtctgcagacgccatgttgaaagctcttctgggatccaaacataaagtgtgcatggacttgcgcgcaaatttgaagcaggtaaagaaagaggatacagagaaagagcgcgatcttcgcgatgtcggcgactggcggaagaatatagaagagaaaagcggcatggaagggcgcaagaagatgtttgagagtgaaagctag

SEQ ID NO: 139150 - DNA, 549 bp, Artificial Sequence
  Description of Artificial Sequence: Synthetic coding sequence
atgggggatgaggagaaacgcaatagagctatcactgcacgtcggcaacacctcaagtctgtcatgctgcagatagctgccacagagttggagaaggaagagagtaggagagaggctgaaaaacagaattatttggcagaacactgcccccccctgcacatacccggctcaatgagcgaggtgcaggaactatgtaaacagctgcatgcaaaaatcgacgctgccgaggaagagaaatatgatatggaagtgcgagtgcagaagactagcaaggaacttgaagacatgaaccagaaactttttgatcttcgaggtaagtttaaacggcctccattgaggagagtccggatgtctgccgacgctatgttaaaagccctcctcgggtcaaagcacaaggtctgcatggatctaagagcaaacctgaagcaggtcaaaaaggaagataccgagaaagagagggatctgagggacgtgggggattggcgaaagaatattgaggaaaagagcggcatggagggcaggaagaaaatgttcgaaagcgagtcttag

SEQ ID NO: 139151 - DNA, 549 bp, Artificial Sequence
  Description of Artificial Sequence: Synthetic coding sequence
atgggggacgaggaaaagcgcaaccgggccatcaccgcacggcggcagcatctaaagagtgtcatgttgcagatagctgccactgagctcgagaaggaagaatcacgccgggaagctgagaagcagaattacctcgccgagcattgcccgcccttgcatatccctggcagtatgtcggaagtgcaagaactgtgtaagcagttacatgctaagattgacgcagctgaggaggagaagtacgatatggaggttcgagtgcaaaagacctccaaagaattggaagacatgaatcaaaaactattcgatctgagggggaagtttaagcgaccaccacttcgacgagtcaggatgagtgctgacgcaatgttgaaggctcttctcggcagcaaacacaaggtatgcatggatttacgggcaaaccttaagcaagtaaagaaggaggatactgagaaagagagggacctacgggacgtcggggattggaggaaaaatatagaagaaaaaagcggcatggagggaagaaagaaaatgtttgagtcagagtcatag

SEQ ID NO: 139152 - DNA, 633 bp, Artificial Sequence
  Description of Artificial Sequence: Synthetic coding sequence
atggccgatggcagttctgatgcagccagagaacctcgcccagcgccagctcccattaggaggcgctcctccaactatcgtgcctatgctactgagcctcatgcaaagaaaaaatctaaaatcagtgccagccgaaagctgcaactcaagactctattgcttcagatcgctaagcaagagctggagcgcgaagctgaagaaaggagaggcgaaaaggggcgtgctctctcgacacgctgccagccattggagttggcgggcctaggttttgccgaactgcaagatctctgtcgacaactgcatgcacgggttgataaggttgatgaggagcgatacgacatcgaggccaaggtcaccaagaacattacagagatcgccgacctcacccagaaaatatttgaccttcgagggaagttcaaacgcccaaccctgcgcagggtcaggatctctgcagacgcgatgatgcaagcgcttctgggtgctagggccaaggagagcctagacctgcgcgcccatctgaagcaagtgaagaaggaggacacagagaaagagaacagagaagttggggattggagaaagaacatcgacgcccttagcggtatggagggaaggaagaagaagttcgaaagttag

SEQ ID NO: 139153 - DNA, 837 bp, Artificial Sequence
  Description of Artificial Sequence: Synthetic coding sequence
atgtctgacacagaggagcaggagtatgaggaggagcagcccgaggaagaggcagctgaggaggaagaagaggctcctgaggaacccgagccagttgctgagcctgaggaggaacggccgaaaccttcccgacccgtggttcccccattgataccccccaagattcctgagggcgagcgagtcgatttcgacgatatccatcgaaaacggatggaaaaggatttattggagctacagacactgattgatgtgcacttcgagcagcgcaaaaaggaggaagaagaactggtggccctcaaagaaaggatcgagagaaggcgttccgaacgcgctgagcagcagcgtttcaggacagaaaaagagagagagcgtcaagctaagctcgccgaagaaaagatgcgtaaagaagaggaagaggcgaaaaaaagagcagaggacgacgctaaaaagaaaaaggtgctgtctaatatgggagcccacttcggtggatacctggttaaagccgaacagaagcggggcaaacggcaaaccggcagggagatgaaagtgcgtattctcagtgagagaaaaaagccattggacattgattacatgggcgaagaacagctccgcgcaagaagtgcgtggctaccaccatctcaaccatcttgccccgcccgggagaaagctcaggaactctctgactggatccatcagctcgagtccgaaaaatttgacctgatggccaagctcaaacaacagaaatatgaaataaatgtcctgtataaccgcatcagccatgcccagaagtttcgcaagggcgcaggaaagggccgtgtcggggggcgttggaagtag

SEQ ID NO: 139154 - DNA, 837 bp, Artificial Sequence
  Description of Artificial Sequence: Synthetic coding sequence
atgagtgacaccgaggaacaggaatacgaagaagagcaacccgaagaagaagccgccgaagaggaggaggaggcccccgaggaaccggaaccagtggcagagcctgaggaagagagacctaaaccgagtcgccctgtggtgcctccactcatcccgccaaaaatccctgaaggcgaacgcgttgactttgatgatatacatcgcaaacggatggaaaaggacctgctggaactccagactctgatcgacgtgcacttcgagcagcgtaaaaaagaagaagaggagttggtcgccctgaaggaacgtattgagaggcgacgcagtgagcgagccgagcagcaaaggtttcgaaccgaaaaggaacgagaacgccaggctaaacttgcggaagagaagatgaggaaggaggaggaagaagctaagaagcgagccgaggatgatgctaaaaagaaaaaggtgctgtcaaatatgggggctcactttggaggctacctggtcaaggctgaacaaaaaaggggcaagagacaaaccggacgggagatgaaggtgagaattttgagcgagcgtaagaagcccctagacatcgattatatgggagaggaacagttgcgagcgcggtccgcatggctccccccctcccagccttcatgccctgccagagaaaaggctcaggaactaagcgactggatccatcagctggagtcagagaaattcgacttgatggccaagctgaagcagcagaagtatgagataaatgtgctgtacaacaggatctcccacgctcagaagtttcgcaaaggcgcaggaaaggggagagtcggtggtaggtggaagtag

SEQ ID NO: 139155 - DNA, 756 bp, Artificial Sequence
  Description of Artificial Sequence: Synthetic coding sequence
atgtccgacactgaggaacaggagtatgaagaggagcagccagaggaagaagctgcagaggaggaggaagaggaagaggaaaggccgaagccttctcggcccgtggtacctccactgatcccacctaagattcccgaaggcgagcgtgttgatttcgacgacatccatagaaagcgaatggagaaagacctgctcgagttacagaccctcattgacgtgcatttcgaacaacggaagaaggaggaggaagagctggtagccctgaaggaaaggattgaacgccgtcgtagtgagagggccgagcaacagcgcttcagaacagaaaaggaaagggagcggcaggctaaattagccgaagaaaaaatgagaaaggaggaggaagaggcaaagaagagagccgaagacgacgccaagaaaaaaaaagtccttagtaacatgggggcccactttgggggttatctggtgaaagcagaacagaaaaggggaaagcggcaaacaggacgagagatgaaagttaggatactgagcgaaaggaaaaaaccactcgacatcgattacatgggggaggagcaacttagagagaaggcacaggagctgagcgattggatccaccagttagagagtgaaaaatttgatctgatggctaagctgaagcagcagaaatacgagattaatgtgctctacaaccggatcagtcatgcccaaaagtttaggaagggcgcaggcaaaggcagggtggggggcagatggaagtag

SEQ ID NO: 139156 - DNA, 522 bp, Artificial Sequence
  Description of Artificial Sequence: Synthetic coding sequence
agtaaggctcagccgcaggattcccagcacttaaggcactcactggggcgcacgcgcatgagcgacaccgaagagcaggaatatgaagaggaacagcccgaggaagaagccgcagaggaggaagaggagggggaagttcccgactcagccgaagaggagcgccctaaaccaagcaggccggtggtccctccactcatcccgccaaagatcccagaaggggagagagtcgattttgatgacattcacaggaagcgcatggagaaggatctgcttgaactacagaccctgattgatgtgcacttcgagcagcgaaaaaaggaggaggaagaactggtggccctcaaggagcgcatagagcgcagacgatctgagagggctgagcaacagcggtttaggacagaaaaagagcgggagcgtcaggcaaagttggcagaagaaaaaatgaggaaagaggaagaagaagccaaaaaacgggccgaggatgacgccaaaaaaaaaaagaagaagaaaaaaaagaaatag

SEQ ID NO: 139157 - DNA, 756 bp, Artificial Sequence
  Description of Artificial Sequence: Synthetic coding sequence
atgtctgacaccgaagagcaggagtatgaagaggagcaacccgaagaggaagccgccgaagaggaggaagaggcaccagaagaacccgagcccgtgcgtccagttgtgcctcctctgattcccccaaaaatccctgaaggggaaagagtcgatttcgacgatatacacagaaaacggatggaaaaggacctattagagctgcaaactttgatcgacgtacattttgaacagcggaagaaagaagaggaggaattggtggccctgaaggagcggatcgagcgcaggcggagcgagcgcgccgaacagcagaggttcaggactgaaaaggagagagagcgccaggcgaagttggcagaagaaaaaatgaggaaggaagaggaggaggctaagaagcgggcggaagacgacgctaaaaagaagaaggtgctttccaatatgggggcccacttcggtggctacttagtgaaagccgaacagaagagaggcaagcggcagacaggcagggagatgaaggtcaggattctgagcgagcggaagaaacctctcgatatagattatatgggggaagaacagctgagggaaaaagcgcaggaattaagcgactggatccaccagctggagagtgaaaaattcgacctaatggcgaagctgaagcagcaaaagtatgaaatcaatgttctttataatagaatttcacacgcacagaaattcaggaaaggcgcgggcaagggacgagtcggaggccgttggaaatag

SEQ ID NO: 139158 - DNA, 579 bp, Artificial Sequence
  Description of Artificial Sequence: Synthetic coding sequence
atggagaaggacctcttggagctgcagacactgatcgatgttcactttgagcagcgtaagaaggaggaagaagaactggtcgctctgaaagagaggatcgagagaaggagatcggaaagggcagagcaacaacggttccgcacagaaaaggagcgcgagaggcaggcaaagttagccgaagagaaaatgcgaaaggaagaggaagaggcgaaaaagcgtgccgaagatgatgctaagaaaaagaaggtcctgtcaaacatgggggcccatttcggcggatacctggtaaaggccgagcaaaagcgaggtaaacggcagacaggccgggagatgaaggtaaggatactttccgaacgcaagaaacctctggatatcgactacatgggagaggaacagttacgggaaaaggcccaggaactgtccgactggatccatcaactggaaagcgagaaattcgatctgatggctaaattgaagcaacagaaatacgaaatcaatgtcctttacaatcgcatatcacacgcccagaaattccgaaaaggggcaggcaaagggcgagttggcggaaggtggaaatag

SEQ ID NO: 139159 - DNA, 882 bp, Artificial Sequence
  Description of Artificial Sequence: Synthetic coding sequence
atgtcagatatcgaggaagtggtcgaggagtacgaggaagagcaccctgaggaagaggaggactggcgggaagacgaagatgagcaagaagaggccgccgaggaagacgctgaagccgaagcggagactgaggaaacgagggctgaggaagacgaagaggaagaggaagcgaaagaggccgaagacggccctatggaggagtcgaagccgaaaccgcgctcgtttatgcctaatttagtccctcccaaaattcccgacggagaaagagtggactttgatgatatccatcgtaagcggatggagaaagatcttaatgagcttcaggctcttattgaagcccattttgagaaccggaagaaagaagaggaggagcttgtatccttgaaggacagaatagagcggcgcagagcagagcgcgcggagcagcagcgcatccggaatgagcgagaaaaggagcgccagaacaggctggccgaggaacgggctcggcgcgaagaagaggagaaccgcagaaaggccgaagacgaagcaaggaagaaaaaagcgctaagcaacatgatgcattttggcggatatattcagaaacaggcacagacagaaagaaagagcggtaaacgtcagactgagcgtgagaagaagaagaaaatcctcgccgagcgccggaaggtgcttgccatcgatcacctaaatgaggatcagctgcgagagaaggcaaaagagttgtggcaatccatttacaaccttgaagccgaaaagttcgatctgcaggaaaaattcaagcagcagaaatatgagataaacgtcctccgtaatcggattaacgacaaccaaaaggtgagcaaaacacggggaaaagcaaaagtgactggacgctggaaatag

SEQ ID NO: 139160 - DNA, 600 bp, Artificial Sequence
  Description of Artificial Sequence: Synthetic coding sequence
atgagtgatatcgaagaggtggtagaggaatacgaagaggaaatggccgctccgcagcaccaggaggaggcggcagaagaggatgccgaagctgaggctgagaccgaagagacaagggctgaggacgaggaagaggaggaggcgaaggaagcagaagacggtccaatggaagagagtaagccaaaaccgaggtcctttatgccaaatctggttcctcctaagataccagacggggagcgagtagactttgatgatatccataggaagcgcatggaaaaggatctgaatgagctgcaagccctgattgaagcccattttgaaaaccgcaagaaagaggaggaggagttggtgtcactcaaagatagaatagagcgacgtcgcgccgagcgagccgaacagcagcggatacgaaatgagcgcgagaaggaacgacagaatcgcttggccgaggagcgggccaggcgggaagaagaggaaaacaggcggaaggccgaggatgaagcccggaagaagaaggctttgtcaaatatgatgcattttggcggctatatccagaagcatcctcctgatcgcgcagaaaaatgggaggaagctgattag

SEQ ID NO: 139161 - DNA, 852 bp, Artificial Sequence
  Description of Artificial Sequence: Synthetic coding sequence
atgagcgatatagaagaggtcgtagaagaatacgaagaggaggccaaactggagcaagaagaggccgcagaagaggacgcggaggccgaagccgagaccgaggagactcgagccgaagaggacgaagaggaggaagaggccaaggaagctgaggacgggccgatggaggaatctaagcccaaaccccgatctttcatgcccaatctagtgcccccgaaaataccggacggagagagggtggacttcgacgacatacatagaaaacggatggaaaaagacttgaatgagctgcaggctcttatcgaggcccattttgaaaatcggaaaaaggaagaggaagaactcgtctccctgaaggaccgaatcgaaaggaggagagctgagcgcgctgaacagcagcgaattcggaacgaacgcgagaaggagcggcaaaaccggcttgcagaagagagagcccgccgagaggaagaggaaaaccgccggaaggcagaggacgaggcccggaaaaaaaaggcattaagcaatatgatgcactttgggggctacattcagaaacaggcccaaacggaacggaaatctggaaagcggcaaacagagagagaaaagaaaaaaaaaattcttgctgaaaggaggaaggtgcttgctattgaccacttgaatgaagatcagctgcgagagaaagcgaaggaactctggcagagcatatataatctcgaggcagagaagttcgatctccaagaaaaattcaagcagcagaagtacgaaataaatgtgctgagaaaccgtatcaacgataaccagaaagtgtcaaaaaccaggggcaaggccaaagtgacaggccgctggaagtag

SEQ ID NO: 139162 - DNA, 858 bp, Artificial Sequence
  Description of Artificial Sequence: Synthetic coding sequence
atgtcagacattgaggaagtggtcgaggagtatgaagaggaagaacaggaggaggcagccgtggaggagcaggaggaagcagcagaagaagatgccgaggccgaggcggagactgaggagaccagggccgaggaagatgaggaggaggaggaggcaaaggaggcagaggacggccctatggaggaaagcaaacctaagcctcgtagctttatgccaaatctggtgcctcccaaaattcctgacggggaaagggtggactttgacgacattcaccgcaaaagaatggagaaggatctgaatgagctgcaagcgctcattgaagcacactttgaaaaccggaagaaggaggaggaggagctagtgtcactgaaggatcgaatcgaaagacggcgtgctgaacgagccgaacagcagcggattaggaacgagcgagaaaaggagaggcagaatagactggccgaggaaagggcgcgccgagaggaggaagagaatcgcaggaaggccgaggacgaagcccgaaagaagaaagccctttccaacatgatgcatttcggagggtacatacaaaagaccgagcgaaaaagtggaaaacggcagacggagagggagaagaagaaaaaaatcctggcagaaaggagaaaagtgttggctatcgaccacttgaatgaggaccagttgagagagaaggccaaggagctttggcaatctatatacaatcttgaggctgagaaatttgacttacaggagaagtttaaacagcaaaagtacgagatcaacgtgctgcgaaatcggataaacgacaaccagaaggtttcaaagacaagggggaaagcaaaagtgactgggcggtggaagtag

SEQ ID NO: 139163 - DNA, 867 bp, Artificial Sequence
  Description of Artificial Sequence: Synthetic coding sequence
atgagtgatattgaagaggtagtagaggagtacgaagaggaggaacaagaagaggcagcagttgaggagcaggaggaggcagccgaagaggatgcagaggccgaagctgaaactgaagagacaagagccgaagaagatgaagaggaggaagaggccaaagaggccgaggatggtcctatggaagagagcaagcccaagcccaggagctttatgcccaacctcgttcccccaaagattcctgacggagaaagggtggacttcgatgacattcaccggaagcgcatggagaaggacctgaacgaactgcaggcactgatagaggcgcactttgagaaccggaaaaaagaggaggaagaacttgtgtccctgaaagaccggatcgagcgacggcgagccgaaagggccgaacagcagagaatcaggaatgaacgagagaaggagcgccagaaccgtttggcggaggaacgggcaagaagggaggaggaagaaaatcgtcggaaggctgaagatgaggcccgaaaaaaaaaggcgctgagcaatatgatgcactttggcggctacatccagaaacaggcccagactgagaggaagagcgggaaacggcaaaccgagagagagaagaaaaagaagattttagctgagaggagaaaggtgctcgcaatcgatcacttgaacgaggaccagctccgtgaaaaagccaaggagctgtggcagtcaatttataatctcgaagcagaaaagttcgatctgcaggaaaagtttaaacagcaaaagtacgaaattaacgttttgcgtaatagaatcaacgataaccagaaagtgtctaaaacgagaggcaaagccaaagtaactgggcgctggaagtag

SEQ ID NO: 139164 - DNA, 867 bp, Artificial Sequence
  Description of Artificial Sequence: Synthetic coding sequence
atgagtgacatcgaagaggtggtcgaggagtacgaggaagaggaacaggaggaagccgcggtggaggaacaggaggaggcagcagaagaggacgccgaggcggaggcagaaacagaagaaacgcgcgctgaggaagacgaggaagaggaggaagccaaagaggcagaagacggtccaatggaagagtcaaaacccaaacctaggtcgtttatgccaaaccttgtccccccaaaaatccctgatggcgagcgcgtcgacttcgatgatattcataggaaacgcatggagaaggacctgaatgaattacaggccctgattgaggcgcacttcgaaaatcggaaaaaggaagaagaggagctggtatctctcaaggaccggattgagagaaggcgcgccgaacgggctgagcagcagagaatacggaacgaacgcgaaaaagaacgccaaaatcggctggccgaggaacgagccaggcgcgaggaagaagagaacaggcgcaaggcagaagatgaggccagaaaaaagaaggccctctctaatatgatgcatttcggaggatatatccagaaacaggcacagaccgagaggaagtctgggaaacgccagacagagagagagaagaaaaaaaagattcttgctgagcggaggaaggtgcttgcgatcgatcacttaaacgaagaccagttaagggagaaagcaaaagaactgtggcagtccatttataaccttgaagcagagaaattcgatctacaagagaagttcaaacaacaaaaatatgagatcaatgttttaagaaatcgcatcaatgacaatcagaaggtgagtaagactcggggcaaagccaaggtgacgggcaggtggaagtag

SEQ ID NO: 139165 - DNA, 681 bp, Artificial Sequence
  Description of Artificial Sequence: Synthetic coding sequence
atggaggagagtaaaccaaagccgcggagcttcatgcccaacctggtgccccctaaaatacccgacggcgagcgggtggacttcgacgatatccatagaaaaaggatggagaaagatctgaatgagctccaggccctcattgaggcccatttcgaaaacaggaagaaagaggaggaggagctggtctccctgaaagaccggatcgagcgtcgccgcgctgagagagccgagcagcaacgcatccgaaacgaaagggaaaaggaaagacaaaataggttagctgaagaacgcgctcgccgcgaagaggaggaaaataggagaaaggccgaggacgaagcgaggaaaaaaaaagccctgtccaacatgatgcattttgggggatacattcagaaaaccgagcggaagagcggcaagcgccagaccgagcgggaaaaaaagaaaaaaattttggccgaacgtcgcaaggtgctggctatcgatcacctgaatgaagaccagcttcgggaaaaggcgaaagagctctggcagtctatctataaccttgaagcagagaaattcgacctccaggaaaagtttaaacagcagaagtacgagattaatgtgctgcggaaccggattaacgataaccagaaggtctccaagacccggggtaaggcaaaagtgacaggacgctggaagtag

SEQ ID NO: 139166 - DNA, 858 bp, Artificial Sequence
  Description of Artificial Sequence: Synthetic coding sequence
atgagcgacatcgaggaggtggtggaagagtatgaagaggaggagcaggaagaggccgcagttgaagaacaagaagaagctgcagaggaagatgccgaggcagaagccgagaccgaagaaacgcgtgccgaagaggacgaggaagaagaggaggctaaggaggccgaggatggcccaatggaggagtctaagcctaaacctcggagcttcatgccaaatttagttcccccaaagatccccgacggcgaacgtgtcgactttgatgatatccacaggaagcgtatggagaaggacctgaacgagctacaggcgctcatagaagcccattttgagaaccggaagaaggaagaggaggagctcgtttcacttaaggaccggatcgagcggcggcgcgcagagagagctgagcaacaacggatcagaaatgaacgtgaaaaggagcggcaaaatagactcgccgaggagcgcgccagaagagaagaagaagaaaataggcgcaaagctgaggatgaggccagaaagaaaaaggctctgtccaacatgatgcacttcggcggttacattcagaagaccgaaagaaaatcaggcaagagacagactgagagagaaaagaagaaaaagatactggccgagcgtcggaaggtactcgccatagatcatttgaacgaagaccagttaagggagaaggctaaagagctctggcagagtatttataatttagaggctgagaagttcgacctgcaggaaaagttcaagcagcaaaagtacgaaatcaacgtgctccggaatagaatcaatgacaatcagaaggtgtccaaaaccagaggcaaagccaaagtaacaggcaggtggaaatag

SEQ ID NO: 139167 - DNA, 876 bp, Artificial Sequence
  Description of Artificial Sequence: Synthetic coding sequence
atgagtgatatcgaggaggtggtcgaggaatacgaggaggaatacctggaacacgcagaggcagccgttgaggaacaggaggaggcagcggaggaagacgccgaggccgaggcagagaccgaggagactagggcggaggaagacgaggaagaggaagaagcaaaggaagctgaggatgggcccatggaggagtcgaagcctaagccgaggagcttcatgccaaaccttgtgcctcccaagatacccgacggggaacgagttgattttgacgacatacacaggaagaggatggagaaggacctcaatgagctgcaggccctcatcgaggcccatttcgagaatcgaaaaaaggaggaggaggaacttgtgagcctgaaggaccgcatcgagaggcgccgcgccgaacgggctgagcagcaaagaataaggaacgagcgggaaaaggaaaggcagaacaggttagcagaagagcgtgcgagaagagaggaggaggaaaatagacgcaaagcagaagacgaggcacggaaaaaaaaggcccttagtaacatgatgcattttggcggatatattcaaaaacacaccctgcagactgagcgaaagtctggtaagcgccaaacagaacgggagaaaaagaaaaaaatccttgccgaaaggagaaaagtgctggccatcgatcatctgaacgaagatcagctcagggaaaaagcgaaagagctctggcagtctatttacaatttggaagcagaaaaattcgatttgcaggagaagtttaaacaacagaagtacgaaattaacgtccttaggaatcggatcaacgataaccaaaaggtcagcaaaactcggggaaaagctaaggtgacgggccggtggaagtag

SEQ ID NO: 139168 - DNA, 894 bp, Artificial Sequence
  Description of Artificial Sequence: Synthetic coding sequence
atgagtgatatagaagaagtggtagaggaatatgaagaagagtacttggaacatgctgaggctgccgtggaagaggaggaggactggagagaagacgaggacgaacaggaggaagctgcggaagaggacgccgaagccgaagccgagactgaagagacccgagccgaggaggatgaggaggaagaggaagcgaaggaagctgaagacggaccaatggaagagagtaagccaaagccccgttcttttatgcccaatcttgtccctccaaaaatcccggacggagagcgcgttgactttgatgatatccatcgtaaacgaatggaaaaagatctgaacgaactccaggccctgatcgaggctcatttcgagaataggaagaaagaggaggaggaacttgtgagcctgaaggataggattgaacggcggagggccgagcgcgccgagcagcaaagaatccgcaatgaaagagaaaaggagcgacaaaacagactggctgaagaacgagcgaggagggaagaggaagagaaccgacgcaaggcggaggacgaagcacggaaaaagaaagctctgtctaatatgatgcactttgggggttatatccagaagactgagcgaaaatcgggaaagagacagactgagcgcgagaagaagaaaaagattctggctgagagaagaaaggtactcgccattgaccatttgaatgaagaccagctccgtgaaaaagctaaggaactatggcaatctatttataatttagaggccgagaagtttgatcttcaggaaaaattcaaacagcagaagtatgaaatcaatgtgcttcggaatagaattaatgataaccagaaagtcagcaaaaccagaggcaaggcgaaagtgaccgggaggtggaagtag

SEQ ID NO: 139169 - DNA, 867 bp, Artificial Sequence
  Description of Artificial Sequence: Synthetic coding sequence
atgagcgacatagaggaggtggtggaagagtatgaagaggaggagcaggaagaggctgctgtggaagaacaggaagaggcggccgaagaggatgccgaggccgaagccgagacagaagagaccagagctgaggaggacgaggaagaggaggaagcgaaagaagccgaggacggaccaatggaggaaagtaagcccaagcccagatcctttatgcctaatcttgttccccctaagatacccgacggcgagagagtggattttgatgacatccaccggaaaagaatggagaaagatctgaatgaattacaagccctgatcgaggctcactttgagaatagaaagaaggaagaggaggagctagtctcacttaaggatcgtatagaaaggagacgcgcagagcgggcggaacagcaacgaatccgcaatgaacgtgagaaggaaaggcagaacagattggccgaggagagggcacgccgggaggaggaggagaatcgacgcaaggcggaagacgaggcccgaaagaagaaagctctcagcaacatgatgcactttggagggtacattcagaaacaggcacagactgagagaaaatctggcaagcggcaaaccgagagggaaaaaaagaagaaaatcctggcggagcgacggaaggtgctggccattgaccatttgaatgaggatcagctaagggagaaagctaaggaattatggcaaagcatatacaacttggaggccgaaaagtttgaccttcaagaaaagtttaaacagcagaaatatgaaatcaatgtcctcagaaaccgcatcaacgacaatcagaaagtatccaagacaagaggcaaggctaaggttaccggccggtggaaatag

SEQ ID NO: 139170 - DNA, 771 bp, Artificial Sequence
  Description of Artificial Sequence: Synthetic coding sequence
atgagcgacgaggaggtggaacaggttgaggagcagtacgaagaggaagaggaggctcaagaagaggcagcggaggtgcatgaagaggtgcatgagccagaggagaaaccacgacccaagcttactgcacccaagatcccagagggcgagaaggtggacttcgacgatatccagaagaaaagacagaataaagatctcatggagttgcaagctctcatagacagtcactttgaagccagaaagaaagaggaagaggaactggtggctttaaaggagaggatcgagaaaagacgcgcggaacgggcagagcagcagagaatccgggccgagaaggagagggagaggcagaaccgcctggccgaagagaaggcacggagggaggaggaggacgctaagcgaagagccgaggatgacttgaaaaagaagaaagccttaagttccatgggtgccaactactccagctatcttgccaaggccgaccaaaaacgcggcaagaagcaaactgcacgcgagatgaaaaaaaagattcttgctgagcggcgaaagcccttgaacattgaccatcttggggaggataagctgcgggataaggcaaaagagttgtgggagacactgcaccagctcgagattgacaagttcgaatttggcgagaagctcaaaagacagaaatacgacatcaccaccctgcgctcaaggatcgatcaagctcagaaacactcgaagaaagccggcactccggctaaaggtaaggtaggtggcaggtggaaatag

SEQ ID NO: 139171 - DNA, 777 bp, Artificial Sequence
  Description of Artificial Sequence: Synthetic coding sequence
atgagtgacgaagaagtcgagcaagtggaggagcaatacgaggaggaggaggaggcacaggaggaagaggaagtccaagaagacaccgcggaggaggatgcagaggaagagaagccccggcctaagctgacagctccaaagataccagaaggtgagaaggtggactttgatgacatccagaagaagcgtcagaacaaggatctcatggaactccaagccctgattgacagtcacttcgaggcccgtaagaaggaggaggaggaattggtggccctgaaggagaggatcgagaaaaggagggcagagagagccgaacagcagcgaattcgtgccgagaaagaacgagagcgtcaaaaccgcttggcggaagagaaggccaggagagaggaggaggacgccaagcgaagagccgaagacgacttgaaaaaaaaaaaggctctctcatcgatgggggctaattattcctcatatctggccaaggctgaccagaagaggggcaaaaagcagaccgctagggaaatgaagaagaagatcctagcagagcgccggaagccactcaacatcgatcacctaggcgaggacaaactgagggataaggctaaagagctgtgggaaactctgcaccaactggagatcgacaagtttgagttcggagaaaaactaaaacgtcagaaatacgacatcacgacccttcgcagccggatagaccaggctcagaaacactcgaaaaaggccggaacgccggctaagggcaaggtgggcggacggtggaagtag

SEQ ID NO: 139172 - DNA, 738 bp, Artificial Sequence
  Description of Artificial Sequence: Synthetic coding sequence
atgagtgatgaggaagtggaacaggttgaagagcaatatgaagaagaggaggaagcacaagaggaggaggaaaagccgcggcctaagttgacagcacctaaaatccctgagggcgaaaaggtcgacttcgacgatatccaaaagaagagacagaacaaagatctcatggagttgcaagcgcttatcgattcccatttcgaagctcgcaagaaagaagaagaggagttggtggccctgaaggaacggattgagaaaaggcgagctgagcgggcagagcagcaaagaataagagccgaaaaggaacgggaacgacagaatcggctggctgaagaaaaagcgcgtagggaagaggaggatgctaagagaagggctgaggacgacctgaagaaaaaaaaagcgctgagcagcatgggcgccaactatagctcatacttagccaaggctgatcagaaaagaggcaagaagcaaacagccagggagatgaaaaaaaagattctggcagagcggaggaaacctctgaacatcgaccacttaggcgaagacaagctgagagacaaggccaaagagttgtgggaaaccctgcatcagcttgaaatagataagttcgagttcggcgagaagctgaagagacagaagtatgacattaccaccctcagatctcggatcgaccaggcccagaagcacagtaaaaaagccggcactcccgcaaagggaaaggtgggaggccggtggaaatag

SEQ ID NO: 139173 - DNA, 759 bp, Artificial Sequence
  Description of Artificial Sequence: Synthetic coding sequence
atgtccgatgaggaggtcgagcaagttgaggaacagtacgaggaagaggaggaggcccaggaggaggctgcggaggtgcatgaggaggaagagaaacctagacccaagctgacggcgcctaaaattccagaaggcgaaaaggtggactttgacgatattcagaagaaacgccaaaataaggacctcatggagctgcaggccctgatcgattcccactttgaagctcggaaaaaagaagaagaggagctcgtggcgctcaaggagaggatcgaaaagagaagggcagaacgggcggagcagcagcgaattcgcgcagaaaaggaaagagagcggcagaaccgcctcgccgaggaaaaggctcgtcgggaagaggaggacgcaaagaggagagccgaggatgacctcaaaaagaaaaaagccctcagctctatgggggctaactattcctcttacctggccaaggctgaccagaagcgcggaaagaagcagaccgctagggagatgaagaaaaaaatcctagccgagagacggaagccattgaacattgatcacctcggtgaagacaagctgagagataaggcgaaagagctgtgggaaacactccatcagctggagattgataaatttgagttcggtgagaaactgaaacgccagaagtacgatattatgaacgtcagagcacgggtgcaaatgctggctaaattctccaaaaaagcgggcacacccgctaagggaaaagtcggcggacgctggaagtag

SEQ ID NO: 139174 - DNA, 783 bp, Artificial Sequence
  Description of Artificial Sequence: Synthetic coding sequence
atgtccgacgaagaggtcgagcaggtagaggagcagtacgaagaggaagaggaagcgcaagaggaggccgccgaagtgcacgaggaggacacggctgaagaagatgccgaggaggagaagccccgaccaaagctcacagccccaaagatccctgaaggggagaaggtcgatttcgacgatatccagaagaaaaggcaaaataaggatctgatggagctgcaggcattaattgatagccacttcgaagctcgaaaaaaggaagaagaggaactggtggccctgaaggagcgaatcgagaagcggagggccgagagagctgaacagcagcggatcagagctgaaaaggagagggagcgccagaatagactcgccgaagagaaagcacgtcgagaggaggaagacgcaaagagacgcgcagaggacgacctgaaaaagaaaaaggcactctcttccatgggcgctaactactcttcctatcttgccaaggccgatcagaagcggggcaaaaagcaaaccgcacgcgaaatgaagaaaaaaatcttagcagaacggcgaaaacctctgaatattgaccacttaggggaagacaaactgagggacaaggcaaaggaattgtgggaaactctgcaccaactggaaatcgacaagttcgagttcggggagaaacttaagcgtcagaagtacgacattaccactctcagaagccgaatcgatcaggctcaaaaacactcaaaaaaagctgggacacctgctaaagggaaagtaggggggcggtggaaatag

SEQ ID NO: 139175 - DNA, 753 bp, Artificial Sequence
  Description of Artificial Sequence: Synthetic coding sequence
atgtcagacgaggaagtagagcaggttgaagaacagtatgaggaggaggaagaggctcaggaggaggaggaagtgcaagaggaggagaagccccggccaaaactcactgcgccaaagatccccgaaggagagaaagtggacttcgacgatatccaaaagaagcgacagaataaagacctgatggagctacaggccctaatcgactcacatttcgaggcacggaaaaaagaggaagaggagctagtagcacttaaagaacggatagaaaagcgaagagccgagcgagccgaacagcagagaataagggccgagaaggaacgtgagaggcaaaaccgcctggccgaagagaaggctaggagagaggaagaggacgctaagagaagggcagaagacgacctgaagaaaaaaaaggctctgtcttccatgggcgccaactattctagttatctcgccaaggctgaccagaaaagaggtaagaaacagacggctagagaaatgaaaaaaaagattctggccgaaagacgcaaaccactcaacatcgaccacctgggcgaagacaaactaagggacaaagcgaaggagctgtgggaaactcttcaccagctggagattgataagtttgaattcggtgagaagctgaagagacagaagtatgacatcaccacactccgctcacggatagatcaggcacagaagcattccaagaaggcggggactcccgccaagggtaaagtaggcggcagatggaagtag

SEQ ID NO: 139176 - DNA, 786 bp, Artificial Sequence
  Description of Artificial Sequence: Synthetic coding sequence
atgtctgatgaagaagtagaacaggttgaagaacagtacgaagaagaagaggaggcccaggaggaagcggcagaagtccatgaggagggtatgcggacgcaagacttttttcatgaagagaaaccccgccccaaattgactgctccaaagatccctgagggagagaaagttgacttcgacgacattcagaaaaagcgacagaacaaagatttgatggagttgcaggcccttatcgatagtcacttcgaggcaagaaagaaggaggaggaggaattggtcgctctgaaagagcgaattgaaaagagacgcgcggaaagggcagagcagcaaagaatccgggctgagaaggaacgggagcggcagaatcggctagcagaggagaaagcacgccgcgaagaggaggacgcaaagaggcgggccgaagacgatttgaagaagaagaaggctttgtcatccatgggcgcaaactacagctcttaccttgccaaggcggaccaaaaaagagggaaaaaacaaacagccagggagatgaaaaaaaaaatccttgcagagcgccggaaaccactgaacatcgaccatctgggagaggataaactgcgggataaagctaaggagctctgggagaccctgcaccagttagagattgataagtttgaatttggagaaaaactgaaacgccagaagtatgatatcaccacgttgaggtcccgcattgaccaggcccagaaacattccaaaaaagctggaacacccgcaaaaggcaaggttggcgggcgttggaaatag

SEQ ID NO: 139177 - DNA, 786 bp, Artificial Sequence
  Description of Artificial Sequence: Synthetic coding sequence
atgagtgacgaagaggtggaacaagtggaggaacagtatgaggaagaggaggaggcccaggaggaggctgctgaggtccatgaggaagtgcacgaacctgaagaggttcaagaagaagagaagcctcgaccgaaacttacagccccaaaaattcccgagggcgaaaaagtggacttcgatgacatccagaaaaagaggcaaaacaaggacctgatggaactgcaggcgctgatcgacagccacttcgaagcccgtaagaaggaggaggaggagctggtggccctgaaagagagaattgaaaagaggagggccgagcgtgctgaacagcaacgcattagggcagagaaggagcgcgaacggcaaaatcgcttggcagaggagaaggccaggcgagaggaggaggatgcaaagcggcgggccgaggatgaccttaaaaagaaaaaagctctgtcatccatgggcgctaactattctagttacctggcaaaagctgatcagaagaggggtaaaaagcagactgcccgtgaaatgaagaagaaaatccttgctgagaggcgcaaaccattgaatatagatcacctgggagaagacaaacttcgggataaagctaaggagctctgggagactttacatcaacttgagatcgacaagttcgagtttggtgaaaaactgaagagacagaagtacgacattactacattgaggagccggatcgaccaggcacagaagcatagcaagaaagctggaacacctgccaagggcaaggtggggggacgatggaagtag

SEQ ID NO: 139178 - DNA, 753 bp, Artificial Sequence
  Description of Artificial Sequence: Synthetic coding sequence
atgagtgacgaggaagtggaacaggtcgaagagcagtatgaggaggaggaggaagcgcaagaagaagaagaagtgcaagaggaggagaagcctaggcctaagttaacggctccaaagatcccagagggggagaaagtggactttgacgatatccaaaagaagcgccaaaataaagacctgatggagcttcaggccctaatcgatagccacttcgaagcacgtaaaaaggaggaggaggaacttgtagctctcaaagaacgcatagaaaagaggcgtgccgaaagagcggaacaacaacggatccgagccgaaaaggagcgcgaacggcagaatcggttagcagaggagaaagctcgacgcgaagaagaggatgctaagcgacgcgccgaggacgacctgaagaagaagaaagcactctcatctatgggcgccaactacagctcctatttagctaaagccgatcaaaaacggggcaaaaagcagaccgcacgggaaatgaagaagaaaatactggccgaaagacgcaaacctctaaatattgatcacctgggcgaagacaaattgcgagacaaggctaaggaattgtgggaaaccctgcatcagctggaaattgacaaattcgagttcggtgagaaattgaaacgacagaagtacgatataatgaacgtgagagcacgggtacagatgttagccaaattttctaagaaggcaggtactcccgcaaaggggaaggttggcggcagatggaagtag

SEQ ID NO: 139179 - DNA, 810 bp, Artificial Sequence
  Description of Artificial Sequence: Synthetic coding sequence
atgagcgatgaagaggtagaacaggtcgaagaacagtatgaggaagaagaagaggcccaagaggaggcagccgaggttcatgaagaggttcacgaacctgaagaagtgcaggaggataccgcagaggaagatgctgaggaagaaaaacctcgccccaagttgacagcaccaaagattccagagggagaaaaggtggacttcgatgacatccaaaagaaacgacaaaataaggaccttatggagctccaggcgttaatagacagtcattttgaagcacgaaaaaaagaagaagaggagctcgtcgccctgaaagagcgcattgagaaacgaagagcagaaagggccgagcagcagcggatccgcgccgaaaaagagcgcgaacggcaaaaccgcctcgccgaagagaaagcgaggcgagaagaagaggacgccaagagacgggctgaggacgacctgaagaaaaagaaagcactttccagcatgggagcaaattacagtagttacctggccaaagccgaccagaagcggggaaagaagcaaaccgctcgtgagatgaaaaagaagatactcgctgagagacggaaacctttgaacattgaccaccttggcgaagacaaactgcgggacaaggctaaggaactttgggagacgctgcaccagctggagatcgacaagttcgagttcggcgagaagcttaaacggcagaagtacgacatcacaacgcttagatccagaatagaccaggctcagaagcattcgaaaaaggctggaacacccgcgaaaggaaaagtaggagggcggtggaaatag

SEQ ID NO: 139180 - DNA, 813 bp, Artificial Sequence
  Description of Artificial Sequence: Synthetic coding sequence
atgtcagacgaggaggtggaacaagtggaggaacaatacgaggaggaggaggaagcccaagaagaggcggctgaggtgcacgaggaggcgcacccgggagaagaaagcgttcgcgaagacacggccgaagaggacgcagaagaggaaaagccacgacctaagctgacagcccctaagataccggagggcgaaaaagtggactttgacgatattcagaagaaacgccaaaacaaagacctcatggagctccaggctcttattgattctcacttcgaagctcgaaagaaagaagaggaagagcttgttgccctgaaggagaggatcgaaaaacgtcgagctgagcgagccgagcaacaacgcattcgcgccgaaaaggaaagggagagacaaaacagattggcggaggagaaagcacgccgtgaggaggaagatgccaagagaagagccgaagacgatttgaaaaagaagaaggctcttagctcaatgggggccaactattcttcttatctggctaaggctgatcaaaagcgaggcaaaaaacagacagccagagagatgaagaagaagattctggcagaacgcaggaagccacttaacattgaccaccttggtgaagataagctgcgcgacaaagcgaaagagctgtgggagacattacaccagctggagatcgataagttcgagttcggcgaaaaactgaagcgccagaaatatgacataacgactctgagatcccgtatagatcaagcccagaaacattcaaagaaagctgggacacccgcaaagggcaaagtgggcggcaggtggaagtag

SEQ ID NO: 139181 - DNA, 435 bp, Artificial Sequence
  Description of Artificial Sequence: Synthetic coding sequence
atgtcagatgaggaggtcgaacaggtcgaagagcaatacgaagaagaggaagaagctcaagaggaagccgcagaagttcatgaagaggagcgtagggctgaggacgaccttaagaaaaaaaaagcccttagctccatgggggccaactattcctcatacctcgccaaagctgaccaaaagcgcggcaaaaagcagaccgcccgtgagatgaaaaagaaaatccttgctgagagacggaaaccactgaatatcgaccacctgggagaggacaaattgagggacaaagccaaggaactgtgggagcctccccagtcatgtcagggactgcccgattctccgggaggaggagaagcaatcccaggacgcccaccccgcctttgtccctgctgtttacaccctctcggtccagtcaacaaggctgccgaacctccttag

SEQ ID NO: 139182 - DNA, 1617 bp, Artificial Sequence
  Description of Artificial Sequence: Synthetic coding sequence
atggaagagagtgtaaaccagatgcagcccctgaatgagaagcaaatcgccaattcccaggacggctacgtttggcaggttacagatatgaatagactccaccgatttttatgttttgggagtgaaggggggacctattacatcaaagaacagaagcttggcctggaaaacgctgaagccctcatccggctgatcgaagacggccgaggttgcgaggtgatccaggaaataaagtcattttcccaggaaggccgtaccactaagcaggaacccatgctattcgccctcgccatctgcagccagtgttctgacatttccacaaagcaggccgcttttaaggccgttagtgaggtatgtcgaatcccaacccacctgttcacttttatccaatttaaaaaggacctcaaagaaagtatgaagtgtgggatgtggggacgtgccctgagaaaagctatagccgattggtacaacgaaaagggcggcatggcacttgcactggctgtaaccaagtacaagcagcgtaacggatggagtcacaaagatctcctgagactaagtcatctgaaaccctcgagcgaaggactggctatagtgacaaaatacattaccaaaggctggaaagaagtgcacgaactctacaaggaaaaagctctgtccgttgagacagagaaattactcaagtatcttgaggcagtcgaaaaggttaaaaggacacgagatgagctggaagtgattcatttaatcgaggaacatcgcttggtaagagaacacttgcttaccaatcatctgaaaagcaaagaggtttggaaagctctgctacaggaaatgccactgactgctctattgcgcaatttgggaaagatgacagccaatagtgtactcgagcctggcaactctgaagtctccctggtctgcgagaagctctgcaatgaaaagctgcttaagaaggcgcggattcatccatttcatattctgatcgctcttgagacttacaaaaccggacatggactgagagggaaactaaaatggcgtcccgacgaggagattctgaaagcccttgatgctgctttctataagacattcaaaactgtggagcccaccggtaaaaggttcttactggctgtggatgtttccgcttcaatgaaccagagggtgctaggcagcatacttaatgcctcgaccgttgcagccgccatgtgtatggtggtgacacgtacagagaaagatagctatgttgtcgcattttccgacgagatggtcccctgtcctgtcactacggatatgacgcttcagcaggtcctgatggctatgagtcaaatcccggccggcgggacggattgctctctgcccatgatttgggctcagaagaccaatactcctgctgacgtcttcatcgtatttaccgacaacgaaaccttcgcaggtggagtgcatccggcaattgctctacgagaataccggaagaagatggacatcccggccaaattaattgtgtgtgggatgacctcgaatggcttcaccatagctgaccccgatgatcgtggcatgctggacatgtgcgggtttgatacgggggcccttgatgtgatcaggaatttcactctggacatgatctag

SEQ ID NO: 139183 - DNA, 1557 bp, Artificial Sequence
  Description of Artificial Sequence: Synthetic coding sequence
atggaagaatccgtgaatcaaatgcagccacttaacgaaaaacagattgccaattcccaggatggctacgtgtggcaggttaccgatatgaatcgcctgcatagatttctgtgctttgggtcagagggtggcacatactacatcaaagaacagaagcttggactggaaaacgcagaggccttgatcaggcttattgaggacggaagaggatgcgaggtgatccaggagattaagagtttctctcaggagggtcgcactacaaagcaagaacctatgctcttcgcactggctatctgcagccagtgttctgacatttcgacaaagcaggccgctttcaaggccgtgtccgaggtctgcagaattcctactcatctttttacatttattcagttcaagaaggatctgaaggagtccatgaaatgcgggatgtggggacgcgccctgcgcaaggccatagccgattggtacaatgaaaaaggtggcatggcgctggctctcgcagttacgaagtataagcagcgcaatggctggtcccataaagaccttctgcgactcagtcacttgaaaccatcaagcgaaggattggctatcgtgacaaaatatatcacaaaggggtggaaagaagttcacgagctttacaaggaaaaggcgctgtccgtcgaaaccgagaaactgctgaaatatctggaagcggtggagaaggttaagcgcacgagagacgagctggaggtgattcacctcattgaggaacatagactggtaagagaacatctgttgaccaatcatctgaagtcgaaggaggtttggaaggccctgttgcaggagatgccactgacagctctgttgcgaaacctagggaagatgactgctaattccgtgcttgagccaggcaacagtgaggtgtctctggtctgcgaaaagctgtgcaacgagaagctgctgaagaaggctaggattcatccctttcacatattaatcgccctggaaacctacaagactggacatgggctcaggggtaagctcaagtggagacccgacgaggagattctaaaggctctcgacgccgccttctataaaacatttaaaaccgttgagccaacgggcaagcgctttctgctggccgttgatgtgtctgcctctatgaatcagagggtcttagggtccattctgaacgcgtccaccgtcgcagcagccatgtgtatggtggtaactcgaactgagaaggattcctacgtggtagccttttcagacgagatggtcccctgccccgtgacaacagacatgaccctacaacaagttctgatggcaatgagccagatcccggctggggggacagactgctcgctgcccatgatatgggctcaaaagacaaacaccccagctgacgtgttcatcgtcttcaccgacaacgagacctttgcaggcggggtgcaccctgctattgctttgagggagtataggaagaaaatggacattcccgccaaactcatagtgtgtgggatgaccagcaatggctttaccatcgccgaccccgacgatcgcgataccgttaaatag

SEQ ID NO: 139184 - DNA, 1578 bp, Artificial Sequence
  Description of Artificial Sequence: Synthetic coding sequence
atggaggagtctgtgaatcagatgcaacctctcaatgagaaacagatcgccaattctcaggatggctacgtatggcaggttaccgatatgaatagacttcacagatttctttgttttggtagcgaggggggcacttactacatcaaagagcagaaattaggactcgagaatgcagaggccctaatacggcttatcgaagacggccgtggctgtgaagtaatccaggagatcaagtcatttagtcaggagggacgcaccacaaaacaggagcctatgctgtttgccctcgctatttgctcacagtgctccgacataagtaccaaacaggctgcattcaaagccgttagtgaagtgtgtagaatcccaactcatctctttacgttcatccaattcaaaaaagatctgaaggagagtatgaaatgcggtatgtggggcagggcactccggaaggcaattgcggattggtacaatgaaaagggcggtatggctcttgctctagccgtgacaaaatacaagcaacgtaatggatggtcccataaggatctgcttcgcctgtcacatctcaaaccctccagcgaaggccttgcaatcgtaaccaagtatatcaccaagggatggaaagaagtgcacgaactctataaagaaaaggcgctgtcagtggagacagaaaagctcttaaagtacctcgaagctgttgagaaggtcaaacggacacgcgacgagctcgaagtcatccacctgatcgaggaacaccgtctggtaagggaacatctgcttactaatcacttgaaatcaaaagaagtctggaaggctctgctccaagaaatgccgctgacagcgctcctccgcaacctgggaaaaatgactgccaattccgtcctggagccaggtaactccgaggtgagcctggtgtgcgagaaactgtgtaacgagaagctgttgaagaaggcacgaattcatccattccatatactcatcgccctggaaacctataagacgggacacggactccgcggcaaactgaaatggaggcctgacgaggagattctcaaagctttggatgctgccttttacaaaaccttcaaaacggtggagccaacagggaagcgtttcctgctcgccgtcgacgtttcagctagtatgaaccagcgtgtgctcggttcaattctgaatgcaagcaccgttgccgccgccatgtgtatggttgtgacgagaacagaaaaagacagctacgtggttgcattcagtgacgagatggtgccctgccccgtgaccacggacatgactttgcagcaggtactgatggccatgagtcagataccagctggcggcaccgattgtagtttgccgatgatatgggcacagaagacaaatacacctgcagacgtttttatcgtgtttacggacaacgagacatttgcagggggagtacaccccgctattgcactgcgcgagtacagaaagaaaatggatatcccagcgaagctgattgtttgcggtatgacatcaaatggttttacaattgcggaccctgatgatcgcgccctgcaaaacactttattaaataaatccttctag

SEQ ID NO: 139185 - DNA, 1605 bp, Artificial Sequence
  Description of Artificial Sequence: Synthetic coding sequence
atggaggagtcagtgaatcagatgcaacctctgaacgaaaagcagatcgctaattcacaggacggatacgtctggcaggtcacagatatgaatagattgcatcggtttctgtgcttcgggtccgaaggtggcacatactacattaaggagcagaagctgggcctcgagaatgcagaggcattgattcggctcatagaggatggccgcggctgcgaggtgatacaggaaatcaaaagcttttcacaggagggccgcactactaaacaggagcccatgctgtttgctctcgccatctgcagtcagtgcagcgacatctctaccaagcaggccgccttcaaagctgtgagtgaagtctgcaggataccgactcatctgtttacattcattcaattcaagaaggacctaaaagaaagcatgaagtgtgggatgtggggtagagccctgcgcaaggcaatcgctgattggtataatgagaagggaggcatggcactcgctttagctgtgaccaagtacaagcagagaaatggatggagccataaggacctacttcgccttagccacctgaagccgtcatctgagggcctggccattgtgacgaagtatattaccaaaggatggaaagaagtgcatgaactctacaaggagaaggctctgtccgtggagacggagaaactgctcaaatacctggaggcagttgagaaggtgaaacggacgcgagacgagctcgaggtgatccaccttatagaggagcaccgtcttgtgcgggaacacttgttaaccaaccatctgaagtccaaagaagtgtggaaggctctgctgcaggagatgccgttgaccgctttgcttagaaacctgggcaagatgaccgcgaatagtgtgttggagccaggtaattctgaagtctccctcgtttgtgagaaactttgcaacgagaaactcttaaaaaaggccaggattcatccatttcacattctgatagcgctggagacctacaaaaccggacatggacttcgcgggaagttaaagtggcggcccgacgaggagatactgaaggccctggacgcagccttctataagaccttcaaaactgtggagccaaccggaaagcggtttttgctcgccgttgatgtttctgcttccatgaaccagcgtgttctgggctccatactcaacgccagtacggtggcggccgcaatgtgcatggtggtaacacgcaccgaaaaagattcctacgtggtggctttcagcgatgaaatggtgccatgtcccgtcacaacggatatgaccctgcaacaggtccttatggcgatgagccaaataccagctggggggaccgactgcagcctccccatgatttgggcacaaaaaacaaatactcctgcggatgtgtttatcgtttttaccgataatgaaacatttgcaggtggcgtacacccggccatagcactccgtgagtacagaaaaaaaatggatataccagcaaagctgatcgtctgcggaatgacatctaatggattcaccattgccgatcctgatgaccgggggatgctagacatgtgcggcttcgataccggggccctggatccctgtaaaatcccctactag

SEQ ID NO: 139186 - DNA, 1617 bp, Artificial Sequence
  Description of Artificial Sequence: Synthetic coding sequence
atggaggagtccgtgaatcagatgcagccactgaacgagaaacagattgctaactctcaggacggctacgtatggcaggtcacagacatgaatcggctccaccgatttctgtgctttggttctgaagggggaacctactacatcaaggagcaaaaactggggttggagaatgctgaagcgcttattaggctgatcgaggatgggaggggctgcgaggtgattcaagagatcaagagtttttctcaggagggtagaaccactaaacaggagcccatgcttttcgctcttgcaatctgtagtcagtgcagcgatatctcgacaaagcaagccgcatttaaggcagtgagtgaggtctgtagaatccccacccatttatttaccttcatccagttcaagaaggacctgaaggagtccatgaaatgtggcatgtggggcagggccctgagaaaggccatagccgactggtataatgaaaaggggggtatggcactggctctggctgttaccaagtacaaacagagaaatgggtggtcccacaaggatctcctaaggctcagccatctgaagcctagttccgaaggccttgctatcgttaccaagtatattacaaaggggtggaaggaggtccatgaactatacaaggagaaagcattatctgtcgagaccgagaaactcctaaagtaccttgaggcagtggaaaaggtcaagaggacaagagacgaactggaggtgatacatttgatcgaagagcatagactggttcgggagcatttgctcactaatcatcttaagtccaaggaggtgtggaaagccctgcttcaggagatgcccctaaccgccctgctcaggaacctgggaaaaatgaccgctaactccgtgctcgagcctggaaattctgaggtgtccctggtgtgcgagaaattatgcaacgagaagttactaaagaaggccaggattcatccctttcacattctcattgccttggagacctataagactgggcacggactgaggggaaagctgaaatggagacccgacgaagaaatcctgaaggccctggacgccgccttctacaagacattcaaaacagtcgagcccacaggcaaaagatttctgctagccgtagacgtgagtgcatctatgaaccagagagttctgggaagcatactcaatgcgtctacggtggccgccgctatgtgtatggtggttactaggactgagaaagattcatatgtggtggccttttcggatgaaatggtaccgtgcccagtaacgacggacatgacgctgcagcaggtccttatggcaatgagtcagatacccgcaggcggcaccgactgcagccttcccatgatttgggcacagaaaacaaatactcctgctgatgtgtttattgtctttaccgacaacgaaactttcgccgggggcgtccacccagccattgcacttcgagagtacaggaagaaaatggacattcccgctaagctgatcgtgtgcggaatgacttcgaacggcttcaccatagcggatcccgatgatcgaggtatgctggatatgtgtggcttcgataccggtgcgctggacgtcatccgcaattttactctcgatatgatttag

SEQ ID NO: 139187 - DNA, 1617 bp, Artificial Sequence
  Description of Artificial Sequence: Synthetic coding sequence
atggaggagtccgtcaaccagatgcagccactgaatgaaaagcagatagcaaattctcaggacggctatgtgtggcaggtcacagacatgaaccgcctccatcggttcctctgtttcggaagtgaaggcggtacatattatataaaggagcagaaacttggcctggaaaacgcagaggcactgatccggcttatcgaagatgggcggggttgcgaggtgatacaggagatcaagtccttcagtcaggagggccggaccacgaagcaggaaccaatgctttttgcgctggcaatttgttcccagtgcagtgatatctccaccaaacaagccgcattcaaggcggtgagcgaagtttgccggattccaacccacctattcacctttatccaatttaaaaaggacctgaaggagtccatgaaatgcggcatgtggggcagggccctcagaaaggctatcgctgactggtataacgagaaaggaggcatggctctggcgctggccgttaccaagtacaagcagagaaacggttggagccacaaagacttattaaggctcagccatttaaaaccatcttctgaggggctcgcgatagtgactaaatatataaccaaaggctggaaggaggtccatgaactctacaaagagaaggccctaagtgtggagaccgagaaactcctgaaatatcttgaggcagtagagaaggtcaaacgtactcgggatgaattggaagtgatccatctcattgaggagcatcgcctggtacgcgaacacctcctcacgaaccacttgaagtctaaagaagtgtggaaagcccttctccaggaaatgccattaacagccttactccggaatctgggtaaaatgacagcaaacagcgtgctggagcccggcaattctgaggttagcttagtgtgcgagaaactgtgtaacgaaaaattgctgaagaaagccaggattcatcctttccacatactgatcgcactggagacttacaagacagggcatgggcttagggggaaattgaaatggcgaccagatgaagaaattctgaaggctctcgacgctgcattctataaaacatttaaaacagtggaacccacaggcaaacgctttctcctggcagttgacgtctccgcgtccatgaaccagcgtgttctgggttccatcttaaacgcatctacagtcgccgcagcaatgtgcatggtcgtcactagaacggaaaaagactcttacgtcgtcgccttttccgacgagatggtcccatgccccgtgaccaccgacatgaccctccagcaagtgctgatggcgatgtctcaaattccagccggtggtactgattgcagcctccccatgatttgggcccagaagacaaatacccccgctgatgtcttcatcgttttcaccgataacgagaccttcgccgggggggtccatcctgccatcgctctgagagagtataggaaaaagatggatatcccagcgaagctgatagtgtgcgggatgaccagcaacggattcacaattgccgatcctgatgaccggggcatgttggacatgtgtggatttgataccggcgctcttgacgtgatccggaatttcaccctggacatgatctag

SEQ ID NO: 139188 - DNA, 792 bp, Artificial Sequence
  Description of Artificial Sequence: Synthetic coding sequence
atgcctcttaccgctctcctgcgaaacctggggaagatgaccgcaaacagtgttttggaacctggaaatagtgaagtatccctggtgtgcgagaagctctgcaatgagaagcttctaaaaaaagcgagaattcacccctttcacattcttatcgccctggaaacttataagactggtcacggactgagggggaagctcaagtggagacccgacgaagagatactgaaggcactggacgcggcgttctataagactttcaagacagttgaacctactggaaaacggtttttactggctgtggatgttagtgcctccatgaatcagcgagtgctgggctcgatcctgaacgcatctactgttgcagccgccatgtgcatggtggtgaccaggacggaaaaggattcatacgttgtggcctttagcgacgaaatggtcccatgccctgtcacaactgacatgactctgcagcaggtcctgatggcaatgtctcagattcctgctggcggtactgattgcagtttacccatgatctgggctcaaaaaactaacacccctgctgatgttttcattgtgttcactgacaatgagacatttgcgggaggagttcatcctgctatcgctctgagggaatatcgtaaaaagatggatatccccgccaaactaatcgtgtgcggaatgaccagtaacggattcaccatcgcagaccccgatgaccgagggatgctcgatatgtgcggattcgatactggcgccttggatgtcatccgaaattttacacttgacatgatatag

SEQ ID NO: 139189 - DNA, 126 bp, Artificial Sequence
  Description of Artificial Sequence: Synthetic coding sequence
atggaggagagcgttaaccagatgcagccgctgaatgaaaagcagattgccaacagtcaggatggctatgtgtggcaggtaaccgatatgaacagattgcatcgtttcctctgtttcggatcttag

SEQ ID NO: 139190 - DNA, 1050 bp, Artificial Sequence
  Description of Artificial Sequence: Synthetic coding sequence
atggccgcctcagaggcagctgtggtgagtagtccctccctgaaaaccgacaccagtccagtcctggaaactgccgggactgtcgcagctatggcagctaccccatcggcccgcgccgccgctgccgtcgtggcggcggctgcccgaactgggtcagaagcacgtgtgagcaaggctgccttggctacaaagcttctctcattaagcggcgtcttcgctgtgcacaaaccaaaaggtccaactagcgcggaactactgaaccggctgaaagaaaagctcctcgccgaggctggtatgccatcccctgaatggacgaaacgcaaaaagcaaactctcaagattggacatggcggaaccttggattcggccgctcgaggggtactggttgtgggaatcggatcgggaactaaaatgctgactagtatgctttctggcagtaagagatatacagctatcggagaactgggaaaggctacagacaccctggacagcacaggccgggttacagaagagaaaccctacgataagattacgcaggaggatatagagggcatcctgcagaagttcacaggcaatattatgcaggttccccccctgtattcagcattgaagaaggatggtcagcgcctcagcacgctcatgaagaggggtgaggtggtagaggctaaacctgcacggccagtaacggtgtatagtattagtttgcagaaatttcaaccgcccttcttcacattggacgtcgagtgtggcggcgggttctacatcagatcattggtaagcgacatcgggaaggagttgtcctcctgcgccaatgtgctagagctgactcgcaccaagcaaggaccttttacccttgaagagcacgcactgcccgaggataagtggacgatcgacgacattgcccagagcctcgaacactgttccagtctgtttcccgctgagctggctcttaagaagagcaagcccgagagcaatgaacaggtactgtcatgtgagtacattactcttaacgagccaaagagggaagatgacgttatcaagacatgttag

SEQ ID NO: 139191 - DNA, 996 bp, Artificial Sequence
  Description of Artificial Sequence: Synthetic coding sequence
atgggcagcgctggactatcccgcctgcatgggctcttcgccgtctataaaccacctgggctcaagtggaagcaccttcgtgacacggtggaactgcaattgctaaagggactcaatgcacggaaacctccagcccctaagcaaagagtgcggtttctcctgggccctatggaagggtctgaagaaaaagaactgaccctcactgcgacctcagtgccctcatttatcaatcaccccctcgtgtgtggtcctgcattcgcacacctgaaggtgggcgtcgggcaccggctggacgcccaggctagcggggtgcttgtactgggcgtgggtcacggctgtagactgctgacggatatgtacaatgcccacctcacaaaggactacaccgtaagggggctccttgggaaggctactgatgattttagggaggacggacggctcgtcgagaagactacatacgaccacgtgacccgagagaagcttgacaggatcctggctgtcatccaaggcagccaccagaaagcactggtgatgtactcgaatttagatcttaaaacacaggaggcgtatgaaatggcagttcgcggcctcattcggcccatgaacaaaagccctatgctaatcaccggcattagatgcctctactttgcaccacccgagttcctgcttgaagtgcaatgtatgcacgaaacccagaaggaactgagaaagctggttcatgagatcgggcttgagctgaagacaaccgctgtgtgcacccaagtgagaagaactcgggacggatttttcaccttggatagcgctttgcttcgcacacagtgggatctaaccaatatacaagatgccattcgcgccgccacaccccaagtggctgccgaattggagaagtctctttcgcctgggttggacacgaagcagctcccatcaccaggttggtcctgggacagtcaaggtccatcaagcacgctcggtcttgagagaggagccggccagtag

SEQ ID NO: 139192 - DNA, 828 bp, Artificial Sequence
  Description of Artificial Sequence: Synthetic coding sequence
atggaaggttccgaagagaaggaactgactctaactgcaacaagtgtgccctcttttatcaatcacccattagtatgcggtccagcattcgcacacctcaaagtcggcgtgggtcatcgactggatgcccaagcctcgggcgtgctggtgctaggggtgggccatgggtgcaggttgcttacagatatgtataatgcccacttaacaaaagattacacggtaagaggtctgctaggcaaagcgactgacgacttccgcgaagacggtcgcctagtggaaaaaacaacttatgatcatgtaactcgagagaagctggatcgcatccttgctgtgattcaggggagccaccaaaaagccttggtaatgtattctaatctggatctcaaaactcaagaggcttacgagatggctgtcaggggcctgattcggcccatgaataagagcccaatgctgattaccgggatcaggtgcctctacttcgctccacccgagtttcttcttgaggtacagtgcatgcatgaaacccagaaggagctgcgcaagcttgtgcacgagatcggactggagctgaagactacagctgtatgcacccaggtgcgccgaacgcgcgatggattctttacacttgactccgctctgctgcgcacccagtgggacctcactaacatccaggacgctattcgtgccgctactccacaggtggccgccgagctggagaagtccttaagccccgggctggacacgaagcagctgcccagtccaggctggagttgggactctcagggaccgagtagcaccctggggttggaaaggggggcaggccagtag

SEQ ID NO: 139193 - DNA, 1701 bp, Artificial Sequence
  Description of Artificial Sequence: Synthetic coding sequence
atgaggcgacagtggggtagcgctatgcgcgcagctgaacaggcggggtgtatggtgagcgcgagtcgggctggccagcctgaagccggcccttggagctgctccggcgttatcctcagcaggtctcccgggttagttctctgtcacggggggatatttgtcccatttctgagggcaggctctgaagtgcttaccgctgccggagcggttttcctgcccggtgacagctgcagagacgacctgagactccacgtccaatgggccccaacagccgccggccccggggggggggctgagcgcgggaggcctggactttgcacccctcaatgtgccagcctcgagcctggtcctccagccccatctcgtgggcggcctctgcagccccgtctccccgctgagctgctcctgctgttgtcctgtccagctttctgggcccattttgcccgactgttcggggatgaggccgccgaacagtggcgtttcagctccgcagcccgagatgacgaagtgtcggaagacgaggaggccgatcagctgcgtgccctcgggtggtttgcattactaggagtgcggctgggacaagaagaagtggaggaggagagaggaccggccatggcagtttctcctctgggggccgttcccaagggcgctccactgctggtatgtggtagtccattcggcgcgttttgccctgatatctttttgaatactctgagctgcggagtcctcagtaacgttgctgggcctctgttgctcacagacgcacgctgcctaccaggcaccgaggggggtggggttttcactgcaagacctgctggcgctctggtggcactggtggttgcccccctctgctggaaagcaggcgaatgggtcggctttaccctcctttgcgcagccgctccacttttcagggctgcgagggacgccctgcatcgcctgcctcactcgactgcagctttggcagccctcctcccgccagaagtaggtgtcccgtggggactgcctctgagggactctggacctctgtgggcagccgcagctgtgctggtagagtgtggcaccgtctggggcagcggagtcgccgtcgcccccagactagtagtgacctgccgccacgtgtcgcctcgagaggcggccagggttctcgtgcgaagcactacccctaagagtgtggccatctggggtcgggttgtgtttgctacccaggaaacatgcccgtatgatatagctgtggtgagcctggaggaggatctggatgatgttcccatccccgttccggctgaacatttccacgagggggaagccgtgagtgttgtgggtttcggcgtcttcggacagagttgcgggcccagcgtaacatccggcatcctaagcgcagtcgttcaggtgaatgggaccccagtgatgctacaaactacatgcgcagtccacagcggttccagtgggggaccccttttttctaatcattctggaaacctactgggcatcatcacctccaatacaagggacaacaatactggggccacctacccccatctaaactttagtatccctattaccgtcctacaaccagctctgcagcaatacagtcagactcaggatttaggggggttgcgggagctagatagagccgcagaaccagttagggtagtttggcggctccagcggcccctggccgaggctccgcgctccaagttgtag

SEQ ID NO: 139194 - DNA, 1197 bp, Artificial Sequence
  Description of Artificial Sequence: Synthetic coding sequence
atgcgacggcagtggggctccgccatgcgagcggcggagcaagctggatgcatggtttccgcatcccgggccggccagcctgaagcgggaccatggagttgctccggcgttattctcagtaggtcaccggggctggttttatgtcatggaggcatattcgtgccgtttctgcgtgcaggtagcgaggttctgacagccgcaggcgctgtgttcctccctggagattcttgcagagacgacctgcgacttcatgtgcaatgggccccgactgccgccggacctggaggcggagccgaacggggccgtcctggtctgtgtacaccacaatgcgccagcctggagcctggcccccccgccccctctcggggacgcccgctccagccacgtctgcccgccgaattgttgctgttactatcatgtcctgctttctgggctcactttgccaggctgttcggagacgaagctgccgagcaatggcggtttagctcagcggcgagggacgatgaggtgagtgaggacgaggaggccgatcagctccgggcactggggtggttcgctctcttgggtgttaggctcgggcaagaagaggtagaagaagaacgggggcccgccatggcggtatcccccctcggagcagtacctaagggtgcccctctgctcgtgtgcggatccccctttggagccttttgtccagacatttttttgaatacgctctcctgcggcgtgttgtcaaatgtggccgggccactcttgcttaccgacgccaggtgtctgccagggacggagggcgggggagtcttcaccgctcgcccagcaggagccttggtagcccttgtcgtcgccccactgtgttggaaagcaggagagtgggtcggtttcacgttactgtgtgccgctgcacctcttttcagggcagcacgcgatgcccttcatcggctcccacactccaccgccgccctcgccgctcttctcccccccgaggttggggttccatggggtcttcccctccgcgacagtggcccgttgtgggctgcagctgcggtgctcgtcgagtgtggcaccgtctggggctccggggtagcagtggcaccacgactggttgtcacttgtcggcacgtttcacctcgggaagccgctcgggttttagtgcgttccaccacccccaagcacaatcatcaacagcaccctggccagtag

SEQ ID NO: 139195 - DNA, 828 bp, Artificial Sequence
  Description of Artificial Sequence: Synthetic coding sequence
atgctgaatctgctactactggctctgcctgtgctggcatcaagggcatatgcggcccctgcccccggccaggctctgcagagagtgggcatagttggcggccaggaagcaccaaggtccaagtggccttggcaagtcagcttgagagttcacggtccatattggatgcacttctgcgggggatctttgatccatccgcagtgggtgctcacagctgcccattgcgtgggaccggatgtgaaggatctagcagctttacgcgtgcagctccgcgaacagcacctttattaccaggatcagttactgccggtcagccggataatcgttcaccctcagttttacaccgcccaaataggcgcagatatcgccctcctcgagctggaggaacctgtcaatgtttcaagccatgttcatacagtgacattaccgccggcctcggaaacatttccaccaggcatgccttgttgggtcacaggctggggcgatgttgacaacgatgaaaggctaccaccacctttccctctgaagcaggtgaaggttccaatcatggaaaaccacatctgcgatgctaagtaccatctgggtgcatatactggggatgacgtgaggattgtgcgagatgacatgctctgtgcaggtaatacccgcagggattcctgtcagggggatagtggcggtccgttggtttgcaaggtcaatgggacttggctgcaggccggggtcgtgagctggggcgagggctgcgcgcagccaaatcgacccgggatctatacccgggtgacgtactatctggattggattcaccactacgtgccaaaaaaaccatag

SEQ ID NO: 139196 - DNA, 849 bp, Artificial Sequence
  Description of Artificial Sequence: Synthetic coding sequence
atgcttcttctcgcaccccagatgctgaacttactgctgctggcccttccagttcttgcatcccgcgcgtacgctgccccggcacctggccaggccctgcaacgtgtcgggattgtgggtggccaggaggctccacgaagcaaatggccttggcaagtgtccttgcgggtgcacgggccttactggatgcatttctgcggggggtccttgatccacccacagtgggtcctcactgcagcacactgtgtgggcccagacgtcaaagatctcgccgcgctgagggtgcagcttcgcgagcaacacctgtactaccaggatcagcttctgccagtatcccggataatcgtgcacccacagttttacaccgctcagatcggcgctgacattgcgctgctggagctggaggagcctgtgaacgtcagttcccacgtccacacagttacactgcctcccgctagtgagacgtttcccccaggaatgccctgctgggtgacagggtggggagacgtggataacgacgagcggcttccccctcccttccctttaaaacaggttaaagtgccaataatggagaaccatatttgtgacgcaaagtaccacctgggtgcctatactggtgacgatgtccggatagtgcgagacgacatgctgtgtgctggcaatacgcgcagggactcttgtcagggcgactctggcgggcctttagtgtgcaaggtgaacggaacctggcttcaggcaggggtcgtctcttggggggagggctgtgctcaacccaataggcctgggatctatacacgcgtcacatattacctcgactggattcatcattatgtaccaaaaaagccctag

SEQ ID NO: 139197 - DNA, 2532 bp, Artificial Sequence
  Description of Artificial Sequence: Synthetic coding sequence
atgtgggggaggctctggccattactcctgagtatccttacagccaccgccgtccctggaccttctttgcgccgcccctctcgggaactggacgctaccccacgaatgaccatcccgtacgaagagctgtcgggcacccgccactttaagggacaagctcagaattacagcacccttctactggaagaagcttcagccaggctgctcgtgggagccagaggagccctattctcgttgtcagccaacgatattggcgacggagctcacaaggaaattcactgggaagccagccctgagatgcaatctaaatgtcaccagaaggggaaaaacaatcagaccgagtgttttaatcacgtgcggttcctacagcgacttaactctacgcatctgtacgcgtgtggcacccacgcatttcaacccctgtgtgcggccatcgatgcggaagctttcacccttcccacgagcttcgaagagggcaaggaaaagtgcccctacgacccggcacgaggctttaccgggctaattattgacggcggtctatataccgccaccagatatgaattcaggagtattccagatatacgtcgatctcgacaccctcattctctcagaaccgaggagaccccaatgcactggctgaatgatgctgaattcgtgtttagcgtgctggtaagagaaagcaaggcttcggcggtcggggatgatgacaaagtctactacttctttactgaacgtgctactgaggaggggagcggcagcttcactcagtcccgctcatcccaccgagtggccagggtggcacgcgtctgtaagggtgaccttggagggaagaaaatactgcagaaaaagtggactagttttctgaaagctcgactgatctgccatatccccttatatgagacacttcgaggcgtttgttccctggatgcggaaaccagcagtagaacgcatttttatgctgccttcacactgtctacccagtggaaaacactggaggctagcgcaatctgtcggtacgatctggcagagatccaggctgtgttcgcaggaccctacatggagtaccaggatggcagtaggcggtggggccgatatgaggggggtgtcccagagccccgcccagggtcctgcatcactgattccttgcgatcacagggttataatagttcccaggatctgcccagccttgtccttgatttcgtgaagctgcatcccctcatggcccgcccagttgtgcctacgcgagggcggcctttgctccttaaaaggaatattagatacactcacctgactggcacccctgtgacgacgccagcaggcccaacttacgacttactgttcctgggaacggcagatggttggattcataaggcagtggtcctggggagtggtatgcatatcattgaggagacccaggttttccgggagtctcaatctgtcgaaaacttggtgatttcattgctgcagcatagtctctacgtcggcgccccatcgggtgtgattcagctgccattgtccagttgtagtaggtatcggtcctgttacgattgtatcctagctagagatccatattgcggctgggatcccgggacccatgcgtgtgctgctgccaccacaatagctaacaggagtcagggatcccgtacagccttgatccaagacatagagcgggggaataggggctgcgagtcatctcgagatactggacctcctccacccctaaagactagaagcgtactgagaggcgacgatgtgttactgccatgtgatcagcctagcaatctggcacgagctttgtggctgcttaacggttctatgggcctgtcagatggtcaggggggatatcgagtgggagttgacggcctcctagttactgatgcccagcctgagcactcaggaaactacgggtgttacgctgaagaaaatgggctccgcaccctgctggcctcatactccctaactgttcggccggctacccctgctcccgcacctaaagcccctgctacacccggtgctcagttggcccccgacgtacgattgctctatgtgttggccatcgcagcactgggcgggctatgcttgattctggccagcagcttgctgtacgtggcttgtctgcgcgagggacggcgtggcaggcgccgcaagtactctctcggtcgcgcgagtagggccggtggttccgctgtgcaactgcagacagttagtgggcagtgccctggtgaggaggatgaaggcgacgacgagggcgccggaggactggaggggtcgtgtctccaaatcatccctggagagggcgccccagccccgcctcctccccccccaccaccccctcctgcggaactgaccaacggactagttgccctcccctccaggctgcgacgaatgaacggcaattcttacgtgctgctcagacagagtaacaacggagtcccggcggggccctgcagctttgcggaggaactcagtcgcattttggaaaagcgtaaacacacacaattggtggagcagcttgacgaaagctcggtatag

SEQ ID NO: 139198 - DNA, 708 bp, Artificial Sequence
  Description of Artificial Sequence: Synthetic coding sequence
atgctgagcctactcctgctggcattgccagtgttagcctcccccgcctacgtggctcccgccccagggcaagcactgcaacagaccggcatcgtgggggggcaggaggctccaaggtccaagtggccatggcaggtaagtctgagagtacgagggccctattggatgcacttttgtgggggcagcttgatccatccacagtgggtactgacggccgcccattgcgtggaacctgacatcaaggacctagctgcacttcgggtgcagctacgagaacagcacctctactatcaggatcagttattgccagtgtctcgcattatagtacacccacagttttacatcattcagaccggagccgacattgctttgcttgagcttgaggagccagttaacatctcctcccacatccacaccgtcactctcccgcccgccagtgagacctttcccccagggatgccctgctgggtgactgggtggggcgatgttgataataatgtgcacctcccacccccttatcctcttaaggaggttgaggtgcctgtcgtggagaatcatctgtgcaatgccgagtatcatactggattgcacacaggtcacagtttccagattgtgagggacgacatgttgtgcgccggctctgaaaaccacgactcttgccagggcgactctggcggaccactcgtctgcaaagtgaacggaacatag

SEQ ID NO: 139199 - DNA, 4281 bp, Artificial Sequence
  Description of Artificial Sequence: Synthetic coding sequence
atgcactcatccaaccccaaagtgcggtcctctccctctggcaacacgcagagttcacctaagtcaaaacaggaggtgatggtacggcctccaaccgtgatgtcgccatctgggaacccccaactcgatagcaagttcagcaaccaaggcaaacaggggggttctgccagtcagagccagcccagtccttgtgattctaagtcagggggacatacccctaaggcccttccaggccctggaggaagtatgggactcaaaaacggagctggtaacggagcgaagggcaagggaaagcgggagaggagtatttccgcagactccttcgaccagagggacccggggacacccaatgatgacagtgatatcaaagagtgtaatagtgccgaccacatcaagtcccaagatagtcagcataccccacatagcatgacccctagtaatgccaccgcccctcggagtagtactccttctcatggccagaccaccgccaccgagcccacaccagcccagaagacacccgcaaaggttgtctatgtgttctccaccgaaatggctaacaaggccgccgaagccgtcctcaagggacaagtggaaacaatagtgagctttcatattcagaacattagcaataataagactgaacgaagtacagcccccctgaacacgcagatcagcgcactgcggaatgacccaaagcccctacctcagcaaccgccggccccagcgaatcaggaccaaaattctagccagaatactcgcctccaacccaccccccctatccctgccccagctccaaaacctgctgctcccccccgaccattggaccgcgaatcgcctggagtggaaaataagctgataccaagtgtagggagtcccgcctcgtcaacaccgttacctccggacgggaccgggcccaacagtaccccaaataaccgggctgtcacccctgtgtcccagggcagcaacagcagttccgctgatcctaaggcccctccacctccccctgtgagttctggagaaccacctacgcttggcgaaaatccagacgggctctcccaggagcagctcgaacaccgggagaggtcactacagacgctgcgtgatattcagcgcatgttatttcccgatgagaaagagtttacaggagctcagagcggcgggccacaacagaacccgggggtgcttgatggaccccaaaaaaagcctgagggcccgatacaagctatgatggctcaatcccagagtcttgggaagggaccaggcccgcgcaccgatgtaggcgcgccgtttggtcctcagggacaccgagacgtcccattctcaccggacgagatggtgccaccttccatgaacagtcagagcggaacaatcggtccagaccatcttgaccacatgactcctgagcagatcgcttggctgaaactccagcaggaattctatgaggaaaaacgacgaaagcaagagcaggtagtagtgcagcagtgttctctgcaggacatgatggttcatcagcatgggccaagaggcgtagttcgcggccctcctcctccatatcaaatgacgcctagtgagggctgggccccgggaggtacagaaccatttagcgatggaataaatatgcctcacagcctgcctcccagagggatggccccccaccctaatatgcccgggagccaaatgcggctgcctggctttgcaggaatgatcaattccgaaatggagggccctaatgtgccaaaccctgcctcccgcccaggtttatctggcgtgtcttggccagacgatgttcctaaaattcctgacggtcggaatttcccgcccggccaggggatctttagcggccccggcaggggagagagattccccaatccccaagggctcagtgaagagatgtttcagcagcagttggctgagaaacagctgggcctccctcccgggatggccatggaaggaatacgaccctctatggagatgaaccgaatgatccccggctcccagcgccacatggagccaggtaataatcccatctttcctcgcatcccagtggagggacccttaagccccagcaggggagatttccctaagggtatccctccacaaatgggtccagggagagaactggaattcggcatggtccccagcggaatgaagggagacgtaaacctgaatgtgaacatgggtagcaacagtcagatgataccacagaagatgcgcgaggccggtgcagggcctgaagagatgctgaaacttcgccccgggggcagtgatatgttgcccgctcagcagaaaatggtgcctctcccgtttggggaacatcctcagcaggagtacggcatggggccccgtccgtttcttcctatgtcccaggggcccggaagtaacagcggtctccgcaatttgagagaacctatcggaccggatcaaagaactaactctaggctcagccatatgccaccgctgccattgaacccatcctcaaatcccacatctctcaatacagcacctcctgtgcagagagggcttggacgaaagcccttagacatctccgtagcgggcagccaggttcactccccaggcattaacccccttaagtcacccaccatgcatcaggtccagagcccaatgttgggctcaccctctggcaatctgaagtctccccagacccccagccaactggcggggatgttggccggcccagcagccgccgcatccatcaaatcgcctcccgtgcttggatcagccgcggcgtcccccgtgcacttgaaaagtccatccctacctgcgccatccccagggtggaccagctctcccaagccacctttgcagtctcccggcataccccccaaccacaaggcgcccctgacaatggcctcaccggcaatgctaggaaacgtcgagtcaggcgggccgcctcctcccaccgctagtcagccagccagcgtgaatatccccgggtctctcccctcctctacgccctacacaatgccccctgaaccaacgctgagccagaacccactgtctatcatgatgtcacgcatgtctaaattcgctatgccatctagcactcccctttaccatgacgcaattaagacagttgcttcatccgacgacgactcccctccagctcgcagccctaacctcccaagcatgaataacatgccaggcatggggattaacactcagaatcctaggatcagcggccctaaccccgtcgtgcccatgcccactttgtcacctatgggcatgactcaacccctgagccactcaaaccaaatgccttctcccaacgctgtcgggccaaacatcccaccccatggggtgcctatgggaccagggctgatgagtcacaacccaataatgggccatgggtcccaagaacccccaatggtcccccaaggacggatgggctttccccagggctttcctcccgtgcaatccccaccccagcaagtgccctttcctcacaacggcccctctggggggcagggttcatttcccggaggtatggggttccccggcgaagggcctctggggcggcctagcaatctcccacagagttccgcggatgcagccctgtgcaaacctggaggccccggaggtccagactcattcaccgtgctcggaaacagcatgccatctgtatttacagacccagatctccaagaggtgatcaggcctggtgcaacggggattcccgagttcgatctgagccgcataattccatccgagaagcctagccaaacattgcaatatttcccacggggggaagtccccggcaggaagcagccccagggaccgggacccggcttctcccacatgcagggcatgatgggtgagcaggcaccccgaatgggacttgccctcccagggatgggggggccaggccccgtcggaaccccagatatacccttgggaaccgcccccagtatgccgggccacaaccctatgagacctccagctttcttgcaacagggcatgatgggccctcaccatagaatgatgagtcccgcccagagcactatgccggggcaacctaccctgatgagcaaccctgctgcagcagttggaatgatccctgggaaggaccgcggccctgccgggctgtacacacatccaggtcccgtcgggtctccagggatgatgatgagcatgcagggtatgatgggcccacagcagaacataatgataccaccccagatgaggccacgggggatggctgccgacgtgggcatgggcggattctcacagggacccggcaatccaggaaacatgatgttctag

SEQ ID NO: 139200 - DNA, 1221 bp, Artificial Sequence
  Description of Artificial Sequence: Synthetic coding sequence
atgtcgggctgtccttttttagggaataatttcgggtatacctttaaaaaactgccagtggagggctcagaagaagataaatcccaaactggagtgaatcgtgcctccaaaggcggcctaatctatgggaactacctccacctggaaaaagtgctcaatgctcaagagcttcagagcgaaactaaaggaaataaaatacacgatgagcatctgtttatcataacccaccaagcctacgagttatggttcaagcagatcctgtgggagctcgacagcgtgcgcgaaatcttccagaatggacatgtgcgagacgagcgaaatatgctgaaggtcgtcagccgcatgcaccgggtttccgtaatactcaagctgctcgtccagcagttctctatcctcgaaactatgaccgccctggactttaacgacttccgcgaatatttgagcccggcttctgggttccaaagcctgcaattcagattgctggaaaacaaaattggagttttacaaaatatgagagttccttacaatcgcaggcattaccgggataactttaaaggtgaggaaaatgagttactgttaaaatccgagcaggaaaagaccctgttagagcttgtcgaagcttggcttgagagaacacccggccttgagccgcatgggtttaacttttggggcaagttggagaagaatatcactcgaggcctggaagaagagtttataagaattcaggcaaaagaggaatccgaggagaaggaggagcaggtagccgaattccagaagcaaaaagaggtgttactgagtctctttgacgagaagcgccacgaacacctactcagcaaaggtgaaaggcgtctcagctacagagcccttcagggagccctaatgatctacttttacagagaagaacccagattccaggtgccctttcagctgctcactagcctaatggatattgattccctaatgacaaagtggagatataatcacgtctgtatggttcatagaatgctaggatccaaagccggaaccggcgggagcagcggttaccactacttgaggagcaccgtttcagatagatacaaagtttttgttgatctgttcaacctcagcacttatctaatccccaggcattggattcccaaaatgaaccctacaattcataaatttctctacacggccgagtactgtgactcctcttacttctcctccgacgaatctgattag

SEQ ID NO: 139201 - DNA, 1335 bp, Artificial Sequence
  Description of Artificial Sequence: Synthetic coding sequence
atgatcgaagataacaaagagaataaagaccacagcctggagcgcgggagggcatctctcatcttcagcttgaaaaatgaggtcgggggtctcattaaagctctgaagatttttcaagaaaaacacgtcaatctcctccacatcgaatcacgcaaaagtaaacgccgcaactccgaattcgaaatctttgtcgactgcgatattaatcgcgaacagttgaacgacatcttccacttgcttaagtctcataccaacgttctgtctgttaacctgcctgataacttcaccctgaaggaagatgggatggagaccgttccctggtttcccaaaaagatcagcgatctggatcactgcgcaaatagagttctcatgtacggctccgaattggatgcagatcaccccggttttaaagacaacgtctatcgcaaacgccggaagtattttgctgatctagctatgaactacaagcacggcgacccgatcccgaaagtagaatttaccgaagaggagatcaagacttgggggactgtcttccaagaattgaataaactctaccctacccacgcctgcagggaatatctcaagaacctgcctctgctctctaaatactgcggatacagagaagataatatccctcagctggaggacgtgtccaattttctgaaggagcgcactggcttttccattaggcctgtagcgggttacctcagccccagagatttcctctcaggccttgccttccgggtgtttcattgtacacagtatgtgagacattcatccgaccccttctacacgcccgagcctgacacctgccatgaattactgggccatgtacctttgctcgctgagcccagctttgctcagttctcacaggaaatcggactggcttccctcggggcgtcagaggaagctgtgcagaaactggccacttgttatttttttacggtggaatttggactctgcaagcaagatggccaattgcgagtgtttggtgccggcttgctttcttctatatctgaacttaagcatgccctgtccgggcacgctaaagtcaaacctttcgatccaaaaattacttgtaaacaggagtgtttgattaccaccttccaggacgtctacttcgtctccgagtccttcgaggatgctaaagagaagatgcgggagtttacaaaaaccattaagagaccatttggggttaagtacaatccctacacccggtccatacagatcctgaaggacacgaaatccatcacgagcgccatgaacgaactccagcacgacctcgacgtggtctcagacgcccttgccaaagtgagtcgtaagccctccatctag

SEQ ID NO: 139202 - DNA, 1401 bp, Artificial Sequence
  Description of Artificial Sequence: Synthetic coding sequence
atgattgaggataacaaggagaacaaggatcactccctggaacggggcagggcatccctgatcttcagtctgaaaaacgaagtcgggggtctcatcaaggctctgaagatcttccaagaaaagcatgtgaacctcctgcatatcgagtccaggaagtcgaagcgtagaaattcagagttcgaaatcttcgttgactgcgatattaacagagagcaactcaatgacatcttccacttgctgaagtcccacacaaacgtgctttccgtgaatctacctgataatttcactctcaaggaggatggaatggaaaccgttccgtggttcccaaagaaaatatcagatctggaccactgtgccaatcgtgtgctgatgtatggttcggaactcgatgctgaccaccctggcttcaaggacaatgtctatcgcaaaaggcgcaagtactttgctgacctcgctatgaactataagcatggagatccaatcccaaaggtcgaatttacagaagaggagatcaagacatggggaaccgtcttccaggaactgaacaagctgtatcccacccatgcctgcagagagtacctaaaaaacctacccctcttgtccaaatattgcgggtaccgcgaagacaatatccctcagttggaggatgtctctaactttctgaaggaacgaaccggattctctatccgcccagtggctggctatctgtctccccgagattttttatcaggactggcattcagggtgtttcactgcacacagtatgtcagacatagttcggaccctttctatactcccgagccagacacctgtcatgaactgctggggcacgtcccattgctggccgagccatccttcgcacagttttcccaagagatcgggttagctagcctcggggctagcgaggaggccgtgcagaagctcgccacgtgttattttttcaccgtcgaattcggtttgtgcaagcaggacggccagttgcgagtgtttggcgctggactgctgtcaagtatctctgagctgaaacatgccctgtctggccatgcaaaggtcaaaccttttgaccccaaaataacatgtaaacaggagtgtctgattactactttccaggatgtctactttgttagtgagtcctttgaagacgctaaggagaagatgagggaattcaccaaaactatcaaacgcccattcggagtgaagtataatccttacactagatctatacaaatcctgaaggataccaagtctatcacctcggcaatgaacgaattgcaacacgacctcgacgtcgtgtcggatgctctggcaaaatctctcaacgaggatgtcttgcaagtcagcgtcttcgccctgctactcttcctgccaagtctgcacggcgaatgtcatcctgatacgtag

SEQ ID NO: 139203 - DNA, 753 bp, Artificial Sequence
  Description of Artificial Sequence: Synthetic coding sequence
atgcagcccgcaatgatgatgttttcatcgaagtactgggcccgtagaggtttcagcctagactccgcagtgccggaagaacaccagctgctgggctcctcaacactgaacaagccaaattctggtaagaacgatgataaagggaacaaaggtagctccaaacgcgaggcagccacagagtctggtaagacagctgtggttttcagtttgaagaatgaagtgggcgggctggtaaaggcgctgagactttttcaggagaagcgcgtcaatatggtgcacatcgaatcacgaaaaagtagacgtcggtcctctgaagtggaaattttcgtggactgtgaatgtggaaagaccgagtttaacgagttgatccagctgttgaagtttcagacaaccatcgtgaccctcaacccacctgagaatatctggactgaggaagaggagctggaggatgttccctggttcccacgtaaaatatctgagctcgataaatgttctcaccgagttttgatgtacggtagcgagcttgacgctgaccacccaggttttaaggacaacgtgtaccgccaaaggcgcaagtactttgtagatgtggcaatgggatacaagtatgggccgagactgctcgccgctataggagattgggagtttcagctcttcagcgtctcctcttctctgagcagcagttcgctttgcatgctttccgtccacattcttatggacgtccggagcatcgttgtcgcggtggatatttag

SEQ ID NO: 139204 - DNA, 1473 bp, Artificial Sequence
  Description of Artificial Sequence: Synthetic coding sequence
atgcagcccgccatgatgatgttctcttctaagtactgggccagaagaggttttagtctggacagcgcagtgcctgaggaacaccagttactgggatcatcaactctgaacaaacccaattccggcaagaacgatgacaagggcaacaagggatccagcaagcgggaggctgccacagagtctgggaagactgcagtagtgttttctctgaagaatgaagtcggcggtttagtcaaagccctacgactgtttcaggaaaaaagagtaaacatggtgcacattgagagtcgcaagtcccgcaggcggtcctcagaggtggaaatcttcgtagactgcgagtgcgggaaaaccgaatttaatgagctgatccagttactgaaattccagaccacaatcgtcacacttaacccgcccgaaaacatttggacagaggaagaggaactcgaggatgttccctggttccctaggaagatttcagaactggataaatgttctcacagggtgctgatgtacggttctgagttggacgctgaccacccgggattcaaggacaacgtgtaccgccagaggaggaaatactttgttgacgtggcgatggggtataaatacggccagccgatccctcgcgtggagtacaccgaggaagagaccaagacctggggggtggtctttcgggagctgagtaaactgtacccaactcatgcctgcagggagtatcttaagaacttcccattgctcaccaagtattgtggataccgagaggataacgttcctcagctggaggacgtctctatgtttctcaaagagaggtctggctttaccgtccgccctgtggctggatacttatctccccgggatttcctggcgggtctggcttatagagtattccattgcacacagtatattcgccacggcagcgaccccctgtacacacccgaacccgacacatgtcacgaactgctcggccatgtacccctgttggccgaccctaaattcgcacagttcagccaggagattggcctggcctccctgggagctagtgatgaagacgtacagaagctcgcgacttgttacttctttacaatcgaatttggactctgcaagcaggaaggtcagcttagagcgtacggcgcaggtcttttgtccagtatcggggaacttaagcacgcgttgtccgataaagcatgcgtgaaggcgttcgacccaaaaactacttgccttcaggagtgcctaatcaccacatttcaggaggcttactttgtgtccgaaagtttcgaagaagccaaggaaaagatgagagatttcgccaagtccattactcgtcctttctctgtctacttcaacccttacacgcagagcatagagatactcaaggacacacggtctatcgaaaacgtggttcaggatctcagaagtgacctcaatacagtctgtgatgcgctgaacaaaatgaaccagtatctaggtatctag

SEQ ID NO: 139205 - DNA, 525 bp, Artificial Sequence
  Description of Artificial Sequence: Synthetic coding sequence
atgagctcagccgctgccgaccactgggcttggttgctggtgctgtcatttgtgttcgggtgcaatgtgctccgaatcctgctgccctctttctcctcgtttatgtcgagggtccttcagaaagacgccgagcaggaatcacaaatgagggctgaaatccaggacatgaagcaggagctttctaccgtgaacatgatggatgaattcgcccggtacgcacgtctcgaaagaaaaatcaacaaaatgactgacaagttgaaaacccatgttaaagctcgtaccgcgcagctggcaaaaattaagtgggtgatcagcgtggcattttacgtgcttcaggcagctctgatgatctccctgatctggaagtattacagcgtccctgtggctgttgtgccgtccaagtggattacacccctcgaccgactcgtggcctttccaacacgggtcgccggaggcgtgggaattacctgttggattctggtgtgcaataaagtcgtggccatcgtgttgcaccccttttcttag

SEQ ID NO: 139206 - DNA, 423 bp, Artificial Sequence
  Description of Artificial Sequence: Synthetic coding sequence
atgtcacgagtactgcagaaggacgcggagcaagagtctcagatgagggccgagatccaggacatgaagcaggaactgtctacggtgaatatgatggacgaattcgctagatacgcccgccttgagagaaagatcaataagatgactgataaacttaaaacgcatgtgaaagccagaactgcccagctggcgaaaatcaagtgggttatctcagtggcgttttacgtattgcaggctgccctgatgatctctctgatctggaaatactattccgtgcctgttgctgtcgttcctagcaagtggatcacacccctggaccggctggttgcattccctactcgcgtggctggcggagtcggtattacctgctggatcctcgtatgcaacaaggtcgttgctatcgtgctgcatccgtttagctag

SEQ ID NO: 139207 - DNA, 423 bp, Artificial Sequence
  Description of Artificial Sequence: Synthetic coding sequence
atgagcagagtgctgcaaaaagacgctgagcaagagtcgcaaatgagggcagagattcaggacatgaagcaagagcttagtaccgtgaacatgatggatgagttcgccagatacgctaggctggaaaggaaaatcaataagatgaccgacaagctgaaaacacacgtcaaagctagaaccgcccaactcgccaagataaaatgggtgatctccgtggcattctacgtcctgcaggctgcacttatgatcagcctcatctggaaatactactctgtgccagtagctgtggtaccttcaaagtggattacccctctcgacagactggtggcattcccaacacgcgtggcaggaggtgtgggtatcacctgctggattctcgtctgtaacaaggtggtagcgatcgtcttgcaccccttctcctag

SEQ ID NO: 139208 - DNA, 519 bp, Artificial Sequence
  Description of Artificial Sequence: Synthetic coding sequence
atgtcctccgcggccgccgatcattgggcgtggctgctcgtgctgagcttcgtcttcggctgtaacgttctccgcatcctccttccctcatttagttccttcatgtcccgggtcctgcagaaggacgccgagcaagaatcgcagatgcgagcagagatccaggacatgaagcaggagctgagcacagtcaatatgatggatgaattcgccagatacgctcgactagaaagaaagatcaataaaatgaccgacaaactcaagacccatgtgaaagctcggaccgcccagcttgccaaaattaaatgggttatcagcgtggccttctatgtgttgcaggctgcccttatgatctccctcatctggaaatattatagtgttcctgtagcggtggttccttctaagtggataactccgttggatcgcctggttgccttcccaacgcgcgtcgcagtcttcagctcatcgatctggacctccaaatgcttctcaagccctgacaaaagcatcctcgagaagtag

SEQ ID NO: 139209 - DNA, 1083 bp, Artificial Sequence
  Description of Artificial Sequence: Synthetic coding sequence
atggccttacattccatgcgtaaagccagagagagatggagcttcatccgagccctgcacaaaggtagcgctgcagcacctgccctacagaaggattcaaaaaaacgtgtttttagcgggattcaacccacaggcattctacacctagggaattatttgggggctattgaaagttgggtgcgcctccaagatgagtacgattccgtgctgtactccatcgtggatctgcactcgattacagtgcctcaagacccggcagtcttaagacaatcgattttggacatgacggctgtgctgttggcctgtgggattaatcctgaaaaaagcattctgttccagcagtcccaggtgagcgaacacacacagttaagctggattctatcctgcatggttcgcctgccacggcttcagcatcttcatcaatggaaggccaaaacgactaagcaaaaacacgacggtactgtgggactactaacttatcccgtgctccaggcagccgatattctcctgtacaaaagcacacatgtgcctgttggagaggatcaggttcaacatatggagctggtgcaggacctcgctcaggggtttaataagaagtacggagaatttttccctgtacccgagtctatcctgacgtccatgaaaaaagttaagtctctgcgggatccttctgccaagatgtcaaagagcgaccctgataagctcgctactgtgagaatcaccgatagcccagaggagatagtgcaaaaattccgcaaggcagttactgatttcacttctgaagttacctatgaccctgccggaagagccggcgtgagcaatatcgttgctgtccatgccgcagtgacgggtctgtctgttgaggaagtggtcagaagatcagccggcatgaacacagccaggtacaaactggcggtcgcggacgcagttatcgagaagtttgccccaattaagagggaaattgagaagctgaagctcgacaaggaccacttagaaaaagttctacagatcggctcagctaaggctaaggaactggcctacacggtctgtcaggaagttaaaaaactggtgggatttctgtag

SEQ ID NO: 139210 - DNA, 663 bp, Artificial Sequence
  Description of Artificial Sequence: Synthetic coding sequence
atggccctccactcaatgcggaaagcccgcgagaggtggagttttattcgagctctgcataagggttccgccgctgcccctgccctgcagaaggattcaaagaaacgggtgttttccggtatccagcctacaggcattttgcatctgggcaattatttgggtgccatagaaagttgggtccgcctgcaggacgaatacgactcggtcctttattcaatcgtggacttgcacagcataacagttccccaggatccagccgttttgcggcaatcgatcctcgacatgacggccgtcctgctggcttgcggtataaatcccgaaaaatccatcctattccagcaatcccaagtaagtgaacatacacagctgagttggatcttaagctgtatggtgcgacttcccaggcttcaacatctacatcaatggaaggctaagaccaccaagcagaagcatgatgggactgtgggactgctcacatatcctgttctccaggccgccgacatccttctgtacaagtctactcacgttcccgtgggcgaggatcaggttcagcacatggagctggtgcaagatctcgctcagggctttaacaagaagtacggagagttctttcccgttcctgaaagtattctgtcaatgtgtgtgctggttttccttacttag

SEQ ID NO: 139211 - DNA, 801 bp, Artificial Sequence
  Description of Artificial Sequence: Synthetic coding sequence
atgaccgccgtgctcctagcttgcggcattaatcctgaaaagtctatcctgtttcagcagagtcaagtgagtgagcacacgcagcttagttggatcctatcctgcatggtcagactgccaaggctccaacaccttcatcagtggaaggccaagacaactaagcaaaagcatgacggaactgtagggttgttgacatacccagtcctgcaggcagctgatattcttctgtacaagtctacgcatgtgcctgttggggaagatcaggtccagcacatggagctggtgcaagacctggcgcagggtttcaacaaaaaatacggcgagttttttcccgttccagagagcattctgacttccatgaaaaaggtcaaaagcttgagagacccatcagctaaaatgagcaagagtgaccctgataagctcgcaactgttcggattaccgactctcccgaagaaatcgtgcagaagtttaggaaagcagtcaccgacttcacaagtgaggttacttatgaccctgccgggcgggcgggagtctctaatatcgtagccgtacatgccgctgtcacggggctgagtgtagaagaggtggtccggcgctcagccggaatgaacactgctcggtacaaattggctgtggccgatgctgtgatcgagaagttcgccccaatcaaaagggaaatcgaaaagttgaaattggataaagatcatctggagaaagttctgcagattggatccgcgaaagccaaggaacttgcttacacagtgtgtcaagaggtcaaaaaactggttggtttcctgtag

SEQ ID NO: 139212 - DNA, 1293 bp, Artificial Sequence
  Description of Artificial Sequence: Synthetic coding sequence
atgcttgtctcattaaagatgagttacaaagccgccgcaggtgaggattataaggccgattgcccccctgggaaccccgccccaacgtcaaaccacggccccgatgcaacagaagccgaagaagattttgtcgacccgtggaccgtgcagacaagcagcgcaaaaggcatcgactacgataaactcattgtccgattcggctcttctaaaattgacaaagagttgatcaaccgaatcgaaagggctactggacaacgccctcaccactttctacggagaggaatcttcttctcccatcgggatatgaaccaggtgttggatgcctacgaaaacaaaaaaccattctatttgtacacaggaaggggtccttcaagcgaggctatgcacgtcgggcacctcattccattcattttcaccaaatggctgcaggatgtctttaatgtgccgttagtcatccaaatgactgacgacgaaaaatacttatggaaagatcttaccctggaccaggcctactcttacgcagtggagaacgccaaggacattattgcctgcggtttcgatataaataaaacatttatcttttccgaccttgattatatgggcatgtcgtctggcttctataaaaacgtggttaagatccagaagcacgtaacctttaatcaggtgaaggggatcttcggctttactgattcagattgtatcggcaagatttctttccctgccatccaggctgcgccaagtttctctaacagctttccacagatcttcagggacagaacagatattcaatgtctgataccctgtgccatcgatcaggacccctactttcgcatgacacgagacgtggctcccagaattggatatcccaaaccggcactgctgcacagtacgttctttccagctctgcagggcgcccaaacgaagatgtccgcgagtgaccctaactccagcatttttttaaccgatactgccaaacaaatcaagacaaaggtcaataaacatgcgttttccggaggcagagatacaattgaggagcacaggcagttcggcgggaattgcgacgttgacgtgagctttatgtatcttacattcttccttgaggatgatgataaactagagcagatccggaaagattacacaagcggagctatgctgaccggagagttaaagaaggcgttgatcgaggtgctgcagcctttaatagccgaacaccaggctaggcgcaaagaagtcacggatgagattgtcaaagagtttatgactccaaggaaactctccttcgactttcagtag

SEQ ID NO: 139213 - DNA, 1416 bp, Artificial Sequence
  Description of Artificial Sequence: Synthetic coding sequence
atgccgaacagtgaacccgcttcactcttggagctcttcaacagcattgctacgcagggagagctggtccgaagtctaaaggcaggcaacgcctccaaagacgagatagacagtgctgtcaaaatgttagtgtctctcaaaatgtcttacaaggcagccgccggtgaagactataaagcagactgccctccgggaaacccggctccaacatcaaatcatgggcctgacgcaaccgaggctgaggaggatttcgtggacccatggacagtacagacttcctctgcaaaaggtatcgactatgacaagctgattgtcaggtttggtagctctaaaattgacaaggagttaatcaacagaatcgagcgcgcaaccgggcagcgaccgcaccactttctcagaagagggatctttttttcccaccgcgatatgaatcaagttctggacgcgtatgagaataaaaaacccttttacctgtatacaggtcggggcccttctagcgaggccatgcacgtggggcatctcataccctttatttttactaagtggctacaggatgtatttaatgttcctcttgttatccagatgaccgacgacgagaaatatctctggaaggatctaaccctggatcaggcctattcgtacgcagtggagaacgcaaaagacatcatcgcgtgtggcttcgatattaacaaaacattcattttctcagatctagactatatgggaatgtcatctggcttttataaaaacgtggtgaagatccaaaagcacgtaaccttcaatcaggtcaagggcatattcggattcacggacagcgattgcatcggcaaaatcagctttcccgccatacaggccgcgcccagttttagcaactccttccctcaaatatttcgggatcgtactgatatacaatgcctcattccctgcgcgattgatcaggatccttattttagaatgacccgggacgtggcaccgcgaataggctacccgaagcctgccttgctacacagcaccttctttcctgcactgcagggagcacagactaaaatgtccgcatcggacccaaatagtagtattttccttaccgacacggccaagcagattaaaactaaggtgaacaaacatgctttcagcggcggtagagacaccatcgaggaacacagacagttcggagggaattgcgacgtcgatgtcagctttatgtatttgactttctttctagaggacgacgacaagctggaacagattcggaaagactacacatccggcgccatgttaacaggtgagctgaagaaggctctgattgaggtgctgcaaccactaattgccgagcatcaggcacgacgaaaagaggtgactgatgagatcgtgaaggagtttatgactcccagaaagttaagtttcgacttccagtag

SEQ ID NO: 139214 - DNA, 1293 bp, Artificial Sequence
  Description of Artificial Sequence: Synthetic coding sequence
atgctggtcagtctgaagatgtcatataaagctgccgccggcgaggattacaaggccgattgtccaccaggcaaccccgcccccactagtaatcacggaccggacgcaacggaggccgaagaggatttcgtggatccttggaccgtgcagacatccagtgcaaaaggaatcgattacgataaactgatcgtcaggtttgggagttccaaaattgataaggaactgataaaccggatcgagagagcgacgggtcagcgtccgcaccatttcctgagaagagggatattctttagtcacagggatatgaaccaggttctcgacgcttatgagaataagaaacctttctacttatatactggcaggggacccagctcggaagccatgcacgtgggacacctgattccttttattttcaccaagtggcttcaggacgtcttcaacgttcctctggtcatacagatgaccgatgatgaaaaatatctctggaaggacttgaccttagatcaggcctatagttacgctgtcgagaacgccaaggacatcattgcatgtggattcgacataaataaaacatttatcttctcagaccttgattacatggggatgtcttctggcttctataagaatgtggtgaagattcagaaacatgtgacattcaatcaggttaaaggcatcttcggcttcacggactcagattgtatcggaaaaatttcattccccgcaatccaagccgctccgagcttttcaaactccttccctcaaatatttcgagaccggactgacatacagtgcttgattccttgtgctattgaccaggatccctactttcgaatgactagggatgtggcccctcgcatcggatatcctaaaccagcgctgctgcacagtaccttttttcctgctctacaaggagcgcagacaaagatgagcgcctcagatccgaattcatccatttttctgaccgatactgcaaaacaaattaaaacgaaagtgaataagcacgctttttccggtgggcgggataccattgaggaacatcggcaatttggtggcaactgtgacgtggacgtatcatttatgtatctaacgttcttcctcgaggacgacgataagctcgaacaaattagaaaagactatacaagcggggcaatgttaactggtgagctgaagaaggccctgattgaagtcttgcagccccttatcgccgagcatcaggccagacgcaaggaagttactgatgagattgtgaaggagttcatgacccctcggaagttatcttttgactttcagtag

SEQ ID NO: 139215 - DNA, 1416 bp, Artificial Sequence
  Description of Artificial Sequence: Synthetic coding sequence
atgcctaactccgaaccggcatcattgctggaactgttcaattccattgcgactcaaggcgagttagtgagaagcctgaaggcaggaaacgcatctaaggatgagatcgattcagccgtaaaaatgctagtgagcctgaaaatgtcctataaggccgcagccggagaggactataaagctgactgccctccaggcaacccagcacccacgtccaatcacggacctgatgctactgaagcggaggaagactttgtcgacccttggactgtccagacaagttccgccaagggtattgactatgacaagttgattgtgcgtttcggcagtagcaagatcgacaaagagctaattaatcgcatcgaacgcgcaacagggcaacgcccacaccacttcttaagacgtggcatatttttttcacatcgggatatgaaccaagtgctcgacgcttatgaaaataaaaagcctttctacctgtacacggggaggggccccagcagtgaggccatgcatgtcggtcacctgatcccattcattttcacaaagtggttacaggacgtgtttaatgttccactcgtgatccagatgactgatgatgagaagtacctttggaaggacttgacgttagaccaggcttacagttacgccgtggaaaacgcgaaagacattatagcctgcggtttcgatattaataaaacctttattttctctgacctcgactacatgggcatgagctccggcttttacaaaaacgtggtaaagatacaaaaacacgtgactttcaatcaagtgaaggggatttttgggttcacggatagcgattgtatcggcaagattagcttccctgctattcaggctgcacccagtttctctaattcctttccacagatctttcgagaccgaacagacattcaatgccttattccttgcgccatcgaccaggacccttactttcggatgaccagggatgtggccccccgtattggctatccaaagcctgccctgttacactccacattctttccggccctgcagggagcccagactaaaatgtcagcctctgacccaaactcaagtatatttctgactgatactgctaaacagattaaaactaaggtgaacaagcacgcattcagcggaggccgtgacacaattgaagaacatcgccaatttggcggaaattgcgatgtcgacgttagctttatgtacttgacattttttttggaggatgatgacaagttagaacagatcagaaaagactatacctcgggggctatgctgactggtgagttgaaaaaggcgctgatagaggtcctacagccccttatcgctgaacatcaagcccgacgcaaagaagtgaccgatgaaatcgtcaaggaattcatgactccccgaaagctttctttcgattttcagtag

SEQ ID NO: 139216 - DNA, 684 bp, Artificial Sequence
  Description of Artificial Sequence: Synthetic coding sequence
atgttggtctcactgaagatgagctataaggccgctgctggcgaagattataaggcagattgtccacccggcaaccctgctcctactagcaatcacggacccgatgccacagaggccgaggaagactttgttgatccctggaccgtacagactagtagcgccaagggcatcgattacgacaagctcattgttcgttttggatcttccaagatcgataaagagctgataaaccgcattgaacgggccactgggcaacggccacaccatttcttgcggcgaggtattttcttcagtcacagggacatgaaccaggtgcttgatgcatacgagaataagaaaccattttatctttacaccggacgggggccttcatccgaggccatgcacgtggggcacctcatccccttcatctttaccaaatggttgcaggacgtttttaacgtacctttggtgatccagatgacagacgacgaaaagtacctgtggaaagacctgacccttgaccaggcgtacagctacgccgtcgaaaatgccaaggacatcattgcttgtggtttcgacataaacaaaacgttcatattctctgacctggactacatgggaatgagttctggattttacaaaaacgtggtcaaaatccagaaacacgtgaccttcaaccaggttaaagggatctttggatag

SEQ ID NO: 139217 - DNA, 324 bp, Artificial Sequence
  Description of Artificial Sequence: Synthetic coding sequence
atgccgaactccgaaccagctagtctcctggagctttttaatagtatcgccacccaaggcgagttagtgcgatcccttaaggctggaaatgcttctaaggatgagatcgacagtgcagtaaagatgctggtttcactcaagatgtcatataaggcggccgcaggggaggactataaagcagattgccctccaggcaatccggcaccaactagcaaccacggaccggacgcaacggaggccgaggaagacttcgtggatccttggaccgtccaaacatcgtcggctaaagggatagactacgacaagctgatagtgcggttttag

SEQ ID NO: 139218 - DNA, 453 bp, Artificial Sequence
  Description of Artificial Sequence: Synthetic coding sequence
atgcccaacagcgagccggccagcctgcttgagttgttcaactctattgccactcagggtgagctggtgcgctccttaaaggctggtaacgcctccaaggatgagatcgactccgcagtgaaaatgctggttagcctgaagatgagctataaagcagcagccggagaagactataaggctgattgcccgcccggcaaccccgcgccaacatcaaatcatggccctgatgccacagaagctgaggaagatttcgttgacccttggactgtccaaacatcttctgccaagggcatcgactacgataagctgatcgtgcgatttggttcatcaaaaattgacaaggaactgatcaacagaattgaaagagccactggccagcggccacaccattttctgcggcggggaattttcttttcccaccgggatatgaatcaggtgttggatgcttactag

SEQ ID NO: 139219 - DNA, 294 bp, Artificial Sequence
  Description of Artificial Sequence: Synthetic coding sequence
atgccaaattctgaacctgcgtctctgctcgagctgttcaattccattgccacccagggggagctggtcaggagtttaaaggctggcaatgcctctaaggatgagattgacagtgcggtgaagatgcttgtgagcctcaagatgagctacaaagcagctgctggggaggactacaaggctgactgtcctcccgggaacccagcacctaccagcaaccacggaccagacgctactgaggctgaggaagatttcgttgatccctggacggtccagacaagctccgccaaaggatag

SEQ ID NO: 139220 - DNA, 81 bp, Artificial Sequence
  Description of Artificial Sequence: Synthetic coding sequence
atgccaaatagcgaacctgcaagcctgctggaactgttcaatagtattgccactcagggcgagttggtgagaagtctgtag

SEQ ID NO: 139221 - DNA, 318 bp, Artificial Sequence
  Description of Artificial Sequence: Synthetic coding sequence
atgccaaacagcgagccagcctcgctgctcgagcttttcaacagtatagctactcagggcgaactcgttcgaagtctgaaggcaggaaatgcctccaaggatgagatcgatagcgcagttaagatgctggtatctctaaagatgtcttacaaggcagcagctggggaagattataaagctgactgccctcctgggaaccccgcccccacttctaatcatgggccagatgcaaccgaggctgaggaggattttgtggacccgtggaccgtacagaccagcagcgctaagggcatcgactatgataaactgatagtgtag

SEQ ID NO: 139222 - DNA, 102 bp, Artificial Sequence
  Description of Artificial Sequence: Synthetic coding sequence
atgcccaactccgagcccgccagcctgctggagctgtttaatagtatcgccacccagggagagctcgttaggtctcttaaagccggtaatgctagcaaatag

SEQ ID NO: 139223 - DNA, 207 bp, Artificial Sequence
  Description of Artificial Sequence: Synthetic coding sequence
atgcctaactcagagccagcttcactgctggagctatttaactccattgcgacacagggagagctagtacggtctctgaaagcaggcaatgcttctaaagatgagatcgattccgctgttaaaatgctggtctcactgaagatgagctacaaggccgccgctggagaagactacaaagcagactgtccacccgggaatccagcatag

SEQ ID NO: 139224 - DNA, 375 bp, Artificial Sequence
  Description of Artificial Sequence: Synthetic coding sequence
atgccaaacagtgagcctgcatccttacttgaactcttcaatagcatcgcaactcagggggagctcgtgaggagccttaaggcaggcaatgccagtaaggacgagatcgattctgcagttaaaatgttagtcagtttgaaaatgtcgtacaaggccgccgcaggagaagactataaagcagattgcccacccggtaacccggcgcccacttctaatcacgggcccgatgctactgaagctgaagaggacttcgtagacccgtggaccgtccagacatccagcgccaaaggaatagactatgacaaactgatcgtgagatttggttctagcaagatcgataaggaacttatcaacagaatcgagagagcgacatag

SEQ ID NO: 139225 - DNA, 261 bp, Artificial Sequence
  Description of Artificial Sequence: Synthetic coding sequence
atgccgaatagcgaacctgcttcactgttagagttgttcaatagtatcgccacacaaggggagctggtgcgctcactcaaggcgggaaacgcctctaaggatgagatcgatagtgctgttaagatgctggtgtctctgaaaatgtcttataaagcagccgctggtgaggactacaaggccgactgtccgcctgggaatcccgctcccacgtcaaatcatggccctgatgccacggaggctgaggaggatttcgtggattag

SEQ ID NO: 139226 - DNA, 168 bp, Artificial Sequence
  Description of Artificial Sequence: Synthetic coding sequence
atgcctaactcggagccggcctcattattggagttattcaatagcattgcaactcaaggagaacttgtgcgcagcttgaaagcaggaaacgctagcaaagacgagatcgactctgcggtgaagatgttggtatctctgaagatgagctacaaagcagccgctgggtag

SEQ ID NO: 139227 - DNA, 192 bp, Artificial Sequence
  Description of Artificial Sequence: Synthetic coding sequence
atgcccaattccgagcccgcgagcctgctcgagctgttcaattcgatcgccacgcagggcgagctggttcgtagtctgaaggccggaaacgcgtccaaggatgagatcgattccgccgtgaaaatgttggtgagcctgaagatgagctataaggcagctgccggtgaagactacaaggccgactgcccatag

SEQ ID NO: 139228 - DNA, 213 bp, Artificial Sequence
  Description of Artificial Sequence: Synthetic coding sequence
atgccaaactccgaacctgcttcacttttagagctcttcaacagtattgcaactcaaggcgaactggtgcgctctttaaaggcagggaacgcctccaaggatgagatcgacagcgccgtcaaaatgcttgtgagtctgaagatgagctataaagccgcagcgggcgaagattacaaagcagactgcccacccggtaaccctgccccaacatag

SEQ ID NO: 139229 - DNA, 177 bp, Artificial Sequence
  Description of Artificial Sequence: Synthetic coding sequence
atgcccaattctgagcccgcgtccctgcttgagctgtttaacagtatcgctacacagggggagctcgtccgaagtttgaaagccgggaacgcatctaaggacgaaattgactcagcggtcaagatgctggtttctcttaagatgtcctataaggccgccgcgggggaggattattag

SEQ ID NO: 139230 - DNA, 423 bp, Artificial Sequence
  Description of Artificial Sequence: Synthetic coding sequence
atgctggtttccctcaagatgagctacaaagcagcagccggagaggattacaaggctgattgccctcctggcaaccctgcacccacatctaaccacggccccgatgctaccgaggccgaagaagacttcgtcgatccgtggacagtgcagacctctagcgccaagggaatagactatgataagctcatcgtcagattcggctctagcaaaatagataaggaactcattaatcgcatcgagcgggccactggccagagaccccaccacttcctgcggaggggcatttttttctctcaccgagacatgaatcaagtattagacgcctacgagaataagaagcctttctatctttacacaggcagaggcccctcgagcgaagccatgcatgtgggccatctgatcccattcatatttaccaagtag

SEQ ID NO: 139231 - DNA, 462 bp, Artificial Sequence
  Description of Artificial Sequence: Synthetic coding sequence
atgctggtttcattgaaaatgagctataaagctgccgctggcgaggactacaaagctgattgccctcctggcaaccctgccccgacgtccaaccatggacctgacgccaccgaggctgaggaggactttgtggatccttggactgtgcaaaccagcagtgctaaaggtattgattacgataagctgatcgttcgcttcgggtcttccaaaattgataaggagctcatcaatcggatcgaacgggcaacaggacagagaccccaccattttctgagaagaggtatttttttctctcaccgggatatgaaccaggtgcttgacgcgtacgaaaacaagaagccgttttacctctacacaggacggggacctagctcagaagccatgcacgtcggacatctgatccccttcatcttcaccaagtggcttcaggacgtatttaacgtaccgctggtcattcagtag

SEQ ID NO: 139232 - DNA, 675 bp, Artificial Sequence
  Description of Artificial Sequence: Synthetic coding sequence
atgctcgtctcacttaagatgtcctacaaagctgctgccggggaggattacaaggcagactgtccgcctggcaaccctgccccaacgtccaaccatgggccagacgccaccgaagccgaagaggattttgttgatccctggacggtgcagaccagcagcgccaaggggatcgactatgacaaactcatcgtccgttttggctcgtccaagattgacaaagaactgattaataggatcgagagagcaacagggcagcgtccccaccacttcttgcgtcgcgggatattcttttcccaccgcgatatgaatcaagtgctggatgcttacgaaaacaagaagccattctatctctacaccggccggggaccctcctctgaggctatgcatgtggggcacctgattccattcatctttacaaagtggctccaggacgtgttcaatgtgccccttgtcatccagatgacagacgatgaaaagtacctgtggaaggacctgaccctcgatcaggcatatagctatgcagtcgagaacgctaaggacatcatcgcatgtggatttgacatcaacaagacatttatctttagcgatcttgattacatggggatgtctagtggattttataaaaatgtcgtgaagatccagaagcatgtgacatttaaccaggtgaagggctag

SEQ ID NO: 139233 - DNA, 1293 bp, Artificial Sequence
  Description of Artificial Sequence: Synthetic coding sequence
atgctggttagcctcaaaatgtcctataaagccgccgcaggggaggactataaggcggactgtccgccaggaaaccccgcaccgacttccaaccacggaccagacgccacagaggcagaagaggattttgtcgacccttggactgtccagacttcctcggcaaagggcatcgactatgataaactgattgtgcgatttgggtcttccaagatcgacaaggagctgattaaccgcatagagcgagcgaccggccaaagaccccaccactttctgcgacgtgggatctttttttcgcacagggatatgaaccaagtactggacgcgtacgagaataagaagccattttatctttatactggtcgcgggccaagttccgaagcgatgcacgtcggacatttgatcccttttatttttacaaagtggctgcaggatgtgttcaatgtgcccctagtgatccagatgaccgatgacgagaaatatctctggaaggaccttactttggatcaggcctattcctacgccgtagaaaacgctaaggatatcattgcctgcggttttgacattaataaaacattcattttcagcgacttggactacatgggtatgtcctctggcttctacaaaaacgttgtaaagattcagaaacatgtcacctttaaccaggtgaaggggattttcgggtttacagactcggattgcataggaaaaatctcttttcctgccatacaggctgccccctccttcagcaactccttcccacagatattcagggatcggacggatatccaatgcttaataccatgtgcaattgaccaggacccatactttcgtatgacccgagatgtcgcaccacggattggttacccaaagcctgctctgctgcactcaaccttttttcctgctctacaaggggcccagacaaaaatgtccgcctccgatcctaattcatcaatatttttaaccgacacagccaagcagattaaaacgaaggtcaacaagcacgcctttagtggcggaagagataccatcgaagagcaccgtcagttcggcggcaattgtgacgttgatgtgagcttcatgtacctaaccttctttttggaggatgacgacaagcttgagcagatccgcaaagattacacttctggcgccatgctgaccggcgagcttaagaaggccctcattgaggtgttgcagcccctgatcgccgagcaccaggcccggcgaaaggaggtcacagacgaaatcgtgaaggaattcatgaccccacgcaagctgtcgtttgacttccagtag

SEQ ID NO: 139234 - DNA, 345 bp, Artificial Sequence
  Description of Artificial Sequence: Synthetic coding sequence
atgccaaactcagaaccggcctctctgttagaactgtttaattctatagctacccagggggagctggtcagaagcttaaaggcgggcaatgcttccaaggatgaaatagattcagccgttaaaatgctggtgtcactgaaaatgagctataaggcggccgctggagaagactacaaagctgattgtccacccggtaaccctgctccaacttcaaatcacggacctgatgcaacggaggcggaagaggattttgtggatccgtggactgtccagacctctagtgccaaaggaatagactacgacaagcttatcgtccgttttggctcttcgaagatcgacaaatag

SEQ ID NO: 139235 - DNA, 177 bp, Artificial Sequence
  Description of Artificial Sequence: Synthetic coding sequence
atgccaaacagcgaacctgccagcctgctcgaactgtttaactccattgctactcaaggtgaattggtgagatctctgaaggccgggaacgccagcaaagatgagatagattcagctgtaaagatgctggtgtcgctcaaaatgagctacaaggcagcggcaggcgaagattattag

SEQ ID NO: 139236 - DNA, 459 bp, Artificial Sequence
  Description of Artificial Sequence: Synthetic coding sequence
atgccaaactcagagcccgccagcctgctagaattgttcaactccatagccacacagggcgagctcgtgagaagtctgaaagcgggaaatgcgagcaaagatgaaatagactccgcagtaaaaatgcttgttagcctgaagatgtcatataaagcagctgcaggtgaagattataaggcagactgtccaccagggaaccctgcacctacctccaaccacggcccagatgccacagaagccgaggaggattttgtggacccatggactgtacaaaccagttcagcgaaaggcattgactacgataaactgatcgtgaggttcggctcatctaagattgacaaggagctgatcaatcgaatcgagcgcgccacaggccagagacctcatcattttctgcgaaggggcatcttcttctctcatcgcgacatgaaccaagtgttagacgcctacgagaactag

SEQ ID NO: 139237 - DNA, 1416 bp, Artificial Sequence
  Description of Artificial Sequence: Synthetic coding sequence
atgcccaatagcgagccagcttctctgttggaactctttaattctattgctacacaaggagaactggtgcgaagcttaaaagctgggaacgcgagcaaagacgagatagactcagcagtcaaaatgcttgtgagcctcaaaatgagttacaaagctgctgcaggcgaagattacaaagccgattgtcctcccgggaacccagcacccactagtaaccatggccccgatgccaccgaagccgaggaggatttcgtagatccttggactgtgcagacgagctccgctaagggtatagattacgataagctaatagtcagatttggatcctcaaaaatcgacaaagagcttattaaccggatcgagagggcaaccggacaacggcctcaccacttcctgcggagagggatctttttttctcaccgcgacatgaatcaggtcctggatgcctacgaaaataagaagcccttttacctatacaccggacggggaccgtcctccgaggccatgcacgtcgggcatctgattccgttcatattcaccaagtggctacaagatgtgttcaacgtgcccttggtcatccagatgacagatgacgaaaagtacctatggaaagatctgacactagatcaggcctacagctatgcggtcgagaacgccaaagacattatcgcatgtgggttcgacattaataaaacctttatctttagcgaccttgattatatgggcatgagctccggtttttacaaaaatgttgtgaagattcagaaacatgtgaccttcaatcaagtgaaagggatcttcggctttaccgattcggactgtatcgggaagattagcttccccgccattcaggcggcccctagtttctctaattctttcccacagattttcagggacagaacagacatccaatgcctgatcccttgtgctattgatcaggacccctacttccgaatgacgagagatgtggcgccccgaattgggtaccccaagcctgccctccttcacagcacgttttttcctgctctccagggggcgcagactaaaatgagtgcatctgatccaaactctagtatttttttgactgacacggctaaacaaataaagaccaaggtcaataagcatgcctttagtggaggaagggacaccatcgaggagcaccgccagtttggaggcaactgcgatgtggatgtgtcatttatgtacctgacatttttcctcgaggacgatgacaagctggaacagatccggaaagattatacaagcggggccatgctgactggcgaactgaaaaaagcactgattgaagtgctgcagccgcttatcgccgagcaccaagctaggcgcaaggaggtgaccgatgaaatcgtaaaggagttcatgacaccacggaaactgtcctttgactttcagtag

SEQ ID NO: 139238 - DNA, 465 bp, Artificial Sequence
  Description of Artificial Sequence: Synthetic coding sequence
atgctggtgtcgcttaaaatgtcctataaagcagcagccggcgaggattacaaagcagattgtcctcctggtaaccccgctccaacctcgaaccacggtcccgatgccaccgaggcggaggaagatttcgttgacccctggaccgtgcagacctccagcgcaaaggggatagattatgataaactgatcgtgcggttcggcagttcaaagattgataaggagcttattaatagaatagagcgcgcaacagggcaacggccgcaccatttcctgcggagaggtatttttttttctcacagagatatgaatcaggtactggacgcttacgaaaataagaaaccattctacctctacacaggaagaggcccttcttcagaggcaatgcatgtcggccatcttattccattcatctttactaagtggctacaagacgtgtttaatgttcccctggtgatccagatgtag

SEQ ID NO: 139239 - DNA, 639 bp, Artificial Sequence
  Description of Artificial Sequence: Synthetic coding sequence
atgcctaattcagagccagcatctttgttggagttgttcaactctatcgccacccagggggaattagtgcgatccctgaaagctgggaacgcatccaaggacgagatcgactctgctgtgaagatgctggtgtccctgaaaatgtcatacaaagccgccgctggcgaggattataaagcggattgcccaccggggaaccccgcgccaacatcaaatcatgggccagacgccaccgaagccgaggaggattttgttgacccttggactgtgcagacgtcatccgccaaagggattgattacgataagctgattgttcgtttcgggtcttccaaaatcgataaggagctgatcaaccggatagagagggcgacaggacagcgtccgcatcactttctccgacggggcattttcttttcccaccgagatatgaatcaggttcttgacgcatacgaaaataagaaacctttttacctgtacacagggaggggccctagctcagaagcaatgcacgtgggacacttgataccattcatatttacaaaatggctccaggacgtcttcaatgttcctctggttatacaaatgactgacgatgagaagtatctgtggaaggacttaaccctggaccaagcttattag

SEQ ID NO: 139240 - DNA, 1041 bp, Artificial Sequence
  Description of Artificial Sequence: Synthetic coding sequence
atgagcttactgcggagcctcagagtctttctcgtcgcccggaccggttcctatccagccgggagccttctgcggcagagtccacagcctaggcatactttttacgcaggcccacgcctctctgcctctgctagttccaaagaactgcttatgaagctcaggagaaagacaggctactcgtttgtgaactgtaagaaagccctggaaacctgcgggggcgacctcaaacaggctgaaatctggctacataaagaggcgcagaaggaggggtggtccaaggctgctaaactgcaggggcggaaaacaaaagagggcctcatcggactcctccaggaaggaaatacgaccgtactggtcgaggtgaattgcgaaactgacttcgtctccaggaacctcaaatttcaactgctagtccagcaagtcgctctgggcactatgatgcactgtcagaccctgaaggatcagccaagcgcatattctaaagtgcagtggctgactccagtcaaccttgccctgtgggaagcagaggcaggagggtctctggagggtttcctgaacagcagtgaactttctggtctgccagccgggcctgatcgagaaggatccctgaaggatcaactggccctggccatcggaaaacttggagagaacatgatactcaagcgtgccgcgtgggttaaggttccaagtggcttctatgtcggcagctatgtacacggtgcaatgcagtccccttcgcttcacaagcttgtcctggggaaatacggtgctttggtgatttgtgaaacgagcgaacagaagacaaacttggaggatgtggggcggaggttagggcagcatgtggttgggatggcgcctctgtccgttgggtcattggacgatgagcctggaggtgaagcggagaccaaaatgctttctcagccttatctgcttgacccaagtatcacactgggccagtatgtgcagccccagggggtgtcggtcgtcgactttgtgagatttgagtgtggcgagggagaggaagccgccgaaactgagtag

SEQ ID NO: 139241 - DNA, 858 bp, Artificial Sequence
  Description of Artificial Sequence: Synthetic coding sequence
atggtctactgtactaccacttgggcgatctggaactgccaattactcctgggctacaaacctcttcagaacgtcacaggactcaacacagtgggaagctgtaatactgtggccgagatctggctgcataaagaggctcagaaagagggatggtcaaaagccgcgaaactccagggacggaaaacaaaggaggggttaattggcttgttgcaggagggcaataccacggtgctagtggaagtgaattgtgagactgactttgtgagtagaaacctgaagttccagcttctggtgcagcaggtggcactcggcaccatgatgcattgccagacactaaaggatcagccgtccgcttactccaagggctttctgaattcctctgaactgtcaggcctcccagcaggtcctgaccgcgagggaagtctgaaagaccagttggcactggccattggcaaattgggggagaacatgatccttaaacgggccgcttgggtgaaagtaccatcaggcttctacgtgggctcctacgtacatggagccatgcaatcccccagcctgcataaattggttcttggaaagtacggcgcgctggtgatctgtgaaacgtcagagcaaaaaactaacctcgaagacgtgggcaggcgcctgggccagcacgtagtgggaatggcccctctcagcgtgggctctctggatgacgaacctggcggagaggcagagaccaagatgctgagccagccctacctgctagacccttctatcaccctgggccagtacgtgcagccccagggtgtgtcagtggttgactttgtgcgtttcgagtgcggcgaaggggaggaggctgcagagacagagtag

SEQ ID NO: 139242 - DNA, 978 bp, Artificial Sequence
  Description of Artificial Sequence: Synthetic coding sequence
atgtcattgttgaggtctctacgggtgttcctggtcgctcggactggttcttatccagctggttcactgttgcgacagtcccctcagccgcgccacaccttttacgccggcccccggctctctgctagcgcctcctcaaaggagctgctcatgaaactccgtagaaaaacgggctattcttttgtgaattgcaagaaggccctcgagacatgcggtggggatctgaagcaagctgaaatctggcttcacaaagaggcccagaaggaaggctggtccaaagccgccaagttgcaaggtcgaaagacgaaggaaggcctaattggccttctgcaggagggcaatactactgtgctcgtcgaagtgaattgcgaaaccgacttcgtctcacggaacctgaagttccagcttcttgtccagcaggtcgctttggggacaatgatgcattgtcagaccctcaaggatcagcctagcgcctacagcaaggggtttttgaattctagcgagctaagcgggctccctgcgggccctgaccgggaagggagcctcaaagaccagttggcactagctataggtaagttgggcgaaaacatgatcttaaaaagagcggcttgggttaaggtccctagcggcttctacgtgggatcttatgtgcacggagccatgcagagccctagcctgcataagttggttctgggtaagtatggcgcccttgtgatctgcgagacctccgagcagaagactaaccttgaggacgttggaaggaggttgggacaacacgtggtgggcatggcacctcttagcgtggggtcattggacgatgagcccggaggcgaagcagagactaagatgttaagccagccttacctattggatccgtcaatcacacttggacagtacgtccaaccccaaggggtgtccgttgtagactttgtccgctttgaatgtggagagggtgaggaagcggcagaaaccgaatag

SEQ ID NO: 139243 - DNA, 504 bp, Artificial Sequence
  Description of Artificial Sequence: Synthetic coding sequence
atgtcattactgcggtctttgcgcgtctttctagtggctaggacagggtcctatcccgcgggatccctgctgcggcaatctcctcagccccgccatacattctacgcaggcccacggttatcagccagcgctagtagcaaggaactccttatgaaactcagacggaaaacaggatattctttcgtgaattgtaaaaaggcccttgagacatgcgggggcgacctcaagcaagctgaaatctggctccacaaggaggcacagaaggagggctggagtaaggccgcaaaactgcaggggcggaagaccaaagaaggacttataggactgctgcaggagggcaatactaccgtcctggtggaggtgaactgcgagacagatttcgtttcgcggaacttgaaattccagctccttgttcaacaggtcgccttggggacgatgatgcactgccagacactgaaggaccagcctagcgcttactctaaagaaaactgggaaaagacctag

SEQ ID NO: 139244 - DNA, 648 bp, Artificial Sequence
  Description of Artificial Sequence: Synthetic coding sequence
atgagtctgttgagaagccttagagtgttcctggtcgcaagaacagggagttatcccgcaggttctctgctgagacaaagcccgcaaccccgacatacattctacgctggtcccagactgagcgcctcagctagtagcaaagagctgctgatgaagctgaggaggaaaactgggtatagctttgtgaactgcaaaaaagccctcgaaacctgtggcggcgatctcaaacaggctgaaatctggcttcacaaagaagcacaaaaagagggatggtccaaggctgccaagcttcaaggcagaaagactaaagaggggcttattggccttctacaggaggggaatacgactgtgttggttgaagtgaattgcgaaacagatttcgtaagccggaacctgaagtttcagcttcttgtccagcaagttgccctcgggaccatgatgcattgtcagacgctgaaggatcagcctagcgcttactctaagggattcctcaattcttcggagctaagtggactccctgccggccccgacagggaaggatccctgaaggaccaactcgctttagccattggacttccttttcagattggcgccgtctcagaacttcagctcccagaatcaaacttccttcagaatacttcaagttag

SEQ ID NO: 139245 - DNA, 435 bp, Artificial Sequence
  Description of Artificial Sequence: Synthetic coding sequence
atgaaatcccagtggtgcaggcccgtggcgatggacttgggcgtgtatcagctccgccacttttctataagtttcttgtcctcactactcggcacggagaacgcttccgtgcggctagacaactcaagcagcggagcatccgtggtcgccattgacaataagattgagcaggctatggatctggtcaagtcccatcttatgtatgcggtgcgcgaggaagttgaagtgctcaaagaacagatcaaagagttgatcgagaagaacagccagctggagcaagagaataacctgcttaagactctggctagccccgagcagctcgcccagttccaggcgcagctgcagacaggtagcccgccagctacgactcaaccgcaaggcacaacccaacccccagcccagcctgccagccaaggctctggcccaacagcatag

SEQ ID NO: 139246 - DNA, 3222 bp, Artificial Sequence
  Description of Artificial Sequence: Synthetic coding sequence
atgcaccagccgcctgagtctaccgctgctgccgccgctgccgcggacatttccgcccggaaaatggctcaccccgccatgtttcctcgcagaggaagtggaagtggaagcgcctccgctctgaacgccgccggtaccggggtggggagcaacgcaacatcttcagaagatttccccccaccatcactgttacagcccccgccccctgcggctagctctaccagtggtccccagccgccacctccacagagcttaaatctgctgtctcaggcccagctgcaagcgcagccactcgctcccgggggcacccagatgaagaagaagtccgggttccaaataacgtccgtgacaccggcccagatctccgccagtatctccagtaataatagcatcgcagaggatacggaatcctacgacgacctcgatgagagccatacggaagatctgtcatcttcggagatactggatgtgtcgctatcaagggccaccgacttgggcgagcccgaacggagctcctctgaggaaacacttaacaactttcaggaggccgagactccaggcgcagtctcaccaaaccagccacatctcccgcagccacatcttccccacctgccccagcagaacgtggtgatcaatggaaatgcacatcctcaccatctccatcaccaccaccagattcatcacggacaccaccttcagcatggccaccaccacccctctcatgttgccgtggctagtgcatctattactgggggccccccttcaagtcctgttagcagaaagctcagtaccaccggatccagcgattctatcacccccgtggctccaacgtccgcggtttcgagcagtggaagcccagcatccgtgatgactaatatgagggccccttcaacaaccggagggatcggaattaacagtgttacagggacctccactgttaataatgtcaatattacggcagttggttctttcaaccccaatgtgacatcctccatgcttggtaacgtcaacatttctacatccaacatcccatccgcagcaggcgtcagcgtgggtcctggagtgacctctggcgtaaatgtgaatattctcagcgggatgggcaatggcaccatttcgtcaagtgctgccgtgagctccgtaccaaatgctgcagctgggatgacaggcgggagtgtgtcttcccaacagcaacagccaaccgtcaatactagccggttcagagtcgtcaagttggactcgagctcagaacctttcaagaagggtagatggacctgtactgagttctacgagaaagagaacgctgtgccagctaccgaaggggtgctaattaataaggttgtggaaactgtgaaacagaaccctatcgaagttactagcgagcgggagtcgacctccggaagcagcgtcagcagtagtgtaagtaccctttcacattataccgagagcgttggaagcggagagatgggagctcccaccgtggtcgtccagcaacagcagcagcagcagcagcagcaacagcagcaaccggccttacaaggagttaccctccagcaaatggattttggatcaacaggtcctcagagcattcccgcagtctcaatcccccaaagcatttcccagtcacagatttcacaggtccagctgcaatcccaagagcttagctatcaacagaagcaggggcttcaacccgtgcccctgcaggctacaatgagcgcagccaccgggatccaacccagccccgttaacgttgtgggagtgaccagcgcacttggccagcagccttcaatcagctctctcgcgcagccgcagctgccctattcacaggccgcccctccagtgcaaactccgctgccaggggcacctccaccacagcagttacagtatggtcagcagcagcccatggtgagcacccaaatggcccctgggcatgtcaagagcgttacccagaacccagcttctgagtatgttcaacagcagcctatactacagacagccatgtcaagcgggcagccctctagcgcaggagtgggagccgggactacagtgatccctgtcgcccagccccagggtatccagctgccagtgcaacccactgccgtccctgcgcaacctgctggagcgagcgtacaaccagtgggccaggcacctgctgcagtgtccgcagtccccaccgggagtcaaattgctaatataggccaacaggccaacatacctactgccgtgcagcagccttccacacaagttcctccctccgtgatacagcagggggctcccccctcatctcaagttgtaccacctgctcagacaggaatcatccatcagggtgtgcagacaagcgcccctagtcttccccaacagctggtgatcgcaagtcagagcagcctgctgaccgttcctcctcagccccagggagttgaaccagtggcacaaggcattgtcagtcagcaacttccagctgtgtcatctctcccaagtgcctcctccatttccgtgaccagccaggtctcctccaccgggccctcgggcatgccgagcgctcccacaaaccttgtccccccccagaacatcgcgcaaaccccggcaactcagaacgggaatctggtgcagtccgtgagccaacccccccttatcgccactaatactaacttgcctctcgcccagcaaataccactgagttcaacacagttcagtgctcagagcctggctcaggcaattggctcccagatcgaagatgcccggcgcgccgctgagcccagtctcgtggggttgcctcagacaattagtggagacagcggcggtatgagcgcggtgtccgatggctccagctccagtttggcagcatccgcctccctctttccgctaaaggtgctaccactcactacccctctcgtcgatggagaggacgagtcttccagcggggcgtccgtcgtagccatcgacaataaaatcgaacaggccatggatcttgtcaagtctcatctgatgtacgccgtgcgcgaggaggtcgaagtcctcaaggaacagatcaaggaactgatcgagaagaattcacagcttgaacaggaaaacaacctgctcaagactttggcttcacccgaacagctggctcagttccaggcccagcttcaaaccggaagcccacccgccactacgcagcctcagggcacgacacagcctcccgctcagccagcctctcagggaagtggcccaacagcatag

SEQ ID NO: 139247 - DNA, 126 bp, Artificial Sequence
  Description of Artificial Sequence: Synthetic coding sequence
atgaagtcacagtggtgccgcccggtcgccatggacctcggagtgtaccagctgagacatttctcaatctcctttttgtctagcctgcttggtacagagaacgcctccgtgaggttggacaattag

SEQ ID NO: 139248 - DNA, 429 bp, Artificial Sequence
  Description of Artificial Sequence: Synthetic coding sequence
atgcatcagccacctgagagtacggctgctgccgcagctgccgctgatatttctgcccggaagatggcccacccagcaatgtttcccagacgggggagtgggtcaggctcggcttcagcactcaatgccgcagggacaggagttgggagtaatgcaactagcagcgaagactttccacctccatcactccttcagcccccccctcctgctgcctccagcacgagtggtccgcagcctccacctccccaatctctaaacctcttaagccaagcccagctgcaagctcaacctctcgcccccggcgggactcagatgaagaagaagtcagggttccagattacatccgtgacacctgcacagattagcgcgtccattagttccaacaatagcattgccgaggatacagagtcctatgatgacctcgattag

SEQ ID NO: 139249 - DNA, 1713 bp, Artificial Sequence
  Description of Artificial Sequence: Synthetic coding sequence
atgcaccagcctcccgagagtaccgccgccgctgctgcagcagcagatatcagcgcacgaaaaatggctcaccctgcaatgttcccacggaggggttctggctcaggaagtgcctctgctctcaacgccgccggtactggggtaggcagtaacgccacgagcagtgaggatttccccccaccttccctccttcagcctcctccaccagccgcatcttctacatcagggccacagccaccacccccacagtccctcaacttgcttagccaggcacagcttcaggctcaacctctcgctccgggcggaacccagatgaaaaaaaaatcagggttccaaattacaagcgtcacaccagctcagatatcagcatctatttctagcaataatagcattgccgaggacactgagagttatgatgatttggatgagagtcacactgaagaccttagctccagcgaaatcctcgacgtcagcctcagccgggccactgatctgggtgagccagagaggtcaagtagcgaggaaacattaaacaattttcaagaggccgaaacacctggagccgtgtcacctaaccagcctcatctcccacagccgcatctcccacatctcccgcagcagaacgtcgtgattaacggcaatgcccacccccaccatctgcaccaccaccatcagattcaccatggtcaccatctccagcacggacaccaccatccatcccatgtggctgtcgcctcagcctctatcacaggaggaccaccctcttctcccgtcagcagaaaactatccactaccggttcttctgactccattactcctgtggccccaaccagtgccgtcagctctagtggttctcctgccagtgtcatgaccaacatgcgggcaccctcaactacagggggcattggcattaattctgtcaccggcacgagcacagtaaataacgttaacattactgcagtggggtcctttaacccaaacgtgaccagctcaatgttagggaatgtgaatatttccaccagcaacatacctagcgctgccggagtttcagtagggcctggagtgacttccggtgtgaacgtcaacattctttcaggaatgggcaatggcacaatcagttcgtccgccgccgtaagttcagttccaaacgcagccgcagggatgacaggagggagtgtctctagccagcagcaacagccaaccgtgaacacatctcggttcagagtagtcaaacttgatagcagcagcgaaccctttaagaaaggtagatggacttgcactgagttttatgagaaggagaatgccgtacccgccaccgagggcgtgctgatcaataaggtcgtcgagactgtgaagcagaaccctatagaggtgaccagcgagcgcgaatcaacctctggcagttctgtaagcagttccgtcagtacgctatcacactacactgaatcagtcggctccggagaaatgggtgcgcctactgtcgtggtgcagcagcagcaacagcagcagcagcaacagcagcagcagcctgcacttcagggggtcacattgcagcagatggactttggcagtacagggcctcaatcaatacccgccgttagcattccgcaatctattagccaatctcaaatctctcaggtgcagctgcaatcccaggaactgagttatctcacgatgaaggttgttctcttaatcgtatatctatgtatgtag

SEQ ID NO: 139250 - DNA, 603 bp, Artificial Sequence
  Description of Artificial Sequence: Synthetic coding sequence
atggcccagtctaaactcgactgtagatcccctgtgggcctggattgctgcaattgctgtctggatcttgcacaccgcagcggacttcagagaggatccagtggcgagaacaacaatcccggctcgccaacggtctccaattttaggcaactccaggagaagctggtattcgagaacttgaatacagataaattaaactcaattatgcgccaagacagtctggagccagtgctgagagacccttgctacctaattaacgaagggatctgtaatagaaatatcgaccagacgatgctgtccatcttgctcttcttccactccgcatcaggcgccagtgtggtggctatcgataataaaattgaacaggccatggatttggtgaagaaccacctgatgtatgcagtgcgggaggaggtggaaatcctgaaagagcagattagagaactggtcgagaagaactctcagttggaacgagaaaacacattgctcaaaactttagcttcacccgaacagcttgagaagttccagagctgtctctctcccgaagagcccgccccagagtcaccccaggtcccagaggctcccgggggatcagccgtatag

SEQ ID NO: 139251 - DNA, 333 bp, Artificial Sequence
  Description of Artificial Sequence: Synthetic coding sequence
atggccttccagcctccatattcgtcaagcctgtttcgtaaaagggataatgccagcggggcaagcgttgtagctattgacaataaaatcgagcaagccatggatctggtgaaaaaccatctaatgtacgctgttcgagaggaggttgagatacttaaagaacagatacgtgaactggtagagaagaactcccagcttgaacgcgagaacacactactcaagacattggccagtcccgagcaactggaaaagtttcaaagctgcttgtctcctgaggagcctgcaccggaaagcccccaggtaccggaagcacccggcggaagtgctgtttag

SEQ ID NO: 139252 - DNA, 603 bp, Artificial Sequence
  Description of Artificial Sequence: Synthetic coding sequence
atggcacaatcaaaactagactgtcggtccccagtgggtctcgactgctgtaattgctgtctagacctagcacaccgctctggcctgcaacgggggtcctctggcgaaaataacaatcccggttcaccaactgtgagtaacttccgtcagttgcaggaaaagttagtgtttgagaacctgaacacagacaaactgaatagtatcatgaggcaagattctctcgagccggtgttgagagacccatgttatctaattaacgaaggcatttgcaacagaaatattgatcagactatgctttccatcctattgttctttcacagtgcctccggtgcctctgttgtggccatcgacaataagattgaacaggctatggatctagtaaaaaaccatcttatgtacgccgttcgagaagaggtcgaaatcctgaaagagcagatcagggagttggtggaaaagaacagccagttggagagggagaataccctactgaagacattggcctcgccagaacagctggagaaattccagtcctgtctcagtcccgaagaaccagcacctgaatcccctcaggtgcccgaggcacctgggggatctgccgtctag

SEQ ID NO: 139253 - DNA, 603 bp, Artificial Sequence
  Description of Artificial Sequence: Synthetic coding sequence
atggcccagtccaagctggactgtagatcgcccgtggggctcgattgctgcaattgctgtctagatctcgcacaccggtccggcttacaaagaggcagcagcggcgaaaacaataatcccgggagccccaccgtgtcaaacttccgccagctgcaggaaaagctggtctttgagaacctcaacactgataagctgaacagcattatgcgacaagattcccttgaaccagtactcagagacccttgctaccttatcaacgaggggatctgcaatcgtaacatcgaccaaacaatgttaagtattcttctcttttttcatagtgccagcggcgcctcggtggtggctatcgacaataagatagagcaggcaatggatttggtcaagaatcaccttatgtacgctgttagggaagaagtcgagattctcaaagagcagatccgcgagctcgtggagaagaactcacagctggagcgggagaacaccctgttaaagactctggcttcccccgagcagctggagaagttccagtcatgtctcagccctgaagaaccagctccagagagccctcaggttcccgaggcacccggcgggtctgctgtgtag

SEQ ID NO: 139254 - DNA, 234 bp, Artificial Sequence
  Description of Artificial Sequence: Synthetic coding sequence
atggacttagtgaagaaccaccttatgtatgccgttagggaagaagtcgaaatccttaaagagcagatacgggagttggtcgaaaaaaacagtcagctggagcgggagaatactctgctaaagactttagcgtctcccgaacagctggagaagtttcaaagctgcctgagtccagaggaacctgcccctgaatctcctcaggtaccggaggcccccgggggtagcgccgtgtag

SEQ ID NO: 139255 - DNA, 405 bp, Artificial Sequence
  Description of Artificial Sequence: Synthetic coding sequence
atgaatacagagatgtaccaaacaccaatggaagtggccgtgtaccaattacacaactttagtatcagcttcttctcttctctgttgggcggggatgtggtgtctgtgaagttagataacagcgccagcggcgcttccgttgtggctattgacaacaagatcgaacaagcaatggacttggttaagaatcacttgatgtacgcggtccgcgaggaagtggagattctcaaagagcaaattcgcgagttagtggaaaagaacagccaactcgagcgggagaacacgttattgaagactctggcttccccagagcagctagaaaaatttcagtcatgcctgtcaccagaggaacctgcgccagagagccctcaagtgcccgaggcccctgggggcagtgccgtctag

SEQ ID NO: 139256 - DNA, 540 bp, Artificial Sequence
  Description of Artificial Sequence: Synthetic coding sequence
atggcccagtctaagctcgactgccgaagcccagtggggctggactgttgtaattgttgtctcgatttggcccatcgttctggcctgcaaagggggagtagtggggagaacaacaaccctgggagccctaccgtttccaatttcagacaggacagtctagagcctgtgctcagagacccttgctaccttatcaatgagggcatttgcaacaggaatattgaccagaccatgttgtctatattgctgttcttccattccgcgagcggagctagcgtagtggcaatcgacaataaaatcgagcaagccatggatttggtaaagaaccacctgatgtacgctgtcagagaggaagtggaaatcttgaaagaacagattagagagttggttgagaaaaattcccagcttgagcgagaaaataccctgctgaaaacactagcttctccagagcagctggagaagtttcagtcgtgtctaagcccggaggagccagctccggaaagccctcaagtgcctgaggctcccggcggcagcgccgtgtag

SEQ ID NO: 139257 - DNA, 372 bp, Artificial Sequence
  Description of Artificial Sequence: Synthetic coding sequence
atggcccaatctaagctcgattgccggagcccggttggcttggactgctgcaattgttgtctggatctggctcacaggtcaggcctgcagaggggctccagcggagagaacaacaaccctggcagtcccaccgtaagtaatttccgccaactccaggagaagctggtgttcgagaacctgaacaccgacaaactgaattccattatgagacaagatagtctggagcccgtgcttagggacccgtgttatttaatcaacgaggggatatgcaaccgaaacattgaccagactatgctgtcaatactgcttttctttcacagcgccagcggcgcttctgtggtcgcgatcgataataaaatagagcaagcctag

SEQ ID NO: 139258 - DNA, 78 bp, Artificial Sequence
  Description of Artificial Sequence: Synthetic coding sequence
atggaccttgtgaaaaatcatctcatgtatgcagtccgagaagaggtcgaaattttaaaagaacagattagggagtag

SEQ ID NO: 139259 - DNA, 351 bp, Artificial Sequence
  Description of Artificial Sequence: Synthetic coding sequence
atggcccagtctaaactggattgccgatcacccgtcggactggattgttgcaattgttgtctcgatctcgcccacagatctggtctgcaacgcggcagcagcggtgaaaacaacaatcctggctctccgacagtgagcaattttcgacagctgcaggagaaacttgtcttcgagaatcttaacactgataaactcaatagcataatgcgccaggactccctcgagcccgtcttgagggatccatgttatctgatcaatgagggtatatgtaacaggaacattgaccaaactatgctgtccattctgctgttcttccattcagccagtggggcttccgtggtcgcaatttag

SEQ ID NO: 139260 - DNA, 177 bp, Artificial Sequence
  Description of Artificial Sequence: Synthetic coding sequence
atggcacagtcaaaattggattgtaggagccctgtgggcctggactgctgtaattgctgcttggacctggcccacagatcggggctgcagaggggttcatctggcgaaaataacaatccaggctcccctacagtctccaacttcaggcaactgcaagaaaaactcgtttttgagtag

SEQ ID NO: 139261 - DNA, 255 bp, Artificial Sequence
  Description of Artificial Sequence: Synthetic coding sequence
atggcacagtccaaactggactgtcgctctccggtgggactggactgttgtaactgctgtctcgatcttgcacacaggtccggccttcagcgcggctcctcaggggaaaacaacaatccagggagtccaacagtctctaactttcggcaactgcaggaaaagcttgtcttcgagaatctaaatactgacaagttgaattctatcatgcgtcaggacagcctcgaacctgtgttacgtgacccttgctacttgtag

SEQ ID NO: 139262 - DNA, 603 bp, Artificial Sequence
  Description of Artificial Sequence: Synthetic coding sequence
atggcccaatcaaagcttgactgccgatccccagtgggtctagactgctgcaactgttgtctagacctcgctcacaggagcgggctccagagaggttcgtctggcgaaaataacaatcccggatcccccaccgtgtctaattttcgacagttgcaggagaagctggtgttcgaaaacctgaataccgacaagctgaactccattatgagacaggacagtttggagcctgtcctcagagacccctgttatctcatcaatgaaggcatttgtaatagaaacatcgatcaaaccatgctgtccatacttctcttcttccactccgcatccggagcctccgtggtggctatcgataataaaatcgaacaggcaatggatcttgtgaagaaccatttaatgtacgccgtccgggaagaagtggagatcctgaaggagcagatccgagagctggtggagaagaactctcaacttgagcgcgaaaacacattgctgaaaacccttgctagccctgagcagctggagaaattccagtcctgtctgtcgcccgaagaaccggctcccgaatccccccaggtacctgaggctcctggtgggtcggccgtgtag

SEQ ID NO: 139263 - DNA, 303 bp, Artificial Sequence
  Description of Artificial Sequence: Synthetic coding sequence
atggcacagagcaagctcgactgtagatctcctgttgggctggactgttgcaactgctgcctggatttggcacatcggagtggcctgcaacggggaagctccggcgagaataacaatccgggaagccctacggtatcgaatttccggcagctgcaggaaaagctggtcttcgaaaacctcaataccgataagcttaacagtattatgcgtcaggatagcttggagccagttctccgagacccttgctacttaatcaacgagggaatctgtaataggaatattgatcagacaatgctcagctag

SEQ ID NO: 139264 - DNA, 360 bp, Artificial Sequence
  Description of Artificial Sequence: Synthetic coding sequence
atggcacagtccaaactggattgccggagtcctgtgggtctggattgttgcaattgctgtcttgacctcgcacatcgcagcggtcttcagagaggatctagcggagaaaataataatcccggctccccaaccgtcagcaactttcggcagctccaggagaaactcgtctttgagaacctgaacacggataagctcaattcaattatgaggcaggatagcctggagccggtgttgcgcgatccttgctatctgataaatgaggggatctgcaatcgcaatatcgatcagactatgctcagtattctgttatttttccacagtgcatccggtgcctcagttgtagctatagacaataaatag

SEQ ID NO: 139265 - DNA, 399 bp, Artificial Sequence
  Description of Artificial Sequence: Synthetic coding sequence
atgcgtcaggatagtttagaacccgtcctccgagacccctgctaccttatcaacgaaggcatctgcaaccggaacatcgaccaaactatgttgtcaatccttctatttttccactccgcaagtggcgcgagcgtggtagcaattgataacaagatcgaacaggccatggatttagtcaagaaccatctaatgtacgccgtccgagaagaagttgagattctcaaggaacagattagagagctggtggaaaaaaattcccagctggagcgagagaataccttattaaagacactggcatctcctgaacagcttgagaaattccagtcatgcctttctccagaagaacccgcaccagaatcaccccaggtgcccgaggctcctgggggatcagctgtctag

SEQ ID NO: 139266 - DNA, 375 bp, Artificial Sequence
  Description of Artificial Sequence: Synthetic coding sequence
atggcacagtctaaactggactgccgaagccctgttggcctggattgctgtaactgctgcttagacctggcccaccggagtgggctgcagcgcggctccagcggcgagaacaacaatccaggctctcctactgtaagtaacttcaggcagctacaggaaaagttggtattcgagaatctgaacactgacaaactgaattcaattatgagacaggacagtctggaaccagtgcttcgagacccttgctatttaatcaatgagggcatctgtaacagaaacatcgatcaaaccatgttgagtatcctgctgttcttccactctgcttccggcgcaagcgtagtggcaatcgacaataaaatagagcaggcaatgtag

SEQ ID NO: 139267 - DNA, 1188 bp, Artificial Sequence
  Description of Artificial Sequence: Synthetic coding sequence
atgtctggcggtaagaaaaagtccagcttccagatcacgtccgtgacaactgactacgaagggcccggctcgccaggtgcctctgacccacccactccacagccacccaccggaccgccaccccgactgcccaatggagagccctcccctgatcctggcgggaagggaacccctcggaacgggtccccacctccgggagccccttcttctcggttccgggttgtaaagctgccgcacggactgggcgaaccttatcgcagaggccggtggacatgcgtggatgtgtatgagagagatttggaaccacactcttttggcgggcttctagaaggcatcagaggcgcttctggcggagccgggggccgaagccttgactccagacttgagctggcgagtctgggactcggggccccaacacccccttccggactctcacagggccctacctcatggttgcgtcctccacccacttcccccggtccccaggctcggtccttcaccgggggcctgggacagctggtcgtcccgagcaaggcgaaggcagaaaagccacccctatctgcgagctcaccacagcagcggccaccagagccggagaccggcgagagcgctggcaccagtcgtgcagctacgccccttccatctctcagagttgaagcggaagcaggcggaagtggagctaggacgcctcctctgagccggcggaaagctgtcgatatgcggctgcgtatggagctgggcgccccagaagagatgggacaggtccccccactggattccagaccatccagtccagcactatactttacccacgatgcctccctagttcataagtctcccgatccctttggagcagtggcggctcagaagtttagcctcgctcattccatgctggccatatctggccaccttgactctgatgatgactcgggtagcggatctctggtcgggattgataataagattgaacaagccatggacctagtcaagagtcacctgatgtttgcggtgagggaagaggtggaggtgctgaaggaacagattagggagttagcagaacgtaacgcggctctggagcaggagaatggcttgctgagggctctggctagtcctgagcaactcgctcagttgccatcgtccggtgtcccacgattaggcccgcccgcacccaacggcccaagcgtatag

SEQ ID NO: 139268 - DNA, 1314 bp, Artificial Sequence
  Description of Artificial Sequence: Synthetic coding sequence
atgtctggcttggacggtgtgaagcgtactaccccgttgcaaacacactctataatcattagtgatcaggtgcccagtgaccaggacgctcaccagtatctgagattgagagatcagtccgaggccactcaggtaatggccgaacccggtgagggagggtcagagaccgtagccctaccccctccccccccgagcgaggaaggaggagttccccaggacgctgccggccggggaggaaccccccagattagagtggtcgggggacgaggccacgtcgccattaaagccggccaggaggaaggacagccccccgccgagggtttggctgccgcgagtgtggtaatggccgcagatcgctcactgaagaaaggagtgcaggggggggagaaagctctggagatttgcggggcgcagcgctccgcctcagaacttaccgcaggggccgaggctgaggccgaagaggtgaaaactggcaaatgcgctacagtgagtgctgccgtcgcagagcgagaatctgcggaagtggtgaaggagggtcttgccgaaaaggaagtcatggaagagcagatggaggttgaggaacaacctcccgaaggcgaagaaatagaggtggctgaggaagaccgtttggaggaagaagccagggaggaagaaggtccctggccacttcacgaagccttacgcatggacccactggaagcgatccagctggaacttgacacggtcaatgcccaggccgaccgggcctttcagcaactagaacataaattcggccggatgcggcgtcattatcttgagcgccgaaattatattattcagaatattcctggtttctggatgacagcgtttagaaaccacccacagctcagcgctatgatcagggggcaggatgccgaaatgctccgatacatcaccaatctggaggtgaaggaactgcggcatccccgtacagggtgcaaatttaaattctttttcagaaggaacccttattttaggaacaaactgatcgtgaaggaatacgaggtgagaagttctggcagagtggtgagtctgagtacaccaatcatctggcggagaggccacgagccccagtcctttattcgcagaaatcaggatctgatttgttctttcttcacttggttcagtgatcattccttacctgagtctgacaagattgccgaaattattaaggaggacctgtggcctaatccactacagtattatctgcttcgagaaggggttcgaagagcacgccggcgaccgctacgggagcctgtggaaattcctagaccttttggcttccagtctgggtag

SEQ ID NO: 139269 - DNA, 522 bp, Artificial Sequence
  Description of Artificial Sequence: Synthetic coding sequence
atgtccggcctagatggagtcaaaaggaccacccccctgcagacacattctatcattatctctgaccaagtgccaagcgatcaggacgcacaccagtacctgagattgcgagatcaatctgaggccacccaggtaatggccgagccaggggagggagggagtgaaacggtggccttacctcccccacctccatctgaagaaggcggggtgccacaggacgccgcgggtcgtggtggaacgccacagatcagagtggtgggagggagaggccatgtggcaatcaaagcaggccaggaagaagggcaaccccctgctgaaggactggccgcagcctcggtagtgatggcagcagatcgctccctgaagaagggtgtacaaggcggggagaaagccttggagatttgtggcgcccaacggagcgcttcagaattgaccgcaggtgccgaagctgaggctgaggaggtgaagaccggtaagtgtgccacggtgagcgctgctgtggctaaaatgcaaagatgttag

SEQ ID NO: 139270 - DNA, 2082 bp, Artificial Sequence
  Description of Artificial Sequence: Synthetic coding sequence
atggacaggccggatgaaggcccacccgctaagactcgcagactgagtagctctgaatccccacagagggacccgcccccaccacctcctcctcctcctctcctgcgactgccactccctccccctcaacagcggccccgcctccaggaggaaactgaggccgcccaagtgctcgcagacatgcggggggtcggcctgggccctgccttgcctcccccacccccatatgtgattctggaggagggcggaatccgcgcatacttcaccttgggcgccgaatgcccagggtgggacagcactattgaatccggatatggggaggcacccccgcccactgaaagcctagaagctttaccaaccccagaggccagtggggggtcattagagattgactttcaggtggtgcagagtagcagtttcggaggagagggagccctggagacttgttcagccgttggatgggcgccacagcgcttggtcgaccctaaatcaaaggaagaggccatcatcattgttgaagatgaggatgaggacgagcgggaatccatgagaagctctcgtagacgacgtcggcgacgccggcgcaaacaacgcaaggtcaaaagggaaagtcgtgagagaaatgccgagaggatggaaagcatcctgcaggcactggaggacattcagctggacctagaagcagtcaacataaaagcagggaaggcctttcttcgcctgaaacggaagtttattcagatgcgacggcccttcctagaaaggcgggatctgataattcagcatatcccaggcttctgggtcaaggctttcttaaaccaccctcgaatcagtattttgatcaaccgaagggacgaggacattttccggtatcttactaatctccaagtccaggacttgagacacatcagcatggggtacaaaatgaagctgtacttccaaaccaacccatactttactaacatggtgatcgtcaaggaattccagagaaaccgttccgggagactcgtctcccattctactccgatccggtggcatagaggccaagaaccacaggccaggagacacgggaaccaagatgcaagccatagtttcttttcatggttttctaaccacagcttgccagaagcagaccgcatagcagagattatcaagaacgacctttgggtgaaccctctgaggtattatctgagggaacgcggtagtagaatcaaacgcaaaaaacaagaaatgaaaaaacgcaagaccaggggacggtgcgaggtggttattatggaggatgctcccgactattatgcggttgaggacatctttagcgaaattagcgatatcgacgaaactatccacgacattaaaatttccgatttcatggaaaccacggattactttgaaactaccgacaacgaaatcaccgacatcaacgagaatatctgcgactcagaaaatcccgatcataatgaagtcccaaacaacgagactactgacaataacgagagcgcggatgatcatgaaaccacagataacaatgagtccgccgatgacaataacgagaatcccgaggataacaataagaatacggacgataacgaggagaatcccaacaataacgagaatacctatggcaataattttttcaagggcggcttctggggatctcatgggaacaaccaggactcctccgattccgataacgaggccgacgaggcaagcgacgatgaggataacgacggaaacgagggagataacgaaggttcagacgacgatggcaatgagggagacaatgaaggcagtgacgatgacgatagggatatagaatactacgagaaagtcatcgaagacttcgataaagaccaggcagactatgaggatgtcatcgagataataagtgatgaatctgtcgaggaggaaggcatcgaggaggggatccagcaagatgaagatatatatgaagagggaaattacgaggaggagggttcagaagacgtgtgggaagaaggggaggattccgatgattccgacctggaggatgtcttacaagtcccgaacggctgggctaaccccggcaaacgcggcaagactggctag

SEQ ID NO: 139271 - DNA, 1062 bp, Artificial Sequence
  Description of Artificial Sequence: Synthetic coding sequence
atgccatggccattgctcctcctccttgccgtctcaggcgcccaaacaactcgtccctgttttcccggctgtcaatgcgaagtagaaacattcggactgtttgactctttcagtttaactagggtcgactgtagtggcttagggccacatattatgcccgtgcccatacctctggacactgctcacctcgacctgtctagtaaccgcctggagatggtgaacgaaagcgtgttagccggacccggatacaccacacttgctggcctggacctttcccataacctgctcacatcgatctcaccaaccgcattttctagactgagatatttagagtctttggacctgtcccataatggacttactgccctgcccgccgagtcctttaccagctcaccactcagcgacgtaaacttgtcgcataaccaattacgggaggttagtgtgtctgctttcaccacccactcacagggcagggcactccatgtggacctatcccacaacctcattcacaggctggtgccgcatcctacacgcgcgggcctaccagctccaacaattcagagccttaatctggcttggaacagacttcatgccgtgcctaatctacgcgacctccccctgagatatttgtcactggacggaaatcccctggccgtcatcggccctggggctttcgccggcttgggagggttgacgcacttgagcttggcttcactccagagactgccggagctcgcaccatcaggtttccgggagctgcctggtttgcaagtgctcgatttgtcaggcaatccaaagttgaattgggctggtgcagaggtgttcagcggcctcagtagtctgcaggagctggatctctccggaactaatctcgtgccacttccagaagccctcctgctccacctccctgcactccagagcgtttccgttggacaagatgtgagatgtcgaaggctggttagggaggggacctaccctcggagaccaggaagctccccaaaagtggccttgcactgcgtcgacacacgggattctgctgcgcgggggccgactatattgtag

SEQ ID NO: 139272 - DNA, 966 bp, Artificial Sequence
  Description of Artificial Sequence: Synthetic coding sequence
atgccctggcccctgctgctcctgctcgctgtgtcaggtgctcagacaaccagaccatgctttccaggatgccaatgtgaagtggagacctttggtttgttcgatagcttctctctaactagagttgactgtagcggactgggcccacatattatgcccgttccaatcccattggatacggcccatcttgacctgtcttccaatcggcttgaaatggtcaacgaatcagttctggcagggcccggctacactactctggctggccttgacctaagtcacaatcttctgactagttcacccttgtccgacgttaatctgtcccataaccagctgcgagaggtaagtgtgagcgccttcacaacacattcacaggggcgcgctcttcatgtggacctatcccataatctgatccatcggcttgtgcctcatcctacccgtgcagggctgcctgcccctactatccagagtctcaatttagcctggaatagactacacgcggtgcccaacctccgggacctgcctttaaggtacctgagcctggatggcaatcctttggccgtgatcggaccaggagcttttgctggcttaggaggactcacacacctgtcacttgcttcactgcagaggctgcccgagctggcaccttctggcttccgcgaactgccaggtctgcaggtgctggacctttccggaaatcccaaactcaactgggccggcgctgaggtattttccggtctaagctccctgcaagagctggatttatccggcactaatctggttcccctcccagaggctttgctactccacctgcctgctctgcagtccgtgagcgttggtcaagacgtgaggtgccggcggcttgtgagggaaggaacatatcctcgaaggcctggcagcagccccaaggtggccctgcactgcgttgacacccgagactcggccgcccggggtcccacaattttgtag

SEQ ID NO: 139273 - DNA, 318 bp, Artificial Sequence
  Description of Artificial Sequence: Synthetic coding sequence
atgccttggcctcttctgctgcttctcgccgtgtccggtgcccaaaccacgaggccctgtttccccggatgccaatgcgaggtggaaaccttcggtttgtttgactctttttccctcacacgagtagattgctctgggctcggccctcatatcatgcctgtgccaattcctctggacacggcccacttagatcttagttccaataggctagagatggtgaatgagtccgtgctcgctggtccaggatacacaacgctggctggcctggatctctcgcacaacctgctcactagcattagccccactgctttttcatag

SEQ ID NO: 139274 - DNA, 1062 bp, Artificial Sequence
  Description of Artificial Sequence: Synthetic coding sequence
atgccttggcctctgcttctgctcctggctgtttcaggcgcacaaaccactcgtccatgcttccctggctgtcaatgtgaggtggaaactttcggtctgttcgattcttttagtcttaccagagtggattgtagtgggctcggtcctcacattatgccagttcccatacccctggacactgctcacctagatctgagcagtaacagacttgagatggtcaatgagtctgtcctggcagggcccggttatactacactggccggactagacctcagtcacaacctactgacatccatctccccgaccgcatttagtagactgaggtatctcgagtcccttgatctttcgcacaatggtctgactgctctgcctgcagaaagcttcacctccagcccactaagcgacgtgaatttgtctcataatcagctgagggaggtgtctgtgtctgcgtttaccacacactcacagggaagggccctccacgtcgacctgtcacacaatctgattcacaggttagtaccccaccccacccgggccggattgcctgcccctactatccaatcactgaacctggcttggaatagactgcatgccgtacccaatctgagagacctgccacttcgatatctttcgctcgacgggaatcctctggcagtcataggtcccggcgcgttcgctggattgggaggcctgactcatctttctctggcatcattgcagagactccccgaattagcgccctccggattccgggaattaccagggctgcaggttctggacctgagcggaaatccgaagctgaactgggcaggagcagaggtgttctccggcttatcatcgcttcaggaactggatttgagtggcactaatcttgtcccactcccagaggccttgcttttacacctgccagccttgcagtcggtatcagtgggccaggacgttagatgccggcgcttggtgcgggaagggacttacccgaggcgaccaggtagtagtccaaaagtagcgctgcattgcgtcgatacgagagactctgcagcccgtggacctactatcctctag

SEQ ID NO: 139275 - DNA, 453 bp, Artificial Sequence
  Description of Artificial Sequence: Synthetic coding sequence
atgccttggcccttgttgctgttgctcgcagtgtcaggggctcagactacgcgtccctgcttccccggctgccaatgcgaggtagagaccttcggactgtttgactccttttctctgacacgcgtcgactgcagcggcctcggcccacacatcatgcccgtaccaattccattggatactgcacacttggacttgtcttcgaatcgtctggaaatggtcaacgagtctgtcctcgccggccccggctacaccacactagcaggcctggacttgtcccacaacctgctgacatccatttccccaacagcttttagcagactgcgatacctggaatcactggacctctcccataatggcctgactgctcttcctgccgagtcatttacctcctcgcctcttagcgacgtaaacctaagtcacaatcagctacgcgaggtatccgtgagtgcatag

SEQ ID NO: 139276 - DNA, 2574 bp, Artificial Sequence
  Description of Artificial Sequence: Synthetic coding sequence
atggaaagcgaggacctaagcggcagagagttaaccatcgattctattatgaacaaggtgcgagacattaaaaataagtttaaaaatgaagacctgacagacgagctgtctcttaacaagatttccgctgatacaaccgacaacagcgggaccgtcaatcaaattatgatgatggccaataaccctgaagactggctgtcgctgctgctaaagctcgagaaaaatagcgtccctctaagcgacgctctactgaacaaactaattggcaggtattctcaagccattgaagcgctgcctcccgataagtacgggcaaaatgaatcttttgcccgcatccaggtgcggttcgccgagttgaaagcaattcaggaaccagatgacgcgcgtgactacttccagatggcgagggccaactgcaagaagttcgcgttcgtccatatctctttcgcccagtttgaactatctcagggcaatgtgaagaagagcaagcagcttctgcagaaggcagtggaacgtggcgctgtgccgcttgagatgcttgagatcgcactgcgcaacctgaatctccaaaagaaacaattgctcagcgaggaagagaagaaaaacctctccgcatcaaccgtgctcactgcacaggaatctttcagcggatccctggggcacctgcaaaaccgcaacaactcctgcgactctagaggacagacgacaaaagctcggtttctgtacggggagaacatgcctccccaggatgccgaaatcgggtatcgaaattccctgcggcagacaaacaaaaccaaacaatcctgccccttcggccgggtaccagtgaacctgctgaactcacccgattgcgacgtgaagaccgacgacagcgtggtgccttgtttcatgaaaaggcagacctcacggagtgagtgccgggatctggtggtacctggctcaaagccatctggcaacgattcctgtgagctcaggaaccttaagagcgttcagaactcccacttcaaggagccgctggtctcggacgagaaatccagtgaactaattattaccgactcgattacccttaagaataagaccgagagctccttactggccaaactggaagaaacaaaggagtatcaggaacctgaggtgcccgagagcaatcaaaagcagtggcagtctaaacgaaaatcagagtgtattaaccaaaatcccgcagcatccagcaatcactggcaaatcccggagctggccagaaaagtcaataccgaacaaaagcatacaactttcgaacaaccagttttcagtgtgtccaaacagagtcccccaatcagcacgtccaagtggttcgatcccaaaagtatctgcaagacaccatcatcaaacactcttgatgactatatgtcttgttttcgcacacctgtcgtaaaaaacgactttcctcccgcctgtcagctcagcacaccttacgggcaacccgcttgtttccagcagcagcagcaccagattctggcaacacccttacagaaccttcaggtcctagcttcttctagtgcaaacgagtgtatctccgtgaagggccgcatttacagtattctgaaacagatcggctcgggcggttcttcgaaggtgtttcaggtcctcaacgaaaagaagcaaatctacgcaataaaatacgtgaatctcgaagaagctgacaaccagacactggattcgtataggaacgaaatcgcttacctgaataagttgcaacagcactcagataaaattatcagactctatgactatgaaattactgatcagtacatctatatggtgatggagtgcggtaatattgatcttaactcatggctcaagaagaagaagagcatagatccgtgggagcgcaagagctattggaagaatatgctcgaggccgtccatacaatacaccagcacggaatcgtgcacagcgacctgaaacctgcgaatttcctgatcgtggacgggatgctcaaacttattgactttggaatagcaaaccagatgcaacctgataccacctcagtggttaaggactcccaggtcgggactgtgaactacatgccgccagaggctatcaaagacatgagctcgagccgcgagaatgggaaatctaagtctaagatttcccccaagagtgacgtgtggagcctagggtgtatcctgtattacatgacctacgggaagaccccctttcagcagatcattaatcagatttctaagctgcatgcaattatcgacccaaatcatgaaatcgaattccccgatattccagagaaagacctccaggatgtgctgaaatgttgcttgaagcgggaccccaagcagcgaatttctatcccagagctgctcgcgcatccctacgtacagatccagacccacccggtcaaccagatggccaaaggcacgacagaggagatgaagtatgttctgggccaacttgtggggctgaactcaccgaattctatactaaaggctgccaagactttgtacgagcactattccgggggagaatcacacaatagttctagcagcaagactttcgagaagaaacgaggcaaaaagtag

SEQ ID NO: 139277 - DNA, 420 bp, Artificial Sequence
  Description of Artificial Sequence: Synthetic coding sequence
atggagtccgaagacctcagcggaagggagctcacaatcgatagcataatgaacaaagtgagggatatcaaaaataagttcaagaacgaagatttgactgacgaattatcgctcaataaaatcagtgctgatacaaccgataatagcggcactgttaatcagattatgatgatggcgaataatcccgaggattggctctccctcctcctcaaactggaaaaaaatagtgtccccctttcagacgcattgctaaacaaactgattggccgctacagtcaagccatcgaagccctgccacccgataagtacggacagaacgagtcatttgctaggattcaggtgcgctttgcggagctgaaagctattcaggaaccagacgacgctagagactatttccaaatggcgagggccaactgttag

SEQ ID NO: 139278 - DNA, 531 bp, Artificial Sequence
  Description of Artificial Sequence: Synthetic coding sequence
atggaatctgaggacctgtctgggcgagaattgaccatagatagcataatgaacaaggtgagagatattaagaataagtttaaaaatgaggacctgaccgacgagctttccctgaataagattagcgcggatactacggataattccggcacggtcaaccagatcatgatgatggccaataatcccgaagactggctgtcgttgctcctcaaactcgaaaaaaattccgtaccgctctccgacgccctgctgaataaacttatagggaggtactcgcaggctatagaagctttgccccctgataagtacggccagaacgaatctttcgcacgtatccaggtccgattcgcagaattaaaggctatacaggagcccgatgacgctcgcgactactttcagatggcacgcgctaattgtaaaaaatttgcgtttgtgcacattagtttcgcgcagttcgaacttagccagggaaatgtcaagaagagcaagcaactgctgcagaaagcagtggaacgcggagcagttccttag

SEQ ID NO: 139279 - DNA, 453 bp, Artificial Sequence
  Description of Artificial Sequence: Synthetic coding sequence
atggagtcagaggacctttcaggacgggagctgaccatcgattccattatgaataaggtgcgagacataaagaataaattcaagaatgaagacctcaccgacgaactgtccctgaataagatttcagccgataccacagacaattcagggacagtcaaccagattatgatgatggccaataaccctgaagactggctgtctctccttctgaaactagagaaaaactcagtccccctcagcgacgccttactgaacaaactgataggtcgctatagtcaagcaatagaagccctgccacctgataagtacgggcagaacgagtctttcgccagaattcaggttcgttttgccgagttgaaagctatacaggagcctgacgatgcccgcgactacttccagatggccagggccaactgtaagaagttcgccttcgtccacatttctttcgcgtag

SEQ ID NO: 139280 - DNA, 492 bp, Artificial Sequence
  Description of Artificial Sequence: Synthetic coding sequence
atggccgaaggaggagggcaaaaccaccacgaggtcgttaagtttatggacgtgtaccagcggtcttactgtcatccaattgaaactctcgtcgacatttttcaagagtaccccgacgaaatcgagtacatatttaaacctagctgtgtccccctgatgcgatgtggcggatgttgtaacgacgagggactggaatgtgtacccacagaggagagtaacataaccatgcagataatgcggatcaagcctcaccagggtcagcacataggagaaatgtcctttcttcaacataacaaatgtgagtgtaggccaaagaaggaccgggccagacaggaaaatccttgtggtccttgctcggagcggcgaaaacatcttttcgtccaagacccacagacctgtaagtgctcttgtaagaacaccgactcccgctgcaaagccagacagctggagctcaacgagcgtacatgccgatgcgacaagcccaggagatag

SEQ ID NO: 139281 - DNA, 1368 bp, Artificial Sequence
  Description of Artificial Sequence: Synthetic coding sequence
atgacaacaatggctgctgccacactgcttcgcgctactccgcacttttccggcctggccgctggccggacttttctgctccagggcctgctccgactgttgaaagccccagccctgccactgctgtgtcgggggttggcagtagaagcaaagaagacttatgttcgcgataaaccccatgtgaatgttgggaccattgggcatgtagaccatggcaagacaaccttgaccgctgcgatcaccaagattctcgccgagggaggtggagcaaaatttaagaagtacgaggagatcgacaacgcccccgaggaacgagcccgcggcatcaccataaatgccgcccacgtggagtacagcaccgctgctcggcattatgcccacaccgattgtccaggccatgccgattacgtgaagaacatgatcacaggaacggcccccctggatggttgtatcctggttgttgccgcgaatgacggccctatgccacagactagggaacacctgttgttggcacgccagatcggggtagaacatgtggtggtctacgtaaacaaggcggatgcagttcaggacagcgaaatggttgaactggtggagctcgagatcagagagctgctgaccgagttcggctataagggtgaagagacaccagtaattgtgggctctgcactgtgtgcacttgagggccgggaccctgaactgggtctcaagagtgttcagaaactcttggacgcggttgatacctacattccagttccagcaagggacctggagaagcccttcctgctcccggtagaagctgtttactctgttcccgggagaggaactgtagttaccggcacgctggaaagggggatactgaagaagggggacgaatgcgagctcctggggcactctaaaaacattcgcaccgttgtgacagggatcgaaatgttccataaaagtttggaacgggcggaggccggagataaccttggcgctcttgtgcgcgggctgaaaagggaggacctgcggcgaggactggtaatggtcaaacctggcagcataaagccccatcaaaaggttgaggcgcaggtgtatatcctctccaaagaggagggtgggcgccacaagcctttcgtctcccacttcatgccagtgatgttttctttgacttgggacatggcctgccgcatcatcctgccaccagagaaggagctggctatgcccggagaggacctcaagttcaatctgatattgcgtcagcctatgattctagagaagggtcaacggtttaccctccgtgacggtaacaggactatcggtaccggcttggtgaccaacactctggcaatgacagaggaagaaaaaaatatcaagtggggctag

SEQ ID NO: 139282 - DNA, 1611 bp, Artificial Sequence
  Description of Artificial Sequence: Synthetic coding sequence
atggctacccccgatgccgggttaccaggcgcagagggcgtggagcccgcaccatgggctcaactggaggcccccgcgcgactgctcctgcaggcattgcaggccggacctgagggggcgagaagagggctgggcgtgctgagggccttgggtagtcgtggatgggagcccttcgactggggacgcctattggaggccctgtgccgcgaggagccagtcgtgcagggccccgatggaagactggaactgaagccacttctgctgcggttgcctcgcatctgccagagaaatctcatgagtctgctcatggctgtgaggccaagcctgcccgaaagcgggttgctgtcagtattacaaattgcacagcaagatctggcgccggatcccgacgcctggctgcgagctcttggtgaactgctccgacgcgatctgggggtgggtacttctatggagggggctagccctctgtcagagcggtgtcagcgtcagttgcaaagcctgtgcagggggttaggactcggcggtagaagactcaagtcaccccaggctccagaccccgaggaagaggagaaccgtgacagtcagcagcccggcaaacgccgaaaagactcagaggaggaagccgccagccccgagggaaagagggtccctaagagactgcgttgctgggaagaggaggaggatcacgagaaggagcgcccagagcataagagcctcgagagccttgctgacggtgggtctgcaagtcctattaaggaccagcctgttatggccgtgaaaaccggcgaagatggaagcaacctcgatgatgccaaggggctggccgaaagtctggagctgcctaaagctatccaggatcagctgccacggctgcagcagcttctgaagacgctcgaggagggattagaaggtctagaagacgcccccccagttgaactgcagttgctacatgagtgtagcccatctcagatggatctcctctgcgcacagctgcagcttcctcagctgtctgatctgggactgctcaggctctgcacctggctgttggcactcagccccgatctgtctctgagcaacgcgactgtactgacaaggagcctttttcttggccgtattctctcacttacctcttccgcctccagactgctcactactgctcttacgtcattctgcgccaagtatacgtatcctgtgtgttcggccctactcgacccagtgctccaggctccaggcacagggcctgctcagaccgaactcctctgttgtctggtgaaaatggagagtcttgagccagacgctcaggttttgatgctgggacagatcctcgagctgccatggaaggaggaaactttcctggtgttacagagtctcctggaacgtcaggtagagatgacacctgaaaagttctctgttctcatggagaagctgtgtaagaaaggactggcagcaacaacttccatggcctacgctaagttgatgcttaccgtgatgaccaagtaccaggctaatatcaccgaaacccagcggttaggtctggctatggctctggagcccaacacgaccttcctccggaagtccctgaaggctgccctgaaacacctcggcccttag

SEQ ID NO: 139283 - DNA, 1470 bp, Artificial Sequence
  Description of Artificial Sequence: Synthetic coding sequence
atgcctcttagggacgagaccctgcgagaagtgtgggcgtcggacagcggccacgaggaagagtcactcagccctgaagcaccacgcagaccaaagcaacgacccgcccccgcgcagcggctccgcaagaagagaacagaggctcctgaatcgccctgcccgacaggctcgaagcctcgaaaaccgggggaggaggaggaggaagaggaggacgaggaagatgaagaggaagaggccgaggaaaagaaagagaagatccttctgccccctaagaaacctcttcgtgagaagtcttccgccgacctcaaagagagacgcgctaaagcccagggcccgagaggggatttgggtagcccggatccgcctcctaagccgcttcgcgtccgtaataaagaagcacctgcaggggagggcacaaaaatgcggaagactaaaaaaaagggctcaggcgaagctgataaggacccttcaggctcccctgccagcgccaggaaaagtcccgcagcgatgtttctcgttggcgagggtagccccgataagaaagccctgaaaaaaaaaggtaccccgaaaggggctcgaaaggaagaggaggaggaggaggaggccgcaaccgttataaagaaaagcaaccaaaaaggtaaagccaagggaaaggggaaaaaaaaggcaaaagaggagcgggccccaagccctcctgtcgaagttgatgaaccaagggaatttgttctcagaccagctccccaaggtcggacggtgaggtgccgattgacccgggataaaaagggtatggacagggggatgtacccgtcttattttcttcacctcgataccgagaagaaggtgtttctgctggcagggcgcaaacgaaaacggagtaaaacagcaaactacctcatttcaattgatcctactaaccttagcagaggtggtgagaactttatcggcaagctgcgctcaaacctgctgggcaatcgttttaccgtgtttgacaatgggcaaaacccgcagaggggatacagcacaaacgtggccagtttgagacaagaacttgctgcagtcatctatgagactaacgtgttggggtttcgcggaccacggcgcatgacagtcattattcccggcatgtcagccgagaatgaaagagttccaatcagaccccgcaatgccagcgatggcctgctcgttcgctggcagaataagaccctggagtctttgattgaacttcacaataagccgcctgtttggaatgacgactcaggcagctataccctgaattttcaggggcgcgtcactcaggcgagcgtaaaaaacttccagatcgtgcatgcagacgatccggattatatagtactacagtttgggagagttgctgaagacgctttcacacttgactatagataccccctatgcgctctccaggcttttgccatcgctctgtcatcatttgacggcaagttagcctgtgagtag

SEQ ID NO: 139284 - DNA, 561 bp, Artificial Sequence
  Description of Artificial Sequence: Synthetic coding sequence
atgccactgcgcgacgagaccctccgcgaagtctgggccagcgactcaggacacgaggaagagtcactatccccagaggctcctagaagaccaaaacagaggcctgcgcctgcacagaggctgagaaagaaaagaaccgaggccccagaatccccctgcccaaccggatctaaacctcgcaaacccggggaggaagaagaggaggaggaggatgaggaggatgaggaagaagaggccgaggagaagaaggagaagattctactgcctccgaagaagcctctgcgtgagaagtcttccgccgacctgaaagagaggagggctaaagcccaggggcctcgcggggacttgggtagtccggatccccctccaaagcccttgcgggtgcgaaacaaagaagctccagccggtgagggtactaaaatgaggaaaaccaagaagaaaggctctggtgaagcagacaaagatccaagtggcagcccggccagtgctcggaagtctcccgcggcaatgttcttggtgggcgaaggttccccggacaaaaaagctctcaaaaagaagtag

SEQ ID NO: 139285 - DNA, 3033 bp, Artificial Sequence
  Description of Artificial Sequence: Synthetic coding sequence
atgggcgcctatgccagagcaagcggcgtgtgcgctcgtggctgtctggattctgctgggccttggactatgtcgcgcgccctgaggccaccgctgcctcctttatgtttctttctgcttctgttagctgctgccggcgccagagctgggggctacgagacatgcccgaccgttcagccgaacatgctgaacgtgcatcttctcccccacacccacgatgacgtagggtggttgaaaaccgtggatcaatacttctacggaatcaaaaatgacatccagcatgcgggagtccaatacatcctagattcggtcattagcgccctccttgccgatcccacccgccgcttcatctatgttgagatcgcgttcttctcccgatggtggcaccaacagacgaatgcgactcaagaggttgtcagggatttggtgagacaaggtagacttgagttcgccaacggtggatgggttatgaatgacgaagccgccacccactacggcgccatcgtggaccagatgacgttgggcctgaggttcctggaggatacattcggcaatgatggcagaccccgtgttgcctggcacatcgacccctttggacattcacgagagcaagccagtctattcgctcaaatgggatttgacggatttttttttggtaggcttgactaccaagataaatgggttaggatgcagaagttggaaatggaacaggtctggagggcgagtacatctctgaaaccaccaacagcggatctcttcaccggcgtactgcctaacggatacaaccccccccgaaatctctgttgggacgtgctgtgtgtggaccagcctctagttgaagacccacgctcccccgagtataatgcaaaggagctggttgattacttcctaaacgtggcaaccgcccagggcaggtactaccgcacaaaccacactgttatgaccatgggatcggacttccagtatgaaaacgccaatatgtggtttaagaatctagacaagctaatcagactggtaaatgctcaggccaaaggttccagcgttcatgtgctctactctactcccgcctgttatctctgggaactaaataaagctaatttaacatggtcagtgaagcacgatgatttcttcccctacgccgacggaccacatcagttttggacaggctatttttcaagtcgcccggctctgaagagatatgagagattaagctataacttcctacaggtctgtaatcagctggaggccctggtaggactagctgcaaacgtggggccctatgggtctggggactcggcaccattaaatgaagccatggcagtgctgcaacaccatgatgccgtgtccggcaccagtaggcaacatgtggcaaatgattacgccagacagctggcggctgggtggggcccttgcgaagttttgttgagtaacgccctggcaaggctcagaggctttaaagatcatttcacattttgtcaacagctcaacattagtatttgtccactcagtcagacggctgcccggttccaggtgattgtttacaaccctctgggcaggaaggtcaattggatggtgcggttgccagtgtctgagggtgttttcgtggtcaaagaccccaatggtcggactgtaccaagcgacgttgttatttttccctcgagtgacagtcaagcccatccgccggagctcctcttctctgcaagcttgcctgccctcggcttttcaacctactccgtggcacaggtcccaaggtggaagccccaggcaagggcaccacagccaatcccaagaagaagctggagtccagccctaactatcgaaaatgaacacattagagctacttttgaccccgacacagggctgctcatggaaattatgaacatgaatcagcagctgctgttgcccgtgcggcagaccttcttttggtacaatgcctctatcggcgataacgaatcagaccaagcaagtggtgcctacattttccgacctaaccagcagaagcctctacctgttagccgatgggcccaaattcacctggtgaagacgcctcttgtacaggaggttcaccaaaacttctccgcatggtgttcacaggtagtacggctgtatccgggccagcgccaccttgaattggagtggtcagtgggccctatccctgtgggggacacatggggcaaagaagtcatcagccgttttgacacaccgttagaaacaaagggccgcttctatactgattcaaacgggagagaaatcctcgaacgaaggcgcgactaccgccccacctggaagctgaatcagactgagccagtggctggcaattattatcctgttaatactcgtatatacatcacggacggcaatatgcaattgacagtcctgactgataggtcccaaggagggtcctccctgcgcgatggctcattggagctcatggtgcacagacggttgttgaaagatgacggcagaggagtgtccgagccgctgatggagaacggaagcggcgcctgggtccgtggcagacacctggtactgttggataccgcacaagcagcggctgccggacatcggctactggccgaacaggaggtgttagcacctcaggtggtgttagctcccggcgggggcgcagcgtacaatctgggagctcctccacgtactcagttttcagggctcagacgggatctgcccccatcggtgcatctccttacccttgcatcatggggccctgaaatggttctgctaagactagaacatcagtttgctgtgggcgaggatagcggacggaacctgagtgcccccgtaactctgaacctgagggatcttttttccacctttaccattacaagattgcaagagaccacccttgttgctaatcagttgcgcgaggctgcctctaggctgaagtggacgacaaacaccggccccaccccccatcagacaccataccagctcgaccctgcaaacattacactcgaacccatggaaatccggacattcctggcctctgtccagtggaaagaagtggacgggtag

SEQ ID NO: 139286 - DNA, 1158 bp, Artificial Sequence
  Description of Artificial Sequence: Synthetic coding sequence
atgcacgtgtgtgtgtgtgtgtgcgtttgtgtgtacatgcccgtgtgtgttgacgcatgcatgtgttgcgaggctggcagacctgcttttcgcagcttcctgttttccttatgctccgaccttggggccgtcatttccctgctgctgtggggcagacagctgtttgccctctatagtggcaatgatgtgactgacattagcgacgatcgtttcccgaaaccaccagagatcgccaatggatacgtggaacacctattccggtaccagtgcaaaaattactacagacttaggaccgaaggcgatggtgtttataccctgaatgataagaagcagtggatcaataaggccgtgggagataaactcccagagtgtgaggctgtgtgcggtaagccaaagaatcctgctaatcccgtgcaacgcatattgggcgggcacctcgatgcgaaagggagctttccttggcaggccaagatggtttctcaccacaacctgacgaccggcgctacccttatcaacgaacaatggctcctgaccacggcaaagaatctcttcctcaatcatagtgagaatgccaccgccaaagacatagcgcctaccctgaccctatatgtcggcaagaaacagctggtggaaatcgagaaggtagtgttgcatcctaattaccatcaagtggatatcgggctgataaagctgaagcaaaaagtgctggtgaatgaacgggtgatgccaatctgcctaccttcgaaaaattacgctgaggtgggcagggtgggttacgtgtccgggtggggacaatccgataacttcaaactaactgaccatcttaagtacgtgatgctccccgtggccgatcagtatgattgtatcacccattacgagggcagcacttgccccaaatggaaggcccctaagtccccagtgggagtccaaccaatcctgaatgaacatactttttgcgtgggaatgtcaaagtaccaagaggatacctgctacggcgacgccggatccgcctttgcagtgcacgatctggaggaagacacttggtacgcagcgggcattttgagctttgacaagagctgcgccgttgcagaatacggagtatacgtgaaggttacaagcatccaacattgggtgcagaaaaccattgctgaaaactag

SEQ ID NO: 139287 - DNA, 1329 bp, Artificial Sequence
  Description of Artificial Sequence: Synthetic coding sequence
atggaagcctctagatgcaggctcagtccgagcggggattccgtatttcacgaggagatgatgaaaatgcgacaggccaaacttgactaccagcgactcttacttgaaaaacgacagcgcaagaagaggctcgaacccttcatggtgcagcccaatccagaagcacggctccgacgtgcgaagccaagggccagcgacgaacagacacctctcgtcaattgccacacacctcattctaatgtcattctccacggcatagacgggcccgccgctgtattgaaacccgatgaggtgcacgcccctagtgtatcatctagcgtcgtggaggaagatgcagagaacacggtggataccgcctcgaagccagggctgcaggaaaggctccagaagcatgacatcagcgaatcagtcaattttgatgaggagactgacgggatcagccagtcagcttgcctggagaggcccaatagcgccagtagccagaacagtaccgacaccggtacctccgggtcggctacggcggcccaacccgctgacaacttattgggagatatcgacgacctagaagatttcgtttactccccagcacctcagggggtgacagtgcgctgtaggattatccgcgataagaggggcatggacagggggctcttccctacgtattatatgtatctcgaaaaagaggaaaatcaaaagatctttctcctcgccgcacgcaagaggaaaaaaagtaaaaccgccaattacctaattagtattgacccagtggacctttctcgagagggagagagttacgtaggaaagttacggagcaacctgatggggactaagtttaccgtatacgataggggcatatgccccatgaaaggaaggggcttagtgggggcagcccatacccgtcaggagctagctgctatctcatacgaaaccaatgtcttggggttcaagggcccaagaaagatgtctgtaattattcccggtatgacccttaaccacaaacagattccgtaccaacctcaaaataatcatgacagtcttctatcccggtggcaaaatagaaccatggagaatctcgtggaacttcataataaggctcctgtgtggaattcagacacccagtcttacgtgctgaatttcagggggcgggttacacaggcctctgttaagaactttcagatagtgcacaagaacgaccccgactatattgtcatgcagttcgggcgcgtggccgatgacgtcttcacactggactacaattatcccctgtgcgccgtacaggcattcggcataggtctatcttccttcgacagcaagctggcttgtgagtag

SEQ ID NO: 139288 - DNA, 513 bp, Artificial Sequence
  Description of Artificial Sequence: Synthetic coding sequence
atgatgaagatgcgacaagcaaaacttgactatcaacggctgttgctcgagaagagacagcggaagaaaagacttgagccattcatggtccagcccaatcccgaagcccgcctgcgaagagccaagccaagggcctcggatgagcagacacctttggtcaattgccacacccctcatagtaatgtcatcctgcatggtatcgacggccccgcagcagtcctgaagcccgacgaggtccatgcgcctagcgtgtcgtcttcagtggtggaagaggacgctgaaaacactgtggataccgcatccaagccaggtctgcaggaaagactccaaaaacacgacatttcagaatcagtgaattttgatgaagagaccgacggcatatctcagtcggcatgtcttgaacggcctaacagcgccagtagccaaaacagcactttttcatctttctgtcagaagactgaggataccggctatcgacattttcgcttctgctattgcagacccacttcctag

SEQ ID NO: 139289 - DNA, 801 bp, Artificial Sequence
  Description of Artificial Sequence: Synthetic coding sequence
atgcttaagactccttggatcctcctgccctctcaagattttcggtctgtctctaaatccatggataccgggacttcaggatcggcgacggctgctcaacccgccgacaatctgctgggcgacatagacgatttagaagacttcgtttactcacctgccccccaaggagtgaccgtcagatgccgtatcatcagagacaaaagaggaatggataggggtctgttcccaacctattatatgtatcttgagaaagaagaaaatcagaaaattttccttttagcagcacgtaagcggaagaaaagcaaaactgcaaattaccttatcagtattgaccctgtggacttgagtagagaaggggaaagttatgtgggcaagctgagatccaatctgatgggtacaaagttcacagtgtatgacagaggcatttgccccatgaagggtcgggggctggttggcgcggcgcatacccgtcaggagcttgccgctatatcttataatcatgactctctactgtctcgctggcagaaccgaactatggaaaacctggtggaattacataataaggcccccgtatggaatagcgacacacaatcttatgtgctgaattttcggggcagggtgactcaggctagcgtgaaaaatttccagatcgtgcacaaaaacgatcccgactatattgtgatgcaattcggaagagtggccgatgacgtttttactctcgactacaactaccctctttgcgccgtgcaggccttcggaatcgggttgtcctctttcgatagcaagctggcctgcgaatag

SEQ ID NO: 139290 - DNA, 1506 bp, Artificial Sequence
  Description of Artificial Sequence: Synthetic coding sequence
atggaggcctcccgctgtaggctcagtccgtcaggagattcagtcttccacgaagagatgatgaaaatgcggcaagccaaacttgattatcagcgcctcctgctggagaagcgacaacggaaaaagcggctcgaacctttcatggtacagccaaatcctgaagctcggctgagaagggccaaacctcgggcctctgacgagcagacgcccctagtcaattgccacacaccgcattccaatgtgatcttgcatggtatcgatggcccggcagccgtactaaagcctgacgaggttcacgcgccgtctgtgagttcttcagttgtagaagaagatgccgaaaatactgttgatactgctagtaagccaggtctccaggaaaggctacagaagcacgatatctctgaaagcgtgaacttcgatgaggagaccgacggcatctcgcagtctgcatgtcttgagcggccaaattctgcttcctcacagaattctaccgatacgggcacctctggaagtgcaaccgctgcacagccagcagacaatctgttaggcgatatcgacgatctggaggatttcgtttattcccctgccccacagggggtcaccgtgagatgtaggatcataagggacaagcgaggcatggacagaggcctctttcctacatattacatgtacctcgagaaggaagagaaccagaagattttcctgctagcggctaggaagcggaagaaaagcaaaaccgctaactatttgatctctatcgacccagtggacctgagccgcgagggtgaaagctatgtgggcaagctaaggagcaacctcatgggcacaaagtttacagtgtacgatcggggcatctgtcctatgaaaggtcgtgggttggttggcgctgctcacactcgacaggaacttgcggccatctcttacgaaactaacgtcttgggctttaagggaccaaggaagatgtctgtgataataccaggcatgacactgaaccataagcagattccatatcaacctcagaataaccatgacagccttctctctcgttggcagaatcgcaccatggagaacctggtggagttgcataataaggcccccgtttggaacagcgacacccaaagctacgtgctgaacttccgtgggcgcgtgacccaggcatccgtcaagaactttcaaatcgtgcacaaaaatgaccctgactacatagtaatgcaatttggtcgcgtggctgatgacgttttcacgctggattataactaccctctgtgcgctgttcaggctttcggaatcgggctttctagctttgataagtgtatccagaccctgcgaatgcaagaattatgcgaactgcaccggcagcaccacagcgccgcaagcctcgtgcacagaaccgtatgtcagcgctgggttggtcacccgtggcgtctcttaccacagactagtctgctgtggacagacctcagcccgccacccgttgtgcccgccccacaccaaattagtatgtag

SEQ ID NO: 139291 - DNA, 1269 bp, Artificial Sequence
  Description of Artificial Sequence: Synthetic coding sequence
atggccctcagcgacgagcctgccgcaggaggaccagaagaagaggcagaggatgagacgctagcttttggcgccgccctggaggcttttggggaatctgcggagactcgcgctctgttaggccggttacgggaagtccacggcggaggtgctgagcgggaggtggccttggagcggtttcgggagtggatgatgaatctgcttctagatatagtgcaggatcagacctcacctgcctccttagttcatttggcattcaagtttctctatattattacgaaggtgaggggctataagacattcctgcggctcttccctcacgaagttgccgatgttgaacccgtcctggacctggtaactatacagaatcctaaggatcacgaagcctgggaaacccggtacatgcttttgctttggctgagcgtcacatgtctaattccatttgacttctcacggttagacggcaatttgttaacccagccgggccaggcgcgcatgtccatcatggacagaattttgcagatagcagagtcttacctcatcgtgagcgacaaagcaagagatgccgcggctgtgctggtgtcccgctttataacccgtccagacgtaaaacagtctaaaatggccgaatttcttgactggtccctctgtaacttagccaggagtagtttccagactatgcagggagttattacaatggacgggactctccaggcgctcgctcagattttcaagcatggcaagagagaggattgcctgccttacgctgctaccgttctgcggtgcctggatgggtgccgcttgccagaaagtaatcagacgctgcttagaaagctgggagtaaaattagtacaacgacttggccttacgttccttaagcccaaagtggccgcatggcgctatcaaagagggtgcaggagcctggctgccaatttacagttgctgactcagggacaaagcgagcaaaagcctctgatcctaacagaggatgatgacgaagacgacgatgttccagagggtgtcgaacgagtaatcgaacaactcttggtaggccttaaagataaggataccgttgtgcggtggagcgccgcaaaaggcattgggagaatggccggccgcttgcctagggctcttgctgatgatgtcgtgggaagtgtgctggattgcttttcatttcaggagaccgacaaggcttggcatggaggatgccttgccctcgccgagctcggtcgacggggtctcctactgccatccaggctggttgattag

SEQ ID NO: 139292 - DNA, 2997 bp, Artificial Sequence
  Description of Artificial Sequence: Synthetic coding sequence
atggacggaacactccaagcactggctcagatctttaagcacgggaagcgcgaggactgtcttccatatgccgcaacagtgttacgctgtctggatggttgcaggctgcccgaatccaaccagaccctcttaaggaagctgggcgtgaagctcgtgcaacggttaggactgacttttctcaaacccaaggtcgccgcgtggcggtatcagaggggatgccgtagcctagccgctaacctccagctactaacccagggccaatctgaacagaagccgctgatcctgaccgaggacgatgatgaggatgacgacgtaccggagggggtagaacgtgttatcgagcagctcctggttggcctgaaggacaaggacacagttgtccgatggtccgcagctaagggcatcgggagaatggccggaaggcttccaagggccctggcagacgatgtggttggtagtgtgttagactgttttagcttccaggagaccgacaaggcctggcatggcggctgcttggccttagccgagctcggcaggaggggcctgttgttgccaagcaggctggtagacgttgtggcagtaattctgaaggcactaacttatgatgagaaaagaggagcctgctccgtaggaacgaatgtccgagacgcggcttgttacgtgtgttgggccttcgcccgggcttacgagccccaggagcttaaaccttttgtgactgccattagctctgccctagtcattgcagctgtgtttgaccgcgatattaactgtcgcagagcagcctctgctgccttccaggaaaacgtgggtcgacagggaactttcccacacggtatcgatatcttgaccaccgcggactatttcgcagtcggtaaccgatccaactgctttctggtgatatccgtttttatcgcagggttccccgagtacacacagccgatgattgatcatttggtcaccatgaaaatttctcattgggacggagtcatccgtgaactggctgctcgtgctctccataacctcgcacaacaggcgcctgagttttcggctacacaggtgttcccgaggctcctctcaatgaccttgtcacctgacctgcatatgagacacgggtctattctggcatgtgcggaagtggcttacgccctgtacaaactggccgctcaggagaaccgccccgtcactgaccaccttgacgagcaggccgttcagggcctgaagcagattcatcagcagctctacgaccgacaattataccgtgggctgggcggccaactgatgagacaagccgtctgtgtgcttatcgaaaagctcagcctgtccaagatgccatttcgcggagacacggtgattgatggttggcagtggttgattaatgataccctgcggcaccttcacctgatctcatcacacagccggcaacagatgaaggacgccgccgtgagcgccctagccgctctctgctccgaatattatatgaaggaaccaggcgaagccgaccccgccattcaagaggaactgatcacacagtatctagccgagctccgcaatccagaggagatgacccgatgcggtttttctctcgctctgggggctttgcctggattcctgttgaagggcaggctgcagcaagtgcttaccggactgcgtgcagttactcacacctcacctgaggacgttagtttcgcggagagcaggcgagacggattaaaggccatcgctcggatttgccagacagtcggagtgaaggccggggcacctgatgaggccgtctgcggcgaaaacgtttcccaaatttactgcgctctactcgggtgtatggacgattatacgacagactcacgcggggacgtggggacttgggtaaggaaggccgcaatgacttctttgatggacttaaccctgctgctcgcacggtcacaacccgaattgattgaagcccatacctgtgaacgcataatgtgctgcgttgcccaacaggcatctgaaaaaatcgatcgctttagggctcacgctgccagtgtgttcctcacgctcctgcactttgactcacccccaataccacacgttcctcaccgaggtgagctggagaaactctttcccaggagtgacgtcgcaagcgtgaactggagtgccccttctcaggccttccctaggattacgcaacttctgggcctgcctacctacagataccatgtgctcctgggactggtggtgtccctaggaggcttaaccgagtctacgatccgacattctacccagagccttttcgagtacatgaagggcatacagtctgatccgcaggcactaggctccttttctggcacgcttcttcagattttcgaggataatttactgaatgagcgggtatctgtgcccctgctgaagacccttgatcatgtgttgacacacggatgtttcgatatcttcacaaccgaggaagaccacccgttcgccgtgaaacttctagctctgtgtaagaaagagatcaaaaactcaaaagatatccaaaagctgctgagcggaattgccgtcgacttccccagcgccactttggtttgcgtcggaaccgtgcagatgtatgctcatacccacctccgtctgggggcgcccggaccccactgcgcccatggctctgcgctgccacgtttttgcgagatggtgcagttccccggcgacgttaggcgtcaggcattgctacaactttgtttgctcctctgccatagattccctctaattagaaagactacagccagccaggtctacgagacactgcttacttactctgacgtggtaggcgccgatgtccttgacgaagtggttaccgtgctgtccgacactgcgtgggatgccgagctagcggtcgtccgcgagcagcggaaccggctgtgcgatctactgggcgttccaccatcttggtgtcctacatggtgccttctcaagccagtgttggagcccattcctcacccctgccttgtacgaatgagctgttcttag

SEQ ID NO: 139293 - DNA, 3579 bp, Artificial Sequence
  Description of Artificial Sequence: Synthetic coding sequence
atggccctatccgatgagcctgcagcaggcggccctgaagaagaggccgaggacgaaaccctggcctttggcgcggcgttagaagcttttggtgaatccgcagagacccgggccttgttggggagacttcgcgaggtccacgggggtggagctgagcgcgaggttgcactcgagagatttcgcgttatcatggataaatatcaggaacagccccacctcttggaccctcatctcgaatggatgatgaatttactacttgatattgtgcaggaccagacttctcctgcctccctggtgcatctagccttcaaatttctctacatcatcacgaaagtccggggctacaagactttcctgaggctcttccctcacgaagtcgccgatgtcgaacctgtgctggacctcgtgacaatccagaatcctaaggaccacgaggcctgggagaccagatatatgttgcttctgtggttgtccgtgacctgcctgattcccttcgatttttccagattggacggcaatctcctcactcagccagggcaagcccgcatgagcataatggatagaattctacaaatcgcagaatcctatcttattgtgagcgacaaggcacgcgatgcagcagctgtcctcgtaagcaggttcattaccaggcccgatgtgaaacaatcaaaaatggctgaatttttagattggtcactctgcaatctggccagatcaagcttccagacaatgcaaggggtaataacaatggatgggaccctgcaggcactggctcagatctttaaacatggtaaacgtgaggattgtctaccttacgctgctacagtgctgcggtgtctcgacgggtgccgtctaccagagagtaaccagacgctcctaagaaagttaggtgttaaactagtccagagactcggcctgacgtttctgaaaccaaaggtggctgcttggcgctaccagcgaggttgtcggtccttggcggcaaacttgcagcttctgacccagggccagtccgaacaaaagcccctgatcctcaccgaagatgacgatgaggatgacgacgtccccgagggcgtcgaaagggtcattgaacagcttctggtcggcttaaaggacaaagacaccgttgtgagatggtctgccgctaagggaattggccgcatggccggccggcttccaagagccctggcagacgacgtcgtcggttcggtattggattgcttctcctttcaggaaacagacaaagcctggcacggcggttgtttagcccttgccgaactggggagacgcggactcctcctgccatctagactcgtcgacgtcgttgcagtgattctgaaagctctgacttacgacgaaaaacggggtgcatgttctgtgggcacaaatgtcagagacgccgcctgttacgtgtgttgggcctttgcacgcgcttacgaacctcaggaattgaaaccatttgtcaccgccataagcagcgcgctggtgatagccgctgtttttgatcgtgatattaattgtcgccgggccgcttctgctgcctttcaggagaatgtggggcggcaaggcacgtttccgcacggtattgatatcctgactactgcagactattttgccgtcggaaatcggtccaattgttttttggtgatctctgtgtttatcgctggatttcctgagtacacgcagcctatgattgatcatctggtgaccatgaagatctcccactgggatggcgtgatcagagagttggcagcccgggctttgcacaacctggcacaacaagctcccgaattctccgccacgcaagttttcccaaggttgctctcaatgaccttgtctcccgatctacacatgcgtcacgggagtatccttgcgtgtgccgaggtggcctatgcactgtacaagttggctgctcaggagaaccgccccgtgaccgatcacctggatgagcaggccgtccagggcctgaagcaaatacaccagcagctgtatgaccgccagctttatagaggcctgggcgggcagcttatgcggcaggccgtatgcgtgctcatagaaaagctcagcctgtctaagatgccattccggggagataccgtcattgacggatggcagtggttgataaatgatacactgcgccacctccacctcatctcaagccattccaggcagcagatgaaggatgcggccgtgagcgccctggcagccctgtgtagtgagtactatatgaaggaacccggcgaggccgaccctgcaattcaggaggagctgataactcagtatctggctgaactgcggaatccggaagaaatgacacggtgtggcttttcactggccctgggcgctctgcccggattcctgctgaagggccgattacaacaggtacttactgggcttagggcagtgacccatacatcacccgaggacgtgagctttgctgaaagcagaagggacggactcaaggcaatcgcaagaatttgtcaaacagtcggggtgaaagccggagcacccgacgaggcagtgtgtggtgagaacgtgagccagatttactgcgcactcctggggtgtatggatgactatacaactgattctaggggagacgtggggacctgggtacggaaagccgcgatgacatccctgatggatcttaccctactactagccaggagccaaccagagctaatcgaggcccacacatgcgagaggatcatgtgctgtgtcgctcagcaggcatctgagaaaatagacagattcagagcgcacgcagcgagtgtgtttctaacactactccactttgatagtccccccatcccccacgtgcctcataggggcgagctggagaagctgttcccacggagtgacgtagcatctgtcaattggagtgctcccagccaggcatttccgagaataacacagttgctaggactgcctacatacagataccatgtgttattgggactggtggtgagtctgggcgggctgactgagtccacgatacgccactcgacccagtcccttttcgagtatatgaaagggatacagagtgacccccaggccctgggaagtttcagcggcaccttgctccaaatattcgaggacaacttgttgaatgagagggtttcagtgccactgttaaagaccttggaccacgtcctgacacacggatgcttcgatatcttcactacagaggaggatcatcccttcgccgtaaaactgctggctctgtgcaaaaaggagatcaaaaattccaaggatatccagaaactactaagcggcatcgctgttttctgtgaaatggtccaattcccaggagacgtaaggagacaagcactactgcaactttgcttactcctgtgtcacaggtttcccctgatacgaaaaaccaccgctagtcaagtatatgagaccttgctgacctacagcgatgtcgtcggcgccgacgtcctcgatgaggtagtaacggtgctgtctgacaccgcttgggacgccgaactcgctgtagttcgcgagcaacgcaacaggctttgtgatttgttaggggtgcctaggccccaactggtcccccaacccggagcgtgttag

SEQ ID NO: 139294 - DNA, 936 bp, Artificial Sequence
  Description of Artificial Sequence: Synthetic coding sequence
atggccggccggcttcctagggcattagcagacgatgtggtagggtcagtactagattgcttttcatttcaggaaaccgacaaagcatggcacggggggtgtctggcattggccgaactgggacggagagggctgttgctaccttctagactggtggacgtggtggccgtcatcctgaaggcgctgacctacgatgagaagaggggcgcttgttcagtagggaccaacgtgagagatgcagcctgttacgtgtgttgggctttcgcacgggcctatgagcctcaggagctcaaaccgtttgttactgcaataagtagcgccttggtaatcgcagccgtgtttgatcgagatattaactgtcggagggccgcatccgccgcctttcaggagaacgtgggaaggcagggcacgtttccccacgggattgatatcctgaccacggcggactactttgctgttggcaacaggagcaattgtttccttgtcatctctgtctttatagcaggcttccctgaatacacccaacccatgatcgaccatttggtgacaatgaagattagccactgggacggggtgatcagagagcttgctgcccgcgccctgcacaaccttgctcagcaggctccagaattctccgctacacaggtattccctagattgttgtccatgacattaagccccgacctacacatgcgtcacgggagcatcctggcttgcgcagaggtggcgtatgcactgtacaagcttgctgcccaggagaatcggcccgtgactgaccatctggacgaacaggccgtgcaggggcttaaacagattcatcagcagccttgtatttgctcttggggcctgatgagcccagagtctaaggccgaattctgtgtttgcgtttgccgaattagcctcggaaggcagtgtgtgcacctctctgggttgtag

SEQ ID NO: 139295 - DNA, 2253 bp, Artificial Sequence
  Description of Artificial Sequence: Synthetic coding sequence
atggcattgtccgatgaacccgcggctggcggtccagaggaggaagcagaagacgagaccctcgccttcggagccgccctagaggcgtttggcgaatctgctgagacacgggcgttgctgggacgtttgcgtgaggtacatggaggaggcgcggagagggaggtggccctggaacgttttagggttatcatggacaagtaccaggagcagccacacttattagacccacatctggaatggatgatgaatcttttattagacattgtccaggatcaaacctccccagcctctctggtacatctcgcatttaagttcctgtacataatcactaaggtcaggggatacaagacctttttgcggttattcccccacgaggtggccgatgtggaacctgtccttgacctggtgacaatacagaatcccaaagaccatgaagcctgggagactcggtacatgctgctgctttggctcagcgtgacttgcttaatccccttcgacttctcgagactggacggaaatctgctcacccagcctggacaggccagaatgtcgattatggacaggattctgcagattgctgagtcttacctcatcgtgtcagacaaggctagagatgcagccgcagtcctggtcagccggtttatcactcgccctgatgtgaagcagtccaaaatggcggaatttctggactggtcattgtgcaacctcgcacgcagctctttccaaaccatgcagggagttatcacaatggacggcacacttcaagcgctggcccagatctttaaacacggaaaacgcgaggattgcctgccatacgcagcgaccgtcctgaggtgcctggacggctgcagattgcccgagagtaaccaaacactgcttcgcaaactgggagtcaaacttgtacagaggctgggacttactttcctcaagcctaaggtggcagcgtggcggtaccaaaggggatgcaggtcactggcagccaacctgcagctgttgacccagggacagtccgaacagaagccccttatccttactgaggacgatgatgaggacgacgacgtgcctgagggcgtcgagcgggtaattgagcaactattggtcggcctaaaagacaaagatacagtggtgcgttggagtgctgctaaaggcatagggagaatggccgggcgacttccacgggcactcgcagacgacgtcgtaggatcagtcttggactgcttttcctttcaggaaaccgataaggcctggcacgggggatgtctagccctggcagaattggggcgccgggggctactgcttccatctcgactcgttgacgtggtagccgtgatcctgaaagctttgacttatgacgagaaaagaggggcctgcagcgttggtaccaacgtgcgagatgcagcgtgttatgtgtgttgggccttcgcccgggcctatgagcctcaggagcttaaacccttcgtaacagcaataagctccgccctcgtaatagccgcagtgttcgaccgcgatattaattgtcgccgggctgcttcagctgccttccaggagaatgtgggccgccagggcactttcccacacggtattgacattctgaccacagccgattatttcgccgtgggcaaccgtagtaattgttttttggtcatctcggtgtttattgctggcttcccagaatacactcaacccatgattgaccacctcgtcactatgaagatatctcactgggatggtgtgattcgcgagctagctgccagagcactacacaatctggcacaacaagcccctgagttctccgctacacaggtgttccctagactgcttagcatgaccctgtccccggatctccatatgagacatggctctatcctggcgtgtgcggaagtcgcttacgccctctacaagctcgcggcacaagaaaacaggccggtgactgatcacctggatgagcaggcagtccaaggcctgaaacagatccatcagcagctgtatgatcgccagttataccggggcctcggtggccagctgatgcgccaggccgtctgcgttctcatcgagaaattgagcctgtctaagatgccttttcggggcgacaccgtgattgatggctggcagtggttgatcaacgacagtctgtggttgctcgtgggtctaggccgaccttcccgattaccatctgaacggcctgctcccgcggggagccatcgattcaagagttcctatccccattttccccggggccggaaattttgctag

SEQ ID NO: 139296 - DNA, 555 bp, Artificial Sequence
  Description of Artificial Sequence: Synthetic coding sequence
atgaaaggaatccaaagcgatcctcaggccctgggtagcttctcgggcactctactccaaatctttgaagacaatctgctgaacgagagggtctctgtgccactactgaagacactcgaccatgtgttaacacacggctgtttcgacattttcaccacagaggaggatcacccttttgcagtgaaactcctggctctgtgtaaaaaagagatcaagaacagcaaggacatccagaagttgctgagcggcattgctgtcttctgcgagatggtgcaatttccgggcgacgtccgccgccaggccctgcttcagctgtgcctgctgctgtgtcatagatttcccttgatacgcaagaccactgctagccaagtttacgagaccctcctaacatactctgatgtcgtaggagctgacgttctggacgaagtggtgacagtgctgagcgacacagcatgggatgccgagttagcggtggtgagggagcagcgtaatcggttgtgcgatcttctaggggtccctcgcccccagttggtgccacaacccggcgcttgctag

SEQ ID NO: 139297 - DNA, 1584 bp, Artificial Sequence
  Description of Artificial Sequence: Synthetic coding sequence
atgtccgacacgctgacggctgacgtgattggtcggcgtgttgaagtgaacggtgagcacgctactgtgcggttcgctggagtggtccctccagttgccggaccatggctcggagtggaatgggataatccagagcgggggaaacatgatggttctcacgagggcacggtttactttaagtgcagacaccctactggaggtagtttcatacgacctaacaaggtgaatttcgggactgatttcctcaccgctattaaaaaccgatatgtgctggaggatggtcctgaggaggacaggaaagaacagatcgttactattgggaacaagcctgtagaaacaatcggattcgactcaatcatgaagcaacagagccagttgagtaagttacaggaagtatcacttcgcaattgtgccgtgtcttgtgccggggaaaagggaggagtggctgaggcctgtccaaacataaggaaggttgacttgagcaagaacctgctctcaagttgggacgaggtcatccacatcgcagaccagctaaggcatctggaggtgctaaacgtgtcagagaacaaactgaaatttcccagtggctcggtgctaacaggaactttgtccgtattaaaggtccttgtgctgaatcagaccggcatcacttgggccgaggtgctgcgatgcgtggcaggctgtcctggtcttgaagagctgtatctggagtcgaataacatctttatctcagagcgcccgacggacgtgctccaaactgtcaaactattggatctcagctccaaccagctgattgacgagaatcagctctacttaattgctcacctgcctagactggagcagctcatcctgtccgatacaggtatcagctctttgcactttcccgatgccgggatcggatgtaagacctcgatgtttccatcgctcaagtacctggtggtaaatgataaccagatctcacaatggtccttctttaacgagcttgagaagctaccatcactgagagcactttcctgtttgcgcaatccactcactaaagaggataaagaggccgagacagcaagattactcattattgcatcgatcgggcaactcaagaccctgaacaaatgtgaaatcctcccagaagagcgccggagggcagaactcgactaccgcaaggccttcggtaatgagtggaaacaagctggcggtcacaaagaccccgagaagaaccgactctcggaagagtttctgacagctcatccgcggtatcagttcctgtgtctgaaatacggcgcccctgaggattgggaactcaagacccagcagcctctcatgctgaaaaaccaactcttgacacttaagatcaagtacccccaccagctggaccagaaagtgctggaaaaacagttgccaggatccatgacgatccagaaggtgaagggcctgctatcccgcctgttaaaggtgcctgtgtccgatttactgctcagctacgagtctcccaaaaaacccggccgggaaattgagctggaaaacgatttaaaatccctgcagttctactcagtggagaatggtgattgcttactggtgcgatggtag

SEQ ID NO: 139298 - DNA, 1584 bp, Artificial Sequence
  Description of Artificial Sequence: Synthetic coding sequence
atgtctgacacattgacagccgatgtgatcgggcggagggtggaggtaaatggagaacatgctaccgtaagatttgccggagtggtcccccccgtcgcagggccctggctgggggtggagtgggacaacccagagcgcggcaaacatgatgggagtcatgagggaacagtgtacttcaagtgtcgccatcccacaggcggatcatttattcgacctaacaaggttaacttcggcactgactttctgacagcaatcaagaataggtacgtgctcgaggacggacccgaggaggacaggaaagagcagatcgtgaccattggcaacaaaccggtggagactatcgggtttgacagcattatgaagcagcaatcccagctctcaaaactacaagaagtgagtttgcgaaactgcgcagtgtcttgtgccggggaaaagggcggagtggcggaggcctgccccaacattcgaaaagtggacctctccaagaacctgctgtctagctgggacgaagtcatccacatagctgaccagcttagacaccttgaggtcctgaatgtgtccgaaaataaactgaagtttccgagcggaagcgtgcttacaggcacgcttagcgttctgaaggtgttggtactgaaccagactggcatcacttgggccgaagtgttacgctgtgtggcgggctgccccggactcgaggagctatatttggagagcaataatatctttattagtgagcggcctacagacgtactgcagaccgtaaagcttctcgatctatcgagcaaccagttgatcgatgaaaaccaactgtaccttattgctcacctgccgcgcctcgagcaactgatactgagcgatactgggatctcctccctgcactttcctgatgctgggatcgggtgtaagacctcaatgtttccttcccttaaataccttgttgtgaatgataaccagatatcccagtggtcttttttcaatgaacttgagaaactgcctagcctgcgtgccttgtcatgccttcgaaatcctttgactaaagaggataaggaggccgaaacagcccgcctcttgattattgccagtattggacaactaaagacactgaacaagtgcgagattctcccagaagagcgacggagagccgaacttgattatagaaaggccttcggaaacgagtggaagcaggccggtggacacaaggaccccgagaagaatcgcttgtcagaagaatttctgaccgcacatccacgttaccagtttctgtgtctgaagtatggagcccccgaggattgggagctgaagacccagcagccgcttatgctgaagaaccagctgctgacactcaaaataaagtatccccatcaattggatcaaaaagtacttgagaagcagcttccaggaagcatgaccatccagaaagttaagggcttgctctctaggctgttaaaagtcccggtctccgacctcttgctgtcgtatgaatcccccaagaaaccaggacgggagatcgaactcgagaacgatcttaaaagtctccaattttatagtgttgagaacggagactgccttctggtgcggtggtag

SEQ ID NO: 139299 - DNA, 1737 bp, Artificial Sequence
  Description of Artificial Sequence: Synthetic coding sequence
atgagcgacactctgactgccgacgtgattgggcgccgcgtggaagtcaatggtgagcatgccacagttcgcttcgccggagttgtgcctcccgtggcaggaccctggctgggggtcgagtgggataatcccgagagaggcaaacatgatgggtcccacgaaggtaccgtctactttaaatgcaggcaccctaccggggggtcctttatcagacctaataaggttaatttcggcaccgactttctgacggcgattaagaaccgttacgtgctggaagacggtcccgaagaggacagaaaagaacagattgtgactattggcaacaagcctgtagagactatcggattcgacagcatcatgaagcagcagagtcagctgtcgaagttgcaagaggtgtcgctgagaaattgcgccgtgtcctgtgccggcgaaaagggaggcgtggcagaggcctgtcccaacatcaggaaggttgacttatccaaaaatttgttatcttcatgggatgaagttattcacatagcagatcagctgcgccacctggaagtccttaatgtgtcagagaataagttgaagtttccctcgggttccgttctaaccggcaccctgtccgtgctgaaagtgctggtgctcaatcagactggcataacatgggccgaagcacacgcacaatgcgggggtagccggcacggacttgacatgcagaaagatgcatcgaagtttgtggatctatgcgttttgcagaagtgtagcacatccaattgcataatttctgccaaagatcatacatcaatgcgaatgaacgttgccaaagtgttgaggtgtgtggccggctgccccggcctggaagagctgtacctggaatcaaataacatcttcattagtgagagaccaaccgatgttctgcagacagtgaaactgctcgacttaagtagcaatcagctgattgatgaaaaccagttatatcttatcgcccacctccctcgtttagagcaattaatactcagcgacaccgggatttcaagcctgcacttccctgacgccggcatcggctgcaagacctcaatgtttccctccctgaagtacctggtggttaacgataatcagatcagtcagtggtccttttttaatgagctcgaaaagttgccctcactgcgggctctctcttgccttcgcaaccccctgaccaaagaggacaaggaggccgagaccgctagactgctcatcattgcttctattggtcagctcaagactctgaacaaatgcgaaattttgcccgaagaaaggcggagagcggaactcgactacagaaaggcattcggcaacgagtggaagcaggccggcggacataaggaccctgagaagaatcgattgagcgaggagtttcttacagctcatccacgctatcaatttctgtgtcttaaatacggtgccccagaggattgggagctcaaaacacaacagcctctcatgctcaagaatcagctgctgacactgaaaattaagtacccacatcagctggatcagaaggtactggaaaaacagcttccaggatccatgaccatacagaaggtcaagggattgctgtccagactgctgaaggtgcctgtaagcgacctgttgttgagttatgaatctcccaaaaaaccaggccgggagatagagttagaaaatgacctaaaaagcctgcagttctattcggttgaaaacggggactgtctcctggtgagatggtag
